United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 44

SEQ ID NO: 1571715 - RNA, 18 nt, Pseudomonas putida KT2440
agcaaaccgaccaggcag

SEQ ID NO: 1571716 - RNA, 22 nt, Pseudomonas putida KT2440
agcaagucccccaucggcaccc

SEQ ID NO: 1571717 - RNA, 15 nt, Pseudomonas putida KT2440
agcaagcuggcaccg

SEQ ID NO: 1571718 - RNA, 23 nt, Pseudomonas putida KT2440
agcaagcggguaaugucccgcac

SEQ ID NO: 1571719 - RNA, 22 nt, Pseudomonas putida KT2440
agcaagcucaucaccaggcccg

SEQ ID NO: 1571720 - RNA, 23 nt, Pseudomonas putida KT2440
agcaagggccguuacucccacag

SEQ ID NO: 1571721 - RNA, 21 nt, Pseudomonas putida KT2440
agcgcuggcuuuggagccugc

SEQ ID NO: 1571722 - RNA, 17 nt, Pseudomonas putida KT2440
agcggcaguugcaggcg

SEQ ID NO: 1571723 - RNA, 17 nt, Pseudomonas putida KT2440
agcggcagaucacgcaa

SEQ ID NO: 1571724 - RNA, 21 nt, Pseudomonas putida KT2440
agcggccuugcgucgcgaaag

SEQ ID NO: 1571725 - RNA, 17 nt, Pseudomonas putida KT2440
agcggccuugucgcgaa

SEQ ID NO: 1571726 - RNA, 20 nt, Pseudomonas putida KT2440
agcggccuugugucucgaug

SEQ ID NO: 1571727 - RNA, 22 nt, Pseudomonas putida KT2440
agcggccuugugucucgauggg

SEQ ID NO: 1571728 - RNA, 19 nt, Pseudomonas putida KT2440
agcggcgaaggauggaccg

SEQ ID NO: 1571729 - RNA, 23 nt, Pseudomonas putida KT2440
agcggccaucgcagaaggccccg

SEQ ID NO: 1571730 - RNA, 18 nt, Pseudomonas putida KT2440
agcggccaguaaggaucg

SEQ ID NO: 1571731 - RNA, 14 nt, Pseudomonas putida KT2440
agcggccagcgccu

SEQ ID NO: 1571732 - RNA, 22 nt, Pseudomonas putida KT2440
agcggccagcgccuggcgcagu

SEQ ID NO: 1571733 - RNA, 23 nt, Pseudomonas putida KT2440
agcggccccaaugaaucagagcg

SEQ ID NO: 1571734 - RNA, 15 nt, Pseudomonas putida KT2440
agcggccccaucacc

SEQ ID NO: 1571735 - RNA, 17 nt, Pseudomonas putida KT2440
agcggccccaucacccc

SEQ ID NO: 1571736 - RNA, 19 nt, Pseudomonas putida KT2440
agcggggauucaacagcgc

SEQ ID NO: 1571737 - RNA, 21 nt, Pseudomonas putida KT2440
agcggggauucaacagcgcga

SEQ ID NO: 1571738 - RNA, 21 nt, Pseudomonas putida KT2440
agcgguagauguagcggguca

SEQ ID NO: 1571739 - RNA, 16 nt, Pseudomonas putida KT2440
agcggucaugcagcgu

SEQ ID NO: 1571740 - RNA, 19 nt, Pseudomonas putida KT2440
agcgggcgauugccagggu

SEQ ID NO: 1571741 - RNA, 13 nt, Pseudomonas putida KT2440
agcgggcguaccu

SEQ ID NO: 1571742 - RNA, 21 nt, Pseudomonas putida KT2440
agcgggcucgcccacacggca

SEQ ID NO: 1571743 - RNA, 15 nt, Pseudomonas putida KT2440
agcgggcuugcccau

SEQ ID NO: 1571744 - RNA, 14 nt, Pseudomonas putida KT2440
agcgggcuugcccg

SEQ ID NO: 1571745 - RNA, 16 nt, Pseudomonas putida KT2440
agcgggcuugcccgcg

SEQ ID NO: 1571746 - RNA, 20 nt, Pseudomonas putida KT2440
agcgggcuugcccgcgaaca

SEQ ID NO: 1571747 - RNA, 20 nt, Pseudomonas putida KT2440
agcgggcuugcccgcgaagc

SEQ ID NO: 1571748 - RNA, 19 nt, Pseudomonas putida KT2440
agcgggcgugcccgcgaag

SEQ ID NO: 1571749 - RNA, 20 nt, Pseudomonas putida KT2440
agcgggcgugcccgcgaaga

SEQ ID NO: 1571750 - RNA, 20 nt, Pseudomonas putida KT2440
agcgggcgugccugcgaaug

SEQ ID NO: 1571751 - RNA, 20 nt, Pseudomonas putida KT2440
agcgggcgcgcccgcgaaga

SEQ ID NO: 1571752 - RNA, 12 nt, Pseudomonas putida KT2440
agcgucagcagg

SEQ ID NO: 1571753 - RNA, 20 nt, Pseudomonas putida KT2440
agcgucagggucucgcggcu

SEQ ID NO: 1571754 - RNA, 19 nt, Pseudomonas putida KT2440
agcguccaucuugguuggc

SEQ ID NO: 1571755 - RNA, 12 nt, Pseudomonas putida KT2440
agcgucacccgu

SEQ ID NO: 1571756 - RNA, 15 nt, Pseudomonas putida KT2440
agcguauugccagaa

SEQ ID NO: 1571757 - RNA, 18 nt, Pseudomonas putida KT2440
agcgucaaccaggcgcag

SEQ ID NO: 1571758 - RNA, 13 nt, Pseudomonas putida KT2440
agcguagugcagg

SEQ ID NO: 1571759 - RNA, 21 nt, Pseudomonas putida KT2440
agcgcgugcuugcaccgacaa

SEQ ID NO: 1571760 - RNA, 22 nt, Pseudomonas putida KT2440
agcgcguuaggcgagaucgaca

SEQ ID NO: 1571761 - RNA, 20 nt, Pseudomonas putida KT2440
agcgcgucugauagccaggg

SEQ ID NO: 1571762 - RNA, 17 nt, Pseudomonas putida KT2440
agcgcugcgaggcccca

SEQ ID NO: 1571763 - RNA, 17 nt, Pseudomonas putida KT2440
agcgcugcgcagguaua

SEQ ID NO: 1571764 - RNA, 19 nt, Pseudomonas putida KT2440
agcgcggcaaagguggcac

SEQ ID NO: 1571765 - RNA, 22 nt, Pseudomonas putida KT2440
agcgcggcaaagguggcaccgc

SEQ ID NO: 1571766 - RNA, 17 nt, Pseudomonas putida KT2440
agcgcgcugagcagguu

SEQ ID NO: 1571767 - RNA, 13 nt, Pseudomonas putida KT2440
agcgccgcagguc

SEQ ID NO: 1571768 - RNA, 16 nt, Pseudomonas putida KT2440
agcgccgcgccaccga

SEQ ID NO: 1571769 - RNA, 13 nt, Pseudomonas putida KT2440
agcgccgccggcu

SEQ ID NO: 1571770 - RNA, 16 nt, Pseudomonas putida KT2440
agcgcccagaucagca

SEQ ID NO: 1571771 - RNA, 18 nt, Pseudomonas putida KT2440
agcgcccagaucagcagc

SEQ ID NO: 1571772 - RNA, 22 nt, Pseudomonas putida KT2440
agcgcccagaucagcagcaccg

SEQ ID NO: 1571773 - RNA, 16 nt, Pseudomonas putida KT2440
agcgcccgucuggcug

SEQ ID NO: 1571774 - RNA, 16 nt, Pseudomonas putida KT2440
agcgcccgguuccagg

SEQ ID NO: 1571775 - RNA, 15 nt, Pseudomonas putida KT2440
agcgcccuugaacag

SEQ ID NO: 1571776 - RNA, 14 nt, Pseudomonas putida KT2440
agcgccgcaacggc

SEQ ID NO: 1571777 - RNA, 23 nt, Pseudomonas putida KT2440
agcgcaaauccccaaccaugcug

SEQ ID NO: 1571778 - RNA, 17 nt, Pseudomonas putida KT2440
agcgaugcacgccagca

SEQ ID NO: 1571779 - RNA, 21 nt, Pseudomonas putida KT2440
agcgaugcacgccagcaucac

SEQ ID NO: 1571780 - RNA, 18 nt, Pseudomonas putida KT2440
agcgcaaaaaacgccgca

SEQ ID NO: 1571781 - RNA, 21 nt, Pseudomonas putida KT2440
agccgccgcugcgaggaucag

SEQ ID NO: 1571782 - RNA, 18 nt, Pseudomonas putida KT2440
agccgccgccugucgcga

SEQ ID NO: 1571783 - RNA, 13 nt, Pseudomonas putida KT2440
agccgccacauga

SEQ ID NO: 1571784 - RNA, 14 nt, Pseudomonas putida KT2440
agccgcggcaccca

SEQ ID NO: 1571785 - RNA, 12 nt, Pseudomonas putida KT2440
agccgccguacc

SEQ ID NO: 1571786 - RNA, 15 nt, Pseudomonas putida KT2440
agccgcgggcgucgc

SEQ ID NO: 1571787 - RNA, 19 nt, Pseudomonas putida KT2440
agccgcgggcgucgcgauc

SEQ ID NO: 1571788 - RNA, 12 nt, Pseudomonas putida KT2440
agccgcuggccc

SEQ ID NO: 1571789 - RNA, 15 nt, Pseudomonas putida KT2440
agcccgggcagccga

SEQ ID NO: 1571790 - RNA, 21 nt, Pseudomonas putida KT2440
agcccggcuugcaccaacggc

SEQ ID NO: 1571791 - RNA, 16 nt, Pseudomonas putida KT2440
agcccggcggccagca

SEQ ID NO: 1571792 - RNA, 15 nt, Pseudomonas putida KT2440
agccaccgggcgagu

SEQ ID NO: 1571793 - RNA, 18 nt, Pseudomonas putida KT2440
agccacccuccgcacagg

SEQ ID NO: 1571794 - RNA, 22 nt, Pseudomonas putida KT2440
agccaccgccaccaucggccag

SEQ ID NO: 1571795 - RNA, 22 nt, Pseudomonas putida KT2440
agccaccggacagaaucgcggu

SEQ ID NO: 1571796 - RNA, 22 nt, Pseudomonas putida KT2440
agcccguggcccucagcccagu

SEQ ID NO: 1571797 - RNA, 13 nt, Pseudomonas putida KT2440
agcccgugccgca

SEQ ID NO: 1571798 - RNA, 21 nt, Pseudomonas putida KT2440
agcccguccgccuugagguug

SEQ ID NO: 1571799 - RNA, 16 nt, Pseudomonas putida KT2440
agcccuugucgaacag

SEQ ID NO: 1571800 - RNA, 19 nt, Pseudomonas putida KT2440
agcccggugaagucaccga

SEQ ID NO: 1571801 - RNA, 21 nt, Pseudomonas putida KT2440
agccgcaaccgggucggcgcc

SEQ ID NO: 1571802 - RNA, 23 nt, Pseudomonas putida KT2440
agccgagcaucuuccagccugca

SEQ ID NO: 1571803 - RNA, 20 nt, Pseudomonas putida KT2440
agccgaaccauucaaugcgu

SEQ ID NO: 1571804 - RNA, 22 nt, Pseudomonas putida KT2440
agcccuugccagugauccggcg

SEQ ID NO: 1571805 - RNA, 14 nt, Pseudomonas putida KT2440
agccgggcugcaaa

SEQ ID NO: 1571806 - RNA, 17 nt, Pseudomonas putida KT2440
agccggucucccagcgc

SEQ ID NO: 1571807 - RNA, 21 nt, Pseudomonas putida KT2440
agccggcgcuggacagcggca

SEQ ID NO: 1571808 - RNA, 20 nt, Pseudomonas putida KT2440
agccggccucagcagcgaca

SEQ ID NO: 1571809 - RNA, 18 nt, Pseudomonas putida KT2440
agccggccuugcuccagu

SEQ ID NO: 1571810 - RNA, 14 nt, Pseudomonas putida KT2440
agccggcgaacagc

SEQ ID NO: 1571811 - RNA, 15 nt, Pseudomonas putida KT2440
agccggcgaacagca

SEQ ID NO: 1571812 - RNA, 22 nt, Pseudomonas putida KT2440
agccggcgaacagcacugccag

SEQ ID NO: 1571813 - RNA, 18 nt, Pseudomonas putida KT2440
agcgaaacaccagcaaca

SEQ ID NO: 1571814 - RNA, 14 nt, Pseudomonas putida KT2440
agcgaaaugggccg

SEQ ID NO: 1571815 - RNA, 13 nt, Pseudomonas putida KT2440
agcgaagggccac

SEQ ID NO: 1571816 - RNA, 16 nt, Pseudomonas putida KT2440
agccucaaggccggca

SEQ ID NO: 1571817 - RNA, 19 nt, Pseudomonas putida KT2440
agccguaggagcgggcuug

SEQ ID NO: 1571818 - RNA, 18 nt, Pseudomonas putida KT2440
agccugaggcugcgccga

SEQ ID NO: 1571819 - RNA, 17 nt, Pseudomonas putida KT2440
agccugcagggccucca

SEQ ID NO: 1571820 - RNA, 13 nt, Pseudomonas putida KT2440
agccugccagguc

SEQ ID NO: 1571821 - RNA, 14 nt, Pseudomonas putida KT2440
agccugcgcaggcg

SEQ ID NO: 1571822 - RNA, 15 nt, Pseudomonas putida KT2440
agccugcuccagcac

SEQ ID NO: 1571823 - RNA, 19 nt, Pseudomonas putida KT2440
agccugcuccagcacccgc

SEQ ID NO: 1571824 - RNA, 11 nt, Pseudomonas putida KT2440
agccuggccgg

SEQ ID NO: 1571825 - RNA, 17 nt, Pseudomonas putida KT2440
agccuguggggcaacug

SEQ ID NO: 1571826 - RNA, 22 nt, Pseudomonas putida KT2440
agccuguggggcaacugcgcga

SEQ ID NO: 1571827 - RNA, 14 nt, Pseudomonas putida KT2440
guuucagucagcca

SEQ ID NO: 1571828 - RNA, 18 nt, Pseudomonas putida KT2440
guuucagccuuggccgcc

SEQ ID NO: 1571829 - RNA, 18 nt, Pseudomonas putida KT2440
uaaagcgucgcccgcgaa

SEQ ID NO: 1571830 - RNA, 20 nt, Pseudomonas putida KT2440
uaaagccgcaccuacaggga

SEQ ID NO: 1571831 - RNA, 19 nt, Pseudomonas putida KT2440
uaaagaaaagccgcuggcc

SEQ ID NO: 1571832 - RNA, 16 nt, Pseudomonas putida KT2440
uaaccugcauugcgcg

SEQ ID NO: 1571833 - RNA, 20 nt, Pseudomonas putida KT2440
uaaccggcccugaaggccgc

SEQ ID NO: 1571834 - RNA, 22 nt, Pseudomonas putida KT2440
uaacacagguaguucacuggcc

SEQ ID NO: 1571835 - RNA, 16 nt, Pseudomonas putida KT2440
uaauuccugugggagc

SEQ ID NO: 1571836 - RNA, 23 nt, Pseudomonas putida KT2440
uaagaagcaaccgcugcauggcc

SEQ ID NO: 1571837 - RNA, 15 nt, Pseudomonas putida KT2440
uaagaucacugcgca

SEQ ID NO: 1571838 - RNA, 14 nt, Pseudomonas putida KT2440
uaagcagcaagccu

SEQ ID NO: 1571839 - RNA, 20 nt, Pseudomonas putida KT2440
guuuacccgcgaaagggccg

SEQ ID NO: 1571840 - RNA, 14 nt, Pseudomonas putida KT2440
guuuacccgcgaac

SEQ ID NO: 1571841 - RNA, 17 nt, Pseudomonas putida KT2440
guuuacccgcgaacagg

SEQ ID NO: 1571842 - RNA, 20 nt, Pseudomonas putida KT2440
guuuacccgcgaagaagcca

SEQ ID NO: 1571843 - RNA, 20 nt, Pseudomonas putida KT2440
guuuacccgcgaagaggccg

SEQ ID NO: 1571844 - RNA, 22 nt, Pseudomonas putida KT2440
guuuacccgcgaagaggccggc

SEQ ID NO: 1571845 - RNA, 22 nt, Pseudomonas putida KT2440
guuuacccgcgaagaggccggu

SEQ ID NO: 1571846 - RNA, 14 nt, Pseudomonas putida KT2440
guuuacccucggga

SEQ ID NO: 1571847 - RNA, 17 nt, Pseudomonas putida KT2440
guuucaaaaacggugca

SEQ ID NO: 1571848 - RNA, 14 nt, Pseudomonas putida KT2440
guuguucgaucagc

SEQ ID NO: 1571849 - RNA, 17 nt, Pseudomonas putida KT2440
guuguggcuguucaggc

SEQ ID NO: 1571850 - RNA, 15 nt, Pseudomonas putida KT2440
guuguucacggucag

SEQ ID NO: 1571851 - RNA, 13 nt, Pseudomonas putida KT2440
guuguucagcagc

SEQ ID NO: 1571852 - RNA, 19 nt, Pseudomonas putida KT2440
guuggcgcgaauuuccggg

SEQ ID NO: 1571853 - RNA, 17 nt, Pseudomonas putida KT2440
guuggcgcuuccuggcc

SEQ ID NO: 1571854 - RNA, 14 nt, Pseudomonas putida KT2440
guuggcucugugga

SEQ ID NO: 1571855 - RNA, 20 nt, Pseudomonas putida KT2440
guuggcgucggcaccggcga

SEQ ID NO: 1571856 - RNA, 23 nt, Pseudomonas putida KT2440
guuguccaccgcgcaacgcgcca

SEQ ID NO: 1571857 - RNA, 12 nt, Pseudomonas putida KT2440
guuguccagcag

SEQ ID NO: 1571858 - RNA, 20 nt, Pseudomonas putida KT2440
guugucgccuuucaggucga

SEQ ID NO: 1571859 - RNA, 21 nt, Pseudomonas putida KT2440
guugagccagggcgcugucgg

SEQ ID NO: 1571860 - RNA, 13 nt, Pseudomonas putida KT2440
guugccgccagcc

SEQ ID NO: 1571861 - RNA, 18 nt, Pseudomonas putida KT2440
guugccuucgaucggcgc

SEQ ID NO: 1571862 - RNA, 23 nt, Pseudomonas putida KT2440
guugccuucgaucggcgcgccug

SEQ ID NO: 1571863 - RNA, 16 nt, Pseudomonas putida KT2440
guugccuucgcgaccg

SEQ ID NO: 1571864 - RNA, 16 nt, Pseudomonas putida KT2440
guugcgagcgaacagc

SEQ ID NO: 1571865 - RNA, 17 nt, Pseudomonas putida KT2440
guugcgaagcggccuga

SEQ ID NO: 1571866 - RNA, 22 nt, Pseudomonas putida KT2440
guuggccaucugguugcuggcg

SEQ ID NO: 1571867 - RNA, 16 nt, Pseudomonas putida KT2440
guuggccaggucgacc

SEQ ID NO: 1571868 - RNA, 14 nt, Pseudomonas putida KT2440
guuggcacguugcu

SEQ ID NO: 1571869 - RNA, 23 nt, Pseudomonas putida KT2440
guuggccaaaccguccagguagc

SEQ ID NO: 1571870 - RNA, 15 nt, Pseudomonas putida KT2440
guugcgcaucaccuc

SEQ ID NO: 1571871 - RNA, 19 nt, Pseudomonas putida KT2440
guugcgcagccggccuugc

SEQ ID NO: 1571872 - RNA, 20 nt, Pseudomonas putida KT2440
guugcgcagccggccuugcu

SEQ ID NO: 1571873 - RNA, 19 nt, Pseudomonas putida KT2440
guugcgccaggcaucccau

SEQ ID NO: 1571874 - RNA, 16 nt, Pseudomonas putida KT2440
guugcuggcgccagcg

SEQ ID NO: 1571875 - RNA, 14 nt, Pseudomonas putida KT2440
guucgacgcugcug

SEQ ID NO: 1571876 - RNA, 14 nt, Pseudomonas putida KT2440
guucgaguccaggu

SEQ ID NO: 1571877 - RNA, 16 nt, Pseudomonas putida KT2440
guucgcccugcgccug

SEQ ID NO: 1571878 - RNA, 19 nt, Pseudomonas putida KT2440
guucgccgcuuacgaacgg

SEQ ID NO: 1571879 - RNA, 13 nt, Pseudomonas putida KT2440
guucgccacggua

SEQ ID NO: 1571880 - RNA, 13 nt, Pseudomonas putida KT2440
guucgcagccaua

SEQ ID NO: 1571881 - RNA, 20 nt, Pseudomonas putida KT2440
guucgcgaggaaacccgcgc

SEQ ID NO: 1571882 - RNA, 17 nt, Pseudomonas putida KT2440
guucgccgucagccuuu

SEQ ID NO: 1571883 - RNA, 21 nt, Pseudomonas putida KT2440
guucgcgcaggauccacgccu

SEQ ID NO: 1571884 - RNA, 19 nt, Pseudomonas putida KT2440
guucgcgggugaaccgcgc

SEQ ID NO: 1571885 - RNA, 23 nt, Pseudomonas putida KT2440
guucgcggucgccgugcaacgcc

SEQ ID NO: 1571886 - RNA, 22 nt, Pseudomonas putida KT2440
guucgcugccagcguuuccggg

SEQ ID NO: 1571887 - RNA, 15 nt, Pseudomonas putida KT2440
guucggacaggcgcu

SEQ ID NO: 1571888 - RNA, 14 nt, Pseudomonas putida KT2440
guucggccagcacu

SEQ ID NO: 1571889 - RNA, 15 nt, Pseudomonas putida KT2440
guucggcaucgacga

SEQ ID NO: 1571890 - RNA, 16 nt, Pseudomonas putida KT2440
guucgguaaugcccgc

SEQ ID NO: 1571891 - RNA, 13 nt, Pseudomonas putida KT2440
guucgggucaacu

SEQ ID NO: 1571892 - RNA, 21 nt, Pseudomonas putida KT2440
guucguccucgacccacggcu

SEQ ID NO: 1571893 - RNA, 15 nt, Pseudomonas putida KT2440
guucuccugcggaaa

SEQ ID NO: 1571894 - RNA, 21 nt, Pseudomonas putida KT2440
guugaccagggcgucgaacac

SEQ ID NO: 1571895 - RNA, 23 nt, Pseudomonas putida KT2440
guugaaggcguauuugaccagcc

SEQ ID NO: 1571896 - RNA, 20 nt, Pseudomonas putida KT2440
guugaagaagaucaggucgc

SEQ ID NO: 1571897 - RNA, 12 nt, Pseudomonas putida KT2440
guugaaugccgc

SEQ ID NO: 1571898 - RNA, 13 nt, Pseudomonas putida KT2440
guugaaugccgcc

SEQ ID NO: 1571899 - RNA, 13 nt, Pseudomonas putida KT2440
guguucgcgggca

SEQ ID NO: 1571900 - RNA, 22 nt, Pseudomonas putida KT2440
guguucuucauauccgcuuugc

SEQ ID NO: 1571901 - RNA, 17 nt, Pseudomonas putida KT2440
guuacaauaccgacaag

SEQ ID NO: 1571902 - RNA, 22 nt, Pseudomonas putida KT2440
guuacccucggcaucgaacagc

SEQ ID NO: 1571903 - RNA, 22 nt, Pseudomonas putida KT2440
guuacacccauguugucaccca

SEQ ID NO: 1571904 - RNA, 22 nt, Pseudomonas putida KT2440
guuacccaacagaccaccugcc

SEQ ID NO: 1571905 - RNA, 17 nt, Pseudomonas putida KT2440
guuacuauuaaccgcuu

SEQ ID NO: 1571906 - RNA, 23 nt, Pseudomonas putida KT2440
guuacgccguugucacgcgccag

SEQ ID NO: 1571907 - RNA, 14 nt, Pseudomonas putida KT2440
guuacgccaggcgu

SEQ ID NO: 1571908 - RNA, 21 nt, Pseudomonas putida KT2440
guggggucugcccggccagca

SEQ ID NO: 1571909 - RNA, 16 nt, Pseudomonas putida KT2440
guggugaccucgaugc

SEQ ID NO: 1571910 - RNA, 21 nt, Pseudomonas putida KT2440
guggugagcccugugggagcg

SEQ ID NO: 1571911 - RNA, 18 nt, Pseudomonas putida KT2440
guggggcgugcucggcau

SEQ ID NO: 1571912 - RNA, 12 nt, Pseudomonas putida KT2440
guggugcuggcg

SEQ ID NO: 1571913 - RNA, 22 nt, Pseudomonas putida KT2440
guggugcgggccaccaggccuu

SEQ ID NO: 1571914 - RNA, 13 nt, Pseudomonas putida KT2440
gugugccacuuca

SEQ ID NO: 1571915 - RNA, 16 nt, Pseudomonas putida KT2440
gugugcccaccaguga

SEQ ID NO: 1571916 - RNA, 13 nt, Pseudomonas putida KT2440
gugugcaccuggu

SEQ ID NO: 1571917 - RNA, 17 nt, Pseudomonas putida KT2440
gugugaaauagccacgc

SEQ ID NO: 1571918 - RNA, 14 nt, Pseudomonas putida KT2440
guguuacgccaggc

SEQ ID NO: 1571919 - RNA, 16 nt, Pseudomonas putida KT2440
guguauccagcccggc

SEQ ID NO: 1571920 - RNA, 21 nt, Pseudomonas putida KT2440
guguagaacggcagcaggcca

SEQ ID NO: 1571921 - RNA, 22 nt, Pseudomonas putida KT2440
gugcuggcguguugucgugugc

SEQ ID NO: 1571922 - RNA, 21 nt, Pseudomonas putida KT2440
gugcugccggucggccugcac

SEQ ID NO: 1571923 - RNA, 15 nt, Pseudomonas putida KT2440
gugcugguggccacg

SEQ ID NO: 1571924 - RNA, 15 nt, Pseudomonas putida KT2440
gugcugucggugaag

SEQ ID NO: 1571925 - RNA, 13 nt, Pseudomonas putida KT2440
guggcccaugacg

SEQ ID NO: 1571926 - RNA, 13 nt, Pseudomonas putida KT2440
guggcccugaccg

SEQ ID NO: 1571927 - RNA, 13 nt, Pseudomonas putida KT2440
guggccggcaacg

SEQ ID NO: 1571928 - RNA, 14 nt, Pseudomonas putida KT2440
guggccgcgcgggu

SEQ ID NO: 1571929 - RNA, 15 nt, Pseudomonas putida KT2440
guggccugagccggu

SEQ ID NO: 1571930 - RNA, 24 nt, Pseudomonas putida KT2440
guggcgaccaacacggugaugcgc

SEQ ID NO: 1571931 - RNA, 13 nt, Pseudomonas putida KT2440
guggcguccacga

SEQ ID NO: 1571932 - RNA, 23 nt, Pseudomonas putida KT2440
gugggauugcgccgaugggcgca

SEQ ID NO: 1571933 - RNA, 15 nt, Pseudomonas putida KT2440
gugggcacacaccgg

SEQ ID NO: 1571934 - RNA, 20 nt, Pseudomonas putida KT2440
gugggaguaacggcccuugc

SEQ ID NO: 1571935 - RNA, 19 nt, Pseudomonas putida KT2440
guggcgccuaucagaucga

SEQ ID NO: 1571936 - RNA, 16 nt, Pseudomonas putida KT2440
guggcggccagcgcau

SEQ ID NO: 1571937 - RNA, 17 nt, Pseudomonas putida KT2440
guggcgauccacagcgg

SEQ ID NO: 1571938 - RNA, 14 nt, Pseudomonas putida KT2440
guggcgaucucugc

SEQ ID NO: 1571939 - RNA, 17 nt, Pseudomonas putida KT2440
gugcguuggcugcugaa

SEQ ID NO: 1571940 - RNA, 19 nt, Pseudomonas putida KT2440
gugcucaggcucagcucca

SEQ ID NO: 1571941 - RNA, 13 nt, Pseudomonas putida KT2440
gugcugcagaccc

SEQ ID NO: 1571942 - RNA, 22 nt, Pseudomonas putida KT2440
gugcugcaaaugggucgcgaag

SEQ ID NO: 1571943 - RNA, 13 nt, Pseudomonas putida KT2440
gugcugccgaggc

SEQ ID NO: 1571944 - RNA, 14 nt, Pseudomonas putida KT2440
gugcgcauuucacg

SEQ ID NO: 1571945 - RNA, 20 nt, Pseudomonas putida KT2440
gugcgcauuucacgcacggc

SEQ ID NO: 1571946 - RNA, 20 nt, Pseudomonas putida KT2440
gugcgcaggcuuucggccac

SEQ ID NO: 1571947 - RNA, 15 nt, Pseudomonas putida KT2440
gugcgccuccagcag

SEQ ID NO: 1571948 - RNA, 18 nt, Pseudomonas putida KT2440
gugcgcugaucgaaagcu

SEQ ID NO: 1571949 - RNA, 17 nt, Pseudomonas putida KT2440
gugcgcucaggcgugga

SEQ ID NO: 1571950 - RNA, 16 nt, Pseudomonas putida KT2440
gugcgcggcaggucga

SEQ ID NO: 1571951 - RNA, 15 nt, Pseudomonas putida KT2440
gugcgcggccgucau

SEQ ID NO: 1571952 - RNA, 21 nt, Pseudomonas putida KT2440
gugccggcagcucgcgcugcg

SEQ ID NO: 1571953 - RNA, 11 nt, Pseudomonas putida KT2440
gugccggcgag

SEQ ID NO: 1571954 - RNA, 22 nt, Pseudomonas putida KT2440
gugccggccucuucgcgggcaa

SEQ ID NO: 1571955 - RNA, 13 nt, Pseudomonas putida KT2440
gugccgaagucau

SEQ ID NO: 1571956 - RNA, 21 nt, Pseudomonas putida KT2440
gugccgaauugacccagucag

SEQ ID NO: 1571957 - RNA, 16 nt, Pseudomonas putida KT2440
gugcccgaucaccgcg

SEQ ID NO: 1571958 - RNA, 12 nt, Pseudomonas putida KT2440
gugccgaacagc

SEQ ID NO: 1571959 - RNA, 15 nt, Pseudomonas putida KT2440
gugcccuugaacggc

SEQ ID NO: 1571960 - RNA, 18 nt, Pseudomonas putida KT2440
gugccugcagcccggcaa

SEQ ID NO: 1571961 - RNA, 16 nt, Pseudomonas putida KT2440
gugccucacgcaugcc

SEQ ID NO: 1571962 - RNA, 13 nt, Pseudomonas putida KT2440
gugccucagccag

SEQ ID NO: 1571963 - RNA, 16 nt, Pseudomonas putida KT2440
gugccgucgagcaggu

SEQ ID NO: 1571964 - RNA, 16 nt, Pseudomonas putida KT2440
aagugccccuggcugu

SEQ ID NO: 1571965 - RNA, 23 nt, Pseudomonas putida KT2440
aagugccgccucguugcgaagcg

SEQ ID NO: 1571966 - RNA, 12 nt, Pseudomonas putida KT2440
aagugccaaggc

SEQ ID NO: 1571967 - RNA, 16 nt, Pseudomonas putida KT2440
aagugaauagccggca

SEQ ID NO: 1571968 - RNA, 14 nt, Pseudomonas putida KT2440
gugcgcacgcugcc

SEQ ID NO: 1571969 - RNA, 23 nt, Pseudomonas putida KT2440
gugcgcacgaagaucaccgacaa

SEQ ID NO: 1571970 - RNA, 13 nt, Pseudomonas putida KT2440
aagugccgugcau

SEQ ID NO: 1571971 - RNA, 20 nt, Pseudomonas putida KT2440
gugcaguguguugcggugga

SEQ ID NO: 1571972 - RNA, 12 nt, Pseudomonas putida KT2440
gugccaccgaug

SEQ ID NO: 1571973 - RNA, 17 nt, Pseudomonas putida KT2440
gugccaccuucagcggg

SEQ ID NO: 1571974 - RNA, 14 nt, Pseudomonas putida KT2440
gugccacccaaggc

SEQ ID NO: 1571975 - RNA, 15 nt, Pseudomonas putida KT2440
gugcagguuggagcg

SEQ ID NO: 1571976 - RNA, 21 nt, Pseudomonas putida KT2440
gugcagggggguaaggcuggc

SEQ ID NO: 1571977 - RNA, 18 nt, Pseudomonas putida KT2440
gugcagaacguacuggcc

SEQ ID NO: 1571978 - RNA, 21 nt, Pseudomonas putida KT2440
gugcagaacguacuggccgcu

SEQ ID NO: 1571979 - RNA, 14 nt, Pseudomonas putida KT2440
gugcacuuucgcgg

SEQ ID NO: 1571980 - RNA, 12 nt, Pseudomonas putida KT2440
gugcacuggcag

SEQ ID NO: 1571981 - RNA, 16 nt, Pseudomonas putida KT2440
gugcacuggcaggccu

SEQ ID NO: 1571982 - RNA, 19 nt, Pseudomonas putida KT2440
gugcagaccugugggagcg

SEQ ID NO: 1571983 - RNA, 14 nt, Pseudomonas putida KT2440
gugcagcaacaccg

SEQ ID NO: 1571984 - RNA, 17 nt, Pseudomonas putida KT2440
gugcaggcgcaggcucu

SEQ ID NO: 1571985 - RNA, 22 nt, Pseudomonas putida KT2440
gugcagcacuucgaucaggcag

SEQ ID NO: 1571986 - RNA, 14 nt, Pseudomonas putida KT2440
gugcaaacacccag

SEQ ID NO: 1571987 - RNA, 16 nt, Pseudomonas putida KT2440
gugcacgcgggcgcga

SEQ ID NO: 1571988 - RNA, 15 nt, Pseudomonas putida KT2440
gugcacgccagccag

SEQ ID NO: 1571989 - RNA, 21 nt, Pseudomonas putida KT2440
gugcacgccagccaguacggc

SEQ ID NO: 1571990 - RNA, 15 nt, Pseudomonas putida KT2440
gugauggcgcauggc

SEQ ID NO: 1571991 - RNA, 16 nt, Pseudomonas putida KT2440
gugaucuggcgcagcg

SEQ ID NO: 1571992 - RNA, 17 nt, Pseudomonas putida KT2440
gugaucguugcgcgcca

SEQ ID NO: 1571993 - RNA, 20 nt, Pseudomonas putida KT2440
gucggcguggaacaacggcu

SEQ ID NO: 1571994 - RNA, 23 nt, Pseudomonas putida KT2440
gucggcguuaccccguugcgcag

SEQ ID NO: 1571995 - RNA, 18 nt, Pseudomonas putida KT2440
gugaucgccucgugcagc

SEQ ID NO: 1571996 - RNA, 19 nt, Pseudomonas putida KT2440
gugaucaucacacucgccc

SEQ ID NO: 1571997 - RNA, 19 nt, Pseudomonas putida KT2440
ucacgcggcgucaccggcc

SEQ ID NO: 1571998 - RNA, 16 nt, Pseudomonas putida KT2440
ucacgaucaugcuggc

SEQ ID NO: 1571999 - RNA, 13 nt, Pseudomonas putida KT2440
ucacgucggccug

SEQ ID NO: 1572000 - RNA, 17 nt, Pseudomonas putida KT2440
ucacgucguacucggcc

SEQ ID NO: 1572001 - RNA, 11 nt, Pseudomonas putida KT2440
ucacucggcag

SEQ ID NO: 1572002 - RNA, 19 nt, Pseudomonas putida KT2440
ucacugcagaucaccagcu

SEQ ID NO: 1572003 - RNA, 22 nt, Pseudomonas putida KT2440
ucacugccaccgugagcauggc

SEQ ID NO: 1572004 - RNA, 16 nt, Pseudomonas putida KT2440
ucacgucacagccaag

SEQ ID NO: 1572005 - RNA, 20 nt, Pseudomonas putida KT2440
ucacguccaaugccgccuug

SEQ ID NO: 1572006 - RNA, 16 nt, Pseudomonas putida KT2440
ucacguaaucggcguu

SEQ ID NO: 1572007 - RNA, 15 nt, Pseudomonas putida KT2440
ucagcaacgccacca

SEQ ID NO: 1572008 - RNA, 19 nt, Pseudomonas putida KT2440
ucagcaaccugcugggcaa

SEQ ID NO: 1572009 - RNA, 14 nt, Pseudomonas putida KT2440
ucagagcgccagca

SEQ ID NO: 1572010 - RNA, 17 nt, Pseudomonas putida KT2440
ucacugcuguaaucggc

SEQ ID NO: 1572011 - RNA, 13 nt, Pseudomonas putida KT2440
ucacuggccaacu

SEQ ID NO: 1572012 - RNA, 14 nt, Pseudomonas putida KT2440
ucacuggccaacuc

SEQ ID NO: 1572013 - RNA, 14 nt, Pseudomonas putida KT2440
ucacuggccagcag

SEQ ID NO: 1572014 - RNA, 20 nt, Pseudomonas putida KT2440
ucacuggccucuucacggcu

SEQ ID NO: 1572015 - RNA, 16 nt, Pseudomonas putida KT2440
ucagccgcugcgccug

SEQ ID NO: 1572016 - RNA, 22 nt, Pseudomonas putida KT2440
ucagcgagucguaguucggcgg

SEQ ID NO: 1572017 - RNA, 13 nt, Pseudomonas putida KT2440
ucagcgcaccgcu

SEQ ID NO: 1572018 - RNA, 23 nt, Pseudomonas putida KT2440
aauacauccgcguccccuucacg

SEQ ID NO: 1572019 - RNA, 16 nt, Pseudomonas putida KT2440
ucagccgcgcccucuu

SEQ ID NO: 1572020 - RNA, 22 nt, Pseudomonas putida KT2440
ucagcaggauggccaugaucgc

SEQ ID NO: 1572021 - RNA, 19 nt, Pseudomonas putida KT2440
ucagcccuugcucggccag

SEQ ID NO: 1572022 - RNA, 19 nt, Pseudomonas putida KT2440
ucagcccuugcugcagcag

SEQ ID NO: 1572023 - RNA, 18 nt, Pseudomonas putida KT2440
ucagcaggcgcggcgugg

SEQ ID NO: 1572024 - RNA, 19 nt, Pseudomonas putida KT2440
ucagcaggaaauacgccgc

SEQ ID NO: 1572025 - RNA, 14 nt, Pseudomonas putida KT2440
ucagcaguggcucc

SEQ ID NO: 1572026 - RNA, 19 nt, Pseudomonas putida KT2440
ucagcaggucggcgucagc

SEQ ID NO: 1572027 - RNA, 19 nt, Pseudomonas putida KT2440
ucagcacgcgaucggcagc

SEQ ID NO: 1572028 - RNA, 18 nt, Pseudomonas putida KT2440
ucacccgugcugcucgcc

SEQ ID NO: 1572029 - RNA, 19 nt, Pseudomonas putida KT2440
ucacccgggaacagcagca

SEQ ID NO: 1572030 - RNA, 19 nt, Pseudomonas putida KT2440
ucaccgcgaccuucacgcc

SEQ ID NO: 1572031 - RNA, 18 nt, Pseudomonas putida KT2440
ucaccgcgcccaagguca

SEQ ID NO: 1572032 - RNA, 21 nt, Pseudomonas putida KT2440
ucaccgccggcucgucacugc

SEQ ID NO: 1572033 - RNA, 20 nt, Pseudomonas putida KT2440
ucacccccgaaucagugcac

SEQ ID NO: 1572034 - RNA, 13 nt, Pseudomonas putida KT2440
ucacccaccagcc

SEQ ID NO: 1572035 - RNA, 19 nt, Pseudomonas putida KT2440
ucaccccuuuacuggccau

SEQ ID NO: 1572036 - RNA, 23 nt, Pseudomonas putida KT2440
ucacccgaccagaucaggccgcu

SEQ ID NO: 1572037 - RNA, 19 nt, Pseudomonas putida KT2440
ucaccguucuugauccagc

SEQ ID NO: 1572038 - RNA, 23 nt, Pseudomonas putida KT2440
ucaccguguuguucgccaacuuc

SEQ ID NO: 1572039 - RNA, 16 nt, Pseudomonas putida KT2440
ucaccucggcaccgca

SEQ ID NO: 1572040 - RNA, 20 nt, Pseudomonas putida KT2440
ucaccaccggcuuccagcuu

SEQ ID NO: 1572041 - RNA, 23 nt, Pseudomonas putida KT2440
ucaccacccccagcgaccagcug

SEQ ID NO: 1572042 - RNA, 20 nt, Pseudomonas putida KT2440
ucaccagcccgaagcgcagg

SEQ ID NO: 1572043 - RNA, 13 nt, Pseudomonas putida KT2440
ucaccagcacguc

SEQ ID NO: 1572044 - RNA, 22 nt, Pseudomonas putida KT2440
ucaccagcaggucggcacgcac

SEQ ID NO: 1572045 - RNA, 18 nt, Pseudomonas putida KT2440
ucaccacgcccgccggca

SEQ ID NO: 1572046 - RNA, 14 nt, Pseudomonas putida KT2440
ucacagaaaagcug

SEQ ID NO: 1572047 - RNA, 20 nt, Pseudomonas putida KT2440
ucacaugcgccacacccgcu

SEQ ID NO: 1572048 - RNA, 18 nt, Pseudomonas putida KT2440
ucaacggguaguugcccg

SEQ ID NO: 1572049 - RNA, 21 nt, Pseudomonas putida KT2440
ucaacgccguacggcccaugu

SEQ ID NO: 1572050 - RNA, 15 nt, Pseudomonas putida KT2440
ucaacgcaacugcgg

SEQ ID NO: 1572051 - RNA, 14 nt, Pseudomonas putida KT2440
ucaacgaggccgcc

SEQ ID NO: 1572052 - RNA, 22 nt, Pseudomonas putida KT2440
uccacguccacuaccuccagcc

SEQ ID NO: 1572053 - RNA, 20 nt, Pseudomonas putida KT2440
uccagcagugccaucgccuc

SEQ ID NO: 1572054 - RNA, 13 nt, Pseudomonas putida KT2440
uccagcgccagca

SEQ ID NO: 1572055 - RNA, 19 nt, Pseudomonas putida KT2440
uccagcgccgccaugcagc

SEQ ID NO: 1572056 - RNA, 22 nt, Pseudomonas putida KT2440
uccaggcggccagccaacggca

SEQ ID NO: 1572057 - RNA, 17 nt, Pseudomonas putida KT2440
uccaggccugcggcagc

SEQ ID NO: 1572058 - RNA, 18 nt, Pseudomonas putida KT2440
uccagcugaaagucgucg

SEQ ID NO: 1572059 - RNA, 19 nt, Pseudomonas putida KT2440
uccagcuugccaccaucga

SEQ ID NO: 1572060 - RNA, 16 nt, Pseudomonas putida KT2440
uccagcuuuggcugca

SEQ ID NO: 1572061 - RNA, 18 nt, Pseudomonas putida KT2440
uccagcuuuggcugcagg

SEQ ID NO: 1572062 - RNA, 21 nt, Pseudomonas putida KT2440
uccagcuucuugugcuuccag

SEQ ID NO: 1572063 - RNA, 17 nt, Pseudomonas putida KT2440
uccagcuucaccucauc

SEQ ID NO: 1572064 - RNA, 20 nt, Pseudomonas putida KT2440
uccagcuguacgcuggccaa

SEQ ID NO: 1572065 - RNA, 18 nt, Pseudomonas putida KT2440
uccaccccgcaggccgca

SEQ ID NO: 1572066 - RNA, 22 nt, Pseudomonas putida KT2440
uccacccccgucucggcaauca

SEQ ID NO: 1572067 - RNA, 16 nt, Pseudomonas putida KT2440
uccacccccgcuccua

SEQ ID NO: 1572068 - RNA, 16 nt, Pseudomonas putida KT2440
uccacccacccucgca

SEQ ID NO: 1572069 - RNA, 14 nt, Pseudomonas putida KT2440
uccaccaggccgau

SEQ ID NO: 1572070 - RNA, 12 nt, Pseudomonas putida KT2440
uccaccaccacu

SEQ ID NO: 1572071 - RNA, 13 nt, Pseudomonas putida KT2440
uccaccuggccac

SEQ ID NO: 1572072 - RNA, 14 nt, Pseudomonas putida KT2440
uccaccuggccacc

SEQ ID NO: 1572073 - RNA, 20 nt, Pseudomonas putida KT2440
uccacgaaccugugcacagc

SEQ ID NO: 1572074 - RNA, 21 nt, Pseudomonas putida KT2440
uccaccgccccaagcgccuga

SEQ ID NO: 1572075 - RNA, 12 nt, Pseudomonas putida KT2440
uccaccgcgcca

SEQ ID NO: 1572076 - RNA, 22 nt, Pseudomonas putida KT2440
uccaccgcgccaucaaggccga

SEQ ID NO: 1572077 - RNA, 17 nt, Pseudomonas putida KT2440
uccaccgggaagcaggu

SEQ ID NO: 1572078 - RNA, 22 nt, Pseudomonas putida KT2440
ucaugcacaacgcgcgggcaau

SEQ ID NO: 1572079 - RNA, 13 nt, Pseudomonas putida KT2440
ucaugaacagcgc

SEQ ID NO: 1572080 - RNA, 14 nt, Pseudomonas putida KT2440
ucaugcugcugcag

SEQ ID NO: 1572081 - RNA, 22 nt, Pseudomonas putida KT2440
ucaugcugcugcagcacugccu

SEQ ID NO: 1572082 - RNA, 18 nt, Pseudomonas putida KT2440
ucaugcuggccaggaugc

SEQ ID NO: 1572083 - RNA, 18 nt, Pseudomonas putida KT2440
ucaugcugguuuggcagc

SEQ ID NO: 1572084 - RNA, 21 nt, Pseudomonas putida KT2440
ucaugcugguuuggcagcacc

SEQ ID NO: 1572085 - RNA, 18 nt, Pseudomonas putida KT2440
ucaugcucgccggccuug

SEQ ID NO: 1572086 - RNA, 22 nt, Pseudomonas putida KT2440
ucaugcucgccggccuuggcgc

SEQ ID NO: 1572087 - RNA, 13 nt, Pseudomonas putida KT2440
uccaaaccugcga

SEQ ID NO: 1572088 - RNA, 13 nt, Pseudomonas putida KT2440
uccaaccagccag

SEQ ID NO: 1572089 - RNA, 17 nt, Pseudomonas putida KT2440
uccaacuccacgcggaa

SEQ ID NO: 1572090 - RNA, 15 nt, Pseudomonas putida KT2440
ucaucgcgguacacc

SEQ ID NO: 1572091 - RNA, 13 nt, Pseudomonas putida KT2440
ucaucgccagcag

SEQ ID NO: 1572092 - RNA, 19 nt, Pseudomonas putida KT2440
ucauccgagcugagcagcg

SEQ ID NO: 1572093 - RNA, 20 nt, Pseudomonas putida KT2440
ucauccgccaacaccaccuc

SEQ ID NO: 1572094 - RNA, 13 nt, Pseudomonas putida KT2440
ucauccgcacgca

SEQ ID NO: 1572095 - RNA, 13 nt, Pseudomonas putida KT2440
ucauccaccgccc

SEQ ID NO: 1572096 - RNA, 21 nt, Pseudomonas putida KT2440
ucaucacuacuccucgcaggu

SEQ ID NO: 1572097 - RNA, 19 nt, Pseudomonas putida KT2440
ucaucacgcgacgggaagu

SEQ ID NO: 1572098 - RNA, 12 nt, Pseudomonas putida KT2440
ucaucaccagcc

SEQ ID NO: 1572099 - RNA, 12 nt, Pseudomonas putida KT2440
ucaucaccggcc

SEQ ID NO: 1572100 - RNA, 19 nt, Pseudomonas putida KT2440
ucauccagcguggccugca

SEQ ID NO: 1572101 - RNA, 19 nt, Pseudomonas putida KT2440
ucauccaggcuggccagca

SEQ ID NO: 1572102 - RNA, 16 nt, Pseudomonas putida KT2440
ucagugucugcgccug

SEQ ID NO: 1572103 - RNA, 14 nt, Pseudomonas putida KT2440
ucagugugaccuuc

SEQ ID NO: 1572104 - RNA, 13 nt, Pseudomonas putida KT2440
ucagugcggucag

SEQ ID NO: 1572105 - RNA, 17 nt, Pseudomonas putida KT2440
ucagugcgucggccacc

SEQ ID NO: 1572106 - RNA, 19 nt, Pseudomonas putida KT2440
ucagucucuuucaacagcu

SEQ ID NO: 1572107 - RNA, 20 nt, Pseudomonas putida KT2440
ucagucgcaucgacaggucc

SEQ ID NO: 1572108 - RNA, 21 nt, Pseudomonas putida KT2440
ucaggcgcgugccugagccuu

SEQ ID NO: 1572109 - RNA, 22 nt, Pseudomonas putida KT2440
ucaggcgcucaccccgccccug

SEQ ID NO: 1572110 - RNA, 12 nt, Pseudomonas putida KT2440
ucaggcgcucca

SEQ ID NO: 1572111 - RNA, 20 nt, Pseudomonas putida KT2440
ucaggcgcuccagcaggguc

SEQ ID NO: 1572112 - RNA, 12 nt, Pseudomonas putida KT2440
ucaggcgcuggu

SEQ ID NO: 1572113 - RNA, 23 nt, Pseudomonas putida KT2440
ucaggcguggaaaaggcgcuguc

SEQ ID NO: 1572114 - RNA, 12 nt, Pseudomonas putida KT2440
ucaggccuucga

SEQ ID NO: 1572115 - RNA, 20 nt, Pseudomonas putida KT2440
ucaggccuucgccacugcca

SEQ ID NO: 1572116 - RNA, 15 nt, Pseudomonas putida KT2440
ucaggccuugccgcu

SEQ ID NO: 1572117 - RNA, 13 nt, Pseudomonas putida KT2440
ucaggccgaugcg

SEQ ID NO: 1572118 - RNA, 16 nt, Pseudomonas putida KT2440
ucagguagaccugcgu

SEQ ID NO: 1572119 - RNA, 18 nt, Pseudomonas putida KT2440
ucaggucgacacccagca

SEQ ID NO: 1572120 - RNA, 13 nt, Pseudomonas putida KT2440
ucaggucguacgg

SEQ ID NO: 1572121 - RNA, 22 nt, Pseudomonas putida KT2440
ucagguuuggggugagcgaauc

SEQ ID NO: 1572122 - RNA, 15 nt, Pseudomonas putida KT2440
ucagguugcccagca

SEQ ID NO: 1572123 - RNA, 20 nt, Pseudomonas putida KT2440
ucaggggugccuucgagcau

SEQ ID NO: 1572124 - RNA, 12 nt, Pseudomonas putida KT2440
ucagggucaggg

SEQ ID NO: 1572125 - RNA, 16 nt, Pseudomonas putida KT2440
ucagggcaauagccac

SEQ ID NO: 1572126 - RNA, 17 nt, Pseudomonas putida KT2440
ucagggcgaugcgcaca

SEQ ID NO: 1572127 - RNA, 15 nt, Pseudomonas putida KT2440
ucagggcacggcugc

SEQ ID NO: 1572128 - RNA, 21 nt, Pseudomonas putida KT2440
ucagggauacugcugaaccug

SEQ ID NO: 1572129 - RNA, 20 nt, Pseudomonas putida KT2440
ucaggcuuugcugcaggucc

SEQ ID NO: 1572130 - RNA, 21 nt, Pseudomonas putida KT2440
uaccgcauucuuggccaggau

SEQ ID NO: 1572131 - RNA, 21 nt, Pseudomonas putida KT2440
uaccgauugccucaggcccca

SEQ ID NO: 1572132 - RNA, 14 nt, Pseudomonas putida KT2440
uaccgcaacaccug

SEQ ID NO: 1572133 - RNA, 15 nt, Pseudomonas putida KT2440
uaccgaacagcaccg

SEQ ID NO: 1572134 - RNA, 12 nt, Pseudomonas putida KT2440
uacccucggcau

SEQ ID NO: 1572135 - RNA, 21 nt, Pseudomonas putida KT2440
uacccuguugcgucaacucau

SEQ ID NO: 1572136 - RNA, 19 nt, Pseudomonas putida KT2440
uacccugcgggagcgggcg

SEQ ID NO: 1572137 - RNA, 20 nt, Pseudomonas putida KT2440
uacccgcguuggcagcacca

SEQ ID NO: 1572138 - RNA, 19 nt, Pseudomonas putida KT2440
uaccccgcugccugcgcuu

SEQ ID NO: 1572139 - RNA, 20 nt, Pseudomonas putida KT2440
uacccgcgaaagggccagca

SEQ ID NO: 1572140 - RNA, 20 nt, Pseudomonas putida KT2440
uacccaugguaaaagccgcc

SEQ ID NO: 1572141 - RNA, 19 nt, Pseudomonas putida KT2440
uacccagcucgaucagcug

SEQ ID NO: 1572142 - RNA, 16 nt, Pseudomonas putida KT2440
uaccaggucgccagca

SEQ ID NO: 1572143 - RNA, 16 nt, Pseudomonas putida KT2440
uaccgggcggccaccg

SEQ ID NO: 1572144 - RNA, 14 nt, Pseudomonas putida KT2440
uaccgugcugcagg

SEQ ID NO: 1572145 - RNA, 15 nt, Pseudomonas putida KT2440
uaccguauucgcggg

SEQ ID NO: 1572146 - RNA, 20 nt, Pseudomonas putida KT2440
uaccgcccucuucgcgggca

SEQ ID NO: 1572147 - RNA, 18 nt, Pseudomonas putida KT2440
uaccggcauaccaucuuc

SEQ ID NO: 1572148 - RNA, 23 nt, Pseudomonas putida KT2440
uaccggccagcugcgcaccggcu

SEQ ID NO: 1572149 - RNA, 19 nt, Pseudomonas putida KT2440
uaccggccgcucaccggcc

SEQ ID NO: 1572150 - RNA, 20 nt, Pseudomonas putida KT2440
uacgccggccaaggucagca

SEQ ID NO: 1572151 - RNA, 15 nt, Pseudomonas putida KT2440
uacgccgucuuccca

SEQ ID NO: 1572152 - RNA, 21 nt, Pseudomonas putida KT2440
uacgcucguaauccucgucca

SEQ ID NO: 1572153 - RNA, 19 nt, Pseudomonas putida KT2440
uaccuuggcguaggccugc

SEQ ID NO: 1572154 - RNA, 19 nt, Pseudomonas putida KT2440
uaccugugggagcgggcgu

SEQ ID NO: 1572155 - RNA, 21 nt, Pseudomonas putida KT2440
uaccugcagcucagccagcaa

SEQ ID NO: 1572156 - RNA, 16 nt, Pseudomonas putida KT2440
uaccugcacacugccc

SEQ ID NO: 1572157 - RNA, 17 nt, Pseudomonas putida KT2440
uaccugcacacugccca

SEQ ID NO: 1572158 - RNA, 19 nt, Pseudomonas putida KT2440
uaccuggccgcguucgccc

SEQ ID NO: 1572159 - RNA, 16 nt, Pseudomonas putida KT2440
uaccucccgcacugcu

SEQ ID NO: 1572160 - RNA, 17 nt, Pseudomonas putida KT2440
uagcagguaaacccgcg

SEQ ID NO: 1572161 - RNA, 16 nt, Pseudomonas putida KT2440
uagcaggcaagcccgc

SEQ ID NO: 1572162 - RNA, 16 nt, Pseudomonas putida KT2440
uagccacaauggcgca

SEQ ID NO: 1572163 - RNA, 20 nt, Pseudomonas putida KT2440
uagcccgaaaccgccagcca

SEQ ID NO: 1572164 - RNA, 14 nt, Pseudomonas putida KT2440
uagcccaccgucag

SEQ ID NO: 1572165 - RNA, 19 nt, Pseudomonas putida KT2440
uagccauuccggcugcagc

SEQ ID NO: 1572166 - RNA, 13 nt, Pseudomonas putida KT2440
uagccauugcggc

SEQ ID NO: 1572167 - RNA, 17 nt, Pseudomonas putida KT2440
uagccagcuggccaccu

SEQ ID NO: 1572168 - RNA, 22 nt, Pseudomonas putida KT2440
uagcgguaaacgucggcagcca

SEQ ID NO: 1572169 - RNA, 21 nt, Pseudomonas putida KT2440
uagcgucaacugccaggcugg

SEQ ID NO: 1572170 - RNA, 16 nt, Pseudomonas putida KT2440
uagcgagcaccggcag

SEQ ID NO: 1572171 - RNA, 18 nt, Pseudomonas putida KT2440
uagcgagccgcauuggcc

SEQ ID NO: 1572172 - RNA, 17 nt, Pseudomonas putida KT2440
uagcgcaacaccgccau

SEQ ID NO: 1572173 - RNA, 15 nt, Pseudomonas putida KT2440
uagccguacuugguc

SEQ ID NO: 1572174 - RNA, 22 nt, Pseudomonas putida KT2440
uagccggcacagugccaaggac

SEQ ID NO: 1572175 - RNA, 19 nt, Pseudomonas putida KT2440
uagccgcuuucggucaggg

SEQ ID NO: 1572176 - RNA, 13 nt, Pseudomonas putida KT2440
uagauaucaagca

SEQ ID NO: 1572177 - RNA, 15 nt, Pseudomonas putida KT2440
uagaucacaccggcc

SEQ ID NO: 1572178 - RNA, 19 nt, Pseudomonas putida KT2440
uagaagcuuggggcgaugu

SEQ ID NO: 1572179 - RNA, 14 nt, Pseudomonas putida KT2440
uagaacuggcgcag

SEQ ID NO: 1572180 - RNA, 15 nt, Pseudomonas putida KT2440
uagaacggcagcagg

SEQ ID NO: 1572181 - RNA, 16 nt, Pseudomonas putida KT2440
uagaacuccaccagcc

SEQ ID NO: 1572182 - RNA, 22 nt, Pseudomonas putida KT2440
uacucgcgacugaagcgcgggu

SEQ ID NO: 1572183 - RNA, 19 nt, Pseudomonas putida KT2440
uacucggccgggcguagca

SEQ ID NO: 1572184 - RNA, 15 nt, Pseudomonas putida KT2440
uauccagcaccggcg

SEQ ID NO: 1572185 - RNA, 16 nt, Pseudomonas putida KT2440
uauccugcagcaccag

SEQ ID NO: 1572186 - RNA, 19 nt, Pseudomonas putida KT2440
uauccugugggagcgggcu

SEQ ID NO: 1572187 - RNA, 15 nt, Pseudomonas putida KT2440
uauccaccaggccga

SEQ ID NO: 1572188 - RNA, 23 nt, Pseudomonas putida KT2440
uaguaggagcggguuuacccgcg

SEQ ID NO: 1572189 - RNA, 14 nt, Pseudomonas putida KT2440
uaggucuaaccgcg

SEQ ID NO: 1572190 - RNA, 19 nt, Pseudomonas putida KT2440
uaguucacccacacccgcg

SEQ ID NO: 1572191 - RNA, 23 nt, Pseudomonas putida KT2440
uaguugaccagcaccagcgacug

SEQ ID NO: 1572192 - RNA, 19 nt, Pseudomonas putida KT2440
uagucaucuguaagugaug

SEQ ID NO: 1572193 - RNA, 23 nt, Pseudomonas putida KT2440
ucaacaccagcauguccugcugc

SEQ ID NO: 1572194 - RNA, 14 nt, Pseudomonas putida KT2440
ucaacaccaucuuc

SEQ ID NO: 1572195 - RNA, 20 nt, Pseudomonas putida KT2440
ucaacagcgcgacgcagcag

SEQ ID NO: 1572196 - RNA, 14 nt, Pseudomonas putida KT2440
ucaacaggcuggcc

SEQ ID NO: 1572197 - RNA, 21 nt, Pseudomonas putida KT2440
ucaacaauuuucgaccaaggc

SEQ ID NO: 1572198 - RNA, 16 nt, Pseudomonas putida KT2440
uauuuuuaccugcucc

SEQ ID NO: 1572199 - RNA, 16 nt, Pseudomonas putida KT2440
ucaaaugggucguuag

SEQ ID NO: 1572200 - RNA, 21 nt, Pseudomonas putida KT2440
ucaacaaaccgacccugcugc

SEQ ID NO: 1572201 - RNA, 18 nt, Pseudomonas putida KT2440
uauuuucgugagaccugc

SEQ ID NO: 1572202 - RNA, 15 nt, Pseudomonas putida KT2440
uauggcucaguguca

SEQ ID NO: 1572203 - RNA, 21 nt, Pseudomonas putida KT2440
uauucaccgguagcggcguug

SEQ ID NO: 1572204 - RNA, 20 nt, Pseudomonas putida KT2440
uauucgcggguaaacccgcg

SEQ ID NO: 1572205 - RNA, 13 nt, Pseudomonas putida KT2440
uaucgcucuggca

SEQ ID NO: 1572206 - RNA, 15 nt, Pseudomonas putida KT2440
uaucgcucuggcacu

SEQ ID NO: 1572207 - RNA, 13 nt, Pseudomonas putida KT2440
uaucgagcauggc

SEQ ID NO: 1572208 - RNA, 22 nt, Pseudomonas putida KT2440
uaucgcuuacagaugucuggca

SEQ ID NO: 1572209 - RNA, 16 nt, Pseudomonas putida KT2440
ugauaccgaacagcac

SEQ ID NO: 1572210 - RNA, 20 nt, Pseudomonas putida KT2440
ugauaccgaggaggaggcug

SEQ ID NO: 1572211 - RNA, 16 nt, Pseudomonas putida KT2440
ugauacacccgcucca

SEQ ID NO: 1572212 - RNA, 21 nt, Pseudomonas putida KT2440
ugaguucccaggcagccucca

SEQ ID NO: 1572213 - RNA, 20 nt, Pseudomonas putida KT2440
ugaggcacaaaaaagcccgg

SEQ ID NO: 1572214 - RNA, 14 nt, Pseudomonas putida KT2440
ugaggaccuugcgg

SEQ ID NO: 1572215 - RNA, 15 nt, Pseudomonas putida KT2440
ugaggaccuugcggg

SEQ ID NO: 1572216 - RNA, 20 nt, Pseudomonas putida KT2440
ugaggccgaacaccgccagc

SEQ ID NO: 1572217 - RNA, 20 nt, Pseudomonas putida KT2440
ugaggccgccauugaugccg

SEQ ID NO: 1572218 - RNA, 14 nt, Pseudomonas putida KT2440
ugagccuuguucgc

SEQ ID NO: 1572219 - RNA, 14 nt, Pseudomonas putida KT2440
ugacucagcggccu

SEQ ID NO: 1572220 - RNA, 14 nt, Pseudomonas putida KT2440
ugacucaugccuuc

SEQ ID NO: 1572221 - RNA, 17 nt, Pseudomonas putida KT2440
ugacguuggccgccagc

SEQ ID NO: 1572222 - RNA, 21 nt, Pseudomonas putida KT2440
ugacggugugcggaucgccgc

SEQ ID NO: 1572223 - RNA, 15 nt, Pseudomonas putida KT2440
ugagcgacgcugccg

SEQ ID NO: 1572224 - RNA, 19 nt, Pseudomonas putida KT2440
ugagcgagcucaaccagcu

SEQ ID NO: 1572225 - RNA, 15 nt, Pseudomonas putida KT2440
ugagcgccgcgauga

SEQ ID NO: 1572226 - RNA, 16 nt, Pseudomonas putida KT2440
ugagcgccgcgaugau

SEQ ID NO: 1572227 - RNA, 16 nt, Pseudomonas putida KT2440
ugaucacgggcaggcc

SEQ ID NO: 1572228 - RNA, 18 nt, Pseudomonas putida KT2440
ugaucaagcccgcucgcc

SEQ ID NO: 1572229 - RNA, 21 nt, Pseudomonas putida KT2440
ugaucaagcuguacaacgcag

SEQ ID NO: 1572230 - RNA, 19 nt, Pseudomonas putida KT2440
ugaucaccagguuguggcc

SEQ ID NO: 1572231 - RNA, 20 nt, Pseudomonas putida KT2440
ugaucgcuucggcgcgggca

SEQ ID NO: 1572232 - RNA, 22 nt, Pseudomonas putida KT2440
ugaucgcggcguugucagccuu

SEQ ID NO: 1572233 - RNA, 15 nt, Pseudomonas putida KT2440
ugaucggcuggccau

SEQ ID NO: 1572234 - RNA, 16 nt, Pseudomonas putida KT2440
ugaucguugcgcgcca

SEQ ID NO: 1572235 - RNA, 15 nt, Pseudomonas putida KT2440
ugaucucgcgcuggc

SEQ ID NO: 1572236 - RNA, 13 nt, Pseudomonas putida KT2440
ugaccgccugcgc

SEQ ID NO: 1572237 - RNA, 15 nt, Pseudomonas putida KT2440
ugaccgcccagcguc

SEQ ID NO: 1572238 - RNA, 17 nt, Pseudomonas putida KT2440
ugaccgcggugcugacc

SEQ ID NO: 1572239 - RNA, 22 nt, Pseudomonas putida KT2440
ugacccucaagugccguccgcu

SEQ ID NO: 1572240 - RNA, 17 nt, Pseudomonas putida KT2440
ugaccgagguaccaccg

SEQ ID NO: 1572241 - RNA, 18 nt, Pseudomonas putida KT2440
ugaccgagaacaggcggc

SEQ ID NO: 1572242 - RNA, 16 nt, Pseudomonas putida KT2440
ugaccgaugaucugcc

SEQ ID NO: 1572243 - RNA, 19 nt, Pseudomonas putida KT2440
ugaccgguuuuggcaggcc

SEQ ID NO: 1572244 - RNA, 15 nt, Pseudomonas putida KT2440
ugaccggccugguca

SEQ ID NO: 1572245 - RNA, 21 nt, Pseudomonas putida KT2440
ugaccucgaccaggcgcucgc

SEQ ID NO: 1572246 - RNA, 15 nt, Pseudomonas putida KT2440
ugaccguuugcagcg

SEQ ID NO: 1572247 - RNA, 19 nt, Pseudomonas putida KT2440
ugaccguguugcagcgggu

SEQ ID NO: 1572248 - RNA, 20 nt, Pseudomonas putida KT2440
ugaccgugaucaucagcgcc

SEQ ID NO: 1572249 - RNA, 14 nt, Pseudomonas putida KT2440
ugaccuggaucgcc

SEQ ID NO: 1572250 - RNA, 16 nt, Pseudomonas putida KT2440
ugacgccaguugguca

SEQ ID NO: 1572251 - RNA, 19 nt, Pseudomonas putida KT2440
ugacgcaagcgcgccgcca

SEQ ID NO: 1572252 - RNA, 17 nt, Pseudomonas putida KT2440
ugacgacguugcgcuca

SEQ ID NO: 1572253 - RNA, 13 nt, Pseudomonas putida KT2440
ugacgauggccac

SEQ ID NO: 1572254 - RNA, 15 nt, Pseudomonas putida KT2440
ugacgaucgccagcc

SEQ ID NO: 1572255 - RNA, 19 nt, Pseudomonas putida KT2440
ugacgcggauagcgcgcca

SEQ ID NO: 1572256 - RNA, 12 nt, Pseudomonas putida KT2440
ugacgcuacgcc

SEQ ID NO: 1572257 - RNA, 16 nt, Pseudomonas putida KT2440
ugacgcugcacuucca

SEQ ID NO: 1572258 - RNA, 21 nt, Pseudomonas putida KT2440
ugacggcgauggcgucgacuc

SEQ ID NO: 1572259 - RNA, 21 nt, Pseudomonas putida KT2440
ugacggugaauuccuugcagc

SEQ ID NO: 1572260 - RNA, 16 nt, Pseudomonas putida KT2440
ugacgggccucuucgc

SEQ ID NO: 1572261 - RNA, 15 nt, Pseudomonas putida KT2440
ugcagcucgaaaauc

SEQ ID NO: 1572262 - RNA, 18 nt, Pseudomonas putida KT2440
ugcaggcaguaggccacc

SEQ ID NO: 1572263 - RNA, 12 nt, Pseudomonas putida KT2440
ugcaggccagcg

SEQ ID NO: 1572264 - RNA, 13 nt, Pseudomonas putida KT2440
ugcaggagcgggc

SEQ ID NO: 1572265 - RNA, 21 nt, Pseudomonas putida KT2440
ugcagcguccacucaccggca

SEQ ID NO: 1572266 - RNA, 20 nt, Pseudomonas putida KT2440
ugcagcgggucgcacucggc

SEQ ID NO: 1572267 - RNA, 20 nt, Pseudomonas putida KT2440
ugcagcgcgucauccgccaa

SEQ ID NO: 1572268 - RNA, 13 nt, Pseudomonas putida KT2440
ugcagcgccaguu

SEQ ID NO: 1572269 - RNA, 14 nt, Pseudomonas putida KT2440
ugcagccugacgcg

SEQ ID NO: 1572270 - RNA, 22 nt, Pseudomonas putida KT2440
ugcagcccuucgccggcacgcc

SEQ ID NO: 1572271 - RNA, 19 nt, Pseudomonas putida KT2440
ugcagcccuucgcgggcac

SEQ ID NO: 1572272 - RNA, 19 nt, Pseudomonas putida KT2440
ugcagcccauucgcgggua

SEQ ID NO: 1572273 - RNA, 19 nt, Pseudomonas putida KT2440
ugcagccauagccaguagc

SEQ ID NO: 1572274 - RNA, 18 nt, Pseudomonas putida KT2440
ugcagcagugccagcaac

SEQ ID NO: 1572275 - RNA, 19 nt, Pseudomonas putida KT2440
ugcagcagugccagcaaca

SEQ ID NO: 1572276 - RNA, 24 nt, Pseudomonas putida KT2440
ugcagcagugccagcaacaagcug

SEQ ID NO: 1572277 - RNA, 14 nt, Pseudomonas putida KT2440
ugcagcaggccgcu

SEQ ID NO: 1572278 - RNA, 15 nt, Pseudomonas putida KT2440
ugcagcaggccgcug

SEQ ID NO: 1572279 - RNA, 24 nt, Pseudomonas putida KT2440
ugcagcagcauuucuucgaccugc

SEQ ID NO: 1572280 - RNA, 14 nt, Pseudomonas putida KT2440
ugcagcacugccug

SEQ ID NO: 1572281 - RNA, 15 nt, Pseudomonas putida KT2440
ugcagcacugccugc

SEQ ID NO: 1572282 - RNA, 18 nt, Pseudomonas putida KT2440
ugcagcacuucgaucagg

SEQ ID NO: 1572283 - RNA, 16 nt, Pseudomonas putida KT2440
ugcagagcucagcgug

SEQ ID NO: 1572284 - RNA, 15 nt, Pseudomonas putida KT2440
ugcagaucaccagcu

SEQ ID NO: 1572285 - RNA, 14 nt, Pseudomonas putida KT2440
ugcagacgaucagg

SEQ ID NO: 1572286 - RNA, 17 nt, Pseudomonas putida KT2440
ugcagaaccgccagcac

SEQ ID NO: 1572287 - RNA, 15 nt, Pseudomonas putida KT2440
ugcagcaacaccgcg

SEQ ID NO: 1572288 - RNA, 21 nt, Pseudomonas putida KT2440
ugcagcaccgcuucacccucg

SEQ ID NO: 1572289 - RNA, 19 nt, Pseudomonas putida KT2440
ugcagcaccuccaccuuca

SEQ ID NO: 1572290 - RNA, 14 nt, Pseudomonas putida KT2440
ugcagcaccgacug

SEQ ID NO: 1572291 - RNA, 22 nt, Pseudomonas putida KT2440
ugcacggcaauugccaccggcg

SEQ ID NO: 1572292 - RNA, 21 nt, Pseudomonas putida KT2440
ugcacggcagcaaucgccgcc

SEQ ID NO: 1572293 - RNA, 21 nt, Pseudomonas putida KT2440
ugcacggcaaaguccagcauc

SEQ ID NO: 1572294 - RNA, 16 nt, Pseudomonas putida KT2440
ugcacgcuuucgccga

SEQ ID NO: 1572295 - RNA, 15 nt, Pseudomonas putida KT2440
ugcacgccagcauca

SEQ ID NO: 1572296 - RNA, 14 nt, Pseudomonas putida KT2440
ugcacucgccgaua

SEQ ID NO: 1572297 - RNA, 22 nt, Pseudomonas putida KT2440
ugcacuaucugcguuucgcugg

SEQ ID NO: 1572298 - RNA, 16 nt, Pseudomonas putida KT2440
ugcacucccgcugcug

SEQ ID NO: 1572299 - RNA, 19 nt, Pseudomonas putida KT2440
ugcacugccagcgccucac

SEQ ID NO: 1572300 - RNA, 15 nt, Pseudomonas putida KT2440
ugcacugggcgaugg

SEQ ID NO: 1572301 - RNA, 17 nt, Pseudomonas putida KT2440
ugcacugggcgauggcg

SEQ ID NO: 1572302 - RNA, 16 nt, Pseudomonas putida KT2440
ugcacggccugcaucc

SEQ ID NO: 1572303 - RNA, 18 nt, Pseudomonas putida KT2440
ugcaccaaugacuccgcc

SEQ ID NO: 1572304 - RNA, 15 nt, Pseudomonas putida KT2440
ugcacccaucggcgc

SEQ ID NO: 1572305 - RNA, 14 nt, Pseudomonas putida KT2440
ugcacccgccagcc

SEQ ID NO: 1572306 - RNA, 13 nt, Pseudomonas putida KT2440
ugcaccagcacca

SEQ ID NO: 1572307 - RNA, 12 nt, Pseudomonas putida KT2440
ugauggucaccu

SEQ ID NO: 1572308 - RNA, 17 nt, Pseudomonas putida KT2440
ugaugguaucugccagc

SEQ ID NO: 1572309 - RNA, 21 nt, Pseudomonas putida KT2440
ugauggggccgcugugggagu

SEQ ID NO: 1572310 - RNA, 23 nt, Pseudomonas putida KT2440
ugauggauuccucgcgcuugccu

SEQ ID NO: 1572311 - RNA, 16 nt, Pseudomonas putida KT2440
ugaugcggacccagcg

SEQ ID NO: 1572312 - RNA, 19 nt, Pseudomonas putida KT2440
ugcccgcaugcaacccgca

SEQ ID NO: 1572313 - RNA, 20 nt, Pseudomonas putida KT2440
ugcccgccaggcgcaagccu

SEQ ID NO: 1572314 - RNA, 17 nt, Pseudomonas putida KT2440
ugcccgcccacgccgcu

SEQ ID NO: 1572315 - RNA, 18 nt, Pseudomonas putida KT2440
ugcccgcccacgccgcug

SEQ ID NO: 1572316 - RNA, 16 nt, Pseudomonas putida KT2440
ugcccgccccugccag

SEQ ID NO: 1572317 - RNA, 15 nt, Pseudomonas putida KT2440
ugcccgcgaacacgg

SEQ ID NO: 1572318 - RNA, 22 nt, Pseudomonas putida KT2440
ugcccgcgaagaggccagcaca

SEQ ID NO: 1572319 - RNA, 22 nt, Pseudomonas putida KT2440
ugcccgcgaagaggccggcaca

SEQ ID NO: 1572320 - RNA, 22 nt, Pseudomonas putida KT2440
ugcccgcgaaggggccggcaca

SEQ ID NO: 1572321 - RNA, 16 nt, Pseudomonas putida KT2440
ugcccgcgaauagccg

SEQ ID NO: 1572322 - RNA, 14 nt, Pseudomonas putida KT2440
ugcccgcgaaugca

SEQ ID NO: 1572323 - RNA, 13 nt, Pseudomonas putida KT2440
ugcccaucaccuc

SEQ ID NO: 1572324 - RNA, 17 nt, Pseudomonas putida KT2440
ugcccauaaaagccuca

SEQ ID NO: 1572325 - RNA, 13 nt, Pseudomonas putida KT2440
ugcccgaucgggu

SEQ ID NO: 1572326 - RNA, 14 nt, Pseudomonas putida KT2440
ugcccaugccaagc

SEQ ID NO: 1572327 - RNA, 22 nt, Pseudomonas putida KT2440
ugcccagggcugcuucacgggu

SEQ ID NO: 1572328 - RNA, 23 nt, Pseudomonas putida KT2440
ugcccugcagcuucccggccugg

SEQ ID NO: 1572329 - RNA, 14 nt, Pseudomonas putida KT2440
ugcccguaggagcg

SEQ ID NO: 1572330 - RNA, 18 nt, Pseudomonas putida KT2440
ugcccuguaggcgcgggu

SEQ ID NO: 1572331 - RNA, 23 nt, Pseudomonas putida KT2440
ugcccuguuucuucaaggccgcc

SEQ ID NO: 1572332 - RNA, 14 nt, Pseudomonas putida KT2440
ugcccggugccgcg

SEQ ID NO: 1572333 - RNA, 20 nt, Pseudomonas putida KT2440
ugcccgggccgcuugcucag

SEQ ID NO: 1572334 - RNA, 22 nt, Pseudomonas putida KT2440
ugcccgggcgcaggcagcacau

SEQ ID NO: 1572335 - RNA, 14 nt, Pseudomonas putida KT2440
ugcccgggcgcggu

SEQ ID NO: 1572336 - RNA, 16 nt, Pseudomonas putida KT2440
ugcccggccagcagga

SEQ ID NO: 1572337 - RNA, 16 nt, Pseudomonas putida KT2440
ugcccggccagcgaua

SEQ ID NO: 1572338 - RNA, 16 nt, Pseudomonas putida KT2440
ugcccgcgccuugcgc

SEQ ID NO: 1572339 - RNA, 20 nt, Pseudomonas putida KT2440
ugcccgcucccacaggucca

SEQ ID NO: 1572340 - RNA, 18 nt, Pseudomonas putida KT2440
ugcccgcucucacaggga

SEQ ID NO: 1572341 - RNA, 13 nt, Pseudomonas putida KT2440
ugcccgcgcaaag

SEQ ID NO: 1572342 - RNA, 16 nt, Pseudomonas putida KT2440
ugccauccgguaugcc

SEQ ID NO: 1572343 - RNA, 21 nt, Pseudomonas putida KT2440
ugccaucucgccaagcauucg

SEQ ID NO: 1572344 - RNA, 20 nt, Pseudomonas putida KT2440
ugccaugcaggucgacgaua

SEQ ID NO: 1572345 - RNA, 16 nt, Pseudomonas putida KT2440
ugccagccgcccaagc

SEQ ID NO: 1572346 - RNA, 22 nt, Pseudomonas putida KT2440
ugccauccaccgcgccagccug

SEQ ID NO: 1572347 - RNA, 19 nt, Pseudomonas putida KT2440
ugccauccaccgcgguguc

SEQ ID NO: 1572348 - RNA, 21 nt, Pseudomonas putida KT2440
ugccagcgccaaucgcaugcu

SEQ ID NO: 1572349 - RNA, 19 nt, Pseudomonas putida KT2440
ugccagcgucuuuggccug

SEQ ID NO: 1572350 - RNA, 16 nt, Pseudomonas putida KT2440
ugcccagcuccagcac

SEQ ID NO: 1572351 - RNA, 15 nt, Pseudomonas putida KT2440
ugcccagcucgcugg

SEQ ID NO: 1572352 - RNA, 23 nt, Pseudomonas putida KT2440
ugcccagcugaagugccaaggcu

SEQ ID NO: 1572353 - RNA, 19 nt, Pseudomonas putida KT2440
ugcccagcgccaccggcag

SEQ ID NO: 1572354 - RNA, 12 nt, Pseudomonas putida KT2440
ugcccacugcag

SEQ ID NO: 1572355 - RNA, 22 nt, Pseudomonas putida KT2440
ugccauguaguugcgcacguug

SEQ ID NO: 1572356 - RNA, 15 nt, Pseudomonas putida KT2440
ugccaugcgcugcag

SEQ ID NO: 1572357 - RNA, 15 nt, Pseudomonas putida KT2440
ugccauugaucaccu

SEQ ID NO: 1572358 - RNA, 20 nt, Pseudomonas putida KT2440
ugccauugcaccacccccag

SEQ ID NO: 1572359 - RNA, 16 nt, Pseudomonas putida KT2440
ugccacgcaugccuau

SEQ ID NO: 1572360 - RNA, 18 nt, Pseudomonas putida KT2440
ugccaccuguugccgcuu

SEQ ID NO: 1572361 - RNA, 18 nt, Pseudomonas putida KT2440
ugccacgacaccgggaua

SEQ ID NO: 1572362 - RNA, 14 nt, Pseudomonas putida KT2440
ugcauaagccacuu

SEQ ID NO: 1572363 - RNA, 14 nt, Pseudomonas putida KT2440
ugcaggccagcguc

SEQ ID NO: 1572364 - RNA, 23 nt, Pseudomonas putida KT2440
ugccagagaauuucuccccagca

SEQ ID NO: 1572365 - RNA, 21 nt, Pseudomonas putida KT2440
ugccagaaaaguuggccaugu

SEQ ID NO: 1572366 - RNA, 20 nt, Pseudomonas putida KT2440
ugccacugcgcuacgaccca

SEQ ID NO: 1572367 - RNA, 19 nt, Pseudomonas putida KT2440
ugccacuggucgccucgac

SEQ ID NO: 1572368 - RNA, 20 nt, Pseudomonas putida KT2440
ugccacgcccgcugcaugcu

SEQ ID NO: 1572369 - RNA, 17 nt, Pseudomonas putida KT2440
ucuggacaagaagcggc

SEQ ID NO: 1572370 - RNA, 16 nt, Pseudomonas putida KT2440
ucugcuucgcugccag

SEQ ID NO: 1572371 - RNA, 22 nt, Pseudomonas putida KT2440
ucugcgccaaagcgagcauggc

SEQ ID NO: 1572372 - RNA, 14 nt, Pseudomonas putida KT2440
ucugcgccugcugg

SEQ ID NO: 1572373 - RNA, 12 nt, Pseudomonas putida KT2440
ucuuagcgggca

SEQ ID NO: 1572374 - RNA, 16 nt, Pseudomonas putida KT2440
ucuucggucagcuggu

SEQ ID NO: 1572375 - RNA, 20 nt, Pseudomonas putida KT2440
ucuugcgaaaggcuuucgau

SEQ ID NO: 1572376 - RNA, 23 nt, Pseudomonas putida KT2440
ucuugccgugcucguccuugccg

SEQ ID NO: 1572377 - RNA, 14 nt, Pseudomonas putida KT2440
ucuugccgagcagc

SEQ ID NO: 1572378 - RNA, 16 nt, Pseudomonas putida KT2440
ucuuggagcggccuuu

SEQ ID NO: 1572379 - RNA, 22 nt, Pseudomonas putida KT2440
ucuucgcgcucgaacaacgccu

SEQ ID NO: 1572380 - RNA, 23 nt, Pseudomonas putida KT2440
ucuucgcgcucgaacaacgccuc

SEQ ID NO: 1572381 - RNA, 13 nt, Pseudomonas putida KT2440
ucuucgcgggcaa

SEQ ID NO: 1572382 - RNA, 14 nt, Pseudomonas putida KT2440
ucuucgcgggcaag

SEQ ID NO: 1572383 - RNA, 20 nt, Pseudomonas putida KT2440
ucuucgcggguaaacccgcu

SEQ ID NO: 1572384 - RNA, 19 nt, Pseudomonas putida KT2440
ucuucgcucacaaagcccu

SEQ ID NO: 1572385 - RNA, 22 nt, Pseudomonas putida KT2440
ucuucggccaguuucagcgccu

SEQ ID NO: 1572386 - RNA, 22 nt, Pseudomonas putida KT2440
ucuucgauccgcgccaucagcu

SEQ ID NO: 1572387 - RNA, 19 nt, Pseudomonas putida KT2440
ucuuucggcagcacccgcu

SEQ ID NO: 1572388 - RNA, 20 nt, Pseudomonas putida KT2440
ugaaagaacuugguccagaa

SEQ ID NO: 1572389 - RNA, 14 nt, Pseudomonas putida KT2440
ugaaaguggccaag

SEQ ID NO: 1572390 - RNA, 22 nt, Pseudomonas putida KT2440
ugaacgaucagggaugcuggac

SEQ ID NO: 1572391 - RNA, 24 nt, Pseudomonas putida KT2440
ugaacgaaaacgaaacgccaggca

SEQ ID NO: 1572392 - RNA, 15 nt, Pseudomonas putida KT2440
ugaacgaggacugca

SEQ ID NO: 1572393 - RNA, 14 nt, Pseudomonas putida KT2440
ugaacccgcuccua

SEQ ID NO: 1572394 - RNA, 16 nt, Pseudomonas putida KT2440
ugaacccgcuccuaca

SEQ ID NO: 1572395 - RNA, 21 nt, Pseudomonas putida KT2440
ugaacccgcuccuacaacggc

SEQ ID NO: 1572396 - RNA, 19 nt, Pseudomonas putida KT2440
ugaacccgugcaucugcuc

SEQ ID NO: 1572397 - RNA, 13 nt, Pseudomonas putida KT2440
ugaacacugccaa

SEQ ID NO: 1572398 - RNA, 16 nt, Pseudomonas putida KT2440
ugaacagcgcccagau

SEQ ID NO: 1572399 - RNA, 18 nt, Pseudomonas putida KT2440
ugaaauuaaagguugaca

SEQ ID NO: 1572400 - RNA, 18 nt, Pseudomonas putida KT2440
ucucgcugucguccagcu

SEQ ID NO: 1572401 - RNA, 18 nt, Pseudomonas putida KT2440
ucucgcucaaauggguac

SEQ ID NO: 1572402 - RNA, 12 nt, Pseudomonas putida KT2440
ucucggccagca

SEQ ID NO: 1572403 - RNA, 12 nt, Pseudomonas putida KT2440
ucucgcagcagc

SEQ ID NO: 1572404 - RNA, 14 nt, Pseudomonas putida KT2440
ucucgcagcagcac

SEQ ID NO: 1572405 - RNA, 13 nt, Pseudomonas putida KT2440
ucucgccagccug

SEQ ID NO: 1572406 - RNA, 18 nt, Pseudomonas putida KT2440
ucucgccaaucaaccgcu

SEQ ID NO: 1572407 - RNA, 19 nt, Pseudomonas putida KT2440
ucucgaucuaugcccggcu

SEQ ID NO: 1572408 - RNA, 17 nt, Pseudomonas putida KT2440
ucucgaugcaauccgcc

SEQ ID NO: 1572409 - RNA, 20 nt, Pseudomonas putida KT2440
ucucgaugcaauccgccaca

SEQ ID NO: 1572410 - RNA, 18 nt, Pseudomonas putida KT2440
ucguggcgcuggcgggca

SEQ ID NO: 1572411 - RNA, 21 nt, Pseudomonas putida KT2440
ucucaaccaccucuaucaccu

SEQ ID NO: 1572412 - RNA, 22 nt, Pseudomonas putida KT2440
ucucaaccaccucuaucaccug

SEQ ID NO: 1572413 - RNA, 12 nt, Pseudomonas putida KT2440
ucucacagcggg

SEQ ID NO: 1572414 - RNA, 14 nt, Pseudomonas putida KT2440
ucucgucacuggcu

SEQ ID NO: 1572415 - RNA, 13 nt, Pseudomonas putida KT2440
ucucguugcgcca

SEQ ID NO: 1572416 - RNA, 17 nt, Pseudomonas putida KT2440
ucucuuugaucagcggu

SEQ ID NO: 1572417 - RNA, 14 nt, Pseudomonas putida KT2440
ucugcaccggcagc

SEQ ID NO: 1572418 - RNA, 14 nt, Pseudomonas putida KT2440
ucugcaccuugccc

SEQ ID NO: 1572419 - RNA, 15 nt, Pseudomonas putida KT2440
ucugcaccuugcccg

SEQ ID NO: 1572420 - RNA, 13 nt, Pseudomonas putida KT2440
ucugcagcagcau

SEQ ID NO: 1572421 - RNA, 13 nt, Pseudomonas putida KT2440
ucugcaaagcgcg

SEQ ID NO: 1572422 - RNA, 13 nt, Pseudomonas putida KT2440
ucugcaggauguc

SEQ ID NO: 1572423 - RNA, 22 nt, Pseudomonas putida KT2440
ucugcccgcgccuugcgcacgc

SEQ ID NO: 1572424 - RNA, 21 nt, Pseudomonas putida KT2440
ucugccguuugcuggccugca

SEQ ID NO: 1572425 - RNA, 17 nt, Pseudomonas putida KT2440
ucugccggaucuggcag

SEQ ID NO: 1572426 - RNA, 18 nt, Pseudomonas putida KT2440
ucgucgaccgcgaccaug

SEQ ID NO: 1572427 - RNA, 22 nt, Pseudomonas putida KT2440
ucgucgacaacgcacccgccuc

SEQ ID NO: 1572428 - RNA, 12 nt, Pseudomonas putida KT2440
ucgucgaugucu

SEQ ID NO: 1572429 - RNA, 21 nt, Pseudomonas putida KT2440
ucgucgaugucugccgcuucg

SEQ ID NO: 1572430 - RNA, 19 nt, Pseudomonas putida KT2440
ucgucgguuuccucgacgc

SEQ ID NO: 1572431 - RNA, 14 nt, Pseudomonas putida KT2440
ucgucuggcacuga

SEQ ID NO: 1572432 - RNA, 18 nt, Pseudomonas putida KT2440
ucgugaucauccccagca

SEQ ID NO: 1572433 - RNA, 22 nt, Pseudomonas putida KT2440
ucgugaucauccccagcauggc

SEQ ID NO: 1572434 - RNA, 14 nt, Pseudomonas putida KT2440
ucggucagcaccug

SEQ ID NO: 1572435 - RNA, 17 nt, Pseudomonas putida KT2440
ucggucagggcgaugau

SEQ ID NO: 1572436 - RNA, 23 nt, Pseudomonas putida KT2440
ucguaggagcggguuuacccgcg

SEQ ID NO: 1572437 - RNA, 19 nt, Pseudomonas putida KT2440
ucgguugaugcagcgcccg

SEQ ID NO: 1572438 - RNA, 23 nt, Pseudomonas putida KT2440
ucgguuggguuggcacguugcug

SEQ ID NO: 1572439 - RNA, 23 nt, Pseudomonas putida KT2440
ucguauuacccuucaucgccggg

SEQ ID NO: 1572440 - RNA, 23 nt, Pseudomonas putida KT2440
ucguaggucacggucuuggccgc

SEQ ID NO: 1572441 - RNA, 21 nt, Pseudomonas putida KT2440
ucgucaaggaagcuccaggcg

SEQ ID NO: 1572442 - RNA, 12 nt, Pseudomonas putida KT2440
ucguccuugccg

SEQ ID NO: 1572443 - RNA, 21 nt, Pseudomonas putida KT2440
ucguccaggcucagcucgucg

SEQ ID NO: 1572444 - RNA, 19 nt, Pseudomonas putida KT2440
ucguccagcucgucgagca

SEQ ID NO: 1572445 - RNA, 14 nt, Pseudomonas putida KT2440
ucguccagcucgcg

SEQ ID NO: 1572446 - RNA, 22 nt, Pseudomonas putida KT2440
ucguccagcucgcgcagggcau

SEQ ID NO: 1572447 - RNA, 23 nt, Pseudomonas putida KT2440
ucgguagggaucaccgccagcag

SEQ ID NO: 1572448 - RNA, 16 nt, Pseudomonas putida KT2440
ucgggucacgcuccuu

SEQ ID NO: 1572449 - RNA, 16 nt, Pseudomonas putida KT2440
ucgggucuucggcguu

SEQ ID NO: 1572450 - RNA, 21 nt, Pseudomonas putida KT2440
ucgggcuuggcacgcuggcug

SEQ ID NO: 1572451 - RNA, 19 nt, Pseudomonas putida KT2440
ucgggcuuggcuucggcgg

SEQ ID NO: 1572452 - RNA, 20 nt, Pseudomonas putida KT2440
ucgggcuuggcuucggcggc

SEQ ID NO: 1572453 - RNA, 21 nt, Pseudomonas putida KT2440
ucgggcaaggccagugccgca

SEQ ID NO: 1572454 - RNA, 13 nt, Pseudomonas putida KT2440
ucgggaucagcac

SEQ ID NO: 1572455 - RNA, 19 nt, Pseudomonas putida KT2440
ucggcgccuucgcccgacc

SEQ ID NO: 1572456 - RNA, 20 nt, Pseudomonas putida KT2440
ucggcgcgaaggucacgccc

SEQ ID NO: 1572457 - RNA, 16 nt, Pseudomonas putida KT2440
ucgggaacucgucgac

SEQ ID NO: 1572458 - RNA, 13 nt, Pseudomonas putida KT2440
uccgcccuugcca

SEQ ID NO: 1572459 - RNA, 18 nt, Pseudomonas putida KT2440
uccgcccuugccaccagu

SEQ ID NO: 1572460 - RNA, 22 nt, Pseudomonas putida KT2440
uccgcccuugccaccagugccg

SEQ ID NO: 1572461 - RNA, 19 nt, Pseudomonas putida KT2440
uccgcccgguaauagcggc

SEQ ID NO: 1572462 - RNA, 13 nt, Pseudomonas putida KT2440
uccgaagcgaaca

SEQ ID NO: 1572463 - RNA, 20 nt, Pseudomonas putida KT2440
ucccugcccgaucgccucgc

SEQ ID NO: 1572464 - RNA, 20 nt, Pseudomonas putida KT2440
ucccugugggagcgggcuug

SEQ ID NO: 1572465 - RNA, 21 nt, Pseudomonas putida KT2440
uccggguuaccgcacagcauc

SEQ ID NO: 1572466 - RNA, 17 nt, Pseudomonas putida KT2440
uccggcgcuuugcgcaa

SEQ ID NO: 1572467 - RNA, 19 nt, Pseudomonas putida KT2440
uccggccucuucgcgggca

SEQ ID NO: 1572468 - RNA, 14 nt, Pseudomonas putida KT2440
uccggaucguugcg

SEQ ID NO: 1572469 - RNA, 18 nt, Pseudomonas putida KT2440
uccggcacuccagcgagu

SEQ ID NO: 1572470 - RNA, 15 nt, Pseudomonas putida KT2440
uccggcccaucccgc

SEQ ID NO: 1572471 - RNA, 12 nt, Pseudomonas putida KT2440
uccggcccggca

SEQ ID NO: 1572472 - RNA, 16 nt, Pseudomonas putida KT2440
uccggccgacucuuca

SEQ ID NO: 1572473 - RNA, 22 nt, Pseudomonas putida KT2440
uccggccgacucuucaccagcu

SEQ ID NO: 1572474 - RNA, 19 nt, Pseudomonas putida KT2440
uccggcccuuucgcgggua

SEQ ID NO: 1572475 - RNA, 17 nt, Pseudomonas putida KT2440
uccggcaaucugcccac

SEQ ID NO: 1572476 - RNA, 13 nt, Pseudomonas putida KT2440
uccgcuggaaugg

SEQ ID NO: 1572477 - RNA, 16 nt, Pseudomonas putida KT2440
uccggauggaucgccu

SEQ ID NO: 1572478 - RNA, 13 nt, Pseudomonas putida KT2440
uccagggccaugg

SEQ ID NO: 1572479 - RNA, 23 nt, Pseudomonas putida KT2440
uccagggcaauggcgucacagac

SEQ ID NO: 1572480 - RNA, 16 nt, Pseudomonas putida KT2440
uccagggcgucggcau

SEQ ID NO: 1572481 - RNA, 15 nt, Pseudomonas putida KT2440
uccagguccugcucc

SEQ ID NO: 1572482 - RNA, 15 nt, Pseudomonas putida KT2440
uccagguccuugcug

SEQ ID NO: 1572483 - RNA, 19 nt, Pseudomonas putida KT2440
uccagguagcgcucgacau

SEQ ID NO: 1572484 - RNA, 14 nt, Pseudomonas putida KT2440
ucccagcaggcaca

SEQ ID NO: 1572485 - RNA, 15 nt, Pseudomonas putida KT2440
ucccagcaccgcgac

SEQ ID NO: 1572486 - RNA, 20 nt, Pseudomonas putida KT2440
uccccaaccggguuugaagc

SEQ ID NO: 1572487 - RNA, 14 nt, Pseudomonas putida KT2440
uccccaaucaccag

SEQ ID NO: 1572488 - RNA, 22 nt, Pseudomonas putida KT2440
uccccaaucaccaggauugccg

SEQ ID NO: 1572489 - RNA, 17 nt, Pseudomonas putida KT2440
uccccaaccaugcuggc

SEQ ID NO: 1572490 - RNA, 20 nt, Pseudomonas putida KT2440
uccccaaccaugcuggccaa

SEQ ID NO: 1572491 - RNA, 22 nt, Pseudomonas putida KT2440
uccccaaccaugcuggccaagg

SEQ ID NO: 1572492 - RNA, 18 nt, Pseudomonas putida KT2440
ucccauguagaccaccag

SEQ ID NO: 1572493 - RNA, 22 nt, Pseudomonas putida KT2440
ucccaugcugcagaaccgccag

SEQ ID NO: 1572494 - RNA, 16 nt, Pseudomonas putida KT2440
uccccaguucacgcag

SEQ ID NO: 1572495 - RNA, 11 nt, Pseudomonas putida KT2440
uccccagcauu

SEQ ID NO: 1572496 - RNA, 17 nt, Pseudomonas putida KT2440
ucccccccaaucgccgc

SEQ ID NO: 1572497 - RNA, 15 nt, Pseudomonas putida KT2440
ucccgcgcaugcugc

SEQ ID NO: 1572498 - RNA, 22 nt, Pseudomonas putida KT2440
ucccgcccugagccaaggccgc

SEQ ID NO: 1572499 - RNA, 23 nt, Pseudomonas putida KT2440
ucccgcccugagccaaggccgcc

SEQ ID NO: 1572500 - RNA, 21 nt, Pseudomonas putida KT2440
uccccggccuccucgcgggca

SEQ ID NO: 1572501 - RNA, 15 nt, Pseudomonas putida KT2440
uccccgacugacgcu

SEQ ID NO: 1572502 - RNA, 15 nt, Pseudomonas putida KT2440
uccccgccgugcagu

SEQ ID NO: 1572503 - RNA, 23 nt, Pseudomonas putida KT2440
uccccgcgcuuugugcacaagcu

SEQ ID NO: 1572504 - RNA, 11 nt, Pseudomonas putida KT2440
ucccgcuccuc

SEQ ID NO: 1572505 - RNA, 22 nt, Pseudomonas putida KT2440
ucccgcuacgagagaucgcagc

SEQ ID NO: 1572506 - RNA, 13 nt, Pseudomonas putida KT2440
ucccggcaccgcu

SEQ ID NO: 1572507 - RNA, 16 nt, Pseudomonas putida KT2440
ucccgcugccguagca

SEQ ID NO: 1572508 - RNA, 19 nt, Pseudomonas putida KT2440
ucccgugcgccuaucaggc

SEQ ID NO: 1572509 - RNA, 15 nt, Pseudomonas putida KT2440
ucccucugccugccc

SEQ ID NO: 1572510 - RNA, 23 nt, Pseudomonas putida KT2440
uccuuuguuuucaucugcccgcg

SEQ ID NO: 1572511 - RNA, 19 nt, Pseudomonas putida KT2440
uccuuuguaggagcgggcu

SEQ ID NO: 1572512 - RNA, 20 nt, Pseudomonas putida KT2440
uccuuguaagagcggccuug

SEQ ID NO: 1572513 - RNA, 22 nt, Pseudomonas putida KT2440
uccuuguagauauugaccagcg

SEQ ID NO: 1572514 - RNA, 23 nt, Pseudomonas putida KT2440
uccuuggucaggucgaucccgcc

SEQ ID NO: 1572515 - RNA, 23 nt, Pseudomonas putida KT2440
uccuugggggugaagcccugcug

SEQ ID NO: 1572516 - RNA, 19 nt, Pseudomonas putida KT2440
uccuugcugguguaggaca

SEQ ID NO: 1572517 - RNA, 19 nt, Pseudomonas putida KT2440
uccuugcgcacgcgcucug

SEQ ID NO: 1572518 - RNA, 21 nt, Pseudomonas putida KT2440
uccuugcagcgccgcauccag

SEQ ID NO: 1572519 - RNA, 21 nt, Pseudomonas putida KT2440
uccuugcagcucuugucgaca

SEQ ID NO: 1572520 - RNA, 18 nt, Pseudomonas putida KT2440
uccuggcccgcgcccuug

SEQ ID NO: 1572521 - RNA, 15 nt, Pseudomonas putida KT2440
uccuggaucagccgc

SEQ ID NO: 1572522 - RNA, 20 nt, Pseudomonas putida KT2440
uccugggaagcugcagcagc

SEQ ID NO: 1572523 - RNA, 15 nt, Pseudomonas putida KT2440
ucgaaguagcgcucu

SEQ ID NO: 1572524 - RNA, 20 nt, Pseudomonas putida KT2440
ucgaccaauggcugcggcag

SEQ ID NO: 1572525 - RNA, 11 nt, Pseudomonas putida KT2440
ucgaacagcug

SEQ ID NO: 1572526 - RNA, 19 nt, Pseudomonas putida KT2440
ucgaacagcauccagcgcc

SEQ ID NO: 1572527 - RNA, 18 nt, Pseudomonas putida KT2440
ucgaacagcgccggcagu

SEQ ID NO: 1572528 - RNA, 14 nt, Pseudomonas putida KT2440
ucgaacauggccac

SEQ ID NO: 1572529 - RNA, 16 nt, Pseudomonas putida KT2440
ucgaagcgacagcggc

SEQ ID NO: 1572530 - RNA, 17 nt, Pseudomonas putida KT2440
ucgaaccgcaacuggcc

SEQ ID NO: 1572531 - RNA, 23 nt, Pseudomonas putida KT2440
uccugaaccaugcgccgcugcuc

SEQ ID NO: 1572532 - RNA, 23 nt, Pseudomonas putida KT2440
uccugauguaggagcggguuuac

SEQ ID NO: 1572533 - RNA, 20 nt, Pseudomonas putida KT2440
uccugcaccgaagcaccacu

SEQ ID NO: 1572534 - RNA, 16 nt, Pseudomonas putida KT2440
uccugcagcaccagcu

SEQ ID NO: 1572535 - RNA, 20 nt, Pseudomonas putida KT2440
uccuggaacgugcgggcuug

SEQ ID NO: 1572536 - RNA, 14 nt, Pseudomonas putida KT2440
uccugcuugccggg

SEQ ID NO: 1572537 - RNA, 21 nt, Pseudomonas putida KT2440
uccugcuugccgggugcaucg

SEQ ID NO: 1572538 - RNA, 11 nt, Pseudomonas putida KT2440
uccugcucgac

SEQ ID NO: 1572539 - RNA, 14 nt, Pseudomonas putida KT2440
uccugcguacccag

SEQ ID NO: 1572540 - RNA, 19 nt, Pseudomonas putida KT2440
uccugcgugcugugcacug

SEQ ID NO: 1572541 - RNA, 11 nt, Pseudomonas putida KT2440
uccugcugcug

SEQ ID NO: 1572542 - RNA, 21 nt, Pseudomonas putida KT2440
uccugccuuccacccgccugc

SEQ ID NO: 1572543 - RNA, 21 nt, Pseudomonas putida KT2440
uccucuucaaggcccaguucg

SEQ ID NO: 1572544 - RNA, 13 nt, Pseudomonas putida KT2440
uccucguccagcu

SEQ ID NO: 1572545 - RNA, 12 nt, Pseudomonas putida KT2440
uccucggccuuu

SEQ ID NO: 1572546 - RNA, 23 nt, Pseudomonas putida KT2440
uccucggccuuuucgaacaaggc

SEQ ID NO: 1572547 - RNA, 15 nt, Pseudomonas putida KT2440
uccgguggcaucacc

SEQ ID NO: 1572548 - RNA, 20 nt, Pseudomonas putida KT2440
ucgaccagggccuuggccug

SEQ ID NO: 1572549 - RNA, 16 nt, Pseudomonas putida KT2440
ucgacgauacccagcg

SEQ ID NO: 1572550 - RNA, 18 nt, Pseudomonas putida KT2440
ucgacgaugaggcgaugc

SEQ ID NO: 1572551 - RNA, 22 nt, Pseudomonas putida KT2440
ucgacgaucgacuucaucaccu

SEQ ID NO: 1572552 - RNA, 14 nt, Pseudomonas putida KT2440
ucgacgaucgccgc

SEQ ID NO: 1572553 - RNA, 19 nt, Pseudomonas putida KT2440
ucgacgaucgccgccacga

SEQ ID NO: 1572554 - RNA, 14 nt, Pseudomonas putida KT2440
ucgacgcgcgcagc

SEQ ID NO: 1572555 - RNA, 14 nt, Pseudomonas putida KT2440
ucgacuugcguccg

SEQ ID NO: 1572556 - RNA, 16 nt, Pseudomonas putida KT2440
ucgacguugguagcgg

SEQ ID NO: 1572557 - RNA, 16 nt, Pseudomonas putida KT2440
ucgauccacucgucga

SEQ ID NO: 1572558 - RNA, 19 nt, Pseudomonas putida KT2440
ucgaucccuggggccaagu

SEQ ID NO: 1572559 - RNA, 22 nt, Pseudomonas putida KT2440
ucgauccggccguguucaggca

SEQ ID NO: 1572560 - RNA, 22 nt, Pseudomonas putida KT2440
ucgaucgcaacgugcgccgaga

SEQ ID NO: 1572561 - RNA, 16 nt, Pseudomonas putida KT2440
ucgagguugcgcucca

SEQ ID NO: 1572562 - RNA, 22 nt, Pseudomonas putida KT2440
ucgagguacuugagcagggugc

SEQ ID NO: 1572563 - RNA, 22 nt, Pseudomonas putida KT2440
ucgaggaaaagcagcuccagcg

SEQ ID NO: 1572564 - RNA, 14 nt, Pseudomonas putida KT2440
ucgagccaccggca

SEQ ID NO: 1572565 - RNA, 16 nt, Pseudomonas putida KT2440
ucgagccgaacagcag

SEQ ID NO: 1572566 - RNA, 14 nt, Pseudomonas putida KT2440
ucgagcauccaggu

SEQ ID NO: 1572567 - RNA, 16 nt, Pseudomonas putida KT2440
ucgagauguaguccac

SEQ ID NO: 1572568 - RNA, 15 nt, Pseudomonas putida KT2440
ucgagagccgggcaa

SEQ ID NO: 1572569 - RNA, 19 nt, Pseudomonas putida KT2440
ucgccuugggagauagccu

SEQ ID NO: 1572570 - RNA, 23 nt, Pseudomonas putida KT2440
ucgcgaaagggccgcaaggccgc

SEQ ID NO: 1572571 - RNA, 18 nt, Pseudomonas putida KT2440
ucgcgaagcggcccccug

SEQ ID NO: 1572572 - RNA, 22 nt, Pseudomonas putida KT2440
ucgcgaucacgcaggcccagca

SEQ ID NO: 1572573 - RNA, 13 nt, Pseudomonas putida KT2440
ucgcgaccgccau

SEQ ID NO: 1572574 - RNA, 22 nt, Pseudomonas putida KT2440
ucgcgacacaaggccgcuccca

SEQ ID NO: 1572575 - RNA, 12 nt, Pseudomonas putida KT2440
ucgccucggggu

SEQ ID NO: 1572576 - RNA, 16 nt, Pseudomonas putida KT2440
ucgccucgugcagcug

SEQ ID NO: 1572577 - RNA, 21 nt, Pseudomonas putida KT2440
ucgccugaacgcugcgcgggu

SEQ ID NO: 1572578 - RNA, 15 nt, Pseudomonas putida KT2440
ucgccugcuuggccg

SEQ ID NO: 1572579 - RNA, 18 nt, Pseudomonas putida KT2440
ucgccuugcgucggccga

SEQ ID NO: 1572580 - RNA, 15 nt, Pseudomonas putida KT2440
ucgccuguaccggcc

SEQ ID NO: 1572581 - RNA, 13 nt, Pseudomonas putida KT2440
ucgccuucacugc

SEQ ID NO: 1572582 - RNA, 18 nt, Pseudomonas putida KT2440
ucgccuucacugcgcggu

SEQ ID NO: 1572583 - RNA, 13 nt, Pseudomonas putida KT2440
ucgccuucagcgc

SEQ ID NO: 1572584 - RNA, 14 nt, Pseudomonas putida KT2440
ucgccuucagcgcc

SEQ ID NO: 1572585 - RNA, 15 nt, Pseudomonas putida KT2440
ucgcgcaacugccca

SEQ ID NO: 1572586 - RNA, 20 nt, Pseudomonas putida KT2440
ucgcgcaacugcccaggauc

SEQ ID NO: 1572587 - RNA, 16 nt, Pseudomonas putida KT2440
ucgcgauugaucagcg

SEQ ID NO: 1572588 - RNA, 20 nt, Pseudomonas putida KT2440
ucgcgauugaucagcgccuc

SEQ ID NO: 1572589 - RNA, 17 nt, Pseudomonas putida KT2440
ucgcgcagauggcagac

SEQ ID NO: 1572590 - RNA, 22 nt, Pseudomonas putida KT2440
ucgcgcagauggcagacaaguc

SEQ ID NO: 1572591 - RNA, 14 nt, Pseudomonas putida KT2440
ucgcgcauggccgc

SEQ ID NO: 1572592 - RNA, 17 nt, Pseudomonas putida KT2440
ucgcgcauuucguccag

SEQ ID NO: 1572593 - RNA, 17 nt, Pseudomonas putida KT2440
ucgcgccaguucgacgc

SEQ ID NO: 1572594 - RNA, 17 nt, Pseudomonas putida KT2440
ucgccucagcgccaaua

SEQ ID NO: 1572595 - RNA, 12 nt, Pseudomonas putida KT2440
ucgccucgacgc

SEQ ID NO: 1572596 - RNA, 19 nt, Pseudomonas putida KT2440
ucgcccacgaucucacgcg

SEQ ID NO: 1572597 - RNA, 17 nt, Pseudomonas putida KT2440
ucgcccacggcgauggu

SEQ ID NO: 1572598 - RNA, 18 nt, Pseudomonas putida KT2440
ucgccauucucgaucaac

SEQ ID NO: 1572599 - RNA, 20 nt, Pseudomonas putida KT2440
ucgccauguguacgccgcug

SEQ ID NO: 1572600 - RNA, 16 nt, Pseudomonas putida KT2440
ucgccauucaccagcu

SEQ ID NO: 1572601 - RNA, 14 nt, Pseudomonas putida KT2440
ucgccaggccccga

SEQ ID NO: 1572602 - RNA, 18 nt, Pseudomonas putida KT2440
ucgccaggaucggcacga

SEQ ID NO: 1572603 - RNA, 23 nt, Pseudomonas putida KT2440
ucgccacuggcgacuucggcgau

SEQ ID NO: 1572604 - RNA, 15 nt, Pseudomonas putida KT2440
ucgccagcagcgcuc

SEQ ID NO: 1572605 - RNA, 23 nt, Pseudomonas putida KT2440
ucgccagcaccaucaggcacagg

SEQ ID NO: 1572606 - RNA, 19 nt, Pseudomonas putida KT2440
ucgccccaggagggcuggu

SEQ ID NO: 1572607 - RNA, 15 nt, Pseudomonas putida KT2440
ucgcccagcagccaa

SEQ ID NO: 1572608 - RNA, 23 nt, Pseudomonas putida KT2440
ucgccccauaaaaaaacccgcug

SEQ ID NO: 1572609 - RNA, 16 nt, Pseudomonas putida KT2440
ucgccccgccagcgcc

SEQ ID NO: 1572610 - RNA, 19 nt, Pseudomonas putida KT2440
ucgcccguguucgcgggca

SEQ ID NO: 1572611 - RNA, 22 nt, Pseudomonas putida KT2440
ucgcccgcaacauaaggugcaa

SEQ ID NO: 1572612 - RNA, 14 nt, Pseudomonas putida KT2440
ucgcccgaccgcca

SEQ ID NO: 1572613 - RNA, 15 nt, Pseudomonas putida KT2440
ucgcccgaccgccag

SEQ ID NO: 1572614 - RNA, 13 nt, Pseudomonas putida KT2440
ucgccgacggcau

SEQ ID NO: 1572615 - RNA, 18 nt, Pseudomonas putida KT2440
ucgccgacggcauggccg

SEQ ID NO: 1572616 - RNA, 18 nt, Pseudomonas putida KT2440
ucgccgagaaauggcagu

SEQ ID NO: 1572617 - RNA, 22 nt, Pseudomonas putida KT2440
ucgcagguucgaauccugcuga

SEQ ID NO: 1572618 - RNA, 12 nt, Pseudomonas putida KT2440
ucgcagcccacg

SEQ ID NO: 1572619 - RNA, 13 nt, Pseudomonas putida KT2440
ucgcauuucuagc

SEQ ID NO: 1572620 - RNA, 15 nt, Pseudomonas putida KT2440
ucgcauucgccggca

SEQ ID NO: 1572621 - RNA, 14 nt, Pseudomonas putida KT2440
ucgccaaccgccag

SEQ ID NO: 1572622 - RNA, 16 nt, Pseudomonas putida KT2440
ucgccaaccgccagca

SEQ ID NO: 1572623 - RNA, 15 nt, Pseudomonas putida KT2440
ucgccaacuucgccg

SEQ ID NO: 1572624 - RNA, 19 nt, Pseudomonas putida KT2440
ucgccaaauucgaccagca

SEQ ID NO: 1572625 - RNA, 20 nt, Pseudomonas putida KT2440
ucgccaaauucgaccagcag

SEQ ID NO: 1572626 - RNA, 21 nt, Pseudomonas putida KT2440
ucgcaugcagguucgaccaga

SEQ ID NO: 1572627 - RNA, 15 nt, Pseudomonas putida KT2440
ucgcauacagcgcac

SEQ ID NO: 1572628 - RNA, 13 nt, Pseudomonas putida KT2440
ucgccaaggucca

SEQ ID NO: 1572629 - RNA, 15 nt, Pseudomonas putida KT2440
ucgccaaggccucga

SEQ ID NO: 1572630 - RNA, 14 nt, Pseudomonas putida KT2440
ucgccaaucaaccg

SEQ ID NO: 1572631 - RNA, 18 nt, Pseudomonas putida KT2440
ucgccaaucucguugcgc

SEQ ID NO: 1572632 - RNA, 24 nt, Pseudomonas putida KT2440
ucgccaaucucguugcgccaggca

SEQ ID NO: 1572633 - RNA, 13 nt, Pseudomonas putida KT2440
ucgcugcgauaga

SEQ ID NO: 1572634 - RNA, 20 nt, Pseudomonas putida KT2440
ucgcugccggucguagcguc

SEQ ID NO: 1572635 - RNA, 14 nt, Pseudomonas putida KT2440
ucgcugccgccuug

SEQ ID NO: 1572636 - RNA, 14 nt, Pseudomonas putida KT2440
ucgcuggagcggga

SEQ ID NO: 1572637 - RNA, 15 nt, Pseudomonas putida KT2440
ucgcuuugcgggcac

SEQ ID NO: 1572638 - RNA, 17 nt, Pseudomonas putida KT2440
ucgcuuucaccuugcug

SEQ ID NO: 1572639 - RNA, 14 nt, Pseudomonas putida KT2440
ucgcguuguucagc

SEQ ID NO: 1572640 - RNA, 16 nt, Pseudomonas putida KT2440
ucgcguuguucagcag

SEQ ID NO: 1572641 - RNA, 17 nt, Pseudomonas putida KT2440
ucgcguuguucagcagc

SEQ ID NO: 1572642 - RNA, 15 nt, Pseudomonas putida KT2440
ucgcucuggcacuca

SEQ ID NO: 1572643 - RNA, 16 nt, Pseudomonas putida KT2440
ucgcuaucguccuggg

SEQ ID NO: 1572644 - RNA, 15 nt, Pseudomonas putida KT2440
ucgcucaggccaugc

SEQ ID NO: 1572645 - RNA, 14 nt, Pseudomonas putida KT2440
ucgcuccaggcggc

SEQ ID NO: 1572646 - RNA, 18 nt, Pseudomonas putida KT2440
ucgcgguagagcugcagg

SEQ ID NO: 1572647 - RNA, 22 nt, Pseudomonas putida KT2440
ucgcggucuuguaucccaggcg

SEQ ID NO: 1572648 - RNA, 20 nt, Pseudomonas putida KT2440
ucgcgggugaaccgcgccua

SEQ ID NO: 1572649 - RNA, 21 nt, Pseudomonas putida KT2440
ucgcggguagacccgcuccua

SEQ ID NO: 1572650 - RNA, 21 nt, Pseudomonas putida KT2440
ucgcggguaaacccgccccua

SEQ ID NO: 1572651 - RNA, 17 nt, Pseudomonas putida KT2440
ucgcggguaaacccgcg

SEQ ID NO: 1572652 - RNA, 18 nt, Pseudomonas putida KT2440
ucgcggguaaacccgcgc

SEQ ID NO: 1572653 - RNA, 21 nt, Pseudomonas putida KT2440
ucgcggguaaacccgcgccua

SEQ ID NO: 1572654 - RNA, 17 nt, Pseudomonas putida KT2440
ucgcggguaaacccgcu

SEQ ID NO: 1572655 - RNA, 21 nt, Pseudomonas putida KT2440
ucgcggguaaacccgcuccca

SEQ ID NO: 1572656 - RNA, 21 nt, Pseudomonas putida KT2440
ucgcggguaaacccgcuccua

SEQ ID NO: 1572657 - RNA, 16 nt, Pseudomonas putida KT2440
aauaccagacgcaggc

SEQ ID NO: 1572658 - RNA, 18 nt, Pseudomonas putida KT2440
aauaccgauugccucagg

SEQ ID NO: 1572659 - RNA, 16 nt, Pseudomonas putida KT2440
aauacgccgccaccgg

SEQ ID NO: 1572660 - RNA, 17 nt, Pseudomonas putida KT2440
aauacgcuggaucacca

SEQ ID NO: 1572661 - RNA, 18 nt, Pseudomonas putida KT2440
ucggcgaaaagccgggua

SEQ ID NO: 1572662 - RNA, 15 nt, Pseudomonas putida KT2440
ucggccuugccgcug

SEQ ID NO: 1572663 - RNA, 18 nt, Pseudomonas putida KT2440
ucggccuugccgcuguug

SEQ ID NO: 1572664 - RNA, 16 nt, Pseudomonas putida KT2440
ucggccgcauccaugc

SEQ ID NO: 1572665 - RNA, 24 nt, Pseudomonas putida KT2440
ucggccgcccucgcgcguugcagc

SEQ ID NO: 1572666 - RNA, 24 nt, Pseudomonas putida KT2440
ucggcgaucuggucgaagcucagg

SEQ ID NO: 1572667 - RNA, 15 nt, Pseudomonas putida KT2440
ucggcgaugccgcgc

SEQ ID NO: 1572668 - RNA, 13 nt, Pseudomonas putida KT2440
ucggcgaugguca

SEQ ID NO: 1572669 - RNA, 16 nt, Pseudomonas putida KT2440
ucggcgacgacuuauc

SEQ ID NO: 1572670 - RNA, 15 nt, Pseudomonas putida KT2440
ucggcaaccgagauc

SEQ ID NO: 1572671 - RNA, 14 nt, Pseudomonas putida KT2440
ucggcaaucacccg

SEQ ID NO: 1572672 - RNA, 13 nt, Pseudomonas putida KT2440
ucggcaaucaccg

SEQ ID NO: 1572673 - RNA, 15 nt, Pseudomonas putida KT2440
ucggcaaucugcagc

SEQ ID NO: 1572674 - RNA, 18 nt, Pseudomonas putida KT2440
ucggcaaucugcagcagc

SEQ ID NO: 1572675 - RNA, 14 nt, Pseudomonas putida KT2440
ucggcaaucugcuu

SEQ ID NO: 1572676 - RNA, 16 nt, Pseudomonas putida KT2440
ucggcaaggcgaccug

SEQ ID NO: 1572677 - RNA, 14 nt, Pseudomonas putida KT2440
ucggcaccaccgau

SEQ ID NO: 1572678 - RNA, 15 nt, Pseudomonas putida KT2440
ucggcaaugcgcgcg

SEQ ID NO: 1572679 - RNA, 19 nt, Pseudomonas putida KT2440
ucggcaugcagcggccagu

SEQ ID NO: 1572680 - RNA, 16 nt, Pseudomonas putida KT2440
ucggcacgcgccagca

SEQ ID NO: 1572681 - RNA, 16 nt, Pseudomonas putida KT2440
ucggcacgcgcccggu

SEQ ID NO: 1572682 - RNA, 17 nt, Pseudomonas putida KT2440
ucggcagagcgccagca

SEQ ID NO: 1572683 - RNA, 22 nt, Pseudomonas putida KT2440
ucggcaccuuucuccaggugga

SEQ ID NO: 1572684 - RNA, 15 nt, Pseudomonas putida KT2440
ucggcacgaagccca

SEQ ID NO: 1572685 - RNA, 17 nt, Pseudomonas putida KT2440
ucggcaccggcgacgcg

SEQ ID NO: 1572686 - RNA, 17 nt, Pseudomonas putida KT2440
ucggccagugcgcccga

SEQ ID NO: 1572687 - RNA, 16 nt, Pseudomonas putida KT2440
ucggccagcucggcag

SEQ ID NO: 1572688 - RNA, 18 nt, Pseudomonas putida KT2440
ucggccagcucggcagug

SEQ ID NO: 1572689 - RNA, 13 nt, Pseudomonas putida KT2440
ucggccacccgcg

SEQ ID NO: 1572690 - RNA, 15 nt, Pseudomonas putida KT2440
ucggccaccagcccg

SEQ ID NO: 1572691 - RNA, 16 nt, Pseudomonas putida KT2440
ucggccaccacccgcu

SEQ ID NO: 1572692 - RNA, 15 nt, Pseudomonas putida KT2440
ucggccaaucgcggc

SEQ ID NO: 1572693 - RNA, 21 nt, Pseudomonas putida KT2440
ucggcauguucaucaccggcc

SEQ ID NO: 1572694 - RNA, 23 nt, Pseudomonas putida KT2440
ucggcauguucaucaccggccag

SEQ ID NO: 1572695 - RNA, 22 nt, Pseudomonas putida KT2440
accccauccacaucgccaggug

SEQ ID NO: 1572696 - RNA, 13 nt, Pseudomonas putida KT2440
accccagccgcuc

SEQ ID NO: 1572697 - RNA, 16 nt, Pseudomonas putida KT2440
accccaccggccugga

SEQ ID NO: 1572698 - RNA, 17 nt, Pseudomonas putida KT2440
accccagaacggcacgc

SEQ ID NO: 1572699 - RNA, 21 nt, Pseudomonas putida KT2440
accccagcgcguacagcgaca

SEQ ID NO: 1572700 - RNA, 19 nt, Pseudomonas putida KT2440
acccccguaggagcggguu

SEQ ID NO: 1572701 - RNA, 16 nt, Pseudomonas putida KT2440
acccccuucaaugccg

SEQ ID NO: 1572702 - RNA, 14 nt, Pseudomonas putida KT2440
acccccagcgacca

SEQ ID NO: 1572703 - RNA, 14 nt, Pseudomonas putida KT2440
accccgccccugcu

SEQ ID NO: 1572704 - RNA, 18 nt, Pseudomonas putida KT2440
accccgccccugcuugac

SEQ ID NO: 1572705 - RNA, 14 nt, Pseudomonas putida KT2440
accccggcacaggg

SEQ ID NO: 1572706 - RNA, 17 nt, Pseudomonas putida KT2440
accccgucgccucaccu

SEQ ID NO: 1572707 - RNA, 21 nt, Pseudomonas putida KT2440
accccguggccccgggccaug

SEQ ID NO: 1572708 - RNA, 15 nt, Pseudomonas putida KT2440
accagcuugugcagc

SEQ ID NO: 1572709 - RNA, 22 nt, Pseudomonas putida KT2440
accaggacuucccggcaccgcu

SEQ ID NO: 1572710 - RNA, 20 nt, Pseudomonas putida KT2440
acccacgcgcuuggagaagc

SEQ ID NO: 1572711 - RNA, 22 nt, Pseudomonas putida KT2440
acccacggcaauucgccggcag

SEQ ID NO: 1572712 - RNA, 12 nt, Pseudomonas putida KT2440
accaggcaccga

SEQ ID NO: 1572713 - RNA, 16 nt, Pseudomonas putida KT2440
accaggcaguaggugc

SEQ ID NO: 1572714 - RNA, 20 nt, Pseudomonas putida KT2440
accaggcauuguugcaacgc

SEQ ID NO: 1572715 - RNA, 22 nt, Pseudomonas putida KT2440
acccagcccccccaaggcgaac

SEQ ID NO: 1572716 - RNA, 12 nt, Pseudomonas putida KT2440
acccagccagcc

SEQ ID NO: 1572717 - RNA, 22 nt, Pseudomonas putida KT2440
acccagccagccacggaucacc

SEQ ID NO: 1572718 - RNA, 18 nt, Pseudomonas putida KT2440
acccagccagcgacagca

SEQ ID NO: 1572719 - RNA, 18 nt, Pseudomonas putida KT2440
acccagcacuucguccag

SEQ ID NO: 1572720 - RNA, 15 nt, Pseudomonas putida KT2440
acccagcacccgcag

SEQ ID NO: 1572721 - RNA, 13 nt, Pseudomonas putida KT2440
acccaggcaacga

SEQ ID NO: 1572722 - RNA, 17 nt, Pseudomonas putida KT2440
acccaggcgcgccugca

SEQ ID NO: 1572723 - RNA, 18 nt, Pseudomonas putida KT2440
acccagguacgaagccau

SEQ ID NO: 1572724 - RNA, 22 nt, Pseudomonas putida KT2440
acccaggcccugacgccagcgc

SEQ ID NO: 1572725 - RNA, 14 nt, Pseudomonas putida KT2440
acccagcgcgaagc

SEQ ID NO: 1572726 - RNA, 16 nt, Pseudomonas putida KT2440
acccagcgcggcaaau

SEQ ID NO: 1572727 - RNA, 13 nt, Pseudomonas putida KT2440
acccagcgcuggu

SEQ ID NO: 1572728 - RNA, 22 nt, Pseudomonas putida KT2440
acccagcgcugguuuaucagca

SEQ ID NO: 1572729 - RNA, 20 nt, Pseudomonas putida KT2440
acccauguugucacccagca

SEQ ID NO: 1572730 - RNA, 20 nt, Pseudomonas putida KT2440
acccaucugcucgccaucug

SEQ ID NO: 1572731 - RNA, 15 nt, Pseudomonas putida KT2440
acccggccaggccgu

SEQ ID NO: 1572732 - RNA, 14 nt, Pseudomonas putida KT2440
acccggccaacgac

SEQ ID NO: 1572733 - RNA, 12 nt, Pseudomonas putida KT2440
acccggccagca

SEQ ID NO: 1572734 - RNA, 13 nt, Pseudomonas putida KT2440
acccggccagcag

SEQ ID NO: 1572735 - RNA, 15 nt, Pseudomonas putida KT2440
acccggccagcaggu

SEQ ID NO: 1572736 - RNA, 17 nt, Pseudomonas putida KT2440
acccggccagcagguca

SEQ ID NO: 1572737 - RNA, 23 nt, Pseudomonas putida KT2440
acccggcaauggucacgcugauc

SEQ ID NO: 1572738 - RNA, 13 nt, Pseudomonas putida KT2440
acccggaccagcg

SEQ ID NO: 1572739 - RNA, 16 nt, Pseudomonas putida KT2440
acccggaccagcgccg

SEQ ID NO: 1572740 - RNA, 18 nt, Pseudomonas putida KT2440
acccgcuugccacggcgu

SEQ ID NO: 1572741 - RNA, 16 nt, Pseudomonas putida KT2440
acccgcuuggccacca

SEQ ID NO: 1572742 - RNA, 13 nt, Pseudomonas putida KT2440
acccgcgucagcu

SEQ ID NO: 1572743 - RNA, 19 nt, Pseudomonas putida KT2440
acccgcgucagcucaagcg

SEQ ID NO: 1572744 - RNA, 16 nt, Pseudomonas putida KT2440
acccgcuaacgcguug

SEQ ID NO: 1572745 - RNA, 17 nt, Pseudomonas putida KT2440
acccgcucaaagcgcaa

SEQ ID NO: 1572746 - RNA, 20 nt, Pseudomonas putida KT2440
acccgccuggugccagcggc

SEQ ID NO: 1572747 - RNA, 22 nt, Pseudomonas putida KT2440
acccgccuggugccagcggcca

SEQ ID NO: 1572748 - RNA, 15 nt, Pseudomonas putida KT2440
acccgcgaagaagcc

SEQ ID NO: 1572749 - RNA, 23 nt, Pseudomonas putida KT2440
acccgcgaagaagccggcaucgc

SEQ ID NO: 1572750 - RNA, 14 nt, Pseudomonas putida KT2440
acccgcgaagaggc

SEQ ID NO: 1572751 - RNA, 18 nt, Pseudomonas putida KT2440
acccgcgaagaggccagu

SEQ ID NO: 1572752 - RNA, 21 nt, Pseudomonas putida KT2440
acccgcgaagaggccaguacc

SEQ ID NO: 1572753 - RNA, 18 nt, Pseudomonas putida KT2440
acccgcgaagaggcccga

SEQ ID NO: 1572754 - RNA, 22 nt, Pseudomonas putida KT2440
acccgcgaagaggcccucaagg

SEQ ID NO: 1572755 - RNA, 13 nt, Pseudomonas putida KT2440
acccgccgguugc

SEQ ID NO: 1572756 - RNA, 22 nt, Pseudomonas putida KT2440
acccgccgguugcgcagccggc

SEQ ID NO: 1572757 - RNA, 14 nt, Pseudomonas putida KT2440
acccgccugacgcc

SEQ ID NO: 1572758 - RNA, 15 nt, Pseudomonas putida KT2440
acccgcgaaagggcc

SEQ ID NO: 1572759 - RNA, 17 nt, Pseudomonas putida KT2440
acccgcgaaagggccag

SEQ ID NO: 1572760 - RNA, 19 nt, Pseudomonas putida KT2440
acccgcgaaagggccagca

SEQ ID NO: 1572761 - RNA, 22 nt, Pseudomonas putida KT2440
acccgcgaaagggccgcaacgc

SEQ ID NO: 1572762 - RNA, 13 nt, Pseudomonas putida KT2440
acccgcgaacagg

SEQ ID NO: 1572763 - RNA, 13 nt, Pseudomonas putida KT2440
acccgcccaucgc

SEQ ID NO: 1572764 - RNA, 20 nt, Pseudomonas putida KT2440
accccuucggcaaucaccgc

SEQ ID NO: 1572765 - RNA, 19 nt, Pseudomonas putida KT2440
accccuucguagacgaagc

SEQ ID NO: 1572766 - RNA, 18 nt, Pseudomonas putida KT2440
accccucggcucacgccc

SEQ ID NO: 1572767 - RNA, 18 nt, Pseudomonas putida KT2440
accccuuccagcuucugc

SEQ ID NO: 1572768 - RNA, 19 nt, Pseudomonas putida KT2440
accccuguaggagcggguu

SEQ ID NO: 1572769 - RNA, 16 nt, Pseudomonas putida KT2440
accccuuuacuggcca

SEQ ID NO: 1572770 - RNA, 19 nt, Pseudomonas putida KT2440
acccggcgcaagccggguu

SEQ ID NO: 1572771 - RNA, 18 nt, Pseudomonas putida KT2440
acccggcguacucucguc

SEQ ID NO: 1572772 - RNA, 19 nt, Pseudomonas putida KT2440
acccggccgaggccggguu

SEQ ID NO: 1572773 - RNA, 21 nt, Pseudomonas putida KT2440
acccggccuuggccgcuggcc

SEQ ID NO: 1572774 - RNA, 16 nt, Pseudomonas putida KT2440
acccgugcugcucgcc

SEQ ID NO: 1572775 - RNA, 16 nt, Pseudomonas putida KT2440
acccucggcaucgaac

SEQ ID NO: 1572776 - RNA, 20 nt, Pseudomonas putida KT2440
acccucgccccgcgcaagcg

SEQ ID NO: 1572777 - RNA, 18 nt, Pseudomonas putida KT2440
acccgugccugccugcaa

SEQ ID NO: 1572778 - RNA, 20 nt, Pseudomonas putida KT2440
acccgucgcucuucaaccgc

SEQ ID NO: 1572779 - RNA, 16 nt, Pseudomonas putida KT2440
acccgucgcugccaaa

SEQ ID NO: 1572780 - RNA, 16 nt, Pseudomonas putida KT2440
accgaccaccugcucg

SEQ ID NO: 1572781 - RNA, 19 nt, Pseudomonas putida KT2440
accgaccacgguaccggca

SEQ ID NO: 1572782 - RNA, 13 nt, Pseudomonas putida KT2440
accgacagcaacg

SEQ ID NO: 1572783 - RNA, 15 nt, Pseudomonas putida KT2440
accgacauccacguc

SEQ ID NO: 1572784 - RNA, 19 nt, Pseudomonas putida KT2440
accgaacagcaccgccaug

SEQ ID NO: 1572785 - RNA, 16 nt, Pseudomonas putida KT2440
acccuugggcucagcc

SEQ ID NO: 1572786 - RNA, 18 nt, Pseudomonas putida KT2440
acccuuugccauccaccg

SEQ ID NO: 1572787 - RNA, 23 nt, Pseudomonas putida KT2440
acccuuuuaucugguugccgcca

SEQ ID NO: 1572788 - RNA, 15 nt, Pseudomonas putida KT2440
accgaaaccacugcu

SEQ ID NO: 1572789 - RNA, 17 nt, Pseudomonas putida KT2440
acccugaucgaugagcg

SEQ ID NO: 1572790 - RNA, 18 nt, Pseudomonas putida KT2440
acccugcucgccaucgcc

SEQ ID NO: 1572791 - RNA, 23 nt, Pseudomonas putida KT2440
accgccuuguaauacggcgccga

SEQ ID NO: 1572792 - RNA, 13 nt, Pseudomonas putida KT2440
accgcgaagcagg

SEQ ID NO: 1572793 - RNA, 13 nt, Pseudomonas putida KT2440
accgccugcgcac

SEQ ID NO: 1572794 - RNA, 12 nt, Pseudomonas putida KT2440
accgccucgauc

SEQ ID NO: 1572795 - RNA, 18 nt, Pseudomonas putida KT2440
accgcgcaacgcgccaug

SEQ ID NO: 1572796 - RNA, 16 nt, Pseudomonas putida KT2440
accgcgcaccucgacc

SEQ ID NO: 1572797 - RNA, 18 nt, Pseudomonas putida KT2440
accgcgccaucaaggccg

SEQ ID NO: 1572798 - RNA, 21 nt, Pseudomonas putida KT2440
accgcgccaucaaggccgaca

SEQ ID NO: 1572799 - RNA, 13 nt, Pseudomonas putida KT2440
accgcgccagcuc

SEQ ID NO: 1572800 - RNA, 19 nt, Pseudomonas putida KT2440
accgcgccuccagcuggcc

SEQ ID NO: 1572801 - RNA, 22 nt, Pseudomonas putida KT2440
accgcgcccaaggucagccaga

SEQ ID NO: 1572802 - RNA, 17 nt, Pseudomonas putida KT2440
accgcauugcaggccag

SEQ ID NO: 1572803 - RNA, 21 nt, Pseudomonas putida KT2440
accgcauugcaggccagcguc

SEQ ID NO: 1572804 - RNA, 15 nt, Pseudomonas putida KT2440
accgcagcccagcgc

SEQ ID NO: 1572805 - RNA, 14 nt, Pseudomonas putida KT2440
accgcaggugcagg

SEQ ID NO: 1572806 - RNA, 22 nt, Pseudomonas putida KT2440
accgcacugugcuggggccagc

SEQ ID NO: 1572807 - RNA, 21 nt, Pseudomonas putida KT2440
accgcacuccccaucagcagc

SEQ ID NO: 1572808 - RNA, 16 nt, Pseudomonas putida KT2440
accgcacucugcugcu

SEQ ID NO: 1572809 - RNA, 11 nt, Pseudomonas putida KT2440
accgacccugc

SEQ ID NO: 1572810 - RNA, 14 nt, Pseudomonas putida KT2440
accgacccugcugc

SEQ ID NO: 1572811 - RNA, 15 nt, Pseudomonas putida KT2440
accgaccaucggcag

SEQ ID NO: 1572812 - RNA, 13 nt, Pseudomonas putida KT2440
accgaccgugcau

SEQ ID NO: 1572813 - RNA, 14 nt, Pseudomonas putida KT2440
accgccaacccgau

SEQ ID NO: 1572814 - RNA, 17 nt, Pseudomonas putida KT2440
accgccaacgaaucagc

SEQ ID NO: 1572815 - RNA, 15 nt, Pseudomonas putida KT2440
accgccagcggcaag

SEQ ID NO: 1572816 - RNA, 17 nt, Pseudomonas putida KT2440
accgccgccaccaucga

SEQ ID NO: 1572817 - RNA, 21 nt, Pseudomonas putida KT2440
accgccgaucgaagcagcagc

SEQ ID NO: 1572818 - RNA, 22 nt, Pseudomonas putida KT2440
accggguaggccccagggggca

SEQ ID NO: 1572819 - RNA, 20 nt, Pseudomonas putida KT2440
accgggcggccaccggccac

SEQ ID NO: 1572820 - RNA, 13 nt, Pseudomonas putida KT2440
accgggcuggcau

SEQ ID NO: 1572821 - RNA, 22 nt, Pseudomonas putida KT2440
accggcuccaccugcuccagca

SEQ ID NO: 1572822 - RNA, 20 nt, Pseudomonas putida KT2440
accggcucaacagcaggugc

SEQ ID NO: 1572823 - RNA, 22 nt, Pseudomonas putida KT2440
accggcggcgaacaucugcucg

SEQ ID NO: 1572824 - RNA, 22 nt, Pseudomonas putida KT2440
accggccuugccgcuggcgaug

SEQ ID NO: 1572825 - RNA, 22 nt, Pseudomonas putida KT2440
accggccuugccguagaugccg

SEQ ID NO: 1572826 - RNA, 18 nt, Pseudomonas putida KT2440
accggccuugcgcaaggc

SEQ ID NO: 1572827 - RNA, 21 nt, Pseudomonas putida KT2440
accggcgacgcggugcucgau

SEQ ID NO: 1572828 - RNA, 16 nt, Pseudomonas putida KT2440
accgcgugcuucaucg

SEQ ID NO: 1572829 - RNA, 21 nt, Pseudomonas putida KT2440
accgcgcugguaagccucgag

SEQ ID NO: 1572830 - RNA, 13 nt, Pseudomonas putida KT2440
accgcgcgccagu

SEQ ID NO: 1572831 - RNA, 17 nt, Pseudomonas putida KT2440
accgcgcgccaguucgc

SEQ ID NO: 1572832 - RNA, 20 nt, Pseudomonas putida KT2440
accgcguuggacaccagguu

SEQ ID NO: 1572833 - RNA, 20 nt, Pseudomonas putida KT2440
accgcuuggaguugcucgag

SEQ ID NO: 1572834 - RNA, 13 nt, Pseudomonas putida KT2440
accgcugaccaca

SEQ ID NO: 1572835 - RNA, 20 nt, Pseudomonas putida KT2440
accgcugccagcugcgcugc

SEQ ID NO: 1572836 - RNA, 22 nt, Pseudomonas putida KT2440
accgcugccauagcgcugcacc

SEQ ID NO: 1572837 - RNA, 23 nt, Pseudomonas putida KT2440
accggcaacccggcagucagggu

SEQ ID NO: 1572838 - RNA, 20 nt, Pseudomonas putida KT2440
accggcaacccuucggccag

SEQ ID NO: 1572839 - RNA, 22 nt, Pseudomonas putida KT2440
accggcaacccuucggccagca

SEQ ID NO: 1572840 - RNA, 15 nt, Pseudomonas putida KT2440
accacgguaccggca

SEQ ID NO: 1572841 - RNA, 15 nt, Pseudomonas putida KT2440
accaccugggccagu

SEQ ID NO: 1572842 - RNA, 22 nt, Pseudomonas putida KT2440
accaccugccaacgcaccgacc

SEQ ID NO: 1572843 - RNA, 17 nt, Pseudomonas putida KT2440
accacccccagcgccuc

SEQ ID NO: 1572844 - RNA, 14 nt, Pseudomonas putida KT2440
accaccaucgccag

SEQ ID NO: 1572845 - RNA, 18 nt, Pseudomonas putida KT2440
accaccaucucgcccaug

SEQ ID NO: 1572846 - RNA, 14 nt, Pseudomonas putida KT2440
accacccaccagca

SEQ ID NO: 1572847 - RNA, 21 nt, Pseudomonas putida KT2440
accacccugaugcagcagugc

SEQ ID NO: 1572848 - RNA, 13 nt, Pseudomonas putida KT2440
accaccaccgacc

SEQ ID NO: 1572849 - RNA, 21 nt, Pseudomonas putida KT2440
accacauccccgccgccagca

SEQ ID NO: 1572850 - RNA, 20 nt, Pseudomonas putida KT2440
accagcggcucgcucaggcg

SEQ ID NO: 1572851 - RNA, 13 nt, Pseudomonas putida KT2440
accagcggcgcga

SEQ ID NO: 1572852 - RNA, 16 nt, Pseudomonas putida KT2440
accacuuuuggcguga

SEQ ID NO: 1572853 - RNA, 17 nt, Pseudomonas putida KT2440
accagcagcaguggcaa

SEQ ID NO: 1572854 - RNA, 22 nt, Pseudomonas putida KT2440
accagcagcaguggcaagccga

SEQ ID NO: 1572855 - RNA, 16 nt, Pseudomonas putida KT2440
accagcagcgccugca

SEQ ID NO: 1572856 - RNA, 14 nt, Pseudomonas putida KT2440
accagcagggccau

SEQ ID NO: 1572857 - RNA, 16 nt, Pseudomonas putida KT2440
accacuucaagcacgc

SEQ ID NO: 1572858 - RNA, 19 nt, Pseudomonas putida KT2440
accacuucacugacaaagc

SEQ ID NO: 1572859 - RNA, 22 nt, Pseudomonas putida KT2440
accacuugcucggugcugcugc

SEQ ID NO: 1572860 - RNA, 19 nt, Pseudomonas putida KT2440
accacugcuucugagccag

SEQ ID NO: 1572861 - RNA, 12 nt, Pseudomonas putida KT2440
accacguugcgc

SEQ ID NO: 1572862 - RNA, 17 nt, Pseudomonas putida KT2440
accacuccagggucugc

SEQ ID NO: 1572863 - RNA, 16 nt, Pseudomonas putida KT2440
acaguuucuucaggug

SEQ ID NO: 1572864 - RNA, 17 nt, Pseudomonas putida KT2440
acauaacugccggcaua

SEQ ID NO: 1572865 - RNA, 15 nt, Pseudomonas putida KT2440
acauccucugcccgc

SEQ ID NO: 1572866 - RNA, 14 nt, Pseudomonas putida KT2440
acauaucgcgaaac

SEQ ID NO: 1572867 - RNA, 18 nt, Pseudomonas putida KT2440
acauagcaggaucuagcc

SEQ ID NO: 1572868 - RNA, 15 nt, Pseudomonas putida KT2440
acaugccacggccuu

SEQ ID NO: 1572869 - RNA, 14 nt, Pseudomonas putida KT2440
acauugaagaagcc

SEQ ID NO: 1572870 - RNA, 19 nt, Pseudomonas putida KT2440
acauuuccagcaugauguc

SEQ ID NO: 1572871 - RNA, 20 nt, Pseudomonas putida KT2440
accaacaguugaccaaggaa

SEQ ID NO: 1572872 - RNA, 16 nt, Pseudomonas putida KT2440
accaaccccugcggcg

SEQ ID NO: 1572873 - RNA, 17 nt, Pseudomonas putida KT2440
accaaagaaaaucgacc

SEQ ID NO: 1572874 - RNA, 22 nt, Pseudomonas putida KT2440
accaaucaacgguggccagcag

SEQ ID NO: 1572875 - RNA, 21 nt, Pseudomonas putida KT2440
accaacggcuucacauccacc

SEQ ID NO: 1572876 - RNA, 18 nt, Pseudomonas putida KT2440
accaacuggucggccuug

SEQ ID NO: 1572877 - RNA, 15 nt, Pseudomonas putida KT2440
acaauguaccgggcu

SEQ ID NO: 1572878 - RNA, 14 nt, Pseudomonas putida KT2440
acacaaggccgcuc

SEQ ID NO: 1572879 - RNA, 22 nt, Pseudomonas putida KT2440
acaacgacuggucauacuccag

SEQ ID NO: 1572880 - RNA, 15 nt, Pseudomonas putida KT2440
acaacggccgcaaug

SEQ ID NO: 1572881 - RNA, 22 nt, Pseudomonas putida KT2440
acaacggcgcuguccagcgcau

SEQ ID NO: 1572882 - RNA, 16 nt, Pseudomonas putida KT2440
acaaggucuccgggaa

SEQ ID NO: 1572883 - RNA, 15 nt, Pseudomonas putida KT2440
acaagguugcgcaag

SEQ ID NO: 1572884 - RNA, 22 nt, Pseudomonas putida KT2440
acaagccacgcaccucggccau

SEQ ID NO: 1572885 - RNA, 21 nt, Pseudomonas putida KT2440
acaagccaugugccuggcccg

SEQ ID NO: 1572886 - RNA, 19 nt, Pseudomonas putida KT2440
acaaccgugaaucgcgcuu

SEQ ID NO: 1572887 - RNA, 18 nt, Pseudomonas putida KT2440
acaacccuugcagcgccu

SEQ ID NO: 1572888 - RNA, 16 nt, Pseudomonas putida KT2440
acaaccccuugcucaa

SEQ ID NO: 1572889 - RNA, 18 nt, Pseudomonas putida KT2440
acaacccgaucaggugca

SEQ ID NO: 1572890 - RNA, 12 nt, Pseudomonas putida KT2440
acaaaucggcag

SEQ ID NO: 1572891 - RNA, 19 nt, Pseudomonas putida KT2440
acaaagggcgacuucgguc

SEQ ID NO: 1572892 - RNA, 22 nt, Pseudomonas putida KT2440
acaccggucagguccgccaagg

SEQ ID NO: 1572893 - RNA, 13 nt, Pseudomonas putida KT2440
acacgcuugucga

SEQ ID NO: 1572894 - RNA, 21 nt, Pseudomonas putida KT2440
acaccggguguuggacacagg

SEQ ID NO: 1572895 - RNA, 17 nt, Pseudomonas putida KT2440
acaccgcgcaccucgac

SEQ ID NO: 1572896 - RNA, 21 nt, Pseudomonas putida KT2440
acaccgacgccgaucaauguc

SEQ ID NO: 1572897 - RNA, 17 nt, Pseudomonas putida KT2440
acaccgccagcgggcug

SEQ ID NO: 1572898 - RNA, 12 nt, Pseudomonas putida KT2440
acaccgccagcg

SEQ ID NO: 1572899 - RNA, 19 nt, Pseudomonas putida KT2440
acacccugcaccacggcag

SEQ ID NO: 1572900 - RNA, 15 nt, Pseudomonas putida KT2440
acacccucgacguug

SEQ ID NO: 1572901 - RNA, 20 nt, Pseudomonas putida KT2440
acacccucgccccgcgcaag

SEQ ID NO: 1572902 - RNA, 15 nt, Pseudomonas putida KT2440
acacccggcuugacc

SEQ ID NO: 1572903 - RNA, 15 nt, Pseudomonas putida KT2440
acacagaugccgccg

SEQ ID NO: 1572904 - RNA, 20 nt, Pseudomonas putida KT2440
acacagcccaaggcuggcca

SEQ ID NO: 1572905 - RNA, 17 nt, Pseudomonas putida KT2440
acacagcggccuugacc

SEQ ID NO: 1572906 - RNA, 20 nt, Pseudomonas putida KT2440
acagccccuuccccaggccg

SEQ ID NO: 1572907 - RNA, 16 nt, Pseudomonas putida KT2440
acagccucaaggccgg

SEQ ID NO: 1572908 - RNA, 17 nt, Pseudomonas putida KT2440
acagccuuggguaacca

SEQ ID NO: 1572909 - RNA, 19 nt, Pseudomonas putida KT2440
acagcgacaugccggccac

SEQ ID NO: 1572910 - RNA, 23 nt, Pseudomonas putida KT2440
acagcgcagccaccagcuucauc

SEQ ID NO: 1572911 - RNA, 19 nt, Pseudomonas putida KT2440
acagcgcauaggccaaggu

SEQ ID NO: 1572912 - RNA, 20 nt, Pseudomonas putida KT2440
acagcgccuugaagcuggcc

SEQ ID NO: 1572913 - RNA, 16 nt, Pseudomonas putida KT2440
acagcgccuggcgaga

SEQ ID NO: 1572914 - RNA, 13 nt, Pseudomonas putida KT2440
acagcgcgacgca

SEQ ID NO: 1572915 - RNA, 23 nt, Pseudomonas putida KT2440
acagcggcaauucggccggccag

SEQ ID NO: 1572916 - RNA, 17 nt, Pseudomonas putida KT2440
acagcggcagcaucgac

SEQ ID NO: 1572917 - RNA, 18 nt, Pseudomonas putida KT2440
acagcggcagcaucgacc

SEQ ID NO: 1572918 - RNA, 22 nt, Pseudomonas putida KT2440
acagcggcgaaggauggaccga

SEQ ID NO: 1572919 - RNA, 16 nt, Pseudomonas putida KT2440
acagcggccacagcgc

SEQ ID NO: 1572920 - RNA, 22 nt, Pseudomonas putida KT2440
acagcggccccaucacccccga

SEQ ID NO: 1572921 - RNA, 22 nt, Pseudomonas putida KT2440
acagcacgggcacacuggccac

SEQ ID NO: 1572922 - RNA, 19 nt, Pseudomonas putida KT2440
acagcacugcauuggccac

SEQ ID NO: 1572923 - RNA, 14 nt, Pseudomonas putida KT2440
acagcaccggccag

SEQ ID NO: 1572924 - RNA, 17 nt, Pseudomonas putida KT2440
acagcccaaggcuggcc

SEQ ID NO: 1572925 - RNA, 20 nt, Pseudomonas putida KT2440
acagcccaaggcuggccaga

SEQ ID NO: 1572926 - RNA, 17 nt, Pseudomonas putida KT2440
acacucgcccccaucgc

SEQ ID NO: 1572927 - RNA, 12 nt, Pseudomonas putida KT2440
acacucaccgcg

SEQ ID NO: 1572928 - RNA, 13 nt, Pseudomonas putida KT2440
acacuucacgcac

SEQ ID NO: 1572929 - RNA, 23 nt, Pseudomonas putida KT2440
acgccaaucaccugcacaucggc

SEQ ID NO: 1572930 - RNA, 16 nt, Pseudomonas putida KT2440
acgccaccuucgccag

SEQ ID NO: 1572931 - RNA, 16 nt, Pseudomonas putida KT2440
acgccgacagcggcga

SEQ ID NO: 1572932 - RNA, 13 nt, Pseudomonas putida KT2440
acgcccggcaauc

SEQ ID NO: 1572933 - RNA, 18 nt, Pseudomonas putida KT2440
acgcccgacuggcuggcc

SEQ ID NO: 1572934 - RNA, 11 nt, Pseudomonas putida KT2440
acgcccgcgug

SEQ ID NO: 1572935 - RNA, 14 nt, Pseudomonas putida KT2440
acgcccgcgugcuu

SEQ ID NO: 1572936 - RNA, 17 nt, Pseudomonas putida KT2440
acgcccgcucccacagg

SEQ ID NO: 1572937 - RNA, 20 nt, Pseudomonas putida KT2440
acgcccgcucccacagguac

SEQ ID NO: 1572938 - RNA, 15 nt, Pseudomonas putida KT2440
acgccccgugaaguc

SEQ ID NO: 1572939 - RNA, 17 nt, Pseudomonas putida KT2440
acgccccuuggcacggc

SEQ ID NO: 1572940 - RNA, 19 nt, Pseudomonas putida KT2440
acgccagggcaaucgccaa

SEQ ID NO: 1572941 - RNA, 16 nt, Pseudomonas putida KT2440
acgccaugugcgcccg

SEQ ID NO: 1572942 - RNA, 19 nt, Pseudomonas putida KT2440
acgccauuguucgccucgu

SEQ ID NO: 1572943 - RNA, 14 nt, Pseudomonas putida KT2440
acgcccaaccccag

SEQ ID NO: 1572944 - RNA, 22 nt, Pseudomonas putida KT2440
acgcaaucucgacaagcgcauu

SEQ ID NO: 1572945 - RNA, 17 nt, Pseudomonas putida KT2440
acgcacacgaccuugga

SEQ ID NO: 1572946 - RNA, 16 nt, Pseudomonas putida KT2440
acgcagccggcaccgc

SEQ ID NO: 1572947 - RNA, 16 nt, Pseudomonas putida KT2440
acgcagguacucgccg

SEQ ID NO: 1572948 - RNA, 22 nt, Pseudomonas putida KT2440
acgcaccaggucgcggugcagc

SEQ ID NO: 1572949 - RNA, 19 nt, Pseudomonas putida KT2440
acgaucuuggccagggccu

SEQ ID NO: 1572950 - RNA, 17 nt, Pseudomonas putida KT2440
acgaugaggcgaugcag

SEQ ID NO: 1572951 - RNA, 19 nt, Pseudomonas putida KT2440
acgacuggucauacuccag

SEQ ID NO: 1572952 - RNA, 21 nt, Pseudomonas putida KT2440
acgaggauaagcaugggucag

SEQ ID NO: 1572953 - RNA, 12 nt, Pseudomonas putida KT2440
acgccgccagcg

SEQ ID NO: 1572954 - RNA, 14 nt, Pseudomonas putida KT2440
acgccgcugguaca

SEQ ID NO: 1572955 - RNA, 13 nt, Pseudomonas putida KT2440
acgccgccgaggc

SEQ ID NO: 1572956 - RNA, 18 nt, Pseudomonas putida KT2440
acgccgccgaggcaccgg

SEQ ID NO: 1572957 - RNA, 20 nt, Pseudomonas putida KT2440
acgccgccgaggcaccggua

SEQ ID NO: 1572958 - RNA, 14 nt, Pseudomonas putida KT2440
acgccggccaaggu

SEQ ID NO: 1572959 - RNA, 15 nt, Pseudomonas putida KT2440
acgccuugcgcucga

SEQ ID NO: 1572960 - RNA, 15 nt, Pseudomonas putida KT2440
acgccuuggccugcg

SEQ ID NO: 1572961 - RNA, 15 nt, Pseudomonas putida KT2440
acgccuuggccuggc

SEQ ID NO: 1572962 - RNA, 21 nt, Pseudomonas putida KT2440
acgcgauaaugggucaacggc

SEQ ID NO: 1572963 - RNA, 20 nt, Pseudomonas putida KT2440
acgcgauauucagugcgcag

SEQ ID NO: 1572964 - RNA, 12 nt, Pseudomonas putida KT2440
acgccucgaagu

SEQ ID NO: 1572965 - RNA, 15 nt, Pseudomonas putida KT2440
acgccguugucacgc

SEQ ID NO: 1572966 - RNA, 22 nt, Pseudomonas putida KT2440
acgccguugucacgcgccaggu

SEQ ID NO: 1572967 - RNA, 20 nt, Pseudomonas putida KT2440
acgcgccacauagcuggcac

SEQ ID NO: 1572968 - RNA, 21 nt, Pseudomonas putida KT2440
acgcgccacauagcuggcacu

SEQ ID NO: 1572969 - RNA, 18 nt, Pseudomonas putida KT2440
acgcgccaccgccgugcc

SEQ ID NO: 1572970 - RNA, 20 nt, Pseudomonas putida KT2440
acgcgccaaccgcgccagca

SEQ ID NO: 1572971 - RNA, 18 nt, Pseudomonas putida KT2440
acgcgcagagaagccgca

SEQ ID NO: 1572972 - RNA, 16 nt, Pseudomonas putida KT2440
acgcgcaggcgcugca

SEQ ID NO: 1572973 - RNA, 12 nt, Pseudomonas putida KT2440
acgcgccagcag

SEQ ID NO: 1572974 - RNA, 17 nt, Pseudomonas putida KT2440
acgcgccgcugccuggg

SEQ ID NO: 1572975 - RNA, 13 nt, Pseudomonas putida KT2440
acgcgcgcuggcu

SEQ ID NO: 1572976 - RNA, 22 nt, Pseudomonas putida KT2440
acgaccgauaaagagaagcugc

SEQ ID NO: 1572977 - RNA, 21 nt, Pseudomonas putida KT2440
acgacccggauaccgacccua

SEQ ID NO: 1572978 - RNA, 19 nt, Pseudomonas putida KT2440
acgacaaaucgacauacag

SEQ ID NO: 1572979 - RNA, 20 nt, Pseudomonas putida KT2440
acgaaguugagcaccggcag

SEQ ID NO: 1572980 - RNA, 14 nt, Pseudomonas putida KT2440
acgaauaucgccga

SEQ ID NO: 1572981 - RNA, 17 nt, Pseudomonas putida KT2440
accuugucagcaaccac

SEQ ID NO: 1572982 - RNA, 19 nt, Pseudomonas putida KT2440
accuugucagcaaccacgc

SEQ ID NO: 1572983 - RNA, 18 nt, Pseudomonas putida KT2440
acgacugacguaguccuu

SEQ ID NO: 1572984 - RNA, 16 nt, Pseudomonas putida KT2440
acgaccuugccaaggu

SEQ ID NO: 1572985 - RNA, 13 nt, Pseudomonas putida KT2440
accugcguggugc

SEQ ID NO: 1572986 - RNA, 14 nt, Pseudomonas putida KT2440
accugcguugcccc

SEQ ID NO: 1572987 - RNA, 23 nt, Pseudomonas putida KT2440
accugcggcuguccagcaagggc

SEQ ID NO: 1572988 - RNA, 21 nt, Pseudomonas putida KT2440
accugcgcuugcaccagguca

SEQ ID NO: 1572989 - RNA, 22 nt, Pseudomonas putida KT2440
accugcgccuugcuuggcagcg

SEQ ID NO: 1572990 - RNA, 18 nt, Pseudomonas putida KT2440
accugcuccugauaguug

SEQ ID NO: 1572991 - RNA, 20 nt, Pseudomonas putida KT2440
accugcucgcucaggcucuu

SEQ ID NO: 1572992 - RNA, 14 nt, Pseudomonas putida KT2440
accugcucggcgcg

SEQ ID NO: 1572993 - RNA, 20 nt, Pseudomonas putida KT2440
accugcucuggcccgaacag

SEQ ID NO: 1572994 - RNA, 23 nt, Pseudomonas putida KT2440
accugcucuggcccgaacagcac

SEQ ID NO: 1572995 - RNA, 14 nt, Pseudomonas putida KT2440
accugcugggucag

SEQ ID NO: 1572996 - RNA, 17 nt, Pseudomonas putida KT2440
accugcugggucagcgc

SEQ ID NO: 1572997 - RNA, 16 nt, Pseudomonas putida KT2440
accugcuucgcgggca

SEQ ID NO: 1572998 - RNA, 22 nt, Pseudomonas putida KT2440
accuggcagccgaagcugucga

SEQ ID NO: 1572999 - RNA, 16 nt, Pseudomonas putida KT2440
accuggccuuccagcu

SEQ ID NO: 1573000 - RNA, 22 nt, Pseudomonas putida KT2440
accuggcugcugugguuuggcc

SEQ ID NO: 1573001 - RNA, 14 nt, Pseudomonas putida KT2440
accuggguccaggc

SEQ ID NO: 1573002 - RNA, 16 nt, Pseudomonas putida KT2440
accugguccagcuuca

SEQ ID NO: 1573003 - RNA, 18 nt, Pseudomonas putida KT2440
accugugggagcgggcau

SEQ ID NO: 1573004 - RNA, 19 nt, Pseudomonas putida KT2440
accugugggagcgggcaug

SEQ ID NO: 1573005 - RNA, 18 nt, Pseudomonas putida KT2440
accugugggagcgggcgu

SEQ ID NO: 1573006 - RNA, 19 nt, Pseudomonas putida KT2440
accugugggagcgggcuug

SEQ ID NO: 1573007 - RNA, 17 nt, Pseudomonas putida KT2440
accuuggacgcuggcag

SEQ ID NO: 1573008 - RNA, 16 nt, Pseudomonas putida KT2440
accuguuucaacgggu

SEQ ID NO: 1573009 - RNA, 15 nt, Pseudomonas putida KT2440
accuucaaccacggu

SEQ ID NO: 1573010 - RNA, 19 nt, Pseudomonas putida KT2440
accuuacuugcacauccca

SEQ ID NO: 1573011 - RNA, 21 nt, Pseudomonas putida KT2440
accuccaggucauccgcacgc

SEQ ID NO: 1573012 - RNA, 23 nt, Pseudomonas putida KT2440
accuccggcaucauccugcuggc

SEQ ID NO: 1573013 - RNA, 19 nt, Pseudomonas putida KT2440
accucgauuuccaccggcu

SEQ ID NO: 1573014 - RNA, 17 nt, Pseudomonas putida KT2440
accucgaccaggcgcuc

SEQ ID NO: 1573015 - RNA, 16 nt, Pseudomonas putida KT2440
accucacuggcauccg

SEQ ID NO: 1573016 - RNA, 14 nt, Pseudomonas putida KT2440
accucaucacgcga

SEQ ID NO: 1573017 - RNA, 15 nt, Pseudomonas putida KT2440
accucaacgccauca

SEQ ID NO: 1573018 - RNA, 16 nt, Pseudomonas putida KT2440
accucaaguucccgau

SEQ ID NO: 1573019 - RNA, 22 nt, Pseudomonas putida KT2440
accggucagcccggcuugcacc

SEQ ID NO: 1573020 - RNA, 21 nt, Pseudomonas putida KT2440
accggucagguccgccaaggu

SEQ ID NO: 1573021 - RNA, 16 nt, Pseudomonas putida KT2440
accgguacauugcgca

SEQ ID NO: 1573022 - RNA, 14 nt, Pseudomonas putida KT2440
accgguaccggcgu

SEQ ID NO: 1573023 - RNA, 15 nt, Pseudomonas putida KT2440
accgguauaacgcac

SEQ ID NO: 1573024 - RNA, 17 nt, Pseudomonas putida KT2440
accgguauaacgcacgu

SEQ ID NO: 1573025 - RNA, 19 nt, Pseudomonas putida KT2440
accuacagggauugcgcag

SEQ ID NO: 1573026 - RNA, 19 nt, Pseudomonas putida KT2440
accggucauggcgcgccau

SEQ ID NO: 1573027 - RNA, 17 nt, Pseudomonas putida KT2440
accucggaugccacgcu

SEQ ID NO: 1573028 - RNA, 22 nt, Pseudomonas putida KT2440
accucggccgcauccugcgugc

SEQ ID NO: 1573029 - RNA, 14 nt, Pseudomonas putida KT2440
accucuuagcgggc

SEQ ID NO: 1573030 - RNA, 15 nt, Pseudomonas putida KT2440
accucuuagcgggca

SEQ ID NO: 1573031 - RNA, 19 nt, Pseudomonas putida KT2440
accucuucgcggguaaacc

SEQ ID NO: 1573032 - RNA, 13 nt, Pseudomonas putida KT2440
accugcccgggaa

SEQ ID NO: 1573033 - RNA, 15 nt, Pseudomonas putida KT2440
accugccccagcguc

SEQ ID NO: 1573034 - RNA, 17 nt, Pseudomonas putida KT2440
accugccccagcgucac

SEQ ID NO: 1573035 - RNA, 16 nt, Pseudomonas putida KT2440
accugccgcagcgauc

SEQ ID NO: 1573036 - RNA, 13 nt, Pseudomonas putida KT2440
accugccgggcau

SEQ ID NO: 1573037 - RNA, 22 nt, Pseudomonas putida KT2440
accugcaggcgcggugccggca

SEQ ID NO: 1573038 - RNA, 19 nt, Pseudomonas putida KT2440
accugcacacugcccagca

SEQ ID NO: 1573039 - RNA, 15 nt, Pseudomonas putida KT2440
accugcacaucggcc

SEQ ID NO: 1573040 - RNA, 14 nt, Pseudomonas putida KT2440
accugaugcaccag

SEQ ID NO: 1573041 - RNA, 19 nt, Pseudomonas putida KT2440
accugauguacaaggaccu

SEQ ID NO: 1573042 - RNA, 14 nt, Pseudomonas putida KT2440
accugauguccaaa

SEQ ID NO: 1573043 - RNA, 13 nt, Pseudomonas putida KT2440
accugacaagcga

SEQ ID NO: 1573044 - RNA, 15 nt, Pseudomonas putida KT2440
accugagucaggcgc

SEQ ID NO: 1573045 - RNA, 16 nt, Pseudomonas putida KT2440
accugagcuucaacgc

SEQ ID NO: 1573046 - RNA, 15 nt, Pseudomonas putida KT2440
acuccagcgccagca

SEQ ID NO: 1573047 - RNA, 19 nt, Pseudomonas putida KT2440
acuccuugcgcaucaagcg

SEQ ID NO: 1573048 - RNA, 15 nt, Pseudomonas putida KT2440
acucgcccgccaggu

SEQ ID NO: 1573049 - RNA, 22 nt, Pseudomonas putida KT2440
acuccgcuucaucaggucgccu

SEQ ID NO: 1573050 - RNA, 21 nt, Pseudomonas putida KT2440
acuccgggugaucauucaggc

SEQ ID NO: 1573051 - RNA, 22 nt, Pseudomonas putida KT2440
acuccgcgagggcaucagcgca

SEQ ID NO: 1573052 - RNA, 19 nt, Pseudomonas putida KT2440
acugcccacccaaccgcgc

SEQ ID NO: 1573053 - RNA, 22 nt, Pseudomonas putida KT2440
acugccagcccggcggccagca

SEQ ID NO: 1573054 - RNA, 17 nt, Pseudomonas putida KT2440
acugccagcgccucacc

SEQ ID NO: 1573055 - RNA, 16 nt, Pseudomonas putida KT2440
acugccaggcuggcgc

SEQ ID NO: 1573056 - RNA, 18 nt, Pseudomonas putida KT2440
acugccuugcccugcagc

SEQ ID NO: 1573057 - RNA, 18 nt, Pseudomonas putida KT2440
acugcgacgaacucaacg

SEQ ID NO: 1573058 - RNA, 12 nt, Pseudomonas putida KT2440
acugccuggcca

SEQ ID NO: 1573059 - RNA, 17 nt, Pseudomonas putida KT2440
acugccugcaugcgugc

SEQ ID NO: 1573060 - RNA, 22 nt, Pseudomonas putida KT2440
acucggcaaucagcaucagugc

SEQ ID NO: 1573061 - RNA, 16 nt, Pseudomonas putida KT2440
acucgcggccggucac

SEQ ID NO: 1573062 - RNA, 14 nt, Pseudomonas putida KT2440
acucgcgcagcaca

SEQ ID NO: 1573063 - RNA, 17 nt, Pseudomonas putida KT2440
acucgcgcagcacauca

SEQ ID NO: 1573064 - RNA, 15 nt, Pseudomonas putida KT2440
acugaacagcgccuu

SEQ ID NO: 1573065 - RNA, 14 nt, Pseudomonas putida KT2440
acucuucgcgggcu

SEQ ID NO: 1573066 - RNA, 17 nt, Pseudomonas putida KT2440
acucuugagcuggccgu

SEQ ID NO: 1573067 - RNA, 18 nt, Pseudomonas putida KT2440
acugaagauuuucagcca

SEQ ID NO: 1573068 - RNA, 18 nt, Pseudomonas putida KT2440
acugaauacagccaaugg

SEQ ID NO: 1573069 - RNA, 16 nt, Pseudomonas putida KT2440
acguuguagcccacca

SEQ ID NO: 1573070 - RNA, 23 nt, Pseudomonas putida KT2440
acguuggugccggucggcgucca

SEQ ID NO: 1573071 - RNA, 15 nt, Pseudomonas putida KT2440
acguuucgucaucca

SEQ ID NO: 1573072 - RNA, 16 nt, Pseudomonas putida KT2440
acgugccuucaccagc

SEQ ID NO: 1573073 - RNA, 13 nt, Pseudomonas putida KT2440
acguucagcgggu

SEQ ID NO: 1573074 - RNA, 13 nt, Pseudomonas putida KT2440
acguggacaugaa

SEQ ID NO: 1573075 - RNA, 13 nt, Pseudomonas putida KT2440
acgugcgggcuug

SEQ ID NO: 1573076 - RNA, 15 nt, Pseudomonas putida KT2440
acggucuggcgcagg

SEQ ID NO: 1573077 - RNA, 23 nt, Pseudomonas putida KT2440
acggucuccggcgaaauacccaa

SEQ ID NO: 1573078 - RNA, 16 nt, Pseudomonas putida KT2440
acgucggcuggcagcu

SEQ ID NO: 1573079 - RNA, 16 nt, Pseudomonas putida KT2440
acguccagagggccug

SEQ ID NO: 1573080 - RNA, 22 nt, Pseudomonas putida KT2440
acguccagcucaacgcgaacga

SEQ ID NO: 1573081 - RNA, 19 nt, Pseudomonas putida KT2440
acgucauucaaggucagcu

SEQ ID NO: 1573082 - RNA, 21 nt, Pseudomonas putida KT2440
acgucauaguuguggcaacga

SEQ ID NO: 1573083 - RNA, 20 nt, Pseudomonas putida KT2440
acgggccagccgcgccaggu

SEQ ID NO: 1573084 - RNA, 18 nt, Pseudomonas putida KT2440
acgggcggaacuggcccu

SEQ ID NO: 1573085 - RNA, 14 nt, Pseudomonas putida KT2440
acgggugcgggcuc

SEQ ID NO: 1573086 - RNA, 22 nt, Pseudomonas putida KT2440
acggguguuuccaccccggcag

SEQ ID NO: 1573087 - RNA, 17 nt, Pseudomonas putida KT2440
acgguaacguuggccgg

SEQ ID NO: 1573088 - RNA, 14 nt, Pseudomonas putida KT2440
acgguacgggcaaa

SEQ ID NO: 1573089 - RNA, 14 nt, Pseudomonas putida KT2440
acggcggguggaga

SEQ ID NO: 1573090 - RNA, 17 nt, Pseudomonas putida KT2440
acggcgggccaucugcu

SEQ ID NO: 1573091 - RNA, 13 nt, Pseudomonas putida KT2440
acggcggcgauca

SEQ ID NO: 1573092 - RNA, 14 nt, Pseudomonas putida KT2440
acggcggcgaucag

SEQ ID NO: 1573093 - RNA, 16 nt, Pseudomonas putida KT2440
acggcggcgaucagcg

SEQ ID NO: 1573094 - RNA, 15 nt, Pseudomonas putida KT2440
acggcuugccggcaa

SEQ ID NO: 1573095 - RNA, 16 nt, Pseudomonas putida KT2440
acggcuugauauccag

SEQ ID NO: 1573096 - RNA, 20 nt, Pseudomonas putida KT2440
acggcuucgcgcauuucguc

SEQ ID NO: 1573097 - RNA, 15 nt, Pseudomonas putida KT2440
acgggcaugguggaa

SEQ ID NO: 1573098 - RNA, 22 nt, Pseudomonas putida KT2440
acgggaagugcacugccuggcu

SEQ ID NO: 1573099 - RNA, 20 nt, Pseudomonas putida KT2440
acggcgaggugauugaaggc

SEQ ID NO: 1573100 - RNA, 23 nt, Pseudomonas putida KT2440
acggccggugguaauuggccggc

SEQ ID NO: 1573101 - RNA, 16 nt, Pseudomonas putida KT2440
acggccggggccuguu

SEQ ID NO: 1573102 - RNA, 15 nt, Pseudomonas putida KT2440
acggcgcugcuggcc

SEQ ID NO: 1573103 - RNA, 17 nt, Pseudomonas putida KT2440
acggcgcugaccgauga

SEQ ID NO: 1573104 - RNA, 14 nt, Pseudomonas putida KT2440
acggccagcagguu

SEQ ID NO: 1573105 - RNA, 20 nt, Pseudomonas putida KT2440
acggccagcagguugaacag

SEQ ID NO: 1573106 - RNA, 18 nt, Pseudomonas putida KT2440
acggccagccagcagcgu

SEQ ID NO: 1573107 - RNA, 22 nt, Pseudomonas putida KT2440
acggccagccagcagcguaccc

SEQ ID NO: 1573108 - RNA, 14 nt, Pseudomonas putida KT2440
acggccaucagcaa

SEQ ID NO: 1573109 - RNA, 18 nt, Pseudomonas putida KT2440
acggcccaugucgaucag

SEQ ID NO: 1573110 - RNA, 16 nt, Pseudomonas putida KT2440
acggcauggccgaagc

SEQ ID NO: 1573111 - RNA, 15 nt, Pseudomonas putida KT2440
acggcauuuccagcg

SEQ ID NO: 1573112 - RNA, 21 nt, Pseudomonas putida KT2440
acggccaauaucuggugcagg

SEQ ID NO: 1573113 - RNA, 19 nt, Pseudomonas putida KT2440
acggccagcaccgaaccgg

SEQ ID NO: 1573114 - RNA, 12 nt, Pseudomonas putida KT2440
acggcaucacgc

SEQ ID NO: 1573115 - RNA, 19 nt, Pseudomonas putida KT2440
acggcaucacgcuggccau

SEQ ID NO: 1573116 - RNA, 13 nt, Pseudomonas putida KT2440
acggcagaucagg

SEQ ID NO: 1573117 - RNA, 16 nt, Pseudomonas putida KT2440
acggcagaucaggcaa

SEQ ID NO: 1573118 - RNA, 14 nt, Pseudomonas putida KT2440
acggcagcaggcca

SEQ ID NO: 1573119 - RNA, 22 nt, Pseudomonas putida KT2440
acggcagcgacagcugcggcau

SEQ ID NO: 1573120 - RNA, 16 nt, Pseudomonas putida KT2440
acgcggccugugccca

SEQ ID NO: 1573121 - RNA, 16 nt, Pseudomonas putida KT2440
acgcuggacuugccuu

SEQ ID NO: 1573122 - RNA, 11 nt, Pseudomonas putida KT2440
acgcuggccaa

SEQ ID NO: 1573123 - RNA, 16 nt, Pseudomonas putida KT2440
acgcuggaucaccacc

SEQ ID NO: 1573124 - RNA, 19 nt, Pseudomonas putida KT2440
acgcuggaucaccaccguc

SEQ ID NO: 1573125 - RNA, 20 nt, Pseudomonas putida KT2440
acgcgcuaccugugggagcg

SEQ ID NO: 1573126 - RNA, 18 nt, Pseudomonas putida KT2440
acggcacucgaagcacuc

SEQ ID NO: 1573127 - RNA, 17 nt, Pseudomonas putida KT2440
acgcuugucuuccagcu

SEQ ID NO: 1573128 - RNA, 17 nt, Pseudomonas putida KT2440
acggaucaccuggccgu

SEQ ID NO: 1573129 - RNA, 13 nt, Pseudomonas putida KT2440
acggagucagugu

SEQ ID NO: 1573130 - RNA, 15 nt, Pseudomonas putida KT2440
acgcuucgauccgcg

SEQ ID NO: 1573131 - RNA, 16 nt, Pseudomonas putida KT2440
acgcuucgaacacccg

SEQ ID NO: 1573132 - RNA, 18 nt, Pseudomonas putida KT2440
uugcgcccggcgucgaac

SEQ ID NO: 1573133 - RNA, 18 nt, Pseudomonas putida KT2440
aauccccaaccaugcugg

SEQ ID NO: 1573134 - RNA, 17 nt, Pseudomonas putida KT2440
uuggcaucgcugcccgg

SEQ ID NO: 1573135 - RNA, 13 nt, Pseudomonas putida KT2440
uuggcaucugcug

SEQ ID NO: 1573136 - RNA, 22 nt, Pseudomonas putida KT2440
uuggcacggccagccagcagcg

SEQ ID NO: 1573137 - RNA, 14 nt, Pseudomonas putida KT2440
uuggccaccucauc

SEQ ID NO: 1573138 - RNA, 14 nt, Pseudomonas putida KT2440
uuggccacgcccaa

SEQ ID NO: 1573139 - RNA, 16 nt, Pseudomonas putida KT2440
uuggccagcaacggug

SEQ ID NO: 1573140 - RNA, 18 nt, Pseudomonas putida KT2440
uugguaccgucgaucagc

SEQ ID NO: 1573141 - RNA, 21 nt, Pseudomonas putida KT2440
uuggguagugcauuucgucga

SEQ ID NO: 1573142 - RNA, 16 nt, Pseudomonas putida KT2440
uuggcggagccagcca

SEQ ID NO: 1573143 - RNA, 21 nt, Pseudomonas putida KT2440
uugggcggcgugaccagcccg

SEQ ID NO: 1573144 - RNA, 22 nt, Pseudomonas putida KT2440
uuggcgaucgaacgcuugcccg

SEQ ID NO: 1573145 - RNA, 11 nt, Pseudomonas putida KT2440
uuggcgaaugc

SEQ ID NO: 1573146 - RNA, 23 nt, Pseudomonas putida KT2440
uugucagcaaccggacggguuuc

SEQ ID NO: 1573147 - RNA, 13 nt, Pseudomonas putida KT2440
uugguguggcagc

SEQ ID NO: 1573148 - RNA, 14 nt, Pseudomonas putida KT2440
uuggugcgcgcauc

SEQ ID NO: 1573149 - RNA, 16 nt, Pseudomonas putida KT2440
uuggugcaugcaagca

SEQ ID NO: 1573150 - RNA, 17 nt, Pseudomonas putida KT2440
uugguuggcggagccag

SEQ ID NO: 1573151 - RNA, 19 nt, Pseudomonas putida KT2440
uuguaagccaugaucagcg

SEQ ID NO: 1573152 - RNA, 20 nt, Pseudomonas putida KT2440
uugucgaacagcauccagcg

SEQ ID NO: 1573153 - RNA, 22 nt, Pseudomonas putida KT2440
uugucgaagcgcaccucggcca

SEQ ID NO: 1573154 - RNA, 16 nt, Pseudomonas putida KT2440
uuguccaccugacgcg

SEQ ID NO: 1573155 - RNA, 13 nt, Pseudomonas putida KT2440
uuguccagcagca

SEQ ID NO: 1573156 - RNA, 23 nt, Pseudomonas putida KT2440
uugugccuggcgcuugaucagcc

SEQ ID NO: 1573157 - RNA, 11 nt, Pseudomonas putida KT2440
uugugggagcg

SEQ ID NO: 1573158 - RNA, 14 nt, Pseudomonas putida KT2440
uuguguugcgaugg

SEQ ID NO: 1573159 - RNA, 13 nt, Pseudomonas putida KT2440
uugccgaucagcg

SEQ ID NO: 1573160 - RNA, 23 nt, Pseudomonas putida KT2440
uugcccgugacuaguggccacuu

SEQ ID NO: 1573161 - RNA, 17 nt, Pseudomonas putida KT2440
uugcccucgcaugcggc

SEQ ID NO: 1573162 - RNA, 20 nt, Pseudomonas putida KT2440
uugcccgcgaacacgggcga

SEQ ID NO: 1573163 - RNA, 20 nt, Pseudomonas putida KT2440
uugcccgcgaagaggccggu

SEQ ID NO: 1573164 - RNA, 12 nt, Pseudomonas putida KT2440
uugcccgcugca

SEQ ID NO: 1573165 - RNA, 17 nt, Pseudomonas putida KT2440
uugcccaagcgcuccgc

SEQ ID NO: 1573166 - RNA, 15 nt, Pseudomonas putida KT2440
uugcccagcgcugca

SEQ ID NO: 1573167 - RNA, 19 nt, Pseudomonas putida KT2440
uugcccagcuccagcaccu

SEQ ID NO: 1573168 - RNA, 12 nt, Pseudomonas putida KT2440
uugccaggcgca

SEQ ID NO: 1573169 - RNA, 17 nt, Pseudomonas putida KT2440
uugccagugauccggcg

SEQ ID NO: 1573170 - RNA, 20 nt, Pseudomonas putida KT2440
uugccgcgcccgcaaccucg

SEQ ID NO: 1573171 - RNA, 22 nt, Pseudomonas putida KT2440
uugccggccucuucgcggguaa

SEQ ID NO: 1573172 - RNA, 19 nt, Pseudomonas putida KT2440
uugccggccuugaccucga

SEQ ID NO: 1573173 - RNA, 21 nt, Pseudomonas putida KT2440
uugccgggugcaucggcaccg

SEQ ID NO: 1573174 - RNA, 19 nt, Pseudomonas putida KT2440
uugccgguguucgcgggca

SEQ ID NO: 1573175 - RNA, 14 nt, Pseudomonas putida KT2440
uugcgcaucaagcg

SEQ ID NO: 1573176 - RNA, 23 nt, Pseudomonas putida KT2440
uugcgcaggguggcgcugaccaa

SEQ ID NO: 1573177 - RNA, 16 nt, Pseudomonas putida KT2440
uugcgccccagcagcg

SEQ ID NO: 1573178 - RNA, 15 nt, Pseudomonas putida KT2440
uugcgccagccgcuc

SEQ ID NO: 1573179 - RNA, 20 nt, Pseudomonas putida KT2440
uugcagcccauucgcgggca

SEQ ID NO: 1573180 - RNA, 19 nt, Pseudomonas putida KT2440
uugcaggggcugcaaggca

SEQ ID NO: 1573181 - RNA, 17 nt, Pseudomonas putida KT2440
uugcaguccuuucgcga

SEQ ID NO: 1573182 - RNA, 15 nt, Pseudomonas putida KT2440
uugcaguaucgcccc

SEQ ID NO: 1573183 - RNA, 16 nt, Pseudomonas putida KT2440
aaucaggcagcgauca

SEQ ID NO: 1573184 - RNA, 14 nt, Pseudomonas putida KT2440
aaucaggcugucca

SEQ ID NO: 1573185 - RNA, 17 nt, Pseudomonas putida KT2440
aaucagguuguucaccu

SEQ ID NO: 1573186 - RNA, 15 nt, Pseudomonas putida KT2440
uugcaaccaggcgcc

SEQ ID NO: 1573187 - RNA, 14 nt, Pseudomonas putida KT2440
uugcagcacaaggc

SEQ ID NO: 1573188 - RNA, 23 nt, Pseudomonas putida KT2440
uugcagcgccgcauccagcacug

SEQ ID NO: 1573189 - RNA, 23 nt, Pseudomonas putida KT2440
uugcagaaacucguuuucgcuga

SEQ ID NO: 1573190 - RNA, 15 nt, Pseudomonas putida KT2440
uugcaacuggcgcag

SEQ ID NO: 1573191 - RNA, 22 nt, Pseudomonas putida KT2440
uucuggcugccuucgcucaggu

SEQ ID NO: 1573192 - RNA, 14 nt, Pseudomonas putida KT2440
uugaucuugcgccc

SEQ ID NO: 1573193 - RNA, 15 nt, Pseudomonas putida KT2440
uugaugugcaggucg

SEQ ID NO: 1573194 - RNA, 22 nt, Pseudomonas putida KT2440
aaucgucguaggcgcggguuua

SEQ ID NO: 1573195 - RNA, 15 nt, Pseudomonas putida KT2440
aaucgggaucaugcc

SEQ ID NO: 1573196 - RNA, 16 nt, Pseudomonas putida KT2440
aaucgcucugccgcac

SEQ ID NO: 1573197 - RNA, 21 nt, Pseudomonas putida KT2440
aaucggcaggccggccaccag

SEQ ID NO: 1573198 - RNA, 18 nt, Pseudomonas putida KT2440
aaugcgcgcgaaggcccg

SEQ ID NO: 1573199 - RNA, 17 nt, Pseudomonas putida KT2440
aaugcgccccggcgauc

SEQ ID NO: 1573200 - RNA, 13 nt, Pseudomonas putida KT2440
aaugcgcccugcu

SEQ ID NO: 1573201 - RNA, 15 nt, Pseudomonas putida KT2440
aaugcgcccugcugc

SEQ ID NO: 1573202 - RNA, 16 nt, Pseudomonas putida KT2440
aaugggcugcaaagca

SEQ ID NO: 1573203 - RNA, 21 nt, Pseudomonas putida KT2440
aauggcguauccacauacugc

SEQ ID NO: 1573204 - RNA, 16 nt, Pseudomonas putida KT2440
aaugucaccgcggcaa

SEQ ID NO: 1573205 - RNA, 21 nt, Pseudomonas putida KT2440
aauguaggaucaaguaccccu

SEQ ID NO: 1573206 - RNA, 12 nt, Pseudomonas putida KT2440
aaugucagcgcu

SEQ ID NO: 1573207 - RNA, 22 nt, Pseudomonas putida KT2440
aaugucgacguacagcagcuca

SEQ ID NO: 1573208 - RNA, 18 nt, Pseudomonas putida KT2440
aaugucggagcgggcuug

SEQ ID NO: 1573209 - RNA, 20 nt, Pseudomonas putida KT2440
uuucgcgggcacgcccgcuc

SEQ ID NO: 1573210 - RNA, 20 nt, Pseudomonas putida KT2440
uuucgcgggcgcgcccgcuc

SEQ ID NO: 1573211 - RNA, 19 nt, Pseudomonas putida KT2440
uuucgcggguaaacccgcu

SEQ ID NO: 1573212 - RNA, 20 nt, Pseudomonas putida KT2440
uuucgcggguaaacccgcuc

SEQ ID NO: 1573213 - RNA, 20 nt, Pseudomonas putida KT2440
uuucgcgggugaacccgcuc

SEQ ID NO: 1573214 - RNA, 18 nt, Pseudomonas putida KT2440
uuucgcuaaguuugccca

SEQ ID NO: 1573215 - RNA, 23 nt, Pseudomonas putida KT2440
uuuccggguugcacgagauguac

SEQ ID NO: 1573216 - RNA, 17 nt, Pseudomonas putida KT2440
uuucggcagcacccgcu

SEQ ID NO: 1573217 - RNA, 18 nt, Pseudomonas putida KT2440
uuucggcagcacccgcuu

SEQ ID NO: 1573218 - RNA, 23 nt, Pseudomonas putida KT2440
uuucuucaggugccguuccggca

SEQ ID NO: 1573219 - RNA, 21 nt, Pseudomonas putida KT2440
uuuccaggcguaaacccaggu

SEQ ID NO: 1573220 - RNA, 21 nt, Pseudomonas putida KT2440
uuuccaccuggccacccggcu

SEQ ID NO: 1573221 - RNA, 18 nt, Pseudomonas putida KT2440
uuuccagauacaggcugu

SEQ ID NO: 1573222 - RNA, 12 nt, Pseudomonas putida KT2440
uuuaccugcagc

SEQ ID NO: 1573223 - RNA, 20 nt, Pseudomonas putida KT2440
uuugccagcgugaaccggcu

SEQ ID NO: 1573224 - RNA, 22 nt, Pseudomonas putida KT2440
uuugcaccuaaccagugggagc

SEQ ID NO: 1573225 - RNA, 23 nt, Pseudomonas putida KT2440
uuugcagcccauucgcgggcaag

SEQ ID NO: 1573226 - RNA, 13 nt, Pseudomonas putida KT2440
uuugaaaccggca

SEQ ID NO: 1573227 - RNA, 22 nt, Pseudomonas putida KT2440
uuugcgucaucaucagcaggca

SEQ ID NO: 1573228 - RNA, 21 nt, Pseudomonas putida KT2440
uucaggcuuugcugcaggucc

SEQ ID NO: 1573229 - RNA, 16 nt, Pseudomonas putida KT2440
uucagguacagcagcu

SEQ ID NO: 1573230 - RNA, 14 nt, Pseudomonas putida KT2440
uucaucgaaggccu

SEQ ID NO: 1573231 - RNA, 23 nt, Pseudomonas putida KT2440
uucacgggucaggugcggggcaa

SEQ ID NO: 1573232 - RNA, 15 nt, Pseudomonas putida KT2440
uucacgggucaugcc

SEQ ID NO: 1573233 - RNA, 20 nt, Pseudomonas putida KT2440
uucagaucacccuuggccac

SEQ ID NO: 1573234 - RNA, 22 nt, Pseudomonas putida KT2440
uucacugguuucagaaccagcg

SEQ ID NO: 1573235 - RNA, 16 nt, Pseudomonas putida KT2440
uuccagaaucugcaca

SEQ ID NO: 1573236 - RNA, 17 nt, Pseudomonas putida KT2440
uuccacgcgcaggcgcu

SEQ ID NO: 1573237 - RNA, 20 nt, Pseudomonas putida KT2440
uuccacagguaccaggcugc

SEQ ID NO: 1573238 - RNA, 16 nt, Pseudomonas putida KT2440
uuccaugcgcgcagcg

SEQ ID NO: 1573239 - RNA, 23 nt, Pseudomonas putida KT2440
uuccagguagcgucgcgcgccca

SEQ ID NO: 1573240 - RNA, 17 nt, Pseudomonas putida KT2440
uucccggccuggcgcag

SEQ ID NO: 1573241 - RNA, 17 nt, Pseudomonas putida KT2440
uucgaccaccgcaggug

SEQ ID NO: 1573242 - RNA, 21 nt, Pseudomonas putida KT2440
uucgaaaacgauaucgacuuc

SEQ ID NO: 1573243 - RNA, 20 nt, Pseudomonas putida KT2440
uucgaagugccacgccgaaa

SEQ ID NO: 1573244 - RNA, 14 nt, Pseudomonas putida KT2440
uucgccagcgccac

SEQ ID NO: 1573245 - RNA, 20 nt, Pseudomonas putida KT2440
uucgcccgaccgccagcccg

SEQ ID NO: 1573246 - RNA, 13 nt, Pseudomonas putida KT2440
uucgcccgcaccg

SEQ ID NO: 1573247 - RNA, 23 nt, Pseudomonas putida KT2440
uucgccccauaaaaaaacccgcu

SEQ ID NO: 1573248 - RNA, 23 nt, Pseudomonas putida KT2440
uuccgccgggaugguaacgggca

SEQ ID NO: 1573249 - RNA, 16 nt, Pseudomonas putida KT2440
uucgcgcaagcaggug

SEQ ID NO: 1573250 - RNA, 20 nt, Pseudomonas putida KT2440
uucgcgcagggugccggcca

SEQ ID NO: 1573251 - RNA, 17 nt, Pseudomonas putida KT2440
uucgcggccaagccgcu

SEQ ID NO: 1573252 - RNA, 19 nt, Pseudomonas putida KT2440
uucgcggaagauacccgcc

SEQ ID NO: 1573253 - RNA, 19 nt, Pseudomonas putida KT2440
uucgcgggcgcgcccgcuc

SEQ ID NO: 1573254 - RNA, 18 nt, Pseudomonas putida KT2440
uucgcgggagacccguuc

SEQ ID NO: 1573255 - RNA, 15 nt, Pseudomonas putida KT2440
uucgcgggcaagccc

SEQ ID NO: 1573256 - RNA, 18 nt, Pseudomonas putida KT2440
uucgcgggcaagcccgcg

SEQ ID NO: 1573257 - RNA, 19 nt, Pseudomonas putida KT2440
uucgcgggcaagcccgcuc

SEQ ID NO: 1573258 - RNA, 11 nt, Pseudomonas putida KT2440
uucgcgggcau

SEQ ID NO: 1573259 - RNA, 19 nt, Pseudomonas putida KT2440
uucgcggguagacccgcuc

SEQ ID NO: 1573260 - RNA, 11 nt, Pseudomonas putida KT2440
uucgcgggcuc

SEQ ID NO: 1573261 - RNA, 14 nt, Pseudomonas putida KT2440
uucgcuguacagca

SEQ ID NO: 1573262 - RNA, 22 nt, Pseudomonas putida KT2440
uucggaaaacuccugcuggucg

SEQ ID NO: 1573263 - RNA, 19 nt, Pseudomonas putida KT2440
uucggcaacagccgggcag

SEQ ID NO: 1573264 - RNA, 23 nt, Pseudomonas putida KT2440
uucggcagcacccgcuuggccac

SEQ ID NO: 1573265 - RNA, 16 nt, Pseudomonas putida KT2440
uucugccccuggccca

SEQ ID NO: 1573266 - RNA, 14 nt, Pseudomonas putida KT2440
uucucgcagcagca

SEQ ID NO: 1573267 - RNA, 19 nt, Pseudomonas putida KT2440
uucggcguacugcacgcuu

SEQ ID NO: 1573268 - RNA, 22 nt, Pseudomonas putida KT2440
uucggcugaucucuucagccac

SEQ ID NO: 1573269 - RNA, 19 nt, Pseudomonas putida KT2440
uguugaugccacgggcaaa

SEQ ID NO: 1573270 - RNA, 14 nt, Pseudomonas putida KT2440
uguugcagcgccag

SEQ ID NO: 1573271 - RNA, 22 nt, Pseudomonas putida KT2440
uguugccacccagaucaucauc

SEQ ID NO: 1573272 - RNA, 16 nt, Pseudomonas putida KT2440
uguucguaggucaggu

SEQ ID NO: 1573273 - RNA, 18 nt, Pseudomonas putida KT2440
uguucguaggucaggucg

SEQ ID NO: 1573274 - RNA, 17 nt, Pseudomonas putida KT2440
uguucugcccggcugga

SEQ ID NO: 1573275 - RNA, 22 nt, Pseudomonas putida KT2440
uuaaccggcccugaaggccgcu

SEQ ID NO: 1573276 - RNA, 12 nt, Pseudomonas putida KT2440
uuaaugcacgcc

SEQ ID NO: 1573277 - RNA, 19 nt, Pseudomonas putida KT2440
uuacccgcgaagaggcccu

SEQ ID NO: 1573278 - RNA, 22 nt, Pseudomonas putida KT2440
uuacccgcgaagaggccggcaa

SEQ ID NO: 1573279 - RNA, 22 nt, Pseudomonas putida KT2440
uuacccaagcacaaggccacug

SEQ ID NO: 1573280 - RNA, 21 nt, Pseudomonas putida KT2440
uuacggacccuaucggcacug

SEQ ID NO: 1573281 - RNA, 16 nt, Pseudomonas putida KT2440
uuacgcggcagcagca

SEQ ID NO: 1573282 - RNA, 20 nt, Pseudomonas putida KT2440
uguucgcgggugaacccgcu

SEQ ID NO: 1573283 - RNA, 16 nt, Pseudomonas putida KT2440
uguucggugcucaggc

SEQ ID NO: 1573284 - RNA, 22 nt, Pseudomonas putida KT2440
uguucaaccggaaucugcucgg

SEQ ID NO: 1573285 - RNA, 16 nt, Pseudomonas putida KT2440
uguggggcaacugcgc

SEQ ID NO: 1573286 - RNA, 20 nt, Pseudomonas putida KT2440
ugugggagcaggcaugcccg

SEQ ID NO: 1573287 - RNA, 20 nt, Pseudomonas putida KT2440
ugugggagcggccuuguguc

SEQ ID NO: 1573288 - RNA, 20 nt, Pseudomonas putida KT2440
ugugggagcgggacugcccg

SEQ ID NO: 1573289 - RNA, 20 nt, Pseudomonas putida KT2440
ugugggagcgggcaugcccg

SEQ ID NO: 1573290 - RNA, 20 nt, Pseudomonas putida KT2440
ugugggagcgggcgugcccg

SEQ ID NO: 1573291 - RNA, 14 nt, Pseudomonas putida KT2440
ugugggagcgggcu

SEQ ID NO: 1573292 - RNA, 13 nt, Pseudomonas putida KT2440
ugugggagcgggg

SEQ ID NO: 1573293 - RNA, 13 nt, Pseudomonas putida KT2440
ugugcuggcgcgc

SEQ ID NO: 1573294 - RNA, 15 nt, Pseudomonas putida KT2440
uguggccaauggcga

SEQ ID NO: 1573295 - RNA, 19 nt, Pseudomonas putida KT2440
uguggcaauugcacccgcg

SEQ ID NO: 1573296 - RNA, 18 nt, Pseudomonas putida KT2440
uguggcagcggcuuggcc

SEQ ID NO: 1573297 - RNA, 18 nt, Pseudomonas putida KT2440
uguggaacagccuugugc

SEQ ID NO: 1573298 - RNA, 20 nt, Pseudomonas putida KT2440
uguggaagcgggcgugcccg

SEQ ID NO: 1573299 - RNA, 21 nt, Pseudomonas putida KT2440
ugugcggccaaugcacgccug

SEQ ID NO: 1573300 - RNA, 21 nt, Pseudomonas putida KT2440
ugugccgcucguacuggucga

SEQ ID NO: 1573301 - RNA, 20 nt, Pseudomonas putida KT2440
ugugccgcuuuggcagcagc

SEQ ID NO: 1573302 - RNA, 17 nt, Pseudomonas putida KT2440
ugugcccuugaacggcc

SEQ ID NO: 1573303 - RNA, 19 nt, Pseudomonas putida KT2440
ugugccaccuucagcgggu

SEQ ID NO: 1573304 - RNA, 15 nt, Pseudomonas putida KT2440
ugucacccuugguca

SEQ ID NO: 1573305 - RNA, 18 nt, Pseudomonas putida KT2440
ugucacccagcacuucgu

SEQ ID NO: 1573306 - RNA, 18 nt, Pseudomonas putida KT2440
ugucagccgccgcugcga

SEQ ID NO: 1573307 - RNA, 20 nt, Pseudomonas putida KT2440
ugucagcagcuucagccagg

SEQ ID NO: 1573308 - RNA, 15 nt, Pseudomonas putida KT2440
ugugaggccuucagc

SEQ ID NO: 1573309 - RNA, 14 nt, Pseudomonas putida KT2440
ugugcaucagcgug

SEQ ID NO: 1573310 - RNA, 16 nt, Pseudomonas putida KT2440
ugugauuuccagcguc

SEQ ID NO: 1573311 - RNA, 15 nt, Pseudomonas putida KT2440
ugugcagcacuucga

SEQ ID NO: 1573312 - RNA, 13 nt, Pseudomonas putida KT2440
ugugcaacagcgc

SEQ ID NO: 1573313 - RNA, 23 nt, Pseudomonas putida KT2440
ugucugccgcuucguccagguag

SEQ ID NO: 1573314 - RNA, 20 nt, Pseudomonas putida KT2440
ugucugccaguucaugcagc

SEQ ID NO: 1573315 - RNA, 18 nt, Pseudomonas putida KT2440
ugugaagccagggcaagc

SEQ ID NO: 1573316 - RNA, 21 nt, Pseudomonas putida KT2440
ugugaaacgaguggaucaacc

SEQ ID NO: 1573317 - RNA, 17 nt, Pseudomonas putida KT2440
ugucuuuacgcauugcc

SEQ ID NO: 1573318 - RNA, 22 nt, Pseudomonas putida KT2440
ugcugcagaaccgccagcacca

SEQ ID NO: 1573319 - RNA, 15 nt, Pseudomonas putida KT2440
ugcugaguccgccac

SEQ ID NO: 1573320 - RNA, 18 nt, Pseudomonas putida KT2440
ugcucgcucaggcucuug

SEQ ID NO: 1573321 - RNA, 22 nt, Pseudomonas putida KT2440
ugcucgcgggccuggagcaagg

SEQ ID NO: 1573322 - RNA, 22 nt, Pseudomonas putida KT2440
ugcucgacaagccgcugggcuu

SEQ ID NO: 1573323 - RNA, 18 nt, Pseudomonas putida KT2440
ugcucgcgcaugaucgcu

SEQ ID NO: 1573324 - RNA, 13 nt, Pseudomonas putida KT2440
ugcucaggcucag

SEQ ID NO: 1573325 - RNA, 16 nt, Pseudomonas putida KT2440
ugcguucaccggcacc

SEQ ID NO: 1573326 - RNA, 18 nt, Pseudomonas putida KT2440
ugcuccgcgaggcucuug

SEQ ID NO: 1573327 - RNA, 12 nt, Pseudomonas putida KT2440
ugcuccagcgug

SEQ ID NO: 1573328 - RNA, 19 nt, Pseudomonas putida KT2440
ugcuccaugggcaggccca

SEQ ID NO: 1573329 - RNA, 22 nt, Pseudomonas putida KT2440
ugcucccacaggggaucgcgca

SEQ ID NO: 1573330 - RNA, 16 nt, Pseudomonas putida KT2440
ugcucaucugcgccag

SEQ ID NO: 1573331 - RNA, 14 nt, Pseudomonas putida KT2440
ugcuccaccugcca

SEQ ID NO: 1573332 - RNA, 19 nt, Pseudomonas putida KT2440
uggaacaggauggcaaagc

SEQ ID NO: 1573333 - RNA, 15 nt, Pseudomonas putida KT2440
uggaaauuggccagc

SEQ ID NO: 1573334 - RNA, 13 nt, Pseudomonas putida KT2440
uggaaauguucaa

SEQ ID NO: 1573335 - RNA, 14 nt, Pseudomonas putida KT2440
ugcuuugcgggcau

SEQ ID NO: 1573336 - RNA, 13 nt, Pseudomonas putida KT2440
uggaaaacagcgc

SEQ ID NO: 1573337 - RNA, 16 nt, Pseudomonas putida KT2440
ugcuugcggaacaccc

SEQ ID NO: 1573338 - RNA, 14 nt, Pseudomonas putida KT2440
ugcuugagcgcagc

SEQ ID NO: 1573339 - RNA, 15 nt, Pseudomonas putida KT2440
ugcuugguaccgucg

SEQ ID NO: 1573340 - RNA, 18 nt, Pseudomonas putida KT2440
ugcugcucauacugcuga

SEQ ID NO: 1573341 - RNA, 15 nt, Pseudomonas putida KT2440
ugcugcgucagcauc

SEQ ID NO: 1573342 - RNA, 18 nt, Pseudomonas putida KT2440
ugcugcgguaccggccag

SEQ ID NO: 1573343 - RNA, 18 nt, Pseudomonas putida KT2440
ugcugcgccucgcaggua

SEQ ID NO: 1573344 - RNA, 15 nt, Pseudomonas putida KT2440
ugcugcgccaggauc

SEQ ID NO: 1573345 - RNA, 18 nt, Pseudomonas putida KT2440
ugcuggcaauccagcgug

SEQ ID NO: 1573346 - RNA, 14 nt, Pseudomonas putida KT2440
ugcugugcacugcg

SEQ ID NO: 1573347 - RNA, 14 nt, Pseudomonas putida KT2440
ugcuggaacugcug

SEQ ID NO: 1573348 - RNA, 16 nt, Pseudomonas putida KT2440
ugcuuccagcugucau

SEQ ID NO: 1573349 - RNA, 13 nt, Pseudomonas putida KT2440
ugcuuccaggucg

SEQ ID NO: 1573350 - RNA, 14 nt, Pseudomonas putida KT2440
ugcuucgcgggcac

SEQ ID NO: 1573351 - RNA, 18 nt, Pseudomonas putida KT2440
ugcuguguuaccagucca

SEQ ID NO: 1573352 - RNA, 16 nt, Pseudomonas putida KT2440
ugcggcguauacccgg

SEQ ID NO: 1573353 - RNA, 19 nt, Pseudomonas putida KT2440
ugcggcucuguuucugccc

SEQ ID NO: 1573354 - RNA, 22 nt, Pseudomonas putida KT2440
ugcggcucuguuucugccccug

SEQ ID NO: 1573355 - RNA, 19 nt, Pseudomonas putida KT2440
ugcgggaccagcaccaccu

SEQ ID NO: 1573356 - RNA, 15 nt, Pseudomonas putida KT2440
ugcggcugaauccua

SEQ ID NO: 1573357 - RNA, 19 nt, Pseudomonas putida KT2440
ugcggcccuucgcgggcac

SEQ ID NO: 1573358 - RNA, 23 nt, Pseudomonas putida KT2440
ugcggccccuuccgaccggucau

SEQ ID NO: 1573359 - RNA, 15 nt, Pseudomonas putida KT2440
ugcggcaagcucagg

SEQ ID NO: 1573360 - RNA, 22 nt, Pseudomonas putida KT2440
ugcggcaaucgggaucaugccg

SEQ ID NO: 1573361 - RNA, 15 nt, Pseudomonas putida KT2440
ugcgcuuugcguggc

SEQ ID NO: 1573362 - RNA, 18 nt, Pseudomonas putida KT2440
ugcgcuuugcguggcacc

SEQ ID NO: 1573363 - RNA, 16 nt, Pseudomonas putida KT2440
ugcgccgucaccagcg

SEQ ID NO: 1573364 - RNA, 17 nt, Pseudomonas putida KT2440
ugcgcuugagcaggucg

SEQ ID NO: 1573365 - RNA, 15 nt, Pseudomonas putida KT2440
ugcgccuccagcagc

SEQ ID NO: 1573366 - RNA, 16 nt, Pseudomonas putida KT2440
ugcgccuccagcagcg

SEQ ID NO: 1573367 - RNA, 16 nt, Pseudomonas putida KT2440
ugcgcuucauccagcg

SEQ ID NO: 1573368 - RNA, 15 nt, Pseudomonas putida KT2440
ugcggucaucaccac

SEQ ID NO: 1573369 - RNA, 14 nt, Pseudomonas putida KT2440
ugcgggccggcacg

SEQ ID NO: 1573370 - RNA, 16 nt, Pseudomonas putida KT2440
ugcgggcccuggucau

SEQ ID NO: 1573371 - RNA, 16 nt, Pseudomonas putida KT2440
ugcggggcaucgccga

SEQ ID NO: 1573372 - RNA, 17 nt, Pseudomonas putida KT2440
ugcggggcauucggcga

SEQ ID NO: 1573373 - RNA, 21 nt, Pseudomonas putida KT2440
ugcggucgggucgcugccgug

SEQ ID NO: 1573374 - RNA, 15 nt, Pseudomonas putida KT2440
ugcgguccgcccuug

SEQ ID NO: 1573375 - RNA, 18 nt, Pseudomonas putida KT2440
ugcggugaccgaggcgaa

SEQ ID NO: 1573376 - RNA, 18 nt, Pseudomonas putida KT2440
ugcgguuugcucugacac

SEQ ID NO: 1573377 - RNA, 22 nt, Pseudomonas putida KT2440
ugcgccaggaucaacugccgcg

SEQ ID NO: 1573378 - RNA, 20 nt, Pseudomonas putida KT2440
ugcgccaucagaggcgaugg

SEQ ID NO: 1573379 - RNA, 22 nt, Pseudomonas putida KT2440
ugcgccaucagaggcgauggca

SEQ ID NO: 1573380 - RNA, 15 nt, Pseudomonas putida KT2440
ugcgccccccaggcg

SEQ ID NO: 1573381 - RNA, 17 nt, Pseudomonas putida KT2440
ugcgcccgcacagcacg

SEQ ID NO: 1573382 - RNA, 19 nt, Pseudomonas putida KT2440
ugcgccccgguacgacgca

SEQ ID NO: 1573383 - RNA, 21 nt, Pseudomonas putida KT2440
ugcgccgaucaggaaggccuu

SEQ ID NO: 1573384 - RNA, 18 nt, Pseudomonas putida KT2440
ugcgccgggacagcacca

SEQ ID NO: 1573385 - RNA, 22 nt, Pseudomonas putida KT2440
ugcgcccggcgcugaucagcug

SEQ ID NO: 1573386 - RNA, 12 nt, Pseudomonas putida KT2440
ugcgcccggcaa

SEQ ID NO: 1573387 - RNA, 22 nt, Pseudomonas putida KT2440
ugcgccccacuuccagcgacaa

SEQ ID NO: 1573388 - RNA, 15 nt, Pseudomonas putida KT2440
ugcgcccggccaggu

SEQ ID NO: 1573389 - RNA, 17 nt, Pseudomonas putida KT2440
ugcgcccggccagguca

SEQ ID NO: 1573390 - RNA, 16 nt, Pseudomonas putida KT2440
ugcgccacacccgcua

SEQ ID NO: 1573391 - RNA, 22 nt, Pseudomonas putida KT2440
ugcgcacguuggccggguuuac

SEQ ID NO: 1573392 - RNA, 16 nt, Pseudomonas putida KT2440
ugcgcacguaggcggg

SEQ ID NO: 1573393 - RNA, 15 nt, Pseudomonas putida KT2440
ugcgcacggccucca

SEQ ID NO: 1573394 - RNA, 21 nt, Pseudomonas putida KT2440
ugcgcacggccuccaccaccu

SEQ ID NO: 1573395 - RNA, 14 nt, Pseudomonas putida KT2440
ugcgcacgcugccc

SEQ ID NO: 1573396 - RNA, 23 nt, Pseudomonas putida KT2440
ugcgcacggaaggcaucgaacuc

SEQ ID NO: 1573397 - RNA, 18 nt, Pseudomonas putida KT2440
ugcgcacgaagaucaccg

SEQ ID NO: 1573398 - RNA, 22 nt, Pseudomonas putida KT2440
ugcgcacgaagaucaccgacaa

SEQ ID NO: 1573399 - RNA, 19 nt, Pseudomonas putida KT2440
ugcgcaccaaggcggcaua

SEQ ID NO: 1573400 - RNA, 15 nt, Pseudomonas putida KT2440
ugcgccagccgcuca

SEQ ID NO: 1573401 - RNA, 17 nt, Pseudomonas putida KT2440
ugcgccagccgcucagc

SEQ ID NO: 1573402 - RNA, 17 nt, Pseudomonas putida KT2440
ugcgccaggauggcuuu

SEQ ID NO: 1573403 - RNA, 12 nt, Pseudomonas putida KT2440
ugcgccaggcau

SEQ ID NO: 1573404 - RNA, 22 nt, Pseudomonas putida KT2440
ugcgccaggcauuccccgguca

SEQ ID NO: 1573405 - RNA, 17 nt, Pseudomonas putida KT2440
ugcgaugggcugcaaag

SEQ ID NO: 1573406 - RNA, 15 nt, Pseudomonas putida KT2440
ugcgcaagcaaccgg

SEQ ID NO: 1573407 - RNA, 13 nt, Pseudomonas putida KT2440
ugcgcaaucccug

SEQ ID NO: 1573408 - RNA, 16 nt, Pseudomonas putida KT2440
ugcgcaauccuugccc

SEQ ID NO: 1573409 - RNA, 17 nt, Pseudomonas putida KT2440
ugcgcaauccuugcccu

SEQ ID NO: 1573410 - RNA, 15 nt, Pseudomonas putida KT2440
ugcgcaaccgauagc

SEQ ID NO: 1573411 - RNA, 20 nt, Pseudomonas putida KT2440
ugcgagacgcaaaaaacccg

SEQ ID NO: 1573412 - RNA, 21 nt, Pseudomonas putida KT2440
ugcgauggaggcgccgggcuc

SEQ ID NO: 1573413 - RNA, 14 nt, Pseudomonas putida KT2440
ugcgagcgaacagc

SEQ ID NO: 1573414 - RNA, 18 nt, Pseudomonas putida KT2440
ugccugucgucagcucag

SEQ ID NO: 1573415 - RNA, 13 nt, Pseudomonas putida KT2440
ugccugugucgaa

SEQ ID NO: 1573416 - RNA, 18 nt, Pseudomonas putida KT2440
ugccuuccucggccaugc

SEQ ID NO: 1573417 - RNA, 14 nt, Pseudomonas putida KT2440
ugccuuccgccauu

SEQ ID NO: 1573418 - RNA, 12 nt, Pseudomonas putida KT2440
ugccuugcccug

SEQ ID NO: 1573419 - RNA, 24 nt, Pseudomonas putida KT2440
ugccuugcgauaccccgcugccug

SEQ ID NO: 1573420 - RNA, 17 nt, Pseudomonas putida KT2440
ugccuuuuuuugccgca

SEQ ID NO: 1573421 - RNA, 22 nt, Pseudomonas putida KT2440
ugcgaaacccccggaaugcccg

SEQ ID NO: 1573422 - RNA, 22 nt, Pseudomonas putida KT2440
ugcgaaacgaaacccugcuggg

SEQ ID NO: 1573423 - RNA, 18 nt, Pseudomonas putida KT2440
ugcgaagaggccccgaca

SEQ ID NO: 1573424 - RNA, 21 nt, Pseudomonas putida KT2440
ugcgaagaggccccgacagca

SEQ ID NO: 1573425 - RNA, 14 nt, Pseudomonas putida KT2440
ugccgcugcgcggu

SEQ ID NO: 1573426 - RNA, 15 nt, Pseudomonas putida KT2440
ugccgcugcgcggua

SEQ ID NO: 1573427 - RNA, 16 nt, Pseudomonas putida KT2440
ugccgcucaucgaggc

SEQ ID NO: 1573428 - RNA, 15 nt, Pseudomonas putida KT2440
ugccgcgugcgaugu

SEQ ID NO: 1573429 - RNA, 16 nt, Pseudomonas putida KT2440
ugccgaaccaccgaug

SEQ ID NO: 1573430 - RNA, 14 nt, Pseudomonas putida KT2440
ugcccuucacuggg

SEQ ID NO: 1573431 - RNA, 16 nt, Pseudomonas putida KT2440
ugccgcuuuggcagca

SEQ ID NO: 1573432 - RNA, 22 nt, Pseudomonas putida KT2440
ugccggaaaacugcgugucaag

SEQ ID NO: 1573433 - RNA, 14 nt, Pseudomonas putida KT2440
ugccgcuucgcgga

SEQ ID NO: 1573434 - RNA, 21 nt, Pseudomonas putida KT2440
ugccgcuucgcggaacucggc

SEQ ID NO: 1573435 - RNA, 12 nt, Pseudomonas putida KT2440
ugccggcaccgu

SEQ ID NO: 1573436 - RNA, 20 nt, Pseudomonas putida KT2440
ugccggcaacgauacccacg

SEQ ID NO: 1573437 - RNA, 15 nt, Pseudomonas putida KT2440
ugccggcccaaggca

SEQ ID NO: 1573438 - RNA, 14 nt, Pseudomonas putida KT2440
ugccggccagcggc

SEQ ID NO: 1573439 - RNA, 13 nt, Pseudomonas putida KT2440
ugccggccagcgg

SEQ ID NO: 1573440 - RNA, 17 nt, Pseudomonas putida KT2440
ugccgggcaaagcgggu

SEQ ID NO: 1573441 - RNA, 19 nt, Pseudomonas putida KT2440
ugccgggccaccaccgcgu

SEQ ID NO: 1573442 - RNA, 17 nt, Pseudomonas putida KT2440
ugccgguaccgccacca

SEQ ID NO: 1573443 - RNA, 14 nt, Pseudomonas putida KT2440
ugccggucggccug

SEQ ID NO: 1573444 - RNA, 12 nt, Pseudomonas putida KT2440
ugccguccgcug

SEQ ID NO: 1573445 - RNA, 18 nt, Pseudomonas putida KT2440
ugccgucgagcaggucga

SEQ ID NO: 1573446 - RNA, 23 nt, Pseudomonas putida KT2440
uggacagcagcuugaacaacggc

SEQ ID NO: 1573447 - RNA, 23 nt, Pseudomonas putida KT2440
uggacagcggcagcaucgaccug

SEQ ID NO: 1573448 - RNA, 16 nt, Pseudomonas putida KT2440
uggccaaaccguccag

SEQ ID NO: 1573449 - RNA, 18 nt, Pseudomonas putida KT2440
uggccaaaccguccaggu

SEQ ID NO: 1573450 - RNA, 13 nt, Pseudomonas putida KT2440
uggcauuggcgug

SEQ ID NO: 1573451 - RNA, 15 nt, Pseudomonas putida KT2440
uggacaaucucggca

SEQ ID NO: 1573452 - RNA, 15 nt, Pseudomonas putida KT2440
uggacaccucccgcg

SEQ ID NO: 1573453 - RNA, 23 nt, Pseudomonas putida KT2440
uggaauucgcugcgcaucacccg

SEQ ID NO: 1573454 - RNA, 20 nt, Pseudomonas putida KT2440
uggccaccaucgccggcacg

SEQ ID NO: 1573455 - RNA, 22 nt, Pseudomonas putida KT2440
uggccaccacguagugcuucug

SEQ ID NO: 1573456 - RNA, 13 nt, Pseudomonas putida KT2440
uggccaacggcau

SEQ ID NO: 1573457 - RNA, 20 nt, Pseudomonas putida KT2440
uggccaacggcaucacgcug

SEQ ID NO: 1573458 - RNA, 24 nt, Pseudomonas putida KT2440
uggccaacggcaucacgcuggcca

SEQ ID NO: 1573459 - RNA, 21 nt, Pseudomonas putida KT2440
uggccaacuccccacccaggu

SEQ ID NO: 1573460 - RNA, 20 nt, Pseudomonas putida KT2440
uggccaagccaccgccacca

SEQ ID NO: 1573461 - RNA, 13 nt, Pseudomonas putida KT2440
uggccaaggccuc

SEQ ID NO: 1573462 - RNA, 21 nt, Pseudomonas putida KT2440
uggccaaggccucuaccgcug

SEQ ID NO: 1573463 - RNA, 19 nt, Pseudomonas putida KT2440
uggccacacgcugcugcug

SEQ ID NO: 1573464 - RNA, 15 nt, Pseudomonas putida KT2440
uggccaauaccgcug

SEQ ID NO: 1573465 - RNA, 18 nt, Pseudomonas putida KT2440
uggccagggugcgggcgu

SEQ ID NO: 1573466 - RNA, 22 nt, Pseudomonas putida KT2440
uggccaguuccuggcacucucg

SEQ ID NO: 1573467 - RNA, 18 nt, Pseudomonas putida KT2440
uggccagcucauccagcc

SEQ ID NO: 1573468 - RNA, 19 nt, Pseudomonas putida KT2440
uggccagcucauccagccg

SEQ ID NO: 1573469 - RNA, 16 nt, Pseudomonas putida KT2440
uggccaggaacagcgc

SEQ ID NO: 1573470 - RNA, 15 nt, Pseudomonas putida KT2440
uggccagacgaugau

SEQ ID NO: 1573471 - RNA, 24 nt, Pseudomonas putida KT2440
uggccagagcgcgccacgcaccag

SEQ ID NO: 1573472 - RNA, 17 nt, Pseudomonas putida KT2440
uggccagaaacggcggc

SEQ ID NO: 1573473 - RNA, 19 nt, Pseudomonas putida KT2440
uggccacuguugcagcgcc

SEQ ID NO: 1573474 - RNA, 18 nt, Pseudomonas putida KT2440
uggccgccaugaucugcc

SEQ ID NO: 1573475 - RNA, 16 nt, Pseudomonas putida KT2440
uggccgcguucgccca

SEQ ID NO: 1573476 - RNA, 14 nt, Pseudomonas putida KT2440
uggccgcaggccca

SEQ ID NO: 1573477 - RNA, 16 nt, Pseudomonas putida KT2440
uggccgccaacagcgc

SEQ ID NO: 1573478 - RNA, 20 nt, Pseudomonas putida KT2440
uggccgaugcccaccuuggc

SEQ ID NO: 1573479 - RNA, 23 nt, Pseudomonas putida KT2440
uggccgagcaggagcugaacugc

SEQ ID NO: 1573480 - RNA, 16 nt, Pseudomonas putida KT2440
uggccgagcugauccg

SEQ ID NO: 1573481 - RNA, 15 nt, Pseudomonas putida KT2440
uggccaugaucgccg

SEQ ID NO: 1573482 - RNA, 16 nt, Pseudomonas putida KT2440
uggccauguugucgaa

SEQ ID NO: 1573483 - RNA, 17 nt, Pseudomonas putida KT2440
uggcccaugacguucuu

SEQ ID NO: 1573484 - RNA, 17 nt, Pseudomonas putida KT2440
uggcccaugaucgcggc

SEQ ID NO: 1573485 - RNA, 16 nt, Pseudomonas putida KT2440
uggcccggucccgcug

SEQ ID NO: 1573486 - RNA, 22 nt, Pseudomonas putida KT2440
uggcccgcgaugccgacagcca

SEQ ID NO: 1573487 - RNA, 12 nt, Pseudomonas putida KT2440
uggcccgcgcca

SEQ ID NO: 1573488 - RNA, 22 nt, Pseudomonas putida KT2440
uggcccgccaguaggcugcagc

SEQ ID NO: 1573489 - RNA, 16 nt, Pseudomonas putida KT2440
uggcccucugcguggu

SEQ ID NO: 1573490 - RNA, 20 nt, Pseudomonas putida KT2440
uggcccugaccgcggugcug

SEQ ID NO: 1573491 - RNA, 22 nt, Pseudomonas putida KT2440
uggccgcugaaccucaccgccg

SEQ ID NO: 1573492 - RNA, 17 nt, Pseudomonas putida KT2440
uggccggcuuggcaccu

SEQ ID NO: 1573493 - RNA, 17 nt, Pseudomonas putida KT2440
uggcgaguagaagcuug

SEQ ID NO: 1573494 - RNA, 22 nt, Pseudomonas putida KT2440
uggcgaguagaagcuuggggcg

SEQ ID NO: 1573495 - RNA, 14 nt, Pseudomonas putida KT2440
uggcgagugccggg

SEQ ID NO: 1573496 - RNA, 19 nt, Pseudomonas putida KT2440
uggcgaaggcugccuggcc

SEQ ID NO: 1573497 - RNA, 22 nt, Pseudomonas putida KT2440
uggcgaucaggcaggccagcac

SEQ ID NO: 1573498 - RNA, 23 nt, Pseudomonas putida KT2440
uggcgaucucugcuuccuugcgc

SEQ ID NO: 1573499 - RNA, 16 nt, Pseudomonas putida KT2440
uggcgaugaacacgcc

SEQ ID NO: 1573500 - RNA, 15 nt, Pseudomonas putida KT2440
uggcgaugaacugcc

SEQ ID NO: 1573501 - RNA, 18 nt, Pseudomonas putida KT2440
uggcgauugggccgcaca

SEQ ID NO: 1573502 - RNA, 17 nt, Pseudomonas putida KT2440
uggcgcggcuggucgcc

SEQ ID NO: 1573503 - RNA, 21 nt, Pseudomonas putida KT2440
uggcgccugcggcaucagggc

SEQ ID NO: 1573504 - RNA, 22 nt, Pseudomonas putida KT2440
uggcgcaaauugcccggccagc

SEQ ID NO: 1573505 - RNA, 19 nt, Pseudomonas putida KT2440
uggcgcggugauggcgcau

SEQ ID NO: 1573506 - RNA, 20 nt, Pseudomonas putida KT2440
uggcgcuggaucuugcugaa

SEQ ID NO: 1573507 - RNA, 22 nt, Pseudomonas putida KT2440
uggcgcuaccccuguaggagcg

SEQ ID NO: 1573508 - RNA, 13 nt, Pseudomonas putida KT2440
uggcggcgccugc

SEQ ID NO: 1573509 - RNA, 17 nt, Pseudomonas putida KT2440
uggcgcuugaucagccu

SEQ ID NO: 1573510 - RNA, 18 nt, Pseudomonas putida KT2440
uggcgcuuucacuggcga

SEQ ID NO: 1573511 - RNA, 14 nt, Pseudomonas putida KT2440
uggcggcugcccgu

SEQ ID NO: 1573512 - RNA, 16 nt, Pseudomonas putida KT2440
uggcgucauccugcgc

SEQ ID NO: 1573513 - RNA, 16 nt, Pseudomonas putida KT2440
uggcgucgacgaugau

SEQ ID NO: 1573514 - RNA, 19 nt, Pseudomonas putida KT2440
uggcgucgaugaucaccug

SEQ ID NO: 1573515 - RNA, 17 nt, Pseudomonas putida KT2440
uggcgucggcgauggcg

SEQ ID NO: 1573516 - RNA, 17 nt, Pseudomonas putida KT2440
ugggccccaggcggugc

SEQ ID NO: 1573517 - RNA, 19 nt, Pseudomonas putida KT2440
ugggcgagcaggugacccu

SEQ ID NO: 1573518 - RNA, 19 nt, Pseudomonas putida KT2440
ugggcgcuuugcacccgcg

SEQ ID NO: 1573519 - RNA, 23 nt, Pseudomonas putida KT2440
ugggcgaugaucgcggcguuguc

SEQ ID NO: 1573520 - RNA, 19 nt, Pseudomonas putida KT2440
uggggucugcuuugcagcc

SEQ ID NO: 1573521 - RNA, 11 nt, Pseudomonas putida KT2440
uggggugagcg

SEQ ID NO: 1573522 - RNA, 13 nt, Pseudomonas putida KT2440
uggggugagcgaa

SEQ ID NO: 1573523 - RNA, 15 nt, Pseudomonas putida KT2440
ugggggaucucuucg

SEQ ID NO: 1573524 - RNA, 14 nt, Pseudomonas putida KT2440
ugggggugaagccc

SEQ ID NO: 1573525 - RNA, 17 nt, Pseudomonas putida KT2440
uggggccugccgguaca

SEQ ID NO: 1573526 - RNA, 22 nt, Pseudomonas putida KT2440
uggggcugcaccgcagccccag

SEQ ID NO: 1573527 - RNA, 23 nt, Pseudomonas putida KT2440
uggguugaucucuucggccaguu

SEQ ID NO: 1573528 - RNA, 16 nt, Pseudomonas putida KT2440
ugguagggaaauccuc

SEQ ID NO: 1573529 - RNA, 15 nt, Pseudomonas putida KT2440
ugggugcuguggcgc

SEQ ID NO: 1573530 - RNA, 22 nt, Pseudomonas putida KT2440
ugggugccaucagggcgaugcg

SEQ ID NO: 1573531 - RNA, 16 nt, Pseudomonas putida KT2440
ugggugccgcggaugu

SEQ ID NO: 1573532 - RNA, 17 nt, Pseudomonas putida KT2440
ugggcgggccgccgaac

SEQ ID NO: 1573533 - RNA, 22 nt, Pseudomonas putida KT2440
ugggcgggccgccgaacaggcc

SEQ ID NO: 1573534 - RNA, 18 nt, Pseudomonas putida KT2440
ugggcggggugaucgaca

SEQ ID NO: 1573535 - RNA, 20 nt, Pseudomonas putida KT2440
ugggcgucaaccaaugucga

SEQ ID NO: 1573536 - RNA, 18 nt, Pseudomonas putida KT2440
ugggcugcaaagcagccc

SEQ ID NO: 1573537 - RNA, 19 nt, Pseudomonas putida KT2440
ugggcucagccgccacaug

SEQ ID NO: 1573538 - RNA, 17 nt, Pseudomonas putida KT2440
uggggccgcgucgcggc

SEQ ID NO: 1573539 - RNA, 19 nt, Pseudomonas putida KT2440
uggggccgcucugcggccc

SEQ ID NO: 1573540 - RNA, 17 nt, Pseudomonas putida KT2440
ugggcuucgacaaccgg

SEQ ID NO: 1573541 - RNA, 12 nt, Pseudomonas putida KT2440
ugggcuguucgc

SEQ ID NO: 1573542 - RNA, 13 nt, Pseudomonas putida KT2440
uguaggcgcgggu

SEQ ID NO: 1573543 - RNA, 14 nt, Pseudomonas putida KT2440
uguaguagcuccag

SEQ ID NO: 1573544 - RNA, 23 nt, Pseudomonas putida KT2440
uguagcgggucacugcgcgccgu

SEQ ID NO: 1573545 - RNA, 20 nt, Pseudomonas putida KT2440
uguaggagcgggcuuacccg

SEQ ID NO: 1573546 - RNA, 23 nt, Pseudomonas putida KT2440
uguaggagcgggcuuacccgcga

SEQ ID NO: 1573547 - RNA, 13 nt, Pseudomonas putida KT2440
uguaggagcgggu

SEQ ID NO: 1573548 - RNA, 20 nt, Pseudomonas putida KT2440
uguaggagcggguuuacccg

SEQ ID NO: 1573549 - RNA, 23 nt, Pseudomonas putida KT2440
uguaggagcggguuuacccgcga

SEQ ID NO: 1573550 - RNA, 20 nt, Pseudomonas putida KT2440
uguaggaucggguuuacccg

SEQ ID NO: 1573551 - RNA, 20 nt, Pseudomonas putida KT2440
uguagcgccuggccugcaga

SEQ ID NO: 1573552 - RNA, 18 nt, Pseudomonas putida KT2440
uguagccgcuuucgguca

SEQ ID NO: 1573553 - RNA, 19 nt, Pseudomonas putida KT2440
uguagauauugaccagcga

SEQ ID NO: 1573554 - RNA, 14 nt, Pseudomonas putida KT2440
uguacgccagguga

SEQ ID NO: 1573555 - RNA, 19 nt, Pseudomonas putida KT2440
uguacucaggggcauugcg

SEQ ID NO: 1573556 - RNA, 22 nt, Pseudomonas putida KT2440
uguacacagcccaaggcuggcc

SEQ ID NO: 1573557 - RNA, 20 nt, Pseudomonas putida KT2440
uguacaacgcagccggcacc

SEQ ID NO: 1573558 - RNA, 21 nt, Pseudomonas putida KT2440
ugguugaucaacugugccugg

SEQ ID NO: 1573559 - RNA, 16 nt, Pseudomonas putida KT2440
ugguuugacgcugcuc

SEQ ID NO: 1573560 - RNA, 14 nt, Pseudomonas putida KT2440
uggugcucagcggc

SEQ ID NO: 1573561 - RNA, 11 nt, Pseudomonas putida KT2440
uggugcuggcg

SEQ ID NO: 1573562 - RNA, 18 nt, Pseudomonas putida KT2440
ugguggcaaugccaugcc

SEQ ID NO: 1573563 - RNA, 12 nt, Pseudomonas putida KT2440
ugguggcggcau

SEQ ID NO: 1573564 - RNA, 18 nt, Pseudomonas putida KT2440
uggugcggcugggcccca

SEQ ID NO: 1573565 - RNA, 16 nt, Pseudomonas putida KT2440
uggugcccuugaugau

SEQ ID NO: 1573566 - RNA, 22 nt, Pseudomonas putida KT2440
uggugcaauggucauugaaggc

SEQ ID NO: 1573567 - RNA, 22 nt, Pseudomonas putida KT2440
ugguccccauagcuuuccagca

SEQ ID NO: 1573568 - RNA, 18 nt, Pseudomonas putida KT2440
ugguccccuucgucgaug

SEQ ID NO: 1573569 - RNA, 19 nt, Pseudomonas putida KT2440
ugguccgaggucagcacca

SEQ ID NO: 1573570 - RNA, 14 nt, Pseudomonas putida KT2440
uggugaaucagccc

SEQ ID NO: 1573571 - RNA, 19 nt, Pseudomonas putida KT2440
uggugaauggcgagcccgg

SEQ ID NO: 1573572 - RNA, 17 nt, Pseudomonas putida KT2440
uggucauugaaggccag

SEQ ID NO: 1573573 - RNA, 18 nt, Pseudomonas putida KT2440
uggucauugaaggccagu

SEQ ID NO: 1573574 - RNA, 21 nt, Pseudomonas putida KT2440
ugguccagcguucggccagca

SEQ ID NO: 1573575 - RNA, 19 nt, Pseudomonas putida KT2440
ugguccacgguucuggcag

SEQ ID NO: 1573576 - RNA, 18 nt, Pseudomonas putida KT2440
ugguaugaugcgcggcau

SEQ ID NO: 1573577 - RNA, 18 nt, Pseudomonas putida KT2440
aaauucaccugccgggca

SEQ ID NO: 1573578 - RNA, 23 nt, Pseudomonas putida KT2440
aaauuggccagcaggucaggccc

SEQ ID NO: 1573579 - RNA, 17 nt, Pseudomonas putida KT2440
aaauuggcgagcaggcc

SEQ ID NO: 1573580 - RNA, 22 nt, Pseudomonas putida KT2440
aaaagcccacucaauacucgcu

SEQ ID NO: 1573581 - RNA, 20 nt, Pseudomonas putida KT2440
aacaggauggcaaagcgcag

SEQ ID NO: 1573582 - RNA, 13 nt, Pseudomonas putida KT2440
aacagcuugccau

SEQ ID NO: 1573583 - RNA, 14 nt, Pseudomonas putida KT2440
aacagcuggcgcau

SEQ ID NO: 1573584 - RNA, 15 nt, Pseudomonas putida KT2440
aacaggcuggccgac

SEQ ID NO: 1573585 - RNA, 22 nt, Pseudomonas putida KT2440
aacaggcugaugcgcuggcccu

SEQ ID NO: 1573586 - RNA, 16 nt, Pseudomonas putida KT2440
aacagguucucggcac

SEQ ID NO: 1573587 - RNA, 15 nt, Pseudomonas putida KT2440
aacagguucgacagu

SEQ ID NO: 1573588 - RNA, 19 nt, Pseudomonas putida KT2440
aacagcccggugaagucac

SEQ ID NO: 1573589 - RNA, 11 nt, Pseudomonas putida KT2440
aacagccuugu

SEQ ID NO: 1573590 - RNA, 16 nt, Pseudomonas putida KT2440
aacagccuugucucaa

SEQ ID NO: 1573591 - RNA, 14 nt, Pseudomonas putida KT2440
aacagcuccagcag

SEQ ID NO: 1573592 - RNA, 14 nt, Pseudomonas putida KT2440
aacagcugaucgcc

SEQ ID NO: 1573593 - RNA, 13 nt, Pseudomonas putida KT2440
aacagcugccggg

SEQ ID NO: 1573594 - RNA, 16 nt, Pseudomonas putida KT2440
aaaagccgcuggcccu

SEQ ID NO: 1573595 - RNA, 16 nt, Pseudomonas putida KT2440
aacaagcgcgacuggu

SEQ ID NO: 1573596 - RNA, 17 nt, Pseudomonas putida KT2440
aacagaacgccuuguuc

SEQ ID NO: 1573597 - RNA, 13 nt, Pseudomonas putida KT2440
aacagcaggcaaa

SEQ ID NO: 1573598 - RNA, 22 nt, Pseudomonas putida KT2440
aacagcaggcaaagaaugccgc

SEQ ID NO: 1573599 - RNA, 19 nt, Pseudomonas putida KT2440
aacagcaguugcugcugcc

SEQ ID NO: 1573600 - RNA, 15 nt, Pseudomonas putida KT2440
aacagcaccggccag

SEQ ID NO: 1573601 - RNA, 21 nt, Pseudomonas putida KT2440
aaacuucucgccucagcgcca

SEQ ID NO: 1573602 - RNA, 19 nt, Pseudomonas putida KT2440
aaccauuggugaaagcgca

SEQ ID NO: 1573603 - RNA, 22 nt, Pseudomonas putida KT2440
aaccaugcgccgcugcuccaug

SEQ ID NO: 1573604 - RNA, 15 nt, Pseudomonas putida KT2440
aacccgcgccuacaa

SEQ ID NO: 1573605 - RNA, 13 nt, Pseudomonas putida KT2440
aacccagccagcg

SEQ ID NO: 1573606 - RNA, 13 nt, Pseudomonas putida KT2440
aacccccacaggg

SEQ ID NO: 1573607 - RNA, 16 nt, Pseudomonas putida KT2440
aaccccacgccuguuu

SEQ ID NO: 1573608 - RNA, 14 nt, Pseudomonas putida KT2440
aacccggccagcag

SEQ ID NO: 1573609 - RNA, 23 nt, Pseudomonas putida KT2440
aacccgcuccuacagggguagcg

SEQ ID NO: 1573610 - RNA, 17 nt, Pseudomonas putida KT2440
aacccgguucgccacgg

SEQ ID NO: 1573611 - RNA, 20 nt, Pseudomonas putida KT2440
aacccgguucgccacgguac

SEQ ID NO: 1573612 - RNA, 17 nt, Pseudomonas putida KT2440
aacccuucggccagcag

SEQ ID NO: 1573613 - RNA, 23 nt, Pseudomonas putida KT2440
aacccuuuuaucugguugccgcc

SEQ ID NO: 1573614 - RNA, 17 nt, Pseudomonas putida KT2440
aaccgaacccgcuggcg

SEQ ID NO: 1573615 - RNA, 20 nt, Pseudomonas putida KT2440
aacccgucagugcucggcaa

SEQ ID NO: 1573616 - RNA, 11 nt, Pseudomonas putida KT2440
aaccgacccug

SEQ ID NO: 1573617 - RNA, 23 nt, Pseudomonas putida KT2440
aaccgccagccaaccgcgugcuu

SEQ ID NO: 1573618 - RNA, 18 nt, Pseudomonas putida KT2440
aacaugaaagugacaggu

SEQ ID NO: 1573619 - RNA, 18 nt, Pseudomonas putida KT2440
aaccaauuacuuggccug

SEQ ID NO: 1573620 - RNA, 18 nt, Pseudomonas putida KT2440
aaccagcccgccgccagu

SEQ ID NO: 1573621 - RNA, 18 nt, Pseudomonas putida KT2440
aaccacacagaugccgcc

SEQ ID NO: 1573622 - RNA, 22 nt, Pseudomonas putida KT2440
aaccacacagaugccgccgcug

SEQ ID NO: 1573623 - RNA, 22 nt, Pseudomonas putida KT2440
aaccacaucggcgcgcccuccu

SEQ ID NO: 1573624 - RNA, 21 nt, Pseudomonas putida KT2440
aaccacgccugcgccgcucgu

SEQ ID NO: 1573625 - RNA, 16 nt, Pseudomonas putida KT2440
aaccaccgaugcugug

SEQ ID NO: 1573626 - RNA, 12 nt, Pseudomonas putida KT2440
aacgcaccgacc

SEQ ID NO: 1573627 - RNA, 17 nt, Pseudomonas putida KT2440
aacgauucugccagcuc

SEQ ID NO: 1573628 - RNA, 16 nt, Pseudomonas putida KT2440
aacgccgagcauuaca

SEQ ID NO: 1573629 - RNA, 21 nt, Pseudomonas putida KT2440
aacgccgagcauuacaggcag

SEQ ID NO: 1573630 - RNA, 14 nt, Pseudomonas putida KT2440
aacgcauccaggcg

SEQ ID NO: 1573631 - RNA, 15 nt, Pseudomonas putida KT2440
aacgaaaucugccug

SEQ ID NO: 1573632 - RNA, 17 nt, Pseudomonas putida KT2440
aacgaaaucugccugcu

SEQ ID NO: 1573633 - RNA, 14 nt, Pseudomonas putida KT2440
aacgaucagcgccg

SEQ ID NO: 1573634 - RNA, 18 nt, Pseudomonas putida KT2440
aacgaugcccgggccuuc

SEQ ID NO: 1573635 - RNA, 22 nt, Pseudomonas putida KT2440
aaccgccccaccacauccgacc

SEQ ID NO: 1573636 - RNA, 23 nt, Pseudomonas putida KT2440
aacgaaaaaaagggcaccuccag

SEQ ID NO: 1573637 - RNA, 17 nt, Pseudomonas putida KT2440
aacgguaauggccggcu

SEQ ID NO: 1573638 - RNA, 20 nt, Pseudomonas putida KT2440
aacgguaauggccggcugug

SEQ ID NO: 1573639 - RNA, 15 nt, Pseudomonas putida KT2440
aacggugaacggcgg

SEQ ID NO: 1573640 - RNA, 17 nt, Pseudomonas putida KT2440
aacggugcugccgaggc

SEQ ID NO: 1573641 - RNA, 18 nt, Pseudomonas putida KT2440
aacgucgccacgcgggcu

SEQ ID NO: 1573642 - RNA, 18 nt, Pseudomonas putida KT2440
aacgcuugcccggcucca

SEQ ID NO: 1573643 - RNA, 17 nt, Pseudomonas putida KT2440
aacggacaacaccguug

SEQ ID NO: 1573644 - RNA, 13 nt, Pseudomonas putida KT2440
aacgcgccgcugc

SEQ ID NO: 1573645 - RNA, 13 nt, Pseudomonas putida KT2440
aacggcuggcgca

SEQ ID NO: 1573646 - RNA, 23 nt, Pseudomonas putida KT2440
aacggcuguuccucgccauggcc

SEQ ID NO: 1573647 - RNA, 12 nt, Pseudomonas putida KT2440
aacggcuucaca

SEQ ID NO: 1573648 - RNA, 17 nt, Pseudomonas putida KT2440
aaucccggucaccucgc

SEQ ID NO: 1573649 - RNA, 22 nt, Pseudomonas putida KT2440
aauagucgaaggcuucguggaa

SEQ ID NO: 1573650 - RNA, 11 nt, Pseudomonas putida KT2440
aauagcggcca

SEQ ID NO: 1573651 - RNA, 22 nt, Pseudomonas putida KT2440
aaucaggucaucgaagaucagc

SEQ ID NO: 1573652 - RNA, 18 nt, Pseudomonas putida KT2440
aaucagguucagggcaau

SEQ ID NO: 1573653 - RNA, 19 nt, Pseudomonas putida KT2440
aaucagggauacugcugaa

SEQ ID NO: 1573654 - RNA, 20 nt, Pseudomonas putida KT2440
aaucagcaugcccagcgcca

SEQ ID NO: 1573655 - RNA, 13 nt, Pseudomonas putida KT2440
aaucagcaaaccg

SEQ ID NO: 1573656 - RNA, 15 nt, Pseudomonas putida KT2440
aauccggcaacuggc

SEQ ID NO: 1573657 - RNA, 20 nt, Pseudomonas putida KT2440
aauccuccugcgcaugcaac

SEQ ID NO: 1573658 - RNA, 12 nt, Pseudomonas putida KT2440
aauccugcugag

SEQ ID NO: 1573659 - RNA, 17 nt, Pseudomonas putida KT2440
aaucgaccagggccuug

SEQ ID NO: 1573660 - RNA, 15 nt, Pseudomonas putida KT2440
aaucgccgggcgcac

SEQ ID NO: 1573661 - RNA, 14 nt, Pseudomonas putida KT2440
aaucgccuugcguc

SEQ ID NO: 1573662 - RNA, 16 nt, Pseudomonas putida KT2440
aaucgcgcuugcgguc

SEQ ID NO: 1573663 - RNA, 20 nt, Pseudomonas putida KT2440
aaucgcgucagcaccggcag

SEQ ID NO: 1573664 - RNA, 24 nt, Pseudomonas putida KT2440
aauucaacgcgguggcuggcaccg

SEQ ID NO: 1573665 - RNA, 18 nt, Pseudomonas putida KT2440
aaucugcucgacgaaggu

SEQ ID NO: 1573666 - RNA, 16 nt, Pseudomonas putida KT2440
aauggccuuggccauc

SEQ ID NO: 1573667 - RNA, 13 nt, Pseudomonas putida KT2440
aaugucgagcaug

SEQ ID NO: 1573668 - RNA, 15 nt, Pseudomonas putida KT2440
aaguccaucaccggc

SEQ ID NO: 1573669 - RNA, 22 nt, Pseudomonas putida KT2440
aaguccuucaucugucagcgcc

SEQ ID NO: 1573670 - RNA, 15 nt, Pseudomonas putida KT2440
aagucgaccagcagc

SEQ ID NO: 1573671 - RNA, 17 nt, Pseudomonas putida KT2440
aagucgauuuucacgcc

SEQ ID NO: 1573672 - RNA, 22 nt, Pseudomonas putida KT2440
aauaccgauggccccgcccagg

SEQ ID NO: 1573673 - RNA, 17 nt, Pseudomonas putida KT2440
aagucaaccucaacgcc

SEQ ID NO: 1573674 - RNA, 17 nt, Pseudomonas putida KT2440
aaguagaacuggcgcag

SEQ ID NO: 1573675 - RNA, 16 nt, Pseudomonas putida KT2440
aaguacuugcaggugc

SEQ ID NO: 1573676 - RNA, 16 nt, Pseudomonas putida KT2440
aaguacggcuugccgg

SEQ ID NO: 1573677 - RNA, 13 nt, Pseudomonas putida KT2440
aagguaaccuggu

SEQ ID NO: 1573678 - RNA, 19 nt, Pseudomonas putida KT2440
aaggggccggcacaggcuu

SEQ ID NO: 1573679 - RNA, 15 nt, Pseudomonas putida KT2440
aaguaacggccacgg

SEQ ID NO: 1573680 - RNA, 13 nt, Pseudomonas putida KT2440
aaggcgcugucga

SEQ ID NO: 1573681 - RNA, 15 nt, Pseudomonas putida KT2440
aaggcguaccggcaa

SEQ ID NO: 1573682 - RNA, 15 nt, Pseudomonas putida KT2440
aaggcguauuugacc

SEQ ID NO: 1573683 - RNA, 14 nt, Pseudomonas putida KT2440
aagggccgccaagc

SEQ ID NO: 1573684 - RNA, 16 nt, Pseudomonas putida KT2440
aagcuugccagcgucu

SEQ ID NO: 1573685 - RNA, 13 nt, Pseudomonas putida KT2440
aagaguucguaca

SEQ ID NO: 1573686 - RNA, 17 nt, Pseudomonas putida KT2440
aagaggcagcgaaagca

SEQ ID NO: 1573687 - RNA, 17 nt, Pseudomonas putida KT2440
aagaggccccgacagca

SEQ ID NO: 1573688 - RNA, 23 nt, Pseudomonas putida KT2440
aagcaccgcgcacacuucgccgg

SEQ ID NO: 1573689 - RNA, 19 nt, Pseudomonas putida KT2440
aagauguguugucugugcc

SEQ ID NO: 1573690 - RNA, 15 nt, Pseudomonas putida KT2440
aagaucacugcgcag

SEQ ID NO: 1573691 - RNA, 20 nt, Pseudomonas putida KT2440
aagaucgguacaugcgaacg

SEQ ID NO: 1573692 - RNA, 20 nt, Pseudomonas putida KT2440
aagcccauggcuggcagcac

SEQ ID NO: 1573693 - RNA, 24 nt, Pseudomonas putida KT2440
aagcccgaagcuaucgccagcagg

SEQ ID NO: 1573694 - RNA, 18 nt, Pseudomonas putida KT2440
aagcccccggaugcgcaa

SEQ ID NO: 1573695 - RNA, 22 nt, Pseudomonas putida KT2440
aagcgacgugcaaggaucacca

SEQ ID NO: 1573696 - RNA, 13 nt, Pseudomonas putida KT2440
aagccuuuggccg

SEQ ID NO: 1573697 - RNA, 23 nt, Pseudomonas putida KT2440
aagcccgcuccuacaggggaugc

SEQ ID NO: 1573698 - RNA, 21 nt, Pseudomonas putida KT2440
aagcccgccccaauggcgaac

SEQ ID NO: 1573699 - RNA, 23 nt, Pseudomonas putida KT2440
aagcccggccaggugccgggcuu

SEQ ID NO: 1573700 - RNA, 12 nt, Pseudomonas putida KT2440
aagccugcacca

SEQ ID NO: 1573701 - RNA, 23 nt, Pseudomonas putida KT2440
aagccuucgucgcuggccagcuu

SEQ ID NO: 1573702 - RNA, 14 nt, Pseudomonas putida KT2440
aagcggccuaguuc

SEQ ID NO: 1573703 - RNA, 16 nt, Pseudomonas putida KT2440
aagcgcgcgcccaccg

SEQ ID NO: 1573704 - RNA, 21 nt, Pseudomonas putida KT2440
aagcucaucaccaggcccgca

SEQ ID NO: 1573705 - RNA, 22 nt, Pseudomonas putida KT2440
aagcuaaacgaguuucucgcaa

SEQ ID NO: 1573706 - RNA, 19 nt, Pseudomonas putida KT2440
aagcugcgcucgauccugu

SEQ ID NO: 1573707 - RNA, 14 nt, Pseudomonas putida KT2440
accccguacacccg

SEQ ID NO: 1573708 - RNA, 20 nt, Pseudomonas putida KT2440
accccuccuucagguaaucc

SEQ ID NO: 1573709 - RNA, 17 nt, Pseudomonas putida KT2440
accccgccuguuggcac

SEQ ID NO: 1573710 - RNA, 11 nt, Pseudomonas putida KT2440
accccgggcac

SEQ ID NO: 1573711 - RNA, 21 nt, Pseudomonas putida KT2440
accccauaacgcccacguuca

SEQ ID NO: 1573712 - RNA, 19 nt, Pseudomonas putida KT2440
accccgccccugcuugacc

SEQ ID NO: 1573713 - RNA, 15 nt, Pseudomonas putida KT2440
accccgccgcuggcu

SEQ ID NO: 1573714 - RNA, 16 nt, Pseudomonas putida KT2440
accccgaugcgcugau

SEQ ID NO: 1573715 - RNA, 17 nt, Pseudomonas putida KT2440
accccgaugcgcugauc

SEQ ID NO: 1573716 - RNA, 15 nt, Pseudomonas putida KT2440
accccaggugcugau

SEQ ID NO: 1573717 - RNA, 19 nt, Pseudomonas putida KT2440
accccaggccacugguaca

SEQ ID NO: 1573718 - RNA, 21 nt, Pseudomonas putida KT2440
accccauagggccagcggcuu

SEQ ID NO: 1573719 - RNA, 16 nt, Pseudomonas putida KT2440
accccauguggcgcag

SEQ ID NO: 1573720 - RNA, 12 nt, Pseudomonas putida KT2440
accccuugcggg

SEQ ID NO: 1573721 - RNA, 17 nt, Pseudomonas putida KT2440
accccuuuacuggccau

SEQ ID NO: 1573722 - RNA, 16 nt, Pseudomonas putida KT2440
accccuucaucaccca

SEQ ID NO: 1573723 - RNA, 15 nt, Pseudomonas putida KT2440
accccuucauccgcg

SEQ ID NO: 1573724 - RNA, 15 nt, Pseudomonas putida KT2440
accccuuccagcuuc

SEQ ID NO: 1573725 - RNA, 19 nt, Pseudomonas putida KT2440
accccugcagagcucagcg

SEQ ID NO: 1573726 - RNA, 22 nt, Pseudomonas putida KT2440
acccgcacgaacagcggcaauu

SEQ ID NO: 1573727 - RNA, 15 nt, Pseudomonas putida KT2440
acccgaccagaucag

SEQ ID NO: 1573728 - RNA, 14 nt, Pseudomonas putida KT2440
accccagcccgaag

SEQ ID NO: 1573729 - RNA, 15 nt, Pseudomonas putida KT2440
accccagcaaggcaa

SEQ ID NO: 1573730 - RNA, 14 nt, Pseudomonas putida KT2440
acccaguucgcgga

SEQ ID NO: 1573731 - RNA, 16 nt, Pseudomonas putida KT2440
accccaccagcacugc

SEQ ID NO: 1573732 - RNA, 16 nt, Pseudomonas putida KT2440
accccaccccagcguu

SEQ ID NO: 1573733 - RNA, 15 nt, Pseudomonas putida KT2440
acccagguacgaagc

SEQ ID NO: 1573734 - RNA, 20 nt, Pseudomonas putida KT2440
acccagguacgaagccaugu

SEQ ID NO: 1573735 - RNA, 21 nt, Pseudomonas putida KT2440
acccaggcccugacgccagcg

SEQ ID NO: 1573736 - RNA, 15 nt, Pseudomonas putida KT2440
acccaguacggcgcc

SEQ ID NO: 1573737 - RNA, 20 nt, Pseudomonas putida KT2440
acccagcacgaaggccagca

SEQ ID NO: 1573738 - RNA, 14 nt, Pseudomonas putida KT2440
acccagcaggccga

SEQ ID NO: 1573739 - RNA, 17 nt, Pseudomonas putida KT2440
accaggcccaacagcgc

SEQ ID NO: 1573740 - RNA, 20 nt, Pseudomonas putida KT2440
accaggcccgcuauccucga

SEQ ID NO: 1573741 - RNA, 21 nt, Pseudomonas putida KT2440
accaggacuucccggcaccgc

SEQ ID NO: 1573742 - RNA, 23 nt, Pseudomonas putida KT2440
accaggacuucccggcaccgcuu

SEQ ID NO: 1573743 - RNA, 21 nt, Pseudomonas putida KT2440
accaggauugccgggcuacgc

SEQ ID NO: 1573744 - RNA, 15 nt, Pseudomonas putida KT2440
accaggacaagccga

SEQ ID NO: 1573745 - RNA, 20 nt, Pseudomonas putida KT2440
accagcuugugaucccgcga

SEQ ID NO: 1573746 - RNA, 14 nt, Pseudomonas putida KT2440
acccaaggcaucca

SEQ ID NO: 1573747 - RNA, 16 nt, Pseudomonas putida KT2440
acccaauagcccaccg

SEQ ID NO: 1573748 - RNA, 18 nt, Pseudomonas putida KT2440
acccaauagcccaccguc

SEQ ID NO: 1573749 - RNA, 14 nt, Pseudomonas putida KT2440
acccaaccugccga

SEQ ID NO: 1573750 - RNA, 14 nt, Pseudomonas putida KT2440
acccacaagcgcag

SEQ ID NO: 1573751 - RNA, 19 nt, Pseudomonas putida KT2440
acccacagagacaccgcag

SEQ ID NO: 1573752 - RNA, 22 nt, Pseudomonas putida KT2440
acccguuccuacgcaggcaccg

SEQ ID NO: 1573753 - RNA, 23 nt, Pseudomonas putida KT2440
acccguuccuacgcaggcaccgc

SEQ ID NO: 1573754 - RNA, 20 nt, Pseudomonas putida KT2440
acccuacgaacaaauccgcg

SEQ ID NO: 1573755 - RNA, 12 nt, Pseudomonas putida KT2440
acccucacgcgc

SEQ ID NO: 1573756 - RNA, 16 nt, Pseudomonas putida KT2440
acccucacgcgccagg

SEQ ID NO: 1573757 - RNA, 18 nt, Pseudomonas putida KT2440
acccucacgcgccagguc

SEQ ID NO: 1573758 - RNA, 22 nt, Pseudomonas putida KT2440
acccugacucaugccuucggug

SEQ ID NO: 1573759 - RNA, 18 nt, Pseudomonas putida KT2440
acccugagggagcgggcu

SEQ ID NO: 1573760 - RNA, 20 nt, Pseudomonas putida KT2440
acccugagggagcgggcuug

SEQ ID NO: 1573761 - RNA, 14 nt, Pseudomonas putida KT2440
acccugaaucagca

SEQ ID NO: 1573762 - RNA, 16 nt, Pseudomonas putida KT2440
acccgugcucuucacc

SEQ ID NO: 1573763 - RNA, 18 nt, Pseudomonas putida KT2440
acccgugcccggcauccg

SEQ ID NO: 1573764 - RNA, 21 nt, Pseudomonas putida KT2440
acccguccaguuccggcaggu

SEQ ID NO: 1573765 - RNA, 22 nt, Pseudomonas putida KT2440
acccugcuauaucucugguaca

SEQ ID NO: 1573766 - RNA, 22 nt, Pseudomonas putida KT2440
acccugucgaucacgggcaaug

SEQ ID NO: 1573767 - RNA, 22 nt, Pseudomonas putida KT2440
accgaaaucagcaacgccacca

SEQ ID NO: 1573768 - RNA, 23 nt, Pseudomonas putida KT2440
acccuuuaggggcucuucgcggg

SEQ ID NO: 1573769 - RNA, 14 nt, Pseudomonas putida KT2440
acccggcuggucga

SEQ ID NO: 1573770 - RNA, 21 nt, Pseudomonas putida KT2440
acccgggcccgcuugcgcggu

SEQ ID NO: 1573771 - RNA, 16 nt, Pseudomonas putida KT2440
acccgggcagcgggcu

SEQ ID NO: 1573772 - RNA, 11 nt, Pseudomonas putida KT2440
acccggucagg

SEQ ID NO: 1573773 - RNA, 17 nt, Pseudomonas putida KT2440
acccgguccugguccga

SEQ ID NO: 1573774 - RNA, 21 nt, Pseudomonas putida KT2440
acccgguaaaaccgcucgaac

SEQ ID NO: 1573775 - RNA, 20 nt, Pseudomonas putida KT2440
acccggccuuucgcgccagu

SEQ ID NO: 1573776 - RNA, 20 nt, Pseudomonas putida KT2440
acccggcagaaucagguuca

SEQ ID NO: 1573777 - RNA, 15 nt, Pseudomonas putida KT2440
acccggcagccaccg

SEQ ID NO: 1573778 - RNA, 15 nt, Pseudomonas putida KT2440
acccggccaaguaca

SEQ ID NO: 1573779 - RNA, 20 nt, Pseudomonas putida KT2440
acccgcaggcgacgagccag

SEQ ID NO: 1573780 - RNA, 20 nt, Pseudomonas putida KT2440
accgcgacgaccgcacuccc

SEQ ID NO: 1573781 - RNA, 14 nt, Pseudomonas putida KT2440
accgcgcgccaguu

SEQ ID NO: 1573782 - RNA, 14 nt, Pseudomonas putida KT2440
accgcgccggucac

SEQ ID NO: 1573783 - RNA, 18 nt, Pseudomonas putida KT2440
accgcucgacguuuaccu

SEQ ID NO: 1573784 - RNA, 13 nt, Pseudomonas putida KT2440
accgcucgaacaa

SEQ ID NO: 1573785 - RNA, 19 nt, Pseudomonas putida KT2440
accgcucaagucugcauag

SEQ ID NO: 1573786 - RNA, 23 nt, Pseudomonas putida KT2440
accgcuaugccaagccacuggcc

SEQ ID NO: 1573787 - RNA, 23 nt, Pseudomonas putida KT2440
accgcgucauacucuucgcgggc

SEQ ID NO: 1573788 - RNA, 14 nt, Pseudomonas putida KT2440
accgcggcugacga

SEQ ID NO: 1573789 - RNA, 15 nt, Pseudomonas putida KT2440
accgccccggccagu

SEQ ID NO: 1573790 - RNA, 13 nt, Pseudomonas putida KT2440
accgccgccacca

SEQ ID NO: 1573791 - RNA, 19 nt, Pseudomonas putida KT2440
accgccgggugggugaaga

SEQ ID NO: 1573792 - RNA, 17 nt, Pseudomonas putida KT2440
accgccgcccacgccgg

SEQ ID NO: 1573793 - RNA, 15 nt, Pseudomonas putida KT2440
accgccgcccagguc

SEQ ID NO: 1573794 - RNA, 15 nt, Pseudomonas putida KT2440
accgagaucucggua

SEQ ID NO: 1573795 - RNA, 13 nt, Pseudomonas putida KT2440
accgagaugaucg

SEQ ID NO: 1573796 - RNA, 22 nt, Pseudomonas putida KT2440
accgagaugaucgcggcaauca

SEQ ID NO: 1573797 - RNA, 22 nt, Pseudomonas putida KT2440
accgagcacucggcggcgaaga

SEQ ID NO: 1573798 - RNA, 19 nt, Pseudomonas putida KT2440
accgagcccggguugaccu

SEQ ID NO: 1573799 - RNA, 12 nt, Pseudomonas putida KT2440
accgagcgccgc

SEQ ID NO: 1573800 - RNA, 23 nt, Pseudomonas putida KT2440
accgcauucuuggccaggauggc

SEQ ID NO: 1573801 - RNA, 13 nt, Pseudomonas putida KT2440
accgccaggucca

SEQ ID NO: 1573802 - RNA, 20 nt, Pseudomonas putida KT2440
accgccagguccaggcugcg

SEQ ID NO: 1573803 - RNA, 13 nt, Pseudomonas putida KT2440
accgccccaagcg

SEQ ID NO: 1573804 - RNA, 13 nt, Pseudomonas putida KT2440
accgccccagcgc

SEQ ID NO: 1573805 - RNA, 23 nt, Pseudomonas putida KT2440
accgccaugagcaauacauccag

SEQ ID NO: 1573806 - RNA, 14 nt, Pseudomonas putida KT2440
accgccauggccag

SEQ ID NO: 1573807 - RNA, 13 nt, Pseudomonas putida KT2440
accgccauucguc

SEQ ID NO: 1573808 - RNA, 21 nt, Pseudomonas putida KT2440
accgccauugacuaccaggua

SEQ ID NO: 1573809 - RNA, 23 nt, Pseudomonas putida KT2440
accgccauugacuaccagguagc

SEQ ID NO: 1573810 - RNA, 17 nt, Pseudomonas putida KT2440
accgggauacugcgcac

SEQ ID NO: 1573811 - RNA, 14 nt, Pseudomonas putida KT2440
accgggaagcaggu

SEQ ID NO: 1573812 - RNA, 16 nt, Pseudomonas putida KT2440
accggcuuguagccgg

SEQ ID NO: 1573813 - RNA, 15 nt, Pseudomonas putida KT2440
accggcugcgccggu

SEQ ID NO: 1573814 - RNA, 22 nt, Pseudomonas putida KT2440
accggcuucgucggcgcggaau

SEQ ID NO: 1573815 - RNA, 23 nt, Pseudomonas putida KT2440
accggcgccaaucaucgccagca

SEQ ID NO: 1573816 - RNA, 14 nt, Pseudomonas putida KT2440
accggcacugcaca

SEQ ID NO: 1573817 - RNA, 13 nt, Pseudomonas putida KT2440
accggcagcagca

SEQ ID NO: 1573818 - RNA, 14 nt, Pseudomonas putida KT2440
accggcagcagcaa

SEQ ID NO: 1573819 - RNA, 15 nt, Pseudomonas putida KT2440
accggcauagcgcaa

SEQ ID NO: 1573820 - RNA, 20 nt, Pseudomonas putida KT2440
accggcauucccggcgccau

SEQ ID NO: 1573821 - RNA, 21 nt, Pseudomonas putida KT2440
accggcauucccggcgccaug

SEQ ID NO: 1573822 - RNA, 13 nt, Pseudomonas putida KT2440
accggcagcgcaa

SEQ ID NO: 1573823 - RNA, 20 nt, Pseudomonas putida KT2440
accggcaguacauagaacag

SEQ ID NO: 1573824 - RNA, 14 nt, Pseudomonas putida KT2440
accggcagugcgaa

SEQ ID NO: 1573825 - RNA, 15 nt, Pseudomonas putida KT2440
accggcagugcgaaa

SEQ ID NO: 1573826 - RNA, 14 nt, Pseudomonas putida KT2440
accggcagagccgg

SEQ ID NO: 1573827 - RNA, 14 nt, Pseudomonas putida KT2440
accggcgaagacgg

SEQ ID NO: 1573828 - RNA, 19 nt, Pseudomonas putida KT2440
accggccuuuucgcgggca

SEQ ID NO: 1573829 - RNA, 23 nt, Pseudomonas putida KT2440
accggccuugccgcuggcgauga

SEQ ID NO: 1573830 - RNA, 20 nt, Pseudomonas putida KT2440
accggccuugcgcaaggcaa

SEQ ID NO: 1573831 - RNA, 18 nt, Pseudomonas putida KT2440
accggccuuggccagcuc

SEQ ID NO: 1573832 - RNA, 19 nt, Pseudomonas putida KT2440
accggccucuucgcgggca

SEQ ID NO: 1573833 - RNA, 20 nt, Pseudomonas putida KT2440
accggccucuucgcgggcaa

SEQ ID NO: 1573834 - RNA, 17 nt, Pseudomonas putida KT2440
accggcccugaaggccg

SEQ ID NO: 1573835 - RNA, 19 nt, Pseudomonas putida KT2440
accggccgacccgccuggu

SEQ ID NO: 1573836 - RNA, 19 nt, Pseudomonas putida KT2440
accggccccccagccagca

SEQ ID NO: 1573837 - RNA, 23 nt, Pseudomonas putida KT2440
accggccaccaggcgcggcagca

SEQ ID NO: 1573838 - RNA, 16 nt, Pseudomonas putida KT2440
accggccaagcgccgg

SEQ ID NO: 1573839 - RNA, 17 nt, Pseudomonas putida KT2440
accggccaagcgccggu

SEQ ID NO: 1573840 - RNA, 16 nt, Pseudomonas putida KT2440
accggccacgaaggcc

SEQ ID NO: 1573841 - RNA, 15 nt, Pseudomonas putida KT2440
accggccacgcgcag

SEQ ID NO: 1573842 - RNA, 16 nt, Pseudomonas putida KT2440
accggccacgcgcagu

SEQ ID NO: 1573843 - RNA, 17 nt, Pseudomonas putida KT2440
accggccacgcgcaguu

SEQ ID NO: 1573844 - RNA, 12 nt, Pseudomonas putida KT2440
accggccagcac

SEQ ID NO: 1573845 - RNA, 23 nt, Pseudomonas putida KT2440
accaccuucucacugaugucguu

SEQ ID NO: 1573846 - RNA, 15 nt, Pseudomonas putida KT2440
accacgaccggcuca

SEQ ID NO: 1573847 - RNA, 22 nt, Pseudomonas putida KT2440
accacgaugccuucgaccacca

SEQ ID NO: 1573848 - RNA, 17 nt, Pseudomonas putida KT2440
accacgcccgccggcac

SEQ ID NO: 1573849 - RNA, 23 nt, Pseudomonas putida KT2440
accacgcccgccggcacuuccuc

SEQ ID NO: 1573850 - RNA, 15 nt, Pseudomonas putida KT2440
accaccguuacgccg

SEQ ID NO: 1573851 - RNA, 23 nt, Pseudomonas putida KT2440
accacgccaccaugcucggccag

SEQ ID NO: 1573852 - RNA, 13 nt, Pseudomonas putida KT2440
accacgccgcugc

SEQ ID NO: 1573853 - RNA, 15 nt, Pseudomonas putida KT2440
accacggaaggccac

SEQ ID NO: 1573854 - RNA, 18 nt, Pseudomonas putida KT2440
accacggucggccugcgc

SEQ ID NO: 1573855 - RNA, 13 nt, Pseudomonas putida KT2440
accacgguaccgg

SEQ ID NO: 1573856 - RNA, 16 nt, Pseudomonas putida KT2440
accacguagugcuucu

SEQ ID NO: 1573857 - RNA, 21 nt, Pseudomonas putida KT2440
accacaggcgcuugaagaagc

SEQ ID NO: 1573858 - RNA, 18 nt, Pseudomonas putida KT2440
accacagcugcgccagcc

SEQ ID NO: 1573859 - RNA, 16 nt, Pseudomonas putida KT2440
accaauggcaaucgcc

SEQ ID NO: 1573860 - RNA, 17 nt, Pseudomonas putida KT2440
accaauggcaaucgccu

SEQ ID NO: 1573861 - RNA, 22 nt, Pseudomonas putida KT2440
accacacagaugccgccgcugc

SEQ ID NO: 1573862 - RNA, 19 nt, Pseudomonas putida KT2440
accacaucacgaucaugcu

SEQ ID NO: 1573863 - RNA, 20 nt, Pseudomonas putida KT2440
accacauggccguucuugau

SEQ ID NO: 1573864 - RNA, 19 nt, Pseudomonas putida KT2440
accacauccgaccccagca

SEQ ID NO: 1573865 - RNA, 13 nt, Pseudomonas putida KT2440
accagcaacggcc

SEQ ID NO: 1573866 - RNA, 14 nt, Pseudomonas putida KT2440
accagcaacggccg

SEQ ID NO: 1573867 - RNA, 21 nt, Pseudomonas putida KT2440
accagauucgccaaggccucg

SEQ ID NO: 1573868 - RNA, 19 nt, Pseudomonas putida KT2440
accagcagcaguggcaagc

SEQ ID NO: 1573869 - RNA, 17 nt, Pseudomonas putida KT2440
accagcaggcugcgugc

SEQ ID NO: 1573870 - RNA, 21 nt, Pseudomonas putida KT2440
accagcaggucggcacgcacc

SEQ ID NO: 1573871 - RNA, 23 nt, Pseudomonas putida KT2440
accagcaugcgaagccgccagcg

SEQ ID NO: 1573872 - RNA, 18 nt, Pseudomonas putida KT2440
accagaaacccagggcag

SEQ ID NO: 1573873 - RNA, 19 nt, Pseudomonas putida KT2440
accagaaauggucgcgggc

SEQ ID NO: 1573874 - RNA, 13 nt, Pseudomonas putida KT2440
accagacgcaggc

SEQ ID NO: 1573875 - RNA, 22 nt, Pseudomonas putida KT2440
accagaccuggaggucauguga

SEQ ID NO: 1573876 - RNA, 18 nt, Pseudomonas putida KT2440
accacguuauccagcugc

SEQ ID NO: 1573877 - RNA, 18 nt, Pseudomonas putida KT2440
accacuggaugacgccgc

SEQ ID NO: 1573878 - RNA, 19 nt, Pseudomonas putida KT2440
accacuggaugacgccgca

SEQ ID NO: 1573879 - RNA, 14 nt, Pseudomonas putida KT2440
accacugcaggugc

SEQ ID NO: 1573880 - RNA, 19 nt, Pseudomonas putida KT2440
accacuucaagcacgccga

SEQ ID NO: 1573881 - RNA, 17 nt, Pseudomonas putida KT2440
accacuuccaacacccg

SEQ ID NO: 1573882 - RNA, 14 nt, Pseudomonas putida KT2440
accacuaucgccag

SEQ ID NO: 1573883 - RNA, 15 nt, Pseudomonas putida KT2440
accacuaucgccaga

SEQ ID NO: 1573884 - RNA, 15 nt, Pseudomonas putida KT2440
accacguccggccag

SEQ ID NO: 1573885 - RNA, 18 nt, Pseudomonas putida KT2440
accacguccggccagcaa

SEQ ID NO: 1573886 - RNA, 14 nt, Pseudomonas putida KT2440
accagccccagcgc

SEQ ID NO: 1573887 - RNA, 22 nt, Pseudomonas putida KT2440
accagccggcaauuuccugcgc

SEQ ID NO: 1573888 - RNA, 23 nt, Pseudomonas putida KT2440
accagcccggcuccgcgcaagcg

SEQ ID NO: 1573889 - RNA, 17 nt, Pseudomonas putida KT2440
accagcgacugcaagcg

SEQ ID NO: 1573890 - RNA, 13 nt, Pseudomonas putida KT2440
accagcgccagcc

SEQ ID NO: 1573891 - RNA, 21 nt, Pseudomonas putida KT2440
accagcucacgcaagcggccc

SEQ ID NO: 1573892 - RNA, 19 nt, Pseudomonas putida KT2440
accagcucguucaacaccu

SEQ ID NO: 1573893 - RNA, 18 nt, Pseudomonas putida KT2440
accaaggugcuaccggcg

SEQ ID NO: 1573894 - RNA, 19 nt, Pseudomonas putida KT2440
accaaggugcuaccggcgc

SEQ ID NO: 1573895 - RNA, 21 nt, Pseudomonas putida KT2440
accaacgguaacguggacagc

SEQ ID NO: 1573896 - RNA, 12 nt, Pseudomonas putida KT2440
accaacgcagca

SEQ ID NO: 1573897 - RNA, 15 nt, Pseudomonas putida KT2440
accaacgcauuuuca

SEQ ID NO: 1573898 - RNA, 23 nt, Pseudomonas putida KT2440
acauucuccaguuguugggcagc

SEQ ID NO: 1573899 - RNA, 22 nt, Pseudomonas putida KT2440
accaaaaaaagccccgccaguu

SEQ ID NO: 1573900 - RNA, 18 nt, Pseudomonas putida KT2440
acaucgugaagcaccgcc

SEQ ID NO: 1573901 - RNA, 18 nt, Pseudomonas putida KT2440
acaucgguuucgccggug

SEQ ID NO: 1573902 - RNA, 15 nt, Pseudomonas putida KT2440
acaucggccaccgcc

SEQ ID NO: 1573903 - RNA, 20 nt, Pseudomonas putida KT2440
acaucgaauuucugcaacag

SEQ ID NO: 1573904 - RNA, 14 nt, Pseudomonas putida KT2440
acauccucugcccg

SEQ ID NO: 1573905 - RNA, 17 nt, Pseudomonas putida KT2440
acauccacagccuccag

SEQ ID NO: 1573906 - RNA, 14 nt, Pseudomonas putida KT2440
acauccagcgccgc

SEQ ID NO: 1573907 - RNA, 11 nt, Pseudomonas putida KT2440
acauggcgcuu

SEQ ID NO: 1573908 - RNA, 13 nt, Pseudomonas putida KT2440
acauggaucagcu

SEQ ID NO: 1573909 - RNA, 13 nt, Pseudomonas putida KT2440
acaugcggaagca

SEQ ID NO: 1573910 - RNA, 17 nt, Pseudomonas putida KT2440
acaugcgccacacccgc

SEQ ID NO: 1573911 - RNA, 21 nt, Pseudomonas putida KT2440
acaugccggccaccacacugg

SEQ ID NO: 1573912 - RNA, 14 nt, Pseudomonas putida KT2440
acauagcuggcacu

SEQ ID NO: 1573913 - RNA, 17 nt, Pseudomonas putida KT2440
acauacuccaccgccag

SEQ ID NO: 1573914 - RNA, 23 nt, Pseudomonas putida KT2440
acauacggcuugauauccagcac

SEQ ID NO: 1573915 - RNA, 18 nt, Pseudomonas putida KT2440
acaguggguggcacgugc

SEQ ID NO: 1573916 - RNA, 22 nt, Pseudomonas putida KT2440
acauaccacacaccccagaacg

SEQ ID NO: 1573917 - RNA, 19 nt, Pseudomonas putida KT2440
acagugcgacccgcuggcc

SEQ ID NO: 1573918 - RNA, 14 nt, Pseudomonas putida KT2440
acaucacggcgcag

SEQ ID NO: 1573919 - RNA, 19 nt, Pseudomonas putida KT2440
acaucacggcgcaggccga

SEQ ID NO: 1573920 - RNA, 13 nt, Pseudomonas putida KT2440
acagggaccucac

SEQ ID NO: 1573921 - RNA, 15 nt, Pseudomonas putida KT2440
acaggggccgcgcag

SEQ ID NO: 1573922 - RNA, 14 nt, Pseudomonas putida KT2440
acagucgucggcac

SEQ ID NO: 1573923 - RNA, 21 nt, Pseudomonas putida KT2440
acagguacucgcaagcuccag

SEQ ID NO: 1573924 - RNA, 21 nt, Pseudomonas putida KT2440
acaggauggcaaagcgcagca

SEQ ID NO: 1573925 - RNA, 17 nt, Pseudomonas putida KT2440
acaggcugucggcaugc

SEQ ID NO: 1573926 - RNA, 21 nt, Pseudomonas putida KT2440
acaggcuguguggccggccau

SEQ ID NO: 1573927 - RNA, 19 nt, Pseudomonas putida KT2440
acaggcuuacaucggcgac

SEQ ID NO: 1573928 - RNA, 24 nt, Pseudomonas putida KT2440
acaggcuugaagcugcgcucgauc

SEQ ID NO: 1573929 - RNA, 14 nt, Pseudomonas putida KT2440
acaggcuggcaucg

SEQ ID NO: 1573930 - RNA, 15 nt, Pseudomonas putida KT2440
acagcgcgccgccga

SEQ ID NO: 1573931 - RNA, 22 nt, Pseudomonas putida KT2440
acagcgccuugaagcuggccgu

SEQ ID NO: 1573932 - RNA, 19 nt, Pseudomonas putida KT2440
acagcgcggaacgucguug

SEQ ID NO: 1573933 - RNA, 18 nt, Pseudomonas putida KT2440
acagcgcguuaggcgaga

SEQ ID NO: 1573934 - RNA, 19 nt, Pseudomonas putida KT2440
acagcgcuaucucggacac

SEQ ID NO: 1573935 - RNA, 20 nt, Pseudomonas putida KT2440
acagcguuuucgucaagguu

SEQ ID NO: 1573936 - RNA, 19 nt, Pseudomonas putida KT2440
acagcucacuggccaacuc

SEQ ID NO: 1573937 - RNA, 12 nt, Pseudomonas putida KT2440
acagcucgauca

SEQ ID NO: 1573938 - RNA, 13 nt, Pseudomonas putida KT2440
acagcucgaucag

SEQ ID NO: 1573939 - RNA, 16 nt, Pseudomonas putida KT2440
acagcucgauggccag

SEQ ID NO: 1573940 - RNA, 21 nt, Pseudomonas putida KT2440
acagcuccagcaacugcgccg

SEQ ID NO: 1573941 - RNA, 22 nt, Pseudomonas putida KT2440
acagcgccuggcgagaaggcgu

SEQ ID NO: 1573942 - RNA, 22 nt, Pseudomonas putida KT2440
acagcccuacgcagucagccac

SEQ ID NO: 1573943 - RNA, 14 nt, Pseudomonas putida KT2440
acagcccgggcaug

SEQ ID NO: 1573944 - RNA, 13 nt, Pseudomonas putida KT2440
acagccgcggcac

SEQ ID NO: 1573945 - RNA, 14 nt, Pseudomonas putida KT2440
acagcccaaggccu

SEQ ID NO: 1573946 - RNA, 18 nt, Pseudomonas putida KT2440
acagccccaucaccagcc

SEQ ID NO: 1573947 - RNA, 18 nt, Pseudomonas putida KT2440
acagcaucugcaccagga

SEQ ID NO: 1573948 - RNA, 13 nt, Pseudomonas putida KT2440
acagccaccgcga

SEQ ID NO: 1573949 - RNA, 20 nt, Pseudomonas putida KT2440
acaaaccgacccugcugcug

SEQ ID NO: 1573950 - RNA, 21 nt, Pseudomonas putida KT2440
acgccauccccccagcccuug

SEQ ID NO: 1573951 - RNA, 23 nt, Pseudomonas putida KT2440
acgcccagcaacugcgcccaaug

SEQ ID NO: 1573952 - RNA, 17 nt, Pseudomonas putida KT2440
acgccagggcaaucgcc

SEQ ID NO: 1573953 - RNA, 22 nt, Pseudomonas putida KT2440
acgccagggcaaucgccaaggu

SEQ ID NO: 1573954 - RNA, 23 nt, Pseudomonas putida KT2440
acgccagggcaaucgccaagguc

SEQ ID NO: 1573955 - RNA, 13 nt, Pseudomonas putida KT2440
acgccagcagcgc

SEQ ID NO: 1573956 - RNA, 17 nt, Pseudomonas putida KT2440
acgcccgcgcauagcag

SEQ ID NO: 1573957 - RNA, 13 nt, Pseudomonas putida KT2440
acgcccaucagcg

SEQ ID NO: 1573958 - RNA, 21 nt, Pseudomonas putida KT2440
acgccccgaaccuacccggua

SEQ ID NO: 1573959 - RNA, 15 nt, Pseudomonas putida KT2440
acgccccacccgcuc

SEQ ID NO: 1573960 - RNA, 22 nt, Pseudomonas putida KT2440
acgcccaggcggcgugacgugc

SEQ ID NO: 1573961 - RNA, 14 nt, Pseudomonas putida KT2440
acgcccgggccagg

SEQ ID NO: 1573962 - RNA, 17 nt, Pseudomonas putida KT2440
acgcccgguugcaccga

SEQ ID NO: 1573963 - RNA, 16 nt, Pseudomonas putida KT2440
acgccaccgaaggcgu

SEQ ID NO: 1573964 - RNA, 18 nt, Pseudomonas putida KT2440
acgccacacugucccggc

SEQ ID NO: 1573965 - RNA, 19 nt, Pseudomonas putida KT2440
acgccaccaguuccaccgg

SEQ ID NO: 1573966 - RNA, 21 nt, Pseudomonas putida KT2440
acgcauggcguuguccagcag

SEQ ID NO: 1573967 - RNA, 14 nt, Pseudomonas putida KT2440
acgcauggucacgu

SEQ ID NO: 1573968 - RNA, 22 nt, Pseudomonas putida KT2440
acgcauugccgacuccaacugg

SEQ ID NO: 1573969 - RNA, 13 nt, Pseudomonas putida KT2440
acgcauauccgca

SEQ ID NO: 1573970 - RNA, 18 nt, Pseudomonas putida KT2440
acgcaucugcaccggcag

SEQ ID NO: 1573971 - RNA, 15 nt, Pseudomonas putida KT2440
acgcaucugcaccug

SEQ ID NO: 1573972 - RNA, 21 nt, Pseudomonas putida KT2440
acgauggacagcccaaggccu

SEQ ID NO: 1573973 - RNA, 13 nt, Pseudomonas putida KT2440
acgauggccacca

SEQ ID NO: 1573974 - RNA, 17 nt, Pseudomonas putida KT2440
acgauggccaccagcac

SEQ ID NO: 1573975 - RNA, 18 nt, Pseudomonas putida KT2440
acgcagcuuccgccacca

SEQ ID NO: 1573976 - RNA, 22 nt, Pseudomonas putida KT2440
acgcagcuuccgccaccacgaa

SEQ ID NO: 1573977 - RNA, 17 nt, Pseudomonas putida KT2440
acgcaggccagcgcaca

SEQ ID NO: 1573978 - RNA, 19 nt, Pseudomonas putida KT2440
acgcagccggcaccgccau

SEQ ID NO: 1573979 - RNA, 21 nt, Pseudomonas putida KT2440
acgagauguacagaaugcgcu

SEQ ID NO: 1573980 - RNA, 16 nt, Pseudomonas putida KT2440
accuucggcgacaggu

SEQ ID NO: 1573981 - RNA, 17 nt, Pseudomonas putida KT2440
accugguucaucgacuu

SEQ ID NO: 1573982 - RNA, 18 nt, Pseudomonas putida KT2440
accugucccagcuggcaa

SEQ ID NO: 1573983 - RNA, 24 nt, Pseudomonas putida KT2440
accugugaggccuucagcgcggca

SEQ ID NO: 1573984 - RNA, 18 nt, Pseudomonas putida KT2440
accugugaagccagggca

SEQ ID NO: 1573985 - RNA, 20 nt, Pseudomonas putida KT2440
accugugaagccagggcaag

SEQ ID NO: 1573986 - RNA, 17 nt, Pseudomonas putida KT2440
accugugggagcgggcg

SEQ ID NO: 1573987 - RNA, 19 nt, Pseudomonas putida KT2440
accugugggagcgggcgug

SEQ ID NO: 1573988 - RNA, 17 nt, Pseudomonas putida KT2440
accugugggagcgggcu

SEQ ID NO: 1573989 - RNA, 18 nt, Pseudomonas putida KT2440
accugugggagcgggcuu

SEQ ID NO: 1573990 - RNA, 17 nt, Pseudomonas putida KT2440
accuguggggcaacugc

SEQ ID NO: 1573991 - RNA, 19 nt, Pseudomonas putida KT2440
accuguggggcaacugcgc

SEQ ID NO: 1573992 - RNA, 22 nt, Pseudomonas putida KT2440
accuguggggcaacugcgcgau

SEQ ID NO: 1573993 - RNA, 17 nt, Pseudomonas putida KT2440
accuucaauagcggcca

SEQ ID NO: 1573994 - RNA, 14 nt, Pseudomonas putida KT2440
acgaucagcgccga

SEQ ID NO: 1573995 - RNA, 13 nt, Pseudomonas putida KT2440
acgaucagcagca

SEQ ID NO: 1573996 - RNA, 23 nt, Pseudomonas putida KT2440
acgaucaguaccggcuugcgccc

SEQ ID NO: 1573997 - RNA, 18 nt, Pseudomonas putida KT2440
accugccgggcaucgauc

SEQ ID NO: 1573998 - RNA, 21 nt, Pseudomonas putida KT2440
accugccaugcaggucgacga

SEQ ID NO: 1573999 - RNA, 16 nt, Pseudomonas putida KT2440
accugcccaccgauca

SEQ ID NO: 1574000 - RNA, 14 nt, Pseudomonas putida KT2440
accugcgcuugcac

SEQ ID NO: 1574001 - RNA, 15 nt, Pseudomonas putida KT2440
accugcucuggcccg

SEQ ID NO: 1574002 - RNA, 18 nt, Pseudomonas putida KT2440
accugcuucgcgggcacg

SEQ ID NO: 1574003 - RNA, 18 nt, Pseudomonas putida KT2440
accuggcccgaacgcagc

SEQ ID NO: 1574004 - RNA, 16 nt, Pseudomonas putida KT2440
accuggcugcgggugc

SEQ ID NO: 1574005 - RNA, 19 nt, Pseudomonas putida KT2440
accuggcucggcugggcuu

SEQ ID NO: 1574006 - RNA, 15 nt, Pseudomonas putida KT2440
accugguccagcuuc

SEQ ID NO: 1574007 - RNA, 18 nt, Pseudomonas putida KT2440
accugguccagcuucacc

SEQ ID NO: 1574008 - RNA, 22 nt, Pseudomonas putida KT2440
accugguucugugcguucaccg

SEQ ID NO: 1574009 - RNA, 24 nt, Pseudomonas putida KT2440
acgccguugcggucgguggucagc

SEQ ID NO: 1574010 - RNA, 15 nt, Pseudomonas putida KT2440
acgccucuugcgaaa

SEQ ID NO: 1574011 - RNA, 14 nt, Pseudomonas putida KT2440
acgccggcgcacgc

SEQ ID NO: 1574012 - RNA, 14 nt, Pseudomonas putida KT2440
acgccgggcacugc

SEQ ID NO: 1574013 - RNA, 21 nt, Pseudomonas putida KT2440
acgccgagcauuacaggcaga

SEQ ID NO: 1574014 - RNA, 21 nt, Pseudomonas putida KT2440
acgccgaucaaugucggagcg

SEQ ID NO: 1574015 - RNA, 22 nt, Pseudomonas putida KT2440
acgccgauccucugugggagcg

SEQ ID NO: 1574016 - RNA, 19 nt, Pseudomonas putida KT2440
acgcccuuuuucaccaggc

SEQ ID NO: 1574017 - RNA, 17 nt, Pseudomonas putida KT2440
acgccgccccacucgcg

SEQ ID NO: 1574018 - RNA, 16 nt, Pseudomonas putida KT2440
acgccgccauccuggu

SEQ ID NO: 1574019 - RNA, 21 nt, Pseudomonas putida KT2440
acgccgauguccuugcuggcc

SEQ ID NO: 1574020 - RNA, 18 nt, Pseudomonas putida KT2440
acgcggauccgugcaccg

SEQ ID NO: 1574021 - RNA, 14 nt, Pseudomonas putida KT2440
acgcggcagcagca

SEQ ID NO: 1574022 - RNA, 14 nt, Pseudomonas putida KT2440
acgccuucgaacaa

SEQ ID NO: 1574023 - RNA, 14 nt, Pseudomonas putida KT2440
acgcgccagcagcg

SEQ ID NO: 1574024 - RNA, 14 nt, Pseudomonas putida KT2440
acgcgccaaccgcg

SEQ ID NO: 1574025 - RNA, 16 nt, Pseudomonas putida KT2440
acgcgccaccgccgug

SEQ ID NO: 1574026 - RNA, 23 nt, Pseudomonas putida KT2440
acgcgccagcauggaccaucagg

SEQ ID NO: 1574027 - RNA, 12 nt, Pseudomonas putida KT2440
acgcgccagguc

SEQ ID NO: 1574028 - RNA, 21 nt, Pseudomonas putida KT2440
acgcgccauggccuggcgggu

SEQ ID NO: 1574029 - RNA, 19 nt, Pseudomonas putida KT2440
acgcgccgauugcugccga

SEQ ID NO: 1574030 - RNA, 17 nt, Pseudomonas putida KT2440
acgcgcccugugggagc

SEQ ID NO: 1574031 - RNA, 16 nt, Pseudomonas putida KT2440
acgcgugccugguugc

SEQ ID NO: 1574032 - RNA, 18 nt, Pseudomonas putida KT2440
acgcguggucgccggcga

SEQ ID NO: 1574033 - RNA, 18 nt, Pseudomonas putida KT2440
acgcucuguaucgaacag

SEQ ID NO: 1574034 - RNA, 23 nt, Pseudomonas putida KT2440
acgcucuguaucgaacaggcaga

SEQ ID NO: 1574035 - RNA, 20 nt, Pseudomonas putida KT2440
acgcucguuguccagcagca

SEQ ID NO: 1574036 - RNA, 21 nt, Pseudomonas putida KT2440
acgcucguuguccagcagcag

SEQ ID NO: 1574037 - RNA, 20 nt, Pseudomonas putida KT2440
acgcuagucaagcugcgccg

SEQ ID NO: 1574038 - RNA, 18 nt, Pseudomonas putida KT2440
acggccuucccgccuggc

SEQ ID NO: 1574039 - RNA, 14 nt, Pseudomonas putida KT2440
acggccuucgaaga

SEQ ID NO: 1574040 - RNA, 19 nt, Pseudomonas putida KT2440
acggcgaagucacaccauc

SEQ ID NO: 1574041 - RNA, 16 nt, Pseudomonas putida KT2440
acggcgccagcagugc

SEQ ID NO: 1574042 - RNA, 19 nt, Pseudomonas putida KT2440
acggcgccgaccgaaccgg

SEQ ID NO: 1574043 - RNA, 23 nt, Pseudomonas putida KT2440
acggcgccgaccgaaccggcgcu

SEQ ID NO: 1574044 - RNA, 23 nt, Pseudomonas putida KT2440
acggcgcaauccgugagccagga

SEQ ID NO: 1574045 - RNA, 21 nt, Pseudomonas putida KT2440
acggcgauggcgucgacucga

SEQ ID NO: 1574046 - RNA, 21 nt, Pseudomonas putida KT2440
acggcgauggucugcuccagu

SEQ ID NO: 1574047 - RNA, 16 nt, Pseudomonas putida KT2440
acggcgcacucucguc

SEQ ID NO: 1574048 - RNA, 11 nt, Pseudomonas putida KT2440
acggccgugcg

SEQ ID NO: 1574049 - RNA, 19 nt, Pseudomonas putida KT2440
acggccgugcgccugaccg

SEQ ID NO: 1574050 - RNA, 11 nt, Pseudomonas putida KT2440
acggccuggcc

SEQ ID NO: 1574051 - RNA, 20 nt, Pseudomonas putida KT2440
acggccugcauccacaccag

SEQ ID NO: 1574052 - RNA, 18 nt, Pseudomonas putida KT2440
acggccugcgaugcacgc

SEQ ID NO: 1574053 - RNA, 18 nt, Pseudomonas putida KT2440
acgcugggcgugccaggc

SEQ ID NO: 1574054 - RNA, 18 nt, Pseudomonas putida KT2440
aaaccacagcggccacag

SEQ ID NO: 1574055 - RNA, 15 nt, Pseudomonas putida KT2440
acggcgucgacaccg

SEQ ID NO: 1574056 - RNA, 17 nt, Pseudomonas putida KT2440
acggcgcugcuggccuu

SEQ ID NO: 1574057 - RNA, 13 nt, Pseudomonas putida KT2440
acggcgucgagca

SEQ ID NO: 1574058 - RNA, 22 nt, Pseudomonas putida KT2440
acggcugaugguggucggcagc

SEQ ID NO: 1574059 - RNA, 15 nt, Pseudomonas putida KT2440
acggcugaagaagcu

SEQ ID NO: 1574060 - RNA, 13 nt, Pseudomonas putida KT2440
acggcguggagcg

SEQ ID NO: 1574061 - RNA, 15 nt, Pseudomonas putida KT2440
acggcuaaagccgca

SEQ ID NO: 1574062 - RNA, 16 nt, Pseudomonas putida KT2440
acggcuuggcugccgg

SEQ ID NO: 1574063 - RNA, 18 nt, Pseudomonas putida KT2440
acgggccagccgcgccag

SEQ ID NO: 1574064 - RNA, 22 nt, Pseudomonas putida KT2440
acgggcauggcaaccaugucga

SEQ ID NO: 1574065 - RNA, 21 nt, Pseudomonas putida KT2440
acgggcauuuuucgaacagcu

SEQ ID NO: 1574066 - RNA, 23 nt, Pseudomonas putida KT2440
acgggccaccaaaggccuugauc

SEQ ID NO: 1574067 - RNA, 18 nt, Pseudomonas putida KT2440
acggcuugauauccagca

SEQ ID NO: 1574068 - RNA, 14 nt, Pseudomonas putida KT2440
acggcuggcugccg

SEQ ID NO: 1574069 - RNA, 18 nt, Pseudomonas putida KT2440
acgggcgacggaucggca

SEQ ID NO: 1574070 - RNA, 15 nt, Pseudomonas putida KT2440
acgggcugucgagca

SEQ ID NO: 1574071 - RNA, 20 nt, Pseudomonas putida KT2440
acgggcugucgagcagguuc

SEQ ID NO: 1574072 - RNA, 20 nt, Pseudomonas putida KT2440
acgggcuugugcaucagcgu

SEQ ID NO: 1574073 - RNA, 22 nt, Pseudomonas putida KT2440
acgggcuugugcaucagcgugu

SEQ ID NO: 1574074 - RNA, 17 nt, Pseudomonas putida KT2440
acgggcuuuaucgauga

SEQ ID NO: 1574075 - RNA, 16 nt, Pseudomonas putida KT2440
acggugcugccgaggc

SEQ ID NO: 1574076 - RNA, 14 nt, Pseudomonas putida KT2440
acggugcgcgccag

SEQ ID NO: 1574077 - RNA, 14 nt, Pseudomonas putida KT2440
acggugccgaacag

SEQ ID NO: 1574078 - RNA, 17 nt, Pseudomonas putida KT2440
acggugccgaacagcac

SEQ ID NO: 1574079 - RNA, 20 nt, Pseudomonas putida KT2440
acggugccgaacagcacgau

SEQ ID NO: 1574080 - RNA, 22 nt, Pseudomonas putida KT2440
acggugacaaaggccggcaccg

SEQ ID NO: 1574081 - RNA, 16 nt, Pseudomonas putida KT2440
acggugaagaguggau

SEQ ID NO: 1574082 - RNA, 19 nt, Pseudomonas putida KT2440
acguccgcucuucucgucg

SEQ ID NO: 1574083 - RNA, 14 nt, Pseudomonas putida KT2440
acguccaaugccgc

SEQ ID NO: 1574084 - RNA, 17 nt, Pseudomonas putida KT2440
acguacuccaccaaggc

SEQ ID NO: 1574085 - RNA, 15 nt, Pseudomonas putida KT2440
acgucacagccaagc

SEQ ID NO: 1574086 - RNA, 15 nt, Pseudomonas putida KT2440
acgucacccacuuca

SEQ ID NO: 1574087 - RNA, 22 nt, Pseudomonas putida KT2440
acgucacccacuucaauggcac

SEQ ID NO: 1574088 - RNA, 18 nt, Pseudomonas putida KT2440
acgucuggcaccaguucc

SEQ ID NO: 1574089 - RNA, 22 nt, Pseudomonas putida KT2440
acgugggucguucggugcacgg

SEQ ID NO: 1574090 - RNA, 13 nt, Pseudomonas putida KT2440
acguggucagcca

SEQ ID NO: 1574091 - RNA, 21 nt, Pseudomonas putida KT2440
acguggugcgggccaccaggc

SEQ ID NO: 1574092 - RNA, 22 nt, Pseudomonas putida KT2440
acuccuugcgcaucaagcggcu

SEQ ID NO: 1574093 - RNA, 16 nt, Pseudomonas putida KT2440
acuccugugcggcgua

SEQ ID NO: 1574094 - RNA, 19 nt, Pseudomonas putida KT2440
acuccugugggagcgggcg

SEQ ID NO: 1574095 - RNA, 15 nt, Pseudomonas putida KT2440
acuccgcgagggcau

SEQ ID NO: 1574096 - RNA, 22 nt, Pseudomonas putida KT2440
acucgcagcgcaaaaaacgccg

SEQ ID NO: 1574097 - RNA, 17 nt, Pseudomonas putida KT2440
acucgaucugugggagc

SEQ ID NO: 1574098 - RNA, 15 nt, Pseudomonas putida KT2440
acucgaauucagccc

SEQ ID NO: 1574099 - RNA, 17 nt, Pseudomonas putida KT2440
acucggucggcuggcac

SEQ ID NO: 1574100 - RNA, 18 nt, Pseudomonas putida KT2440
acucggucggcuggcacu

SEQ ID NO: 1574101 - RNA, 22 nt, Pseudomonas putida KT2440
acucgucacccuccacgcguug

SEQ ID NO: 1574102 - RNA, 20 nt, Pseudomonas putida KT2440
acucggccagguacucgcgc

SEQ ID NO: 1574103 - RNA, 15 nt, Pseudomonas putida KT2440
acucggacuucagcu

SEQ ID NO: 1574104 - RNA, 16 nt, Pseudomonas putida KT2440
acuccccaucagcagc

SEQ ID NO: 1574105 - RNA, 21 nt, Pseudomonas putida KT2440
acucaggugcacgacgucguc

SEQ ID NO: 1574106 - RNA, 14 nt, Pseudomonas putida KT2440
acuccacgcggaac

SEQ ID NO: 1574107 - RNA, 19 nt, Pseudomonas putida KT2440
acuccacugugcccgccag

SEQ ID NO: 1574108 - RNA, 17 nt, Pseudomonas putida KT2440
acuccacgacaaaucga

SEQ ID NO: 1574109 - RNA, 15 nt, Pseudomonas putida KT2440
acguugagccaggcu

SEQ ID NO: 1574110 - RNA, 17 nt, Pseudomonas putida KT2440
acguugcugccugugcc

SEQ ID NO: 1574111 - RNA, 13 nt, Pseudomonas putida KT2440
acuucaaccgcac

SEQ ID NO: 1574112 - RNA, 21 nt, Pseudomonas putida KT2440
acuucaaguucguuggcgaac

SEQ ID NO: 1574113 - RNA, 18 nt, Pseudomonas putida KT2440
acuucucgccucagcgcc

SEQ ID NO: 1574114 - RNA, 23 nt, Pseudomonas putida KT2440
acuucauggucgaccgcuauggc

SEQ ID NO: 1574115 - RNA, 23 nt, Pseudomonas putida KT2440
acuucgcugucuuccagggcaau

SEQ ID NO: 1574116 - RNA, 19 nt, Pseudomonas putida KT2440
acuucgccguacuggcugc

SEQ ID NO: 1574117 - RNA, 21 nt, Pseudomonas putida KT2440
acuucgccguacuggcugcac

SEQ ID NO: 1574118 - RNA, 18 nt, Pseudomonas putida KT2440
acuugcgcaguaacaggc

SEQ ID NO: 1574119 - RNA, 19 nt, Pseudomonas putida KT2440
acuugcuggauuccgacaa

SEQ ID NO: 1574120 - RNA, 18 nt, Pseudomonas putida KT2440
acuugcuggguaccgugc

SEQ ID NO: 1574121 - RNA, 21 nt, Pseudomonas putida KT2440
acuugcuggguaccgugcugc

SEQ ID NO: 1574122 - RNA, 22 nt, Pseudomonas putida KT2440
acuugcuggguaccgugcugca

SEQ ID NO: 1574123 - RNA, 16 nt, Pseudomonas putida KT2440
acuuggaaaacagcgc

SEQ ID NO: 1574124 - RNA, 20 nt, Pseudomonas putida KT2440
acuuggaaaacagcgcgcga

SEQ ID NO: 1574125 - RNA, 15 nt, Pseudomonas putida KT2440
acuuggcagccccga

SEQ ID NO: 1574126 - RNA, 14 nt, Pseudomonas putida KT2440
acuuggccuccagc

SEQ ID NO: 1574127 - RNA, 21 nt, Pseudomonas putida KT2440
acuuuaaaacuaauauuugaa

SEQ ID NO: 1574128 - RNA, 20 nt, Pseudomonas putida KT2440
acuugauugggcuuggcagc

SEQ ID NO: 1574129 - RNA, 19 nt, Pseudomonas putida KT2440
acugcucgucaaaccggca

SEQ ID NO: 1574130 - RNA, 22 nt, Pseudomonas putida KT2440
acugcucuucgaguuuggccag

SEQ ID NO: 1574131 - RNA, 23 nt, Pseudomonas putida KT2440
acugcguucaucgaacugcaagc

SEQ ID NO: 1574132 - RNA, 13 nt, Pseudomonas putida KT2440
acugccuugcccu

SEQ ID NO: 1574133 - RNA, 14 nt, Pseudomonas putida KT2440
acucguugaccacg

SEQ ID NO: 1574134 - RNA, 13 nt, Pseudomonas putida KT2440
acuggcggggcuu

SEQ ID NO: 1574135 - RNA, 20 nt, Pseudomonas putida KT2440
acuggcauccagcgccacca

SEQ ID NO: 1574136 - RNA, 22 nt, Pseudomonas putida KT2440
acuggcugaccagugucugcaa

SEQ ID NO: 1574137 - RNA, 18 nt, Pseudomonas putida KT2440
acuggcucaugcgccagg

SEQ ID NO: 1574138 - RNA, 21 nt, Pseudomonas putida KT2440
acugcuuuaucuccaagccgc

SEQ ID NO: 1574139 - RNA, 16 nt, Pseudomonas putida KT2440
acugcuucugagccag

SEQ ID NO: 1574140 - RNA, 19 nt, Pseudomonas putida KT2440
acugcuucaucugcgccug

SEQ ID NO: 1574141 - RNA, 15 nt, Pseudomonas putida KT2440
acugcuucaggccuu

SEQ ID NO: 1574142 - RNA, 21 nt, Pseudomonas putida KT2440
acugcuggcgcgaccaucacc

SEQ ID NO: 1574143 - RNA, 23 nt, Pseudomonas putida KT2440
acuggaugacgccgcagccgggc

SEQ ID NO: 1574144 - RNA, 14 nt, Pseudomonas putida KT2440
agcacgaaggccag

SEQ ID NO: 1574145 - RNA, 16 nt, Pseudomonas putida KT2440
agcacgaaggccagca

SEQ ID NO: 1574146 - RNA, 17 nt, Pseudomonas putida KT2440
agcacgaaguaacggcc

SEQ ID NO: 1574147 - RNA, 23 nt, Pseudomonas putida KT2440
agcaccugggcgucaucacccgg

SEQ ID NO: 1574148 - RNA, 17 nt, Pseudomonas putida KT2440
agcacgaaacugcgcug

SEQ ID NO: 1574149 - RNA, 14 nt, Pseudomonas putida KT2440
agcacgauggcggu

SEQ ID NO: 1574150 - RNA, 14 nt, Pseudomonas putida KT2440
agcagaaugguguu

SEQ ID NO: 1574151 - RNA, 22 nt, Pseudomonas putida KT2440
agcagaacaucaggucugccag

SEQ ID NO: 1574152 - RNA, 16 nt, Pseudomonas putida KT2440
agcacuuuugccacca

SEQ ID NO: 1574153 - RNA, 15 nt, Pseudomonas putida KT2440
agcacugccuggcca

SEQ ID NO: 1574154 - RNA, 16 nt, Pseudomonas putida KT2440
agcacugccuggccac

SEQ ID NO: 1574155 - RNA, 12 nt, Pseudomonas putida KT2440
agcacugcugcg

SEQ ID NO: 1574156 - RNA, 16 nt, Pseudomonas putida KT2440
agcacugcugcgcagu

SEQ ID NO: 1574157 - RNA, 19 nt, Pseudomonas putida KT2440
agcacugcugcgcaguaca

SEQ ID NO: 1574158 - RNA, 22 nt, Pseudomonas putida KT2440
agcacgucgcgauugaucagcg

SEQ ID NO: 1574159 - RNA, 16 nt, Pseudomonas putida KT2440
agcacgucggcgccga

SEQ ID NO: 1574160 - RNA, 19 nt, Pseudomonas putida KT2440
agcacgggcacacuggcca

SEQ ID NO: 1574161 - RNA, 20 nt, Pseudomonas putida KT2440
agcacgggcacacuggccac

SEQ ID NO: 1574162 - RNA, 20 nt, Pseudomonas putida KT2440
aaacccucacgcgccagguc

SEQ ID NO: 1574163 - RNA, 20 nt, Pseudomonas putida KT2440
aaacccgcuccuacacaggu

SEQ ID NO: 1574164 - RNA, 20 nt, Pseudomonas putida KT2440
agcagcccuucgcucaaccg

SEQ ID NO: 1574165 - RNA, 18 nt, Pseudomonas putida KT2440
agcagcaaugccgaacag

SEQ ID NO: 1574166 - RNA, 21 nt, Pseudomonas putida KT2440
agcagcaccgaggcgugauca

SEQ ID NO: 1574167 - RNA, 17 nt, Pseudomonas putida KT2440
agcaauugcgagguacc

SEQ ID NO: 1574168 - RNA, 13 nt, Pseudomonas putida KT2440
agcacacccagca

SEQ ID NO: 1574169 - RNA, 22 nt, Pseudomonas putida KT2440
agcaaugccgaacagucaucca

SEQ ID NO: 1574170 - RNA, 14 nt, Pseudomonas putida KT2440
agcaagcuggcacc

SEQ ID NO: 1574171 - RNA, 17 nt, Pseudomonas putida KT2440
agcaagucaugcucgcc

SEQ ID NO: 1574172 - RNA, 20 nt, Pseudomonas putida KT2440
agcaacggugaaaaacgcgg

SEQ ID NO: 1574173 - RNA, 18 nt, Pseudomonas putida KT2440
agcaacggugaacggcgg

SEQ ID NO: 1574174 - RNA, 20 nt, Pseudomonas putida KT2440
agcaacgguuuaccgccguu

SEQ ID NO: 1574175 - RNA, 13 nt, Pseudomonas putida KT2440
agcaacuugcgca

SEQ ID NO: 1574176 - RNA, 21 nt, Pseudomonas putida KT2440
agcaaacccgacaacagcugc

SEQ ID NO: 1574177 - RNA, 23 nt, Pseudomonas putida KT2440
acuuucaccccuuuacuggccau

SEQ ID NO: 1574178 - RNA, 21 nt, Pseudomonas putida KT2440
acuuuacggcugauggugguc

SEQ ID NO: 1574179 - RNA, 18 nt, Pseudomonas putida KT2440
agcaacgcaucgacgaac

SEQ ID NO: 1574180 - RNA, 22 nt, Pseudomonas putida KT2440
agcaacaacgccuuggccuggc

SEQ ID NO: 1574181 - RNA, 20 nt, Pseudomonas putida KT2440
agcaccgcgacgaccgcacu

SEQ ID NO: 1574182 - RNA, 15 nt, Pseudomonas putida KT2440
agcaccgaggcguga

SEQ ID NO: 1574183 - RNA, 14 nt, Pseudomonas putida KT2440
agcaccgaucagcg

SEQ ID NO: 1574184 - RNA, 11 nt, Pseudomonas putida KT2440
agcacccgcuu

SEQ ID NO: 1574185 - RNA, 16 nt, Pseudomonas putida KT2440
agcaccgacuggcgua

SEQ ID NO: 1574186 - RNA, 19 nt, Pseudomonas putida KT2440
agcaccgguaccgcucugc

SEQ ID NO: 1574187 - RNA, 23 nt, Pseudomonas putida KT2440
agcaccggcaacccuucggccag

SEQ ID NO: 1574188 - RNA, 15 nt, Pseudomonas putida KT2440
agcaccggccaggcu

SEQ ID NO: 1574189 - RNA, 16 nt, Pseudomonas putida KT2440
agcaccaucagagcgc

SEQ ID NO: 1574190 - RNA, 17 nt, Pseudomonas putida KT2440
agcaccaucaggcacag

SEQ ID NO: 1574191 - RNA, 19 nt, Pseudomonas putida KT2440
agcaccaucaggcacaggc

SEQ ID NO: 1574192 - RNA, 13 nt, Pseudomonas putida KT2440
agcaccccagcac

SEQ ID NO: 1574193 - RNA, 18 nt, Pseudomonas putida KT2440
agcacccggucgccgacg

SEQ ID NO: 1574194 - RNA, 15 nt, Pseudomonas putida KT2440
agcacaucccgucag

SEQ ID NO: 1574195 - RNA, 14 nt, Pseudomonas putida KT2440
agcacagugcggcg

SEQ ID NO: 1574196 - RNA, 12 nt, Pseudomonas putida KT2440
agcccgggcaug

SEQ ID NO: 1574197 - RNA, 14 nt, Pseudomonas putida KT2440
agcccgccgccagu

SEQ ID NO: 1574198 - RNA, 20 nt, Pseudomonas putida KT2440
agcccgcgaagaggccagca

SEQ ID NO: 1574199 - RNA, 14 nt, Pseudomonas putida KT2440
agccccgcuggucg

SEQ ID NO: 1574200 - RNA, 14 nt, Pseudomonas putida KT2440
agcccauggcuggc

SEQ ID NO: 1574201 - RNA, 20 nt, Pseudomonas putida KT2440
agcccauuucaccugcucug

SEQ ID NO: 1574202 - RNA, 22 nt, Pseudomonas putida KT2440
agcccauuucgugggucacgca

SEQ ID NO: 1574203 - RNA, 19 nt, Pseudomonas putida KT2440
agccccaaaaaaucuagcg

SEQ ID NO: 1574204 - RNA, 19 nt, Pseudomonas putida KT2440
agccccaaccuuccagcaa

SEQ ID NO: 1574205 - RNA, 15 nt, Pseudomonas putida KT2440
agccccgcuggucgc

SEQ ID NO: 1574206 - RNA, 13 nt, Pseudomonas putida KT2440
agccccgguucgc

SEQ ID NO: 1574207 - RNA, 15 nt, Pseudomonas putida KT2440
agccccucaggcaca

SEQ ID NO: 1574208 - RNA, 15 nt, Pseudomonas putida KT2440
agccccugcggcugc

SEQ ID NO: 1574209 - RNA, 16 nt, Pseudomonas putida KT2440
agcccgccagcaggcc

SEQ ID NO: 1574210 - RNA, 20 nt, Pseudomonas putida KT2440
agcccgccagcaggccaccg

SEQ ID NO: 1574211 - RNA, 13 nt, Pseudomonas putida KT2440
agcccgaagccgg

SEQ ID NO: 1574212 - RNA, 20 nt, Pseudomonas putida KT2440
agccagguauggccagagcg

SEQ ID NO: 1574213 - RNA, 20 nt, Pseudomonas putida KT2440
agccagccaccaccaugcga

SEQ ID NO: 1574214 - RNA, 15 nt, Pseudomonas putida KT2440
agccaguacgcaggc

SEQ ID NO: 1574215 - RNA, 22 nt, Pseudomonas putida KT2440
agcccaguagaucgcgccaguu

SEQ ID NO: 1574216 - RNA, 15 nt, Pseudomonas putida KT2440
agcccaccuucacgc

SEQ ID NO: 1574217 - RNA, 21 nt, Pseudomonas putida KT2440
agcccaccgucaggcucagca

SEQ ID NO: 1574218 - RNA, 18 nt, Pseudomonas putida KT2440
agcccggugaagucaccg

SEQ ID NO: 1574219 - RNA, 22 nt, Pseudomonas putida KT2440
agcccguauucgcggguaaacc

SEQ ID NO: 1574220 - RNA, 15 nt, Pseudomonas putida KT2440
agcccgucacgugcc

SEQ ID NO: 1574221 - RNA, 18 nt, Pseudomonas putida KT2440
agccgaaguugcccgaac

SEQ ID NO: 1574222 - RNA, 13 nt, Pseudomonas putida KT2440
agccgacggccaa

SEQ ID NO: 1574223 - RNA, 19 nt, Pseudomonas putida KT2440
agccgagcaucuuccagcc

SEQ ID NO: 1574224 - RNA, 14 nt, Pseudomonas putida KT2440
agccgcacccaggc

SEQ ID NO: 1574225 - RNA, 19 nt, Pseudomonas putida KT2440
agccgcacccaggccacga

SEQ ID NO: 1574226 - RNA, 20 nt, Pseudomonas putida KT2440
agccgcguccacaaaccccg

SEQ ID NO: 1574227 - RNA, 20 nt, Pseudomonas putida KT2440
aaaccugugggagcgggcgu

SEQ ID NO: 1574228 - RNA, 21 nt, Pseudomonas putida KT2440
agcauucagcucauaucgcuc

SEQ ID NO: 1574229 - RNA, 18 nt, Pseudomonas putida KT2440
agccaaugcugaugaagc

SEQ ID NO: 1574230 - RNA, 22 nt, Pseudomonas putida KT2440
agccaaucugauuugcgcuaca

SEQ ID NO: 1574231 - RNA, 16 nt, Pseudomonas putida KT2440
agccacccuccgcaca

SEQ ID NO: 1574232 - RNA, 14 nt, Pseudomonas putida KT2440
agccaccgacgaac

SEQ ID NO: 1574233 - RNA, 15 nt, Pseudomonas putida KT2440
agccaccaccaugcg

SEQ ID NO: 1574234 - RNA, 15 nt, Pseudomonas putida KT2440
agccacagcugcugc

SEQ ID NO: 1574235 - RNA, 22 nt, Pseudomonas putida KT2440
agccaauuucaacgcucgcgca

SEQ ID NO: 1574236 - RNA, 12 nt, Pseudomonas putida KT2440
agccacucggca

SEQ ID NO: 1574237 - RNA, 18 nt, Pseudomonas putida KT2440
agccaccgcacucugcug

SEQ ID NO: 1574238 - RNA, 16 nt, Pseudomonas putida KT2440
agccacuccgccucgu

SEQ ID NO: 1574239 - RNA, 16 nt, Pseudomonas putida KT2440
agccagacgaccagca

SEQ ID NO: 1574240 - RNA, 13 nt, Pseudomonas putida KT2440
agccaggccgaca

SEQ ID NO: 1574241 - RNA, 16 nt, Pseudomonas putida KT2440
agccagccacggauca

SEQ ID NO: 1574242 - RNA, 16 nt, Pseudomonas putida KT2440
agccagauauggaagc

SEQ ID NO: 1574243 - RNA, 20 nt, Pseudomonas putida KT2440
agcaucugcugcggcaggcu

SEQ ID NO: 1574244 - RNA, 19 nt, Pseudomonas putida KT2440
agcaucucggucgacaggg

SEQ ID NO: 1574245 - RNA, 16 nt, Pseudomonas putida KT2440
agcaucagugcaggug

SEQ ID NO: 1574246 - RNA, 16 nt, Pseudomonas putida KT2440
agcaucagccaugggc

SEQ ID NO: 1574247 - RNA, 17 nt, Pseudomonas putida KT2440
agcaucacccgcgaaug

SEQ ID NO: 1574248 - RNA, 16 nt, Pseudomonas putida KT2440
agcaucaccgcgucga

SEQ ID NO: 1574249 - RNA, 14 nt, Pseudomonas putida KT2440
agcaucggcguugc

SEQ ID NO: 1574250 - RNA, 18 nt, Pseudomonas putida KT2440
agcaguuccuucagcagu

SEQ ID NO: 1574251 - RNA, 17 nt, Pseudomonas putida KT2440
agcaguggugcucagcg

SEQ ID NO: 1574252 - RNA, 14 nt, Pseudomonas putida KT2440
agcagugccagcaa

SEQ ID NO: 1574253 - RNA, 16 nt, Pseudomonas putida KT2440
agcagucuugugcugc

SEQ ID NO: 1574254 - RNA, 18 nt, Pseudomonas putida KT2440
agcagugcaucgaagcag

SEQ ID NO: 1574255 - RNA, 18 nt, Pseudomonas putida KT2440
agcaggugcucaagccgg

SEQ ID NO: 1574256 - RNA, 22 nt, Pseudomonas putida KT2440
agcagguugcugguggucacgu

SEQ ID NO: 1574257 - RNA, 13 nt, Pseudomonas putida KT2440
agcaggucggcac

SEQ ID NO: 1574258 - RNA, 22 nt, Pseudomonas putida KT2440
agcaggccauacagggccuggc

SEQ ID NO: 1574259 - RNA, 20 nt, Pseudomonas putida KT2440
agcaggccaaugcccaugcc

SEQ ID NO: 1574260 - RNA, 14 nt, Pseudomonas putida KT2440
agcaggccaccggc

SEQ ID NO: 1574261 - RNA, 23 nt, Pseudomonas putida KT2440
agcaggcccggcccauucgcggg

SEQ ID NO: 1574262 - RNA, 14 nt, Pseudomonas putida KT2440
agcagguacagcac

SEQ ID NO: 1574263 - RNA, 14 nt, Pseudomonas putida KT2440
agcaggauggccau

SEQ ID NO: 1574264 - RNA, 20 nt, Pseudomonas putida KT2440
agcaggauggugacugccag

SEQ ID NO: 1574265 - RNA, 23 nt, Pseudomonas putida KT2440
agcaggauggugacugccagcac

SEQ ID NO: 1574266 - RNA, 15 nt, Pseudomonas putida KT2440
agcagcgcgccgaac

SEQ ID NO: 1574267 - RNA, 17 nt, Pseudomonas putida KT2440
agcagcgcauccaccuc

SEQ ID NO: 1574268 - RNA, 17 nt, Pseudomonas putida KT2440
agcagccgccgccuguc

SEQ ID NO: 1574269 - RNA, 16 nt, Pseudomonas putida KT2440
agcaggaagcuguaca

SEQ ID NO: 1574270 - RNA, 13 nt, Pseudomonas putida KT2440
agcucuccagcag

SEQ ID NO: 1574271 - RNA, 22 nt, Pseudomonas putida KT2440
agcugcuggcgucauccugcgc

SEQ ID NO: 1574272 - RNA, 15 nt, Pseudomonas putida KT2440
agcuccagcguuugc

SEQ ID NO: 1574273 - RNA, 17 nt, Pseudomonas putida KT2440
agcucaaaugcuggcaa

SEQ ID NO: 1574274 - RNA, 18 nt, Pseudomonas putida KT2440
agcucaaaugcuggcaau

SEQ ID NO: 1574275 - RNA, 23 nt, Pseudomonas putida KT2440
agcucaaaugcuggcaauccagc

SEQ ID NO: 1574276 - RNA, 22 nt, Pseudomonas putida KT2440
agcucccucgguuucucacccc

SEQ ID NO: 1574277 - RNA, 21 nt, Pseudomonas putida KT2440
agcucccucguaggagcgggu

SEQ ID NO: 1574278 - RNA, 22 nt, Pseudomonas putida KT2440
agcucccucguaggagcggguu

SEQ ID NO: 1574279 - RNA, 23 nt, Pseudomonas putida KT2440
agcucgcuggccaccagcauggc

SEQ ID NO: 1574280 - RNA, 22 nt, Pseudomonas putida KT2440
agcucgcuuuccaaaccugcga

SEQ ID NO: 1574281 - RNA, 14 nt, Pseudomonas putida KT2440
agcggucguuaccc

SEQ ID NO: 1574282 - RNA, 21 nt, Pseudomonas putida KT2440
agcggucugcugcgucagcau

SEQ ID NO: 1574283 - RNA, 14 nt, Pseudomonas putida KT2440
agcggucgcagguu

SEQ ID NO: 1574284 - RNA, 15 nt, Pseudomonas putida KT2440
agcggucaugcagcg

SEQ ID NO: 1574285 - RNA, 16 nt, Pseudomonas putida KT2440
agcgucccugcccgau

SEQ ID NO: 1574286 - RNA, 13 nt, Pseudomonas putida KT2440
agcgucgaugcgg

SEQ ID NO: 1574287 - RNA, 15 nt, Pseudomonas putida KT2440
agcgugaagcggaca

SEQ ID NO: 1574288 - RNA, 17 nt, Pseudomonas putida KT2440
agcgugacgauggccac

SEQ ID NO: 1574289 - RNA, 16 nt, Pseudomonas putida KT2440
agcgugggccgugcag

SEQ ID NO: 1574290 - RNA, 20 nt, Pseudomonas putida KT2440
agcguggcaaacccggccag

SEQ ID NO: 1574291 - RNA, 23 nt, Pseudomonas putida KT2440
agcguugucgacugcacugccag

SEQ ID NO: 1574292 - RNA, 12 nt, Pseudomonas putida KT2440
agcuaucgccag

SEQ ID NO: 1574293 - RNA, 14 nt, Pseudomonas putida KT2440
agcuaucgccagca

SEQ ID NO: 1574294 - RNA, 12 nt, Pseudomonas putida KT2440
agcguucgagca

SEQ ID NO: 1574295 - RNA, 23 nt, Pseudomonas putida KT2440
agcggcugccuacccaggcaacg

SEQ ID NO: 1574296 - RNA, 12 nt, Pseudomonas putida KT2440
agcggcucgauu

SEQ ID NO: 1574297 - RNA, 12 nt, Pseudomonas putida KT2440
agcggcggcaau

SEQ ID NO: 1574298 - RNA, 13 nt, Pseudomonas putida KT2440
agcggcgcgauca

SEQ ID NO: 1574299 - RNA, 14 nt, Pseudomonas putida KT2440
agcggcaggcuggc

SEQ ID NO: 1574300 - RNA, 13 nt, Pseudomonas putida KT2440
agcggcagcgacg

SEQ ID NO: 1574301 - RNA, 18 nt, Pseudomonas putida KT2440
agcggcagcaucgaccug

SEQ ID NO: 1574302 - RNA, 23 nt, Pseudomonas putida KT2440
agcggcaguugcaggcgcagggu

SEQ ID NO: 1574303 - RNA, 23 nt, Pseudomonas putida KT2440
agcggccaacgcugcucggccuc

SEQ ID NO: 1574304 - RNA, 19 nt, Pseudomonas putida KT2440
agcggccaaugaucgagcg

SEQ ID NO: 1574305 - RNA, 21 nt, Pseudomonas putida KT2440
agcggcuuugcgucccgaaag

SEQ ID NO: 1574306 - RNA, 13 nt, Pseudomonas putida KT2440
agcggcuggcgcu

SEQ ID NO: 1574307 - RNA, 20 nt, Pseudomonas putida KT2440
agcgggucacugcgcgccgu

SEQ ID NO: 1574308 - RNA, 16 nt, Pseudomonas putida KT2440
agcgggucgagccagg

SEQ ID NO: 1574309 - RNA, 19 nt, Pseudomonas putida KT2440
agcggguuuucucgcgaau

SEQ ID NO: 1574310 - RNA, 20 nt, Pseudomonas putida KT2440
agcggguuuucucgcgaaug

SEQ ID NO: 1574311 - RNA, 16 nt, Pseudomonas putida KT2440
agcgguacagcaccca

SEQ ID NO: 1574312 - RNA, 19 nt, Pseudomonas putida KT2440
agcgggugccgcagcaccg

SEQ ID NO: 1574313 - RNA, 20 nt, Pseudomonas putida KT2440
agcgggucuacccgcgaaag

SEQ ID NO: 1574314 - RNA, 16 nt, Pseudomonas putida KT2440
agcggguucacccgcg

SEQ ID NO: 1574315 - RNA, 20 nt, Pseudomonas putida KT2440
agcggguucacccgcgaaag

SEQ ID NO: 1574316 - RNA, 20 nt, Pseudomonas putida KT2440
agcggguucacccgcgaaga

SEQ ID NO: 1574317 - RNA, 19 nt, Pseudomonas putida KT2440
agcggguucacccgcgaau

SEQ ID NO: 1574318 - RNA, 20 nt, Pseudomonas putida KT2440
agcggguucacccgcgaaua

SEQ ID NO: 1574319 - RNA, 20 nt, Pseudomonas putida KT2440
agcggguucacccgcgaaug

SEQ ID NO: 1574320 - RNA, 21 nt, Pseudomonas putida KT2440
agcggguucacccgcgaaugc

SEQ ID NO: 1574321 - RNA, 16 nt, Pseudomonas putida KT2440
agcggguuuacccgcg

SEQ ID NO: 1574322 - RNA, 17 nt, Pseudomonas putida KT2440
agcggguuuacccgcga

SEQ ID NO: 1574323 - RNA, 19 nt, Pseudomonas putida KT2440
agcggguuuacccgcgaaa

SEQ ID NO: 1574324 - RNA, 20 nt, Pseudomonas putida KT2440
agcggguuuacccgcgaaag

SEQ ID NO: 1574325 - RNA, 19 nt, Pseudomonas putida KT2440
agcggguuuacccgcgaac

SEQ ID NO: 1574326 - RNA, 21 nt, Pseudomonas putida KT2440
agcggguuuacccgcgaacag

SEQ ID NO: 1574327 - RNA, 20 nt, Pseudomonas putida KT2440
agcggguuuacccgcgaagg

SEQ ID NO: 1574328 - RNA, 19 nt, Pseudomonas putida KT2440
agcggguuuacccgcgaau

SEQ ID NO: 1574329 - RNA, 20 nt, Pseudomonas putida KT2440
agcggguuuacccgcgaaua

SEQ ID NO: 1574330 - RNA, 20 nt, Pseudomonas putida KT2440
agcggguuuacccgcgaaug

SEQ ID NO: 1574331 - RNA, 15 nt, Pseudomonas putida KT2440
agcggcagcaacggu

SEQ ID NO: 1574332 - RNA, 17 nt, Pseudomonas putida KT2440
agcgcuucagcucgcac

SEQ ID NO: 1574333 - RNA, 16 nt, Pseudomonas putida KT2440
agcgcuucgaucagcg

SEQ ID NO: 1574334 - RNA, 15 nt, Pseudomonas putida KT2440
agcgcuugccgcugc

SEQ ID NO: 1574335 - RNA, 20 nt, Pseudomonas putida KT2440
agcgcuugagaccaggccug

SEQ ID NO: 1574336 - RNA, 23 nt, Pseudomonas putida KT2440
agcgcggccgggucgaaggcaau

SEQ ID NO: 1574337 - RNA, 14 nt, Pseudomonas putida KT2440
agcgcggucugcgg

SEQ ID NO: 1574338 - RNA, 22 nt, Pseudomonas putida KT2440
agcgcuaucucggacacgucac

SEQ ID NO: 1574339 - RNA, 23 nt, Pseudomonas putida KT2440
agcgcuccgccaauugcgccagc

SEQ ID NO: 1574340 - RNA, 23 nt, Pseudomonas putida KT2440
agcgcguacagcgacaugccggc

SEQ ID NO: 1574341 - RNA, 21 nt, Pseudomonas putida KT2440
agcgccuggcgagaaggcgug

SEQ ID NO: 1574342 - RNA, 19 nt, Pseudomonas putida KT2440
agcgccugauuacccugcg

SEQ ID NO: 1574343 - RNA, 13 nt, Pseudomonas putida KT2440
agcgccugacgca

SEQ ID NO: 1574344 - RNA, 17 nt, Pseudomonas putida KT2440
agcgccugacgcagugc

SEQ ID NO: 1574345 - RNA, 12 nt, Pseudomonas putida KT2440
agcgccgccaug

SEQ ID NO: 1574346 - RNA, 16 nt, Pseudomonas putida KT2440
agcgccgcauccagca

SEQ ID NO: 1574347 - RNA, 20 nt, Pseudomonas putida KT2440
agcgccgcauccagcacugc

SEQ ID NO: 1574348 - RNA, 15 nt, Pseudomonas putida KT2440
agcgccgcaggucca

SEQ ID NO: 1574349 - RNA, 13 nt, Pseudomonas putida KT2440
agcgccagggcau

SEQ ID NO: 1574350 - RNA, 14 nt, Pseudomonas putida KT2440
agcgcccgcugcgc

SEQ ID NO: 1574351 - RNA, 20 nt, Pseudomonas putida KT2440
agcgccgaugcucgucagcc

SEQ ID NO: 1574352 - RNA, 20 nt, Pseudomonas putida KT2440
agcgccugugagaucgagcg

SEQ ID NO: 1574353 - RNA, 17 nt, Pseudomonas putida KT2440
agcgccuugaucgucau

SEQ ID NO: 1574354 - RNA, 15 nt, Pseudomonas putida KT2440
agcgcgccacgcacc

SEQ ID NO: 1574355 - RNA, 16 nt, Pseudomonas putida KT2440
agcgcgauaccgacgu

SEQ ID NO: 1574356 - RNA, 20 nt, Pseudomonas putida KT2440
agcgcgacuggugcucugca

SEQ ID NO: 1574357 - RNA, 16 nt, Pseudomonas putida KT2440
agcgcggcaaccugcu

SEQ ID NO: 1574358 - RNA, 22 nt, Pseudomonas putida KT2440
agcgcgccgccgauagcagcac

SEQ ID NO: 1574359 - RNA, 19 nt, Pseudomonas putida KT2440
agcgcagccuugugcugcg

SEQ ID NO: 1574360 - RNA, 12 nt, Pseudomonas putida KT2440
agcgcagcgacg

SEQ ID NO: 1574361 - RNA, 23 nt, Pseudomonas putida KT2440
agcgcaccaguguagugaacagg

SEQ ID NO: 1574362 - RNA, 17 nt, Pseudomonas putida KT2440
agcgcaaugcccagcgc

SEQ ID NO: 1574363 - RNA, 19 nt, Pseudomonas putida KT2440
agcgagcuugcucgcgaug

SEQ ID NO: 1574364 - RNA, 20 nt, Pseudomonas putida KT2440
agcgagcuugcucgcgaugc

SEQ ID NO: 1574365 - RNA, 13 nt, Pseudomonas putida KT2440
aaacgcugagcga

SEQ ID NO: 1574366 - RNA, 16 nt, Pseudomonas putida KT2440
aaacgccccgacuggu

SEQ ID NO: 1574367 - RNA, 13 nt, Pseudomonas putida KT2440
aaacgccagcugu

SEQ ID NO: 1574368 - RNA, 14 nt, Pseudomonas putida KT2440
agcgacaccgccaa

SEQ ID NO: 1574369 - RNA, 16 nt, Pseudomonas putida KT2440
agcgacaccaaugccu

SEQ ID NO: 1574370 - RNA, 13 nt, Pseudomonas putida KT2440
agcgacaccagcg

SEQ ID NO: 1574371 - RNA, 14 nt, Pseudomonas putida KT2440
agcgaaugcagcuc

SEQ ID NO: 1574372 - RNA, 15 nt, Pseudomonas putida KT2440
agcgacgcgcuaccu

SEQ ID NO: 1574373 - RNA, 15 nt, Pseudomonas putida KT2440
agcgacgcugccgca

SEQ ID NO: 1574374 - RNA, 13 nt, Pseudomonas putida KT2440
agccggucaccga

SEQ ID NO: 1574375 - RNA, 22 nt, Pseudomonas putida KT2440
agccggucaucacgcucacgca

SEQ ID NO: 1574376 - RNA, 16 nt, Pseudomonas putida KT2440
agccggucauccagca

SEQ ID NO: 1574377 - RNA, 18 nt, Pseudomonas putida KT2440
agccggucguugagcacg

SEQ ID NO: 1574378 - RNA, 21 nt, Pseudomonas putida KT2440
agccgggcugcaaagcgggca

SEQ ID NO: 1574379 - RNA, 19 nt, Pseudomonas putida KT2440
agccgcucgagaaacgcca

SEQ ID NO: 1574380 - RNA, 20 nt, Pseudomonas putida KT2440
agccgcucgagaaacgccag

SEQ ID NO: 1574381 - RNA, 12 nt, Pseudomonas putida KT2440
agccugcugcuc

SEQ ID NO: 1574382 - RNA, 16 nt, Pseudomonas putida KT2440
agccugggcgugaaag

SEQ ID NO: 1574383 - RNA, 15 nt, Pseudomonas putida KT2440
agccugggucacggc

SEQ ID NO: 1574384 - RNA, 20 nt, Pseudomonas putida KT2440
agccugggucacggcauccc

SEQ ID NO: 1574385 - RNA, 18 nt, Pseudomonas putida KT2440
agccuggugaguggcccu

SEQ ID NO: 1574386 - RNA, 19 nt, Pseudomonas putida KT2440
agccuggugaguggcccug

SEQ ID NO: 1574387 - RNA, 20 nt, Pseudomonas putida KT2440
agccuguggggcaacugcgc

SEQ ID NO: 1574388 - RNA, 14 nt, Pseudomonas putida KT2440
agccguugaccagg

SEQ ID NO: 1574389 - RNA, 17 nt, Pseudomonas putida KT2440
agccugcugacgcaggg

SEQ ID NO: 1574390 - RNA, 16 nt, Pseudomonas putida KT2440
agccguucccgggcag

SEQ ID NO: 1574391 - RNA, 19 nt, Pseudomonas putida KT2440
agccguucccgggcagguu

SEQ ID NO: 1574392 - RNA, 22 nt, Pseudomonas putida KT2440
agccgugguuucgaagucgaac

SEQ ID NO: 1574393 - RNA, 17 nt, Pseudomonas putida KT2440
agccguaggagcgggcu

SEQ ID NO: 1574394 - RNA, 12 nt, Pseudomonas putida KT2440
aucacugcgcag

SEQ ID NO: 1574395 - RNA, 13 nt, Pseudomonas putida KT2440
aucacgucggccu

SEQ ID NO: 1574396 - RNA, 16 nt, Pseudomonas putida KT2440
aucacgucggccugcc

SEQ ID NO: 1574397 - RNA, 21 nt, Pseudomonas putida KT2440
aucagcagcaccgaggcguga

SEQ ID NO: 1574398 - RNA, 17 nt, Pseudomonas putida KT2440
aucagcaacccggccag

SEQ ID NO: 1574399 - RNA, 18 nt, Pseudomonas putida KT2440
aucagauaggcgccgugc

SEQ ID NO: 1574400 - RNA, 15 nt, Pseudomonas putida KT2440
aucagcaggucggcg

SEQ ID NO: 1574401 - RNA, 18 nt, Pseudomonas putida KT2440
aucagcaggucggcguca

SEQ ID NO: 1574402 - RNA, 22 nt, Pseudomonas putida KT2440
aucagcgcguccagcaacagcu

SEQ ID NO: 1574403 - RNA, 18 nt, Pseudomonas putida KT2440
aucagcgcggugaccagc

SEQ ID NO: 1574404 - RNA, 13 nt, Pseudomonas putida KT2440
aucaccgccagca

SEQ ID NO: 1574405 - RNA, 13 nt, Pseudomonas putida KT2440
aucaccgccagcg

SEQ ID NO: 1574406 - RNA, 14 nt, Pseudomonas putida KT2440
aucacccgcgaaug

SEQ ID NO: 1574407 - RNA, 16 nt, Pseudomonas putida KT2440
aucaccaggauugccg

SEQ ID NO: 1574408 - RNA, 20 nt, Pseudomonas putida KT2440
aucaccaggauugccgggcu

SEQ ID NO: 1574409 - RNA, 15 nt, Pseudomonas putida KT2440
aucacgucggcguca

SEQ ID NO: 1574410 - RNA, 21 nt, Pseudomonas putida KT2440
aucacgguguccgccgccguc

SEQ ID NO: 1574411 - RNA, 17 nt, Pseudomonas putida KT2440
aucacgaacacaucacc

SEQ ID NO: 1574412 - RNA, 14 nt, Pseudomonas putida KT2440
aucaccucgucgcu

SEQ ID NO: 1574413 - RNA, 13 nt, Pseudomonas putida KT2440
aucaccucggcac

SEQ ID NO: 1574414 - RNA, 15 nt, Pseudomonas putida KT2440
aucaccuugaugcgc

SEQ ID NO: 1574415 - RNA, 21 nt, Pseudomonas putida KT2440
aucaacucacuuucagcgccu

SEQ ID NO: 1574416 - RNA, 14 nt, Pseudomonas putida KT2440
auaugugaccgcau

SEQ ID NO: 1574417 - RNA, 23 nt, Pseudomonas putida KT2440
aucaacgguggccagcagcucca

SEQ ID NO: 1574418 - RNA, 15 nt, Pseudomonas putida KT2440
auagcgcugcaccga

SEQ ID NO: 1574419 - RNA, 18 nt, Pseudomonas putida KT2440
auagccucguucgggcac

SEQ ID NO: 1574420 - RNA, 20 nt, Pseudomonas putida KT2440
auagggcuacguggaccaga

SEQ ID NO: 1574421 - RNA, 16 nt, Pseudomonas putida KT2440
auagguaaagccaccg

SEQ ID NO: 1574422 - RNA, 19 nt, Pseudomonas putida KT2440
auaucugcgccaccggccu

SEQ ID NO: 1574423 - RNA, 22 nt, Pseudomonas putida KT2440
auauccuuuguaggagcgggcu

SEQ ID NO: 1574424 - RNA, 11 nt, Pseudomonas putida KT2440
auagaucagcg

SEQ ID NO: 1574425 - RNA, 16 nt, Pseudomonas putida KT2440
auagaucagcgaugcc

SEQ ID NO: 1574426 - RNA, 16 nt, Pseudomonas putida KT2440
auagccaugcaccguc

SEQ ID NO: 1574427 - RNA, 17 nt, Pseudomonas putida KT2440
auagccauugcggcuga

SEQ ID NO: 1574428 - RNA, 13 nt, Pseudomonas putida KT2440
auagcccaccguc

SEQ ID NO: 1574429 - RNA, 21 nt, Pseudomonas putida KT2440
auagccacaauggcgcacagg

SEQ ID NO: 1574430 - RNA, 22 nt, Pseudomonas putida KT2440
auacggcgcacucucgucaccu

SEQ ID NO: 1574431 - RNA, 23 nt, Pseudomonas putida KT2440
auacggcuugauauccagcaccg

SEQ ID NO: 1574432 - RNA, 15 nt, Pseudomonas putida KT2440
auacggggaggccgu

SEQ ID NO: 1574433 - RNA, 18 nt, Pseudomonas putida KT2440
auacgguaagccgccgug

SEQ ID NO: 1574434 - RNA, 16 nt, Pseudomonas putida KT2440
auacgugcaccggccu

SEQ ID NO: 1574435 - RNA, 20 nt, Pseudomonas putida KT2440
auaccgcaacaccugccgca

SEQ ID NO: 1574436 - RNA, 21 nt, Pseudomonas putida KT2440
auaccucccgcacugcugccg

SEQ ID NO: 1574437 - RNA, 16 nt, Pseudomonas putida KT2440
auacgauauccgcagc

SEQ ID NO: 1574438 - RNA, 16 nt, Pseudomonas putida KT2440
auacgcacaggcgcag

SEQ ID NO: 1574439 - RNA, 22 nt, Pseudomonas putida KT2440
auacgcaguacgugaaagcccg

SEQ ID NO: 1574440 - RNA, 13 nt, Pseudomonas putida KT2440
aguuugcccagcg

SEQ ID NO: 1574441 - RNA, 12 nt, Pseudomonas putida KT2440
aguuuucgcagu

SEQ ID NO: 1574442 - RNA, 16 nt, Pseudomonas putida KT2440
auaaaaaaaccggcca

SEQ ID NO: 1574443 - RNA, 22 nt, Pseudomonas putida KT2440
auaaccaaucaacgguggccag

SEQ ID NO: 1574444 - RNA, 23 nt, Pseudomonas putida KT2440
auaacaccccccagcagcgggca

SEQ ID NO: 1574445 - RNA, 23 nt, Pseudomonas putida KT2440
auaagcccaauacccaacagcau

SEQ ID NO: 1574446 - RNA, 18 nt, Pseudomonas putida KT2440
auaacuccagcgccagca

SEQ ID NO: 1574447 - RNA, 16 nt, Pseudomonas putida KT2440
agucucuuucaacagc

SEQ ID NO: 1574448 - RNA, 21 nt, Pseudomonas putida KT2440
agucucuuucaacagcuggcu

SEQ ID NO: 1574449 - RNA, 15 nt, Pseudomonas putida KT2440
agucacccaccggcu

SEQ ID NO: 1574450 - RNA, 19 nt, Pseudomonas putida KT2440
agucuucaagcucgaagcg

SEQ ID NO: 1574451 - RNA, 18 nt, Pseudomonas putida KT2440
agucuucucauagggugu

SEQ ID NO: 1574452 - RNA, 17 nt, Pseudomonas putida KT2440
agugcucggcaacggcc

SEQ ID NO: 1574453 - RNA, 17 nt, Pseudomonas putida KT2440
agugcguuggcugcuga

SEQ ID NO: 1574454 - RNA, 23 nt, Pseudomonas putida KT2440
agugcggcaaccaccaacagcac

SEQ ID NO: 1574455 - RNA, 18 nt, Pseudomonas putida KT2440
agugcuggggccgcaaag

SEQ ID NO: 1574456 - RNA, 16 nt, Pseudomonas putida KT2440
agugcgucggccacca

SEQ ID NO: 1574457 - RNA, 15 nt, Pseudomonas putida KT2440
aguggauauccagcg

SEQ ID NO: 1574458 - RNA, 21 nt, Pseudomonas putida KT2440
aguggaucaaccgaccagcgg

SEQ ID NO: 1574459 - RNA, 14 nt, Pseudomonas putida KT2440
agugcuucugccag

SEQ ID NO: 1574460 - RNA, 15 nt, Pseudomonas putida KT2440
aguggcacaccaugg

SEQ ID NO: 1574461 - RNA, 15 nt, Pseudomonas putida KT2440
agugcgaaacacgaa

SEQ ID NO: 1574462 - RNA, 20 nt, Pseudomonas putida KT2440
agugccugugagaucgagcg

SEQ ID NO: 1574463 - RNA, 14 nt, Pseudomonas putida KT2440
agugcggcaggccg

SEQ ID NO: 1574464 - RNA, 18 nt, Pseudomonas putida KT2440
agugcgcaugcccgcgca

SEQ ID NO: 1574465 - RNA, 13 nt, Pseudomonas putida KT2440
aguucgugcaccc

SEQ ID NO: 1574466 - RNA, 20 nt, Pseudomonas putida KT2440
aguucugcacagcgcggaac

SEQ ID NO: 1574467 - RNA, 21 nt, Pseudomonas putida KT2440
aguucauggucaccacgcccg

SEQ ID NO: 1574468 - RNA, 17 nt, Pseudomonas putida KT2440
aguucgacgcugcuguc

SEQ ID NO: 1574469 - RNA, 16 nt, Pseudomonas putida KT2440
aguuccuggcgcuccu

SEQ ID NO: 1574470 - RNA, 18 nt, Pseudomonas putida KT2440
aguuccaugucgugcugc

SEQ ID NO: 1574471 - RNA, 14 nt, Pseudomonas putida KT2440
aguagaucaucagc

SEQ ID NO: 1574472 - RNA, 16 nt, Pseudomonas putida KT2440
aguagaucaucagcgc

SEQ ID NO: 1574473 - RNA, 22 nt, Pseudomonas putida KT2440
aguacgccucgaaguaggcaaa

SEQ ID NO: 1574474 - RNA, 19 nt, Pseudomonas putida KT2440
aguacggccaucagcaagc

SEQ ID NO: 1574475 - RNA, 16 nt, Pseudomonas putida KT2440
aguacuuauaagcagc

SEQ ID NO: 1574476 - RNA, 15 nt, Pseudomonas putida KT2440
aguacuccagcagcg

SEQ ID NO: 1574477 - RNA, 15 nt, Pseudomonas putida KT2440
aguaaggaucgcgca

SEQ ID NO: 1574478 - RNA, 22 nt, Pseudomonas putida KT2440
aggugcacagggcggccaaggc

SEQ ID NO: 1574479 - RNA, 13 nt, Pseudomonas putida KT2440
aggugcaggguag

SEQ ID NO: 1574480 - RNA, 17 nt, Pseudomonas putida KT2440
aggugcccaagcggcac

SEQ ID NO: 1574481 - RNA, 22 nt, Pseudomonas putida KT2440
aggugcgauagauguccagcgu

SEQ ID NO: 1574482 - RNA, 19 nt, Pseudomonas putida KT2440
aggugcggcuuuagccgug

SEQ ID NO: 1574483 - RNA, 14 nt, Pseudomonas putida KT2440
agguuguucggcag

SEQ ID NO: 1574484 - RNA, 13 nt, Pseudomonas putida KT2440
agguuuugcagcg

SEQ ID NO: 1574485 - RNA, 17 nt, Pseudomonas putida KT2440
agguccagccgccauuu

SEQ ID NO: 1574486 - RNA, 12 nt, Pseudomonas putida KT2440
aggucagugaug

SEQ ID NO: 1574487 - RNA, 14 nt, Pseudomonas putida KT2440
aggucaucgaacac

SEQ ID NO: 1574488 - RNA, 13 nt, Pseudomonas putida KT2440
agguccaggcugc

SEQ ID NO: 1574489 - RNA, 23 nt, Pseudomonas putida KT2440
agguccaggcugcgcgccauggc

SEQ ID NO: 1574490 - RNA, 13 nt, Pseudomonas putida KT2440
agguccaguucgc

SEQ ID NO: 1574491 - RNA, 16 nt, Pseudomonas putida KT2440
agguccaggccagcuu

SEQ ID NO: 1574492 - RNA, 23 nt, Pseudomonas putida KT2440
agguccauguugugcuggcggcu

SEQ ID NO: 1574493 - RNA, 19 nt, Pseudomonas putida KT2440
agggucuucucaggcacca

SEQ ID NO: 1574494 - RNA, 23 nt, Pseudomonas putida KT2440
agggucuucucaggcaccagcgc

SEQ ID NO: 1574495 - RNA, 17 nt, Pseudomonas putida KT2440
agggucuugcucgcgcu

SEQ ID NO: 1574496 - RNA, 18 nt, Pseudomonas putida KT2440
agggugaucgcgcuggca

SEQ ID NO: 1574497 - RNA, 18 nt, Pseudomonas putida KT2440
agggugaggugcugcaga

SEQ ID NO: 1574498 - RNA, 17 nt, Pseudomonas putida KT2440
aggucagcaagccgccg

SEQ ID NO: 1574499 - RNA, 20 nt, Pseudomonas putida KT2440
agguauucgaggaucagcgc

SEQ ID NO: 1574500 - RNA, 23 nt, Pseudomonas putida KT2440
aggucgguagggaucaccgccag

SEQ ID NO: 1574501 - RNA, 23 nt, Pseudomonas putida KT2440
aggucggcucgucgaacagcaug

SEQ ID NO: 1574502 - RNA, 18 nt, Pseudomonas putida KT2440
aggucgggaauugcagcc

SEQ ID NO: 1574503 - RNA, 17 nt, Pseudomonas putida KT2440
aggugaucguugcgcgc

SEQ ID NO: 1574504 - RNA, 20 nt, Pseudomonas putida KT2440
aggucgauccgggugcuggc

SEQ ID NO: 1574505 - RNA, 19 nt, Pseudomonas putida KT2440
agguccgagugcucgauca

SEQ ID NO: 1574506 - RNA, 15 nt, Pseudomonas putida KT2440
aggucgaccgagaag

SEQ ID NO: 1574507 - RNA, 22 nt, Pseudomonas putida KT2440
aggucgacacccagcacccgca

SEQ ID NO: 1574508 - RNA, 20 nt, Pseudomonas putida KT2440
aggcggguuugggcagugac

SEQ ID NO: 1574509 - RNA, 20 nt, Pseudomonas putida KT2440
aggcggcgacaaccgaaaag

SEQ ID NO: 1574510 - RNA, 13 nt, Pseudomonas putida KT2440
aggcuaugccggu

SEQ ID NO: 1574511 - RNA, 19 nt, Pseudomonas putida KT2440
aggcucuugaggucggcgc

SEQ ID NO: 1574512 - RNA, 13 nt, Pseudomonas putida KT2440
aggcucuccagcc

SEQ ID NO: 1574513 - RNA, 19 nt, Pseudomonas putida KT2440
aggcucuccauugcgccug

SEQ ID NO: 1574514 - RNA, 21 nt, Pseudomonas putida KT2440
aggcucuccauugcgccuguc

SEQ ID NO: 1574515 - RNA, 14 nt, Pseudomonas putida KT2440
aggcgucacccgcg

SEQ ID NO: 1574516 - RNA, 18 nt, Pseudomonas putida KT2440
aggcgucacgcagggcca

SEQ ID NO: 1574517 - RNA, 14 nt, Pseudomonas putida KT2440
aggggcagccaggu

SEQ ID NO: 1574518 - RNA, 21 nt, Pseudomonas putida KT2440
aggggccggcacaggcuuaca

SEQ ID NO: 1574519 - RNA, 20 nt, Pseudomonas putida KT2440
aggggcuagcuacucggcaa

SEQ ID NO: 1574520 - RNA, 22 nt, Pseudomonas putida KT2440
agggucgggcacaggcccagca

SEQ ID NO: 1574521 - RNA, 13 nt, Pseudomonas putida KT2440
agggcguugccga

SEQ ID NO: 1574522 - RNA, 19 nt, Pseudomonas putida KT2440
agggcccagccaccgacga

SEQ ID NO: 1574523 - RNA, 19 nt, Pseudomonas putida KT2440
agggcccucaacccucgcc

SEQ ID NO: 1574524 - RNA, 15 nt, Pseudomonas putida KT2440
aggcuguuggcgguc

SEQ ID NO: 1574525 - RNA, 21 nt, Pseudomonas putida KT2440
aggcugucggcgucggccaug

SEQ ID NO: 1574526 - RNA, 17 nt, Pseudomonas putida KT2440
aggcuggucgcugcccu

SEQ ID NO: 1574527 - RNA, 17 nt, Pseudomonas putida KT2440
aggcugggcgugacggc

SEQ ID NO: 1574528 - RNA, 15 nt, Pseudomonas putida KT2440
aggcugucacgauga

SEQ ID NO: 1574529 - RNA, 19 nt, Pseudomonas putida KT2440
aggcugucacgaugaugcu

SEQ ID NO: 1574530 - RNA, 18 nt, Pseudomonas putida KT2440
aggccguagcgcugacca

SEQ ID NO: 1574531 - RNA, 22 nt, Pseudomonas putida KT2440
aggccguaggccagguacaggc

SEQ ID NO: 1574532 - RNA, 14 nt, Pseudomonas putida KT2440
aggccgucagcagc

SEQ ID NO: 1574533 - RNA, 13 nt, Pseudomonas putida KT2440
aggccggggaugc

SEQ ID NO: 1574534 - RNA, 16 nt, Pseudomonas putida KT2440
aggccgguacagccag

SEQ ID NO: 1574535 - RNA, 17 nt, Pseudomonas putida KT2440
aggccgguacagccagc

SEQ ID NO: 1574536 - RNA, 15 nt, Pseudomonas putida KT2440
aggccgguaggccuc

SEQ ID NO: 1574537 - RNA, 21 nt, Pseudomonas putida KT2440
aggccgguuuuuucaugcacg

SEQ ID NO: 1574538 - RNA, 18 nt, Pseudomonas putida KT2440
aggccggccauaccggua

SEQ ID NO: 1574539 - RNA, 15 nt, Pseudomonas putida KT2440
aggccggcaucgacg

SEQ ID NO: 1574540 - RNA, 18 nt, Pseudomonas putida KT2440
aggccggaccugcuggcc

SEQ ID NO: 1574541 - RNA, 18 nt, Pseudomonas putida KT2440
aggccggcgcagauggug

SEQ ID NO: 1574542 - RNA, 17 nt, Pseudomonas putida KT2440
aggccgaguaaccggcg

SEQ ID NO: 1574543 - RNA, 15 nt, Pseudomonas putida KT2440
aggccgagcgcgagc

SEQ ID NO: 1574544 - RNA, 14 nt, Pseudomonas putida KT2440
aggcccggcagguu

SEQ ID NO: 1574545 - RNA, 14 nt, Pseudomonas putida KT2440
aggccgcugugcca

SEQ ID NO: 1574546 - RNA, 22 nt, Pseudomonas putida KT2440
aggccgcuccugcggucagccu

SEQ ID NO: 1574547 - RNA, 16 nt, Pseudomonas putida KT2440
aggccagccagguaug

SEQ ID NO: 1574548 - RNA, 23 nt, Pseudomonas putida KT2440
aggcccaguucggacaggcgcuu

SEQ ID NO: 1574549 - RNA, 19 nt, Pseudomonas putida KT2440
aggccccuuggccaacggc

SEQ ID NO: 1574550 - RNA, 21 nt, Pseudomonas putida KT2440
aggcccggcugaaaccgcgaa

SEQ ID NO: 1574551 - RNA, 23 nt, Pseudomonas putida KT2440
aggcccgcuauccucgaucgcca

SEQ ID NO: 1574552 - RNA, 14 nt, Pseudomonas putida KT2440
aggccccgacagca

SEQ ID NO: 1574553 - RNA, 16 nt, Pseudomonas putida KT2440
aggccccgauacagcg

SEQ ID NO: 1574554 - RNA, 18 nt, Pseudomonas putida KT2440
aggcccgaacuggccggu

SEQ ID NO: 1574555 - RNA, 17 nt, Pseudomonas putida KT2440
aggcauacagcuggccu

SEQ ID NO: 1574556 - RNA, 19 nt, Pseudomonas putida KT2440
aggcauagcgguacagcac

SEQ ID NO: 1574557 - RNA, 21 nt, Pseudomonas putida KT2440
aggcauagcgguacagcaccc

SEQ ID NO: 1574558 - RNA, 19 nt, Pseudomonas putida KT2440
aggcauccagggcgucggc

SEQ ID NO: 1574559 - RNA, 15 nt, Pseudomonas putida KT2440
aggcaugcgucuggc

SEQ ID NO: 1574560 - RNA, 19 nt, Pseudomonas putida KT2440
aggcaugccagcagcuggc

SEQ ID NO: 1574561 - RNA, 22 nt, Pseudomonas putida KT2440
aggcaucguuguaagccaugau

SEQ ID NO: 1574562 - RNA, 20 nt, Pseudomonas putida KT2440
aggccacgccgccuucggac

SEQ ID NO: 1574563 - RNA, 14 nt, Pseudomonas putida KT2440
aggccacgguaggc

SEQ ID NO: 1574564 - RNA, 16 nt, Pseudomonas putida KT2440
aggccagcacggccag

SEQ ID NO: 1574565 - RNA, 20 nt, Pseudomonas putida KT2440
agcuggagaucuugucgacc

SEQ ID NO: 1574566 - RNA, 16 nt, Pseudomonas putida KT2440
agcuggcaaugcaacu

SEQ ID NO: 1574567 - RNA, 15 nt, Pseudomonas putida KT2440
agcuggagccggauc

SEQ ID NO: 1574568 - RNA, 16 nt, Pseudomonas putida KT2440
agcuggccaucgaccc

SEQ ID NO: 1574569 - RNA, 16 nt, Pseudomonas putida KT2440
agcuggaacgcuuggc

SEQ ID NO: 1574570 - RNA, 19 nt, Pseudomonas putida KT2440
agcuggagacgaacagcgc

SEQ ID NO: 1574571 - RNA, 13 nt, Pseudomonas putida KT2440
aggcacuggccag

SEQ ID NO: 1574572 - RNA, 17 nt, Pseudomonas putida KT2440
aggcagaccacgcgcuc

SEQ ID NO: 1574573 - RNA, 23 nt, Pseudomonas putida KT2440
aggcaguccugcaacucggccuu

SEQ ID NO: 1574574 - RNA, 16 nt, Pseudomonas putida KT2440
aggcaguaggccaccg

SEQ ID NO: 1574575 - RNA, 13 nt, Pseudomonas putida KT2440
aggcagcugccuu

SEQ ID NO: 1574576 - RNA, 20 nt, Pseudomonas putida KT2440
aggcaggccagcacggccag

SEQ ID NO: 1574577 - RNA, 14 nt, Pseudomonas putida KT2440
aggcagccugccag

SEQ ID NO: 1574578 - RNA, 20 nt, Pseudomonas putida KT2440
aggcagcaacgccuucaggc

SEQ ID NO: 1574579 - RNA, 22 nt, Pseudomonas putida KT2440
aggcgcugaaacugucguggcg

SEQ ID NO: 1574580 - RNA, 17 nt, Pseudomonas putida KT2440
aggcgcuccagcagggu

SEQ ID NO: 1574581 - RNA, 19 nt, Pseudomonas putida KT2440
aggcgcggguuuacccgcg

SEQ ID NO: 1574582 - RNA, 21 nt, Pseudomonas putida KT2440
aggcgcggguuuacccgcgaa

SEQ ID NO: 1574583 - RNA, 20 nt, Pseudomonas putida KT2440
aggcgcggguuugcccgcga

SEQ ID NO: 1574584 - RNA, 21 nt, Pseudomonas putida KT2440
aggcgcggguuugcccgcgaa

SEQ ID NO: 1574585 - RNA, 21 nt, Pseudomonas putida KT2440
aggcgcggguuugcccgcgag

SEQ ID NO: 1574586 - RNA, 17 nt, Pseudomonas putida KT2440
aggcgcggugccggcag

SEQ ID NO: 1574587 - RNA, 23 nt, Pseudomonas putida KT2440
aggcgcggcagcaugaacagcgc

SEQ ID NO: 1574588 - RNA, 21 nt, Pseudomonas putida KT2440
aggcggcaagggcgaaccagg

SEQ ID NO: 1574589 - RNA, 15 nt, Pseudomonas putida KT2440
aggcgcuugagcucg

SEQ ID NO: 1574590 - RNA, 21 nt, Pseudomonas putida KT2440
aggcgcgccugcaccugacga

SEQ ID NO: 1574591 - RNA, 15 nt, Pseudomonas putida KT2440
aggcgccugccgggu

SEQ ID NO: 1574592 - RNA, 15 nt, Pseudomonas putida KT2440
aggcgcaggugcagc

SEQ ID NO: 1574593 - RNA, 12 nt, Pseudomonas putida KT2440
aggcgcagcugc

SEQ ID NO: 1574594 - RNA, 15 nt, Pseudomonas putida KT2440
aggccguggcaaggc

SEQ ID NO: 1574595 - RNA, 16 nt, Pseudomonas putida KT2440
aggccguugaucagcg

SEQ ID NO: 1574596 - RNA, 14 nt, Pseudomonas putida KT2440
aggccuccagguaa

SEQ ID NO: 1574597 - RNA, 17 nt, Pseudomonas putida KT2440
aggccuaucuucgucau

SEQ ID NO: 1574598 - RNA, 19 nt, Pseudomonas putida KT2440
aggccuucagcgcggcaac

SEQ ID NO: 1574599 - RNA, 19 nt, Pseudomonas putida KT2440
aggccugcgaaaggcgcuc

SEQ ID NO: 1574600 - RNA, 23 nt, Pseudomonas putida KT2440
aggccuuguuccacgcgcaggcg

SEQ ID NO: 1574601 - RNA, 18 nt, Pseudomonas putida KT2440
aggccuuggccaccucau

SEQ ID NO: 1574602 - RNA, 13 nt, Pseudomonas putida KT2440
aggccuucugcgc

SEQ ID NO: 1574603 - RNA, 15 nt, Pseudomonas putida KT2440
aggccuugccgcuca

SEQ ID NO: 1574604 - RNA, 15 nt, Pseudomonas putida KT2440
aggcgagguucagcg

SEQ ID NO: 1574605 - RNA, 19 nt, Pseudomonas putida KT2440
aggcgacgaucaucgcgcc

SEQ ID NO: 1574606 - RNA, 15 nt, Pseudomonas putida KT2440
aggcgacgagccagu

SEQ ID NO: 1574607 - RNA, 18 nt, Pseudomonas putida KT2440
aggcgauggcauccacac

SEQ ID NO: 1574608 - RNA, 15 nt, Pseudomonas putida KT2440
aggcgaucuggcgga

SEQ ID NO: 1574609 - RNA, 20 nt, Pseudomonas putida KT2440
aggcgauaccgccaucgauc

SEQ ID NO: 1574610 - RNA, 15 nt, Pseudomonas putida KT2440
augccgugaugguau

SEQ ID NO: 1574611 - RNA, 20 nt, Pseudomonas putida KT2440
augccuacugcuggcgcgac

SEQ ID NO: 1574612 - RNA, 19 nt, Pseudomonas putida KT2440
augaucugcaagcgcagcc

SEQ ID NO: 1574613 - RNA, 14 nt, Pseudomonas putida KT2440
augaucgcggcaau

SEQ ID NO: 1574614 - RNA, 22 nt, Pseudomonas putida KT2440
augaucgcggcguugucagccu

SEQ ID NO: 1574615 - RNA, 15 nt, Pseudomonas putida KT2440
augaugcuauggcuu

SEQ ID NO: 1574616 - RNA, 23 nt, Pseudomonas putida KT2440
augccgagggugaggugcugcag

SEQ ID NO: 1574617 - RNA, 15 nt, Pseudomonas putida KT2440
augcgucggcgugga

SEQ ID NO: 1574618 - RNA, 20 nt, Pseudomonas putida KT2440
augcguagguuauuggccag

SEQ ID NO: 1574619 - RNA, 22 nt, Pseudomonas putida KT2440
augcuguuugugccggccucuu

SEQ ID NO: 1574620 - RNA, 15 nt, Pseudomonas putida KT2440
augcuggucgaacaa

SEQ ID NO: 1574621 - RNA, 12 nt, Pseudomonas putida KT2440
augcuucgcggg

SEQ ID NO: 1574622 - RNA, 18 nt, Pseudomonas putida KT2440
augccgguuugcggccuu

SEQ ID NO: 1574623 - RNA, 16 nt, Pseudomonas putida KT2440
augcgggcuuuccacg

SEQ ID NO: 1574624 - RNA, 13 nt, Pseudomonas putida KT2440
augcggccacagc

SEQ ID NO: 1574625 - RNA, 18 nt, Pseudomonas putida KT2440
augcggacccagcgguca

SEQ ID NO: 1574626 - RNA, 16 nt, Pseudomonas putida KT2440
augcgcuugaggcuuu

SEQ ID NO: 1574627 - RNA, 15 nt, Pseudomonas putida KT2440
auggcucaucgccgu

SEQ ID NO: 1574628 - RNA, 18 nt, Pseudomonas putida KT2440
auggcugcggcagguagg

SEQ ID NO: 1574629 - RNA, 23 nt, Pseudomonas putida KT2440
augggcaccggccaccaggcgcg

SEQ ID NO: 1574630 - RNA, 19 nt, Pseudomonas putida KT2440
auggcgucuucgccaggug

SEQ ID NO: 1574631 - RNA, 16 nt, Pseudomonas putida KT2440
auggcggaucagcgcg

SEQ ID NO: 1574632 - RNA, 23 nt, Pseudomonas putida KT2440
auggcgaaucagcaugcccagcg

SEQ ID NO: 1574633 - RNA, 14 nt, Pseudomonas putida KT2440
auggccuggcgggu

SEQ ID NO: 1574634 - RNA, 12 nt, Pseudomonas putida KT2440
auggccgugcaa

SEQ ID NO: 1574635 - RNA, 17 nt, Pseudomonas putida KT2440
auggccagccggcagca

SEQ ID NO: 1574636 - RNA, 19 nt, Pseudomonas putida KT2440
auggccccgcccagguuac

SEQ ID NO: 1574637 - RNA, 20 nt, Pseudomonas putida KT2440
auggugguuuauccggcaca

SEQ ID NO: 1574638 - RNA, 23 nt, Pseudomonas putida KT2440
augguguucaugcccaccgcugc

SEQ ID NO: 1574639 - RNA, 20 nt, Pseudomonas putida KT2440
auguaccgggcggccaccgg

SEQ ID NO: 1574640 - RNA, 17 nt, Pseudomonas putida KT2440
auguacagaaugcgcuc

SEQ ID NO: 1574641 - RNA, 13 nt, Pseudomonas putida KT2440
auggugacugcca

SEQ ID NO: 1574642 - RNA, 16 nt, Pseudomonas putida KT2440
augggcaggcccaggu

SEQ ID NO: 1574643 - RNA, 18 nt, Pseudomonas putida KT2440
augggccaugcccaccgc

SEQ ID NO: 1574644 - RNA, 15 nt, Pseudomonas putida KT2440
augggccgcagagcg

SEQ ID NO: 1574645 - RNA, 17 nt, Pseudomonas putida KT2440
auguagaccaccagcgu

SEQ ID NO: 1574646 - RNA, 15 nt, Pseudomonas putida KT2440
auguagcgccuggcc

SEQ ID NO: 1574647 - RNA, 16 nt, Pseudomonas putida KT2440
auguaguucuugcgca

SEQ ID NO: 1574648 - RNA, 14 nt, Pseudomonas putida KT2440
augucccaguucau

SEQ ID NO: 1574649 - RNA, 19 nt, Pseudomonas putida KT2440
auguccgcgccagcggcca

SEQ ID NO: 1574650 - RNA, 14 nt, Pseudomonas putida KT2440
auguccugcugcag

SEQ ID NO: 1574651 - RNA, 12 nt, Pseudomonas putida KT2440
auguccucggcg

SEQ ID NO: 1574652 - RNA, 18 nt, Pseudomonas putida KT2440
augucggcguggaugauc

SEQ ID NO: 1574653 - RNA, 19 nt, Pseudomonas putida KT2440
auguuggccgagucggugg

SEQ ID NO: 1574654 - RNA, 17 nt, Pseudomonas putida KT2440
auguggcgcagcaccgu

SEQ ID NO: 1574655 - RNA, 14 nt, Pseudomonas putida KT2440
augugcucggccug

SEQ ID NO: 1574656 - RNA, 14 nt, Pseudomonas putida KT2440
auguucaucaccgg

SEQ ID NO: 1574657 - RNA, 13 nt, Pseudomonas putida KT2440
auuauuggccagc

SEQ ID NO: 1574658 - RNA, 15 nt, Pseudomonas putida KT2440
auugacccgacggcu

SEQ ID NO: 1574659 - RNA, 19 nt, Pseudomonas putida KT2440
auugaccagcgacgguggc

SEQ ID NO: 1574660 - RNA, 13 nt, Pseudomonas putida KT2440
auugaauguugau

SEQ ID NO: 1574661 - RNA, 14 nt, Pseudomonas putida KT2440
auugaauucuggcu

SEQ ID NO: 1574662 - RNA, 21 nt, Pseudomonas putida KT2440
auucgcugcgcaucacccgcc

SEQ ID NO: 1574663 - RNA, 15 nt, Pseudomonas putida KT2440
auucggccggccaga

SEQ ID NO: 1574664 - RNA, 13 nt, Pseudomonas putida KT2440
auuccuugcagcg

SEQ ID NO: 1574665 - RNA, 19 nt, Pseudomonas putida KT2440
auuccugugggagcgggcg

SEQ ID NO: 1574666 - RNA, 13 nt, Pseudomonas putida KT2440
auucgcgggcaug

SEQ ID NO: 1574667 - RNA, 20 nt, Pseudomonas putida KT2440
auucgcgggcaugcccgcuc

SEQ ID NO: 1574668 - RNA, 19 nt, Pseudomonas putida KT2440
auucgcggguaaacccgcg

SEQ ID NO: 1574669 - RNA, 19 nt, Pseudomonas putida KT2440
auucgcggguaaacccgcu

SEQ ID NO: 1574670 - RNA, 20 nt, Pseudomonas putida KT2440
auucgcggguaaacccgcuc

SEQ ID NO: 1574671 - RNA, 18 nt, Pseudomonas putida KT2440
auugguggugcugggcau

SEQ ID NO: 1574672 - RNA, 13 nt, Pseudomonas putida KT2440
auuggagcggccu

SEQ ID NO: 1574673 - RNA, 15 nt, Pseudomonas putida KT2440
auuguaggcggcaag

SEQ ID NO: 1574674 - RNA, 21 nt, Pseudomonas putida KT2440
auuguucgccucgucggcgcg

SEQ ID NO: 1574675 - RNA, 13 nt, Pseudomonas putida KT2440
auugcacccgcgg

SEQ ID NO: 1574676 - RNA, 21 nt, Pseudomonas putida KT2440
auugccugggcgagccacucg

SEQ ID NO: 1574677 - RNA, 21 nt, Pseudomonas putida KT2440
auugcuccauauguagcgguc

SEQ ID NO: 1574678 - RNA, 16 nt, Pseudomonas putida KT2440
aucgcccccgcugcac

SEQ ID NO: 1574679 - RNA, 22 nt, Pseudomonas putida KT2440
aucgccagcaggccgccgacga

SEQ ID NO: 1574680 - RNA, 19 nt, Pseudomonas putida KT2440
aucgccaaccccaacccgg

SEQ ID NO: 1574681 - RNA, 14 nt, Pseudomonas putida KT2440
aucgcauacagcgc

SEQ ID NO: 1574682 - RNA, 16 nt, Pseudomonas putida KT2440
aucgcauucgccggca

SEQ ID NO: 1574683 - RNA, 21 nt, Pseudomonas putida KT2440
aucgcacucaguuaaucagca

SEQ ID NO: 1574684 - RNA, 20 nt, Pseudomonas putida KT2440
aucgaucugcucgcccaccg

SEQ ID NO: 1574685 - RNA, 24 nt, Pseudomonas putida KT2440
aucgaucaggaaggcaccacggaa

SEQ ID NO: 1574686 - RNA, 22 nt, Pseudomonas putida KT2440
aucgauggucuucgccgccaug

SEQ ID NO: 1574687 - RNA, 23 nt, Pseudomonas putida KT2440
aucaggccuucggugcuggcgcu

SEQ ID NO: 1574688 - RNA, 17 nt, Pseudomonas putida KT2440
aucaggcugaucaccgc

SEQ ID NO: 1574689 - RNA, 20 nt, Pseudomonas putida KT2440
aucgacaggugcggcagcuc

SEQ ID NO: 1574690 - RNA, 21 nt, Pseudomonas putida KT2440
aucaggauugccgcagcugcg

SEQ ID NO: 1574691 - RNA, 16 nt, Pseudomonas putida KT2440
aucaggcaggccagca

SEQ ID NO: 1574692 - RNA, 15 nt, Pseudomonas putida KT2440
aucgacgggcauggc

SEQ ID NO: 1574693 - RNA, 15 nt, Pseudomonas putida KT2440
aucgaccuggcccga

SEQ ID NO: 1574694 - RNA, 14 nt, Pseudomonas putida KT2440
aucgacccuggcau

SEQ ID NO: 1574695 - RNA, 14 nt, Pseudomonas putida KT2440
aucgagcgcccacg

SEQ ID NO: 1574696 - RNA, 15 nt, Pseudomonas putida KT2440
aucgagccgaacagc

SEQ ID NO: 1574697 - RNA, 18 nt, Pseudomonas putida KT2440
aucgagccggucacgauc

SEQ ID NO: 1574698 - RNA, 16 nt, Pseudomonas putida KT2440
aucgacuucaaugccc

SEQ ID NO: 1574699 - RNA, 18 nt, Pseudomonas putida KT2440
aucgauacccacgccaug

SEQ ID NO: 1574700 - RNA, 17 nt, Pseudomonas putida KT2440
aucgcugacuuccagca

SEQ ID NO: 1574701 - RNA, 23 nt, Pseudomonas putida KT2440
aucgcucaccguucuucuccaac

SEQ ID NO: 1574702 - RNA, 13 nt, Pseudomonas putida KT2440
aucgcucaugccc

SEQ ID NO: 1574703 - RNA, 16 nt, Pseudomonas putida KT2440
aucgcuuacagauguc

SEQ ID NO: 1574704 - RNA, 18 nt, Pseudomonas putida KT2440
aucggacgaugaggccgg

SEQ ID NO: 1574705 - RNA, 20 nt, Pseudomonas putida KT2440
aucgcgcuugcgguccugca

SEQ ID NO: 1574706 - RNA, 23 nt, Pseudomonas putida KT2440
aucgcgccuucauaggcggccac

SEQ ID NO: 1574707 - RNA, 20 nt, Pseudomonas putida KT2440
aucgccgcgcugauaucgau

SEQ ID NO: 1574708 - RNA, 14 nt, Pseudomonas putida KT2440
aucgccgggcgcac

SEQ ID NO: 1574709 - RNA, 14 nt, Pseudomonas putida KT2440
aucgccgucgacca

SEQ ID NO: 1574710 - RNA, 22 nt, Pseudomonas putida KT2440
aucgccgcaucguuauccagca

SEQ ID NO: 1574711 - RNA, 18 nt, Pseudomonas putida KT2440
aucgcgacacaaggccgc

SEQ ID NO: 1574712 - RNA, 19 nt, Pseudomonas putida KT2440
aucgcgaggcccgaacugg

SEQ ID NO: 1574713 - RNA, 15 nt, Pseudomonas putida KT2440
aucgcgcaagccuuu

SEQ ID NO: 1574714 - RNA, 16 nt, Pseudomonas putida KT2440
aucgccucggcacugc

SEQ ID NO: 1574715 - RNA, 12 nt, Pseudomonas putida KT2440
aucgccucgauc

SEQ ID NO: 1574716 - RNA, 14 nt, Pseudomonas putida KT2440
aucggcuccagcgc

SEQ ID NO: 1574717 - RNA, 16 nt, Pseudomonas putida KT2440
aucggcgcugacgaac

SEQ ID NO: 1574718 - RNA, 16 nt, Pseudomonas putida KT2440
aucggcgccggccgca

SEQ ID NO: 1574719 - RNA, 11 nt, Pseudomonas putida KT2440
aucggccaccg

SEQ ID NO: 1574720 - RNA, 20 nt, Pseudomonas putida KT2440
aucggcaugcagcggccagu

SEQ ID NO: 1574721 - RNA, 20 nt, Pseudomonas putida KT2440
aucggccucuucgcggguaa

SEQ ID NO: 1574722 - RNA, 23 nt, Pseudomonas putida KT2440
aucggccggcucgaacugaagga

SEQ ID NO: 1574723 - RNA, 18 nt, Pseudomonas putida KT2440
aucggcacgaagcccagu

SEQ ID NO: 1574724 - RNA, 18 nt, Pseudomonas putida KT2440
aucggcacgccagcagcg

SEQ ID NO: 1574725 - RNA, 19 nt, Pseudomonas putida KT2440
aucggcacgccagcagcgu

SEQ ID NO: 1574726 - RNA, 22 nt, Pseudomonas putida KT2440
aucggcaggucauuggcgccau

SEQ ID NO: 1574727 - RNA, 20 nt, Pseudomonas putida KT2440
aucggcagcgcgcaggucgu

SEQ ID NO: 1574728 - RNA, 20 nt, Pseudomonas putida KT2440
aucggcaaacacauccagcg

SEQ ID NO: 1574729 - RNA, 21 nt, Pseudomonas putida KT2440
aucggcaaacacauccagcgc

SEQ ID NO: 1574730 - RNA, 20 nt, Pseudomonas putida KT2440
aucgugacggucugccggca

SEQ ID NO: 1574731 - RNA, 19 nt, Pseudomonas putida KT2440
aucguuguaggagcgggcu

SEQ ID NO: 1574732 - RNA, 20 nt, Pseudomonas putida KT2440
aucguccgccgcgcugacca

SEQ ID NO: 1574733 - RNA, 18 nt, Pseudomonas putida KT2440
aucggguaagccaugcgc

SEQ ID NO: 1574734 - RNA, 19 nt, Pseudomonas putida KT2440
aucggcuuucauugaguug

SEQ ID NO: 1574735 - RNA, 21 nt, Pseudomonas putida KT2440
aucgucacauccugcucgucg

SEQ ID NO: 1574736 - RNA, 13 nt, Pseudomonas putida KT2440
aucgguacgccgc

SEQ ID NO: 1574737 - RNA, 21 nt, Pseudomonas putida KT2440
aucugucagguguggcucagc

SEQ ID NO: 1574738 - RNA, 20 nt, Pseudomonas putida KT2440
aucugguugcuggcgccagc

SEQ ID NO: 1574739 - RNA, 21 nt, Pseudomonas putida KT2440
aucuggucgaagcucagguag

SEQ ID NO: 1574740 - RNA, 13 nt, Pseudomonas putida KT2440
aucugcucgacga

SEQ ID NO: 1574741 - RNA, 21 nt, Pseudomonas putida KT2440
aucucgaucaugucgccguau

SEQ ID NO: 1574742 - RNA, 16 nt, Pseudomonas putida KT2440
augaucaggccgcuca

SEQ ID NO: 1574743 - RNA, 16 nt, Pseudomonas putida KT2440
augaucgaaagcgguu

SEQ ID NO: 1574744 - RNA, 21 nt, Pseudomonas putida KT2440
augaucgaagcgacagcggcc

SEQ ID NO: 1574745 - RNA, 22 nt, Pseudomonas putida KT2440
augaucgaagcgacagcggcca

SEQ ID NO: 1574746 - RNA, 14 nt, Pseudomonas putida KT2440
cacccucugccauc

SEQ ID NO: 1574747 - RNA, 21 nt, Pseudomonas putida KT2440
cacccugaucgaugagcgagc

SEQ ID NO: 1574748 - RNA, 16 nt, Pseudomonas putida KT2440
cacccucgcaccacag

SEQ ID NO: 1574749 - RNA, 14 nt, Pseudomonas putida KT2440
cacccgugccugcc

SEQ ID NO: 1574750 - RNA, 24 nt, Pseudomonas putida KT2440
cacccugucguuauccugcagcac

SEQ ID NO: 1574751 - RNA, 16 nt, Pseudomonas putida KT2440
cacccuggucacgcag

SEQ ID NO: 1574752 - RNA, 16 nt, Pseudomonas putida KT2440
cacccuuccccccugg

SEQ ID NO: 1574753 - RNA, 17 nt, Pseudomonas putida KT2440
cacccuuuaggggcucu

SEQ ID NO: 1574754 - RNA, 15 nt, Pseudomonas putida KT2440
cacccuugggcacca

SEQ ID NO: 1574755 - RNA, 12 nt, Pseudomonas putida KT2440
cacccuugggcu

SEQ ID NO: 1574756 - RNA, 20 nt, Pseudomonas putida KT2440
cacccuugggcucagccgcc

SEQ ID NO: 1574757 - RNA, 14 nt, Pseudomonas putida KT2440
caccgaagcaccac

SEQ ID NO: 1574758 - RNA, 18 nt, Pseudomonas putida KT2440
caccgaaggccgccggca

SEQ ID NO: 1574759 - RNA, 16 nt, Pseudomonas putida KT2440
caccgaaggcgucacc

SEQ ID NO: 1574760 - RNA, 13 nt, Pseudomonas putida KT2440
caccgaaccggcg

SEQ ID NO: 1574761 - RNA, 19 nt, Pseudomonas putida KT2440
caccgaaccggcgaucagg

SEQ ID NO: 1574762 - RNA, 19 nt, Pseudomonas putida KT2440
caccgaaaucagcaacgcc

SEQ ID NO: 1574763 - RNA, 15 nt, Pseudomonas putida KT2440
cacccgugcaggggu

SEQ ID NO: 1574764 - RNA, 20 nt, Pseudomonas putida KT2440
cacccggucggccagcugcu

SEQ ID NO: 1574765 - RNA, 14 nt, Pseudomonas putida KT2440
cacccggugacggc

SEQ ID NO: 1574766 - RNA, 17 nt, Pseudomonas putida KT2440
cacccgggaacagcagc

SEQ ID NO: 1574767 - RNA, 18 nt, Pseudomonas putida KT2440
cacccgggaacagcagca

SEQ ID NO: 1574768 - RNA, 19 nt, Pseudomonas putida KT2440
cacccgggaacagcagcac

SEQ ID NO: 1574769 - RNA, 20 nt, Pseudomonas putida KT2440
cacccgggaacagcagcacc

SEQ ID NO: 1574770 - RNA, 22 nt, Pseudomonas putida KT2440
cacccgcugcacgucgcgcagg

SEQ ID NO: 1574771 - RNA, 19 nt, Pseudomonas putida KT2440
cacccgcuugccacggcgu

SEQ ID NO: 1574772 - RNA, 20 nt, Pseudomonas putida KT2440
caccgaucacggggcgacgc

SEQ ID NO: 1574773 - RNA, 23 nt, Pseudomonas putida KT2440
caccgaucacggggcgacgcauc

SEQ ID NO: 1574774 - RNA, 14 nt, Pseudomonas putida KT2440
caccgauccggugu

SEQ ID NO: 1574775 - RNA, 16 nt, Pseudomonas putida KT2440
caccgacgccgaucaa

SEQ ID NO: 1574776 - RNA, 16 nt, Pseudomonas putida KT2440
caccgccaccaucggc

SEQ ID NO: 1574777 - RNA, 13 nt, Pseudomonas putida KT2440
caccgccaaggca

SEQ ID NO: 1574778 - RNA, 17 nt, Pseudomonas putida KT2440
caccgccacaauccgcu

SEQ ID NO: 1574779 - RNA, 18 nt, Pseudomonas putida KT2440
caccgcauugcaggccag

SEQ ID NO: 1574780 - RNA, 20 nt, Pseudomonas putida KT2440
caccgcauugcaggccagcg

SEQ ID NO: 1574781 - RNA, 19 nt, Pseudomonas putida KT2440
caccgauguguguccacca

SEQ ID NO: 1574782 - RNA, 15 nt, Pseudomonas putida KT2440
caccgauuaccuguu

SEQ ID NO: 1574783 - RNA, 14 nt, Pseudomonas putida KT2440
caccgaugccugug

SEQ ID NO: 1574784 - RNA, 23 nt, Pseudomonas putida KT2440
caccgaugccuuuuuuugccgca

SEQ ID NO: 1574785 - RNA, 17 nt, Pseudomonas putida KT2440
caccgaucucgccagcc

SEQ ID NO: 1574786 - RNA, 17 nt, Pseudomonas putida KT2440
caccgccacugaccagc

SEQ ID NO: 1574787 - RNA, 19 nt, Pseudomonas putida KT2440
caccgccgccaccgacaca

SEQ ID NO: 1574788 - RNA, 18 nt, Pseudomonas putida KT2440
caccgccgccccgcacca

SEQ ID NO: 1574789 - RNA, 15 nt, Pseudomonas putida KT2440
caccgccucgaucgu

SEQ ID NO: 1574790 - RNA, 20 nt, Pseudomonas putida KT2440
caccgccucgaucgucgaca

SEQ ID NO: 1574791 - RNA, 15 nt, Pseudomonas putida KT2440
caccgccucgguacc

SEQ ID NO: 1574792 - RNA, 21 nt, Pseudomonas putida KT2440
caccgccucuaccacgccgcu

SEQ ID NO: 1574793 - RNA, 20 nt, Pseudomonas putida KT2440
caccgccuaugaaaccgagc

SEQ ID NO: 1574794 - RNA, 15 nt, Pseudomonas putida KT2440
caccggaucggugcc

SEQ ID NO: 1574795 - RNA, 16 nt, Pseudomonas putida KT2440
caccggcaaagcugau

SEQ ID NO: 1574796 - RNA, 23 nt, Pseudomonas putida KT2440
caccggcaacccuucggccagca

SEQ ID NO: 1574797 - RNA, 14 nt, Pseudomonas putida KT2440
caccggcaccaucu

SEQ ID NO: 1574798 - RNA, 16 nt, Pseudomonas putida KT2440
caccggcaccaucuuc

SEQ ID NO: 1574799 - RNA, 20 nt, Pseudomonas putida KT2440
caccggcaccaucuucgaca

SEQ ID NO: 1574800 - RNA, 14 nt, Pseudomonas putida KT2440
caccggcaaucgac

SEQ ID NO: 1574801 - RNA, 14 nt, Pseudomonas putida KT2440
caccggcaccugcu

SEQ ID NO: 1574802 - RNA, 22 nt, Pseudomonas putida KT2440
caccggcaucgaaggugguagc

SEQ ID NO: 1574803 - RNA, 15 nt, Pseudomonas putida KT2440
caccggccaccgugg

SEQ ID NO: 1574804 - RNA, 12 nt, Pseudomonas putida KT2440
caccggccagca

SEQ ID NO: 1574805 - RNA, 15 nt, Pseudomonas putida KT2440
caccggccagcgcgc

SEQ ID NO: 1574806 - RNA, 19 nt, Pseudomonas putida KT2440
caccggccccccagccagc

SEQ ID NO: 1574807 - RNA, 13 nt, Pseudomonas putida KT2440
caccggccgaccc

SEQ ID NO: 1574808 - RNA, 21 nt, Pseudomonas putida KT2440
caccggccgacccgccuggug

SEQ ID NO: 1574809 - RNA, 18 nt, Pseudomonas putida KT2440
caccgcugguggcguggc

SEQ ID NO: 1574810 - RNA, 12 nt, Pseudomonas putida KT2440
caccgcugccga

SEQ ID NO: 1574811 - RNA, 17 nt, Pseudomonas putida KT2440
caccgcguuggccaggu

SEQ ID NO: 1574812 - RNA, 20 nt, Pseudomonas putida KT2440
caccgcguuggccaggucga

SEQ ID NO: 1574813 - RNA, 18 nt, Pseudomonas putida KT2440
caccgcguuaugacuggc

SEQ ID NO: 1574814 - RNA, 13 nt, Pseudomonas putida KT2440
caccgcguaacca

SEQ ID NO: 1574815 - RNA, 17 nt, Pseudomonas putida KT2440
caccgcgacgaccgcac

SEQ ID NO: 1574816 - RNA, 17 nt, Pseudomonas putida KT2440
caccgcgaaacacagca

SEQ ID NO: 1574817 - RNA, 22 nt, Pseudomonas putida KT2440
caccgcgaaacacagcaggcca

SEQ ID NO: 1574818 - RNA, 20 nt, Pseudomonas putida KT2440
caccgcguacagcugcucac

SEQ ID NO: 1574819 - RNA, 22 nt, Pseudomonas putida KT2440
caccgcguacagcugcucacca

SEQ ID NO: 1574820 - RNA, 15 nt, Pseudomonas putida KT2440
caccgcgucgauacg

SEQ ID NO: 1574821 - RNA, 17 nt, Pseudomonas putida KT2440
caccguuaacacaggua

SEQ ID NO: 1574822 - RNA, 11 nt, Pseudomonas putida KT2440
caccgucgaug

SEQ ID NO: 1574823 - RNA, 15 nt, Pseudomonas putida KT2440
caccgucgaugucgg

SEQ ID NO: 1574824 - RNA, 13 nt, Pseudomonas putida KT2440
caccgucaccuug

SEQ ID NO: 1574825 - RNA, 19 nt, Pseudomonas putida KT2440
caccgguacauugcgcacc

SEQ ID NO: 1574826 - RNA, 22 nt, Pseudomonas putida KT2440
caccggcgaguccugccuucca

SEQ ID NO: 1574827 - RNA, 17 nt, Pseudomonas putida KT2440
caccggccuccuugaug

SEQ ID NO: 1574828 - RNA, 21 nt, Pseudomonas putida KT2440
caccggccucuucgcgggcaa

SEQ ID NO: 1574829 - RNA, 13 nt, Pseudomonas putida KT2440
caccggccuugcc

SEQ ID NO: 1574830 - RNA, 22 nt, Pseudomonas putida KT2440
caccggccuugccguagaugcc

SEQ ID NO: 1574831 - RNA, 18 nt, Pseudomonas putida KT2440
caccggccuuggccagcu

SEQ ID NO: 1574832 - RNA, 21 nt, Pseudomonas putida KT2440
caccggccuuggccagcucau

SEQ ID NO: 1574833 - RNA, 14 nt, Pseudomonas putida KT2440
caccggcgaacagc

SEQ ID NO: 1574834 - RNA, 17 nt, Pseudomonas putida KT2440
caccggcgaagacggca

SEQ ID NO: 1574835 - RNA, 15 nt, Pseudomonas putida KT2440
cacccccgucucggc

SEQ ID NO: 1574836 - RNA, 14 nt, Pseudomonas putida KT2440
caccccccagcagc

SEQ ID NO: 1574837 - RNA, 19 nt, Pseudomonas putida KT2440
caccccccagcagcgggca

SEQ ID NO: 1574838 - RNA, 18 nt, Pseudomonas putida KT2440
caccccgaccaaggccaa

SEQ ID NO: 1574839 - RNA, 17 nt, Pseudomonas putida KT2440
caccccuuuacuggcca

SEQ ID NO: 1574840 - RNA, 19 nt, Pseudomonas putida KT2440
caccccucggcucacgccc

SEQ ID NO: 1574841 - RNA, 22 nt, Pseudomonas putida KT2440
caccccgcaaagcccugccuca

SEQ ID NO: 1574842 - RNA, 22 nt, Pseudomonas putida KT2440
caccccgcaggccgcagccucu

SEQ ID NO: 1574843 - RNA, 12 nt, Pseudomonas putida KT2440
caccccgcgcau

SEQ ID NO: 1574844 - RNA, 18 nt, Pseudomonas putida KT2440
caccaguuccaccggcaa

SEQ ID NO: 1574845 - RNA, 15 nt, Pseudomonas putida KT2440
caccaucagagcgcc

SEQ ID NO: 1574846 - RNA, 23 nt, Pseudomonas putida KT2440
caccauggcuaagccaagccggc

SEQ ID NO: 1574847 - RNA, 15 nt, Pseudomonas putida KT2440
caccauguacugcag

SEQ ID NO: 1574848 - RNA, 17 nt, Pseudomonas putida KT2440
cacccgcuacaccggcc

SEQ ID NO: 1574849 - RNA, 19 nt, Pseudomonas putida KT2440
cacccgccugcaaccaguc

SEQ ID NO: 1574850 - RNA, 16 nt, Pseudomonas putida KT2440
cacccgcgaagaggcc

SEQ ID NO: 1574851 - RNA, 24 nt, Pseudomonas putida KT2440
cacccgcgaagcaggcgacgcagu

SEQ ID NO: 1574852 - RNA, 18 nt, Pseudomonas putida KT2440
cacccgcgaaugcuacag

SEQ ID NO: 1574853 - RNA, 16 nt, Pseudomonas putida KT2440
cacccgcgaaugcucc

SEQ ID NO: 1574854 - RNA, 20 nt, Pseudomonas putida KT2440
cacccgcgaccacaggcgcu

SEQ ID NO: 1574855 - RNA, 22 nt, Pseudomonas putida KT2440
caccaguguagugaacaggcgu

SEQ ID NO: 1574856 - RNA, 15 nt, Pseudomonas putida KT2440
caccaggucaggaca

SEQ ID NO: 1574857 - RNA, 14 nt, Pseudomonas putida KT2440
caccaggcuggcca

SEQ ID NO: 1574858 - RNA, 23 nt, Pseudomonas putida KT2440
caccaggcuggccaccaccaucu

SEQ ID NO: 1574859 - RNA, 23 nt, Pseudomonas putida KT2440
caccagcggcucgcucaggcgca

SEQ ID NO: 1574860 - RNA, 21 nt, Pseudomonas putida KT2440
caccagcucacgcaagcggcc

SEQ ID NO: 1574861 - RNA, 17 nt, Pseudomonas putida KT2440
caccagcuccauggcaa

SEQ ID NO: 1574862 - RNA, 22 nt, Pseudomonas putida KT2440
caccagcguugucccgcccuga

SEQ ID NO: 1574863 - RNA, 19 nt, Pseudomonas putida KT2440
caccagcccuucggcaucg

SEQ ID NO: 1574864 - RNA, 17 nt, Pseudomonas putida KT2440
caccacguccggccagc

SEQ ID NO: 1574865 - RNA, 21 nt, Pseudomonas putida KT2440
caccacguccggccagcaaca

SEQ ID NO: 1574866 - RNA, 22 nt, Pseudomonas putida KT2440
caccacguccggccagcaacag

SEQ ID NO: 1574867 - RNA, 17 nt, Pseudomonas putida KT2440
caccacgucacgcacca

SEQ ID NO: 1574868 - RNA, 19 nt, Pseudomonas putida KT2440
caccacguucgggcauugc

SEQ ID NO: 1574869 - RNA, 14 nt, Pseudomonas putida KT2440
cacauaggccagcu

SEQ ID NO: 1574870 - RNA, 22 nt, Pseudomonas putida KT2440
cacaucaaaagggugaugcccg

SEQ ID NO: 1574871 - RNA, 16 nt, Pseudomonas putida KT2440
cacauccacagccucc

SEQ ID NO: 1574872 - RNA, 16 nt, Pseudomonas putida KT2440
cacauccacauccggu

SEQ ID NO: 1574873 - RNA, 14 nt, Pseudomonas putida KT2440
cacauccagcgccg

SEQ ID NO: 1574874 - RNA, 15 nt, Pseudomonas putida KT2440
cacauccagcgccgc

SEQ ID NO: 1574875 - RNA, 15 nt, Pseudomonas putida KT2440
cacauccagcgccuc

SEQ ID NO: 1574876 - RNA, 13 nt, Pseudomonas putida KT2440
cacaugcgccaca

SEQ ID NO: 1574877 - RNA, 12 nt, Pseudomonas putida KT2440
cacaugcagguu

SEQ ID NO: 1574878 - RNA, 23 nt, Pseudomonas putida KT2440
cacaucccagaacuucaccccgu

SEQ ID NO: 1574879 - RNA, 21 nt, Pseudomonas putida KT2440
cacaugcaaacccuggcccug

SEQ ID NO: 1574880 - RNA, 22 nt, Pseudomonas putida KT2440
cacaggaauuacgcaggcucca

SEQ ID NO: 1574881 - RNA, 20 nt, Pseudomonas putida KT2440
cacaggccagccccagcggc

SEQ ID NO: 1574882 - RNA, 19 nt, Pseudomonas putida KT2440
cacaggccguaguaggagc

SEQ ID NO: 1574883 - RNA, 14 nt, Pseudomonas putida KT2440
cacagccgagggca

SEQ ID NO: 1574884 - RNA, 12 nt, Pseudomonas putida KT2440
cacagccaugcc

SEQ ID NO: 1574885 - RNA, 16 nt, Pseudomonas putida KT2440
cacagccaugccggca

SEQ ID NO: 1574886 - RNA, 18 nt, Pseudomonas putida KT2440
cacagccaugccggcaac

SEQ ID NO: 1574887 - RNA, 19 nt, Pseudomonas putida KT2440
cacagcccaaggcuggcca

SEQ ID NO: 1574888 - RNA, 12 nt, Pseudomonas putida KT2440
cacagcccagcu

SEQ ID NO: 1574889 - RNA, 20 nt, Pseudomonas putida KT2440
cacagcauuacgcggcagca

SEQ ID NO: 1574890 - RNA, 16 nt, Pseudomonas putida KT2440
cacaaaaucacaggcc

SEQ ID NO: 1574891 - RNA, 14 nt, Pseudomonas putida KT2440
caccaccaggugcu

SEQ ID NO: 1574892 - RNA, 18 nt, Pseudomonas putida KT2440
cacauguaggcgccgauc

SEQ ID NO: 1574893 - RNA, 14 nt, Pseudomonas putida KT2440
cacauucagcagcg

SEQ ID NO: 1574894 - RNA, 15 nt, Pseudomonas putida KT2440
cacauugcgauguau

SEQ ID NO: 1574895 - RNA, 16 nt, Pseudomonas putida KT2440
caccaacccacggcaa

SEQ ID NO: 1574896 - RNA, 17 nt, Pseudomonas putida KT2440
caccaacccacggcaau

SEQ ID NO: 1574897 - RNA, 20 nt, Pseudomonas putida KT2440
caccaacacuuccagcaucg

SEQ ID NO: 1574898 - RNA, 13 nt, Pseudomonas putida KT2440
caccaacagcacc

SEQ ID NO: 1574899 - RNA, 17 nt, Pseudomonas putida KT2440
caccacgccaccaugcu

SEQ ID NO: 1574900 - RNA, 15 nt, Pseudomonas putida KT2440
caccacgaucacgcc

SEQ ID NO: 1574901 - RNA, 16 nt, Pseudomonas putida KT2440
caccacgaucacgccc

SEQ ID NO: 1574902 - RNA, 21 nt, Pseudomonas putida KT2440
caccaccggacgcuugccacc

SEQ ID NO: 1574903 - RNA, 24 nt, Pseudomonas putida KT2440
caccacggcggcgaucagcgcggu

SEQ ID NO: 1574904 - RNA, 15 nt, Pseudomonas putida KT2440
caacaaggacugccu

SEQ ID NO: 1574905 - RNA, 22 nt, Pseudomonas putida KT2440
caacaccguugguaucgaucag

SEQ ID NO: 1574906 - RNA, 21 nt, Pseudomonas putida KT2440
caacaaagccccggcaucgcu

SEQ ID NO: 1574907 - RNA, 20 nt, Pseudomonas putida KT2440
caacaaaaaacgaagauggc

SEQ ID NO: 1574908 - RNA, 16 nt, Pseudomonas putida KT2440
caacaaaccgacccug

SEQ ID NO: 1574909 - RNA, 22 nt, Pseudomonas putida KT2440
caacaacgccuuggccuggcga

SEQ ID NO: 1574910 - RNA, 15 nt, Pseudomonas putida KT2440
caaaucggcagaauu

SEQ ID NO: 1574911 - RNA, 15 nt, Pseudomonas putida KT2440
caaauagaagaacag

SEQ ID NO: 1574912 - RNA, 17 nt, Pseudomonas putida KT2440
caaaugcaccacgcgca

SEQ ID NO: 1574913 - RNA, 19 nt, Pseudomonas putida KT2440
caaaugcgguauaggccgc

SEQ ID NO: 1574914 - RNA, 22 nt, Pseudomonas putida KT2440
caaaugcuggcaauccagcgug

SEQ ID NO: 1574915 - RNA, 14 nt, Pseudomonas putida KT2440
caaagccugcucca

SEQ ID NO: 1574916 - RNA, 20 nt, Pseudomonas putida KT2440
caaauacggccaauaacucg

SEQ ID NO: 1574917 - RNA, 22 nt, Pseudomonas putida KT2440
caaagccccggcagcgaugccg

SEQ ID NO: 1574918 - RNA, 16 nt, Pseudomonas putida KT2440
caaagccccggcaucg

SEQ ID NO: 1574919 - RNA, 21 nt, Pseudomonas putida KT2440
caaagccaauuugccagcgug

SEQ ID NO: 1574920 - RNA, 16 nt, Pseudomonas putida KT2440
caaagcccgugccgca

SEQ ID NO: 1574921 - RNA, 17 nt, Pseudomonas putida KT2440
caaagcccgugccgcau

SEQ ID NO: 1574922 - RNA, 15 nt, Pseudomonas putida KT2440
caaagcccugccuca

SEQ ID NO: 1574923 - RNA, 21 nt, Pseudomonas putida KT2440
caacagcucauccaggcugca

SEQ ID NO: 1574924 - RNA, 22 nt, Pseudomonas putida KT2440
caacagcgcgacgcagcagcgc

SEQ ID NO: 1574925 - RNA, 14 nt, Pseudomonas putida KT2440
caacaccugccgca

SEQ ID NO: 1574926 - RNA, 15 nt, Pseudomonas putida KT2440
caacaccugccgcag

SEQ ID NO: 1574927 - RNA, 18 nt, Pseudomonas putida KT2440
caacauaccgcugggcac

SEQ ID NO: 1574928 - RNA, 16 nt, Pseudomonas putida KT2440
caacaggucgaccugc

SEQ ID NO: 1574929 - RNA, 14 nt, Pseudomonas putida KT2440
caacaggucggcgc

SEQ ID NO: 1574930 - RNA, 14 nt, Pseudomonas putida KT2440
caacagguucgaca

SEQ ID NO: 1574931 - RNA, 15 nt, Pseudomonas putida KT2440
caacaggcuggccga

SEQ ID NO: 1574932 - RNA, 13 nt, Pseudomonas putida KT2440
caacaggaacagc

SEQ ID NO: 1574933 - RNA, 12 nt, Pseudomonas putida KT2440
caaccacgaccg

SEQ ID NO: 1574934 - RNA, 15 nt, Pseudomonas putida KT2440
caaccacgaccggcu

SEQ ID NO: 1574935 - RNA, 16 nt, Pseudomonas putida KT2440
caaccacgaccggcuc

SEQ ID NO: 1574936 - RNA, 23 nt, Pseudomonas putida KT2440
caaccacgaccggcucaacagca

SEQ ID NO: 1574937 - RNA, 17 nt, Pseudomonas putida KT2440
caaccaggugugccacu

SEQ ID NO: 1574938 - RNA, 15 nt, Pseudomonas putida KT2440
caacauucaccagcc

SEQ ID NO: 1574939 - RNA, 18 nt, Pseudomonas putida KT2440
caaccaacaggcucucca

SEQ ID NO: 1574940 - RNA, 18 nt, Pseudomonas putida KT2440
caacgccagggcaaucgc

SEQ ID NO: 1574941 - RNA, 21 nt, Pseudomonas putida KT2440
caacgccaguugucgcugggu

SEQ ID NO: 1574942 - RNA, 16 nt, Pseudomonas putida KT2440
caacgccccacccgcu

SEQ ID NO: 1574943 - RNA, 17 nt, Pseudomonas putida KT2440
caacgccccacccgcuc

SEQ ID NO: 1574944 - RNA, 21 nt, Pseudomonas putida KT2440
caacgccccaggguguuguuc

SEQ ID NO: 1574945 - RNA, 14 nt, Pseudomonas putida KT2440
caacgcccgcgcau

SEQ ID NO: 1574946 - RNA, 17 nt, Pseudomonas putida KT2440
caacgcagccggcaccg

SEQ ID NO: 1574947 - RNA, 17 nt, Pseudomonas putida KT2440
caacgaucugcguacac

SEQ ID NO: 1574948 - RNA, 15 nt, Pseudomonas putida KT2440
caacgaucagcgccg

SEQ ID NO: 1574949 - RNA, 18 nt, Pseudomonas putida KT2440
caacgaucagcgccgaac

SEQ ID NO: 1574950 - RNA, 22 nt, Pseudomonas putida KT2440
caacgauuggcaguccugaaug

SEQ ID NO: 1574951 - RNA, 18 nt, Pseudomonas putida KT2440
caacgauugggcggcagu

SEQ ID NO: 1574952 - RNA, 18 nt, Pseudomonas putida KT2440
caacgcaacaaccccguc

SEQ ID NO: 1574953 - RNA, 16 nt, Pseudomonas putida KT2440
caaccugggugugccg

SEQ ID NO: 1574954 - RNA, 14 nt, Pseudomonas putida KT2440
caaccuuugcggca

SEQ ID NO: 1574955 - RNA, 19 nt, Pseudomonas putida KT2440
caacgccuucaggcgaagc

SEQ ID NO: 1574956 - RNA, 17 nt, Pseudomonas putida KT2440
caacgccguacggccca

SEQ ID NO: 1574957 - RNA, 14 nt, Pseudomonas putida KT2440
caacgcgcgggcaa

SEQ ID NO: 1574958 - RNA, 22 nt, Pseudomonas putida KT2440
caacgcugccuugcccagcucc

SEQ ID NO: 1574959 - RNA, 15 nt, Pseudomonas putida KT2440
caaccccaacccggu

SEQ ID NO: 1574960 - RNA, 14 nt, Pseudomonas putida KT2440
caaccccagcccga

SEQ ID NO: 1574961 - RNA, 20 nt, Pseudomonas putida KT2440
caaccccaggugcugaugcc

SEQ ID NO: 1574962 - RNA, 18 nt, Pseudomonas putida KT2440
caaccccaucaccuuggc

SEQ ID NO: 1574963 - RNA, 14 nt, Pseudomonas putida KT2440
caacccccacaggg

SEQ ID NO: 1574964 - RNA, 16 nt, Pseudomonas putida KT2440
caaccccuugcucaac

SEQ ID NO: 1574965 - RNA, 20 nt, Pseudomonas putida KT2440
caaccccugcggcgugcgcc

SEQ ID NO: 1574966 - RNA, 18 nt, Pseudomonas putida KT2440
caaccccgcagacagcuc

SEQ ID NO: 1574967 - RNA, 20 nt, Pseudomonas putida KT2440
caaccccgcagacagcucga

SEQ ID NO: 1574968 - RNA, 21 nt, Pseudomonas putida KT2440
caacccgauuccuugcagcgc

SEQ ID NO: 1574969 - RNA, 14 nt, Pseudomonas putida KT2440
caacccgaucaggu

SEQ ID NO: 1574970 - RNA, 16 nt, Pseudomonas putida KT2440
caaccgccuccacggu

SEQ ID NO: 1574971 - RNA, 17 nt, Pseudomonas putida KT2440
caaccgcgugacgcgga

SEQ ID NO: 1574972 - RNA, 16 nt, Pseudomonas putida KT2440
caaccgcaagcggcuc

SEQ ID NO: 1574973 - RNA, 16 nt, Pseudomonas putida KT2440
caacccuaucagggcu

SEQ ID NO: 1574974 - RNA, 16 nt, Pseudomonas putida KT2440
caacccugcgcccagu

SEQ ID NO: 1574975 - RNA, 18 nt, Pseudomonas putida KT2440
caaccgcgugcuucaucg

SEQ ID NO: 1574976 - RNA, 21 nt, Pseudomonas putida KT2440
caaccggagcgacuucgacca

SEQ ID NO: 1574977 - RNA, 22 nt, Pseudomonas putida KT2440
caaccggagcgacuucgaccac

SEQ ID NO: 1574978 - RNA, 13 nt, Pseudomonas putida KT2440
caaccggccagug

SEQ ID NO: 1574979 - RNA, 17 nt, Pseudomonas putida KT2440
caaccgggucggcgcca

SEQ ID NO: 1574980 - RNA, 22 nt, Pseudomonas putida KT2440
caaccgggucggcgccaggccu

SEQ ID NO: 1574981 - RNA, 19 nt, Pseudomonas putida KT2440
caaccguacccuuccugga

SEQ ID NO: 1574982 - RNA, 18 nt, Pseudomonas putida KT2440
caaccgugguucuugccg

SEQ ID NO: 1574983 - RNA, 15 nt, Pseudomonas putida KT2440
caaccguuccugcag

SEQ ID NO: 1574984 - RNA, 20 nt, Pseudomonas putida KT2440
caaccgugaaucgcgcuugc

SEQ ID NO: 1574985 - RNA, 15 nt, Pseudomonas putida KT2440
caaccucaacgccuc

SEQ ID NO: 1574986 - RNA, 13 nt, Pseudomonas putida KT2440
caaccucacuggc

SEQ ID NO: 1574987 - RNA, 23 nt, Pseudomonas putida KT2440
caaccugaacaaggccuggccca

SEQ ID NO: 1574988 - RNA, 18 nt, Pseudomonas putida KT2440
caaucagcacugugcucg

SEQ ID NO: 1574989 - RNA, 18 nt, Pseudomonas putida KT2440
caaggcuuuccaccuggc

SEQ ID NO: 1574990 - RNA, 19 nt, Pseudomonas putida KT2440
caagggccugcaggcagca

SEQ ID NO: 1574991 - RNA, 15 nt, Pseudomonas putida KT2440
caagguuucagcagc

SEQ ID NO: 1574992 - RNA, 20 nt, Pseudomonas putida KT2440
caagucccccaucggcaccc

SEQ ID NO: 1574993 - RNA, 21 nt, Pseudomonas putida KT2440
caagucccccaucggcacccg

SEQ ID NO: 1574994 - RNA, 23 nt, Pseudomonas putida KT2440
caaguccgaacuccccaccaggc

SEQ ID NO: 1574995 - RNA, 16 nt, Pseudomonas putida KT2440
caaguacaacugccac

SEQ ID NO: 1574996 - RNA, 20 nt, Pseudomonas putida KT2440
caauagccauuccggcugca

SEQ ID NO: 1574997 - RNA, 15 nt, Pseudomonas putida KT2440
caaugcccagcgcgc

SEQ ID NO: 1574998 - RNA, 18 nt, Pseudomonas putida KT2440
caaugcacagcgcucgau

SEQ ID NO: 1574999 - RNA, 22 nt, Pseudomonas putida KT2440
caaugcaggcaguaggccaccg

SEQ ID NO: 1575000 - RNA, 16 nt, Pseudomonas putida KT2440
caauggcaaucgccug

SEQ ID NO: 1575001 - RNA, 21 nt, Pseudomonas putida KT2440
caaugcggugugcugcggcca

SEQ ID NO: 1575002 - RNA, 22 nt, Pseudomonas putida KT2440
caaugcuuugauaccugcuugc

SEQ ID NO: 1575003 - RNA, 20 nt, Pseudomonas putida KT2440
caaucgucaugaucgcuaca

SEQ ID NO: 1575004 - RNA, 17 nt, Pseudomonas putida KT2440
caauucugaaggugcug

SEQ ID NO: 1575005 - RNA, 13 nt, Pseudomonas putida KT2440
caauuuggccagc

SEQ ID NO: 1575006 - RNA, 16 nt, Pseudomonas putida KT2440
caaugggccgaucacg

SEQ ID NO: 1575007 - RNA, 19 nt, Pseudomonas putida KT2440
caaugggcuuccccagccu

SEQ ID NO: 1575008 - RNA, 18 nt, Pseudomonas putida KT2440
caauggcgcgaacagggc

SEQ ID NO: 1575009 - RNA, 20 nt, Pseudomonas putida KT2440
caauggccugcaugucggca

SEQ ID NO: 1575010 - RNA, 20 nt, Pseudomonas putida KT2440
caauuacuuugucgccuacc

SEQ ID NO: 1575011 - RNA, 20 nt, Pseudomonas putida KT2440
caacgucucgaacggcgcca

SEQ ID NO: 1575012 - RNA, 14 nt, Pseudomonas putida KT2440
caacguucaucccc

SEQ ID NO: 1575013 - RNA, 21 nt, Pseudomonas putida KT2440
caacuaucgagcauggcgauc

SEQ ID NO: 1575014 - RNA, 21 nt, Pseudomonas putida KT2440
caacugcccacccaaccgcgc

SEQ ID NO: 1575015 - RNA, 21 nt, Pseudomonas putida KT2440
caacugcccaggaucacuggc

SEQ ID NO: 1575016 - RNA, 23 nt, Pseudomonas putida KT2440
caacugcccaggaucacuggccu

SEQ ID NO: 1575017 - RNA, 20 nt, Pseudomonas putida KT2440
caacugccaggcuggcgcua

SEQ ID NO: 1575018 - RNA, 21 nt, Pseudomonas putida KT2440
caacugcacccgccagccguu

SEQ ID NO: 1575019 - RNA, 19 nt, Pseudomonas putida KT2440
caacugaugggucuugccg

SEQ ID NO: 1575020 - RNA, 20 nt, Pseudomonas putida KT2440
caacgguaacguggacagca

SEQ ID NO: 1575021 - RNA, 15 nt, Pseudomonas putida KT2440
caacggucgaucagc

SEQ ID NO: 1575022 - RNA, 14 nt, Pseudomonas putida KT2440
caacggcuggcgga

SEQ ID NO: 1575023 - RNA, 18 nt, Pseudomonas putida KT2440
caacggcagcgacagcug

SEQ ID NO: 1575024 - RNA, 13 nt, Pseudomonas putida KT2440
caacggcaucacg

SEQ ID NO: 1575025 - RNA, 18 nt, Pseudomonas putida KT2440
caacggcaucacgcuggc

SEQ ID NO: 1575026 - RNA, 22 nt, Pseudomonas putida KT2440
caacggcaucacgcuggccauu

SEQ ID NO: 1575027 - RNA, 16 nt, Pseudomonas putida KT2440
caacggcacucgaagc

SEQ ID NO: 1575028 - RNA, 17 nt, Pseudomonas putida KT2440
caacggcacacgcacca

SEQ ID NO: 1575029 - RNA, 17 nt, Pseudomonas putida KT2440
caagcuggucaggugca

SEQ ID NO: 1575030 - RNA, 13 nt, Pseudomonas putida KT2440
caagcuucaccuc

SEQ ID NO: 1575031 - RNA, 20 nt, Pseudomonas putida KT2440
caagcuguacaacgcagccg

SEQ ID NO: 1575032 - RNA, 14 nt, Pseudomonas putida KT2440
caagcugcgccgca

SEQ ID NO: 1575033 - RNA, 18 nt, Pseudomonas putida KT2440
caagcuggaugaagcccg

SEQ ID NO: 1575034 - RNA, 16 nt, Pseudomonas putida KT2440
caagcuggcaccggcg

SEQ ID NO: 1575035 - RNA, 19 nt, Pseudomonas putida KT2440
caagcuggcaccggcgcca

SEQ ID NO: 1575036 - RNA, 18 nt, Pseudomonas putida KT2440
caagcuggcacgugcagg

SEQ ID NO: 1575037 - RNA, 17 nt, Pseudomonas putida KT2440
caaggcaaaggucugcu

SEQ ID NO: 1575038 - RNA, 12 nt, Pseudomonas putida KT2440
caaggaucagcu

SEQ ID NO: 1575039 - RNA, 20 nt, Pseudomonas putida KT2440
caaggaacugcgcugcccca

SEQ ID NO: 1575040 - RNA, 22 nt, Pseudomonas putida KT2440
caaggcggcucuugcagcgagu

SEQ ID NO: 1575041 - RNA, 21 nt, Pseudomonas putida KT2440
caaggcgaccugccagccuuc

SEQ ID NO: 1575042 - RNA, 18 nt, Pseudomonas putida KT2440
caaggcgagggcuucgcc

SEQ ID NO: 1575043 - RNA, 18 nt, Pseudomonas putida KT2440
caaggcucaagcgcagcc

SEQ ID NO: 1575044 - RNA, 16 nt, Pseudomonas putida KT2440
caaggcuggcaacccg

SEQ ID NO: 1575045 - RNA, 14 nt, Pseudomonas putida KT2440
caaggcguggcuug

SEQ ID NO: 1575046 - RNA, 14 nt, Pseudomonas putida KT2440
caaggccagcgccu

SEQ ID NO: 1575047 - RNA, 20 nt, Pseudomonas putida KT2440
caaggcauaaaaaagggccc

SEQ ID NO: 1575048 - RNA, 16 nt, Pseudomonas putida KT2440
caaggcaucggcgccu

SEQ ID NO: 1575049 - RNA, 15 nt, Pseudomonas putida KT2440
caagccgcugccaca

SEQ ID NO: 1575050 - RNA, 18 nt, Pseudomonas putida KT2440
caagccgcugccacaggu

SEQ ID NO: 1575051 - RNA, 22 nt, Pseudomonas putida KT2440
caagccgccauugcccagccug

SEQ ID NO: 1575052 - RNA, 14 nt, Pseudomonas putida KT2440
caagccgccgacca

SEQ ID NO: 1575053 - RNA, 15 nt, Pseudomonas putida KT2440
caagccgccgaccag

SEQ ID NO: 1575054 - RNA, 16 nt, Pseudomonas putida KT2440
caagcucgaagcgcuc

SEQ ID NO: 1575055 - RNA, 17 nt, Pseudomonas putida KT2440
caagcucaucaccaggc

SEQ ID NO: 1575056 - RNA, 21 nt, Pseudomonas putida KT2440
caagccugaggcugcgccgau

SEQ ID NO: 1575057 - RNA, 20 nt, Pseudomonas putida KT2440
caagccuucgucgcuggcca

SEQ ID NO: 1575058 - RNA, 22 nt, Pseudomonas putida KT2440
caagccuucgucgcuggccagc

SEQ ID NO: 1575059 - RNA, 12 nt, Pseudomonas putida KT2440
caacugcgcgau

SEQ ID NO: 1575060 - RNA, 17 nt, Pseudomonas putida KT2440
caacugcgcgauagccu

SEQ ID NO: 1575061 - RNA, 17 nt, Pseudomonas putida KT2440
caagacgggaucaccgu

SEQ ID NO: 1575062 - RNA, 23 nt, Pseudomonas putida KT2440
ccaugaaaaagcccggccaggug

SEQ ID NO: 1575063 - RNA, 12 nt, Pseudomonas putida KT2440
ccaucuugcugc

SEQ ID NO: 1575064 - RNA, 21 nt, Pseudomonas putida KT2440
ccaucuugcugcucugcaaug

SEQ ID NO: 1575065 - RNA, 23 nt, Pseudomonas putida KT2440
ccaugagcgagcucaaccagcug

SEQ ID NO: 1575066 - RNA, 18 nt, Pseudomonas putida KT2440
ccaugaucagcgccugcu

SEQ ID NO: 1575067 - RNA, 19 nt, Pseudomonas putida KT2440
ccaugaucagcgccugcug

SEQ ID NO: 1575068 - RNA, 14 nt, Pseudomonas putida KT2440
ccaugaucagcgcc

SEQ ID NO: 1575069 - RNA, 17 nt, Pseudomonas putida KT2440
ccaugcaggucgacgau

SEQ ID NO: 1575070 - RNA, 16 nt, Pseudomonas putida KT2440
ccaugccaagcccaca

SEQ ID NO: 1575071 - RNA, 22 nt, Pseudomonas putida KT2440
ccaugccaagcccacacaccgc

SEQ ID NO: 1575072 - RNA, 20 nt, Pseudomonas putida KT2440
ccaugcaccgucuggaaguc

SEQ ID NO: 1575073 - RNA, 17 nt, Pseudomonas putida KT2440
ccauggggucaguucag

SEQ ID NO: 1575074 - RNA, 22 nt, Pseudomonas putida KT2440
ccaugggcuuuucguuggccag

SEQ ID NO: 1575075 - RNA, 17 nt, Pseudomonas putida KT2440
ccauggcaaucagcgac

SEQ ID NO: 1575076 - RNA, 14 nt, Pseudomonas putida KT2440
ccaugggccugcac

SEQ ID NO: 1575077 - RNA, 14 nt, Pseudomonas putida KT2440
ccaugggcaggccc

SEQ ID NO: 1575078 - RNA, 16 nt, Pseudomonas putida KT2440
ccauggcuggcagcac

SEQ ID NO: 1575079 - RNA, 21 nt, Pseudomonas putida KT2440
ccauggcgggcgacgaaggcc

SEQ ID NO: 1575080 - RNA, 21 nt, Pseudomonas putida KT2440
ccauggcuaagccaagccggc

SEQ ID NO: 1575081 - RNA, 12 nt, Pseudomonas putida KT2440
ccauggccagcg

SEQ ID NO: 1575082 - RNA, 22 nt, Pseudomonas putida KT2440
ccaugcugcagaaccgccagca

SEQ ID NO: 1575083 - RNA, 22 nt, Pseudomonas putida KT2440
ccaugccggcaacgauacccac

SEQ ID NO: 1575084 - RNA, 18 nt, Pseudomonas putida KT2440
ccaugcccagcucgcugg

SEQ ID NO: 1575085 - RNA, 22 nt, Pseudomonas putida KT2440
ccaugccccgaguaacccuggc

SEQ ID NO: 1575086 - RNA, 19 nt, Pseudomonas putida KT2440
ccauccgguaugcccaugc

SEQ ID NO: 1575087 - RNA, 16 nt, Pseudomonas putida KT2440
ccauccucggccaggc

SEQ ID NO: 1575088 - RNA, 17 nt, Pseudomonas putida KT2440
ccaucgacccgcugccc

SEQ ID NO: 1575089 - RNA, 18 nt, Pseudomonas putida KT2440
ccaucgaggaaguggcag

SEQ ID NO: 1575090 - RNA, 23 nt, Pseudomonas putida KT2440
ccaucagguauugcgcaaggccg

SEQ ID NO: 1575091 - RNA, 20 nt, Pseudomonas putida KT2440
ccaucaguugcagcaacgcc

SEQ ID NO: 1575092 - RNA, 16 nt, Pseudomonas putida KT2440
ccauccacaucgccag

SEQ ID NO: 1575093 - RNA, 14 nt, Pseudomonas putida KT2440
ccauccaccggauc

SEQ ID NO: 1575094 - RNA, 15 nt, Pseudomonas putida KT2440
ccauccagcggcgac

SEQ ID NO: 1575095 - RNA, 17 nt, Pseudomonas putida KT2440
ccauccagucggcgcug

SEQ ID NO: 1575096 - RNA, 19 nt, Pseudomonas putida KT2440
ccauccccgcacgcggugg

SEQ ID NO: 1575097 - RNA, 17 nt, Pseudomonas putida KT2440
ccaucggcgcgaagguc

SEQ ID NO: 1575098 - RNA, 16 nt, Pseudomonas putida KT2440
ccaucgcccacggcga

SEQ ID NO: 1575099 - RNA, 15 nt, Pseudomonas putida KT2440
ccaucgcagaaggcc

SEQ ID NO: 1575100 - RNA, 20 nt, Pseudomonas putida KT2440
cccagcauggccgaaaccag

SEQ ID NO: 1575101 - RNA, 14 nt, Pseudomonas putida KT2440
cccagccaucgagc

SEQ ID NO: 1575102 - RNA, 22 nt, Pseudomonas putida KT2440
cccagccaacgccccacccgcu

SEQ ID NO: 1575103 - RNA, 20 nt, Pseudomonas putida KT2440
cccagccaccgacgaacagg

SEQ ID NO: 1575104 - RNA, 21 nt, Pseudomonas putida KT2440
cccagccccgagcaaagcccg

SEQ ID NO: 1575105 - RNA, 15 nt, Pseudomonas putida KT2440
cccagccccgcaugc

SEQ ID NO: 1575106 - RNA, 20 nt, Pseudomonas putida KT2440
cccagcccggacugcaccag

SEQ ID NO: 1575107 - RNA, 15 nt, Pseudomonas putida KT2440
cccagccuucagcag

SEQ ID NO: 1575108 - RNA, 22 nt, Pseudomonas putida KT2440
cccagccgggcaugcaggucga

SEQ ID NO: 1575109 - RNA, 22 nt, Pseudomonas putida KT2440
cccagccgggccaacuugcgca

SEQ ID NO: 1575110 - RNA, 14 nt, Pseudomonas putida KT2440
cccagcgcgccagc

SEQ ID NO: 1575111 - RNA, 17 nt, Pseudomonas putida KT2440
cccagcgccuuggccug

SEQ ID NO: 1575112 - RNA, 13 nt, Pseudomonas putida KT2440
cccagcgaccagc

SEQ ID NO: 1575113 - RNA, 21 nt, Pseudomonas putida KT2440
cccaggccgccgaugaucgaa

SEQ ID NO: 1575114 - RNA, 11 nt, Pseudomonas putida KT2440
cccaggccgcg

SEQ ID NO: 1575115 - RNA, 17 nt, Pseudomonas putida KT2440
cccaggccgcggccgaa

SEQ ID NO: 1575116 - RNA, 14 nt, Pseudomonas putida KT2440
cccaggaucacugg

SEQ ID NO: 1575117 - RNA, 19 nt, Pseudomonas putida KT2440
cccaggcauacagcuggcc

SEQ ID NO: 1575118 - RNA, 18 nt, Pseudomonas putida KT2440
ccauguugucacccagca

SEQ ID NO: 1575119 - RNA, 20 nt, Pseudomonas putida KT2440
ccauguugucgaagcgcacc

SEQ ID NO: 1575120 - RNA, 23 nt, Pseudomonas putida KT2440
ccauguugugcuggcggcugccc

SEQ ID NO: 1575121 - RNA, 14 nt, Pseudomonas putida KT2440
cccaaggcauccag

SEQ ID NO: 1575122 - RNA, 22 nt, Pseudomonas putida KT2440
cccaaggcauccagcucggcaa

SEQ ID NO: 1575123 - RNA, 22 nt, Pseudomonas putida KT2440
cccaaggcugccaaucaacccg

SEQ ID NO: 1575124 - RNA, 18 nt, Pseudomonas putida KT2440
cccaaguaguguucgccg

SEQ ID NO: 1575125 - RNA, 18 nt, Pseudomonas putida KT2440
cccaagugccagaaccag

SEQ ID NO: 1575126 - RNA, 19 nt, Pseudomonas putida KT2440
cccaauaaaaacaacaggu

SEQ ID NO: 1575127 - RNA, 22 nt, Pseudomonas putida KT2440
cccaauacgcaccgcuaccaug

SEQ ID NO: 1575128 - RNA, 22 nt, Pseudomonas putida KT2440
cccaaugcaugcaucagggucu

SEQ ID NO: 1575129 - RNA, 14 nt, Pseudomonas putida KT2440
ccauguugcgcagc

SEQ ID NO: 1575130 - RNA, 15 nt, Pseudomonas putida KT2440
ccauguugcgcagca

SEQ ID NO: 1575131 - RNA, 15 nt, Pseudomonas putida KT2440
ccauguggcgcagca

SEQ ID NO: 1575132 - RNA, 20 nt, Pseudomonas putida KT2440
ccaugucggaagccugcauc

SEQ ID NO: 1575133 - RNA, 12 nt, Pseudomonas putida KT2440
cccacauagcgc

SEQ ID NO: 1575134 - RNA, 19 nt, Pseudomonas putida KT2440
cccacauagcgcacuugca

SEQ ID NO: 1575135 - RNA, 22 nt, Pseudomonas putida KT2440
cccacagugucccggccagggc

SEQ ID NO: 1575136 - RNA, 19 nt, Pseudomonas putida KT2440
cccacaggggccgcgcagc

SEQ ID NO: 1575137 - RNA, 20 nt, Pseudomonas putida KT2440
cccacagguacucgcaagcu

SEQ ID NO: 1575138 - RNA, 18 nt, Pseudomonas putida KT2440
cccacagguuuagcgcug

SEQ ID NO: 1575139 - RNA, 15 nt, Pseudomonas putida KT2440
cccacagggaccgca

SEQ ID NO: 1575140 - RNA, 20 nt, Pseudomonas putida KT2440
cccacagggcaaacaccuug

SEQ ID NO: 1575141 - RNA, 16 nt, Pseudomonas putida KT2440
cccacgcccaggcggc

SEQ ID NO: 1575142 - RNA, 12 nt, Pseudomonas putida KT2440
cccacgccaugu

SEQ ID NO: 1575143 - RNA, 19 nt, Pseudomonas putida KT2440
cccacgcaguuggccauca

SEQ ID NO: 1575144 - RNA, 16 nt, Pseudomonas putida KT2440
ccaggcauugcucgau

SEQ ID NO: 1575145 - RNA, 18 nt, Pseudomonas putida KT2440
ccaggccaaacaggccga

SEQ ID NO: 1575146 - RNA, 12 nt, Pseudomonas putida KT2440
ccaggcccacca

SEQ ID NO: 1575147 - RNA, 16 nt, Pseudomonas putida KT2440
ccaggccgauggcgau

SEQ ID NO: 1575148 - RNA, 11 nt, Pseudomonas putida KT2440
ccaggccgaca

SEQ ID NO: 1575149 - RNA, 18 nt, Pseudomonas putida KT2440
ccaggccgaucaccagca

SEQ ID NO: 1575150 - RNA, 18 nt, Pseudomonas putida KT2440
ccaggccccuuggccaac

SEQ ID NO: 1575151 - RNA, 19 nt, Pseudomonas putida KT2440
ccaggccccgauacagcgc

SEQ ID NO: 1575152 - RNA, 14 nt, Pseudomonas putida KT2440
ccaggcccgccaga

SEQ ID NO: 1575153 - RNA, 15 nt, Pseudomonas putida KT2440
ccaggcccgccagag

SEQ ID NO: 1575154 - RNA, 10 nt, Pseudomonas putida KT2440
ccaggccgaa

SEQ ID NO: 1575155 - RNA, 17 nt, Pseudomonas putida KT2440
ccaggcccugcagcgcu

SEQ ID NO: 1575156 - RNA, 18 nt, Pseudomonas putida KT2440
ccaggcccugcagcgcuu

SEQ ID NO: 1575157 - RNA, 18 nt, Pseudomonas putida KT2440
ccaggcggucggccagcg

SEQ ID NO: 1575158 - RNA, 22 nt, Pseudomonas putida KT2440
ccaggcggucggccagcggcac

SEQ ID NO: 1575159 - RNA, 23 nt, Pseudomonas putida KT2440
ccaggcggugcacggccugcauc

SEQ ID NO: 1575160 - RNA, 17 nt, Pseudomonas putida KT2440
ccaggcguaaacccagg

SEQ ID NO: 1575161 - RNA, 16 nt, Pseudomonas putida KT2440
ccaggcguauucggcc

SEQ ID NO: 1575162 - RNA, 13 nt, Pseudomonas putida KT2440
ccaggcgucgauc

SEQ ID NO: 1575163 - RNA, 15 nt, Pseudomonas putida KT2440
ccaggcuggccagca

SEQ ID NO: 1575164 - RNA, 18 nt, Pseudomonas putida KT2440
ccagggaaauuggccagc

SEQ ID NO: 1575165 - RNA, 20 nt, Pseudomonas putida KT2440
ccagggaaauuggccagcag

SEQ ID NO: 1575166 - RNA, 21 nt, Pseudomonas putida KT2440
ccaggcuugguuuggccucug

SEQ ID NO: 1575167 - RNA, 13 nt, Pseudomonas putida KT2440
ccaggcgcagcag

SEQ ID NO: 1575168 - RNA, 13 nt, Pseudomonas putida KT2440
ccaggcgcaucac

SEQ ID NO: 1575169 - RNA, 15 nt, Pseudomonas putida KT2440
ccaggcgcaagccuu

SEQ ID NO: 1575170 - RNA, 14 nt, Pseudomonas putida KT2440
ccaggcgccgcagc

SEQ ID NO: 1575171 - RNA, 17 nt, Pseudomonas putida KT2440
ccaggugcgcaccuugg

SEQ ID NO: 1575172 - RNA, 20 nt, Pseudomonas putida KT2440
ccaggugcuugcggaacacc

SEQ ID NO: 1575173 - RNA, 20 nt, Pseudomonas putida KT2440
ccagguuuucucgucuggcg

SEQ ID NO: 1575174 - RNA, 19 nt, Pseudomonas putida KT2440
ccagguccgguaacuggcc

SEQ ID NO: 1575175 - RNA, 15 nt, Pseudomonas putida KT2440
ccagguccugcucca

SEQ ID NO: 1575176 - RNA, 16 nt, Pseudomonas putida KT2440
ccagguccaggccagc

SEQ ID NO: 1575177 - RNA, 20 nt, Pseudomonas putida KT2440
ccagggucugcgcuucaagc

SEQ ID NO: 1575178 - RNA, 16 nt, Pseudomonas putida KT2440
ccagggggcagcugcu

SEQ ID NO: 1575179 - RNA, 22 nt, Pseudomonas putida KT2440
ccaggguaccgccguccaccau

SEQ ID NO: 1575180 - RNA, 23 nt, Pseudomonas putida KT2440
ccagggcaaaaugcagcaagcug

SEQ ID NO: 1575181 - RNA, 15 nt, Pseudomonas putida KT2440
ccauagcaccagcgg

SEQ ID NO: 1575182 - RNA, 19 nt, Pseudomonas putida KT2440
ccauaccucccgcacugcu

SEQ ID NO: 1575183 - RNA, 22 nt, Pseudomonas putida KT2440
ccaguugguaaaacacauugcg

SEQ ID NO: 1575184 - RNA, 20 nt, Pseudomonas putida KT2440
ccauaaaagccucagcgccc

SEQ ID NO: 1575185 - RNA, 14 nt, Pseudomonas putida KT2440
ccaucaaggccgac

SEQ ID NO: 1575186 - RNA, 13 nt, Pseudomonas putida KT2440
ccaucaccgccag

SEQ ID NO: 1575187 - RNA, 21 nt, Pseudomonas putida KT2440
ccaucaccgccagcauggccg

SEQ ID NO: 1575188 - RNA, 14 nt, Pseudomonas putida KT2440
ccaucaggcagcuc

SEQ ID NO: 1575189 - RNA, 18 nt, Pseudomonas putida KT2440
ccaucagagcgccagcaa

SEQ ID NO: 1575190 - RNA, 18 nt, Pseudomonas putida KT2440
ccagugggcacgguuggc

SEQ ID NO: 1575191 - RNA, 14 nt, Pseudomonas putida KT2440
ccagugcgcgcaac

SEQ ID NO: 1575192 - RNA, 20 nt, Pseudomonas putida KT2440
ccagugucaggugguagucc

SEQ ID NO: 1575193 - RNA, 22 nt, Pseudomonas putida KT2440
ccaguguagacaugaggcccuc

SEQ ID NO: 1575194 - RNA, 20 nt, Pseudomonas putida KT2440
ccaguggcacccacagcgcc

SEQ ID NO: 1575195 - RNA, 21 nt, Pseudomonas putida KT2440
ccaguggcacccacagcgccu

SEQ ID NO: 1575196 - RNA, 16 nt, Pseudomonas putida KT2440
ccaguuccaccggcaa

SEQ ID NO: 1575197 - RNA, 22 nt, Pseudomonas putida KT2440
ccaguuccacgaccgugaaacc

SEQ ID NO: 1575198 - RNA, 13 nt, Pseudomonas putida KT2440
ccaguucagcgcc

SEQ ID NO: 1575199 - RNA, 17 nt, Pseudomonas putida KT2440
ccaguucaaugccagca

SEQ ID NO: 1575200 - RNA, 16 nt, Pseudomonas putida KT2440
ccaguuccucggccug

SEQ ID NO: 1575201 - RNA, 14 nt, Pseudomonas putida KT2440
ccaguuccggcagg

SEQ ID NO: 1575202 - RNA, 16 nt, Pseudomonas putida KT2440
ccaguuccaguucgcc

SEQ ID NO: 1575203 - RNA, 23 nt, Pseudomonas putida KT2440
ccaguucgcggcgcaccgcuugc

SEQ ID NO: 1575204 - RNA, 14 nt, Pseudomonas putida KT2440
ccaguucggacagg

SEQ ID NO: 1575205 - RNA, 19 nt, Pseudomonas putida KT2440
ccaguucggacaggcgcuu

SEQ ID NO: 1575206 - RNA, 22 nt, Pseudomonas putida KT2440
ccaguuggcggcgcagcgcacg

SEQ ID NO: 1575207 - RNA, 22 nt, Pseudomonas putida KT2440
ccaguuggcguauuuuggcagg

SEQ ID NO: 1575208 - RNA, 16 nt, Pseudomonas putida KT2440
ccaguucuccggcagg

SEQ ID NO: 1575209 - RNA, 18 nt, Pseudomonas putida KT2440
ccagucgcgcaacugccc

SEQ ID NO: 1575210 - RNA, 13 nt, Pseudomonas putida KT2440
ccagucagcgccg

SEQ ID NO: 1575211 - RNA, 23 nt, Pseudomonas putida KT2440
ccagucauccucagggguaaugc

SEQ ID NO: 1575212 - RNA, 12 nt, Pseudomonas putida KT2440
ccagugccgcaa

SEQ ID NO: 1575213 - RNA, 19 nt, Pseudomonas putida KT2440
ccagugccugaccggucag

SEQ ID NO: 1575214 - RNA, 17 nt, Pseudomonas putida KT2440
ccagugcggugaccgag

SEQ ID NO: 1575215 - RNA, 22 nt, Pseudomonas putida KT2440
ccccgaagcagccgccgccugu

SEQ ID NO: 1575216 - RNA, 18 nt, Pseudomonas putida KT2440
cccccuguaggagcgggu

SEQ ID NO: 1575217 - RNA, 19 nt, Pseudomonas putida KT2440
cccccgguaccagcaggcc

SEQ ID NO: 1575218 - RNA, 13 nt, Pseudomonas putida KT2440
cccccggugccgg

SEQ ID NO: 1575219 - RNA, 18 nt, Pseudomonas putida KT2440
cccccaucauucgauagc

SEQ ID NO: 1575220 - RNA, 22 nt, Pseudomonas putida KT2440
cccccaucauucgauagccugc

SEQ ID NO: 1575221 - RNA, 12 nt, Pseudomonas putida KT2440
ccccccaccugg

SEQ ID NO: 1575222 - RNA, 14 nt, Pseudomonas putida KT2440
ccccgagcaaagcc

SEQ ID NO: 1575223 - RNA, 21 nt, Pseudomonas putida KT2440
ccccgcgccgccgacgaugcc

SEQ ID NO: 1575224 - RNA, 13 nt, Pseudomonas putida KT2440
ccccgcgcaagcg

SEQ ID NO: 1575225 - RNA, 12 nt, Pseudomonas putida KT2440
ccccgccgugca

SEQ ID NO: 1575226 - RNA, 14 nt, Pseudomonas putida KT2440
ccccgccgugcagu

SEQ ID NO: 1575227 - RNA, 16 nt, Pseudomonas putida KT2440
cccaggcggugcacgg

SEQ ID NO: 1575228 - RNA, 22 nt, Pseudomonas putida KT2440
ccccaccgcgguuucucacagc

SEQ ID NO: 1575229 - RNA, 16 nt, Pseudomonas putida KT2440
cccaggcgcuugagcu

SEQ ID NO: 1575230 - RNA, 22 nt, Pseudomonas putida KT2440
cccaggcggcgugacgugcgcu

SEQ ID NO: 1575231 - RNA, 18 nt, Pseudomonas putida KT2440
ccccacccgcucaaagcg

SEQ ID NO: 1575232 - RNA, 18 nt, Pseudomonas putida KT2440
cccaggcgccgcagcagu

SEQ ID NO: 1575233 - RNA, 15 nt, Pseudomonas putida KT2440
ccccagggcccucaa

SEQ ID NO: 1575234 - RNA, 20 nt, Pseudomonas putida KT2440
ccccagucuuggcucgacgc

SEQ ID NO: 1575235 - RNA, 21 nt, Pseudomonas putida KT2440
ccccaggguguuguucacggg

SEQ ID NO: 1575236 - RNA, 18 nt, Pseudomonas putida KT2440
ccccaggugcugaugccc

SEQ ID NO: 1575237 - RNA, 15 nt, Pseudomonas putida KT2440
ccccaguucacgcag

SEQ ID NO: 1575238 - RNA, 18 nt, Pseudomonas putida KT2440
ccccauagcuuuccagca

SEQ ID NO: 1575239 - RNA, 20 nt, Pseudomonas putida KT2440
ccccauagggccagcggcuu

SEQ ID NO: 1575240 - RNA, 13 nt, Pseudomonas putida KT2440
ccccaggcgcaca

SEQ ID NO: 1575241 - RNA, 11 nt, Pseudomonas putida KT2440
ccccaggcggu

SEQ ID NO: 1575242 - RNA, 19 nt, Pseudomonas putida KT2440
ccccagauuucucagcugg

SEQ ID NO: 1575243 - RNA, 13 nt, Pseudomonas putida KT2440
ccccguugcgcag

SEQ ID NO: 1575244 - RNA, 14 nt, Pseudomonas putida KT2440
ccccuaccgccaac

SEQ ID NO: 1575245 - RNA, 16 nt, Pseudomonas putida KT2440
ccccuagcgcauccug

SEQ ID NO: 1575246 - RNA, 22 nt, Pseudomonas putida KT2440
ccccuauacacaugcacaggcc

SEQ ID NO: 1575247 - RNA, 12 nt, Pseudomonas putida KT2440
ccccuccagcac

SEQ ID NO: 1575248 - RNA, 20 nt, Pseudomonas putida KT2440
ccccuccuccagcauggcga

SEQ ID NO: 1575249 - RNA, 21 nt, Pseudomonas putida KT2440
ccccuccugauguaggagcgg

SEQ ID NO: 1575250 - RNA, 13 nt, Pseudomonas putida KT2440
ccccucgaucaac

SEQ ID NO: 1575251 - RNA, 14 nt, Pseudomonas putida KT2440
cccgaacaacaggu

SEQ ID NO: 1575252 - RNA, 14 nt, Pseudomonas putida KT2440
cccgaagcgcaggu

SEQ ID NO: 1575253 - RNA, 14 nt, Pseudomonas putida KT2440
cccgaccucacgca

SEQ ID NO: 1575254 - RNA, 21 nt, Pseudomonas putida KT2440
cccgaccucacgcagguacuc

SEQ ID NO: 1575255 - RNA, 19 nt, Pseudomonas putida KT2440
cccgaccgccagcccgcca

SEQ ID NO: 1575256 - RNA, 15 nt, Pseudomonas putida KT2440
cccgacgccaccuuc

SEQ ID NO: 1575257 - RNA, 14 nt, Pseudomonas putida KT2440
cccgcuggccgcac

SEQ ID NO: 1575258 - RNA, 17 nt, Pseudomonas putida KT2440
cccgcugcugcggcaac

SEQ ID NO: 1575259 - RNA, 14 nt, Pseudomonas putida KT2440
cccgcuggcgauca

SEQ ID NO: 1575260 - RNA, 19 nt, Pseudomonas putida KT2440
cccgcuccgacauugaucg

SEQ ID NO: 1575261 - RNA, 20 nt, Pseudomonas putida KT2440
cccgcugcgccgcucugccc

SEQ ID NO: 1575262 - RNA, 19 nt, Pseudomonas putida KT2440
cccgcuccuacaaagcggc

SEQ ID NO: 1575263 - RNA, 19 nt, Pseudomonas putida KT2440
cccgcuccuacaacggcug

SEQ ID NO: 1575264 - RNA, 20 nt, Pseudomonas putida KT2440
cccgcuccuacgacgggcug

SEQ ID NO: 1575265 - RNA, 22 nt, Pseudomonas putida KT2440
cccgcuccuacgacggucugcg

SEQ ID NO: 1575266 - RNA, 23 nt, Pseudomonas putida KT2440
cccgcuccuacgcggggcagcgc

SEQ ID NO: 1575267 - RNA, 19 nt, Pseudomonas putida KT2440
cccgcuccuacggccgaca

SEQ ID NO: 1575268 - RNA, 20 nt, Pseudomonas putida KT2440
cccgcuccuacgggcaaccg

SEQ ID NO: 1575269 - RNA, 22 nt, Pseudomonas putida KT2440
cccgcuccuacgggggguucac

SEQ ID NO: 1575270 - RNA, 21 nt, Pseudomonas putida KT2440
cccgcuccuacggggguucac

SEQ ID NO: 1575271 - RNA, 22 nt, Pseudomonas putida KT2440
cccgcuccuacuacggccugug

SEQ ID NO: 1575272 - RNA, 19 nt, Pseudomonas putida KT2440
cccgcucccacaggaauca

SEQ ID NO: 1575273 - RNA, 20 nt, Pseudomonas putida KT2440
cccgcucccacaggaaucac

SEQ ID NO: 1575274 - RNA, 20 nt, Pseudomonas putida KT2440
cccgcucccacaggaauuac

SEQ ID NO: 1575275 - RNA, 16 nt, Pseudomonas putida KT2440
cccgcucccacaggga

SEQ ID NO: 1575276 - RNA, 18 nt, Pseudomonas putida KT2440
cccgcucccacagggacc

SEQ ID NO: 1575277 - RNA, 16 nt, Pseudomonas putida KT2440
cccgcucccacaggua

SEQ ID NO: 1575278 - RNA, 21 nt, Pseudomonas putida KT2440
cccgcucccacagguaaguca

SEQ ID NO: 1575279 - RNA, 21 nt, Pseudomonas putida KT2440
cccgcucccacagguaaugca

SEQ ID NO: 1575280 - RNA, 19 nt, Pseudomonas putida KT2440
cccgcucccacagguacuc

SEQ ID NO: 1575281 - RNA, 20 nt, Pseudomonas putida KT2440
cccgcucauguccaggucac

SEQ ID NO: 1575282 - RNA, 22 nt, Pseudomonas putida KT2440
cccgcgccuacagcggccugug

SEQ ID NO: 1575283 - RNA, 19 nt, Pseudomonas putida KT2440
cccgcgccuacaggcaacc

SEQ ID NO: 1575284 - RNA, 20 nt, Pseudomonas putida KT2440
cccgcgccuacgacggccug

SEQ ID NO: 1575285 - RNA, 21 nt, Pseudomonas putida KT2440
cccgcgucagcucaagcgcuc

SEQ ID NO: 1575286 - RNA, 16 nt, Pseudomonas putida KT2440
cccgcgucguucggca

SEQ ID NO: 1575287 - RNA, 18 nt, Pseudomonas putida KT2440
cccgcguuugcaacuggc

SEQ ID NO: 1575288 - RNA, 20 nt, Pseudomonas putida KT2440
cccgcgaagaagacaccgcg

SEQ ID NO: 1575289 - RNA, 22 nt, Pseudomonas putida KT2440
cccgcgaagaagccggcaucgc

SEQ ID NO: 1575290 - RNA, 20 nt, Pseudomonas putida KT2440
cccgcgaagaggccagcaca

SEQ ID NO: 1575291 - RNA, 20 nt, Pseudomonas putida KT2440
cccgcgaagaggccaggaca

SEQ ID NO: 1575292 - RNA, 18 nt, Pseudomonas putida KT2440
cccgcgaagaggcccgaa

SEQ ID NO: 1575293 - RNA, 20 nt, Pseudomonas putida KT2440
cccgcgaagaggccgguaca

SEQ ID NO: 1575294 - RNA, 23 nt, Pseudomonas putida KT2440
cccgcgaagaggccgguaggugc

SEQ ID NO: 1575295 - RNA, 17 nt, Pseudomonas putida KT2440
cccgcgaagagggcgac

SEQ ID NO: 1575296 - RNA, 17 nt, Pseudomonas putida KT2440
cccgcgaagcaggcgac

SEQ ID NO: 1575297 - RNA, 19 nt, Pseudomonas putida KT2440
cccgcgaagcaggcgacgc

SEQ ID NO: 1575298 - RNA, 20 nt, Pseudomonas putida KT2440
cccgcgaaggcuccagcacc

SEQ ID NO: 1575299 - RNA, 17 nt, Pseudomonas putida KT2440
cccgcgaagggccgcaa

SEQ ID NO: 1575300 - RNA, 17 nt, Pseudomonas putida KT2440
cccgcgcccuugcggac

SEQ ID NO: 1575301 - RNA, 14 nt, Pseudomonas putida KT2440
cccgcgaaagggcc

SEQ ID NO: 1575302 - RNA, 20 nt, Pseudomonas putida KT2440
cccgcgaaagggccagcaca

SEQ ID NO: 1575303 - RNA, 14 nt, Pseudomonas putida KT2440
cccgccugacgccg

SEQ ID NO: 1575304 - RNA, 19 nt, Pseudomonas putida KT2440
cccgccuggugccagcggc

SEQ ID NO: 1575305 - RNA, 20 nt, Pseudomonas putida KT2440
cccgccuggugccagcggcc

SEQ ID NO: 1575306 - RNA, 17 nt, Pseudomonas putida KT2440
cccgccagcaggccacc

SEQ ID NO: 1575307 - RNA, 16 nt, Pseudomonas putida KT2440
cccgccgaagccauga

SEQ ID NO: 1575308 - RNA, 19 nt, Pseudomonas putida KT2440
cccgccaugcaacugcaug

SEQ ID NO: 1575309 - RNA, 20 nt, Pseudomonas putida KT2440
cccgcccaauuuggccagcu

SEQ ID NO: 1575310 - RNA, 17 nt, Pseudomonas putida KT2440
cccgcccacaugcgagc

SEQ ID NO: 1575311 - RNA, 20 nt, Pseudomonas putida KT2440
cccgccgcccgcggcgaaca

SEQ ID NO: 1575312 - RNA, 21 nt, Pseudomonas putida KT2440
cccgccgccagcagcggguuc

SEQ ID NO: 1575313 - RNA, 12 nt, Pseudomonas putida KT2440
cccgccgccagc

SEQ ID NO: 1575314 - RNA, 13 nt, Pseudomonas putida KT2440
cccgccgugcagu

SEQ ID NO: 1575315 - RNA, 14 nt, Pseudomonas putida KT2440
cccgcaagggucug

SEQ ID NO: 1575316 - RNA, 14 nt, Pseudomonas putida KT2440
cccgcaaucgucga

SEQ ID NO: 1575317 - RNA, 13 nt, Pseudomonas putida KT2440
cccgcaagccagc

SEQ ID NO: 1575318 - RNA, 15 nt, Pseudomonas putida KT2440
cccgcaagccagccu

SEQ ID NO: 1575319 - RNA, 16 nt, Pseudomonas putida KT2440
cccgcaagccagccuc

SEQ ID NO: 1575320 - RNA, 14 nt, Pseudomonas putida KT2440
cccgcaacgcaucg

SEQ ID NO: 1575321 - RNA, 15 nt, Pseudomonas putida KT2440
cccgcaacaccagga

SEQ ID NO: 1575322 - RNA, 18 nt, Pseudomonas putida KT2440
cccgauuccaagguauca

SEQ ID NO: 1575323 - RNA, 13 nt, Pseudomonas putida KT2440
cccggcagaucga

SEQ ID NO: 1575324 - RNA, 16 nt, Pseudomonas putida KT2440
cccggcagaagcgcug

SEQ ID NO: 1575325 - RNA, 19 nt, Pseudomonas putida KT2440
cccggcagaaucagguuca

SEQ ID NO: 1575326 - RNA, 21 nt, Pseudomonas putida KT2440
cccggcagguugcuggccuug

SEQ ID NO: 1575327 - RNA, 16 nt, Pseudomonas putida KT2440
cccggcaugaucagcu

SEQ ID NO: 1575328 - RNA, 17 nt, Pseudomonas putida KT2440
cccggauaguguucgag

SEQ ID NO: 1575329 - RNA, 14 nt, Pseudomonas putida KT2440
cccggccagggcug

SEQ ID NO: 1575330 - RNA, 14 nt, Pseudomonas putida KT2440
cccggccaggccgu

SEQ ID NO: 1575331 - RNA, 16 nt, Pseudomonas putida KT2440
cccggcauccuguugu

SEQ ID NO: 1575332 - RNA, 19 nt, Pseudomonas putida KT2440
cccggccuccucgcgggca

SEQ ID NO: 1575333 - RNA, 20 nt, Pseudomonas putida KT2440
cccggcccuuucgcggguaa

SEQ ID NO: 1575334 - RNA, 18 nt, Pseudomonas putida KT2440
cccggcuaucucaggcca

SEQ ID NO: 1575335 - RNA, 20 nt, Pseudomonas putida KT2440
cccggcuaucucaggccagu

SEQ ID NO: 1575336 - RNA, 21 nt, Pseudomonas putida KT2440
cccggcuaucucaggccaguu

SEQ ID NO: 1575337 - RNA, 21 nt, Pseudomonas putida KT2440
cccggcuccgcgcaagcgguu

SEQ ID NO: 1575338 - RNA, 16 nt, Pseudomonas putida KT2440
cccggcgccgccaggc

SEQ ID NO: 1575339 - RNA, 14 nt, Pseudomonas putida KT2440
cccgguacgguacg

SEQ ID NO: 1575340 - RNA, 19 nt, Pseudomonas putida KT2440
cccgguacgguacgugcac

SEQ ID NO: 1575341 - RNA, 17 nt, Pseudomonas putida KT2440
cccggguuucggugcgc

SEQ ID NO: 1575342 - RNA, 18 nt, Pseudomonas putida KT2440
cccgggaucuggccgaug

SEQ ID NO: 1575343 - RNA, 14 nt, Pseudomonas putida KT2440
cccgggcagcgggc

SEQ ID NO: 1575344 - RNA, 16 nt, Pseudomonas putida KT2440
cccgggcagcgggcuc

SEQ ID NO: 1575345 - RNA, 21 nt, Pseudomonas putida KT2440
cccgggcagcgggcucgccca

SEQ ID NO: 1575346 - RNA, 17 nt, Pseudomonas putida KT2440
cccgggagggugaacga

SEQ ID NO: 1575347 - RNA, 21 nt, Pseudomonas putida KT2440
cccgggagggugaacgaucag

SEQ ID NO: 1575348 - RNA, 23 nt, Pseudomonas putida KT2440
cccugcccccaaagccgccaugu

SEQ ID NO: 1575349 - RNA, 17 nt, Pseudomonas putida KT2440
cccugcggcugccccaa

SEQ ID NO: 1575350 - RNA, 15 nt, Pseudomonas putida KT2440
cccugcagagcucag

SEQ ID NO: 1575351 - RNA, 17 nt, Pseudomonas putida KT2440
cccugcgggagcgggcg

SEQ ID NO: 1575352 - RNA, 18 nt, Pseudomonas putida KT2440
cccugcgggagcgggcgu

SEQ ID NO: 1575353 - RNA, 17 nt, Pseudomonas putida KT2440
cccugagggagcgggcu

SEQ ID NO: 1575354 - RNA, 13 nt, Pseudomonas putida KT2440
cccugacucgacc

SEQ ID NO: 1575355 - RNA, 21 nt, Pseudomonas putida KT2440
cccugaucgguuggguuggca

SEQ ID NO: 1575356 - RNA, 18 nt, Pseudomonas putida KT2440
cccugaugcagcagugcc

SEQ ID NO: 1575357 - RNA, 21 nt, Pseudomonas putida KT2440
cccugaugcagcagugccagc

SEQ ID NO: 1575358 - RNA, 23 nt, Pseudomonas putida KT2440
cccugaugcagcagugccagcaa

SEQ ID NO: 1575359 - RNA, 22 nt, Pseudomonas putida KT2440
cccuggcgguugaccagggcgu

SEQ ID NO: 1575360 - RNA, 16 nt, Pseudomonas putida KT2440
cccugcgucuugcgca

SEQ ID NO: 1575361 - RNA, 16 nt, Pseudomonas putida KT2440
cccugggcgagcaggu

SEQ ID NO: 1575362 - RNA, 20 nt, Pseudomonas putida KT2440
cccugucgaucacgggcaau

SEQ ID NO: 1575363 - RNA, 15 nt, Pseudomonas putida KT2440
cccugguucgagucc

SEQ ID NO: 1575364 - RNA, 18 nt, Pseudomonas putida KT2440
cccugguuuuccaccggc

SEQ ID NO: 1575365 - RNA, 12 nt, Pseudomonas putida KT2440
cccuguaggagc

SEQ ID NO: 1575366 - RNA, 16 nt, Pseudomonas putida KT2440
cccuguaggaucgggu

SEQ ID NO: 1575367 - RNA, 23 nt, Pseudomonas putida KT2440
cccuucaugcgcccuggcggcca

SEQ ID NO: 1575368 - RNA, 15 nt, Pseudomonas putida KT2440
ccgaaaccgccagcc

SEQ ID NO: 1575369 - RNA, 15 nt, Pseudomonas putida KT2440
cccugugggagcaca

SEQ ID NO: 1575370 - RNA, 17 nt, Pseudomonas putida KT2440
cccugugggagcggccu

SEQ ID NO: 1575371 - RNA, 18 nt, Pseudomonas putida KT2440
cccugugggagcgggcau

SEQ ID NO: 1575372 - RNA, 18 nt, Pseudomonas putida KT2440
cccugugggagcgggcgu

SEQ ID NO: 1575373 - RNA, 15 nt, Pseudomonas putida KT2440
cccuucacggcuuug

SEQ ID NO: 1575374 - RNA, 18 nt, Pseudomonas putida KT2440
cccuucacuguggucauc

SEQ ID NO: 1575375 - RNA, 16 nt, Pseudomonas putida KT2440
cccuucauacagcgcc

SEQ ID NO: 1575376 - RNA, 18 nt, Pseudomonas putida KT2440
cccgugcucacgcacgau

SEQ ID NO: 1575377 - RNA, 14 nt, Pseudomonas putida KT2440
cccgugguuggagc

SEQ ID NO: 1575378 - RNA, 22 nt, Pseudomonas putida KT2440
cccuauggggugagcggcuuuu

SEQ ID NO: 1575379 - RNA, 16 nt, Pseudomonas putida KT2440
cccucagcccaguacc

SEQ ID NO: 1575380 - RNA, 22 nt, Pseudomonas putida KT2440
cccucacgcgccaggucggaca

SEQ ID NO: 1575381 - RNA, 13 nt, Pseudomonas putida KT2440
cccucacucaccg

SEQ ID NO: 1575382 - RNA, 13 nt, Pseudomonas putida KT2440
cccucguaggagc

SEQ ID NO: 1575383 - RNA, 19 nt, Pseudomonas putida KT2440
cccucguaggagcggguuc

SEQ ID NO: 1575384 - RNA, 19 nt, Pseudomonas putida KT2440
cccucguucgcgggcacgc

SEQ ID NO: 1575385 - RNA, 14 nt, Pseudomonas putida KT2440
cccugaagcccugg

SEQ ID NO: 1575386 - RNA, 14 nt, Pseudomonas putida KT2440
cccugaaggccgcu

SEQ ID NO: 1575387 - RNA, 17 nt, Pseudomonas putida KT2440
cccucugcgugguaugc

SEQ ID NO: 1575388 - RNA, 16 nt, Pseudomonas putida KT2440
cccucggccaccuggc

SEQ ID NO: 1575389 - RNA, 13 nt, Pseudomonas putida KT2440
cccucgggacugu

SEQ ID NO: 1575390 - RNA, 15 nt, Pseudomonas putida KT2440
cccucguaacgagcc

SEQ ID NO: 1575391 - RNA, 16 nt, Pseudomonas putida KT2440
cccgguucgccacggu

SEQ ID NO: 1575392 - RNA, 16 nt, Pseudomonas putida KT2440
cccgugcugucgguga

SEQ ID NO: 1575393 - RNA, 17 nt, Pseudomonas putida KT2440
cccgugcaggggucugu

SEQ ID NO: 1575394 - RNA, 17 nt, Pseudomonas putida KT2440
ccagccagcagcguacc

SEQ ID NO: 1575395 - RNA, 13 nt, Pseudomonas putida KT2440
ccagccagccacc

SEQ ID NO: 1575396 - RNA, 12 nt, Pseudomonas putida KT2440
ccagccagauug

SEQ ID NO: 1575397 - RNA, 23 nt, Pseudomonas putida KT2440
ccagccacuuguucggguucagc

SEQ ID NO: 1575398 - RNA, 22 nt, Pseudomonas putida KT2440
ccagcauguaagcuucagcgac

SEQ ID NO: 1575399 - RNA, 23 nt, Pseudomonas putida KT2440
ccagcauguaagcuucagcgacc

SEQ ID NO: 1575400 - RNA, 12 nt, Pseudomonas putida KT2440
ccagcauggccg

SEQ ID NO: 1575401 - RNA, 17 nt, Pseudomonas putida KT2440
ccagcaucucggccagu

SEQ ID NO: 1575402 - RNA, 13 nt, Pseudomonas putida KT2440
ccagcaugaacgc

SEQ ID NO: 1575403 - RNA, 21 nt, Pseudomonas putida KT2440
ccagcagggcaggggacagcc

SEQ ID NO: 1575404 - RNA, 18 nt, Pseudomonas putida KT2440
ccagcaggguggccagca

SEQ ID NO: 1575405 - RNA, 17 nt, Pseudomonas putida KT2440
ccagcaggcuggcggcc

SEQ ID NO: 1575406 - RNA, 13 nt, Pseudomonas putida KT2440
ccagcaggccacc

SEQ ID NO: 1575407 - RNA, 18 nt, Pseudomonas putida KT2440
ccagcaggccaccggcag

SEQ ID NO: 1575408 - RNA, 21 nt, Pseudomonas putida KT2440
ccagcaggccaccggcagcac

SEQ ID NO: 1575409 - RNA, 22 nt, Pseudomonas putida KT2440
ccagcaggccaccggcagcacc

SEQ ID NO: 1575410 - RNA, 23 nt, Pseudomonas putida KT2440
ccagcaggccaccggcagcaccu

SEQ ID NO: 1575411 - RNA, 15 nt, Pseudomonas putida KT2440
ccagcaggccauaca

SEQ ID NO: 1575412 - RNA, 22 nt, Pseudomonas putida KT2440
ccagcaggccgaacucgauucg

SEQ ID NO: 1575413 - RNA, 19 nt, Pseudomonas putida KT2440
ccagcaggacccggcugga

SEQ ID NO: 1575414 - RNA, 13 nt, Pseudomonas putida KT2440
ccagcagcgggca

SEQ ID NO: 1575415 - RNA, 18 nt, Pseudomonas putida KT2440
ccagcagcgggcacaggc

SEQ ID NO: 1575416 - RNA, 15 nt, Pseudomonas putida KT2440
ccagcagcgccugca

SEQ ID NO: 1575417 - RNA, 15 nt, Pseudomonas putida KT2440
ccagcagcgcgugcu

SEQ ID NO: 1575418 - RNA, 20 nt, Pseudomonas putida KT2440
ccagcagcgcuccgccaaac

SEQ ID NO: 1575419 - RNA, 23 nt, Pseudomonas putida KT2440
ccagcagcgcuucgaucgccggc

SEQ ID NO: 1575420 - RNA, 18 nt, Pseudomonas putida KT2440
ccagcagcgacaccagcg

SEQ ID NO: 1575421 - RNA, 21 nt, Pseudomonas putida KT2440
ccagcaccgccccggccagug

SEQ ID NO: 1575422 - RNA, 16 nt, Pseudomonas putida KT2440
ccagcaccgaaccggc

SEQ ID NO: 1575423 - RNA, 17 nt, Pseudomonas putida KT2440
ccagcaccgaaccggcg

SEQ ID NO: 1575424 - RNA, 23 nt, Pseudomonas putida KT2440
ccagcaccaccugugccggcagc

SEQ ID NO: 1575425 - RNA, 18 nt, Pseudomonas putida KT2440
ccagcacgcaggccagcg

SEQ ID NO: 1575426 - RNA, 22 nt, Pseudomonas putida KT2440
ccagcacgcaggccagcgcaca

SEQ ID NO: 1575427 - RNA, 18 nt, Pseudomonas putida KT2440
ccagcacuacgccggcca

SEQ ID NO: 1575428 - RNA, 20 nt, Pseudomonas putida KT2440
ccagcacuacgccggccaag

SEQ ID NO: 1575429 - RNA, 22 nt, Pseudomonas putida KT2440
ccagcacguucucgcucagcgu

SEQ ID NO: 1575430 - RNA, 17 nt, Pseudomonas putida KT2440
ccagcacugccuggcca

SEQ ID NO: 1575431 - RNA, 20 nt, Pseudomonas putida KT2440
ccagcacugccuggccacug

SEQ ID NO: 1575432 - RNA, 14 nt, Pseudomonas putida KT2440
ccagcacugccuug

SEQ ID NO: 1575433 - RNA, 17 nt, Pseudomonas putida KT2440
ccagcacugccuugccc

SEQ ID NO: 1575434 - RNA, 21 nt, Pseudomonas putida KT2440
ccagcacugccuugcccugca

SEQ ID NO: 1575435 - RNA, 21 nt, Pseudomonas putida KT2440
ccagcacugcugcgcaguaca

SEQ ID NO: 1575436 - RNA, 18 nt, Pseudomonas putida KT2440
ccagcacuuuugccacca

SEQ ID NO: 1575437 - RNA, 17 nt, Pseudomonas putida KT2440
ccagcagcaguggcaag

SEQ ID NO: 1575438 - RNA, 14 nt, Pseudomonas putida KT2440
ccagcagccaacgc

SEQ ID NO: 1575439 - RNA, 13 nt, Pseudomonas putida KT2440
ccagcagcagcgc

SEQ ID NO: 1575440 - RNA, 15 nt, Pseudomonas putida KT2440
ccagcagcagcgcac

SEQ ID NO: 1575441 - RNA, 11 nt, Pseudomonas putida KT2440
ccagcagcagc

SEQ ID NO: 1575442 - RNA, 16 nt, Pseudomonas putida KT2440
ccagcagcaccugccg

SEQ ID NO: 1575443 - RNA, 14 nt, Pseudomonas putida KT2440
ccagcagcaccugc

SEQ ID NO: 1575444 - RNA, 14 nt, Pseudomonas putida KT2440
ccagcagcaacgca

SEQ ID NO: 1575445 - RNA, 16 nt, Pseudomonas putida KT2440
ccagcgccugcaggcc

SEQ ID NO: 1575446 - RNA, 12 nt, Pseudomonas putida KT2440
ccagcgccugcu

SEQ ID NO: 1575447 - RNA, 15 nt, Pseudomonas putida KT2440
ccagcgccugcugcc

SEQ ID NO: 1575448 - RNA, 18 nt, Pseudomonas putida KT2440
ccagcgccuuggccugcu

SEQ ID NO: 1575449 - RNA, 19 nt, Pseudomonas putida KT2440
ccagcgcgcugcgcaagga

SEQ ID NO: 1575450 - RNA, 12 nt, Pseudomonas putida KT2440
ccagcgcggcaa

SEQ ID NO: 1575451 - RNA, 18 nt, Pseudomonas putida KT2440
ccagcgcgaagcccagcu

SEQ ID NO: 1575452 - RNA, 15 nt, Pseudomonas putida KT2440
ccagcgccagcagcc

SEQ ID NO: 1575453 - RNA, 18 nt, Pseudomonas putida KT2440
ccagcgccaaucgcaugc

SEQ ID NO: 1575454 - RNA, 16 nt, Pseudomonas putida KT2440
ccagcgccgccaugca

SEQ ID NO: 1575455 - RNA, 16 nt, Pseudomonas putida KT2440
ccagcgccgccggcug

SEQ ID NO: 1575456 - RNA, 13 nt, Pseudomonas putida KT2440
ccagccaggcaca

SEQ ID NO: 1575457 - RNA, 12 nt, Pseudomonas putida KT2440
ccagccagcgug

SEQ ID NO: 1575458 - RNA, 16 nt, Pseudomonas putida KT2440
ccagccagcgacagca

SEQ ID NO: 1575459 - RNA, 21 nt, Pseudomonas putida KT2440
ccagcccgguauuggccacgu

SEQ ID NO: 1575460 - RNA, 23 nt, Pseudomonas putida KT2440
ccagccgaacuugucuguacugc

SEQ ID NO: 1575461 - RNA, 15 nt, Pseudomonas putida KT2440
ccagcccucaaggga

SEQ ID NO: 1575462 - RNA, 14 nt, Pseudomonas putida KT2440
ccagcccugccgag

SEQ ID NO: 1575463 - RNA, 17 nt, Pseudomonas putida KT2440
ccagccgcucagccacc

SEQ ID NO: 1575464 - RNA, 14 nt, Pseudomonas putida KT2440
ccagccgcgucucg

SEQ ID NO: 1575465 - RNA, 17 nt, Pseudomonas putida KT2440
ccagccuucgccaacug

SEQ ID NO: 1575466 - RNA, 14 nt, Pseudomonas putida KT2440
ccagccuucaaccc

SEQ ID NO: 1575467 - RNA, 16 nt, Pseudomonas putida KT2440
ccagccuucagcaggc

SEQ ID NO: 1575468 - RNA, 20 nt, Pseudomonas putida KT2440
ccagcgauggcggaucagcg

SEQ ID NO: 1575469 - RNA, 21 nt, Pseudomonas putida KT2440
ccagcgauaaaccagcagcgc

SEQ ID NO: 1575470 - RNA, 23 nt, Pseudomonas putida KT2440
ccagcgauaaaccagcagcgccu

SEQ ID NO: 1575471 - RNA, 17 nt, Pseudomonas putida KT2440
ccagccguugcgccgcu

SEQ ID NO: 1575472 - RNA, 14 nt, Pseudomonas putida KT2440
ccagccugcagcac

SEQ ID NO: 1575473 - RNA, 20 nt, Pseudomonas putida KT2440
ccagccguggcaacgccaca

SEQ ID NO: 1575474 - RNA, 21 nt, Pseudomonas putida KT2440
ccacguucccgccauguugcg

SEQ ID NO: 1575475 - RNA, 18 nt, Pseudomonas putida KT2440
ccacguccuggucacggc

SEQ ID NO: 1575476 - RNA, 21 nt, Pseudomonas putida KT2440
ccacggugccgaacagcacga

SEQ ID NO: 1575477 - RNA, 16 nt, Pseudomonas putida KT2440
ccacgguucuggcagc

SEQ ID NO: 1575478 - RNA, 22 nt, Pseudomonas putida KT2440
ccacuugguggcguccacgacc

SEQ ID NO: 1575479 - RNA, 23 nt, Pseudomonas putida KT2440
ccacuucgcaacgcuuggcaauc

SEQ ID NO: 1575480 - RNA, 22 nt, Pseudomonas putida KT2440
ccacucacgcaacucuaccuca

SEQ ID NO: 1575481 - RNA, 12 nt, Pseudomonas putida KT2440
ccacuaucgcca

SEQ ID NO: 1575482 - RNA, 21 nt, Pseudomonas putida KT2440
ccacucggugcacgggccgau

SEQ ID NO: 1575483 - RNA, 14 nt, Pseudomonas putida KT2440
ccacucagcggguc

SEQ ID NO: 1575484 - RNA, 15 nt, Pseudomonas putida KT2440
ccacucagcgggucc

SEQ ID NO: 1575485 - RNA, 18 nt, Pseudomonas putida KT2440
ccacucaggcgcaaaucg

SEQ ID NO: 1575486 - RNA, 22 nt, Pseudomonas putida KT2440
ccacugcacccgugcagggcug

SEQ ID NO: 1575487 - RNA, 15 nt, Pseudomonas putida KT2440
ccagauacgcuucga

SEQ ID NO: 1575488 - RNA, 23 nt, Pseudomonas putida KT2440
ccagaucacuuccaccugcgccu

SEQ ID NO: 1575489 - RNA, 13 nt, Pseudomonas putida KT2440
ccagcaacggauu

SEQ ID NO: 1575490 - RNA, 16 nt, Pseudomonas putida KT2440
ccagcaacggguucag

SEQ ID NO: 1575491 - RNA, 14 nt, Pseudomonas putida KT2440
ccagaucagcagca

SEQ ID NO: 1575492 - RNA, 14 nt, Pseudomonas putida KT2440
ccagcaacgcagcc

SEQ ID NO: 1575493 - RNA, 15 nt, Pseudomonas putida KT2440
ccagaguugccacca

SEQ ID NO: 1575494 - RNA, 21 nt, Pseudomonas putida KT2440
ccagagggaagggcgucugcu

SEQ ID NO: 1575495 - RNA, 19 nt, Pseudomonas putida KT2440
ccagcaagggccugugccg

SEQ ID NO: 1575496 - RNA, 22 nt, Pseudomonas putida KT2440
ccagcaagggccugugccgaac

SEQ ID NO: 1575497 - RNA, 18 nt, Pseudomonas putida KT2440
ccagcaauccuuggcgca

SEQ ID NO: 1575498 - RNA, 16 nt, Pseudomonas putida KT2440
ccagcaacugcgccca

SEQ ID NO: 1575499 - RNA, 22 nt, Pseudomonas putida KT2440
ccagcaacuccccccgcgccag

SEQ ID NO: 1575500 - RNA, 23 nt, Pseudomonas putida KT2440
ccagcaacuccccccgcgccaga

SEQ ID NO: 1575501 - RNA, 19 nt, Pseudomonas putida KT2440
ccagcaccacccaccagca

SEQ ID NO: 1575502 - RNA, 15 nt, Pseudomonas putida KT2440
ccagaggcgcguagu

SEQ ID NO: 1575503 - RNA, 16 nt, Pseudomonas putida KT2440
ccagagaaccgcacac

SEQ ID NO: 1575504 - RNA, 16 nt, Pseudomonas putida KT2440
ccagaaucucaaccac

SEQ ID NO: 1575505 - RNA, 12 nt, Pseudomonas putida KT2440
ccagacagcgcu

SEQ ID NO: 1575506 - RNA, 16 nt, Pseudomonas putida KT2440
ccagaccagcagcagu

SEQ ID NO: 1575507 - RNA, 16 nt, Pseudomonas putida KT2440
ccagaccagacagcgc

SEQ ID NO: 1575508 - RNA, 15 nt, Pseudomonas putida KT2440
ccaccuggcccugcu

SEQ ID NO: 1575509 - RNA, 16 nt, Pseudomonas putida KT2440
ccaccuaucaggagca

SEQ ID NO: 1575510 - RNA, 21 nt, Pseudomonas putida KT2440
ccaccugugccggcagcgagc

SEQ ID NO: 1575511 - RNA, 21 nt, Pseudomonas putida KT2440
ccaccugggcgcuuugcaccc

SEQ ID NO: 1575512 - RNA, 15 nt, Pseudomonas putida KT2440
ccaccuggccuucca

SEQ ID NO: 1575513 - RNA, 16 nt, Pseudomonas putida KT2440
ccaccuuccaggucga

SEQ ID NO: 1575514 - RNA, 23 nt, Pseudomonas putida KT2440
ccacgaccggcucaacagcaggu

SEQ ID NO: 1575515 - RNA, 15 nt, Pseudomonas putida KT2440
ccaccuuggcccuuc

SEQ ID NO: 1575516 - RNA, 16 nt, Pseudomonas putida KT2440
ccaccuuggcccuucc

SEQ ID NO: 1575517 - RNA, 16 nt, Pseudomonas putida KT2440
ccacgaccgugaaacc

SEQ ID NO: 1575518 - RNA, 18 nt, Pseudomonas putida KT2440
ccaccggcuccaccugcu

SEQ ID NO: 1575519 - RNA, 12 nt, Pseudomonas putida KT2440
ccaccccggcag

SEQ ID NO: 1575520 - RNA, 17 nt, Pseudomonas putida KT2440
ccaccgaaaucagcaac

SEQ ID NO: 1575521 - RNA, 20 nt, Pseudomonas putida KT2440
ccacgcggguccagcgcggc

SEQ ID NO: 1575522 - RNA, 23 nt, Pseudomonas putida KT2440
ccacgcucaaccccaucaccuug

SEQ ID NO: 1575523 - RNA, 15 nt, Pseudomonas putida KT2440
ccacggccaccuugc

SEQ ID NO: 1575524 - RNA, 20 nt, Pseudomonas putida KT2440
ccacggccaccuugccaucg

SEQ ID NO: 1575525 - RNA, 14 nt, Pseudomonas putida KT2440
ccacgccggcaacc

SEQ ID NO: 1575526 - RNA, 14 nt, Pseudomonas putida KT2440
ccacgcccgcugca

SEQ ID NO: 1575527 - RNA, 22 nt, Pseudomonas putida KT2440
ccacgcccgucaccuugccauc

SEQ ID NO: 1575528 - RNA, 15 nt, Pseudomonas putida KT2440
ccaccaucggccagg

SEQ ID NO: 1575529 - RNA, 15 nt, Pseudomonas putida KT2440
ccaccaucucgccca

SEQ ID NO: 1575530 - RNA, 18 nt, Pseudomonas putida KT2440
ccaccaucucgcccaugc

SEQ ID NO: 1575531 - RNA, 16 nt, Pseudomonas putida KT2440
ccaccaugaacagcac

SEQ ID NO: 1575532 - RNA, 12 nt, Pseudomonas putida KT2440
ccaccaucgacc

SEQ ID NO: 1575533 - RNA, 16 nt, Pseudomonas putida KT2440
ccaccaucgaccuggc

SEQ ID NO: 1575534 - RNA, 17 nt, Pseudomonas putida KT2440
ccaccaucgaccuggcc

SEQ ID NO: 1575535 - RNA, 18 nt, Pseudomonas putida KT2440
ccaccauguacugcagac

SEQ ID NO: 1575536 - RNA, 14 nt, Pseudomonas putida KT2440
ccacccacaggcac

SEQ ID NO: 1575537 - RNA, 18 nt, Pseudomonas putida KT2440
ccacccaacgaacggaac

SEQ ID NO: 1575538 - RNA, 18 nt, Pseudomonas putida KT2440
ccacccccgccgccaggg

SEQ ID NO: 1575539 - RNA, 17 nt, Pseudomonas putida KT2440
ccacccccgcuccuacg

SEQ ID NO: 1575540 - RNA, 13 nt, Pseudomonas putida KT2440
ccacccccagcga

SEQ ID NO: 1575541 - RNA, 14 nt, Pseudomonas putida KT2440
ccacccccagcgcc

SEQ ID NO: 1575542 - RNA, 21 nt, Pseudomonas putida KT2440
ccaccccgcaggccgcagccu

SEQ ID NO: 1575543 - RNA, 13 nt, Pseudomonas putida KT2440
ccacccaggcccu

SEQ ID NO: 1575544 - RNA, 18 nt, Pseudomonas putida KT2440
ccaccagcaucagcgagg

SEQ ID NO: 1575545 - RNA, 19 nt, Pseudomonas putida KT2440
ccaccagcucacgcaagcg

SEQ ID NO: 1575546 - RNA, 14 nt, Pseudomonas putida KT2440
ccaccagcaucaac

SEQ ID NO: 1575547 - RNA, 17 nt, Pseudomonas putida KT2440
ccaccagcaucaacagg

SEQ ID NO: 1575548 - RNA, 19 nt, Pseudomonas putida KT2440
ccaccagcaucaacagguc

SEQ ID NO: 1575549 - RNA, 17 nt, Pseudomonas putida KT2440
ccaccagcacugcugcg

SEQ ID NO: 1575550 - RNA, 17 nt, Pseudomonas putida KT2440
ccaccaggaacaucgcc

SEQ ID NO: 1575551 - RNA, 18 nt, Pseudomonas putida KT2440
ccaccaggaagcuggcca

SEQ ID NO: 1575552 - RNA, 16 nt, Pseudomonas putida KT2440
ccaccaggccgaucac

SEQ ID NO: 1575553 - RNA, 21 nt, Pseudomonas putida KT2440
ccaccaggccgaucaccagca

SEQ ID NO: 1575554 - RNA, 20 nt, Pseudomonas putida KT2440
ccaccaggguggcgauccac

SEQ ID NO: 1575555 - RNA, 12 nt, Pseudomonas putida KT2440
ccacauggccgu

SEQ ID NO: 1575556 - RNA, 16 nt, Pseudomonas putida KT2440
ccacauagcuggcacu

SEQ ID NO: 1575557 - RNA, 14 nt, Pseudomonas putida KT2440
ccaccagacgggca

SEQ ID NO: 1575558 - RNA, 18 nt, Pseudomonas putida KT2440
ccacacccggcuugaccg

SEQ ID NO: 1575559 - RNA, 17 nt, Pseudomonas putida KT2440
ccacaccaaagucagcc

SEQ ID NO: 1575560 - RNA, 16 nt, Pseudomonas putida KT2440
ccacauaacugccggc

SEQ ID NO: 1575561 - RNA, 20 nt, Pseudomonas putida KT2440
ccacaggcacaggcccagca

SEQ ID NO: 1575562 - RNA, 18 nt, Pseudomonas putida KT2440
ccacagggaucgcgccag

SEQ ID NO: 1575563 - RNA, 20 nt, Pseudomonas putida KT2440
ccacagggaucgcgccagcu

SEQ ID NO: 1575564 - RNA, 22 nt, Pseudomonas putida KT2440
ccacagggcaaacaccuugccc

SEQ ID NO: 1575565 - RNA, 18 nt, Pseudomonas putida KT2440
ccacaggugacaagcugc

SEQ ID NO: 1575566 - RNA, 23 nt, Pseudomonas putida KT2440
ccacagguacucgcaagcuccag

SEQ ID NO: 1575567 - RNA, 20 nt, Pseudomonas putida KT2440
ccacagguacugcgcaaucc

SEQ ID NO: 1575568 - RNA, 14 nt, Pseudomonas putida KT2440
ccacagguccagcg

SEQ ID NO: 1575569 - RNA, 17 nt, Pseudomonas putida KT2440
ccacagguccagcgcag

SEQ ID NO: 1575570 - RNA, 15 nt, Pseudomonas putida KT2440
ccacagcgccugcug

SEQ ID NO: 1575571 - RNA, 15 nt, Pseudomonas putida KT2440
ccaauuggucguagg

SEQ ID NO: 1575572 - RNA, 22 nt, Pseudomonas putida KT2440
ccaaugucgacguacagcagcu

SEQ ID NO: 1575573 - RNA, 14 nt, Pseudomonas putida KT2440
ccaauggcaaucgc

SEQ ID NO: 1575574 - RNA, 20 nt, Pseudomonas putida KT2440
ccaaggaucagcucggcaac

SEQ ID NO: 1575575 - RNA, 19 nt, Pseudomonas putida KT2440
ccaaggccaacugcgcccg

SEQ ID NO: 1575576 - RNA, 15 nt, Pseudomonas putida KT2440
ccaaccgcaagcggc

SEQ ID NO: 1575577 - RNA, 12 nt, Pseudomonas putida KT2440
ccaacuccagcg

SEQ ID NO: 1575578 - RNA, 13 nt, Pseudomonas putida KT2440
ccaacuccagcgc

SEQ ID NO: 1575579 - RNA, 15 nt, Pseudomonas putida KT2440
ccaacccugcgccca

SEQ ID NO: 1575580 - RNA, 14 nt, Pseudomonas putida KT2440
ccaaccccagcgca

SEQ ID NO: 1575581 - RNA, 22 nt, Pseudomonas putida KT2440
ccaaccgcgugcuucaucgcug

SEQ ID NO: 1575582 - RNA, 15 nt, Pseudomonas putida KT2440
ccaaccgcuucaccg

SEQ ID NO: 1575583 - RNA, 20 nt, Pseudomonas putida KT2440
ccaaccgcuucaccgcgcac

SEQ ID NO: 1575584 - RNA, 13 nt, Pseudomonas putida KT2440
ccaagccggcuuu

SEQ ID NO: 1575585 - RNA, 18 nt, Pseudomonas putida KT2440
ccaagcgucggccaccug

SEQ ID NO: 1575586 - RNA, 18 nt, Pseudomonas putida KT2440
ccaagcggcagaacacau

SEQ ID NO: 1575587 - RNA, 21 nt, Pseudomonas putida KT2440
ccaagcggcagaacacaucgg

SEQ ID NO: 1575588 - RNA, 19 nt, Pseudomonas putida KT2440
ccaaacaacaaagccccgg

SEQ ID NO: 1575589 - RNA, 21 nt, Pseudomonas putida KT2440
ccaaauugggcugggcgucaa

SEQ ID NO: 1575590 - RNA, 18 nt, Pseudomonas putida KT2440
ccaacaaucgcgucagca

SEQ ID NO: 1575591 - RNA, 17 nt, Pseudomonas putida KT2440
ccaacacccucacccac

SEQ ID NO: 1575592 - RNA, 21 nt, Pseudomonas putida KT2440
ccaaacaguuggugggcaacc

SEQ ID NO: 1575593 - RNA, 14 nt, Pseudomonas putida KT2440
cauuucaccugcuc

SEQ ID NO: 1575594 - RNA, 21 nt, Pseudomonas putida KT2440
cauuuccauacgugcaccggc

SEQ ID NO: 1575595 - RNA, 18 nt, Pseudomonas putida KT2440
cauuugcuuugcgggcau

SEQ ID NO: 1575596 - RNA, 23 nt, Pseudomonas putida KT2440
cauuucgcgcagggugccggcca

SEQ ID NO: 1575597 - RNA, 12 nt, Pseudomonas putida KT2440
cauuggucgugc

SEQ ID NO: 1575598 - RNA, 14 nt, Pseudomonas putida KT2440
cauuggagcguugc

SEQ ID NO: 1575599 - RNA, 22 nt, Pseudomonas putida KT2440
cauuggagcguugcaggcgcuc

SEQ ID NO: 1575600 - RNA, 14 nt, Pseudomonas putida KT2440
cauuggcguugagc

SEQ ID NO: 1575601 - RNA, 18 nt, Pseudomonas putida KT2440
cauuggcgucagcguugc

SEQ ID NO: 1575602 - RNA, 22 nt, Pseudomonas putida KT2440
cauggccgaagcggucguugau

SEQ ID NO: 1575603 - RNA, 16 nt, Pseudomonas putida KT2440
cauggccguucuugau

SEQ ID NO: 1575604 - RNA, 20 nt, Pseudomonas putida KT2440
cauggcgacaauggcgcgga

SEQ ID NO: 1575605 - RNA, 19 nt, Pseudomonas putida KT2440
cauggcaaucagcgacaac

SEQ ID NO: 1575606 - RNA, 22 nt, Pseudomonas putida KT2440
cauggcaaucgggccggcguug

SEQ ID NO: 1575607 - RNA, 13 nt, Pseudomonas putida KT2440
cauggccagcgug

SEQ ID NO: 1575608 - RNA, 18 nt, Pseudomonas putida KT2440
cauggccaguuccuggca

SEQ ID NO: 1575609 - RNA, 20 nt, Pseudomonas putida KT2440
cauggcccaugaucgcggca

SEQ ID NO: 1575610 - RNA, 17 nt, Pseudomonas putida KT2440
cauggcgugcccggcaa

SEQ ID NO: 1575611 - RNA, 21 nt, Pseudomonas putida KT2440
cauggcuaagccaagccggcu

SEQ ID NO: 1575612 - RNA, 22 nt, Pseudomonas putida KT2440
cauggcgguauucacaccugcc

SEQ ID NO: 1575613 - RNA, 17 nt, Pseudomonas putida KT2440
cauggcgggcgacgaag

SEQ ID NO: 1575614 - RNA, 15 nt, Pseudomonas putida KT2440
cauggcgcugaccgg

SEQ ID NO: 1575615 - RNA, 15 nt, Pseudomonas putida KT2440
cauggcgcgccaugc

SEQ ID NO: 1575616 - RNA, 22 nt, Pseudomonas putida KT2440
cauggcgccgaugccgucgauu

SEQ ID NO: 1575617 - RNA, 19 nt, Pseudomonas putida KT2440
caugggcagaguaaccgcg

SEQ ID NO: 1575618 - RNA, 21 nt, Pseudomonas putida KT2440
caugggccacggucuggcgca

SEQ ID NO: 1575619 - RNA, 20 nt, Pseudomonas putida KT2440
cauggcucaacuggcagggu

SEQ ID NO: 1575620 - RNA, 20 nt, Pseudomonas putida KT2440
cauggcuccacccaacgaac

SEQ ID NO: 1575621 - RNA, 19 nt, Pseudomonas putida KT2440
cauggcuggcagcacgauc

SEQ ID NO: 1575622 - RNA, 23 nt, Pseudomonas putida KT2440
cauggcuucgguggugaucauca

SEQ ID NO: 1575623 - RNA, 23 nt, Pseudomonas putida KT2440
caugggcuuuucguuggccagcu

SEQ ID NO: 1575624 - RNA, 15 nt, Pseudomonas putida KT2440
cauggggacuccggc

SEQ ID NO: 1575625 - RNA, 14 nt, Pseudomonas putida KT2440
cauggggaugccga

SEQ ID NO: 1575626 - RNA, 15 nt, Pseudomonas putida KT2440
caugguaaagcccga

SEQ ID NO: 1575627 - RNA, 13 nt, Pseudomonas putida KT2440
caugguggauggu

SEQ ID NO: 1575628 - RNA, 23 nt, Pseudomonas putida KT2440
cauggucgcguuguucagcagcg

SEQ ID NO: 1575629 - RNA, 14 nt, Pseudomonas putida KT2440
caugcgggccggca

SEQ ID NO: 1575630 - RNA, 21 nt, Pseudomonas putida KT2440
caugcgggggccccaccaggc

SEQ ID NO: 1575631 - RNA, 22 nt, Pseudomonas putida KT2440
caugcgggggccccaccaggca

SEQ ID NO: 1575632 - RNA, 16 nt, Pseudomonas putida KT2440
caugcgguacagcacu

SEQ ID NO: 1575633 - RNA, 14 nt, Pseudomonas putida KT2440
caugcucggccagc

SEQ ID NO: 1575634 - RNA, 14 nt, Pseudomonas putida KT2440
caugcuccugcgcc

SEQ ID NO: 1575635 - RNA, 14 nt, Pseudomonas putida KT2440
caugcucugcgcaa

SEQ ID NO: 1575636 - RNA, 15 nt, Pseudomonas putida KT2440
caugcugcugcagca

SEQ ID NO: 1575637 - RNA, 16 nt, Pseudomonas putida KT2440
caugcugcugcagcac

SEQ ID NO: 1575638 - RNA, 14 nt, Pseudomonas putida KT2440
caugcugaugcggu

SEQ ID NO: 1575639 - RNA, 16 nt, Pseudomonas putida KT2440
caugcugcagaaccgc

SEQ ID NO: 1575640 - RNA, 17 nt, Pseudomonas putida KT2440
caugcugccaggcaaag

SEQ ID NO: 1575641 - RNA, 13 nt, Pseudomonas putida KT2440
cauggaagggcgg

SEQ ID NO: 1575642 - RNA, 16 nt, Pseudomonas putida KT2440
caugcuuggcgaaggu

SEQ ID NO: 1575643 - RNA, 15 nt, Pseudomonas putida KT2440
caugcgcgcagcgaa

SEQ ID NO: 1575644 - RNA, 22 nt, Pseudomonas putida KT2440
caugcgcuggccacgacguguc

SEQ ID NO: 1575645 - RNA, 23 nt, Pseudomonas putida KT2440
caugcgcaggcuuguccuugagc

SEQ ID NO: 1575646 - RNA, 18 nt, Pseudomonas putida KT2440
caugcgccacacccgcua

SEQ ID NO: 1575647 - RNA, 14 nt, Pseudomonas putida KT2440
caugcgcgacagca

SEQ ID NO: 1575648 - RNA, 20 nt, Pseudomonas putida KT2440
caugccuuggcuacgcaagg

SEQ ID NO: 1575649 - RNA, 23 nt, Pseudomonas putida KT2440
caugccugugauuuacgcugggc

SEQ ID NO: 1575650 - RNA, 18 nt, Pseudomonas putida KT2440
caugcgaccaguaccgcg

SEQ ID NO: 1575651 - RNA, 21 nt, Pseudomonas putida KT2440
caugcgaacgcaggcgcgaca

SEQ ID NO: 1575652 - RNA, 19 nt, Pseudomonas putida KT2440
caugcgaacugcagagccu

SEQ ID NO: 1575653 - RNA, 22 nt, Pseudomonas putida KT2440
caugcgaacugcagagccugca

SEQ ID NO: 1575654 - RNA, 23 nt, Pseudomonas putida KT2440
cauugccgacuccaacuggacca

SEQ ID NO: 1575655 - RNA, 13 nt, Pseudomonas putida KT2440
cauugcagcccca

SEQ ID NO: 1575656 - RNA, 14 nt, Pseudomonas putida KT2440
cauugcagccccaa

SEQ ID NO: 1575657 - RNA, 15 nt, Pseudomonas putida KT2440
cauugcccagccugc

SEQ ID NO: 1575658 - RNA, 23 nt, Pseudomonas putida KT2440
cauugcaccacccccagcgccuc

SEQ ID NO: 1575659 - RNA, 16 nt, Pseudomonas putida KT2440
cauugcccaagcgcuc

SEQ ID NO: 1575660 - RNA, 16 nt, Pseudomonas putida KT2440
cauugcaagguccuug

SEQ ID NO: 1575661 - RNA, 18 nt, Pseudomonas putida KT2440
cauucgcgcccgcagugc

SEQ ID NO: 1575662 - RNA, 20 nt, Pseudomonas putida KT2440
cauucgcgggcaagcccgcu

SEQ ID NO: 1575663 - RNA, 13 nt, Pseudomonas putida KT2440
cauucgcgggcau

SEQ ID NO: 1575664 - RNA, 20 nt, Pseudomonas putida KT2440
cauucgcggguaaacccgcg

SEQ ID NO: 1575665 - RNA, 21 nt, Pseudomonas putida KT2440
cauucgcggguaaacccgcgc

SEQ ID NO: 1575666 - RNA, 20 nt, Pseudomonas putida KT2440
cauucgcggguaaacccgcu

SEQ ID NO: 1575667 - RNA, 16 nt, Pseudomonas putida KT2440
cauucgauagccugca

SEQ ID NO: 1575668 - RNA, 20 nt, Pseudomonas putida KT2440
cauucgcauuaccagcacca

SEQ ID NO: 1575669 - RNA, 13 nt, Pseudomonas putida KT2440
cauuccggcugca

SEQ ID NO: 1575670 - RNA, 22 nt, Pseudomonas putida KT2440
cauucacggcgucgagcagggu

SEQ ID NO: 1575671 - RNA, 15 nt, Pseudomonas putida KT2440
cauucagcagcgccu

SEQ ID NO: 1575672 - RNA, 22 nt, Pseudomonas putida KT2440
cauucagcucggccacccgcgu

SEQ ID NO: 1575673 - RNA, 12 nt, Pseudomonas putida KT2440
cauucaccagcu

SEQ ID NO: 1575674 - RNA, 19 nt, Pseudomonas putida KT2440
cauuauccaccaggccgau

SEQ ID NO: 1575675 - RNA, 16 nt, Pseudomonas putida KT2440
cauucaagaaugcccg

SEQ ID NO: 1575676 - RNA, 17 nt, Pseudomonas putida KT2440
cauguaccgggcggcca

SEQ ID NO: 1575677 - RNA, 17 nt, Pseudomonas putida KT2440
cauguagaccaccagcg

SEQ ID NO: 1575678 - RNA, 16 nt, Pseudomonas putida KT2440
cauguacucuucgacg

SEQ ID NO: 1575679 - RNA, 23 nt, Pseudomonas putida KT2440
cauguagaacguggugcgggcca

SEQ ID NO: 1575680 - RNA, 17 nt, Pseudomonas putida KT2440
caugucgaaccacaucg

SEQ ID NO: 1575681 - RNA, 16 nt, Pseudomonas putida KT2440
cauguccauggcaauc

SEQ ID NO: 1575682 - RNA, 20 nt, Pseudomonas putida KT2440
cauguccaggucacccuggu

SEQ ID NO: 1575683 - RNA, 15 nt, Pseudomonas putida KT2440
cauguccagucaggc

SEQ ID NO: 1575684 - RNA, 17 nt, Pseudomonas putida KT2440
cauguucaggucgugau

SEQ ID NO: 1575685 - RNA, 16 nt, Pseudomonas putida KT2440
caugucggaagccugc

SEQ ID NO: 1575686 - RNA, 13 nt, Pseudomonas putida KT2440
caugucuucacga

SEQ ID NO: 1575687 - RNA, 16 nt, Pseudomonas putida KT2440
caugucuucgcccggu

SEQ ID NO: 1575688 - RNA, 17 nt, Pseudomonas putida KT2440
cauuacgcggcagcagc

SEQ ID NO: 1575689 - RNA, 13 nt, Pseudomonas putida KT2440
cauuaccagcacc

SEQ ID NO: 1575690 - RNA, 20 nt, Pseudomonas putida KT2440
cauguucaucaccggccagc

SEQ ID NO: 1575691 - RNA, 21 nt, Pseudomonas putida KT2440
cauguugcgcagcaauccgcu

SEQ ID NO: 1575692 - RNA, 13 nt, Pseudomonas putida KT2440
cagugccguggca

SEQ ID NO: 1575693 - RNA, 16 nt, Pseudomonas putida KT2440
cagugccgccugguug

SEQ ID NO: 1575694 - RNA, 19 nt, Pseudomonas putida KT2440
cagugccgccaccuggcug

SEQ ID NO: 1575695 - RNA, 22 nt, Pseudomonas putida KT2440
cagugagaaugcggauguaguu

SEQ ID NO: 1575696 - RNA, 21 nt, Pseudomonas putida KT2440
cagugcccccgucagcggcaa

SEQ ID NO: 1575697 - RNA, 14 nt, Pseudomonas putida KT2440
caguccuuggccaa

SEQ ID NO: 1575698 - RNA, 13 nt, Pseudomonas putida KT2440
cagucggcgcugg

SEQ ID NO: 1575699 - RNA, 14 nt, Pseudomonas putida KT2440
caguaccagcagca

SEQ ID NO: 1575700 - RNA, 13 nt, Pseudomonas putida KT2440
caguaaggcuugc

SEQ ID NO: 1575701 - RNA, 19 nt, Pseudomonas putida KT2440
cagugccucacgcaugccg

SEQ ID NO: 1575702 - RNA, 17 nt, Pseudomonas putida KT2440
caguggcaagccgagca

SEQ ID NO: 1575703 - RNA, 16 nt, Pseudomonas putida KT2440
caguggcacuggcgcg

SEQ ID NO: 1575704 - RNA, 15 nt, Pseudomonas putida KT2440
caguggcagguucga

SEQ ID NO: 1575705 - RNA, 18 nt, Pseudomonas putida KT2440
caguggcagguucgacca

SEQ ID NO: 1575706 - RNA, 16 nt, Pseudomonas putida KT2440
caguggcuccauggua

SEQ ID NO: 1575707 - RNA, 19 nt, Pseudomonas putida KT2440
caguggcuguaccaggucu

SEQ ID NO: 1575708 - RNA, 23 nt, Pseudomonas putida KT2440
caguggcuguaccaggucuucaa

SEQ ID NO: 1575709 - RNA, 18 nt, Pseudomonas putida KT2440
caguguaaauagcugcca

SEQ ID NO: 1575710 - RNA, 16 nt, Pseudomonas putida KT2440
cagugguguacagcaa

SEQ ID NO: 1575711 - RNA, 13 nt, Pseudomonas putida KT2440
caguggucuucaa

SEQ ID NO: 1575712 - RNA, 18 nt, Pseudomonas putida KT2440
caguggucuucaaggcca

SEQ ID NO: 1575713 - RNA, 19 nt, Pseudomonas putida KT2440
caguggucuucaaggccac

SEQ ID NO: 1575714 - RNA, 15 nt, Pseudomonas putida KT2440
caguucccggugcug

SEQ ID NO: 1575715 - RNA, 17 nt, Pseudomonas putida KT2440
caguucagcgcccgcaa

SEQ ID NO: 1575716 - RNA, 13 nt, Pseudomonas putida KT2440
caguucgcagcca

SEQ ID NO: 1575717 - RNA, 14 nt, Pseudomonas putida KT2440
caguucgcagccca

SEQ ID NO: 1575718 - RNA, 15 nt, Pseudomonas putida KT2440
caguucgcagcccac

SEQ ID NO: 1575719 - RNA, 20 nt, Pseudomonas putida KT2440
caguucgccacccgacgcca

SEQ ID NO: 1575720 - RNA, 18 nt, Pseudomonas putida KT2440
caguucgacgcggaccuu

SEQ ID NO: 1575721 - RNA, 23 nt, Pseudomonas putida KT2440
caguucuuggcggcugggugcca

SEQ ID NO: 1575722 - RNA, 19 nt, Pseudomonas putida KT2440
caguugauaacacuugccg

SEQ ID NO: 1575723 - RNA, 14 nt, Pseudomonas putida KT2440
caguucgucgagca

SEQ ID NO: 1575724 - RNA, 22 nt, Pseudomonas putida KT2440
caguucguccaccgacggcgga

SEQ ID NO: 1575725 - RNA, 20 nt, Pseudomonas putida KT2440
caggucuucgcgcuugagca

SEQ ID NO: 1575726 - RNA, 16 nt, Pseudomonas putida KT2440
caggugaaucagcggc

SEQ ID NO: 1575727 - RNA, 14 nt, Pseudomonas putida KT2440
caggugaugcaggc

SEQ ID NO: 1575728 - RNA, 17 nt, Pseudomonas putida KT2440
caggugaugcaggcaau

SEQ ID NO: 1575729 - RNA, 18 nt, Pseudomonas putida KT2440
caggucguugacgaucug

SEQ ID NO: 1575730 - RNA, 19 nt, Pseudomonas putida KT2440
caggucgugauagaccugc

SEQ ID NO: 1575731 - RNA, 17 nt, Pseudomonas putida KT2440
caggucguaaucgcccg

SEQ ID NO: 1575732 - RNA, 15 nt, Pseudomonas putida KT2440
cagguccaccagcag

SEQ ID NO: 1575733 - RNA, 22 nt, Pseudomonas putida KT2440
caggucgccggugugcauccag

SEQ ID NO: 1575734 - RNA, 14 nt, Pseudomonas putida KT2440
caggucgcgcugca

SEQ ID NO: 1575735 - RNA, 17 nt, Pseudomonas putida KT2440
caggucgcuaucggcag

SEQ ID NO: 1575736 - RNA, 18 nt, Pseudomonas putida KT2440
caggucgcuaucggcagg

SEQ ID NO: 1575737 - RNA, 21 nt, Pseudomonas putida KT2440
caggucggugauauagcaccg

SEQ ID NO: 1575738 - RNA, 16 nt, Pseudomonas putida KT2440
caggucgggcuggcug

SEQ ID NO: 1575739 - RNA, 13 nt, Pseudomonas putida KT2440
caggugcagccag

SEQ ID NO: 1575740 - RNA, 15 nt, Pseudomonas putida KT2440
caggugcagguucga

SEQ ID NO: 1575741 - RNA, 18 nt, Pseudomonas putida KT2440
caggugcagguucgacca

SEQ ID NO: 1575742 - RNA, 15 nt, Pseudomonas putida KT2440
caggugccaggcuca

SEQ ID NO: 1575743 - RNA, 19 nt, Pseudomonas putida KT2440
caggugccguuccggcaaa

SEQ ID NO: 1575744 - RNA, 13 nt, Pseudomonas putida KT2440
caggugcgaaucg

SEQ ID NO: 1575745 - RNA, 12 nt, Pseudomonas putida KT2440
caggugcgcgcg

SEQ ID NO: 1575746 - RNA, 22 nt, Pseudomonas putida KT2440
cagguucaccguacccagguga

SEQ ID NO: 1575747 - RNA, 23 nt, Pseudomonas putida KT2440
cagguucacuuccacacggcggu

SEQ ID NO: 1575748 - RNA, 14 nt, Pseudomonas putida KT2440
cagguuacuggcca

SEQ ID NO: 1575749 - RNA, 23 nt, Pseudomonas putida KT2440
cagguuacgcaccagcuccaaca

SEQ ID NO: 1575750 - RNA, 14 nt, Pseudomonas putida KT2440
cagguuucagucga

SEQ ID NO: 1575751 - RNA, 16 nt, Pseudomonas putida KT2440
cagguguuccagcacg

SEQ ID NO: 1575752 - RNA, 14 nt, Pseudomonas putida KT2440
cagguuuuccagcc

SEQ ID NO: 1575753 - RNA, 15 nt, Pseudomonas putida KT2440
cagguaguuggccgg

SEQ ID NO: 1575754 - RNA, 22 nt, Pseudomonas putida KT2440
cagguauagggcuacguggacc

SEQ ID NO: 1575755 - RNA, 12 nt, Pseudomonas putida KT2440
caggucaugaug

SEQ ID NO: 1575756 - RNA, 16 nt, Pseudomonas putida KT2440
caggucaugcagguca

SEQ ID NO: 1575757 - RNA, 17 nt, Pseudomonas putida KT2440
caggucauguagcgccu

SEQ ID NO: 1575758 - RNA, 23 nt, Pseudomonas putida KT2440
caggucauguagcgccuggccug

SEQ ID NO: 1575759 - RNA, 23 nt, Pseudomonas putida KT2440
caggucauuggcgccaucgccca

SEQ ID NO: 1575760 - RNA, 15 nt, Pseudomonas putida KT2440
cagguaggcagcaac

SEQ ID NO: 1575761 - RNA, 23 nt, Pseudomonas putida KT2440
cagguaggugcugaccgccugcg

SEQ ID NO: 1575762 - RNA, 20 nt, Pseudomonas putida KT2440
cagguagguuuucggcugga

SEQ ID NO: 1575763 - RNA, 16 nt, Pseudomonas putida KT2440
cagguaggccgcagcc

SEQ ID NO: 1575764 - RNA, 16 nt, Pseudomonas putida KT2440
cagguaagucagcgag

SEQ ID NO: 1575765 - RNA, 17 nt, Pseudomonas putida KT2440
cagguaacugccgaccu

SEQ ID NO: 1575766 - RNA, 14 nt, Pseudomonas putida KT2440
cagguaaacccgcg

SEQ ID NO: 1575767 - RNA, 20 nt, Pseudomonas putida KT2440
cagguaaacccgcgccugca

SEQ ID NO: 1575768 - RNA, 14 nt, Pseudomonas putida KT2440
caggguggccagca

SEQ ID NO: 1575769 - RNA, 24 nt, Pseudomonas putida KT2440
cagggugccggccagcggcaugug

SEQ ID NO: 1575770 - RNA, 23 nt, Pseudomonas putida KT2440
cagggccagguagacgaucgagc

SEQ ID NO: 1575771 - RNA, 18 nt, Pseudomonas putida KT2440
cagggcauugcgcaugcg

SEQ ID NO: 1575772 - RNA, 15 nt, Pseudomonas putida KT2440
cagggaccucacagc

SEQ ID NO: 1575773 - RNA, 19 nt, Pseudomonas putida KT2440
caucaaauacucagaccaa

SEQ ID NO: 1575774 - RNA, 20 nt, Pseudomonas putida KT2440
cauaucgcgaaacgcggcaa

SEQ ID NO: 1575775 - RNA, 15 nt, Pseudomonas putida KT2440
cauaucaggcaugcc

SEQ ID NO: 1575776 - RNA, 16 nt, Pseudomonas putida KT2440
cauaucaggcaugcca

SEQ ID NO: 1575777 - RNA, 15 nt, Pseudomonas putida KT2440
cauaggccagcuccu

SEQ ID NO: 1575778 - RNA, 20 nt, Pseudomonas putida KT2440
cauagcucauggucagccgg

SEQ ID NO: 1575779 - RNA, 17 nt, Pseudomonas putida KT2440
cauagcuuucaggcgca

SEQ ID NO: 1575780 - RNA, 16 nt, Pseudomonas putida KT2440
cauagcgcugcaccga

SEQ ID NO: 1575781 - RNA, 17 nt, Pseudomonas putida KT2440
cauagcgcucgcgcagg

SEQ ID NO: 1575782 - RNA, 18 nt, Pseudomonas putida KT2440
cauacccuuugccaucca

SEQ ID NO: 1575783 - RNA, 22 nt, Pseudomonas putida KT2440
cauaguccaggaagcaggcgua

SEQ ID NO: 1575784 - RNA, 21 nt, Pseudomonas putida KT2440
cauagucgauacccaggcgcg

SEQ ID NO: 1575785 - RNA, 22 nt, Pseudomonas putida KT2440
caguugccaguguucgaacggg

SEQ ID NO: 1575786 - RNA, 17 nt, Pseudomonas putida KT2440
caguugccccaggccca

SEQ ID NO: 1575787 - RNA, 14 nt, Pseudomonas putida KT2440
caguugcaggcgca

SEQ ID NO: 1575788 - RNA, 18 nt, Pseudomonas putida KT2440
caguugcagacgcgcagc

SEQ ID NO: 1575789 - RNA, 19 nt, Pseudomonas putida KT2440
caguugcagacgcgcagca

SEQ ID NO: 1575790 - RNA, 22 nt, Pseudomonas putida KT2440
caguugcgggaaggucggccag

SEQ ID NO: 1575791 - RNA, 14 nt, Pseudomonas putida KT2440
caguugcucgcccg

SEQ ID NO: 1575792 - RNA, 16 nt, Pseudomonas putida KT2440
caguugcucgcccgca

SEQ ID NO: 1575793 - RNA, 22 nt, Pseudomonas putida KT2440
caguuggcguauuuuggcaggu

SEQ ID NO: 1575794 - RNA, 13 nt, Pseudomonas putida KT2440
caguuggcgucca

SEQ ID NO: 1575795 - RNA, 20 nt, Pseudomonas putida KT2440
caguuguccaggcugcgcau

SEQ ID NO: 1575796 - RNA, 17 nt, Pseudomonas putida KT2440
caguuguucgucgagca

SEQ ID NO: 1575797 - RNA, 19 nt, Pseudomonas putida KT2440
caguuguucgucgagcacc

SEQ ID NO: 1575798 - RNA, 22 nt, Pseudomonas putida KT2440
caguuguucgucgagcaccacg

SEQ ID NO: 1575799 - RNA, 13 nt, Pseudomonas putida KT2440
cauacagcgccuc

SEQ ID NO: 1575800 - RNA, 18 nt, Pseudomonas putida KT2440
cauacagcucccgcgcau

SEQ ID NO: 1575801 - RNA, 14 nt, Pseudomonas putida KT2440
cauaccaauggcaa

SEQ ID NO: 1575802 - RNA, 17 nt, Pseudomonas putida KT2440
cauaccaauggcaaucg

SEQ ID NO: 1575803 - RNA, 18 nt, Pseudomonas putida KT2440
cauaccaauggcaaucgc

SEQ ID NO: 1575804 - RNA, 22 nt, Pseudomonas putida KT2440
cauaaaccccagccuucagcag

SEQ ID NO: 1575805 - RNA, 17 nt, Pseudomonas putida KT2440
cauaagcugucagcacc

SEQ ID NO: 1575806 - RNA, 18 nt, Pseudomonas putida KT2440
caucgcagggucgcgccc

SEQ ID NO: 1575807 - RNA, 17 nt, Pseudomonas putida KT2440
caucgcccauugccgga

SEQ ID NO: 1575808 - RNA, 19 nt, Pseudomonas putida KT2440
caucgccaacagaggccuc

SEQ ID NO: 1575809 - RNA, 16 nt, Pseudomonas putida KT2440
caucgcauaugcccca

SEQ ID NO: 1575810 - RNA, 16 nt, Pseudomonas putida KT2440
caucgcagcggccgaa

SEQ ID NO: 1575811 - RNA, 21 nt, Pseudomonas putida KT2440
caucgaucaggguuuccaccg

SEQ ID NO: 1575812 - RNA, 19 nt, Pseudomonas putida KT2440
caucgaguaucgccucgau

SEQ ID NO: 1575813 - RNA, 21 nt, Pseudomonas putida KT2440
caucgaauuucugcaacagcu

SEQ ID NO: 1575814 - RNA, 19 nt, Pseudomonas putida KT2440
caucgacagguccaccgcu

SEQ ID NO: 1575815 - RNA, 14 nt, Pseudomonas putida KT2440
caucgacaggugcg

SEQ ID NO: 1575816 - RNA, 18 nt, Pseudomonas putida KT2440
caucgacaggugcggcag

SEQ ID NO: 1575817 - RNA, 22 nt, Pseudomonas putida KT2440
caucgacaggugcggcagcucg

SEQ ID NO: 1575818 - RNA, 16 nt, Pseudomonas putida KT2440
caucgaaguguugccg

SEQ ID NO: 1575819 - RNA, 17 nt, Pseudomonas putida KT2440
caucgaagaucagcacc

SEQ ID NO: 1575820 - RNA, 18 nt, Pseudomonas putida KT2440
caucgaagaucagcucau

SEQ ID NO: 1575821 - RNA, 16 nt, Pseudomonas putida KT2440
cauccugcguggcggu

SEQ ID NO: 1575822 - RNA, 21 nt, Pseudomonas putida KT2440
cauccugcucgacaagccgcu

SEQ ID NO: 1575823 - RNA, 14 nt, Pseudomonas putida KT2440
cauccugcuggccc

SEQ ID NO: 1575824 - RNA, 15 nt, Pseudomonas putida KT2440
cauccugcgcggcca

SEQ ID NO: 1575825 - RNA, 23 nt, Pseudomonas putida KT2440
cauccggaauuucugcaccuugc

SEQ ID NO: 1575826 - RNA, 14 nt, Pseudomonas putida KT2440
cauccgccucaucc

SEQ ID NO: 1575827 - RNA, 16 nt, Pseudomonas putida KT2440
cauccucggugcgcgg

SEQ ID NO: 1575828 - RNA, 18 nt, Pseudomonas putida KT2440
cauccucgcccaccagcu

SEQ ID NO: 1575829 - RNA, 19 nt, Pseudomonas putida KT2440
cauccuggucacucugccg

SEQ ID NO: 1575830 - RNA, 22 nt, Pseudomonas putida KT2440
caucaccgccagcauggccgga

SEQ ID NO: 1575831 - RNA, 23 nt, Pseudomonas putida KT2440
caucacccgcgaaugcuccggcg

SEQ ID NO: 1575832 - RNA, 23 nt, Pseudomonas putida KT2440
caucacccgggaacagcagcacc

SEQ ID NO: 1575833 - RNA, 23 nt, Pseudomonas putida KT2440
caucaugccgcccaugccaccca

SEQ ID NO: 1575834 - RNA, 14 nt, Pseudomonas putida KT2440
caucaucucgcgau

SEQ ID NO: 1575835 - RNA, 13 nt, Pseudomonas putida KT2440
caucaucacgcgc

SEQ ID NO: 1575836 - RNA, 16 nt, Pseudomonas putida KT2440
caucaucagcaggcag

SEQ ID NO: 1575837 - RNA, 13 nt, Pseudomonas putida KT2440
cauccagcgccac

SEQ ID NO: 1575838 - RNA, 14 nt, Pseudomonas putida KT2440
cauccagcgccacc

SEQ ID NO: 1575839 - RNA, 21 nt, Pseudomonas putida KT2440
cauccccuguaggagcgggcu

SEQ ID NO: 1575840 - RNA, 17 nt, Pseudomonas putida KT2440
caucccccggcccagcc

SEQ ID NO: 1575841 - RNA, 21 nt, Pseudomonas putida KT2440
cauccccggccuccucgcggg

SEQ ID NO: 1575842 - RNA, 18 nt, Pseudomonas putida KT2440
cauccccuccggaucggu

SEQ ID NO: 1575843 - RNA, 21 nt, Pseudomonas putida KT2440
cauccagcacugccuggccac

SEQ ID NO: 1575844 - RNA, 16 nt, Pseudomonas putida KT2440
cauccagaucggcagu

SEQ ID NO: 1575845 - RNA, 20 nt, Pseudomonas putida KT2440
cauccaccgcgccagccugg

SEQ ID NO: 1575846 - RNA, 19 nt, Pseudomonas putida KT2440
cauccaccaggcuggccac

SEQ ID NO: 1575847 - RNA, 16 nt, Pseudomonas putida KT2440
cauccacacgcugcug

SEQ ID NO: 1575848 - RNA, 14 nt, Pseudomonas putida KT2440
cauccacaggcgcc

SEQ ID NO: 1575849 - RNA, 14 nt, Pseudomonas putida KT2440
cauccaacccugcg

SEQ ID NO: 1575850 - RNA, 17 nt, Pseudomonas putida KT2440
cauccaacgcauccagg

SEQ ID NO: 1575851 - RNA, 22 nt, Pseudomonas putida KT2440
cagcgggguguccucgaucaca

SEQ ID NO: 1575852 - RNA, 14 nt, Pseudomonas putida KT2440
cagcggcuccaccg

SEQ ID NO: 1575853 - RNA, 23 nt, Pseudomonas putida KT2440
cagcgggcucgcccacacggcaa

SEQ ID NO: 1575854 - RNA, 19 nt, Pseudomonas putida KT2440
cagcguccacucaccggca

SEQ ID NO: 1575855 - RNA, 12 nt, Pseudomonas putida KT2440
cagcgucaugcg

SEQ ID NO: 1575856 - RNA, 20 nt, Pseudomonas putida KT2440
cagcgccucccccagcgcgg

SEQ ID NO: 1575857 - RNA, 13 nt, Pseudomonas putida KT2440
cagcgccuccagc

SEQ ID NO: 1575858 - RNA, 20 nt, Pseudomonas putida KT2440
cagcggcguguaguagcucc

SEQ ID NO: 1575859 - RNA, 20 nt, Pseudomonas putida KT2440
cagcggcucgcucaggcgca

SEQ ID NO: 1575860 - RNA, 14 nt, Pseudomonas putida KT2440
cagcggcgucaccu

SEQ ID NO: 1575861 - RNA, 13 nt, Pseudomonas putida KT2440
cagcgccggcagu

SEQ ID NO: 1575862 - RNA, 17 nt, Pseudomonas putida KT2440
cagcgccggcaguugcu

SEQ ID NO: 1575863 - RNA, 17 nt, Pseudomonas putida KT2440
cagcgucuuguuguccg

SEQ ID NO: 1575864 - RNA, 15 nt, Pseudomonas putida KT2440
cagcgucucgaugca

SEQ ID NO: 1575865 - RNA, 16 nt, Pseudomonas putida KT2440
cagcucaaucagccaa

SEQ ID NO: 1575866 - RNA, 13 nt, Pseudomonas putida KT2440
cagcucacagcac

SEQ ID NO: 1575867 - RNA, 13 nt, Pseudomonas putida KT2440
cagcucaacgcga

SEQ ID NO: 1575868 - RNA, 16 nt, Pseudomonas putida KT2440
cagcguucggccagca

SEQ ID NO: 1575869 - RNA, 24 nt, Pseudomonas putida KT2440
cagcguuguucaccacacccggcu

SEQ ID NO: 1575870 - RNA, 12 nt, Pseudomonas putida KT2440
cagcucauccag

SEQ ID NO: 1575871 - RNA, 14 nt, Pseudomonas putida KT2440
cagcucacgcaagc

SEQ ID NO: 1575872 - RNA, 13 nt, Pseudomonas putida KT2440
cagcucaccggca

SEQ ID NO: 1575873 - RNA, 16 nt, Pseudomonas putida KT2440
cagcucagccagcaag

SEQ ID NO: 1575874 - RNA, 15 nt, Pseudomonas putida KT2440
cagcuccagcagugc

SEQ ID NO: 1575875 - RNA, 15 nt, Pseudomonas putida KT2440
cagcuccagcaccuc

SEQ ID NO: 1575876 - RNA, 14 nt, Pseudomonas putida KT2440
cagcuccagcacca

SEQ ID NO: 1575877 - RNA, 17 nt, Pseudomonas putida KT2440
cagcucgacaacccgcg

SEQ ID NO: 1575878 - RNA, 18 nt, Pseudomonas putida KT2440
cagcucgacaacccgcgc

SEQ ID NO: 1575879 - RNA, 15 nt, Pseudomonas putida KT2440
cagcugcaccgaccg

SEQ ID NO: 1575880 - RNA, 22 nt, Pseudomonas putida KT2440
cagcugcauauaccgcgcacgc

SEQ ID NO: 1575881 - RNA, 20 nt, Pseudomonas putida KT2440
cagcugccauuucuucagca

SEQ ID NO: 1575882 - RNA, 17 nt, Pseudomonas putida KT2440
cagcugcauuggcggca

SEQ ID NO: 1575883 - RNA, 21 nt, Pseudomonas putida KT2440
cagcugccacucuucaccaug

SEQ ID NO: 1575884 - RNA, 11 nt, Pseudomonas putida KT2440
cagcugcgcac

SEQ ID NO: 1575885 - RNA, 19 nt, Pseudomonas putida KT2440
cagcugaucgccgucgacc

SEQ ID NO: 1575886 - RNA, 23 nt, Pseudomonas putida KT2440
cagcugaucgccgucgaccaggc

SEQ ID NO: 1575887 - RNA, 22 nt, Pseudomonas putida KT2440
cagcugcaacagaaaaugcccg

SEQ ID NO: 1575888 - RNA, 16 nt, Pseudomonas putida KT2440
cagcugcaacagcggc

SEQ ID NO: 1575889 - RNA, 20 nt, Pseudomonas putida KT2440
cagcugagcgccauccaccu

SEQ ID NO: 1575890 - RNA, 23 nt, Pseudomonas putida KT2440
cagcugagcgccauccaccugug

SEQ ID NO: 1575891 - RNA, 14 nt, Pseudomonas putida KT2440
cagcucgucgagca

SEQ ID NO: 1575892 - RNA, 12 nt, Pseudomonas putida KT2440
cagcucugcgac

SEQ ID NO: 1575893 - RNA, 18 nt, Pseudomonas putida KT2440
cagcucuggcagcagugc

SEQ ID NO: 1575894 - RNA, 21 nt, Pseudomonas putida KT2440
cagcucuucaucccugaccga

SEQ ID NO: 1575895 - RNA, 16 nt, Pseudomonas putida KT2440
cagcucuugucgacag

SEQ ID NO: 1575896 - RNA, 19 nt, Pseudomonas putida KT2440
cagcucuuugggggugcug

SEQ ID NO: 1575897 - RNA, 16 nt, Pseudomonas putida KT2440
cagcucgcgcugcgca

SEQ ID NO: 1575898 - RNA, 17 nt, Pseudomonas putida KT2440
cagcucgcgcagggcau

SEQ ID NO: 1575899 - RNA, 23 nt, Pseudomonas putida KT2440
cagcucgaucucccgcgaacgcc

SEQ ID NO: 1575900 - RNA, 13 nt, Pseudomonas putida KT2440
cagcucgauggcc

SEQ ID NO: 1575901 - RNA, 18 nt, Pseudomonas putida KT2440
cagcucgccaacaccgcc

SEQ ID NO: 1575902 - RNA, 23 nt, Pseudomonas putida KT2440
cagcucggccgaugccagguaca

SEQ ID NO: 1575903 - RNA, 12 nt, Pseudomonas putida KT2440
cagcucgcuggc

SEQ ID NO: 1575904 - RNA, 14 nt, Pseudomonas putida KT2440
cagcucgcuggcca

SEQ ID NO: 1575905 - RNA, 16 nt, Pseudomonas putida KT2440
cagcucgucagccacc

SEQ ID NO: 1575906 - RNA, 23 nt, Pseudomonas putida KT2440
cagcucgucagccaccaccagcu

SEQ ID NO: 1575907 - RNA, 20 nt, Pseudomonas putida KT2440
cagcuggagacgaacagcgc

SEQ ID NO: 1575908 - RNA, 11 nt, Pseudomonas putida KT2440
cagcuggccau

SEQ ID NO: 1575909 - RNA, 14 nt, Pseudomonas putida KT2440
cagcuggccuugcg

SEQ ID NO: 1575910 - RNA, 17 nt, Pseudomonas putida KT2440
cagcuggccuugcggca

SEQ ID NO: 1575911 - RNA, 20 nt, Pseudomonas putida KT2440
cagcuggccuugcggcaagc

SEQ ID NO: 1575912 - RNA, 23 nt, Pseudomonas putida KT2440
cagcuggcuggugacaacgcccg

SEQ ID NO: 1575913 - RNA, 18 nt, Pseudomonas putida KT2440
cagcugggugacaaagcg

SEQ ID NO: 1575914 - RNA, 23 nt, Pseudomonas putida KT2440
cagcuggucgagcaaggcaucca

SEQ ID NO: 1575915 - RNA, 14 nt, Pseudomonas putida KT2440
cagcugcgccugca

SEQ ID NO: 1575916 - RNA, 17 nt, Pseudomonas putida KT2440
cagcugcugcggcaccu

SEQ ID NO: 1575917 - RNA, 16 nt, Pseudomonas putida KT2440
cagcugcugcagggcc

SEQ ID NO: 1575918 - RNA, 19 nt, Pseudomonas putida KT2440
cagcuucaccucaucggca

SEQ ID NO: 1575919 - RNA, 18 nt, Pseudomonas putida KT2440
cagcuucagccagggcga

SEQ ID NO: 1575920 - RNA, 22 nt, Pseudomonas putida KT2440
cagcuucaaaauagucgaaggc

SEQ ID NO: 1575921 - RNA, 17 nt, Pseudomonas putida KT2440
cagcuuccgccaccacg

SEQ ID NO: 1575922 - RNA, 14 nt, Pseudomonas putida KT2440
cagcuucgacgaag

SEQ ID NO: 1575923 - RNA, 21 nt, Pseudomonas putida KT2440
cagcuucucgcggcgaaugcu

SEQ ID NO: 1575924 - RNA, 23 nt, Pseudomonas putida KT2440
cagcuguacgcuggccaaggccu

SEQ ID NO: 1575925 - RNA, 20 nt, Pseudomonas putida KT2440
cagcugugugucgucacggc

SEQ ID NO: 1575926 - RNA, 23 nt, Pseudomonas putida KT2440
cagcuuaacgcuuggccagacuc

SEQ ID NO: 1575927 - RNA, 15 nt, Pseudomonas putida KT2440
cagcuucuggcgcgu

SEQ ID NO: 1575928 - RNA, 13 nt, Pseudomonas putida KT2440
cagcuugacgauc

SEQ ID NO: 1575929 - RNA, 23 nt, Pseudomonas putida KT2440
cagcuugacgaucuucugcacgc

SEQ ID NO: 1575930 - RNA, 21 nt, Pseudomonas putida KT2440
cagcuugacggugcgcgccag

SEQ ID NO: 1575931 - RNA, 18 nt, Pseudomonas putida KT2440
cagcuugcagcgccgagc

SEQ ID NO: 1575932 - RNA, 15 nt, Pseudomonas putida KT2440
cagcuugaugcuguc

SEQ ID NO: 1575933 - RNA, 20 nt, Pseudomonas putida KT2440
cagcuugaugcugucgaagc

SEQ ID NO: 1575934 - RNA, 21 nt, Pseudomonas putida KT2440
cagcuugaugcugucgaagcg

SEQ ID NO: 1575935 - RNA, 20 nt, Pseudomonas putida KT2440
cagcuuggccauuuccggcc

SEQ ID NO: 1575936 - RNA, 14 nt, Pseudomonas putida KT2440
cagcuugcccagcu

SEQ ID NO: 1575937 - RNA, 15 nt, Pseudomonas putida KT2440
caggcuacgcagcac

SEQ ID NO: 1575938 - RNA, 21 nt, Pseudomonas putida KT2440
caggcuaugccggucagcagc

SEQ ID NO: 1575939 - RNA, 18 nt, Pseudomonas putida KT2440
caggcguucaucgaaggc

SEQ ID NO: 1575940 - RNA, 19 nt, Pseudomonas putida KT2440
caggcguucaucgaaggcc

SEQ ID NO: 1575941 - RNA, 17 nt, Pseudomonas putida KT2440
caggcguguuagccgug

SEQ ID NO: 1575942 - RNA, 19 nt, Pseudomonas putida KT2440
caggcgcugguugacggcu

SEQ ID NO: 1575943 - RNA, 20 nt, Pseudomonas putida KT2440
caggcgcugguugacggcuu

SEQ ID NO: 1575944 - RNA, 15 nt, Pseudomonas putida KT2440
caggcgcuucaggua

SEQ ID NO: 1575945 - RNA, 20 nt, Pseudomonas putida KT2440
caggcgcuugagcucggcaa

SEQ ID NO: 1575946 - RNA, 15 nt, Pseudomonas putida KT2440
caggcgucguuguug

SEQ ID NO: 1575947 - RNA, 14 nt, Pseudomonas putida KT2440
caggcgcuggcgcc

SEQ ID NO: 1575948 - RNA, 17 nt, Pseudomonas putida KT2440
caggcgcggugccggca

SEQ ID NO: 1575949 - RNA, 14 nt, Pseudomonas putida KT2440
caggcgcucguagg

SEQ ID NO: 1575950 - RNA, 14 nt, Pseudomonas putida KT2440
caggcgcggcagca

SEQ ID NO: 1575951 - RNA, 14 nt, Pseudomonas putida KT2440
caggcgcggcucga

SEQ ID NO: 1575952 - RNA, 22 nt, Pseudomonas putida KT2440
caggcgcggcucgaugcugcgu

SEQ ID NO: 1575953 - RNA, 22 nt, Pseudomonas putida KT2440
caggcucugaaugucagcgcuc

SEQ ID NO: 1575954 - RNA, 17 nt, Pseudomonas putida KT2440
caggcucugcgccagca

SEQ ID NO: 1575955 - RNA, 17 nt, Pseudomonas putida KT2440
caggcucugcuccagcu

SEQ ID NO: 1575956 - RNA, 23 nt, Pseudomonas putida KT2440
caggcucuugaacugggcaucca

SEQ ID NO: 1575957 - RNA, 18 nt, Pseudomonas putida KT2440
caggcugcgugccugcug

SEQ ID NO: 1575958 - RNA, 19 nt, Pseudomonas putida KT2440
caggcugcgugccugcugc

SEQ ID NO: 1575959 - RNA, 23 nt, Pseudomonas putida KT2440
caggcucuccucaucgaugcccg

SEQ ID NO: 1575960 - RNA, 13 nt, Pseudomonas putida KT2440
caggcucagggcc

SEQ ID NO: 1575961 - RNA, 14 nt, Pseudomonas putida KT2440
caggcucagucgca

SEQ ID NO: 1575962 - RNA, 13 nt, Pseudomonas putida KT2440
caggcuggccagc

SEQ ID NO: 1575963 - RNA, 16 nt, Pseudomonas putida KT2440
caggcuggcgacgcca

SEQ ID NO: 1575964 - RNA, 17 nt, Pseudomonas putida KT2440
cagggaacugcgcgagc

SEQ ID NO: 1575965 - RNA, 22 nt, Pseudomonas putida KT2440
cagggaagguggccggcaacgg

SEQ ID NO: 1575966 - RNA, 12 nt, Pseudomonas putida KT2440
caggcuggcgcu

SEQ ID NO: 1575967 - RNA, 20 nt, Pseudomonas putida KT2440
caggcuugcuucuugaagcg

SEQ ID NO: 1575968 - RNA, 14 nt, Pseudomonas putida KT2440
caggcuuggcgaac

SEQ ID NO: 1575969 - RNA, 20 nt, Pseudomonas putida KT2440
caggcgaagcguucaugccc

SEQ ID NO: 1575970 - RNA, 18 nt, Pseudomonas putida KT2440
caggccuucaucggccuc

SEQ ID NO: 1575971 - RNA, 14 nt, Pseudomonas putida KT2440
caggccugucacgc

SEQ ID NO: 1575972 - RNA, 22 nt, Pseudomonas putida KT2440
caggcgacaaaaaccucacggc

SEQ ID NO: 1575973 - RNA, 16 nt, Pseudomonas putida KT2440
caggccgauggcgaug

SEQ ID NO: 1575974 - RNA, 13 nt, Pseudomonas putida KT2440
caggccgaucacc

SEQ ID NO: 1575975 - RNA, 19 nt, Pseudomonas putida KT2440
caggccgaugggcaggcca

SEQ ID NO: 1575976 - RNA, 15 nt, Pseudomonas putida KT2440
caggccgcagccucu

SEQ ID NO: 1575977 - RNA, 20 nt, Pseudomonas putida KT2440
caggccguagcgcugaccau

SEQ ID NO: 1575978 - RNA, 14 nt, Pseudomonas putida KT2440
caggccggguccug

SEQ ID NO: 1575979 - RNA, 16 nt, Pseudomonas putida KT2440
caggccacgguccagu

SEQ ID NO: 1575980 - RNA, 18 nt, Pseudomonas putida KT2440
caggccaaggaacguuuc

SEQ ID NO: 1575981 - RNA, 15 nt, Pseudomonas putida KT2440
caggccaccggcagc

SEQ ID NO: 1575982 - RNA, 21 nt, Pseudomonas putida KT2440
caggcaugccagcagcuggcu

SEQ ID NO: 1575983 - RNA, 22 nt, Pseudomonas putida KT2440
caggcauuguugcaacgcagcg

SEQ ID NO: 1575984 - RNA, 19 nt, Pseudomonas putida KT2440
caggaugccaaggaucagc

SEQ ID NO: 1575985 - RNA, 16 nt, Pseudomonas putida KT2440
caggcaccagcgcugc

SEQ ID NO: 1575986 - RNA, 12 nt, Pseudomonas putida KT2440
caggcaccgcac

SEQ ID NO: 1575987 - RNA, 23 nt, Pseudomonas putida KT2440
caggcaauugugccgcgccagcu

SEQ ID NO: 1575988 - RNA, 15 nt, Pseudomonas putida KT2440
caggcacaggccagc

SEQ ID NO: 1575989 - RNA, 13 nt, Pseudomonas putida KT2440
caggcacaggccc

SEQ ID NO: 1575990 - RNA, 14 nt, Pseudomonas putida KT2440
caggcacaggccca

SEQ ID NO: 1575991 - RNA, 13 nt, Pseudomonas putida KT2440
aaagccagcagcc

SEQ ID NO: 1575992 - RNA, 13 nt, Pseudomonas putida KT2440
aaagccagcagug

SEQ ID NO: 1575993 - RNA, 19 nt, Pseudomonas putida KT2440
caggccagcuucgacgaag

SEQ ID NO: 1575994 - RNA, 23 nt, Pseudomonas putida KT2440
caggccagcgucguguucgccug

SEQ ID NO: 1575995 - RNA, 21 nt, Pseudomonas putida KT2440
aaagcccaguucuuggcggcu

SEQ ID NO: 1575996 - RNA, 17 nt, Pseudomonas putida KT2440
caggcccagccgggcca

SEQ ID NO: 1575997 - RNA, 21 nt, Pseudomonas putida KT2440
caggcccgugacgaaggcggu

SEQ ID NO: 1575998 - RNA, 13 nt, Pseudomonas putida KT2440
caggcccugcugc

SEQ ID NO: 1575999 - RNA, 17 nt, Pseudomonas putida KT2440
caggcccugacaggcga

SEQ ID NO: 1576000 - RNA, 22 nt, Pseudomonas putida KT2440
caggcccugacaggcgaucagu

SEQ ID NO: 1576001 - RNA, 22 nt, Pseudomonas putida KT2440
caggaaggcgucguacaggccu

SEQ ID NO: 1576002 - RNA, 16 nt, Pseudomonas putida KT2440
caggaagcuggccagc

SEQ ID NO: 1576003 - RNA, 19 nt, Pseudomonas putida KT2440
caggaagaucacgucggcc

SEQ ID NO: 1576004 - RNA, 23 nt, Pseudomonas putida KT2440
caggaacgguguaucggccaguu

SEQ ID NO: 1576005 - RNA, 17 nt, Pseudomonas putida KT2440
caggaagaaggcaucca

SEQ ID NO: 1576006 - RNA, 14 nt, Pseudomonas putida KT2440
cagcuuguugccgg

SEQ ID NO: 1576007 - RNA, 18 nt, Pseudomonas putida KT2440
cagcuugucgaccaggau

SEQ ID NO: 1576008 - RNA, 14 nt, Pseudomonas putida KT2440
cagcuugucgacca

SEQ ID NO: 1576009 - RNA, 19 nt, Pseudomonas putida KT2440
caggaaaacggcuaccccg

SEQ ID NO: 1576010 - RNA, 22 nt, Pseudomonas putida KT2440
caggaacaaccugaacaaggcc

SEQ ID NO: 1576011 - RNA, 19 nt, Pseudomonas putida KT2440
caggaacaccacguucggg

SEQ ID NO: 1576012 - RNA, 13 nt, Pseudomonas putida KT2440
caggaacagcgca

SEQ ID NO: 1576013 - RNA, 22 nt, Pseudomonas putida KT2440
caggaacagcgccacgccugca

SEQ ID NO: 1576014 - RNA, 12 nt, Pseudomonas putida KT2440
caggaacagcgu

SEQ ID NO: 1576015 - RNA, 14 nt, Pseudomonas putida KT2440
caggaacagcucga

SEQ ID NO: 1576016 - RNA, 18 nt, Pseudomonas putida KT2440
caggaucugcugcagcau

SEQ ID NO: 1576017 - RNA, 14 nt, Pseudomonas putida KT2440
caggaagucgaugu

SEQ ID NO: 1576018 - RNA, 23 nt, Pseudomonas putida KT2440
caggaagucgauguucagcaccu

SEQ ID NO: 1576019 - RNA, 16 nt, Pseudomonas putida KT2440
caggaauuacgcaggc

SEQ ID NO: 1576020 - RNA, 20 nt, Pseudomonas putida KT2440
caggacaaaccagcggucug

SEQ ID NO: 1576021 - RNA, 14 nt, Pseudomonas putida KT2440
cagccuuggguaac

SEQ ID NO: 1576022 - RNA, 16 nt, Pseudomonas putida KT2440
cagccuuucgagagcc

SEQ ID NO: 1576023 - RNA, 22 nt, Pseudomonas putida KT2440
cagccuuugaaacggucagcgg

SEQ ID NO: 1576024 - RNA, 23 nt, Pseudomonas putida KT2440
cagccuuugaaacggucagcggc

SEQ ID NO: 1576025 - RNA, 18 nt, Pseudomonas putida KT2440
cagccuuuuccagcucgg

SEQ ID NO: 1576026 - RNA, 16 nt, Pseudomonas putida KT2440
cagccuuuagcgcauc

SEQ ID NO: 1576027 - RNA, 19 nt, Pseudomonas putida KT2440
cagcgaaagcaagguagcg

SEQ ID NO: 1576028 - RNA, 22 nt, Pseudomonas putida KT2440
cagcgacccugagucuggcgcc

SEQ ID NO: 1576029 - RNA, 13 nt, Pseudomonas putida KT2440
cagcgacaugccg

SEQ ID NO: 1576030 - RNA, 13 nt, Pseudomonas putida KT2440
cagcgacagguag

SEQ ID NO: 1576031 - RNA, 15 nt, Pseudomonas putida KT2440
cagcgacgaccugca

SEQ ID NO: 1576032 - RNA, 16 nt, Pseudomonas putida KT2440
cagccguugcugggcu

SEQ ID NO: 1576033 - RNA, 15 nt, Pseudomonas putida KT2440
cagccguucuggcca

SEQ ID NO: 1576034 - RNA, 19 nt, Pseudomonas putida KT2440
cagccuccagguucgggua

SEQ ID NO: 1576035 - RNA, 14 nt, Pseudomonas putida KT2440
cagccuccggccca

SEQ ID NO: 1576036 - RNA, 17 nt, Pseudomonas putida KT2440
cagccggcccggcuggc

SEQ ID NO: 1576037 - RNA, 12 nt, Pseudomonas putida KT2440
cagccuucagca

SEQ ID NO: 1576038 - RNA, 13 nt, Pseudomonas putida KT2440
cagccuucagugc

SEQ ID NO: 1576039 - RNA, 14 nt, Pseudomonas putida KT2440
cagccugugcggcu

SEQ ID NO: 1576040 - RNA, 14 nt, Pseudomonas putida KT2440
cagccuucgccaac

SEQ ID NO: 1576041 - RNA, 18 nt, Pseudomonas putida KT2440
cagccucuucuucaaggc

SEQ ID NO: 1576042 - RNA, 15 nt, Pseudomonas putida KT2440
cagcgcauugcccgc

SEQ ID NO: 1576043 - RNA, 19 nt, Pseudomonas putida KT2440
cagcgcaugcaucugcgcc

SEQ ID NO: 1576044 - RNA, 17 nt, Pseudomonas putida KT2440
cagcgccaauaccgcgc

SEQ ID NO: 1576045 - RNA, 19 nt, Pseudomonas putida KT2440
cagcgccaauaccgcgcau

SEQ ID NO: 1576046 - RNA, 18 nt, Pseudomonas putida KT2440
cagcgccaaaggcgcguc

SEQ ID NO: 1576047 - RNA, 16 nt, Pseudomonas putida KT2440
cagcgagcgggugccg

SEQ ID NO: 1576048 - RNA, 12 nt, Pseudomonas putida KT2440
cagcgaugaccc

SEQ ID NO: 1576049 - RNA, 15 nt, Pseudomonas putida KT2440
cagcgaugacccggc

SEQ ID NO: 1576050 - RNA, 21 nt, Pseudomonas putida KT2440
cagcgauucaguucaaagcga

SEQ ID NO: 1576051 - RNA, 16 nt, Pseudomonas putida KT2440
cagcgcauaggccaag

SEQ ID NO: 1576052 - RNA, 20 nt, Pseudomonas putida KT2440
cagcgccaguacggccauca

SEQ ID NO: 1576053 - RNA, 14 nt, Pseudomonas putida KT2440
cagcgccgccggcu

SEQ ID NO: 1576054 - RNA, 17 nt, Pseudomonas putida KT2440
cagcgccgccaggccca

SEQ ID NO: 1576055 - RNA, 19 nt, Pseudomonas putida KT2440
cagcgcccagaucagcagc

SEQ ID NO: 1576056 - RNA, 19 nt, Pseudomonas putida KT2440
cagcccggacugcaccagg

SEQ ID NO: 1576057 - RNA, 23 nt, Pseudomonas putida KT2440
cagcccggacugcaccaggucca

SEQ ID NO: 1576058 - RNA, 12 nt, Pseudomonas putida KT2440
cagccgacggcc

SEQ ID NO: 1576059 - RNA, 19 nt, Pseudomonas putida KT2440
cagccgagggcaugggcca

SEQ ID NO: 1576060 - RNA, 22 nt, Pseudomonas putida KT2440
cagccgcccuugagcuucagcg

SEQ ID NO: 1576061 - RNA, 24 nt, Pseudomonas putida KT2440
cagccgcgggcgucgcgaucacgc

SEQ ID NO: 1576062 - RNA, 16 nt, Pseudomonas putida KT2440
cagccggcaccgccau

SEQ ID NO: 1576063 - RNA, 11 nt, Pseudomonas putida KT2440
cagccgcgaac

SEQ ID NO: 1576064 - RNA, 18 nt, Pseudomonas putida KT2440
cagccaugccggcaacga

SEQ ID NO: 1576065 - RNA, 18 nt, Pseudomonas putida KT2440
cagccaucgagcaccggc

SEQ ID NO: 1576066 - RNA, 22 nt, Pseudomonas putida KT2440
cagccaucaucagguacggguu

SEQ ID NO: 1576067 - RNA, 15 nt, Pseudomonas putida KT2440
cagccagucgcgcaa

SEQ ID NO: 1576068 - RNA, 13 nt, Pseudomonas putida KT2440
cagcccaccacga

SEQ ID NO: 1576069 - RNA, 17 nt, Pseudomonas putida KT2440
cagcccaaggcuggcca

SEQ ID NO: 1576070 - RNA, 20 nt, Pseudomonas putida KT2440
cagcccaaggcuggccagac

SEQ ID NO: 1576071 - RNA, 16 nt, Pseudomonas putida KT2440
cagcccaccgagcuug

SEQ ID NO: 1576072 - RNA, 17 nt, Pseudomonas putida KT2440
cagcccaccgagcuugg

SEQ ID NO: 1576073 - RNA, 13 nt, Pseudomonas putida KT2440
cagcccagcgcca

SEQ ID NO: 1576074 - RNA, 14 nt, Pseudomonas putida KT2440
cagcccagcgccgc

SEQ ID NO: 1576075 - RNA, 20 nt, Pseudomonas putida KT2440
cagccccagcggcagcagca

SEQ ID NO: 1576076 - RNA, 15 nt, Pseudomonas putida KT2440
cagccccaccucggc

SEQ ID NO: 1576077 - RNA, 18 nt, Pseudomonas putida KT2440
cagccccaccucggcgau

SEQ ID NO: 1576078 - RNA, 17 nt, Pseudomonas putida KT2440
cagccccaucaccagcc

SEQ ID NO: 1576079 - RNA, 17 nt, Pseudomonas putida KT2440
cagcccauagcgccauc

SEQ ID NO: 1576080 - RNA, 17 nt, Pseudomonas putida KT2440
cagcccauucgcgggca

SEQ ID NO: 1576081 - RNA, 15 nt, Pseudomonas putida KT2440
cagccccgcaugcuc

SEQ ID NO: 1576082 - RNA, 14 nt, Pseudomonas putida KT2440
cagccccuagcgca

SEQ ID NO: 1576083 - RNA, 13 nt, Pseudomonas putida KT2440
cagcccgccugcu

SEQ ID NO: 1576084 - RNA, 21 nt, Pseudomonas putida KT2440
cagcacgcccaucagcgccgc

SEQ ID NO: 1576085 - RNA, 17 nt, Pseudomonas putida KT2440
cagcacgauggcggucg

SEQ ID NO: 1576086 - RNA, 23 nt, Pseudomonas putida KT2440
cagcacgccgccgauaccgaaca

SEQ ID NO: 1576087 - RNA, 14 nt, Pseudomonas putida KT2440
cagcacgcaggcca

SEQ ID NO: 1576088 - RNA, 19 nt, Pseudomonas putida KT2440
cagcacgcccaagccggcc

SEQ ID NO: 1576089 - RNA, 20 nt, Pseudomonas putida KT2440
cagcacgggcacacuggcca

SEQ ID NO: 1576090 - RNA, 17 nt, Pseudomonas putida KT2440
cagcagcaggcgcgagc

SEQ ID NO: 1576091 - RNA, 23 nt, Pseudomonas putida KT2440
cagcagcaaagguuugucgcccg

SEQ ID NO: 1576092 - RNA, 23 nt, Pseudomonas putida KT2440
cagcaccaaugaaagugucggcc

SEQ ID NO: 1576093 - RNA, 18 nt, Pseudomonas putida KT2440
cagcacaucacacagcgg

SEQ ID NO: 1576094 - RNA, 13 nt, Pseudomonas putida KT2440
cagcaccaucagg

SEQ ID NO: 1576095 - RNA, 15 nt, Pseudomonas putida KT2440
cagcaacgcccgcaa

SEQ ID NO: 1576096 - RNA, 15 nt, Pseudomonas putida KT2440
cagcaacgccgagca

SEQ ID NO: 1576097 - RNA, 15 nt, Pseudomonas putida KT2440
cagcaacgccaccag

SEQ ID NO: 1576098 - RNA, 17 nt, Pseudomonas putida KT2440
cagcaaccugcugggca

SEQ ID NO: 1576099 - RNA, 12 nt, Pseudomonas putida KT2440
cagcacaccgcg

SEQ ID NO: 1576100 - RNA, 20 nt, Pseudomonas putida KT2440
cagcaacggugaaaaacgcg

SEQ ID NO: 1576101 - RNA, 18 nt, Pseudomonas putida KT2440
cagcacaaggcucaagcg

SEQ ID NO: 1576102 - RNA, 14 nt, Pseudomonas putida KT2440
cagcacaaggcugu

SEQ ID NO: 1576103 - RNA, 13 nt, Pseudomonas putida KT2440
cagcacaggcggc

SEQ ID NO: 1576104 - RNA, 22 nt, Pseudomonas putida KT2440
cagcacagauaaaccugccacc

SEQ ID NO: 1576105 - RNA, 17 nt, Pseudomonas putida KT2440
cagcaacccggccaggc

SEQ ID NO: 1576106 - RNA, 16 nt, Pseudomonas putida KT2440
cagcaacagguacaug

SEQ ID NO: 1576107 - RNA, 13 nt, Pseudomonas putida KT2440
cagcaacaucgcc

SEQ ID NO: 1576108 - RNA, 22 nt, Pseudomonas putida KT2440
cagagccacggguuuacccucg

SEQ ID NO: 1576109 - RNA, 20 nt, Pseudomonas putida KT2440
cagauagaucaugcaaggua

SEQ ID NO: 1576110 - RNA, 15 nt, Pseudomonas putida KT2440
cagauacugcacccu

SEQ ID NO: 1576111 - RNA, 14 nt, Pseudomonas putida KT2440
cagauacuggcgcu

SEQ ID NO: 1576112 - RNA, 15 nt, Pseudomonas putida KT2440
cagccagcgacagca

SEQ ID NO: 1576113 - RNA, 24 nt, Pseudomonas putida KT2440
cagccagcgacagcaucggcaggu

SEQ ID NO: 1576114 - RNA, 12 nt, Pseudomonas putida KT2440
cagccagccucu

SEQ ID NO: 1576115 - RNA, 23 nt, Pseudomonas putida KT2440
cagccagccccaacccaccagca

SEQ ID NO: 1576116 - RNA, 22 nt, Pseudomonas putida KT2440
cagccagccacggaucaccugg

SEQ ID NO: 1576117 - RNA, 15 nt, Pseudomonas putida KT2440
cagccagaugcgccg

SEQ ID NO: 1576118 - RNA, 19 nt, Pseudomonas putida KT2440
cagccagaugcgcgcugca

SEQ ID NO: 1576119 - RNA, 23 nt, Pseudomonas putida KT2440
cagccacagcugcugcagggccc

SEQ ID NO: 1576120 - RNA, 16 nt, Pseudomonas putida KT2440
cagcaucuuccugcca

SEQ ID NO: 1576121 - RNA, 19 nt, Pseudomonas putida KT2440
cagcaugacaguggcaggu

SEQ ID NO: 1576122 - RNA, 20 nt, Pseudomonas putida KT2440
cagcaugacaguggcagguu

SEQ ID NO: 1576123 - RNA, 14 nt, Pseudomonas putida KT2440
cagcaugaucuugg

SEQ ID NO: 1576124 - RNA, 20 nt, Pseudomonas putida KT2440
cagcaugaugucgcugccgc

SEQ ID NO: 1576125 - RNA, 15 nt, Pseudomonas putida KT2440
cagcaugcccagcgc

SEQ ID NO: 1576126 - RNA, 17 nt, Pseudomonas putida KT2440
cagcaugcccagcgcca

SEQ ID NO: 1576127 - RNA, 14 nt, Pseudomonas putida KT2440
cagccaacugguug

SEQ ID NO: 1576128 - RNA, 20 nt, Pseudomonas putida KT2440
cagccaacuuuugcuggcug

SEQ ID NO: 1576129 - RNA, 12 nt, Pseudomonas putida KT2440
cagcaucagcga

SEQ ID NO: 1576130 - RNA, 14 nt, Pseudomonas putida KT2440
cagcaucagcgagg

SEQ ID NO: 1576131 - RNA, 15 nt, Pseudomonas putida KT2440
cagcaucagccaugg

SEQ ID NO: 1576132 - RNA, 17 nt, Pseudomonas putida KT2440
cagcagcgaagggcuca

SEQ ID NO: 1576133 - RNA, 23 nt, Pseudomonas putida KT2440
cagcagcgacaccagcgcaccac

SEQ ID NO: 1576134 - RNA, 13 nt, Pseudomonas putida KT2440
cagcagcgacacu

SEQ ID NO: 1576135 - RNA, 20 nt, Pseudomonas putida KT2440
cagcagccugugcggcuccg

SEQ ID NO: 1576136 - RNA, 13 nt, Pseudomonas putida KT2440
cagcaggcugcgu

SEQ ID NO: 1576137 - RNA, 15 nt, Pseudomonas putida KT2440
cagcagguucaacgg

SEQ ID NO: 1576138 - RNA, 21 nt, Pseudomonas putida KT2440
cagcagguugaacagcagcgc

SEQ ID NO: 1576139 - RNA, 22 nt, Pseudomonas putida KT2440
cagcagguugaacagcagcgcc

SEQ ID NO: 1576140 - RNA, 16 nt, Pseudomonas putida KT2440
cagcagguugaacagg

SEQ ID NO: 1576141 - RNA, 17 nt, Pseudomonas putida KT2440
cagcaggguggccagca

SEQ ID NO: 1576142 - RNA, 15 nt, Pseudomonas putida KT2440
cagcaggcuugccag

SEQ ID NO: 1576143 - RNA, 14 nt, Pseudomonas putida KT2440
cagcagugccagca

SEQ ID NO: 1576144 - RNA, 20 nt, Pseudomonas putida KT2440
cagcagugccaucgccucgg

SEQ ID NO: 1576145 - RNA, 12 nt, Pseudomonas putida KT2440
cagcagugcacc

SEQ ID NO: 1576146 - RNA, 17 nt, Pseudomonas putida KT2440
cagcaucacgccgcgcu

SEQ ID NO: 1576147 - RNA, 13 nt, Pseudomonas putida KT2440
cagcaucaccgcg

SEQ ID NO: 1576148 - RNA, 17 nt, Pseudomonas putida KT2440
cagcaucagcacacgcc

SEQ ID NO: 1576149 - RNA, 20 nt, Pseudomonas putida KT2440
cagcaucacccgcgaaugcu

SEQ ID NO: 1576150 - RNA, 22 nt, Pseudomonas putida KT2440
cacgguaggccuugaccagcuu

SEQ ID NO: 1576151 - RNA, 18 nt, Pseudomonas putida KT2440
cacgguaugcagguacca

SEQ ID NO: 1576152 - RNA, 15 nt, Pseudomonas putida KT2440
cacggucagcaucca

SEQ ID NO: 1576153 - RNA, 20 nt, Pseudomonas putida KT2440
cacgguccaucaggugcagc

SEQ ID NO: 1576154 - RNA, 22 nt, Pseudomonas putida KT2440
cacggucgaaccggucugcacg

SEQ ID NO: 1576155 - RNA, 12 nt, Pseudomonas putida KT2440
cacgggcacacu

SEQ ID NO: 1576156 - RNA, 12 nt, Pseudomonas putida KT2440
cacgggccagcg

SEQ ID NO: 1576157 - RNA, 18 nt, Pseudomonas putida KT2440
cacggguauagccaugca

SEQ ID NO: 1576158 - RNA, 17 nt, Pseudomonas putida KT2440
cacggucggccugcgcu

SEQ ID NO: 1576159 - RNA, 18 nt, Pseudomonas putida KT2440
cacggucggccugcgcuc

SEQ ID NO: 1576160 - RNA, 14 nt, Pseudomonas putida KT2440
cacggugccgaaca

SEQ ID NO: 1576161 - RNA, 23 nt, Pseudomonas putida KT2440
cacgguugcgcccggcgucgaac

SEQ ID NO: 1576162 - RNA, 12 nt, Pseudomonas putida KT2440
aaacugcgggcu

SEQ ID NO: 1576163 - RNA, 20 nt, Pseudomonas putida KT2440
cacggcggaaggcgucacgc

SEQ ID NO: 1576164 - RNA, 20 nt, Pseudomonas putida KT2440
cacggcguugccccuucgac

SEQ ID NO: 1576165 - RNA, 23 nt, Pseudomonas putida KT2440
cacggcgguucugcgcacgacca

SEQ ID NO: 1576166 - RNA, 17 nt, Pseudomonas putida KT2440
cacggcgaacaccccga

SEQ ID NO: 1576167 - RNA, 22 nt, Pseudomonas putida KT2440
cacggccuucccgccuggcgcc

SEQ ID NO: 1576168 - RNA, 14 nt, Pseudomonas putida KT2440
cacggcgcaggccg

SEQ ID NO: 1576169 - RNA, 22 nt, Pseudomonas putida KT2440
cacggcgccgaccgaaccggcg

SEQ ID NO: 1576170 - RNA, 18 nt, Pseudomonas putida KT2440
aaacugggcagcccucag

SEQ ID NO: 1576171 - RNA, 19 nt, Pseudomonas putida KT2440
cacgcggcaauccgcugga

SEQ ID NO: 1576172 - RNA, 18 nt, Pseudomonas putida KT2440
caccucaucgacccuggc

SEQ ID NO: 1576173 - RNA, 10 nt, Pseudomonas putida KT2440
caccuccaga

SEQ ID NO: 1576174 - RNA, 19 nt, Pseudomonas putida KT2440
caccguucuugauccagcu

SEQ ID NO: 1576175 - RNA, 21 nt, Pseudomonas putida KT2440
caccguugcgcucgagcccgc

SEQ ID NO: 1576176 - RNA, 20 nt, Pseudomonas putida KT2440
caccguugguaucgaucagg

SEQ ID NO: 1576177 - RNA, 16 nt, Pseudomonas putida KT2440
cacgcgguaccugugg

SEQ ID NO: 1576178 - RNA, 20 nt, Pseudomonas putida KT2440
cacgcucuguaucgaacagg

SEQ ID NO: 1576179 - RNA, 19 nt, Pseudomonas putida KT2440
cacgcucguuguccagcag

SEQ ID NO: 1576180 - RNA, 21 nt, Pseudomonas putida KT2440
cacgcuccgggugcggcauca

SEQ ID NO: 1576181 - RNA, 23 nt, Pseudomonas putida KT2440
cacgcuccuucgccacgaacagg

SEQ ID NO: 1576182 - RNA, 20 nt, Pseudomonas putida KT2440
cacgcguugggggugcuuuu

SEQ ID NO: 1576183 - RNA, 17 nt, Pseudomonas putida KT2440
cacgcucaugaacagcg

SEQ ID NO: 1576184 - RNA, 19 nt, Pseudomonas putida KT2440
cacgcucaugaacagcgcc

SEQ ID NO: 1576185 - RNA, 18 nt, Pseudomonas putida KT2440
cacgcucaugcugguuug

SEQ ID NO: 1576186 - RNA, 16 nt, Pseudomonas putida KT2440
cacgcugccaggaccg

SEQ ID NO: 1576187 - RNA, 14 nt, Pseudomonas putida KT2440
cacgcugcccaggu

SEQ ID NO: 1576188 - RNA, 16 nt, Pseudomonas putida KT2440
cacgcuuacagguagu

SEQ ID NO: 1576189 - RNA, 17 nt, Pseudomonas putida KT2440
cacggccgaguccuugc

SEQ ID NO: 1576190 - RNA, 16 nt, Pseudomonas putida KT2440
cacggccagccagcag

SEQ ID NO: 1576191 - RNA, 23 nt, Pseudomonas putida KT2440
cacggaucagccgcgggcgucgc

SEQ ID NO: 1576192 - RNA, 15 nt, Pseudomonas putida KT2440
cacggcaagccugac

SEQ ID NO: 1576193 - RNA, 19 nt, Pseudomonas putida KT2440
cacggcaaucggcaggccg

SEQ ID NO: 1576194 - RNA, 21 nt, Pseudomonas putida KT2440
cacggcaauucgccggcagca

SEQ ID NO: 1576195 - RNA, 20 nt, Pseudomonas putida KT2440
cacggcaauugccaccggcg

SEQ ID NO: 1576196 - RNA, 22 nt, Pseudomonas putida KT2440
cacggcagcaaucgccgccugg

SEQ ID NO: 1576197 - RNA, 13 nt, Pseudomonas putida KT2440
cacugggcgaagg

SEQ ID NO: 1576198 - RNA, 12 nt, Pseudomonas putida KT2440
cacuggccucuu

SEQ ID NO: 1576199 - RNA, 15 nt, Pseudomonas putida KT2440
cacugccugcacggc

SEQ ID NO: 1576200 - RNA, 17 nt, Pseudomonas putida KT2440
cacugccugcacggcaa

SEQ ID NO: 1576201 - RNA, 22 nt, Pseudomonas putida KT2440
cacugccuggccacuguugcag

SEQ ID NO: 1576202 - RNA, 19 nt, Pseudomonas putida KT2440
cacugccuggcucaggcgc

SEQ ID NO: 1576203 - RNA, 17 nt, Pseudomonas putida KT2440
cacucguccgggcgcca

SEQ ID NO: 1576204 - RNA, 14 nt, Pseudomonas putida KT2440
cacugaacagcgcc

SEQ ID NO: 1576205 - RNA, 16 nt, Pseudomonas putida KT2440
cacugacagcaugccc

SEQ ID NO: 1576206 - RNA, 15 nt, Pseudomonas putida KT2440
cacugacaaagccug

SEQ ID NO: 1576207 - RNA, 14 nt, Pseudomonas putida KT2440
cacguucugcagcc

SEQ ID NO: 1576208 - RNA, 22 nt, Pseudomonas putida KT2440
cacguuugggcggcgugaccag

SEQ ID NO: 1576209 - RNA, 22 nt, Pseudomonas putida KT2440
cacuaagaagcaaccgcugcau

SEQ ID NO: 1576210 - RNA, 20 nt, Pseudomonas putida KT2440
cacuaccgcaaaugcugcca

SEQ ID NO: 1576211 - RNA, 15 nt, Pseudomonas putida KT2440
cacuacccaggccaa

SEQ ID NO: 1576212 - RNA, 13 nt, Pseudomonas putida KT2440
cacucgcgcagca

SEQ ID NO: 1576213 - RNA, 13 nt, Pseudomonas putida KT2440
cacguccgaugcc

SEQ ID NO: 1576214 - RNA, 16 nt, Pseudomonas putida KT2440
cacguccggccagcaa

SEQ ID NO: 1576215 - RNA, 20 nt, Pseudomonas putida KT2440
cacguccacuaccuccagcc

SEQ ID NO: 1576216 - RNA, 22 nt, Pseudomonas putida KT2440
cacgucauaguuguggcaacga

SEQ ID NO: 1576217 - RNA, 14 nt, Pseudomonas putida KT2440
cacgucacgcacca

SEQ ID NO: 1576218 - RNA, 15 nt, Pseudomonas putida KT2440
cacgucacgcaccau

SEQ ID NO: 1576219 - RNA, 20 nt, Pseudomonas putida KT2440
cacguaguaauccggcaacu

SEQ ID NO: 1576220 - RNA, 23 nt, Pseudomonas putida KT2440
cacguagcgcccgucuggcugca

SEQ ID NO: 1576221 - RNA, 14 nt, Pseudomonas putida KT2440
cacgugcacggguu

SEQ ID NO: 1576222 - RNA, 13 nt, Pseudomonas putida KT2440
cacgugccuucac

SEQ ID NO: 1576223 - RNA, 17 nt, Pseudomonas putida KT2440
cacguuauccagcugca

SEQ ID NO: 1576224 - RNA, 17 nt, Pseudomonas putida KT2440
cacgucgcgcagggccu

SEQ ID NO: 1576225 - RNA, 17 nt, Pseudomonas putida KT2440
cacgucggcgucagccg

SEQ ID NO: 1576226 - RNA, 19 nt, Pseudomonas putida KT2440
cagagcauggccagccggc

SEQ ID NO: 1576227 - RNA, 13 nt, Pseudomonas putida KT2440
cagagcgccagca

SEQ ID NO: 1576228 - RNA, 16 nt, Pseudomonas putida KT2440
cagagcgccagcaagc

SEQ ID NO: 1576229 - RNA, 17 nt, Pseudomonas putida KT2440
cagacuucgaagugcca

SEQ ID NO: 1576230 - RNA, 21 nt, Pseudomonas putida KT2440
cagaccgccgaucgaagcagc

SEQ ID NO: 1576231 - RNA, 15 nt, Pseudomonas putida KT2440
cagaccugcuggcac

SEQ ID NO: 1576232 - RNA, 13 nt, Pseudomonas putida KT2440
cagaccuggaggu

SEQ ID NO: 1576233 - RNA, 20 nt, Pseudomonas putida KT2440
cagaccugauccaaauugcu

SEQ ID NO: 1576234 - RNA, 15 nt, Pseudomonas putida KT2440
cagacgcgcgcuggc

SEQ ID NO: 1576235 - RNA, 18 nt, Pseudomonas putida KT2440
cagacgcggaacuggcug

SEQ ID NO: 1576236 - RNA, 16 nt, Pseudomonas putida KT2440
cagaccagcagcagug

SEQ ID NO: 1576237 - RNA, 14 nt, Pseudomonas putida KT2440
cagaccaucaggua

SEQ ID NO: 1576238 - RNA, 22 nt, Pseudomonas putida KT2440
cagaaggaagauugaaggggca

SEQ ID NO: 1576239 - RNA, 19 nt, Pseudomonas putida KT2440
cagaagccuguacacagcc

SEQ ID NO: 1576240 - RNA, 20 nt, Pseudomonas putida KT2440
cagaagccuguacacagccc

SEQ ID NO: 1576241 - RNA, 14 nt, Pseudomonas putida KT2440
cagaccaccugcca

SEQ ID NO: 1576242 - RNA, 16 nt, Pseudomonas putida KT2440
cagaaucagcuugcca

SEQ ID NO: 1576243 - RNA, 20 nt, Pseudomonas putida KT2440
cacuuuugccaccacccggg

SEQ ID NO: 1576244 - RNA, 15 nt, Pseudomonas putida KT2440
cacugguacagcuca

SEQ ID NO: 1576245 - RNA, 16 nt, Pseudomonas putida KT2440
cacuguagcgcccuug

SEQ ID NO: 1576246 - RNA, 21 nt, Pseudomonas putida KT2440
cacuguaggcaaacagcucga

SEQ ID NO: 1576247 - RNA, 23 nt, Pseudomonas putida KT2440
cacuguugcagcgccaguuaccc

SEQ ID NO: 1576248 - RNA, 21 nt, Pseudomonas putida KT2440
cacuguggucgaauagcgcga

SEQ ID NO: 1576249 - RNA, 19 nt, Pseudomonas putida KT2440
cacuguucagauacgccug

SEQ ID NO: 1576250 - RNA, 13 nt, Pseudomonas putida KT2440
cacuguucaggug

SEQ ID NO: 1576251 - RNA, 19 nt, Pseudomonas putida KT2440
ccgaugaguugucugccga

SEQ ID NO: 1576252 - RNA, 16 nt, Pseudomonas putida KT2440
ccgaugccaagcaccg

SEQ ID NO: 1576253 - RNA, 15 nt, Pseudomonas putida KT2440
ccgaucuucgcccug

SEQ ID NO: 1576254 - RNA, 15 nt, Pseudomonas putida KT2440
ccgaucucgccagcc

SEQ ID NO: 1576255 - RNA, 20 nt, Pseudomonas putida KT2440
ccgaucucgccagccugcag

SEQ ID NO: 1576256 - RNA, 22 nt, Pseudomonas putida KT2440
ccgauggccuugaucaggcccu

SEQ ID NO: 1576257 - RNA, 14 nt, Pseudomonas putida KT2440
ccgaugcugugccg

SEQ ID NO: 1576258 - RNA, 21 nt, Pseudomonas putida KT2440
ccgauguuguggcuguucagg

SEQ ID NO: 1576259 - RNA, 17 nt, Pseudomonas putida KT2440
ccgauuacaagggccug

SEQ ID NO: 1576260 - RNA, 23 nt, Pseudomonas putida KT2440
ccgauuaucgagcuacagccccu

SEQ ID NO: 1576261 - RNA, 15 nt, Pseudomonas putida KT2440
ccgaugggcaggcca

SEQ ID NO: 1576262 - RNA, 13 nt, Pseudomonas putida KT2440
ccgaugggcgucg

SEQ ID NO: 1576263 - RNA, 16 nt, Pseudomonas putida KT2440
ccgaugggcgucgccu

SEQ ID NO: 1576264 - RNA, 19 nt, Pseudomonas putida KT2440
ccgaugggcgucgccugca

SEQ ID NO: 1576265 - RNA, 18 nt, Pseudomonas putida KT2440
ccgaugggcuguuccagc

SEQ ID NO: 1576266 - RNA, 15 nt, Pseudomonas putida KT2440
ccgaucggguacucc

SEQ ID NO: 1576267 - RNA, 17 nt, Pseudomonas putida KT2440
ccgaucaugaacaugcc

SEQ ID NO: 1576268 - RNA, 21 nt, Pseudomonas putida KT2440
ccgaucaugaacaugcccauu

SEQ ID NO: 1576269 - RNA, 20 nt, Pseudomonas putida KT2440
ccgauccuuggcgaaggcug

SEQ ID NO: 1576270 - RNA, 18 nt, Pseudomonas putida KT2440
ccgaucgaagcagcagcu

SEQ ID NO: 1576271 - RNA, 20 nt, Pseudomonas putida KT2440
ccgaucagcacgccgccgau

SEQ ID NO: 1576272 - RNA, 19 nt, Pseudomonas putida KT2440
ccgaucacuuccuggccgc

SEQ ID NO: 1576273 - RNA, 18 nt, Pseudomonas putida KT2440
ccgaucaccugggcgauc

SEQ ID NO: 1576274 - RNA, 19 nt, Pseudomonas putida KT2440
ccgaucaccugggcgauca

SEQ ID NO: 1576275 - RNA, 13 nt, Pseudomonas putida KT2440
ccgaucaggugca

SEQ ID NO: 1576276 - RNA, 19 nt, Pseudomonas putida KT2440
ccgaucagguugcccagca

SEQ ID NO: 1576277 - RNA, 22 nt, Pseudomonas putida KT2440
ccgaucagcuuaacgcuuggcc

SEQ ID NO: 1576278 - RNA, 22 nt, Pseudomonas putida KT2440
ccgaucaggaagccccgcgcgu

SEQ ID NO: 1576279 - RNA, 18 nt, Pseudomonas putida KT2440
ccgaucacggggcgacgc

SEQ ID NO: 1576280 - RNA, 20 nt, Pseudomonas putida KT2440
ccgauacagcgcgccgccga

SEQ ID NO: 1576281 - RNA, 18 nt, Pseudomonas putida KT2440
ccgagucgguggcgaagg

SEQ ID NO: 1576282 - RNA, 15 nt, Pseudomonas putida KT2440
ccgaggaacggcugg

SEQ ID NO: 1576283 - RNA, 12 nt, Pseudomonas putida KT2440
ccgagccuuccg

SEQ ID NO: 1576284 - RNA, 20 nt, Pseudomonas putida KT2440
ccgagcggucgcagguucga

SEQ ID NO: 1576285 - RNA, 19 nt, Pseudomonas putida KT2440
ccgagccauugacccgcuu

SEQ ID NO: 1576286 - RNA, 19 nt, Pseudomonas putida KT2440
ccgagccaagcgacgugca

SEQ ID NO: 1576287 - RNA, 19 nt, Pseudomonas putida KT2440
ccgaaaucagcaacgccac

SEQ ID NO: 1576288 - RNA, 13 nt, Pseudomonas putida KT2440
ccgaacagcaggc

SEQ ID NO: 1576289 - RNA, 16 nt, Pseudomonas putida KT2440
ccgaacaccgccagcc

SEQ ID NO: 1576290 - RNA, 23 nt, Pseudomonas putida KT2440
ccgaacagcaccgccauggccag

SEQ ID NO: 1576291 - RNA, 16 nt, Pseudomonas putida KT2440
ccgcaccucacaacgc

SEQ ID NO: 1576292 - RNA, 20 nt, Pseudomonas putida KT2440
ccgcaccgcggaugcgccug

SEQ ID NO: 1576293 - RNA, 15 nt, Pseudomonas putida KT2440
ccgcacccgcaagcg

SEQ ID NO: 1576294 - RNA, 14 nt, Pseudomonas putida KT2440
ccgcacucagguga

SEQ ID NO: 1576295 - RNA, 21 nt, Pseudomonas putida KT2440
ccgcacuccccaucagcagcu

SEQ ID NO: 1576296 - RNA, 19 nt, Pseudomonas putida KT2440
ccgcacuuguugcgcaggu

SEQ ID NO: 1576297 - RNA, 20 nt, Pseudomonas putida KT2440
ccgcacguuauccacagcgu

SEQ ID NO: 1576298 - RNA, 14 nt, Pseudomonas putida KT2440
ccgcagcccagcgc

SEQ ID NO: 1576299 - RNA, 15 nt, Pseudomonas putida KT2440
ccgcagcccagcgcc

SEQ ID NO: 1576300 - RNA, 16 nt, Pseudomonas putida KT2440
ccgcagcccagcgccg

SEQ ID NO: 1576301 - RNA, 21 nt, Pseudomonas putida KT2440
ccgcagccccaccucggcgau

SEQ ID NO: 1576302 - RNA, 13 nt, Pseudomonas putida KT2440
ccgcacaggcugg

SEQ ID NO: 1576303 - RNA, 16 nt, Pseudomonas putida KT2440
ccgcacaggcuggcca

SEQ ID NO: 1576304 - RNA, 14 nt, Pseudomonas putida KT2440
ccgcacaucacggc

SEQ ID NO: 1576305 - RNA, 16 nt, Pseudomonas putida KT2440
ccgcacaucacggcgc

SEQ ID NO: 1576306 - RNA, 17 nt, Pseudomonas putida KT2440
ccgcacaucacggcgca

SEQ ID NO: 1576307 - RNA, 16 nt, Pseudomonas putida KT2440
ccgcacaggcauaccg

SEQ ID NO: 1576308 - RNA, 21 nt, Pseudomonas putida KT2440
ccgcacaggcauaccgcaaca

SEQ ID NO: 1576309 - RNA, 20 nt, Pseudomonas putida KT2440
ccgcacacagcccaaagggc

SEQ ID NO: 1576310 - RNA, 13 nt, Pseudomonas putida KT2440
ccgcacaaggccg

SEQ ID NO: 1576311 - RNA, 17 nt, Pseudomonas putida KT2440
ccgcaccagaccagcag

SEQ ID NO: 1576312 - RNA, 21 nt, Pseudomonas putida KT2440
ccgcaccagaccagcagcagu

SEQ ID NO: 1576313 - RNA, 15 nt, Pseudomonas putida KT2440
ccgcacccaggccac

SEQ ID NO: 1576314 - RNA, 16 nt, Pseudomonas putida KT2440
ccgcacccaggccacg

SEQ ID NO: 1576315 - RNA, 16 nt, Pseudomonas putida KT2440
ccgcaagcugcaccgc

SEQ ID NO: 1576316 - RNA, 23 nt, Pseudomonas putida KT2440
ccgcaagcagucccagcaccgcg

SEQ ID NO: 1576317 - RNA, 17 nt, Pseudomonas putida KT2440
ccgcaagccagccuccg

SEQ ID NO: 1576318 - RNA, 15 nt, Pseudomonas putida KT2440
ccgcaagcccgcguu

SEQ ID NO: 1576319 - RNA, 13 nt, Pseudomonas putida KT2440
ccgcaaggccgcu

SEQ ID NO: 1576320 - RNA, 22 nt, Pseudomonas putida KT2440
ccgcaaccgaugaacccgcgau

SEQ ID NO: 1576321 - RNA, 14 nt, Pseudomonas putida KT2440
ccgcaaccugggca

SEQ ID NO: 1576322 - RNA, 17 nt, Pseudomonas putida KT2440
ccgcaacaugaagccau

SEQ ID NO: 1576323 - RNA, 19 nt, Pseudomonas putida KT2440
ccgcaacaugaagccaugg

SEQ ID NO: 1576324 - RNA, 17 nt, Pseudomonas putida KT2440
ccgcaacauaaggugca

SEQ ID NO: 1576325 - RNA, 23 nt, Pseudomonas putida KT2440
ccgcaacauaaggugcaaagcgc

SEQ ID NO: 1576326 - RNA, 15 nt, Pseudomonas putida KT2440
ccgcaaauucucgag

SEQ ID NO: 1576327 - RNA, 15 nt, Pseudomonas putida KT2440
ccgcaacaccugccg

SEQ ID NO: 1576328 - RNA, 18 nt, Pseudomonas putida KT2440
ccgcaacaccugccgcag

SEQ ID NO: 1576329 - RNA, 13 nt, Pseudomonas putida KT2440
ccgcaacggccga

SEQ ID NO: 1576330 - RNA, 23 nt, Pseudomonas putida KT2440
ccgccauugaggaaguagaacac

SEQ ID NO: 1576331 - RNA, 17 nt, Pseudomonas putida KT2440
ccgccauugcaccacgc

SEQ ID NO: 1576332 - RNA, 18 nt, Pseudomonas putida KT2440
ccgccauguugcgcagca

SEQ ID NO: 1576333 - RNA, 14 nt, Pseudomonas putida KT2440
ccgccagccaacgc

SEQ ID NO: 1576334 - RNA, 19 nt, Pseudomonas putida KT2440
ccgcccccucggcgccaua

SEQ ID NO: 1576335 - RNA, 22 nt, Pseudomonas putida KT2440
ccgcccgaacgggcucaccugg

SEQ ID NO: 1576336 - RNA, 16 nt, Pseudomonas putida KT2440
ccgccccaaaccaggc

SEQ ID NO: 1576337 - RNA, 15 nt, Pseudomonas putida KT2440
ccgccccacucgcgc

SEQ ID NO: 1576338 - RNA, 16 nt, Pseudomonas putida KT2440
ccgccccauagccugc

SEQ ID NO: 1576339 - RNA, 19 nt, Pseudomonas putida KT2440
ccgccccagcgcgccagca

SEQ ID NO: 1576340 - RNA, 22 nt, Pseudomonas putida KT2440
ccgcccaucaccggcaccggga

SEQ ID NO: 1576341 - RNA, 22 nt, Pseudomonas putida KT2440
ccgcccacuucugcggccaggg

SEQ ID NO: 1576342 - RNA, 15 nt, Pseudomonas putida KT2440
ccgcccagcuggcuc

SEQ ID NO: 1576343 - RNA, 15 nt, Pseudomonas putida KT2440
ccgcccacgccggca

SEQ ID NO: 1576344 - RNA, 15 nt, Pseudomonas putida KT2440
ccgccaugcaacugc

SEQ ID NO: 1576345 - RNA, 20 nt, Pseudomonas putida KT2440
ccgcccaauuuggccagcuu

SEQ ID NO: 1576346 - RNA, 15 nt, Pseudomonas putida KT2440
ccgcccaagcggcag

SEQ ID NO: 1576347 - RNA, 13 nt, Pseudomonas putida KT2440
ccgccagcaggcc

SEQ ID NO: 1576348 - RNA, 15 nt, Pseudomonas putida KT2440
ccgccagcaggccac

SEQ ID NO: 1576349 - RNA, 15 nt, Pseudomonas putida KT2440
ccgccagcagcuggu

SEQ ID NO: 1576350 - RNA, 16 nt, Pseudomonas putida KT2440
ccgccagcaucacgcc

SEQ ID NO: 1576351 - RNA, 19 nt, Pseudomonas putida KT2440
ccgccagcauggccggaua

SEQ ID NO: 1576352 - RNA, 15 nt, Pseudomonas putida KT2440
ccgccagcaguucga

SEQ ID NO: 1576353 - RNA, 16 nt, Pseudomonas putida KT2440
ccgccaauugcgccag

SEQ ID NO: 1576354 - RNA, 15 nt, Pseudomonas putida KT2440
ccgccaaggcgaugc

SEQ ID NO: 1576355 - RNA, 22 nt, Pseudomonas putida KT2440
ccgccaagggucgacaccagga

SEQ ID NO: 1576356 - RNA, 14 nt, Pseudomonas putida KT2440
ccgccacaaacgcc

SEQ ID NO: 1576357 - RNA, 13 nt, Pseudomonas putida KT2440
ccgccaagcggcc

SEQ ID NO: 1576358 - RNA, 15 nt, Pseudomonas putida KT2440
ccgccaauacccacg

SEQ ID NO: 1576359 - RNA, 19 nt, Pseudomonas putida KT2440
ccgccaauacccacgucga

SEQ ID NO: 1576360 - RNA, 18 nt, Pseudomonas putida KT2440
ccgcaucguuauccagca

SEQ ID NO: 1576361 - RNA, 15 nt, Pseudomonas putida KT2440
ccgccaacgaaucag

SEQ ID NO: 1576362 - RNA, 13 nt, Pseudomonas putida KT2440
ccgccaacagcgc

SEQ ID NO: 1576363 - RNA, 19 nt, Pseudomonas putida KT2440
ccgccaacaacaagcgcug

SEQ ID NO: 1576364 - RNA, 21 nt, Pseudomonas putida KT2440
ccgcauucgcgcccgcagugc

SEQ ID NO: 1576365 - RNA, 12 nt, Pseudomonas putida KT2440
ccgccggcaacu

SEQ ID NO: 1576366 - RNA, 15 nt, Pseudomonas putida KT2440
ccgccgcuggcggcg

SEQ ID NO: 1576367 - RNA, 14 nt, Pseudomonas putida KT2440
ccgccgcugccagc

SEQ ID NO: 1576368 - RNA, 16 nt, Pseudomonas putida KT2440
ccgccguucaggcgcc

SEQ ID NO: 1576369 - RNA, 20 nt, Pseudomonas putida KT2440
ccgccguucaggcgccugcc

SEQ ID NO: 1576370 - RNA, 17 nt, Pseudomonas putida KT2440
ccgccguguucccagca

SEQ ID NO: 1576371 - RNA, 16 nt, Pseudomonas putida KT2440
ccgccgugccggucac

SEQ ID NO: 1576372 - RNA, 20 nt, Pseudomonas putida KT2440
ccgccgugccggucacuggc

SEQ ID NO: 1576373 - RNA, 22 nt, Pseudomonas putida KT2440
ccgccgugccggucacuggcaa

SEQ ID NO: 1576374 - RNA, 23 nt, Pseudomonas putida KT2440
ccgccucggcuacgccgccgcug

SEQ ID NO: 1576375 - RNA, 20 nt, Pseudomonas putida KT2440
ccgccucgaucgucgacaac

SEQ ID NO: 1576376 - RNA, 16 nt, Pseudomonas putida KT2440
ccgccucguugcgaag

SEQ ID NO: 1576377 - RNA, 20 nt, Pseudomonas putida KT2440
ccgcgaauacgagggugaac

SEQ ID NO: 1576378 - RNA, 21 nt, Pseudomonas putida KT2440
ccgcgaauacgagggugaacc

SEQ ID NO: 1576379 - RNA, 23 nt, Pseudomonas putida KT2440
ccgcgaauacgguagcggcggca

SEQ ID NO: 1576380 - RNA, 20 nt, Pseudomonas putida KT2440
ccgcgaauacgguggcggca

SEQ ID NO: 1576381 - RNA, 13 nt, Pseudomonas putida KT2440
ccgccugccgccu

SEQ ID NO: 1576382 - RNA, 15 nt, Pseudomonas putida KT2440
ccgccugccgccugu

SEQ ID NO: 1576383 - RNA, 18 nt, Pseudomonas putida KT2440
ccgcgaaugaucaugucc

SEQ ID NO: 1576384 - RNA, 20 nt, Pseudomonas putida KT2440
ccgcgaaugcuccggcgaca

SEQ ID NO: 1576385 - RNA, 22 nt, Pseudomonas putida KT2440
ccgcgaaugcuccggcgacagc

SEQ ID NO: 1576386 - RNA, 23 nt, Pseudomonas putida KT2440
ccgcgaaugcuccggcgacagcu

SEQ ID NO: 1576387 - RNA, 15 nt, Pseudomonas putida KT2440
ccgcgaaugggcugc

SEQ ID NO: 1576388 - RNA, 14 nt, Pseudomonas putida KT2440
ccgcgaauggguca

SEQ ID NO: 1576389 - RNA, 20 nt, Pseudomonas putida KT2440
ccgcgacgaugaucagguug

SEQ ID NO: 1576390 - RNA, 17 nt, Pseudomonas putida KT2440
ccgcgacgcggcccugg

SEQ ID NO: 1576391 - RNA, 16 nt, Pseudomonas putida KT2440
ccgcgccggguuaccc

SEQ ID NO: 1576392 - RNA, 15 nt, Pseudomonas putida KT2440
ccgcgccgccgacga

SEQ ID NO: 1576393 - RNA, 21 nt, Pseudomonas putida KT2440
ccgcgcaugaucagcugccac

SEQ ID NO: 1576394 - RNA, 22 nt, Pseudomonas putida KT2440
ccgcgcaugaugaaguggcgca

SEQ ID NO: 1576395 - RNA, 22 nt, Pseudomonas putida KT2440
ccgcgcauuugcuccagggcau

SEQ ID NO: 1576396 - RNA, 18 nt, Pseudomonas putida KT2440
ccgcgauggauggcaccg

SEQ ID NO: 1576397 - RNA, 12 nt, Pseudomonas putida KT2440
ccgcggcucacc

SEQ ID NO: 1576398 - RNA, 22 nt, Pseudomonas putida KT2440
ccgcggcucacccaccagccaa

SEQ ID NO: 1576399 - RNA, 15 nt, Pseudomonas putida KT2440
ccgcgcuuggcggcc

SEQ ID NO: 1576400 - RNA, 16 nt, Pseudomonas putida KT2440
ccgcggcacccaauag

SEQ ID NO: 1576401 - RNA, 16 nt, Pseudomonas putida KT2440
ccgcggaugcgccugg

SEQ ID NO: 1576402 - RNA, 18 nt, Pseudomonas putida KT2440
ccgcgugagauguucacc

SEQ ID NO: 1576403 - RNA, 20 nt, Pseudomonas putida KT2440
ccgcgugcgauguugaucag

SEQ ID NO: 1576404 - RNA, 15 nt, Pseudomonas putida KT2440
ccgcgugugcucgag

SEQ ID NO: 1576405 - RNA, 16 nt, Pseudomonas putida KT2440
ccgcgguaaugcgcac

SEQ ID NO: 1576406 - RNA, 14 nt, Pseudomonas putida KT2440
ccgcucaccggcca

SEQ ID NO: 1576407 - RNA, 12 nt, Pseudomonas putida KT2440
ccgcuccagcuc

SEQ ID NO: 1576408 - RNA, 14 nt, Pseudomonas putida KT2440
ccgcucccacaggc

SEQ ID NO: 1576409 - RNA, 20 nt, Pseudomonas putida KT2440
ccgcucccacagggaccgca

SEQ ID NO: 1576410 - RNA, 18 nt, Pseudomonas putida KT2440
ccgcucccacagguaaua

SEQ ID NO: 1576411 - RNA, 17 nt, Pseudomonas putida KT2440
ccgcucccacagguaug

SEQ ID NO: 1576412 - RNA, 22 nt, Pseudomonas putida KT2440
ccgcucccacagguuugcugag

SEQ ID NO: 1576413 - RNA, 15 nt, Pseudomonas putida KT2440
ccgcucccacgagga

SEQ ID NO: 1576414 - RNA, 13 nt, Pseudomonas putida KT2440
ccgcuauggcgac

SEQ ID NO: 1576415 - RNA, 15 nt, Pseudomonas putida KT2440
ccgcucaagucugca

SEQ ID NO: 1576416 - RNA, 12 nt, Pseudomonas putida KT2440
ccgcucugcgcc

SEQ ID NO: 1576417 - RNA, 15 nt, Pseudomonas putida KT2440
ccgcucugcgccacg

SEQ ID NO: 1576418 - RNA, 14 nt, Pseudomonas putida KT2440
ccgcucucacaggg

SEQ ID NO: 1576419 - RNA, 17 nt, Pseudomonas putida KT2440
ccgcugcgcgguaaacg

SEQ ID NO: 1576420 - RNA, 20 nt, Pseudomonas putida KT2440
ccgcugcgccugccgggcca

SEQ ID NO: 1576421 - RNA, 17 nt, Pseudomonas putida KT2440
ccgcugcgaggaucagc

SEQ ID NO: 1576422 - RNA, 19 nt, Pseudomonas putida KT2440
ccgcuggcgaugagguaga

SEQ ID NO: 1576423 - RNA, 15 nt, Pseudomonas putida KT2440
ccgcuggcgaucagg

SEQ ID NO: 1576424 - RNA, 22 nt, Pseudomonas putida KT2440
ccgcuggcgaucaggcaggcca

SEQ ID NO: 1576425 - RNA, 18 nt, Pseudomonas putida KT2440
ccgcuggcgccugcggca

SEQ ID NO: 1576426 - RNA, 18 nt, Pseudomonas putida KT2440
ccgcuggcccuucgcgga

SEQ ID NO: 1576427 - RNA, 16 nt, Pseudomonas putida KT2440
ccgcuguacaccagga

SEQ ID NO: 1576428 - RNA, 14 nt, Pseudomonas putida KT2440
ccgcuucgccagcg

SEQ ID NO: 1576429 - RNA, 17 nt, Pseudomonas putida KT2440
ccgcuucgccagcgcca

SEQ ID NO: 1576430 - RNA, 19 nt, Pseudomonas putida KT2440
ccgcuucgccagcgccacc

SEQ ID NO: 1576431 - RNA, 18 nt, Pseudomonas putida KT2440
ccgcuucguccagguagu

SEQ ID NO: 1576432 - RNA, 23 nt, Pseudomonas putida KT2440
ccgcuucguccagguaguacggc

SEQ ID NO: 1576433 - RNA, 13 nt, Pseudomonas putida KT2440
ccgcuucgcgacc

SEQ ID NO: 1576434 - RNA, 21 nt, Pseudomonas putida KT2440
ccgcuucacccucgcgcagca

SEQ ID NO: 1576435 - RNA, 23 nt, Pseudomonas putida KT2440
ccgcuguucugcccggcuggaug

SEQ ID NO: 1576436 - RNA, 16 nt, Pseudomonas putida KT2440
ccgcuguugagcagca

SEQ ID NO: 1576437 - RNA, 17 nt, Pseudomonas putida KT2440
ccggcguguugccgcug

SEQ ID NO: 1576438 - RNA, 13 nt, Pseudomonas putida KT2440
ccggcguggcgag

SEQ ID NO: 1576439 - RNA, 16 nt, Pseudomonas putida KT2440
ccggcguggcgagcug

SEQ ID NO: 1576440 - RNA, 23 nt, Pseudomonas putida KT2440
ccggcgucggcgcgcaacagcaa

SEQ ID NO: 1576441 - RNA, 21 nt, Pseudomonas putida KT2440
ccggcgucccggccagcgacc

SEQ ID NO: 1576442 - RNA, 16 nt, Pseudomonas putida KT2440
ccggcguuucuucgag

SEQ ID NO: 1576443 - RNA, 21 nt, Pseudomonas putida KT2440
ccggcuccacaccccaagcca

SEQ ID NO: 1576444 - RNA, 16 nt, Pseudomonas putida KT2440
ccggcucaucaggcga

SEQ ID NO: 1576445 - RNA, 17 nt, Pseudomonas putida KT2440
ccggcucaucaggcgau

SEQ ID NO: 1576446 - RNA, 22 nt, Pseudomonas putida KT2440
ccggcuccaccugcuccagcac

SEQ ID NO: 1576447 - RNA, 21 nt, Pseudomonas putida KT2440
ccggcugcagcuugaggccca

SEQ ID NO: 1576448 - RNA, 14 nt, Pseudomonas putida KT2440
ccggcggccaucgc

SEQ ID NO: 1576449 - RNA, 20 nt, Pseudomonas putida KT2440
ccggggcagcaucaccacgc

SEQ ID NO: 1576450 - RNA, 20 nt, Pseudomonas putida KT2440
ccggggcaccuugaagugcg

SEQ ID NO: 1576451 - RNA, 17 nt, Pseudomonas putida KT2440
ccgggcgcaggcagcac

SEQ ID NO: 1576452 - RNA, 17 nt, Pseudomonas putida KT2440
ccgggccuuucaccgcu

SEQ ID NO: 1576453 - RNA, 19 nt, Pseudomonas putida KT2440
ccgggccuuucaccgcuuc

SEQ ID NO: 1576454 - RNA, 21 nt, Pseudomonas putida KT2440
ccgggccuucaaccucacugg

SEQ ID NO: 1576455 - RNA, 17 nt, Pseudomonas putida KT2440
ccgggccuugaccagca

SEQ ID NO: 1576456 - RNA, 15 nt, Pseudomonas putida KT2440
ccgggcugcaaagcg

SEQ ID NO: 1576457 - RNA, 21 nt, Pseudomonas putida KT2440
ccgggcugcaaagcgggcaac

SEQ ID NO: 1576458 - RNA, 22 nt, Pseudomonas putida KT2440
ccgggcagcgggcucgcccaca

SEQ ID NO: 1576459 - RNA, 21 nt, Pseudomonas putida KT2440
ccgggaucgagaucaggugga

SEQ ID NO: 1576460 - RNA, 15 nt, Pseudomonas putida KT2440
ccgggagggcuuugc

SEQ ID NO: 1576461 - RNA, 16 nt, Pseudomonas putida KT2440
ccgggauacugcgcac

SEQ ID NO: 1576462 - RNA, 14 nt, Pseudomonas putida KT2440
ccggcauucccggc

SEQ ID NO: 1576463 - RNA, 23 nt, Pseudomonas putida KT2440
ccggcaugaacacauacccggcc

SEQ ID NO: 1576464 - RNA, 17 nt, Pseudomonas putida KT2440
ccggaaacucacgcgcc

SEQ ID NO: 1576465 - RNA, 20 nt, Pseudomonas putida KT2440
ccgcuuucggucagggcgau

SEQ ID NO: 1576466 - RNA, 20 nt, Pseudomonas putida KT2440
ccgcuugcgcggucgaugca

SEQ ID NO: 1576467 - RNA, 22 nt, Pseudomonas putida KT2440
ccgcuugaucuuguccuggauc

SEQ ID NO: 1576468 - RNA, 18 nt, Pseudomonas putida KT2440
ccgcuugcacagguaucg

SEQ ID NO: 1576469 - RNA, 15 nt, Pseudomonas putida KT2440
ccggccaaggucagc

SEQ ID NO: 1576470 - RNA, 20 nt, Pseudomonas putida KT2440
ccggccaaucgaucugcucg

SEQ ID NO: 1576471 - RNA, 13 nt, Pseudomonas putida KT2440
ccggccagcaggu

SEQ ID NO: 1576472 - RNA, 19 nt, Pseudomonas putida KT2440
ccggccagcaggucagcac

SEQ ID NO: 1576473 - RNA, 14 nt, Pseudomonas putida KT2440
ccggccagcaggac

SEQ ID NO: 1576474 - RNA, 17 nt, Pseudomonas putida KT2440
ccggccuauucgcgggu

SEQ ID NO: 1576475 - RNA, 12 nt, Pseudomonas putida KT2440
ccggccgcucca

SEQ ID NO: 1576476 - RNA, 15 nt, Pseudomonas putida KT2440
ccggccgcuccagcu

SEQ ID NO: 1576477 - RNA, 18 nt, Pseudomonas putida KT2440
ccggccaggugccgggcu

SEQ ID NO: 1576478 - RNA, 15 nt, Pseudomonas putida KT2440
ccggccagugccuug

SEQ ID NO: 1576479 - RNA, 13 nt, Pseudomonas putida KT2440
ccggccagcgccu

SEQ ID NO: 1576480 - RNA, 13 nt, Pseudomonas putida KT2440
ccggccccggcaa

SEQ ID NO: 1576481 - RNA, 19 nt, Pseudomonas putida KT2440
ccggcccuucugcugcucg

SEQ ID NO: 1576482 - RNA, 17 nt, Pseudomonas putida KT2440
ccggcgccgccaggcag

SEQ ID NO: 1576483 - RNA, 19 nt, Pseudomonas putida KT2440
ccggcgaacagcacugcca

SEQ ID NO: 1576484 - RNA, 16 nt, Pseudomonas putida KT2440
ccggccuuggccagcu

SEQ ID NO: 1576485 - RNA, 14 nt, Pseudomonas putida KT2440
ccggcgaagcacug

SEQ ID NO: 1576486 - RNA, 23 nt, Pseudomonas putida KT2440
ccggcgccaaucaucgccagcag

SEQ ID NO: 1576487 - RNA, 18 nt, Pseudomonas putida KT2440
ccggcgcagaugguggca

SEQ ID NO: 1576488 - RNA, 21 nt, Pseudomonas putida KT2440
ccggcgcacgcaugcgcgaca

SEQ ID NO: 1576489 - RNA, 18 nt, Pseudomonas putida KT2440
ccggcgcuucggcacgcg

SEQ ID NO: 1576490 - RNA, 22 nt, Pseudomonas putida KT2440
ccggcgcugcguuggccaucug

SEQ ID NO: 1576491 - RNA, 13 nt, Pseudomonas putida KT2440
ccggcgcuggaca

SEQ ID NO: 1576492 - RNA, 14 nt, Pseudomonas putida KT2440
ccggcgcugaucag

SEQ ID NO: 1576493 - RNA, 23 nt, Pseudomonas putida KT2440
ccggcggauagccccgcccagca

SEQ ID NO: 1576494 - RNA, 13 nt, Pseudomonas putida KT2440
ccggcgcgcagcg

SEQ ID NO: 1576495 - RNA, 18 nt, Pseudomonas putida KT2440
ccggcgcgcagcgcacuu

SEQ ID NO: 1576496 - RNA, 17 nt, Pseudomonas putida KT2440
ccggcgcggccugcucc

SEQ ID NO: 1576497 - RNA, 12 nt, Pseudomonas putida KT2440
ccgguggccuug

SEQ ID NO: 1576498 - RNA, 19 nt, Pseudomonas putida KT2440
ccggugccauccaccgcgc

SEQ ID NO: 1576499 - RNA, 15 nt, Pseudomonas putida KT2440
ccggugcccuugccg

SEQ ID NO: 1576500 - RNA, 18 nt, Pseudomonas putida KT2440
ccgguucagucgguaugc

SEQ ID NO: 1576501 - RNA, 18 nt, Pseudomonas putida KT2440
ccgguucgcgagaaccgg

SEQ ID NO: 1576502 - RNA, 18 nt, Pseudomonas putida KT2440
ccgguuggucgaagccga

SEQ ID NO: 1576503 - RNA, 21 nt, Pseudomonas putida KT2440
ccgguuucucgcagcagcacc

SEQ ID NO: 1576504 - RNA, 17 nt, Pseudomonas putida KT2440
ccgguuuguccuggccg

SEQ ID NO: 1576505 - RNA, 19 nt, Pseudomonas putida KT2440
ccggugcaagccaauggua

SEQ ID NO: 1576506 - RNA, 19 nt, Pseudomonas putida KT2440
ccggucuugucugacagca

SEQ ID NO: 1576507 - RNA, 22 nt, Pseudomonas putida KT2440
ccggucuugucugacagcagga

SEQ ID NO: 1576508 - RNA, 23 nt, Pseudomonas putida KT2440
ccggucuugucugacagcaggaa

SEQ ID NO: 1576509 - RNA, 20 nt, Pseudomonas putida KT2440
ccggucguuacccaccagcu

SEQ ID NO: 1576510 - RNA, 19 nt, Pseudomonas putida KT2440
ccggggugucugggcacuu

SEQ ID NO: 1576511 - RNA, 22 nt, Pseudomonas putida KT2440
ccggggcuuuuugauggugcag

SEQ ID NO: 1576512 - RNA, 13 nt, Pseudomonas putida KT2440
ccggguaggcccc

SEQ ID NO: 1576513 - RNA, 16 nt, Pseudomonas putida KT2440
ccgggucaaggccagc

SEQ ID NO: 1576514 - RNA, 23 nt, Pseudomonas putida KT2440
ccggguaaucgccaggcccagcc

SEQ ID NO: 1576515 - RNA, 15 nt, Pseudomonas putida KT2440
ccggguacagccccu

SEQ ID NO: 1576516 - RNA, 20 nt, Pseudomonas putida KT2440
ccggguacagccccugcauc

SEQ ID NO: 1576517 - RNA, 16 nt, Pseudomonas putida KT2440
ccggucgccgacggca

SEQ ID NO: 1576518 - RNA, 21 nt, Pseudomonas putida KT2440
ccggucgccgacggcauggcc

SEQ ID NO: 1576519 - RNA, 14 nt, Pseudomonas putida KT2440
ccgucggcgucaac

SEQ ID NO: 1576520 - RNA, 20 nt, Pseudomonas putida KT2440
ccgugacgaaggcgguaugg

SEQ ID NO: 1576521 - RNA, 17 nt, Pseudomonas putida KT2440
ccgugacuaguggccac

SEQ ID NO: 1576522 - RNA, 22 nt, Pseudomonas putida KT2440
ccgugaaaccgaaaaagccuac

SEQ ID NO: 1576523 - RNA, 15 nt, Pseudomonas putida KT2440
ccgugaagaggccag

SEQ ID NO: 1576524 - RNA, 15 nt, Pseudomonas putida KT2440
ccgugcccaccagcg

SEQ ID NO: 1576525 - RNA, 17 nt, Pseudomonas putida KT2440
ccgugcagggcgccgau

SEQ ID NO: 1576526 - RNA, 17 nt, Pseudomonas putida KT2440
ccgugcauacacccggu

SEQ ID NO: 1576527 - RNA, 18 nt, Pseudomonas putida KT2440
ccgucgggcacgaucagc

SEQ ID NO: 1576528 - RNA, 21 nt, Pseudomonas putida KT2440
ccgucgggcacgaucagcagc

SEQ ID NO: 1576529 - RNA, 20 nt, Pseudomonas putida KT2440
ccgucguaggagcggguuua

SEQ ID NO: 1576530 - RNA, 23 nt, Pseudomonas putida KT2440
ccgucgaaugcgacugaggcacc

SEQ ID NO: 1576531 - RNA, 17 nt, Pseudomonas putida KT2440
ccguccccaaccggguu

SEQ ID NO: 1576532 - RNA, 19 nt, Pseudomonas putida KT2440
ccguccccaaccggguuug

SEQ ID NO: 1576533 - RNA, 23 nt, Pseudomonas putida KT2440
ccguccagguagcgcucgacauc

SEQ ID NO: 1576534 - RNA, 18 nt, Pseudomonas putida KT2440
ccguccagguccaggcca

SEQ ID NO: 1576535 - RNA, 14 nt, Pseudomonas putida KT2440
ccgucaggcucagc

SEQ ID NO: 1576536 - RNA, 15 nt, Pseudomonas putida KT2440
ccgucaggcaaacca

SEQ ID NO: 1576537 - RNA, 21 nt, Pseudomonas putida KT2440
ccgucagcggcaacaccagca

SEQ ID NO: 1576538 - RNA, 20 nt, Pseudomonas putida KT2440
ccguacuugcugcagggcac

SEQ ID NO: 1576539 - RNA, 17 nt, Pseudomonas putida KT2440
ccgucagugcucggcaa

SEQ ID NO: 1576540 - RNA, 21 nt, Pseudomonas putida KT2440
ccguaccuucggcgacaggug

SEQ ID NO: 1576541 - RNA, 17 nt, Pseudomonas putida KT2440
ccguacgguagccccag

SEQ ID NO: 1576542 - RNA, 18 nt, Pseudomonas putida KT2440
ccguacggcccaugucga

SEQ ID NO: 1576543 - RNA, 23 nt, Pseudomonas putida KT2440
ccguacggcccaugucgaucagc

SEQ ID NO: 1576544 - RNA, 14 nt, Pseudomonas putida KT2440
ccguacccagguga

SEQ ID NO: 1576545 - RNA, 22 nt, Pseudomonas putida KT2440
ccucggaaaugaagacggugag

SEQ ID NO: 1576546 - RNA, 12 nt, Pseudomonas putida KT2440
ccucgcugccca

SEQ ID NO: 1576547 - RNA, 14 nt, Pseudomonas putida KT2440
ccucgcucagcuug

SEQ ID NO: 1576548 - RNA, 22 nt, Pseudomonas putida KT2440
ccucggcgaucagcuucaacug

SEQ ID NO: 1576549 - RNA, 15 nt, Pseudomonas putida KT2440
ccucggcgaucgcca

SEQ ID NO: 1576550 - RNA, 21 nt, Pseudomonas putida KT2440
ccucgguaaaggugcccugcu

SEQ ID NO: 1576551 - RNA, 22 nt, Pseudomonas putida KT2440
ccucgacgaccaguucgacgcu

SEQ ID NO: 1576552 - RNA, 14 nt, Pseudomonas putida KT2440
ccucgaccaggcgc

SEQ ID NO: 1576553 - RNA, 12 nt, Pseudomonas putida KT2440
ccucgacccagc

SEQ ID NO: 1576554 - RNA, 20 nt, Pseudomonas putida KT2440
ccucgacccagccacccggc

SEQ ID NO: 1576555 - RNA, 15 nt, Pseudomonas putida KT2440
ccucgagugcgcuga

SEQ ID NO: 1576556 - RNA, 16 nt, Pseudomonas putida KT2440
ccucgagugcgcugau

SEQ ID NO: 1576557 - RNA, 17 nt, Pseudomonas putida KT2440
ccucgagugcgcugauc

SEQ ID NO: 1576558 - RNA, 23 nt, Pseudomonas putida KT2440
ccucgcccaccagcugcaccacc

SEQ ID NO: 1576559 - RNA, 17 nt, Pseudomonas putida KT2440
ccucacacugguaacuc

SEQ ID NO: 1576560 - RNA, 13 nt, Pseudomonas putida KT2440
ccucacagccuuc

SEQ ID NO: 1576561 - RNA, 14 nt, Pseudomonas putida KT2440
ccucauaguaaggc

SEQ ID NO: 1576562 - RNA, 13 nt, Pseudomonas putida KT2440
ccuaucagaucga

SEQ ID NO: 1576563 - RNA, 17 nt, Pseudomonas putida KT2440
ccuaucgcucuggcacu

SEQ ID NO: 1576564 - RNA, 19 nt, Pseudomonas putida KT2440
ccuaugaaaccgagcgccg

SEQ ID NO: 1576565 - RNA, 19 nt, Pseudomonas putida KT2440
ccucaaaccggaucgggca

SEQ ID NO: 1576566 - RNA, 18 nt, Pseudomonas putida KT2440
ccucaaaugcgcccugcu

SEQ ID NO: 1576567 - RNA, 22 nt, Pseudomonas putida KT2440
ccucgacaaacugcucgcugcc

SEQ ID NO: 1576568 - RNA, 19 nt, Pseudomonas putida KT2440
ccuccucgcgggcaaaccc

SEQ ID NO: 1576569 - RNA, 13 nt, Pseudomonas putida KT2440
ccuccucaccgca

SEQ ID NO: 1576570 - RNA, 12 nt, Pseudomonas putida KT2440
ccuccuccagca

SEQ ID NO: 1576571 - RNA, 19 nt, Pseudomonas putida KT2440
ccuccuccagcauggcgau

SEQ ID NO: 1576572 - RNA, 23 nt, Pseudomonas putida KT2440
ccuccggaucgguccauugcucg

SEQ ID NO: 1576573 - RNA, 15 nt, Pseudomonas putida KT2440
ccguugaucagcgac

SEQ ID NO: 1576574 - RNA, 16 nt, Pseudomonas putida KT2440
ccguugaucagcgaca

SEQ ID NO: 1576575 - RNA, 14 nt, Pseudomonas putida KT2440
ccguucgcggucgg

SEQ ID NO: 1576576 - RNA, 22 nt, Pseudomonas putida KT2440
ccguucgcggucggucagcacc

SEQ ID NO: 1576577 - RNA, 17 nt, Pseudomonas putida KT2440
ccguucggcgcgcugcu

SEQ ID NO: 1576578 - RNA, 13 nt, Pseudomonas putida KT2440
ccguucggcguac

SEQ ID NO: 1576579 - RNA, 20 nt, Pseudomonas putida KT2440
ccguucgcccugcgccugca

SEQ ID NO: 1576580 - RNA, 21 nt, Pseudomonas putida KT2440
ccguucgcccugcgccugcag

SEQ ID NO: 1576581 - RNA, 15 nt, Pseudomonas putida KT2440
ccguguacgacugcc

SEQ ID NO: 1576582 - RNA, 19 nt, Pseudomonas putida KT2440
ccguguaggagcggguuua

SEQ ID NO: 1576583 - RNA, 19 nt, Pseudomonas putida KT2440
ccgugguucuugccgagca

SEQ ID NO: 1576584 - RNA, 15 nt, Pseudomonas putida KT2440
ccgugguuggagcgc

SEQ ID NO: 1576585 - RNA, 13 nt, Pseudomonas putida KT2440
ccguguucgcgag

SEQ ID NO: 1576586 - RNA, 11 nt, Pseudomonas putida KT2440
ccguuccgcaa

SEQ ID NO: 1576587 - RNA, 17 nt, Pseudomonas putida KT2440
ccguucaccguugccgc

SEQ ID NO: 1576588 - RNA, 13 nt, Pseudomonas putida KT2440
ccguucaggcgcc

SEQ ID NO: 1576589 - RNA, 12 nt, Pseudomonas putida KT2440
ccuacgcugguu

SEQ ID NO: 1576590 - RNA, 15 nt, Pseudomonas putida KT2440
ccuaccaacgcagca

SEQ ID NO: 1576591 - RNA, 22 nt, Pseudomonas putida KT2440
ccuacgggcgagcgcgcaggcg

SEQ ID NO: 1576592 - RNA, 15 nt, Pseudomonas putida KT2440
ccuagcaaggccucc

SEQ ID NO: 1576593 - RNA, 22 nt, Pseudomonas putida KT2440
ccuagccaaucugauuugcgcu

SEQ ID NO: 1576594 - RNA, 19 nt, Pseudomonas putida KT2440
ccuacagggguagcgucaa

SEQ ID NO: 1576595 - RNA, 17 nt, Pseudomonas putida KT2440
ccuacauggaucgcauu

SEQ ID NO: 1576596 - RNA, 22 nt, Pseudomonas putida KT2440
ccguugcgccgcucgcccagca

SEQ ID NO: 1576597 - RNA, 15 nt, Pseudomonas putida KT2440
ccguuugcuggccug

SEQ ID NO: 1576598 - RNA, 16 nt, Pseudomonas putida KT2440
ccguuuucgguaauca

SEQ ID NO: 1576599 - RNA, 18 nt, Pseudomonas putida KT2440
ccguuguucacggucagg

SEQ ID NO: 1576600 - RNA, 23 nt, Pseudomonas putida KT2440
ccguuucauucaagaaugcccgg

SEQ ID NO: 1576601 - RNA, 19 nt, Pseudomonas putida KT2440
cgcagguuguucggcaggc

SEQ ID NO: 1576602 - RNA, 23 nt, Pseudomonas putida KT2440
cgcagguuguucggcaggcucug

SEQ ID NO: 1576603 - RNA, 20 nt, Pseudomonas putida KT2440
cgcagucaccacacggcagc

SEQ ID NO: 1576604 - RNA, 14 nt, Pseudomonas putida KT2440
cgcauacagcgcac

SEQ ID NO: 1576605 - RNA, 12 nt, Pseudomonas putida KT2440
cgcaucaucacg

SEQ ID NO: 1576606 - RNA, 13 nt, Pseudomonas putida KT2440
cgcaucaagcggc

SEQ ID NO: 1576607 - RNA, 15 nt, Pseudomonas putida KT2440
cgcaggcaccgcacc

SEQ ID NO: 1576608 - RNA, 21 nt, Pseudomonas putida KT2440
cgcaggaucaugugcgccacu

SEQ ID NO: 1576609 - RNA, 17 nt, Pseudomonas putida KT2440
cgcaggagcggccuuca

SEQ ID NO: 1576610 - RNA, 17 nt, Pseudomonas putida KT2440
cgcagccuuugaaacgg

SEQ ID NO: 1576611 - RNA, 14 nt, Pseudomonas putida KT2440
cgcaggaaggugcc

SEQ ID NO: 1576612 - RNA, 20 nt, Pseudomonas putida KT2440
cgcaggaauaacuggcccga

SEQ ID NO: 1576613 - RNA, 21 nt, Pseudomonas putida KT2440
cgcagccucuucggccagcaa

SEQ ID NO: 1576614 - RNA, 21 nt, Pseudomonas putida KT2440
cgcagccggcaccgccauggu

SEQ ID NO: 1576615 - RNA, 18 nt, Pseudomonas putida KT2440
cgcagcccacggccgcca

SEQ ID NO: 1576616 - RNA, 16 nt, Pseudomonas putida KT2440
cgcagccccaccucgg

SEQ ID NO: 1576617 - RNA, 13 nt, Pseudomonas putida KT2440
cgcagggccuugu

SEQ ID NO: 1576618 - RNA, 20 nt, Pseudomonas putida KT2440
cgcagggcgcgaaaagccug

SEQ ID NO: 1576619 - RNA, 13 nt, Pseudomonas putida KT2440
cgcaggugcaggc

SEQ ID NO: 1576620 - RNA, 23 nt, Pseudomonas putida KT2440
cgcaggucuucucggcagacccu

SEQ ID NO: 1576621 - RNA, 13 nt, Pseudomonas putida KT2440
cgcaggucuugcc

SEQ ID NO: 1576622 - RNA, 16 nt, Pseudomonas putida KT2440
cgcaggcuuguccuug

SEQ ID NO: 1576623 - RNA, 17 nt, Pseudomonas putida KT2440
cgcagggaagguggccg

SEQ ID NO: 1576624 - RNA, 20 nt, Pseudomonas putida KT2440
cgcagggaagguggccggca

SEQ ID NO: 1576625 - RNA, 22 nt, Pseudomonas putida KT2440
cgcagggaagguggccggcaac

SEQ ID NO: 1576626 - RNA, 14 nt, Pseudomonas putida KT2440
cgcaggccgacaac

SEQ ID NO: 1576627 - RNA, 16 nt, Pseudomonas putida KT2440
cgcaggcccagcaggu

SEQ ID NO: 1576628 - RNA, 12 nt, Pseudomonas putida KT2440
cgcaggccagcg

SEQ ID NO: 1576629 - RNA, 18 nt, Pseudomonas putida KT2440
cgcaggcauacaggacca

SEQ ID NO: 1576630 - RNA, 14 nt, Pseudomonas putida KT2440
cgcaggccacggua

SEQ ID NO: 1576631 - RNA, 20 nt, Pseudomonas putida KT2440
cgcaugacuuccagguagcg

SEQ ID NO: 1576632 - RNA, 23 nt, Pseudomonas putida KT2440
cgcaucugcaccggcagcgcaau

SEQ ID NO: 1576633 - RNA, 15 nt, Pseudomonas putida KT2440
cgcaugaaacucgcg

SEQ ID NO: 1576634 - RNA, 18 nt, Pseudomonas putida KT2440
cgcaugcuuggcgaaggu

SEQ ID NO: 1576635 - RNA, 15 nt, Pseudomonas putida KT2440
cgcaugcgcgacagc

SEQ ID NO: 1576636 - RNA, 21 nt, Pseudomonas putida KT2440
cgcaugcgcgccauggccucg

SEQ ID NO: 1576637 - RNA, 12 nt, Pseudomonas putida KT2440
cgcaugccgaug

SEQ ID NO: 1576638 - RNA, 19 nt, Pseudomonas putida KT2440
cgcaugccgaugucggcgu

SEQ ID NO: 1576639 - RNA, 20 nt, Pseudomonas putida KT2440
cgcaucgcuguccuuggcca

SEQ ID NO: 1576640 - RNA, 17 nt, Pseudomonas putida KT2440
cgcaucgacagguccac

SEQ ID NO: 1576641 - RNA, 21 nt, Pseudomonas putida KT2440
cgcaucgaccggcaggcgcuu

SEQ ID NO: 1576642 - RNA, 23 nt, Pseudomonas putida KT2440
cgcauccugagguauacacuggc

SEQ ID NO: 1576643 - RNA, 20 nt, Pseudomonas putida KT2440
cgcauccugcgugcugugca

SEQ ID NO: 1576644 - RNA, 20 nt, Pseudomonas putida KT2440
cgcaucagccgcgcccucuu

SEQ ID NO: 1576645 - RNA, 12 nt, Pseudomonas putida KT2440
cgcauccgcacc

SEQ ID NO: 1576646 - RNA, 22 nt, Pseudomonas putida KT2440
cgcauccggaauuucugcaccu

SEQ ID NO: 1576647 - RNA, 13 nt, Pseudomonas putida KT2440
cgccacacccgcu

SEQ ID NO: 1576648 - RNA, 20 nt, Pseudomonas putida KT2440
cgccacacugucccggcaca

SEQ ID NO: 1576649 - RNA, 14 nt, Pseudomonas putida KT2440
cgccacauccagcg

SEQ ID NO: 1576650 - RNA, 15 nt, Pseudomonas putida KT2440
cgccacccucgcacc

SEQ ID NO: 1576651 - RNA, 16 nt, Pseudomonas putida KT2440
cgccacccucgcacca

SEQ ID NO: 1576652 - RNA, 17 nt, Pseudomonas putida KT2440
cgccaccgacuccggca

SEQ ID NO: 1576653 - RNA, 20 nt, Pseudomonas putida KT2440
cgccaccgacauuguaggcg

SEQ ID NO: 1576654 - RNA, 14 nt, Pseudomonas putida KT2440
cgccaccgaaggcg

SEQ ID NO: 1576655 - RNA, 15 nt, Pseudomonas putida KT2440
cgccaccaaccggcc

SEQ ID NO: 1576656 - RNA, 15 nt, Pseudomonas putida KT2440
cgccaccaagcccuu

SEQ ID NO: 1576657 - RNA, 21 nt, Pseudomonas putida KT2440
cgccacccgacgccaccuucg

SEQ ID NO: 1576658 - RNA, 22 nt, Pseudomonas putida KT2440
cgcauggcguuguccagcaggu

SEQ ID NO: 1576659 - RNA, 17 nt, Pseudomonas putida KT2440
cgcauggcucaacuggc

SEQ ID NO: 1576660 - RNA, 21 nt, Pseudomonas putida KT2440
cgcauggcucaacuggcaggg

SEQ ID NO: 1576661 - RNA, 21 nt, Pseudomonas putida KT2440
cgcauggucacguagaacagg

SEQ ID NO: 1576662 - RNA, 20 nt, Pseudomonas putida KT2440
cgcauuagcagguaaacccg

SEQ ID NO: 1576663 - RNA, 17 nt, Pseudomonas putida KT2440
cgccaauugcgccagcc

SEQ ID NO: 1576664 - RNA, 20 nt, Pseudomonas putida KT2440
cgccaauugcgccagccgcu

SEQ ID NO: 1576665 - RNA, 15 nt, Pseudomonas putida KT2440
cgccacaccacagcu

SEQ ID NO: 1576666 - RNA, 19 nt, Pseudomonas putida KT2440
cgccacaaaaucacaggcc

SEQ ID NO: 1576667 - RNA, 22 nt, Pseudomonas putida KT2440
cgccaaccucaggccugcacug

SEQ ID NO: 1576668 - RNA, 17 nt, Pseudomonas putida KT2440
cgccaaccgcgccagca

SEQ ID NO: 1576669 - RNA, 18 nt, Pseudomonas putida KT2440
cgccaaccccacgccugu

SEQ ID NO: 1576670 - RNA, 17 nt, Pseudomonas putida KT2440
cgccaaccccuccuuca

SEQ ID NO: 1576671 - RNA, 14 nt, Pseudomonas putida KT2440
cgccaacaccaccu

SEQ ID NO: 1576672 - RNA, 13 nt, Pseudomonas putida KT2440
cgcacacgcucca

SEQ ID NO: 1576673 - RNA, 16 nt, Pseudomonas putida KT2440
cgcacacgaccuugga

SEQ ID NO: 1576674 - RNA, 16 nt, Pseudomonas putida KT2440
cgcacaucacggcgca

SEQ ID NO: 1576675 - RNA, 23 nt, Pseudomonas putida KT2440
cgcacaucacggcgcaggccgac

SEQ ID NO: 1576676 - RNA, 15 nt, Pseudomonas putida KT2440
cgcacaugaagccgc

SEQ ID NO: 1576677 - RNA, 18 nt, Pseudomonas putida KT2440
cgcacaugaagccgcgca

SEQ ID NO: 1576678 - RNA, 21 nt, Pseudomonas putida KT2440
cgcacaugaagccgcgcagga

SEQ ID NO: 1576679 - RNA, 19 nt, Pseudomonas putida KT2440
cgcacagguccagccgcca

SEQ ID NO: 1576680 - RNA, 19 nt, Pseudomonas putida KT2440
cgcaaguucccgugcgccu

SEQ ID NO: 1576681 - RNA, 22 nt, Pseudomonas putida KT2440
cgcaaggccgcggcugaacacg

SEQ ID NO: 1576682 - RNA, 16 nt, Pseudomonas putida KT2440
cgcaaggccgcuccca

SEQ ID NO: 1576683 - RNA, 18 nt, Pseudomonas putida KT2440
cgcaaggcggcccaacga

SEQ ID NO: 1576684 - RNA, 21 nt, Pseudomonas putida KT2440
cgcaagcuggcgcaagccgug

SEQ ID NO: 1576685 - RNA, 14 nt, Pseudomonas putida KT2440
cgcaagcugcaccg

SEQ ID NO: 1576686 - RNA, 18 nt, Pseudomonas putida KT2440
cgcaagcugcaccgccac

SEQ ID NO: 1576687 - RNA, 17 nt, Pseudomonas putida KT2440
cgcaagcgggcagugca

SEQ ID NO: 1576688 - RNA, 14 nt, Pseudomonas putida KT2440
cgcaauccuugccc

SEQ ID NO: 1576689 - RNA, 15 nt, Pseudomonas putida KT2440
cgcaauccuugcccu

SEQ ID NO: 1576690 - RNA, 20 nt, Pseudomonas putida KT2440
cgcaauccccuccgccugcg

SEQ ID NO: 1576691 - RNA, 17 nt, Pseudomonas putida KT2440
cgauggccccgcccagg

SEQ ID NO: 1576692 - RNA, 16 nt, Pseudomonas putida KT2440
cgauuuccaccggcuu

SEQ ID NO: 1576693 - RNA, 18 nt, Pseudomonas putida KT2440
cgaugcucgucagccccu

SEQ ID NO: 1576694 - RNA, 15 nt, Pseudomonas putida KT2440
cgauggccaccagca

SEQ ID NO: 1576695 - RNA, 18 nt, Pseudomonas putida KT2440
cgauggccaccagcaccu

SEQ ID NO: 1576696 - RNA, 14 nt, Pseudomonas putida KT2440
cgcaagcgccugau

SEQ ID NO: 1576697 - RNA, 18 nt, Pseudomonas putida KT2440
cgcaagcgcgccgccaca

SEQ ID NO: 1576698 - RNA, 17 nt, Pseudomonas putida KT2440
cgcaagcagucccagca

SEQ ID NO: 1576699 - RNA, 14 nt, Pseudomonas putida KT2440
cgcaacgugcgccg

SEQ ID NO: 1576700 - RNA, 12 nt, Pseudomonas putida KT2440
cgcaacucagcg

SEQ ID NO: 1576701 - RNA, 17 nt, Pseudomonas putida KT2440
cgcaacucagcgcagcu

SEQ ID NO: 1576702 - RNA, 22 nt, Pseudomonas putida KT2440
cgcaacucuaccucacugacag

SEQ ID NO: 1576703 - RNA, 16 nt, Pseudomonas putida KT2440
cgcaacaccgccagcg

SEQ ID NO: 1576704 - RNA, 15 nt, Pseudomonas putida KT2440
cgcaacaccugccgc

SEQ ID NO: 1576705 - RNA, 16 nt, Pseudomonas putida KT2440
cgcaaauccuccugcg

SEQ ID NO: 1576706 - RNA, 22 nt, Pseudomonas putida KT2440
cgcaaauccuccugcgcaugca

SEQ ID NO: 1576707 - RNA, 16 nt, Pseudomonas putida KT2440
cgcaaaucgccgcauc

SEQ ID NO: 1576708 - RNA, 16 nt, Pseudomonas putida KT2440
cgcaaagcggccccca

SEQ ID NO: 1576709 - RNA, 19 nt, Pseudomonas putida KT2440
cgcaaagcggcccccagca

SEQ ID NO: 1576710 - RNA, 19 nt, Pseudomonas putida KT2440
cgcaaauucucgagcugau

SEQ ID NO: 1576711 - RNA, 13 nt, Pseudomonas putida KT2440
cgcaaaugcaccc

SEQ ID NO: 1576712 - RNA, 16 nt, Pseudomonas putida KT2440
cgcaaaugcaccccug

SEQ ID NO: 1576713 - RNA, 13 nt, Pseudomonas putida KT2440
cgcaacaaggcca

SEQ ID NO: 1576714 - RNA, 13 nt, Pseudomonas putida KT2440
cgcaccagggcug

SEQ ID NO: 1576715 - RNA, 21 nt, Pseudomonas putida KT2440
cgcaccagggcuggcagcggg

SEQ ID NO: 1576716 - RNA, 22 nt, Pseudomonas putida KT2440
cgcaccagggcuggcagcgggu

SEQ ID NO: 1576717 - RNA, 16 nt, Pseudomonas putida KT2440
cgcaccagcuccaaca

SEQ ID NO: 1576718 - RNA, 14 nt, Pseudomonas putida KT2440
cgcaccucgaccgc

SEQ ID NO: 1576719 - RNA, 22 nt, Pseudomonas putida KT2440
cgcaccgucgaugucggcgugg

SEQ ID NO: 1576720 - RNA, 17 nt, Pseudomonas putida KT2440
cgcaccgugcaccagca

SEQ ID NO: 1576721 - RNA, 12 nt, Pseudomonas putida KT2440
cgcacggcuucg

SEQ ID NO: 1576722 - RNA, 15 nt, Pseudomonas putida KT2440
cgcacggccuccacc

SEQ ID NO: 1576723 - RNA, 14 nt, Pseudomonas putida KT2440
cgcacucggcaauc

SEQ ID NO: 1576724 - RNA, 15 nt, Pseudomonas putida KT2440
cgcacucggcaauca

SEQ ID NO: 1576725 - RNA, 16 nt, Pseudomonas putida KT2440
cgcacucaggugagcc

SEQ ID NO: 1576726 - RNA, 22 nt, Pseudomonas putida KT2440
cgcacgggucaccucaucgacc

SEQ ID NO: 1576727 - RNA, 19 nt, Pseudomonas putida KT2440
cgcacugaauacaccagcu

SEQ ID NO: 1576728 - RNA, 15 nt, Pseudomonas putida KT2440
cgcagagcaugguca

SEQ ID NO: 1576729 - RNA, 23 nt, Pseudomonas putida KT2440
cgcagagggccgcgcaggcggcu

SEQ ID NO: 1576730 - RNA, 16 nt, Pseudomonas putida KT2440
cgcagcagcaggcccg

SEQ ID NO: 1576731 - RNA, 14 nt, Pseudomonas putida KT2440
cgagcugagcagcg

SEQ ID NO: 1576732 - RNA, 19 nt, Pseudomonas putida KT2440
cgagcgggugccgcagcac

SEQ ID NO: 1576733 - RNA, 18 nt, Pseudomonas putida KT2440
cgagcuugcucgcgaugc

SEQ ID NO: 1576734 - RNA, 21 nt, Pseudomonas putida KT2440
cgaggccgauuuggcccgcug

SEQ ID NO: 1576735 - RNA, 12 nt, Pseudomonas putida KT2440
cgaggaucagcg

SEQ ID NO: 1576736 - RNA, 15 nt, Pseudomonas putida KT2440
cgaggaucagcgcau

SEQ ID NO: 1576737 - RNA, 16 nt, Pseudomonas putida KT2440
cgaggcgaauggcagg

SEQ ID NO: 1576738 - RNA, 18 nt, Pseudomonas putida KT2440
cgagggugaggugcugca

SEQ ID NO: 1576739 - RNA, 19 nt, Pseudomonas putida KT2440
cgaguauccuccagcccug

SEQ ID NO: 1576740 - RNA, 16 nt, Pseudomonas putida KT2440
cgaguaucgccucgau

SEQ ID NO: 1576741 - RNA, 21 nt, Pseudomonas putida KT2440
cgagucaggcugcacaaggug

SEQ ID NO: 1576742 - RNA, 18 nt, Pseudomonas putida KT2440
cgagucaacacggcugga

SEQ ID NO: 1576743 - RNA, 19 nt, Pseudomonas putida KT2440
cgaucacuacaugcggccc

SEQ ID NO: 1576744 - RNA, 21 nt, Pseudomonas putida KT2440
cgaucagauaggcgccgugcu

SEQ ID NO: 1576745 - RNA, 19 nt, Pseudomonas putida KT2440
cgaucacgucguacucggc

SEQ ID NO: 1576746 - RNA, 13 nt, Pseudomonas putida KT2440
cgaucaccugggc

SEQ ID NO: 1576747 - RNA, 15 nt, Pseudomonas putida KT2440
cgaucaccugggcga

SEQ ID NO: 1576748 - RNA, 13 nt, Pseudomonas putida KT2440
cgaucaccugcgg

SEQ ID NO: 1576749 - RNA, 16 nt, Pseudomonas putida KT2440
cgaucaccugcggccu

SEQ ID NO: 1576750 - RNA, 14 nt, Pseudomonas putida KT2440
cgaucagcgccugc

SEQ ID NO: 1576751 - RNA, 19 nt, Pseudomonas putida KT2440
cgaucagcgccugcucauc

SEQ ID NO: 1576752 - RNA, 15 nt, Pseudomonas putida KT2440
cgaucagcgccgaac

SEQ ID NO: 1576753 - RNA, 17 nt, Pseudomonas putida KT2440
cgaucagcgagucguag

SEQ ID NO: 1576754 - RNA, 15 nt, Pseudomonas putida KT2440
cgaucagcgcggcaa

SEQ ID NO: 1576755 - RNA, 20 nt, Pseudomonas putida KT2440
cgaucagcggcgccacccag

SEQ ID NO: 1576756 - RNA, 16 nt, Pseudomonas putida KT2440
cgaucaggaagccccg

SEQ ID NO: 1576757 - RNA, 20 nt, Pseudomonas putida KT2440
cgaucaggcaggccagcacg

SEQ ID NO: 1576758 - RNA, 22 nt, Pseudomonas putida KT2440
cgaucagcugguuagcgucgau

SEQ ID NO: 1576759 - RNA, 16 nt, Pseudomonas putida KT2440
cgaucagguuugccgc

SEQ ID NO: 1576760 - RNA, 23 nt, Pseudomonas putida KT2440
cgaucaguaaucugccggcgccu

SEQ ID NO: 1576761 - RNA, 12 nt, Pseudomonas putida KT2440
cgaucaguacga

SEQ ID NO: 1576762 - RNA, 20 nt, Pseudomonas putida KT2440
cgaucaguacgaugcugcgg

SEQ ID NO: 1576763 - RNA, 19 nt, Pseudomonas putida KT2440
cgaucagguucaccguacc

SEQ ID NO: 1576764 - RNA, 21 nt, Pseudomonas putida KT2440
cgaucagguugagcaccgggc

SEQ ID NO: 1576765 - RNA, 23 nt, Pseudomonas putida KT2440
cgagugccaacaaucucggucug

SEQ ID NO: 1576766 - RNA, 18 nt, Pseudomonas putida KT2440
cgauaauuaccggcuguu

SEQ ID NO: 1576767 - RNA, 18 nt, Pseudomonas putida KT2440
cgauacggaaagcccccg

SEQ ID NO: 1576768 - RNA, 19 nt, Pseudomonas putida KT2440
cgaucaaugggccgaucac

SEQ ID NO: 1576769 - RNA, 23 nt, Pseudomonas putida KT2440
cgaucacacccucugccaucuca

SEQ ID NO: 1576770 - RNA, 16 nt, Pseudomonas putida KT2440
cgaucacaccggcaau

SEQ ID NO: 1576771 - RNA, 18 nt, Pseudomonas putida KT2440
cgauagcgugaagcggcc

SEQ ID NO: 1576772 - RNA, 18 nt, Pseudomonas putida KT2440
cgauagccagcuggccac

SEQ ID NO: 1576773 - RNA, 14 nt, Pseudomonas putida KT2440
cgauagcagcaccg

SEQ ID NO: 1576774 - RNA, 17 nt, Pseudomonas putida KT2440
cgauccuuggcgaaggc

SEQ ID NO: 1576775 - RNA, 21 nt, Pseudomonas putida KT2440
cgaucgaaaggcgacuccuga

SEQ ID NO: 1576776 - RNA, 17 nt, Pseudomonas putida KT2440
cgaucgaacgcuugccc

SEQ ID NO: 1576777 - RNA, 22 nt, Pseudomonas putida KT2440
cgauccucaucguccaccgcgc

SEQ ID NO: 1576778 - RNA, 18 nt, Pseudomonas putida KT2440
cgauccgcgccaucagcu

SEQ ID NO: 1576779 - RNA, 22 nt, Pseudomonas putida KT2440
cgauccaucuucaccuugccua

SEQ ID NO: 1576780 - RNA, 20 nt, Pseudomonas putida KT2440
cgaucccggcucgcgaucca

SEQ ID NO: 1576781 - RNA, 19 nt, Pseudomonas putida KT2440
cgaucccuggggccaagug

SEQ ID NO: 1576782 - RNA, 20 nt, Pseudomonas putida KT2440
cgaucccuguaggagcgggu

SEQ ID NO: 1576783 - RNA, 21 nt, Pseudomonas putida KT2440
cgaucccugugggagcgggcu

SEQ ID NO: 1576784 - RNA, 14 nt, Pseudomonas putida KT2440
cgaucaucgaagcc

SEQ ID NO: 1576785 - RNA, 17 nt, Pseudomonas putida KT2440
cgaucaugcuggccagg

SEQ ID NO: 1576786 - RNA, 23 nt, Pseudomonas putida KT2440
cgauccccggccggucguuaccc

SEQ ID NO: 1576787 - RNA, 19 nt, Pseudomonas putida KT2440
cgaucccgaggucagcagu

SEQ ID NO: 1576788 - RNA, 16 nt, Pseudomonas putida KT2440
cgauccacucgucgau

SEQ ID NO: 1576789 - RNA, 21 nt, Pseudomonas putida KT2440
cgaucgacaaccccagcccga

SEQ ID NO: 1576790 - RNA, 13 nt, Pseudomonas putida KT2440
cgaucgacuucau

SEQ ID NO: 1576791 - RNA, 18 nt, Pseudomonas putida KT2440
cgaucgacuucaucaccu

SEQ ID NO: 1576792 - RNA, 20 nt, Pseudomonas putida KT2440
cgaucgacuucaucaccucc

SEQ ID NO: 1576793 - RNA, 16 nt, Pseudomonas putida KT2440
cgaucgccucgcuggc

SEQ ID NO: 1576794 - RNA, 23 nt, Pseudomonas putida KT2440
cgaucgccucgcuggcgguguag

SEQ ID NO: 1576795 - RNA, 17 nt, Pseudomonas putida KT2440
cgaucgccauguguacg

SEQ ID NO: 1576796 - RNA, 12 nt, Pseudomonas putida KT2440
cgaucgucgaca

SEQ ID NO: 1576797 - RNA, 23 nt, Pseudomonas putida KT2440
cgaucgucgacaacgcacccgcc

SEQ ID NO: 1576798 - RNA, 17 nt, Pseudomonas putida KT2440
cgaucucgaagcugcca

SEQ ID NO: 1576799 - RNA, 20 nt, Pseudomonas putida KT2440
cgaucucccggcucaucagg

SEQ ID NO: 1576800 - RNA, 15 nt, Pseudomonas putida KT2440
cgaugaaggcaucca

SEQ ID NO: 1576801 - RNA, 15 nt, Pseudomonas putida KT2440
cgaucugcagcaccg

SEQ ID NO: 1576802 - RNA, 14 nt, Pseudomonas putida KT2440
cgaugaaggcugcu

SEQ ID NO: 1576803 - RNA, 12 nt, Pseudomonas putida KT2440
cgaugcccaccu

SEQ ID NO: 1576804 - RNA, 13 nt, Pseudomonas putida KT2440
cgaugcccauggc

SEQ ID NO: 1576805 - RNA, 16 nt, Pseudomonas putida KT2440
cgaugcccaccuuggc

SEQ ID NO: 1576806 - RNA, 21 nt, Pseudomonas putida KT2440
cgaugaucugccgggccacca

SEQ ID NO: 1576807 - RNA, 19 nt, Pseudomonas putida KT2440
cgaugaugauaccgaacag

SEQ ID NO: 1576808 - RNA, 16 nt, Pseudomonas putida KT2440
cgaugaugcgggcaaa

SEQ ID NO: 1576809 - RNA, 18 nt, Pseudomonas putida KT2440
cgaugcggugcagcaccu

SEQ ID NO: 1576810 - RNA, 22 nt, Pseudomonas putida KT2440
cgaugccugggcgguccuucau

SEQ ID NO: 1576811 - RNA, 21 nt, Pseudomonas putida KT2440
cgaacaacuguccugugcgca

SEQ ID NO: 1576812 - RNA, 15 nt, Pseudomonas putida KT2440
cgaacaccgccagcc

SEQ ID NO: 1576813 - RNA, 20 nt, Pseudomonas putida KT2440
cgaacaccgccagcccgcca

SEQ ID NO: 1576814 - RNA, 18 nt, Pseudomonas putida KT2440
cgaacaccaguucgccau

SEQ ID NO: 1576815 - RNA, 22 nt, Pseudomonas putida KT2440
cgaacaccccgauucacagcag

SEQ ID NO: 1576816 - RNA, 19 nt, Pseudomonas putida KT2440
cgaacaaauccgcgccgau

SEQ ID NO: 1576817 - RNA, 16 nt, Pseudomonas putida KT2440
cgaaaucguaggucac

SEQ ID NO: 1576818 - RNA, 21 nt, Pseudomonas putida KT2440
cgaacaguggcccgaugauca

SEQ ID NO: 1576819 - RNA, 15 nt, Pseudomonas putida KT2440
cgaacaggcgcuugc

SEQ ID NO: 1576820 - RNA, 18 nt, Pseudomonas putida KT2440
cgaacagcgccggcaguu

SEQ ID NO: 1576821 - RNA, 13 nt, Pseudomonas putida KT2440
cgaacaggcccug

SEQ ID NO: 1576822 - RNA, 20 nt, Pseudomonas putida KT2440
cgaacacgaaaaagccagcg

SEQ ID NO: 1576823 - RNA, 13 nt, Pseudomonas putida KT2440
cgaacaccugcgc

SEQ ID NO: 1576824 - RNA, 20 nt, Pseudomonas putida KT2440
cgaacacgggcgaagcccgu

SEQ ID NO: 1576825 - RNA, 20 nt, Pseudomonas putida KT2440
cgaacagccagaugcgcgcu

SEQ ID NO: 1576826 - RNA, 23 nt, Pseudomonas putida KT2440
cgaacagcgaaguguucggggug

SEQ ID NO: 1576827 - RNA, 22 nt, Pseudomonas putida KT2440
cgaacagcaccgccauggccag

SEQ ID NO: 1576828 - RNA, 15 nt, Pseudomonas putida KT2440
cgaacacuuggcagc

SEQ ID NO: 1576829 - RNA, 15 nt, Pseudomonas putida KT2440
cgaacgacuucggca

SEQ ID NO: 1576830 - RNA, 17 nt, Pseudomonas putida KT2440
cgaacgcaagaaggcug

SEQ ID NO: 1576831 - RNA, 18 nt, Pseudomonas putida KT2440
cgaaccguucacguucaa

SEQ ID NO: 1576832 - RNA, 21 nt, Pseudomonas putida KT2440
cgaaccaguacugggcguccu

SEQ ID NO: 1576833 - RNA, 14 nt, Pseudomonas putida KT2440
cgaacccacuguca

SEQ ID NO: 1576834 - RNA, 15 nt, Pseudomonas putida KT2440
cgaacccgcuggcga

SEQ ID NO: 1576835 - RNA, 19 nt, Pseudomonas putida KT2440
cgaacccgcuggcgaucag

SEQ ID NO: 1576836 - RNA, 14 nt, Pseudomonas putida KT2440
cgaacgggccacca

SEQ ID NO: 1576837 - RNA, 16 nt, Pseudomonas putida KT2440
cgaacgcuugcccggc

SEQ ID NO: 1576838 - RNA, 22 nt, Pseudomonas putida KT2440
cgaacgcgaguaacgcccuuca

SEQ ID NO: 1576839 - RNA, 14 nt, Pseudomonas putida KT2440
cgaacucgcgccca

SEQ ID NO: 1576840 - RNA, 23 nt, Pseudomonas putida KT2440
cgaagaagccggcaucgccaaca

SEQ ID NO: 1576841 - RNA, 12 nt, Pseudomonas putida KT2440
cgaagcccaguu

SEQ ID NO: 1576842 - RNA, 14 nt, Pseudomonas putida KT2440
cgaagccgccagcg

SEQ ID NO: 1576843 - RNA, 17 nt, Pseudomonas putida KT2440
cgaagcccguggcccuc

SEQ ID NO: 1576844 - RNA, 16 nt, Pseudomonas putida KT2440
cgaagcgacagcggcc

SEQ ID NO: 1576845 - RNA, 17 nt, Pseudomonas putida KT2440
cgaagcuaucgccagca

SEQ ID NO: 1576846 - RNA, 20 nt, Pseudomonas putida KT2440
cgaagcgcaccucggccagu

SEQ ID NO: 1576847 - RNA, 21 nt, Pseudomonas putida KT2440
cgaaguacggcuugccggcaa

SEQ ID NO: 1576848 - RNA, 22 nt, Pseudomonas putida KT2440
cgaaguacggcuugccggcaau

SEQ ID NO: 1576849 - RNA, 18 nt, Pseudomonas putida KT2440
cgaaggucuugccgugcu

SEQ ID NO: 1576850 - RNA, 18 nt, Pseudomonas putida KT2440
cgaaggugcgauagaugu

SEQ ID NO: 1576851 - RNA, 16 nt, Pseudomonas putida KT2440
cgaagcucuggucgau

SEQ ID NO: 1576852 - RNA, 15 nt, Pseudomonas putida KT2440
cgaaguggaucacgg

SEQ ID NO: 1576853 - RNA, 13 nt, Pseudomonas putida KT2440
cgaaguggcggcu

SEQ ID NO: 1576854 - RNA, 17 nt, Pseudomonas putida KT2440
cgaaguggcggcucgcu

SEQ ID NO: 1576855 - RNA, 18 nt, Pseudomonas putida KT2440
cgaauaaccgcuguacag

SEQ ID NO: 1576856 - RNA, 13 nt, Pseudomonas putida KT2440
cgaauaucgccga

SEQ ID NO: 1576857 - RNA, 21 nt, Pseudomonas putida KT2440
cgaauacgguaguggcggcaa

SEQ ID NO: 1576858 - RNA, 14 nt, Pseudomonas putida KT2440
cgaaucagcgccuc

SEQ ID NO: 1576859 - RNA, 16 nt, Pseudomonas putida KT2440
ccuugccccacucggc

SEQ ID NO: 1576860 - RNA, 23 nt, Pseudomonas putida KT2440
ccuugccguaggugaucagcuug

SEQ ID NO: 1576861 - RNA, 15 nt, Pseudomonas putida KT2440
ccuugcgauaccccg

SEQ ID NO: 1576862 - RNA, 14 nt, Pseudomonas putida KT2440
ccuugcgccaggug

SEQ ID NO: 1576863 - RNA, 15 nt, Pseudomonas putida KT2440
ccuugcgcucgacgc

SEQ ID NO: 1576864 - RNA, 12 nt, Pseudomonas putida KT2440
ccuugcagcgcc

SEQ ID NO: 1576865 - RNA, 17 nt, Pseudomonas putida KT2440
ccuugauuaccagcgcc

SEQ ID NO: 1576866 - RNA, 18 nt, Pseudomonas putida KT2440
ccuugauuaccagcgccc

SEQ ID NO: 1576867 - RNA, 15 nt, Pseudomonas putida KT2440
ccuugaucaggcccu

SEQ ID NO: 1576868 - RNA, 14 nt, Pseudomonas putida KT2440
ccuugccaacggca

SEQ ID NO: 1576869 - RNA, 15 nt, Pseudomonas putida KT2440
ccuugccaacggcac

SEQ ID NO: 1576870 - RNA, 14 nt, Pseudomonas putida KT2440
ccuugccaucgacc

SEQ ID NO: 1576871 - RNA, 13 nt, Pseudomonas putida KT2440
ccuugcagcgccg

SEQ ID NO: 1576872 - RNA, 13 nt, Pseudomonas putida KT2440
ccuugcagcgccu

SEQ ID NO: 1576873 - RNA, 13 nt, Pseudomonas putida KT2440
ccuugcagggcac

SEQ ID NO: 1576874 - RNA, 14 nt, Pseudomonas putida KT2440
ccuugcagggcacc

SEQ ID NO: 1576875 - RNA, 20 nt, Pseudomonas putida KT2440
ccuugcccagcuccagcacc

SEQ ID NO: 1576876 - RNA, 17 nt, Pseudomonas putida KT2440
ccuugcccaaccguucc

SEQ ID NO: 1576877 - RNA, 16 nt, Pseudomonas putida KT2440
ccuugcccaccaggau

SEQ ID NO: 1576878 - RNA, 20 nt, Pseudomonas putida KT2440
ccuuggcguuacuguuccag

SEQ ID NO: 1576879 - RNA, 17 nt, Pseudomonas putida KT2440
ccuuggcuacgcaaggu

SEQ ID NO: 1576880 - RNA, 16 nt, Pseudomonas putida KT2440
ccuuggccaacugcag

SEQ ID NO: 1576881 - RNA, 13 nt, Pseudomonas putida KT2440
ccuugggcccaca

SEQ ID NO: 1576882 - RNA, 18 nt, Pseudomonas putida KT2440
ccuugggcgugcgcugca

SEQ ID NO: 1576883 - RNA, 17 nt, Pseudomonas putida KT2440
ccuuggcggcggaucgg

SEQ ID NO: 1576884 - RNA, 18 nt, Pseudomonas putida KT2440
ccuugcucuguucgcugg

SEQ ID NO: 1576885 - RNA, 21 nt, Pseudomonas putida KT2440
ccuugcugaaauccagccgcc

SEQ ID NO: 1576886 - RNA, 15 nt, Pseudomonas putida KT2440
ccuuggacaccaggc

SEQ ID NO: 1576887 - RNA, 15 nt, Pseudomonas putida KT2440
ccuugcugcagcagg

SEQ ID NO: 1576888 - RNA, 16 nt, Pseudomonas putida KT2440
ccuugcuguagcccac

SEQ ID NO: 1576889 - RNA, 14 nt, Pseudomonas putida KT2440
ccuugucagcaacc

SEQ ID NO: 1576890 - RNA, 16 nt, Pseudomonas putida KT2440
ccuuguccagcaggcc

SEQ ID NO: 1576891 - RNA, 22 nt, Pseudomonas putida KT2440
ccuugucggcacgcgccagcag

SEQ ID NO: 1576892 - RNA, 18 nt, Pseudomonas putida KT2440
ccuuggugcaccagcuug

SEQ ID NO: 1576893 - RNA, 20 nt, Pseudomonas putida KT2440
ccuuugguuggcuuguccag

SEQ ID NO: 1576894 - RNA, 22 nt, Pseudomonas putida KT2440
ccuuugcggcacaucucaaggc

SEQ ID NO: 1576895 - RNA, 22 nt, Pseudomonas putida KT2440
ccuuucgcgggagacccguucc

SEQ ID NO: 1576896 - RNA, 16 nt, Pseudomonas putida KT2440
ccuuucgcggguaaac

SEQ ID NO: 1576897 - RNA, 18 nt, Pseudomonas putida KT2440
ccuuucgcggguaaaccc

SEQ ID NO: 1576898 - RNA, 20 nt, Pseudomonas putida KT2440
ccuuucacggcgguaacagg

SEQ ID NO: 1576899 - RNA, 18 nt, Pseudomonas putida KT2440
ccuuuaggggcucuucgc

SEQ ID NO: 1576900 - RNA, 17 nt, Pseudomonas putida KT2440
ccuuuuuuuugccuggg

SEQ ID NO: 1576901 - RNA, 21 nt, Pseudomonas putida KT2440
cgaaaagccggguacuuggca

SEQ ID NO: 1576902 - RNA, 14 nt, Pseudomonas putida KT2440
cgaaaggcgcucga

SEQ ID NO: 1576903 - RNA, 19 nt, Pseudomonas putida KT2440
cgaaagggccaguacaggc

SEQ ID NO: 1576904 - RNA, 21 nt, Pseudomonas putida KT2440
cgaaagggccgcaaagcggcc

SEQ ID NO: 1576905 - RNA, 17 nt, Pseudomonas putida KT2440
cgaaacgaaacccugcu

SEQ ID NO: 1576906 - RNA, 15 nt, Pseudomonas putida KT2440
cgaaacccugcuggg

SEQ ID NO: 1576907 - RNA, 14 nt, Pseudomonas putida KT2440
cgaaaccgccagcc

SEQ ID NO: 1576908 - RNA, 15 nt, Pseudomonas putida KT2440
cgaaaccgccagcca

SEQ ID NO: 1576909 - RNA, 16 nt, Pseudomonas putida KT2440
cgaaacacagcaggcc

SEQ ID NO: 1576910 - RNA, 20 nt, Pseudomonas putida KT2440
ccuuccucggccaugcgcgg

SEQ ID NO: 1576911 - RNA, 13 nt, Pseudomonas putida KT2440
ccuuccugcaccu

SEQ ID NO: 1576912 - RNA, 16 nt, Pseudomonas putida KT2440
ccuucgccaacugcac

SEQ ID NO: 1576913 - RNA, 18 nt, Pseudomonas putida KT2440
ccuucgcaggcacgcccg

SEQ ID NO: 1576914 - RNA, 13 nt, Pseudomonas putida KT2440
ccuucgcuucgcg

SEQ ID NO: 1576915 - RNA, 19 nt, Pseudomonas putida KT2440
ccuucaggcacaccucggu

SEQ ID NO: 1576916 - RNA, 16 nt, Pseudomonas putida KT2440
ccuucauacagcgccu

SEQ ID NO: 1576917 - RNA, 15 nt, Pseudomonas putida KT2440
ccuucagcagccggu

SEQ ID NO: 1576918 - RNA, 18 nt, Pseudomonas putida KT2440
ccuucagcggccgcgcaa

SEQ ID NO: 1576919 - RNA, 23 nt, Pseudomonas putida KT2440
ccuucagcgggucgagccaggcg

SEQ ID NO: 1576920 - RNA, 12 nt, Pseudomonas putida KT2440
ccuugaccagcu

SEQ ID NO: 1576921 - RNA, 18 nt, Pseudomonas putida KT2440
ccuucuucggucagcugg

SEQ ID NO: 1576922 - RNA, 17 nt, Pseudomonas putida KT2440
ccuugagaucagcaacc

SEQ ID NO: 1576923 - RNA, 23 nt, Pseudomonas putida KT2440
ccuucguuugcgaagguaaccug

SEQ ID NO: 1576924 - RNA, 23 nt, Pseudomonas putida KT2440
ccuucuccgccuaccgcgucgcc

SEQ ID NO: 1576925 - RNA, 19 nt, Pseudomonas putida KT2440
ccuucucgaacagcuggcg

SEQ ID NO: 1576926 - RNA, 19 nt, Pseudomonas putida KT2440
ccuucugugauuuccagcg

SEQ ID NO: 1576927 - RNA, 19 nt, Pseudomonas putida KT2440
ccuucguaguaauggccga

SEQ ID NO: 1576928 - RNA, 16 nt, Pseudomonas putida KT2440
ccuucgucgcuggcca

SEQ ID NO: 1576929 - RNA, 15 nt, Pseudomonas putida KT2440
ccuguuuggccgcau

SEQ ID NO: 1576930 - RNA, 19 nt, Pseudomonas putida KT2440
ccuuacgcagccuucugug

SEQ ID NO: 1576931 - RNA, 15 nt, Pseudomonas putida KT2440
ccugugguggcugcu

SEQ ID NO: 1576932 - RNA, 23 nt, Pseudomonas putida KT2440
ccugugguuucacacucgccagg

SEQ ID NO: 1576933 - RNA, 19 nt, Pseudomonas putida KT2440
ccugugccggccucuucgc

SEQ ID NO: 1576934 - RNA, 20 nt, Pseudomonas putida KT2440
ccugugccggccucuucgcg

SEQ ID NO: 1576935 - RNA, 15 nt, Pseudomonas putida KT2440
ccugugccgggccau

SEQ ID NO: 1576936 - RNA, 16 nt, Pseudomonas putida KT2440
ccuguggaagcgggcg

SEQ ID NO: 1576937 - RNA, 20 nt, Pseudomonas putida KT2440
ccuguguuuucccaauccuc

SEQ ID NO: 1576938 - RNA, 18 nt, Pseudomonas putida KT2440
ccuguguaggagcggguu

SEQ ID NO: 1576939 - RNA, 20 nt, Pseudomonas putida KT2440
ccuguguaggagcggguuca

SEQ ID NO: 1576940 - RNA, 21 nt, Pseudomonas putida KT2440
ccuguguaggagcggguuuac

SEQ ID NO: 1576941 - RNA, 16 nt, Pseudomonas putida KT2440
ccuguuccggccucuu

SEQ ID NO: 1576942 - RNA, 20 nt, Pseudomonas putida KT2440
ccuguuccggccucuucgcg

SEQ ID NO: 1576943 - RNA, 19 nt, Pseudomonas putida KT2440
ccucgucgauguagaugcc

SEQ ID NO: 1576944 - RNA, 11 nt, Pseudomonas putida KT2440
ccuguggcugu

SEQ ID NO: 1576945 - RNA, 16 nt, Pseudomonas putida KT2440
ccugugggagcgggcg

SEQ ID NO: 1576946 - RNA, 20 nt, Pseudomonas putida KT2440
ccugugggagcgggcgugcc

SEQ ID NO: 1576947 - RNA, 20 nt, Pseudomonas putida KT2440
ccugugggagcgggcuugcc

SEQ ID NO: 1576948 - RNA, 18 nt, Pseudomonas putida KT2440
ccuguggggcaacugcgc

SEQ ID NO: 1576949 - RNA, 14 nt, Pseudomonas putida KT2440
ccuguggguaaccc

SEQ ID NO: 1576950 - RNA, 19 nt, Pseudomonas putida KT2440
ccugugcuuugagcaggcg

SEQ ID NO: 1576951 - RNA, 13 nt, Pseudomonas putida KT2440
ccugugcggcgua

SEQ ID NO: 1576952 - RNA, 19 nt, Pseudomonas putida KT2440
ccugugcggcguauccgug

SEQ ID NO: 1576953 - RNA, 19 nt, Pseudomonas putida KT2440
ccugugaggccuucagcgc

SEQ ID NO: 1576954 - RNA, 19 nt, Pseudomonas putida KT2440
ccugucguuauccugcagc

SEQ ID NO: 1576955 - RNA, 22 nt, Pseudomonas putida KT2440
ccugucguuauccugcagcacc

SEQ ID NO: 1576956 - RNA, 19 nt, Pseudomonas putida KT2440
ccugucuggccucuucgcg

SEQ ID NO: 1576957 - RNA, 17 nt, Pseudomonas putida KT2440
ccugucgcgacgggcug

SEQ ID NO: 1576958 - RNA, 18 nt, Pseudomonas putida KT2440
cgaccacccucgggcgug

SEQ ID NO: 1576959 - RNA, 17 nt, Pseudomonas putida KT2440
cgaccaccgcaggugca

SEQ ID NO: 1576960 - RNA, 17 nt, Pseudomonas putida KT2440
cgaccacugcaggugca

SEQ ID NO: 1576961 - RNA, 20 nt, Pseudomonas putida KT2440
cgaccacgaucuuggccagg

SEQ ID NO: 1576962 - RNA, 14 nt, Pseudomonas putida KT2440
cgacccagccaccc

SEQ ID NO: 1576963 - RNA, 14 nt, Pseudomonas putida KT2440
cgaccaaaccacgg

SEQ ID NO: 1576964 - RNA, 14 nt, Pseudomonas putida KT2440
cgaccaaaggucgc

SEQ ID NO: 1576965 - RNA, 13 nt, Pseudomonas putida KT2440
cgaccaagcgccc

SEQ ID NO: 1576966 - RNA, 15 nt, Pseudomonas putida KT2440
cgaccaagcgcccca

SEQ ID NO: 1576967 - RNA, 21 nt, Pseudomonas putida KT2440
cgaccaaggcuuccgccggga

SEQ ID NO: 1576968 - RNA, 22 nt, Pseudomonas putida KT2440
cgacaucguaaauaguggcuag

SEQ ID NO: 1576969 - RNA, 13 nt, Pseudomonas putida KT2440
cgaaugccucguc

SEQ ID NO: 1576970 - RNA, 19 nt, Pseudomonas putida KT2440
cgaaugcgcccggccaggu

SEQ ID NO: 1576971 - RNA, 18 nt, Pseudomonas putida KT2440
cgaauuucaaggcgccga

SEQ ID NO: 1576972 - RNA, 18 nt, Pseudomonas putida KT2440
cgacaaaguugccgauga

SEQ ID NO: 1576973 - RNA, 20 nt, Pseudomonas putida KT2440
cgacaaaccgcacccggcua

SEQ ID NO: 1576974 - RNA, 18 nt, Pseudomonas putida KT2440
cgacaaacugcugaguca

SEQ ID NO: 1576975 - RNA, 18 nt, Pseudomonas putida KT2440
cgaccgucgcuggacgcu

SEQ ID NO: 1576976 - RNA, 18 nt, Pseudomonas putida KT2440
cgaccugcccggcguuca

SEQ ID NO: 1576977 - RNA, 21 nt, Pseudomonas putida KT2440
cgaccucgauuuccaccggcu

SEQ ID NO: 1576978 - RNA, 15 nt, Pseudomonas putida KT2440
cgaccggagcaucgc

SEQ ID NO: 1576979 - RNA, 16 nt, Pseudomonas putida KT2440
cgaccuguguccaccc

SEQ ID NO: 1576980 - RNA, 15 nt, Pseudomonas putida KT2440
cgaccugggccaggu

SEQ ID NO: 1576981 - RNA, 15 nt, Pseudomonas putida KT2440
cgaccugguccagcu

SEQ ID NO: 1576982 - RNA, 23 nt, Pseudomonas putida KT2440
cgacgaaacccaguacggcgcca

SEQ ID NO: 1576983 - RNA, 15 nt, Pseudomonas putida KT2440
cgacgauggacagcc

SEQ ID NO: 1576984 - RNA, 16 nt, Pseudomonas putida KT2440
cgacgacuuauccgcu

SEQ ID NO: 1576985 - RNA, 20 nt, Pseudomonas putida KT2440
cgagaaugcugcgcagcugg

SEQ ID NO: 1576986 - RNA, 14 nt, Pseudomonas putida KT2440
cgagaagguggccg

SEQ ID NO: 1576987 - RNA, 23 nt, Pseudomonas putida KT2440
cgacugcagguaguuuuccagcc

SEQ ID NO: 1576988 - RNA, 16 nt, Pseudomonas putida KT2440
cgacuggugcucugca

SEQ ID NO: 1576989 - RNA, 15 nt, Pseudomonas putida KT2440
cgacuggaaggcgcu

SEQ ID NO: 1576990 - RNA, 15 nt, Pseudomonas putida KT2440
cgagagccgggcaau

SEQ ID NO: 1576991 - RNA, 15 nt, Pseudomonas putida KT2440
cgagaucgacagggg

SEQ ID NO: 1576992 - RNA, 22 nt, Pseudomonas putida KT2440
cgacucuucccaccaccagcgc

SEQ ID NO: 1576993 - RNA, 19 nt, Pseudomonas putida KT2440
cgacucgguacgcacugua

SEQ ID NO: 1576994 - RNA, 16 nt, Pseudomonas putida KT2440
cgacugcacugccagc

SEQ ID NO: 1576995 - RNA, 13 nt, Pseudomonas putida KT2440
cgacugaccgcgc

SEQ ID NO: 1576996 - RNA, 19 nt, Pseudomonas putida KT2440
cgacugaacaccugccagc

SEQ ID NO: 1576997 - RNA, 14 nt, Pseudomonas putida KT2440
cgacugaggcaccg

SEQ ID NO: 1576998 - RNA, 23 nt, Pseudomonas putida KT2440
cgacugaggcaccgguucgccgc

SEQ ID NO: 1576999 - RNA, 14 nt, Pseudomonas putida KT2440
cgacguugcgcuca

SEQ ID NO: 1577000 - RNA, 15 nt, Pseudomonas putida KT2440
cgacucgaugccauc

SEQ ID NO: 1577001 - RNA, 17 nt, Pseudomonas putida KT2440
cgacucgcggccgguca

SEQ ID NO: 1577002 - RNA, 17 nt, Pseudomonas putida KT2440
aacaaguucaaggucau

SEQ ID NO: 1577003 - RNA, 23 nt, Pseudomonas putida KT2440
aacaaguucaaggucaucgcugc

SEQ ID NO: 1577004 - RNA, 19 nt, Pseudomonas putida KT2440
aacaaguccacgaaccugu

SEQ ID NO: 1577005 - RNA, 14 nt, Pseudomonas putida KT2440
aacaaugcacagcg

SEQ ID NO: 1577006 - RNA, 16 nt, Pseudomonas putida KT2440
cgacggcauggccgaa

SEQ ID NO: 1577007 - RNA, 22 nt, Pseudomonas putida KT2440
cgacggcgcaauccgugagcca

SEQ ID NO: 1577008 - RNA, 18 nt, Pseudomonas putida KT2440
cgacgauggccaccagca

SEQ ID NO: 1577009 - RNA, 15 nt, Pseudomonas putida KT2440
cgacgccaccuucgc

SEQ ID NO: 1577010 - RNA, 20 nt, Pseudomonas putida KT2440
cgacgccaacaauagccccg

SEQ ID NO: 1577011 - RNA, 22 nt, Pseudomonas putida KT2440
cgacggucauggucguguugag

SEQ ID NO: 1577012 - RNA, 22 nt, Pseudomonas putida KT2440
cgacggcucuugauguugaaga

SEQ ID NO: 1577013 - RNA, 21 nt, Pseudomonas putida KT2440
cgggcauaacgccccagcagu

SEQ ID NO: 1577014 - RNA, 20 nt, Pseudomonas putida KT2440
cgggcaguucgaugcgaagc

SEQ ID NO: 1577015 - RNA, 16 nt, Pseudomonas putida KT2440
cgggcagcgggcucgc

SEQ ID NO: 1577016 - RNA, 15 nt, Pseudomonas putida KT2440
cgggccaucggugcc

SEQ ID NO: 1577017 - RNA, 16 nt, Pseudomonas putida KT2440
cgggccaucggugccg

SEQ ID NO: 1577018 - RNA, 22 nt, Pseudomonas putida KT2440
cgggccagccgcgccaggucgg

SEQ ID NO: 1577019 - RNA, 15 nt, Pseudomonas putida KT2440
cgggcaacugcgccu

SEQ ID NO: 1577020 - RNA, 20 nt, Pseudomonas putida KT2440
cgggcaagcccgcucccaca

SEQ ID NO: 1577021 - RNA, 13 nt, Pseudomonas putida KT2440
cgggcaaggcugg

SEQ ID NO: 1577022 - RNA, 16 nt, Pseudomonas putida KT2440
cgggcaaggucgaugc

SEQ ID NO: 1577023 - RNA, 14 nt, Pseudomonas putida KT2440
cgggcacaccuggu

SEQ ID NO: 1577024 - RNA, 17 nt, Pseudomonas putida KT2440
cgggcagccgucggcgu

SEQ ID NO: 1577025 - RNA, 13 nt, Pseudomonas putida KT2440
cgggcagccgacu

SEQ ID NO: 1577026 - RNA, 16 nt, Pseudomonas putida KT2440
cgggcaauggccacac

SEQ ID NO: 1577027 - RNA, 22 nt, Pseudomonas putida KT2440
cgggcagacuucggucuggccg

SEQ ID NO: 1577028 - RNA, 23 nt, Pseudomonas putida KT2440
cgggcagacuucggucuggccga

SEQ ID NO: 1577029 - RNA, 17 nt, Pseudomonas putida KT2440
cgggcagaccugcuggc

SEQ ID NO: 1577030 - RNA, 22 nt, Pseudomonas putida KT2440
cgggcagaccugcuggcacugc

SEQ ID NO: 1577031 - RNA, 14 nt, Pseudomonas putida KT2440
cgggcacugcccgg

SEQ ID NO: 1577032 - RNA, 19 nt, Pseudomonas putida KT2440
cgggauggcggcgccugcc

SEQ ID NO: 1577033 - RNA, 13 nt, Pseudomonas putida KT2440
cgggauguucagg

SEQ ID NO: 1577034 - RNA, 23 nt, Pseudomonas putida KT2440
cgggauguuggucuugaugccgu

SEQ ID NO: 1577035 - RNA, 11 nt, Pseudomonas putida KT2440
cgggaucagca

SEQ ID NO: 1577036 - RNA, 12 nt, Pseudomonas putida KT2440
cgggaucagcac

SEQ ID NO: 1577037 - RNA, 23 nt, Pseudomonas putida KT2440
cgggaucagcacgcccaucagcg

SEQ ID NO: 1577038 - RNA, 16 nt, Pseudomonas putida KT2440
cgggaucaugccgaag

SEQ ID NO: 1577039 - RNA, 15 nt, Pseudomonas putida KT2440
cgggagagcagggcu

SEQ ID NO: 1577040 - RNA, 17 nt, Pseudomonas putida KT2440
cgggagagcagggcugc

SEQ ID NO: 1577041 - RNA, 21 nt, Pseudomonas putida KT2440
cgggauaaccgcagauggccg

SEQ ID NO: 1577042 - RNA, 22 nt, Pseudomonas putida KT2440
cgggauaaccgcagauggccgc

SEQ ID NO: 1577043 - RNA, 17 nt, Pseudomonas putida KT2440
cgggaauugcagcccgc

SEQ ID NO: 1577044 - RNA, 18 nt, Pseudomonas putida KT2440
cgggaaugaacugcaacu

SEQ ID NO: 1577045 - RNA, 21 nt, Pseudomonas putida KT2440
cggcugaugguggucggcagc

SEQ ID NO: 1577046 - RNA, 16 nt, Pseudomonas putida KT2440
cggcugagccggcugg

SEQ ID NO: 1577047 - RNA, 19 nt, Pseudomonas putida KT2440
cggcugaccuguucgcgca

SEQ ID NO: 1577048 - RNA, 18 nt, Pseudomonas putida KT2440
cggcguggaugaucggcu

SEQ ID NO: 1577049 - RNA, 14 nt, Pseudomonas putida KT2440
cggcgugguccagc

SEQ ID NO: 1577050 - RNA, 14 nt, Pseudomonas putida KT2440
cggcuggcgcaugc

SEQ ID NO: 1577051 - RNA, 15 nt, Pseudomonas putida KT2440
cggcuguuccucgcc

SEQ ID NO: 1577052 - RNA, 14 nt, Pseudomonas putida KT2440
cggcuguucgcagc

SEQ ID NO: 1577053 - RNA, 15 nt, Pseudomonas putida KT2440
cggcuguucgcagca

SEQ ID NO: 1577054 - RNA, 16 nt, Pseudomonas putida KT2440
cggcuugccggcaaua

SEQ ID NO: 1577055 - RNA, 22 nt, Pseudomonas putida KT2440
cggcuugcuccaagugccgugc

SEQ ID NO: 1577056 - RNA, 20 nt, Pseudomonas putida KT2440
cggcuuggcacgaaacgcca

SEQ ID NO: 1577057 - RNA, 22 nt, Pseudomonas putida KT2440
cggcuugcgcccguaacgguca

SEQ ID NO: 1577058 - RNA, 12 nt, Pseudomonas putida KT2440
cggcuugcgccg

SEQ ID NO: 1577059 - RNA, 15 nt, Pseudomonas putida KT2440
cggcuuucagcgccg

SEQ ID NO: 1577060 - RNA, 17 nt, Pseudomonas putida KT2440
cgggaaaagccugccag

SEQ ID NO: 1577061 - RNA, 19 nt, Pseudomonas putida KT2440
cggcuuuuuuguuuggcuu

SEQ ID NO: 1577062 - RNA, 12 nt, Pseudomonas putida KT2440
cgggaaguccgc

SEQ ID NO: 1577063 - RNA, 18 nt, Pseudomonas putida KT2440
cgggaaguuacgggucga

SEQ ID NO: 1577064 - RNA, 23 nt, Pseudomonas putida KT2440
cgggaaguuacgggucgaggugg

SEQ ID NO: 1577065 - RNA, 17 nt, Pseudomonas putida KT2440
cgggaagguuuccagcc

SEQ ID NO: 1577066 - RNA, 15 nt, Pseudomonas putida KT2440
cgggaagccaugcac

SEQ ID NO: 1577067 - RNA, 20 nt, Pseudomonas putida KT2440
cggguaaacccauuccuaca

SEQ ID NO: 1577068 - RNA, 20 nt, Pseudomonas putida KT2440
cggguaaacccgcgccuaca

SEQ ID NO: 1577069 - RNA, 20 nt, Pseudomonas putida KT2440
cggguaaacccgcucccaca

SEQ ID NO: 1577070 - RNA, 20 nt, Pseudomonas putida KT2440
cggguaaacccgcuccuaca

SEQ ID NO: 1577071 - RNA, 20 nt, Pseudomonas putida KT2440
cggguaaacccgcuccuacg

SEQ ID NO: 1577072 - RNA, 22 nt, Pseudomonas putida KT2440
cgggguuuuuuuugcccggaau

SEQ ID NO: 1577073 - RNA, 21 nt, Pseudomonas putida KT2440
cggguaagccaugcgcaggca

SEQ ID NO: 1577074 - RNA, 20 nt, Pseudomonas putida KT2440
cggguaagcccgcuccuaca

SEQ ID NO: 1577075 - RNA, 21 nt, Pseudomonas putida KT2440
cggggugaucgacagguucga

SEQ ID NO: 1577076 - RNA, 13 nt, Pseudomonas putida KT2440
cggggcucacagc

SEQ ID NO: 1577077 - RNA, 20 nt, Pseudomonas putida KT2440
cggggcuuuuugauggugca

SEQ ID NO: 1577078 - RNA, 24 nt, Pseudomonas putida KT2440
cggggcaccuugaagugcgcaauc

SEQ ID NO: 1577079 - RNA, 18 nt, Pseudomonas putida KT2440
cggggcagcaucaccacg

SEQ ID NO: 1577080 - RNA, 15 nt, Pseudomonas putida KT2440
cggggcaucgccgag

SEQ ID NO: 1577081 - RNA, 19 nt, Pseudomonas putida KT2440
cggggaucuugcuggccgg

SEQ ID NO: 1577082 - RNA, 20 nt, Pseudomonas putida KT2440
cggggcaaacuucucgauga

SEQ ID NO: 1577083 - RNA, 17 nt, Pseudomonas putida KT2440
cggggauguugugggca

SEQ ID NO: 1577084 - RNA, 19 nt, Pseudomonas putida KT2440
cggggaggccgucaggccu

SEQ ID NO: 1577085 - RNA, 15 nt, Pseudomonas putida KT2440
cgggccugcuggcga

SEQ ID NO: 1577086 - RNA, 21 nt, Pseudomonas putida KT2440
cgggccuucaaccucacuggc

SEQ ID NO: 1577087 - RNA, 23 nt, Pseudomonas putida KT2440
cgggccuucaaccucacuggcau

SEQ ID NO: 1577088 - RNA, 20 nt, Pseudomonas putida KT2440
cgggcgugcccgcgaaugca

SEQ ID NO: 1577089 - RNA, 19 nt, Pseudomonas putida KT2440
cgggcgugccugcgaaugg

SEQ ID NO: 1577090 - RNA, 18 nt, Pseudomonas putida KT2440
cgggcuuggugaugggcg

SEQ ID NO: 1577091 - RNA, 18 nt, Pseudomonas putida KT2440
cgggcuugugcaucagcg

SEQ ID NO: 1577092 - RNA, 18 nt, Pseudomonas putida KT2440
cgggcuugcccgcgaagg

SEQ ID NO: 1577093 - RNA, 19 nt, Pseudomonas putida KT2440
cgggcuugcccgcgaaugg

SEQ ID NO: 1577094 - RNA, 21 nt, Pseudomonas putida KT2440
cgggcuuuuuuuguuggccug

SEQ ID NO: 1577095 - RNA, 23 nt, Pseudomonas putida KT2440
cgggcuuuuuuuguuggccugga

SEQ ID NO: 1577096 - RNA, 19 nt, Pseudomonas putida KT2440
cgggcuuccagucggccug

SEQ ID NO: 1577097 - RNA, 22 nt, Pseudomonas putida KT2440
cgggcugucgagcagguucagg

SEQ ID NO: 1577098 - RNA, 15 nt, Pseudomonas putida KT2440
cgggcugcugcgcag

SEQ ID NO: 1577099 - RNA, 16 nt, Pseudomonas putida KT2440
cgggcugcugcgcagc

SEQ ID NO: 1577100 - RNA, 17 nt, Pseudomonas putida KT2440
cgggcugcugcgcagcc

SEQ ID NO: 1577101 - RNA, 16 nt, Pseudomonas putida KT2440
cggcggccugcugccg

SEQ ID NO: 1577102 - RNA, 18 nt, Pseudomonas putida KT2440
cggcggcgaucagcgcgg

SEQ ID NO: 1577103 - RNA, 14 nt, Pseudomonas putida KT2440
cggcggccugcagc

SEQ ID NO: 1577104 - RNA, 16 nt, Pseudomonas putida KT2440
cggcggcuaagcgcca

SEQ ID NO: 1577105 - RNA, 19 nt, Pseudomonas putida KT2440
cggcggcuaagcgccagca

SEQ ID NO: 1577106 - RNA, 13 nt, Pseudomonas putida KT2440
cggcggcgugagc

SEQ ID NO: 1577107 - RNA, 23 nt, Pseudomonas putida KT2440
cggcggguggaaauuggccagca

SEQ ID NO: 1577108 - RNA, 23 nt, Pseudomonas putida KT2440
cggcggguggaaauuggcgagca

SEQ ID NO: 1577109 - RNA, 22 nt, Pseudomonas putida KT2440
cggcggguggagauuggucggc

SEQ ID NO: 1577110 - RNA, 23 nt, Pseudomonas putida KT2440
cggcggguggagauuggucggca

SEQ ID NO: 1577111 - RNA, 14 nt, Pseudomonas putida KT2440
cggcggugccugca

SEQ ID NO: 1577112 - RNA, 15 nt, Pseudomonas putida KT2440
cggcggugacacugc

SEQ ID NO: 1577113 - RNA, 16 nt, Pseudomonas putida KT2440
cggcggugacacugcc

SEQ ID NO: 1577114 - RNA, 18 nt, Pseudomonas putida KT2440
cggcgguugucgucgacc

SEQ ID NO: 1577115 - RNA, 16 nt, Pseudomonas putida KT2440
cggcgguucugcgcac

SEQ ID NO: 1577116 - RNA, 17 nt, Pseudomonas putida KT2440
cggcgguucugcgcacg

SEQ ID NO: 1577117 - RNA, 21 nt, Pseudomonas putida KT2440
cggcgguucugcgcacgacca

SEQ ID NO: 1577118 - RNA, 20 nt, Pseudomonas putida KT2440
cggcgguucuucaacuccug

SEQ ID NO: 1577119 - RNA, 24 nt, Pseudomonas putida KT2440
cggcgguuaagaaggcgaauagca

SEQ ID NO: 1577120 - RNA, 22 nt, Pseudomonas putida KT2440
cggcgucaacgguaacguuggc

SEQ ID NO: 1577121 - RNA, 12 nt, Pseudomonas putida KT2440
cggcguccaggc

SEQ ID NO: 1577122 - RNA, 17 nt, Pseudomonas putida KT2440
cggcguauggcuucacg

SEQ ID NO: 1577123 - RNA, 19 nt, Pseudomonas putida KT2440
cggcgugauuuucguugag

SEQ ID NO: 1577124 - RNA, 16 nt, Pseudomonas putida KT2440
cggcgugacgugcgcu

SEQ ID NO: 1577125 - RNA, 21 nt, Pseudomonas putida KT2440
cggcgucgaucugcagguggu

SEQ ID NO: 1577126 - RNA, 14 nt, Pseudomonas putida KT2440
cggcgccggccgca

SEQ ID NO: 1577127 - RNA, 14 nt, Pseudomonas putida KT2440
cggcgcggcccugu

SEQ ID NO: 1577128 - RNA, 14 nt, Pseudomonas putida KT2440
cggcgcuuggccgg

SEQ ID NO: 1577129 - RNA, 18 nt, Pseudomonas putida KT2440
cggcgcugucggucagca

SEQ ID NO: 1577130 - RNA, 13 nt, Pseudomonas putida KT2440
cggcgcugggcuu

SEQ ID NO: 1577131 - RNA, 21 nt, Pseudomonas putida KT2440
cggcgcgugccgcaugugcca

SEQ ID NO: 1577132 - RNA, 18 nt, Pseudomonas putida KT2440
cggcggccagcacgaaca

SEQ ID NO: 1577133 - RNA, 21 nt, Pseudomonas putida KT2440
cggcggccagcacgaacagca

SEQ ID NO: 1577134 - RNA, 13 nt, Pseudomonas putida KT2440
cggcggcagcggc

SEQ ID NO: 1577135 - RNA, 18 nt, Pseudomonas putida KT2440
cggcggcacugaugccca

SEQ ID NO: 1577136 - RNA, 14 nt, Pseudomonas putida KT2440
cggcggcaacggug

SEQ ID NO: 1577137 - RNA, 13 nt, Pseudomonas putida KT2440
cggcgcagggccu

SEQ ID NO: 1577138 - RNA, 20 nt, Pseudomonas putida KT2440
cggcgccaggccuuucagcg

SEQ ID NO: 1577139 - RNA, 18 nt, Pseudomonas putida KT2440
cggcgcaggccgacaaca

SEQ ID NO: 1577140 - RNA, 20 nt, Pseudomonas putida KT2440
cggcgcccagcaacaugccg

SEQ ID NO: 1577141 - RNA, 21 nt, Pseudomonas putida KT2440
cggcgcccagcaacaugccgg

SEQ ID NO: 1577142 - RNA, 22 nt, Pseudomonas putida KT2440
cggcgccaucggcacgccagca

SEQ ID NO: 1577143 - RNA, 17 nt, Pseudomonas putida KT2440
cggcgccauaggcuugc

SEQ ID NO: 1577144 - RNA, 19 nt, Pseudomonas putida KT2440
cggcgcaccgcuugcgcac

SEQ ID NO: 1577145 - RNA, 20 nt, Pseudomonas putida KT2440
cggcgauggucaaccggcca

SEQ ID NO: 1577146 - RNA, 16 nt, Pseudomonas putida KT2440
cggcgauggcgucgac

SEQ ID NO: 1577147 - RNA, 18 nt, Pseudomonas putida KT2440
cggcgaucugucaggugu

SEQ ID NO: 1577148 - RNA, 13 nt, Pseudomonas putida KT2440
cggccuuggcgcg

SEQ ID NO: 1577149 - RNA, 22 nt, Pseudomonas putida KT2440
cggcgaucgccagguggaagcg

SEQ ID NO: 1577150 - RNA, 14 nt, Pseudomonas putida KT2440
cggccuuguucaac

SEQ ID NO: 1577151 - RNA, 17 nt, Pseudomonas putida KT2440
cggcgaaaagccgggua

SEQ ID NO: 1577152 - RNA, 20 nt, Pseudomonas putida KT2440
cggaucugacggcgcugcug

SEQ ID NO: 1577153 - RNA, 22 nt, Pseudomonas putida KT2440
cggaucaucggcacgcccagca

SEQ ID NO: 1577154 - RNA, 19 nt, Pseudomonas putida KT2440
cggaucgacgcaaugaucg

SEQ ID NO: 1577155 - RNA, 22 nt, Pseudomonas putida KT2440
cggaucgauguacuuguucagg

SEQ ID NO: 1577156 - RNA, 18 nt, Pseudomonas putida KT2440
cggaucggcgugguccag

SEQ ID NO: 1577157 - RNA, 20 nt, Pseudomonas putida KT2440
cggaugcgcuucauccagcg

SEQ ID NO: 1577158 - RNA, 14 nt, Pseudomonas putida KT2440
cggaugcgccuggc

SEQ ID NO: 1577159 - RNA, 15 nt, Pseudomonas putida KT2440
cggaugcgccuggcc

SEQ ID NO: 1577160 - RNA, 16 nt, Pseudomonas putida KT2440
cggauggugugcagca

SEQ ID NO: 1577161 - RNA, 15 nt, Pseudomonas putida KT2440
cggauguuggccacg

SEQ ID NO: 1577162 - RNA, 19 nt, Pseudomonas putida KT2440
cggcaaacuucucgccuca

SEQ ID NO: 1577163 - RNA, 22 nt, Pseudomonas putida KT2440
aacaggucgccgcuguucagcc

SEQ ID NO: 1577164 - RNA, 14 nt, Pseudomonas putida KT2440
aacaggugcucacc

SEQ ID NO: 1577165 - RNA, 15 nt, Pseudomonas putida KT2440
aacaggugcucacca

SEQ ID NO: 1577166 - RNA, 17 nt, Pseudomonas putida KT2440
cggcaccgucgccugca

SEQ ID NO: 1577167 - RNA, 17 nt, Pseudomonas putida KT2440
cggcacaucucaaggcu

SEQ ID NO: 1577168 - RNA, 22 nt, Pseudomonas putida KT2440
cggcaccagcaccagcuccugg

SEQ ID NO: 1577169 - RNA, 21 nt, Pseudomonas putida KT2440
cggcacaccacgccaaccuga

SEQ ID NO: 1577170 - RNA, 17 nt, Pseudomonas putida KT2440
cggcacaaccgaacccg

SEQ ID NO: 1577171 - RNA, 15 nt, Pseudomonas putida KT2440
cggcacagcccagcu

SEQ ID NO: 1577172 - RNA, 15 nt, Pseudomonas putida KT2440
cggcacaggaaggca

SEQ ID NO: 1577173 - RNA, 17 nt, Pseudomonas putida KT2440
cggcacagugccaagga

SEQ ID NO: 1577174 - RNA, 23 nt, Pseudomonas putida KT2440
cggcacagugccaaggaccagac

SEQ ID NO: 1577175 - RNA, 12 nt, Pseudomonas putida KT2440
cggcaauggccg

SEQ ID NO: 1577176 - RNA, 18 nt, Pseudomonas putida KT2440
cggcaauugccaccggcg

SEQ ID NO: 1577177 - RNA, 17 nt, Pseudomonas putida KT2440
cggcaauucgccggcag

SEQ ID NO: 1577178 - RNA, 19 nt, Pseudomonas putida KT2440
cggcaauacaacgaucagc

SEQ ID NO: 1577179 - RNA, 22 nt, Pseudomonas putida KT2440
cggcaauaccgauuaucgagcu

SEQ ID NO: 1577180 - RNA, 13 nt, Pseudomonas putida KT2440
cggcaaucgacuc

SEQ ID NO: 1577181 - RNA, 21 nt, Pseudomonas putida KT2440
cggcaauccgcuggaauggug

SEQ ID NO: 1577182 - RNA, 16 nt, Pseudomonas putida KT2440
cggcaaucugcagcag

SEQ ID NO: 1577183 - RNA, 14 nt, Pseudomonas putida KT2440
cggcaaugcgcgcg

SEQ ID NO: 1577184 - RNA, 18 nt, Pseudomonas putida KT2440
cggcaaugcgcgcgaagg

SEQ ID NO: 1577185 - RNA, 20 nt, Pseudomonas putida KT2440
cggcaaugcgccggucgcgu

SEQ ID NO: 1577186 - RNA, 19 nt, Pseudomonas putida KT2440
cggcaaucgggauggcacc

SEQ ID NO: 1577187 - RNA, 21 nt, Pseudomonas putida KT2440
cggcaauccugggugaaacgg

SEQ ID NO: 1577188 - RNA, 18 nt, Pseudomonas putida KT2440
cggcaaucgccaggcgca

SEQ ID NO: 1577189 - RNA, 13 nt, Pseudomonas putida KT2440
cggcaaugaccaa

SEQ ID NO: 1577190 - RNA, 21 nt, Pseudomonas putida KT2440
cggcaaugaccaagcaacgca

SEQ ID NO: 1577191 - RNA, 17 nt, Pseudomonas putida KT2440
cggcaagcccauggcug

SEQ ID NO: 1577192 - RNA, 20 nt, Pseudomonas putida KT2440
cggcaagcccauggcuggca

SEQ ID NO: 1577193 - RNA, 21 nt, Pseudomonas putida KT2440
cggcaagcccauggcuggcag

SEQ ID NO: 1577194 - RNA, 19 nt, Pseudomonas putida KT2440
cggcaagcccgcuccuaca

SEQ ID NO: 1577195 - RNA, 18 nt, Pseudomonas putida KT2440
cggcaagguagccugcug

SEQ ID NO: 1577196 - RNA, 23 nt, Pseudomonas putida KT2440
cggcaagguagccugcugacgca

SEQ ID NO: 1577197 - RNA, 22 nt, Pseudomonas putida KT2440
cggcaaggucaacggcaacgcc

SEQ ID NO: 1577198 - RNA, 16 nt, Pseudomonas putida KT2440
cggcaagcuugccagc

SEQ ID NO: 1577199 - RNA, 19 nt, Pseudomonas putida KT2440
cggcaaggcgaccugccag

SEQ ID NO: 1577200 - RNA, 17 nt, Pseudomonas putida KT2440
cggcaacuccuccagcc

SEQ ID NO: 1577201 - RNA, 14 nt, Pseudomonas putida KT2440
cggcaacuggcaca

SEQ ID NO: 1577202 - RNA, 21 nt, Pseudomonas putida KT2440
cggcaacggccgugcgccuga

SEQ ID NO: 1577203 - RNA, 16 nt, Pseudomonas putida KT2440
cggcaacgauggucgc

SEQ ID NO: 1577204 - RNA, 16 nt, Pseudomonas putida KT2440
cggcaaccugcucgcu

SEQ ID NO: 1577205 - RNA, 18 nt, Pseudomonas putida KT2440
cggcaaccugcucgcuca

SEQ ID NO: 1577206 - RNA, 19 nt, Pseudomonas putida KT2440
cggcaacccuucggccagc

SEQ ID NO: 1577207 - RNA, 17 nt, Pseudomonas putida KT2440
cggcaaccauggcuucg

SEQ ID NO: 1577208 - RNA, 13 nt, Pseudomonas putida KT2440
cggcaacccggca

SEQ ID NO: 1577209 - RNA, 14 nt, Pseudomonas putida KT2440
cggcaacccggcag

SEQ ID NO: 1577210 - RNA, 14 nt, Pseudomonas putida KT2440
cggcaacaccagca

SEQ ID NO: 1577211 - RNA, 17 nt, Pseudomonas putida KT2440
cggcaacaccagcagcc

SEQ ID NO: 1577212 - RNA, 20 nt, Pseudomonas putida KT2440
cggcaacauucaccagccag

SEQ ID NO: 1577213 - RNA, 14 nt, Pseudomonas putida KT2440
cggaccagcgccgc

SEQ ID NO: 1577214 - RNA, 15 nt, Pseudomonas putida KT2440
cgcugacucagcggc

SEQ ID NO: 1577215 - RNA, 18 nt, Pseudomonas putida KT2440
cgcugacucagcggccuu

SEQ ID NO: 1577216 - RNA, 14 nt, Pseudomonas putida KT2440
cgcugacugccagg

SEQ ID NO: 1577217 - RNA, 15 nt, Pseudomonas putida KT2440
cgcugacuuccagca

SEQ ID NO: 1577218 - RNA, 15 nt, Pseudomonas putida KT2440
cgcugagcgacagca

SEQ ID NO: 1577219 - RNA, 12 nt, Pseudomonas putida KT2440
cggacaggcgcu

SEQ ID NO: 1577220 - RNA, 14 nt, Pseudomonas putida KT2440
cggacgucccagca

SEQ ID NO: 1577221 - RNA, 17 nt, Pseudomonas putida KT2440
cggacgcuugccaccca

SEQ ID NO: 1577222 - RNA, 20 nt, Pseudomonas putida KT2440
cggacucauagcucagcugg

SEQ ID NO: 1577223 - RNA, 20 nt, Pseudomonas putida KT2440
cggagauuggccagcaggcc

SEQ ID NO: 1577224 - RNA, 15 nt, Pseudomonas putida KT2440
cggagccaaucucgg

SEQ ID NO: 1577225 - RNA, 18 nt, Pseudomonas putida KT2440
cggagaacaugaaaguga

SEQ ID NO: 1577226 - RNA, 14 nt, Pseudomonas putida KT2440
cggagcuggagccg

SEQ ID NO: 1577227 - RNA, 20 nt, Pseudomonas putida KT2440
cggaggugucaccgcgagca

SEQ ID NO: 1577228 - RNA, 22 nt, Pseudomonas putida KT2440
cggaggugucaccgcgagcagc

SEQ ID NO: 1577229 - RNA, 21 nt, Pseudomonas putida KT2440
cggauagagcccggcgcagcc

SEQ ID NO: 1577230 - RNA, 17 nt, Pseudomonas putida KT2440
cggauagaacgggucau

SEQ ID NO: 1577231 - RNA, 14 nt, Pseudomonas putida KT2440
cggauacagcgccc

SEQ ID NO: 1577232 - RNA, 17 nt, Pseudomonas putida KT2440
cggauacaucgcauaca

SEQ ID NO: 1577233 - RNA, 24 nt, Pseudomonas putida KT2440
cggauacaucgcauacagcgcacu

SEQ ID NO: 1577234 - RNA, 19 nt, Pseudomonas putida KT2440
cggaucaccacgucuuccu

SEQ ID NO: 1577235 - RNA, 16 nt, Pseudomonas putida KT2440
cggauaucugcgccac

SEQ ID NO: 1577236 - RNA, 18 nt, Pseudomonas putida KT2440
cggccagaccuugcgcac

SEQ ID NO: 1577237 - RNA, 19 nt, Pseudomonas putida KT2440
cggccagaccuugcgcacg

SEQ ID NO: 1577238 - RNA, 15 nt, Pseudomonas putida KT2440
cggccacuucgcgga

SEQ ID NO: 1577239 - RNA, 15 nt, Pseudomonas putida KT2440
cggccacgucggugg

SEQ ID NO: 1577240 - RNA, 14 nt, Pseudomonas putida KT2440
cggccacgaaggcc

SEQ ID NO: 1577241 - RNA, 15 nt, Pseudomonas putida KT2440
cggccacgaaggccg

SEQ ID NO: 1577242 - RNA, 17 nt, Pseudomonas putida KT2440
cggccacgaaggccggu

SEQ ID NO: 1577243 - RNA, 16 nt, Pseudomonas putida KT2440
cggccagcggcaugug

SEQ ID NO: 1577244 - RNA, 20 nt, Pseudomonas putida KT2440
cggccagcccgccacccgcu

SEQ ID NO: 1577245 - RNA, 23 nt, Pseudomonas putida KT2440
cggccagcagguugaacagguug

SEQ ID NO: 1577246 - RNA, 17 nt, Pseudomonas putida KT2440
cggccagccaacggcau

SEQ ID NO: 1577247 - RNA, 19 nt, Pseudomonas putida KT2440
cggccagcaggucagcacg

SEQ ID NO: 1577248 - RNA, 19 nt, Pseudomonas putida KT2440
cggccaguuucagcgccuu

SEQ ID NO: 1577249 - RNA, 15 nt, Pseudomonas putida KT2440
cggccagugcgcccg

SEQ ID NO: 1577250 - RNA, 23 nt, Pseudomonas putida KT2440
cggccagugcgcccgaggcaauc

SEQ ID NO: 1577251 - RNA, 21 nt, Pseudomonas putida KT2440
cggccaggccgugcuugaggc

SEQ ID NO: 1577252 - RNA, 12 nt, Pseudomonas putida KT2440
cggccagggccc

SEQ ID NO: 1577253 - RNA, 16 nt, Pseudomonas putida KT2440
cggccaggccggcgca

SEQ ID NO: 1577254 - RNA, 21 nt, Pseudomonas putida KT2440
cggccaugaucucgcccauga

SEQ ID NO: 1577255 - RNA, 13 nt, Pseudomonas putida KT2440
cggccauggccga

SEQ ID NO: 1577256 - RNA, 12 nt, Pseudomonas putida KT2440
cggccauggccg

SEQ ID NO: 1577257 - RNA, 14 nt, Pseudomonas putida KT2440
cggccauggccgag

SEQ ID NO: 1577258 - RNA, 21 nt, Pseudomonas putida KT2440
cggcccacagugcuuccagca

SEQ ID NO: 1577259 - RNA, 12 nt, Pseudomonas putida KT2440
cggccaugccac

SEQ ID NO: 1577260 - RNA, 18 nt, Pseudomonas putida KT2440
cggcccagccagucgcgc

SEQ ID NO: 1577261 - RNA, 22 nt, Pseudomonas putida KT2440
cggcccaucccgcuucgccagc

SEQ ID NO: 1577262 - RNA, 14 nt, Pseudomonas putida KT2440
cggccccaaugaau

SEQ ID NO: 1577263 - RNA, 18 nt, Pseudomonas putida KT2440
cggcccaugucgaucagc

SEQ ID NO: 1577264 - RNA, 22 nt, Pseudomonas putida KT2440
cggcccaugucgaucagcggcu

SEQ ID NO: 1577265 - RNA, 20 nt, Pseudomonas putida KT2440
cggcccauucgcggguaaac

SEQ ID NO: 1577266 - RNA, 21 nt, Pseudomonas putida KT2440
cggcccacggcgucuggucgc

SEQ ID NO: 1577267 - RNA, 21 nt, Pseudomonas putida KT2440
cggcaucacuacccaggccaa

SEQ ID NO: 1577268 - RNA, 23 nt, Pseudomonas putida KT2440
cggcaucagcucauacggguguu

SEQ ID NO: 1577269 - RNA, 21 nt, Pseudomonas putida KT2440
cggcaucauccugcucgacaa

SEQ ID NO: 1577270 - RNA, 17 nt, Pseudomonas putida KT2440
cggcaucgacgaugccg

SEQ ID NO: 1577271 - RNA, 20 nt, Pseudomonas putida KT2440
cggcaucgacgaugccguac

SEQ ID NO: 1577272 - RNA, 13 nt, Pseudomonas putida KT2440
cggcaucgaagcg

SEQ ID NO: 1577273 - RNA, 16 nt, Pseudomonas putida KT2440
cggcaucgaagguggu

SEQ ID NO: 1577274 - RNA, 13 nt, Pseudomonas putida KT2440
cggcaucgaacag

SEQ ID NO: 1577275 - RNA, 14 nt, Pseudomonas putida KT2440
cggcaucgaacagc

SEQ ID NO: 1577276 - RNA, 16 nt, Pseudomonas putida KT2440
cggcauccucaagcug

SEQ ID NO: 1577277 - RNA, 17 nt, Pseudomonas putida KT2440
cggcauccucaagcugc

SEQ ID NO: 1577278 - RNA, 11 nt, Pseudomonas putida KT2440
cggcaggucga

SEQ ID NO: 1577279 - RNA, 11 nt, Pseudomonas putida KT2440
cggcaggucgg

SEQ ID NO: 1577280 - RNA, 15 nt, Pseudomonas putida KT2440
cggcagcucaccggc

SEQ ID NO: 1577281 - RNA, 16 nt, Pseudomonas putida KT2440
cggcagcucaccggca

SEQ ID NO: 1577282 - RNA, 17 nt, Pseudomonas putida KT2440
cggcagcucaccggcaa

SEQ ID NO: 1577283 - RNA, 15 nt, Pseudomonas putida KT2440
cggcagcucgccgug

SEQ ID NO: 1577284 - RNA, 16 nt, Pseudomonas putida KT2440
cggccacccuccgggu

SEQ ID NO: 1577285 - RNA, 19 nt, Pseudomonas putida KT2440
cggccacaucggcaaguug

SEQ ID NO: 1577286 - RNA, 17 nt, Pseudomonas putida KT2440
cggccaccgccgggugg

SEQ ID NO: 1577287 - RNA, 13 nt, Pseudomonas putida KT2440
cggccaccgccuc

SEQ ID NO: 1577288 - RNA, 14 nt, Pseudomonas putida KT2440
cggccaccuggucg

SEQ ID NO: 1577289 - RNA, 14 nt, Pseudomonas putida KT2440
cggccaccuggccu

SEQ ID NO: 1577290 - RNA, 15 nt, Pseudomonas putida KT2440
cggccaccuggccuu

SEQ ID NO: 1577291 - RNA, 12 nt, Pseudomonas putida KT2440
cggcauggcgug

SEQ ID NO: 1577292 - RNA, 20 nt, Pseudomonas putida KT2440
cggcauggcgugcccggcaa

SEQ ID NO: 1577293 - RNA, 16 nt, Pseudomonas putida KT2440
cggcaugucgaugcgg

SEQ ID NO: 1577294 - RNA, 18 nt, Pseudomonas putida KT2440
cggcaugugcacuggcag

SEQ ID NO: 1577295 - RNA, 19 nt, Pseudomonas putida KT2440
cggcaugugcacuggcagg

SEQ ID NO: 1577296 - RNA, 15 nt, Pseudomonas putida KT2440
cggcaugugcggguu

SEQ ID NO: 1577297 - RNA, 13 nt, Pseudomonas putida KT2440
cggcauguucauc

SEQ ID NO: 1577298 - RNA, 18 nt, Pseudomonas putida KT2440
cggccgaucacucggcag

SEQ ID NO: 1577299 - RNA, 15 nt, Pseudomonas putida KT2440
cggccgaggccgggu

SEQ ID NO: 1577300 - RNA, 17 nt, Pseudomonas putida KT2440
cggccgcauccaugccg

SEQ ID NO: 1577301 - RNA, 13 nt, Pseudomonas putida KT2440
cggccgcauccug

SEQ ID NO: 1577302 - RNA, 23 nt, Pseudomonas putida KT2440
cggccgcacuucuguggaaaacc

SEQ ID NO: 1577303 - RNA, 21 nt, Pseudomonas putida KT2440
cggccgacccgccuggugcca

SEQ ID NO: 1577304 - RNA, 22 nt, Pseudomonas putida KT2440
cggccgacccgccuggugccag

SEQ ID NO: 1577305 - RNA, 16 nt, Pseudomonas putida KT2440
cggcccuucgcgggca

SEQ ID NO: 1577306 - RNA, 22 nt, Pseudomonas putida KT2440
cggcccuucuccgccuaccgcg

SEQ ID NO: 1577307 - RNA, 15 nt, Pseudomonas putida KT2440
cggcccuugcucaau

SEQ ID NO: 1577308 - RNA, 14 nt, Pseudomonas putida KT2440
cggcccuuggcagc

SEQ ID NO: 1577309 - RNA, 20 nt, Pseudomonas putida KT2440
cggcccuuggcagcgcugca

SEQ ID NO: 1577310 - RNA, 12 nt, Pseudomonas putida KT2440
cggcccggcugg

SEQ ID NO: 1577311 - RNA, 15 nt, Pseudomonas putida KT2440
cggcccggcuggcca

SEQ ID NO: 1577312 - RNA, 14 nt, Pseudomonas putida KT2440
cggccccaggguua

SEQ ID NO: 1577313 - RNA, 17 nt, Pseudomonas putida KT2440
cggccccaggguuaccu

SEQ ID NO: 1577314 - RNA, 15 nt, Pseudomonas putida KT2440
cggccccaggugcca

SEQ ID NO: 1577315 - RNA, 20 nt, Pseudomonas putida KT2440
cggccccacgcaguuggcca

SEQ ID NO: 1577316 - RNA, 13 nt, Pseudomonas putida KT2440
cggccccagggcu

SEQ ID NO: 1577317 - RNA, 15 nt, Pseudomonas putida KT2440
cggccgcuucgcgga

SEQ ID NO: 1577318 - RNA, 19 nt, Pseudomonas putida KT2440
cggccgccuccugcugcug

SEQ ID NO: 1577319 - RNA, 11 nt, Pseudomonas putida KT2440
cggccgcuugc

SEQ ID NO: 1577320 - RNA, 14 nt, Pseudomonas putida KT2440
cggccgugcagggc

SEQ ID NO: 1577321 - RNA, 20 nt, Pseudomonas putida KT2440
cggccguugaaggcgaauga

SEQ ID NO: 1577322 - RNA, 20 nt, Pseudomonas putida KT2440
cggccuauucgcggguaaac

SEQ ID NO: 1577323 - RNA, 14 nt, Pseudomonas putida KT2440
cggccucagcagcg

SEQ ID NO: 1577324 - RNA, 17 nt, Pseudomonas putida KT2440
cggccgggucgaaggca

SEQ ID NO: 1577325 - RNA, 15 nt, Pseudomonas putida KT2440
cggccgucgguaaac

SEQ ID NO: 1577326 - RNA, 20 nt, Pseudomonas putida KT2440
cggccucuucgcggguaaac

SEQ ID NO: 1577327 - RNA, 20 nt, Pseudomonas putida KT2440
cggccucuucgcggguaagc

SEQ ID NO: 1577328 - RNA, 21 nt, Pseudomonas putida KT2440
cggccucuucgcggguaagcc

SEQ ID NO: 1577329 - RNA, 20 nt, Pseudomonas putida KT2440
cggccucuucgcgggugaac

SEQ ID NO: 1577330 - RNA, 12 nt, Pseudomonas putida KT2440
cggccugcacaa

SEQ ID NO: 1577331 - RNA, 15 nt, Pseudomonas putida KT2440
cggccucggccgggu

SEQ ID NO: 1577332 - RNA, 20 nt, Pseudomonas putida KT2440
cggccuccucgcgggcaaac

SEQ ID NO: 1577333 - RNA, 18 nt, Pseudomonas putida KT2440
cggccuugaccucgacca

SEQ ID NO: 1577334 - RNA, 20 nt, Pseudomonas putida KT2440
cggccuucccgccuggcgcc

SEQ ID NO: 1577335 - RNA, 17 nt, Pseudomonas putida KT2440
cggccuguggguaaccc

SEQ ID NO: 1577336 - RNA, 16 nt, Pseudomonas putida KT2440
cggccuguguccaaca

SEQ ID NO: 1577337 - RNA, 16 nt, Pseudomonas putida KT2440
cggccuguugcgcacu

SEQ ID NO: 1577338 - RNA, 21 nt, Pseudomonas putida KT2440
cggccuguugcgcacugccgc

SEQ ID NO: 1577339 - RNA, 15 nt, Pseudomonas putida KT2440
cggccugggucagcu

SEQ ID NO: 1577340 - RNA, 22 nt, Pseudomonas putida KT2440
cggccugggucagcugguucug

SEQ ID NO: 1577341 - RNA, 21 nt, Pseudomonas putida KT2440
cggccugcauccacaccagcg

SEQ ID NO: 1577342 - RNA, 12 nt, Pseudomonas putida KT2440
cggccugcccgg

SEQ ID NO: 1577343 - RNA, 15 nt, Pseudomonas putida KT2440
cggccugccgcugac

SEQ ID NO: 1577344 - RNA, 13 nt, Pseudomonas putida KT2440
cgcgcaacgcgcc

SEQ ID NO: 1577345 - RNA, 22 nt, Pseudomonas putida KT2440
cgcgcaacgcgccauggccugg

SEQ ID NO: 1577346 - RNA, 16 nt, Pseudomonas putida KT2440
cgcgauggauggcacc

SEQ ID NO: 1577347 - RNA, 20 nt, Pseudomonas putida KT2440
cgcgaugcuugaggugcucg

SEQ ID NO: 1577348 - RNA, 22 nt, Pseudomonas putida KT2440
cgcgaugccgacagccaccgcg

SEQ ID NO: 1577349 - RNA, 14 nt, Pseudomonas putida KT2440
cgcgcaacugccca

SEQ ID NO: 1577350 - RNA, 19 nt, Pseudomonas putida KT2440
cgcgcaagcaggugcgcag

SEQ ID NO: 1577351 - RNA, 13 nt, Pseudomonas putida KT2440
cgcgauagcucag

SEQ ID NO: 1577352 - RNA, 18 nt, Pseudomonas putida KT2440
cgcgaucccugugggagc

SEQ ID NO: 1577353 - RNA, 19 nt, Pseudomonas putida KT2440
cgcgauccccugugggagc

SEQ ID NO: 1577354 - RNA, 12 nt, Pseudomonas putida KT2440
cgcgauacgccg

SEQ ID NO: 1577355 - RNA, 20 nt, Pseudomonas putida KT2440
cgcgauagggaucaccucgu

SEQ ID NO: 1577356 - RNA, 14 nt, Pseudomonas putida KT2440
cgcgauagccugug

SEQ ID NO: 1577357 - RNA, 20 nt, Pseudomonas putida KT2440
cgcgauagccuguggggcaa

SEQ ID NO: 1577358 - RNA, 24 nt, Pseudomonas putida KT2440
cgcgauagccuguggggcaacugc

SEQ ID NO: 1577359 - RNA, 15 nt, Pseudomonas putida KT2440
cgccugcugccaggc

SEQ ID NO: 1577360 - RNA, 14 nt, Pseudomonas putida KT2440
cgcgccgaccagua

SEQ ID NO: 1577361 - RNA, 18 nt, Pseudomonas putida KT2440
cgcgcccacgcgggucca

SEQ ID NO: 1577362 - RNA, 14 nt, Pseudomonas putida KT2440
cgcgcccaggccca

SEQ ID NO: 1577363 - RNA, 14 nt, Pseudomonas putida KT2440
cgcgcccgcgaaga

SEQ ID NO: 1577364 - RNA, 18 nt, Pseudomonas putida KT2440
cgcgccaucaaggccgac

SEQ ID NO: 1577365 - RNA, 18 nt, Pseudomonas putida KT2440
cgcgccccaagcgggcca

SEQ ID NO: 1577366 - RNA, 22 nt, Pseudomonas putida KT2440
cgcgccgccgcugcugcgccuc

SEQ ID NO: 1577367 - RNA, 12 nt, Pseudomonas putida KT2440
cgcgccgccgca

SEQ ID NO: 1577368 - RNA, 17 nt, Pseudomonas putida KT2440
cgcgcagguuguucggc

SEQ ID NO: 1577369 - RNA, 21 nt, Pseudomonas putida KT2440
cgcgcagggugccggccagcg

SEQ ID NO: 1577370 - RNA, 20 nt, Pseudomonas putida KT2440
cgcgcaggguuuucagcgcc

SEQ ID NO: 1577371 - RNA, 13 nt, Pseudomonas putida KT2440
cgcgcagggcguu

SEQ ID NO: 1577372 - RNA, 15 nt, Pseudomonas putida KT2440
cgcgcacuugccagc

SEQ ID NO: 1577373 - RNA, 14 nt, Pseudomonas putida KT2440
cgcgcagcgaacgc

SEQ ID NO: 1577374 - RNA, 13 nt, Pseudomonas putida KT2440
cgcgccagcucca

SEQ ID NO: 1577375 - RNA, 12 nt, Pseudomonas putida KT2440
cgcgccagcggg

SEQ ID NO: 1577376 - RNA, 22 nt, Pseudomonas putida KT2440
cgcgccagcgggucgucgccca

SEQ ID NO: 1577377 - RNA, 16 nt, Pseudomonas putida KT2440
cgcgccacgcaccagg

SEQ ID NO: 1577378 - RNA, 16 nt, Pseudomonas putida KT2440
cgcgccaggcugcgcu

SEQ ID NO: 1577379 - RNA, 16 nt, Pseudomonas putida KT2440
cgcgccaggguuugca

SEQ ID NO: 1577380 - RNA, 18 nt, Pseudomonas putida KT2440
cgcgccaguucgacgcug

SEQ ID NO: 1577381 - RNA, 19 nt, Pseudomonas putida KT2440
cgcgccaguucgcggcgca

SEQ ID NO: 1577382 - RNA, 18 nt, Pseudomonas putida KT2440
cgcgcaugcugugcccug

SEQ ID NO: 1577383 - RNA, 12 nt, Pseudomonas putida KT2440
cgcgcauggccg

SEQ ID NO: 1577384 - RNA, 18 nt, Pseudomonas putida KT2440
cgcgcauuucguccaggc

SEQ ID NO: 1577385 - RNA, 14 nt, Pseudomonas putida KT2440
cgcgccacccgcug

SEQ ID NO: 1577386 - RNA, 19 nt, Pseudomonas putida KT2440
cgcgccaaccgcgccagca

SEQ ID NO: 1577387 - RNA, 20 nt, Pseudomonas putida KT2440
cgcgccaaccgcgccagcaa

SEQ ID NO: 1577388 - RNA, 15 nt, Pseudomonas putida KT2440
cgcgccaaagccugg

SEQ ID NO: 1577389 - RNA, 20 nt, Pseudomonas putida KT2440
cgcgcggcuugcucgcggcg

SEQ ID NO: 1577390 - RNA, 16 nt, Pseudomonas putida KT2440
cgcgcggcucggccac

SEQ ID NO: 1577391 - RNA, 22 nt, Pseudomonas putida KT2440
cgcgcucacgcuugccaaggcu

SEQ ID NO: 1577392 - RNA, 14 nt, Pseudomonas putida KT2440
cgcgcucacugcau

SEQ ID NO: 1577393 - RNA, 20 nt, Pseudomonas putida KT2440
cgcgcuaccugguucaucga

SEQ ID NO: 1577394 - RNA, 20 nt, Pseudomonas putida KT2440
cgcgcuaaaggccgcuccug

SEQ ID NO: 1577395 - RNA, 17 nt, Pseudomonas putida KT2440
cgcgcuuugugugccca

SEQ ID NO: 1577396 - RNA, 21 nt, Pseudomonas putida KT2440
cgcgcuuucucuuugaucagc

SEQ ID NO: 1577397 - RNA, 23 nt, Pseudomonas putida KT2440
cgcgcugguaagccucgagcgcu

SEQ ID NO: 1577398 - RNA, 18 nt, Pseudomonas putida KT2440
cgcggaagauacccgcca

SEQ ID NO: 1577399 - RNA, 21 nt, Pseudomonas putida KT2440
cgcggaaauaccagacgcagg

SEQ ID NO: 1577400 - RNA, 13 nt, Pseudomonas putida KT2440
cgcggaacuggcu

SEQ ID NO: 1577401 - RNA, 18 nt, Pseudomonas putida KT2440
cgcggaacuggcugacca

SEQ ID NO: 1577402 - RNA, 23 nt, Pseudomonas putida KT2440
cgcgcuggccgcccgcccgcguc

SEQ ID NO: 1577403 - RNA, 15 nt, Pseudomonas putida KT2440
cgcgcugcgcaagga

SEQ ID NO: 1577404 - RNA, 13 nt, Pseudomonas putida KT2440
cgcgcugccaggc

SEQ ID NO: 1577405 - RNA, 14 nt, Pseudomonas putida KT2440
cgcgcugagcaggu

SEQ ID NO: 1577406 - RNA, 15 nt, Pseudomonas putida KT2440
cgcgcugagcagguu

SEQ ID NO: 1577407 - RNA, 16 nt, Pseudomonas putida KT2440
cgcgcgcccaggccca

SEQ ID NO: 1577408 - RNA, 14 nt, Pseudomonas putida KT2440
cgcgcgcgacagca

SEQ ID NO: 1577409 - RNA, 23 nt, Pseudomonas putida KT2440
cgcgccuucgcuggcgacgaagc

SEQ ID NO: 1577410 - RNA, 23 nt, Pseudomonas putida KT2440
cgcgccuugaggaccuugcgggu

SEQ ID NO: 1577411 - RNA, 18 nt, Pseudomonas putida KT2440
cgcgccuugauacgccca

SEQ ID NO: 1577412 - RNA, 15 nt, Pseudomonas putida KT2440
cgcgccuugcgcacg

SEQ ID NO: 1577413 - RNA, 17 nt, Pseudomonas putida KT2440
cgcgcgcagacgggcga

SEQ ID NO: 1577414 - RNA, 16 nt, Pseudomonas putida KT2440
cgcgccucgcggugca

SEQ ID NO: 1577415 - RNA, 18 nt, Pseudomonas putida KT2440
cgcgccuccagcuggcca

SEQ ID NO: 1577416 - RNA, 21 nt, Pseudomonas putida KT2440
cgcgccuacgacggccugcgc

SEQ ID NO: 1577417 - RNA, 22 nt, Pseudomonas putida KT2440
cgcgccuacgacggccugcgcc

SEQ ID NO: 1577418 - RNA, 22 nt, Pseudomonas putida KT2440
cgcgccuacagcggccugugca

SEQ ID NO: 1577419 - RNA, 20 nt, Pseudomonas putida KT2440
cgcgccuacaggcaaccgca

SEQ ID NO: 1577420 - RNA, 18 nt, Pseudomonas putida KT2440
cgcgccugcaccuggcug

SEQ ID NO: 1577421 - RNA, 17 nt, Pseudomonas putida KT2440
cgcucaagucugcauag

SEQ ID NO: 1577422 - RNA, 22 nt, Pseudomonas putida KT2440
cgcucaagucugcauaggcgcu

SEQ ID NO: 1577423 - RNA, 20 nt, Pseudomonas putida KT2440
cgcucaauggcaccgucagg

SEQ ID NO: 1577424 - RNA, 18 nt, Pseudomonas putida KT2440
cgcucaugaacagcgccc

SEQ ID NO: 1577425 - RNA, 20 nt, Pseudomonas putida KT2440
cgcucaugaacagcgcccag

SEQ ID NO: 1577426 - RNA, 19 nt, Pseudomonas putida KT2440
cgcucaacagguccacugc

SEQ ID NO: 1577427 - RNA, 21 nt, Pseudomonas putida KT2440
cgcucaagcgaggugacugca

SEQ ID NO: 1577428 - RNA, 15 nt, Pseudomonas putida KT2440
cgcuagucaagcugc

SEQ ID NO: 1577429 - RNA, 21 nt, Pseudomonas putida KT2440
cgcguugcggcccuucgcggg

SEQ ID NO: 1577430 - RNA, 20 nt, Pseudomonas putida KT2440
cgcguugauuuagcaggcac

SEQ ID NO: 1577431 - RNA, 19 nt, Pseudomonas putida KT2440
cgcguucuuucucccaggc

SEQ ID NO: 1577432 - RNA, 20 nt, Pseudomonas putida KT2440
cgcgucugcuucuucgcggg

SEQ ID NO: 1577433 - RNA, 16 nt, Pseudomonas putida KT2440
cgcgucugccgcagcc

SEQ ID NO: 1577434 - RNA, 21 nt, Pseudomonas putida KT2440
cgcguuacccaccagauucgc

SEQ ID NO: 1577435 - RNA, 16 nt, Pseudomonas putida KT2440
cgcgugugcaggugga

SEQ ID NO: 1577436 - RNA, 19 nt, Pseudomonas putida KT2440
cgcgucgucaugguccuug

SEQ ID NO: 1577437 - RNA, 17 nt, Pseudomonas putida KT2440
cgcucgcccagcagcca

SEQ ID NO: 1577438 - RNA, 23 nt, Pseudomonas putida KT2440
cgcucgagcccgccagcaggcca

SEQ ID NO: 1577439 - RNA, 14 nt, Pseudomonas putida KT2440
cgcucgauaugccg

SEQ ID NO: 1577440 - RNA, 19 nt, Pseudomonas putida KT2440
cgcucgaucucacaggcga

SEQ ID NO: 1577441 - RNA, 16 nt, Pseudomonas putida KT2440
cgcucgagaaacgcca

SEQ ID NO: 1577442 - RNA, 22 nt, Pseudomonas putida KT2440
cgcucgagaaaugccucggcaa

SEQ ID NO: 1577443 - RNA, 22 nt, Pseudomonas putida KT2440
cgcuccaggcggccagccaacg

SEQ ID NO: 1577444 - RNA, 16 nt, Pseudomonas putida KT2440
cgcuccagcagcucca

SEQ ID NO: 1577445 - RNA, 15 nt, Pseudomonas putida KT2440
cgcucgcgguucauc

SEQ ID NO: 1577446 - RNA, 12 nt, Pseudomonas putida KT2440
cgcucgccuggc

SEQ ID NO: 1577447 - RNA, 16 nt, Pseudomonas putida KT2440
cgcucgccuggccaua

SEQ ID NO: 1577448 - RNA, 18 nt, Pseudomonas putida KT2440
cgcucgcugcgaucgaaa

SEQ ID NO: 1577449 - RNA, 13 nt, Pseudomonas putida KT2440
cgcucugcgccug

SEQ ID NO: 1577450 - RNA, 19 nt, Pseudomonas putida KT2440
cgcucuucaaccgccucca

SEQ ID NO: 1577451 - RNA, 22 nt, Pseudomonas putida KT2440
cgcucuuugccacucagcgggu

SEQ ID NO: 1577452 - RNA, 23 nt, Pseudomonas putida KT2440
cgcucuuugccacucagcggguc

SEQ ID NO: 1577453 - RNA, 14 nt, Pseudomonas putida KT2440
cgcugaacacgccc

SEQ ID NO: 1577454 - RNA, 20 nt, Pseudomonas putida KT2440
cgcugaacacgcccgcgugc

SEQ ID NO: 1577455 - RNA, 17 nt, Pseudomonas putida KT2440
cgcugaccacgccgaag

SEQ ID NO: 1577456 - RNA, 21 nt, Pseudomonas putida KT2440
cgcucguugcgagcgaacagc

SEQ ID NO: 1577457 - RNA, 16 nt, Pseudomonas putida KT2440
cgcucguuguccagca

SEQ ID NO: 1577458 - RNA, 17 nt, Pseudomonas putida KT2440
cgcucguuguccagcag

SEQ ID NO: 1577459 - RNA, 14 nt, Pseudomonas putida KT2440
cgcucucacaggga

SEQ ID NO: 1577460 - RNA, 13 nt, Pseudomonas putida KT2440
cgcucgugcaggc

SEQ ID NO: 1577461 - RNA, 18 nt, Pseudomonas putida KT2440
cgcucgucgaacucgcgc

SEQ ID NO: 1577462 - RNA, 19 nt, Pseudomonas putida KT2440
cgcucguaggcuucacgcg

SEQ ID NO: 1577463 - RNA, 16 nt, Pseudomonas putida KT2440
cgcucguccaggcccu

SEQ ID NO: 1577464 - RNA, 21 nt, Pseudomonas putida KT2440
cgcucguagagcuuggacagg

SEQ ID NO: 1577465 - RNA, 23 nt, Pseudomonas putida KT2440
cgcggucaauuggagcggccuug

SEQ ID NO: 1577466 - RNA, 15 nt, Pseudomonas putida KT2440
cgcggucagcgaaua

SEQ ID NO: 1577467 - RNA, 15 nt, Pseudomonas putida KT2440
cgcggugcggcgaca

SEQ ID NO: 1577468 - RNA, 23 nt, Pseudomonas putida KT2440
cgcggugcggcgacagggcgaag

SEQ ID NO: 1577469 - RNA, 15 nt, Pseudomonas putida KT2440
cgcgguucgaagcug

SEQ ID NO: 1577470 - RNA, 18 nt, Pseudomonas putida KT2440
cgcgguuaagcgccacca

SEQ ID NO: 1577471 - RNA, 16 nt, Pseudomonas putida KT2440
cgcgguucuucgccug

SEQ ID NO: 1577472 - RNA, 19 nt, Pseudomonas putida KT2440
cgcgguucuucgccugcag

SEQ ID NO: 1577473 - RNA, 22 nt, Pseudomonas putida KT2440
cgcgguuucugcaaccacgacc

SEQ ID NO: 1577474 - RNA, 20 nt, Pseudomonas putida KT2440
cgcgguuuggucgcggcaaa

SEQ ID NO: 1577475 - RNA, 14 nt, Pseudomonas putida KT2440
aacagcgccggcag

SEQ ID NO: 1577476 - RNA, 15 nt, Pseudomonas putida KT2440
aacagcgcgacgcag

SEQ ID NO: 1577477 - RNA, 19 nt, Pseudomonas putida KT2440
cgcgggugcgagaggcgcu

SEQ ID NO: 1577478 - RNA, 19 nt, Pseudomonas putida KT2440
cgcgggugaaccgcgccua

SEQ ID NO: 1577479 - RNA, 20 nt, Pseudomonas putida KT2440
cgcgggugaaccgcgccuac

SEQ ID NO: 1577480 - RNA, 21 nt, Pseudomonas putida KT2440
cgcggguaaacccgcgccuac

SEQ ID NO: 1577481 - RNA, 20 nt, Pseudomonas putida KT2440
cgcggguaaacccgcuccca

SEQ ID NO: 1577482 - RNA, 20 nt, Pseudomonas putida KT2440
cgcggguaaacccgcuccua

SEQ ID NO: 1577483 - RNA, 21 nt, Pseudomonas putida KT2440
cgcggguaagcccgcuccuac

SEQ ID NO: 1577484 - RNA, 12 nt, Pseudomonas putida KT2440
cgcggggcagcg

SEQ ID NO: 1577485 - RNA, 20 nt, Pseudomonas putida KT2440
cgcgggcucgcccacuccca

SEQ ID NO: 1577486 - RNA, 21 nt, Pseudomonas putida KT2440
cgcgggcgucggucgccccca

SEQ ID NO: 1577487 - RNA, 19 nt, Pseudomonas putida KT2440
cgcgggcgugcccgcgaau

SEQ ID NO: 1577488 - RNA, 15 nt, Pseudomonas putida KT2440
cgcggacccggcauc

SEQ ID NO: 1577489 - RNA, 17 nt, Pseudomonas putida KT2440
cgcggacccggcauccu

SEQ ID NO: 1577490 - RNA, 14 nt, Pseudomonas putida KT2440
aacagcacugccag

SEQ ID NO: 1577491 - RNA, 13 nt, Pseudomonas putida KT2440
aacagcagcgccg

SEQ ID NO: 1577492 - RNA, 20 nt, Pseudomonas putida KT2440
cgcgggccagguggccuucc

SEQ ID NO: 1577493 - RNA, 21 nt, Pseudomonas putida KT2440
cgcgggcaugcccgcucccac

SEQ ID NO: 1577494 - RNA, 19 nt, Pseudomonas putida KT2440
cgcgggagacccguuccua

SEQ ID NO: 1577495 - RNA, 22 nt, Pseudomonas putida KT2440
cgccgcgcggcuugcucgcggc

SEQ ID NO: 1577496 - RNA, 20 nt, Pseudomonas putida KT2440
cgccgcggguaccaccuggg

SEQ ID NO: 1577497 - RNA, 21 nt, Pseudomonas putida KT2440
cgccgccgguuucucgcagca

SEQ ID NO: 1577498 - RNA, 13 nt, Pseudomonas putida KT2440
cgccgccgcuggc

SEQ ID NO: 1577499 - RNA, 13 nt, Pseudomonas putida KT2440
cgccgccuccacc

SEQ ID NO: 1577500 - RNA, 13 nt, Pseudomonas putida KT2440
cgccgcuguucag

SEQ ID NO: 1577501 - RNA, 14 nt, Pseudomonas putida KT2440
cgccgcuucagccu

SEQ ID NO: 1577502 - RNA, 15 nt, Pseudomonas putida KT2440
cgccgcuucagccuu

SEQ ID NO: 1577503 - RNA, 14 nt, Pseudomonas putida KT2440
cgccgcuguacacc

SEQ ID NO: 1577504 - RNA, 21 nt, Pseudomonas putida KT2440
cgccggccaaggucagcaagc

SEQ ID NO: 1577505 - RNA, 22 nt, Pseudomonas putida KT2440
cgccggcaucgccuccagcgca

SEQ ID NO: 1577506 - RNA, 20 nt, Pseudomonas putida KT2440
cgccggcaagcuggucaggu

SEQ ID NO: 1577507 - RNA, 19 nt, Pseudomonas putida KT2440
aacacgucggcuggcagcu

SEQ ID NO: 1577508 - RNA, 15 nt, Pseudomonas putida KT2440
aacacuuccgggcug

SEQ ID NO: 1577509 - RNA, 13 nt, Pseudomonas putida KT2440
aacagacaacauc

SEQ ID NO: 1577510 - RNA, 15 nt, Pseudomonas putida KT2440
aacacggugaugcgc

SEQ ID NO: 1577511 - RNA, 14 nt, Pseudomonas putida KT2440
cgccguuucagcca

SEQ ID NO: 1577512 - RNA, 21 nt, Pseudomonas putida KT2440
cgccguugcggucggugguca

SEQ ID NO: 1577513 - RNA, 19 nt, Pseudomonas putida KT2440
cgccguugaaagacugcuc

SEQ ID NO: 1577514 - RNA, 17 nt, Pseudomonas putida KT2440
cgccguucaggcgccug

SEQ ID NO: 1577515 - RNA, 15 nt, Pseudomonas putida KT2440
cgccguucaccguug

SEQ ID NO: 1577516 - RNA, 19 nt, Pseudomonas putida KT2440
cgccuauccugugggagcg

SEQ ID NO: 1577517 - RNA, 20 nt, Pseudomonas putida KT2440
cgccuaugaaaccgagcgcc

SEQ ID NO: 1577518 - RNA, 21 nt, Pseudomonas putida KT2440
cgccuaugaaaccgagcgccg

SEQ ID NO: 1577519 - RNA, 13 nt, Pseudomonas putida KT2440
cgccucaccgacc

SEQ ID NO: 1577520 - RNA, 20 nt, Pseudomonas putida KT2440
cgccucaccgacccacaggc

SEQ ID NO: 1577521 - RNA, 17 nt, Pseudomonas putida KT2440
cgccucgcagguaaucg

SEQ ID NO: 1577522 - RNA, 17 nt, Pseudomonas putida KT2440
cgccucgaucauuuccg

SEQ ID NO: 1577523 - RNA, 23 nt, Pseudomonas putida KT2440
cgccucaugcagcaccuccugca

SEQ ID NO: 1577524 - RNA, 19 nt, Pseudomonas putida KT2440
cgccucguugcgaagcggc

SEQ ID NO: 1577525 - RNA, 19 nt, Pseudomonas putida KT2440
cgccucuaccacgccgcug

SEQ ID NO: 1577526 - RNA, 16 nt, Pseudomonas putida KT2440
cgccugaacagcauca

SEQ ID NO: 1577527 - RNA, 18 nt, Pseudomonas putida KT2440
cgccugaaucuugcgcgc

SEQ ID NO: 1577528 - RNA, 23 nt, Pseudomonas putida KT2440
cgccugaaucuugcgcgccagcg

SEQ ID NO: 1577529 - RNA, 20 nt, Pseudomonas putida KT2440
cgccugaagcacgucgcgau

SEQ ID NO: 1577530 - RNA, 23 nt, Pseudomonas putida KT2440
cgccucggcacugcacgcuucga

SEQ ID NO: 1577531 - RNA, 18 nt, Pseudomonas putida KT2440
cgccugcagcgcgucauc

SEQ ID NO: 1577532 - RNA, 15 nt, Pseudomonas putida KT2440
cgccugcagggccug

SEQ ID NO: 1577533 - RNA, 19 nt, Pseudomonas putida KT2440
cgccugcagggccuggacg

SEQ ID NO: 1577534 - RNA, 22 nt, Pseudomonas putida KT2440
cgccucuugcaccugucccagc

SEQ ID NO: 1577535 - RNA, 14 nt, Pseudomonas putida KT2440
cgccugcaggccca

SEQ ID NO: 1577536 - RNA, 13 nt, Pseudomonas putida KT2440
cgccgugcaguuc

SEQ ID NO: 1577537 - RNA, 13 nt, Pseudomonas putida KT2440
cgccgugccgguc

SEQ ID NO: 1577538 - RNA, 21 nt, Pseudomonas putida KT2440
cgccgugcucuucguggaacu

SEQ ID NO: 1577539 - RNA, 17 nt, Pseudomonas putida KT2440
cgccgguggcggccgca

SEQ ID NO: 1577540 - RNA, 19 nt, Pseudomonas putida KT2440
cgccgguguucgcgggcau

SEQ ID NO: 1577541 - RNA, 14 nt, Pseudomonas putida KT2440
cgccgucaccagcg

SEQ ID NO: 1577542 - RNA, 15 nt, Pseudomonas putida KT2440
cgccgguugcgcagc

SEQ ID NO: 1577543 - RNA, 22 nt, Pseudomonas putida KT2440
cgccgggcacaucaccagcagc

SEQ ID NO: 1577544 - RNA, 23 nt, Pseudomonas putida KT2440
cgccgggcacaucaccagcagcu

SEQ ID NO: 1577545 - RNA, 14 nt, Pseudomonas putida KT2440
cgccgggcacugcc

SEQ ID NO: 1577546 - RNA, 18 nt, Pseudomonas putida KT2440
cgcccgacaauacgcaca

SEQ ID NO: 1577547 - RNA, 20 nt, Pseudomonas putida KT2440
cgcccgaacaacaggucggc

SEQ ID NO: 1577548 - RNA, 22 nt, Pseudomonas putida KT2440
cgcccgaacaacaggucggcgc

SEQ ID NO: 1577549 - RNA, 19 nt, Pseudomonas putida KT2440
cgccccucgucacugaccc

SEQ ID NO: 1577550 - RNA, 21 nt, Pseudomonas putida KT2440
cgccccuauacacaugcacag

SEQ ID NO: 1577551 - RNA, 22 nt, Pseudomonas putida KT2440
cgccccgugcccgaucaccgcg

SEQ ID NO: 1577552 - RNA, 23 nt, Pseudomonas putida KT2440
cgccccgcgcaagcguucgagca

SEQ ID NO: 1577553 - RNA, 17 nt, Pseudomonas putida KT2440
cgccccgccagcgccug

SEQ ID NO: 1577554 - RNA, 20 nt, Pseudomonas putida KT2440
cgccccgcaccagaccagca

SEQ ID NO: 1577555 - RNA, 23 nt, Pseudomonas putida KT2440
cgccccgcaccagaccagcagca

SEQ ID NO: 1577556 - RNA, 14 nt, Pseudomonas putida KT2440
cgcccccaugauga

SEQ ID NO: 1577557 - RNA, 23 nt, Pseudomonas putida KT2440
cgccccccaguaaaaacuggcca

SEQ ID NO: 1577558 - RNA, 15 nt, Pseudomonas putida KT2440
cgccccccggcucca

SEQ ID NO: 1577559 - RNA, 17 nt, Pseudomonas putida KT2440
cgccccauagccugcug

SEQ ID NO: 1577560 - RNA, 19 nt, Pseudomonas putida KT2440
cgccccgaaccuacccggu

SEQ ID NO: 1577561 - RNA, 14 nt, Pseudomonas putida KT2440
cgccccacccgcuc

SEQ ID NO: 1577562 - RNA, 13 nt, Pseudomonas putida KT2440
cgccccaagcggg

SEQ ID NO: 1577563 - RNA, 21 nt, Pseudomonas putida KT2440
cgccccaagcgggccaagguc

SEQ ID NO: 1577564 - RNA, 16 nt, Pseudomonas putida KT2440
cgccccaauggcgaac

SEQ ID NO: 1577565 - RNA, 22 nt, Pseudomonas putida KT2440
cgcccauggcuccacccaacga

SEQ ID NO: 1577566 - RNA, 20 nt, Pseudomonas putida KT2440
cgccccagcaguucgcgcac

SEQ ID NO: 1577567 - RNA, 18 nt, Pseudomonas putida KT2440
cgccccacucgcgcagca

SEQ ID NO: 1577568 - RNA, 15 nt, Pseudomonas putida KT2440
cgccccacgcacauc

SEQ ID NO: 1577569 - RNA, 20 nt, Pseudomonas putida KT2440
cgcccagcccaugaacagca

SEQ ID NO: 1577570 - RNA, 22 nt, Pseudomonas putida KT2440
cgcccagcccaugaacagcaag

SEQ ID NO: 1577571 - RNA, 24 nt, Pseudomonas putida KT2440
cgcccagcuucuccagcaagcgcu

SEQ ID NO: 1577572 - RNA, 14 nt, Pseudomonas putida KT2440
cgcccaguagcgcc

SEQ ID NO: 1577573 - RNA, 13 nt, Pseudomonas putida KT2440
cgcccauaccgcc

SEQ ID NO: 1577574 - RNA, 20 nt, Pseudomonas putida KT2440
cgcccaucucaggcccacca

SEQ ID NO: 1577575 - RNA, 18 nt, Pseudomonas putida KT2440
cgcccagguuauacgccg

SEQ ID NO: 1577576 - RNA, 16 nt, Pseudomonas putida KT2440
cgcccagucaccguuc

SEQ ID NO: 1577577 - RNA, 13 nt, Pseudomonas putida KT2440
cgcccagugccug

SEQ ID NO: 1577578 - RNA, 16 nt, Pseudomonas putida KT2440
cgcccagugccugacc

SEQ ID NO: 1577579 - RNA, 19 nt, Pseudomonas putida KT2440
cgcccagugccugaccggu

SEQ ID NO: 1577580 - RNA, 18 nt, Pseudomonas putida KT2440
cgcccaggcgcaucacga

SEQ ID NO: 1577581 - RNA, 17 nt, Pseudomonas putida KT2440
cgcccggcagaucgagc

SEQ ID NO: 1577582 - RNA, 18 nt, Pseudomonas putida KT2440
cgcccggauggcggugau

SEQ ID NO: 1577583 - RNA, 14 nt, Pseudomonas putida KT2440
cgcccggcgcagca

SEQ ID NO: 1577584 - RNA, 20 nt, Pseudomonas putida KT2440
cgcccggcgcagcauaugcu

SEQ ID NO: 1577585 - RNA, 12 nt, Pseudomonas putida KT2440
cgcccggccagg

SEQ ID NO: 1577586 - RNA, 13 nt, Pseudomonas putida KT2440
cgcccggccaggu

SEQ ID NO: 1577587 - RNA, 14 nt, Pseudomonas putida KT2440
cgcccgcugcgccg

SEQ ID NO: 1577588 - RNA, 22 nt, Pseudomonas putida KT2440
cgcccgcgugagauguucacca

SEQ ID NO: 1577589 - RNA, 20 nt, Pseudomonas putida KT2440
cgcccgcucccacaggaauc

SEQ ID NO: 1577590 - RNA, 19 nt, Pseudomonas putida KT2440
cgcccgcucccacaggcca

SEQ ID NO: 1577591 - RNA, 20 nt, Pseudomonas putida KT2440
cgcccgcucccacagggacc

SEQ ID NO: 1577592 - RNA, 22 nt, Pseudomonas putida KT2440
cgcccgguauucggguguccac

SEQ ID NO: 1577593 - RNA, 14 nt, Pseudomonas putida KT2440
cgcccgggucaggu

SEQ ID NO: 1577594 - RNA, 17 nt, Pseudomonas putida KT2440
cgcccgggagggugaac

SEQ ID NO: 1577595 - RNA, 17 nt, Pseudomonas putida KT2440
cgcccgggaucuggccg

SEQ ID NO: 1577596 - RNA, 17 nt, Pseudomonas putida KT2440
cgcccggcuugcccggg

SEQ ID NO: 1577597 - RNA, 14 nt, Pseudomonas putida KT2440
cgcccgaucaccga

SEQ ID NO: 1577598 - RNA, 20 nt, Pseudomonas putida KT2440
cgcccgcaaccucggccgca

SEQ ID NO: 1577599 - RNA, 16 nt, Pseudomonas putida KT2440
cgcccgcacagcacgu

SEQ ID NO: 1577600 - RNA, 12 nt, Pseudomonas putida KT2440
cgcccgacuggc

SEQ ID NO: 1577601 - RNA, 12 nt, Pseudomonas putida KT2440
cgcccgccugcg

SEQ ID NO: 1577602 - RNA, 15 nt, Pseudomonas putida KT2440
cgcccgcggcgaaca

SEQ ID NO: 1577603 - RNA, 22 nt, Pseudomonas putida KT2440
cgcccgcggcgaacacagcggc

SEQ ID NO: 1577604 - RNA, 20 nt, Pseudomonas putida KT2440
cgcccgcgcagcuuccacca

SEQ ID NO: 1577605 - RNA, 21 nt, Pseudomonas putida KT2440
cgccgauccucugugggagcg

SEQ ID NO: 1577606 - RNA, 18 nt, Pseudomonas putida KT2440
cgccgaugaagcaggccg

SEQ ID NO: 1577607 - RNA, 20 nt, Pseudomonas putida KT2440
cgccgaugaagcaggccgag

SEQ ID NO: 1577608 - RNA, 21 nt, Pseudomonas putida KT2440
cgccgagcgcggcgcccagca

SEQ ID NO: 1577609 - RNA, 21 nt, Pseudomonas putida KT2440
cgccgacagccucaaggccgg

SEQ ID NO: 1577610 - RNA, 21 nt, Pseudomonas putida KT2440
cgccgacgauaccgcccaggu

SEQ ID NO: 1577611 - RNA, 21 nt, Pseudomonas putida KT2440
cgccgacggcauggccgaagc

SEQ ID NO: 1577612 - RNA, 18 nt, Pseudomonas putida KT2440
cgccgaaccccaccagca

SEQ ID NO: 1577613 - RNA, 22 nt, Pseudomonas putida KT2440
cgccgaaacguagucgaccaga

SEQ ID NO: 1577614 - RNA, 18 nt, Pseudomonas putida KT2440
cgcccugggcgagcaggu

SEQ ID NO: 1577615 - RNA, 23 nt, Pseudomonas putida KT2440
cgcccugggcgagcaggugaccc

SEQ ID NO: 1577616 - RNA, 13 nt, Pseudomonas putida KT2440
cgcccuucgcgga

SEQ ID NO: 1577617 - RNA, 16 nt, Pseudomonas putida KT2440
cgcccugugggagcgg

SEQ ID NO: 1577618 - RNA, 22 nt, Pseudomonas putida KT2440
cgcccugugggagcggccuugu

SEQ ID NO: 1577619 - RNA, 20 nt, Pseudomonas putida KT2440
cgcccuucacgcucaugcug

SEQ ID NO: 1577620 - RNA, 12 nt, Pseudomonas putida KT2440
cgcccuucagca

SEQ ID NO: 1577621 - RNA, 15 nt, Pseudomonas putida KT2440
cgcccuuucgcgggu

SEQ ID NO: 1577622 - RNA, 19 nt, Pseudomonas putida KT2440
cgcccuuucgcgggugaac

SEQ ID NO: 1577623 - RNA, 14 nt, Pseudomonas putida KT2440
cgcccuuggugcac

SEQ ID NO: 1577624 - RNA, 21 nt, Pseudomonas putida KT2440
cgcccucgcgcguugcagcca

SEQ ID NO: 1577625 - RNA, 18 nt, Pseudomonas putida KT2440
cgcccucguucgcgggca

SEQ ID NO: 1577626 - RNA, 13 nt, Pseudomonas putida KT2440
cgcccugcgccug

SEQ ID NO: 1577627 - RNA, 15 nt, Pseudomonas putida KT2440
cgcccugcgccugca

SEQ ID NO: 1577628 - RNA, 16 nt, Pseudomonas putida KT2440
cgcccugcucauccag

SEQ ID NO: 1577629 - RNA, 22 nt, Pseudomonas putida KT2440
cgcccugcggcuguucgcagca

SEQ ID NO: 1577630 - RNA, 23 nt, Pseudomonas putida KT2440
cgcccugcccucgacaaucgcca

SEQ ID NO: 1577631 - RNA, 19 nt, Pseudomonas putida KT2440
cgcccugagccaaggccgc

SEQ ID NO: 1577632 - RNA, 18 nt, Pseudomonas putida KT2440
cgcccucuugcugcaaca

SEQ ID NO: 1577633 - RNA, 21 nt, Pseudomonas putida KT2440
cgcccguaacggucacugagc

SEQ ID NO: 1577634 - RNA, 19 nt, Pseudomonas putida KT2440
cgcccguaugcauccgcca

SEQ ID NO: 1577635 - RNA, 18 nt, Pseudomonas putida KT2440
cgcccuagaacaggcggc

SEQ ID NO: 1577636 - RNA, 12 nt, Pseudomonas putida KT2440
cgcccuccagcc

SEQ ID NO: 1577637 - RNA, 16 nt, Pseudomonas putida KT2440
cgcccuccaucaaucg

SEQ ID NO: 1577638 - RNA, 19 nt, Pseudomonas putida KT2440
gcgcccugcaaaggcaugg

SEQ ID NO: 1577639 - RNA, 13 nt, Pseudomonas putida KT2440
gcgcccugcgcca

SEQ ID NO: 1577640 - RNA, 23 nt, Pseudomonas putida KT2440
gcgcccugccuuagaacagaucc

SEQ ID NO: 1577641 - RNA, 18 nt, Pseudomonas putida KT2440
gcgcccugggcgccgguu

SEQ ID NO: 1577642 - RNA, 15 nt, Pseudomonas putida KT2440
gcgcccuggcggcca

SEQ ID NO: 1577643 - RNA, 19 nt, Pseudomonas putida KT2440
gcgcccuggcggccacggc

SEQ ID NO: 1577644 - RNA, 13 nt, Pseudomonas putida KT2440
gcgcccggcuugc

SEQ ID NO: 1577645 - RNA, 19 nt, Pseudomonas putida KT2440
gcgcccggggcaaugccga

SEQ ID NO: 1577646 - RNA, 15 nt, Pseudomonas putida KT2440
gcgcccggugcaagc

SEQ ID NO: 1577647 - RNA, 16 nt, Pseudomonas putida KT2440
gcgcccgucuggcugc

SEQ ID NO: 1577648 - RNA, 17 nt, Pseudomonas putida KT2440
gcgcccguugcgcuuga

SEQ ID NO: 1577649 - RNA, 18 nt, Pseudomonas putida KT2440
gcgcccgcucccacaggu

SEQ ID NO: 1577650 - RNA, 15 nt, Pseudomonas putida KT2440
gcgccgagcgaguga

SEQ ID NO: 1577651 - RNA, 17 nt, Pseudomonas putida KT2440
gcgccgagaggcgcugc

SEQ ID NO: 1577652 - RNA, 20 nt, Pseudomonas putida KT2440
gcgccgaugaguugucugcc

SEQ ID NO: 1577653 - RNA, 23 nt, Pseudomonas putida KT2440
gcgccgaugaguugucugccgaa

SEQ ID NO: 1577654 - RNA, 19 nt, Pseudomonas putida KT2440
gcgccgaugcucgucagcc

SEQ ID NO: 1577655 - RNA, 17 nt, Pseudomonas putida KT2440
gcgccaguacgccagca

SEQ ID NO: 1577656 - RNA, 21 nt, Pseudomonas putida KT2440
gcgccaguacggccaucagca

SEQ ID NO: 1577657 - RNA, 18 nt, Pseudomonas putida KT2440
gcgccaugagugcaggca

SEQ ID NO: 1577658 - RNA, 11 nt, Pseudomonas putida KT2440
gcgccaggucg

SEQ ID NO: 1577659 - RNA, 21 nt, Pseudomonas putida KT2440
gcgccaugccccccgccagca

SEQ ID NO: 1577660 - RNA, 20 nt, Pseudomonas putida KT2440
gcgccauggccuggcggguu

SEQ ID NO: 1577661 - RNA, 20 nt, Pseudomonas putida KT2440
gcgccaggcugcgcuccaac

SEQ ID NO: 1577662 - RNA, 13 nt, Pseudomonas putida KT2440
gcgccaggguugc

SEQ ID NO: 1577663 - RNA, 21 nt, Pseudomonas putida KT2440
gcgccaggguugcaucgcgca

SEQ ID NO: 1577664 - RNA, 23 nt, Pseudomonas putida KT2440
gcgcccgcgaagaggccggcaca

SEQ ID NO: 1577665 - RNA, 16 nt, Pseudomonas putida KT2440
gcgccccccaggcggu

SEQ ID NO: 1577666 - RNA, 16 nt, Pseudomonas putida KT2440
gcgccccagcagcgcu

SEQ ID NO: 1577667 - RNA, 14 nt, Pseudomonas putida KT2440
gcgccccagguugc

SEQ ID NO: 1577668 - RNA, 23 nt, Pseudomonas putida KT2440
gcgcccaugaaguucauccagau

SEQ ID NO: 1577669 - RNA, 15 nt, Pseudomonas putida KT2440
gcgcccagaucagca

SEQ ID NO: 1577670 - RNA, 15 nt, Pseudomonas putida KT2440
gcgcccacgcggguc

SEQ ID NO: 1577671 - RNA, 22 nt, Pseudomonas putida KT2440
gcgcccacgcggguccagcgcg

SEQ ID NO: 1577672 - RNA, 13 nt, Pseudomonas putida KT2440
gcgcccagcaaca

SEQ ID NO: 1577673 - RNA, 12 nt, Pseudomonas putida KT2440
gcgccacggcgc

SEQ ID NO: 1577674 - RNA, 16 nt, Pseudomonas putida KT2440
gcgccacggcgcugac

SEQ ID NO: 1577675 - RNA, 14 nt, Pseudomonas putida KT2440
gcgccacgccgcca

SEQ ID NO: 1577676 - RNA, 17 nt, Pseudomonas putida KT2440
gcgccaauaccgcgcau

SEQ ID NO: 1577677 - RNA, 19 nt, Pseudomonas putida KT2440
gcgccaaucaucgccagca

SEQ ID NO: 1577678 - RNA, 13 nt, Pseudomonas putida KT2440
gcgccagcagugc

SEQ ID NO: 1577679 - RNA, 13 nt, Pseudomonas putida KT2440
gcgccagcagcgc

SEQ ID NO: 1577680 - RNA, 14 nt, Pseudomonas putida KT2440
gcgccagcagcgcg

SEQ ID NO: 1577681 - RNA, 13 nt, Pseudomonas putida KT2440
gcgccagcagccg

SEQ ID NO: 1577682 - RNA, 20 nt, Pseudomonas putida KT2440
gcgccagcaacgcagccagg

SEQ ID NO: 1577683 - RNA, 13 nt, Pseudomonas putida KT2440
gcgccagcggcca

SEQ ID NO: 1577684 - RNA, 16 nt, Pseudomonas putida KT2440
gcgccagcggcucgau

SEQ ID NO: 1577685 - RNA, 13 nt, Pseudomonas putida KT2440
gcgccagcuccac

SEQ ID NO: 1577686 - RNA, 16 nt, Pseudomonas putida KT2440
gcgccagccgccacga

SEQ ID NO: 1577687 - RNA, 18 nt, Pseudomonas putida KT2440
gcgccagccgcucagcca

SEQ ID NO: 1577688 - RNA, 14 nt, Pseudomonas putida KT2440
gcgcaugcugccag

SEQ ID NO: 1577689 - RNA, 16 nt, Pseudomonas putida KT2440
gcgcaugcucgcgggc

SEQ ID NO: 1577690 - RNA, 21 nt, Pseudomonas putida KT2440
gcgccaaaccucaaaugcgcc

SEQ ID NO: 1577691 - RNA, 22 nt, Pseudomonas putida KT2440
gcgccaaaaccuguuccagccc

SEQ ID NO: 1577692 - RNA, 12 nt, Pseudomonas putida KT2440
gcgccaaagcga

SEQ ID NO: 1577693 - RNA, 20 nt, Pseudomonas putida KT2440
gcgccaaagcgagcauggcg

SEQ ID NO: 1577694 - RNA, 23 nt, Pseudomonas putida KT2440
gcgcaugcccgcgcaaaucgccg

SEQ ID NO: 1577695 - RNA, 21 nt, Pseudomonas putida KT2440
gcgcauccggaauuucugcac

SEQ ID NO: 1577696 - RNA, 15 nt, Pseudomonas putida KT2440
gcgcaggugcagcca

SEQ ID NO: 1577697 - RNA, 16 nt, Pseudomonas putida KT2440
gcgcaggugcagccag

SEQ ID NO: 1577698 - RNA, 21 nt, Pseudomonas putida KT2440
gcgcaggugcagccagcccca

SEQ ID NO: 1577699 - RNA, 13 nt, Pseudomonas putida KT2440
gcgcacgccggua

SEQ ID NO: 1577700 - RNA, 17 nt, Pseudomonas putida KT2440
gcgcacucucccgcagc

SEQ ID NO: 1577701 - RNA, 20 nt, Pseudomonas putida KT2440
gcgcacugaauacaccagcu

SEQ ID NO: 1577702 - RNA, 15 nt, Pseudomonas putida KT2440
gcgcacugagcaacg

SEQ ID NO: 1577703 - RNA, 18 nt, Pseudomonas putida KT2440
gcgcacugccgccggugu

SEQ ID NO: 1577704 - RNA, 14 nt, Pseudomonas putida KT2440
gcgcacuugccagc

SEQ ID NO: 1577705 - RNA, 18 nt, Pseudomonas putida KT2440
gcgcacuuguuccagccg

SEQ ID NO: 1577706 - RNA, 19 nt, Pseudomonas putida KT2440
gcgcacuuguuccagccgc

SEQ ID NO: 1577707 - RNA, 13 nt, Pseudomonas putida KT2440
gcgcauaggccaa

SEQ ID NO: 1577708 - RNA, 15 nt, Pseudomonas putida KT2440
gcgcauaggccaagg

SEQ ID NO: 1577709 - RNA, 17 nt, Pseudomonas putida KT2440
gcgcaucaacguuccca

SEQ ID NO: 1577710 - RNA, 20 nt, Pseudomonas putida KT2440
gcgcaucaacguucccaaug

SEQ ID NO: 1577711 - RNA, 18 nt, Pseudomonas putida KT2440
gcgcaucagccgcgcccu

SEQ ID NO: 1577712 - RNA, 19 nt, Pseudomonas putida KT2440
gcgcaucauggcggugaau

SEQ ID NO: 1577713 - RNA, 14 nt, Pseudomonas putida KT2440
gcgcauccacaggc

SEQ ID NO: 1577714 - RNA, 14 nt, Pseudomonas putida KT2440
gcgcauccagcagg

SEQ ID NO: 1577715 - RNA, 14 nt, Pseudomonas putida KT2440
gcgcauccagccag

SEQ ID NO: 1577716 - RNA, 15 nt, Pseudomonas putida KT2440
gcgccucgcggugca

SEQ ID NO: 1577717 - RNA, 20 nt, Pseudomonas putida KT2440
gcgccuauccugugggagcg

SEQ ID NO: 1577718 - RNA, 13 nt, Pseudomonas putida KT2440
gcgccucccccag

SEQ ID NO: 1577719 - RNA, 12 nt, Pseudomonas putida KT2440
gcgccuccagca

SEQ ID NO: 1577720 - RNA, 21 nt, Pseudomonas putida KT2440
gcgccguggccgccaugaucu

SEQ ID NO: 1577721 - RNA, 18 nt, Pseudomonas putida KT2440
gcgccgugcucggccuug

SEQ ID NO: 1577722 - RNA, 22 nt, Pseudomonas putida KT2440
gcgccgguagcggcugggcgcg

SEQ ID NO: 1577723 - RNA, 20 nt, Pseudomonas putida KT2440
gcgccgguauucgcgagcca

SEQ ID NO: 1577724 - RNA, 20 nt, Pseudomonas putida KT2440
gcgccggucacuucggcaua

SEQ ID NO: 1577725 - RNA, 13 nt, Pseudomonas putida KT2440
gcgccggccaagu

SEQ ID NO: 1577726 - RNA, 21 nt, Pseudomonas putida KT2440
gcgccgccaccugcggcaggu

SEQ ID NO: 1577727 - RNA, 21 nt, Pseudomonas putida KT2440
gcgccgccaaaaaauccgccu

SEQ ID NO: 1577728 - RNA, 13 nt, Pseudomonas putida KT2440
gcgccgccacauc

SEQ ID NO: 1577729 - RNA, 20 nt, Pseudomonas putida KT2440
gcgccuuuuccaccagcccu

SEQ ID NO: 1577730 - RNA, 22 nt, Pseudomonas putida KT2440
gcgccuuuuccaccagcccuuc

SEQ ID NO: 1577731 - RNA, 19 nt, Pseudomonas putida KT2440
gcgcgaaaagccugcacca

SEQ ID NO: 1577732 - RNA, 23 nt, Pseudomonas putida KT2440
gcgcgaaacccucacgcgccagg

SEQ ID NO: 1577733 - RNA, 19 nt, Pseudomonas putida KT2440
gcgccuugcgccaggugcc

SEQ ID NO: 1577734 - RNA, 16 nt, Pseudomonas putida KT2440
gcgccuugcuuggcag

SEQ ID NO: 1577735 - RNA, 22 nt, Pseudomonas putida KT2440
gcgccuugggcaacaccgccag

SEQ ID NO: 1577736 - RNA, 19 nt, Pseudomonas putida KT2440
gcgcgauagggaucaccuc

SEQ ID NO: 1577737 - RNA, 20 nt, Pseudomonas putida KT2440
gcgcgauagggaucaccucg

SEQ ID NO: 1577738 - RNA, 12 nt, Pseudomonas putida KT2440
gcgcgauuggac

SEQ ID NO: 1577739 - RNA, 13 nt, Pseudomonas putida KT2440
gcgcgaugcgccg

SEQ ID NO: 1577740 - RNA, 14 nt, Pseudomonas putida KT2440
gcgcgauaccgacg

SEQ ID NO: 1577741 - RNA, 21 nt, Pseudomonas putida KT2440
gcgcgaccaucaccgccagca

SEQ ID NO: 1577742 - RNA, 21 nt, Pseudomonas putida KT2440
gcgccuggcgagaaggcgugg

SEQ ID NO: 1577743 - RNA, 16 nt, Pseudomonas putida KT2440
gcgccuggcccgcagc

SEQ ID NO: 1577744 - RNA, 13 nt, Pseudomonas putida KT2440
gcgccuggcucga

SEQ ID NO: 1577745 - RNA, 13 nt, Pseudomonas putida KT2440
gcgccuggucgcc

SEQ ID NO: 1577746 - RNA, 17 nt, Pseudomonas putida KT2440
gcgccuggucgccgcca

SEQ ID NO: 1577747 - RNA, 15 nt, Pseudomonas putida KT2440
gcgccugugaucgag

SEQ ID NO: 1577748 - RNA, 17 nt, Pseudomonas putida KT2440
gcgccugugaucgagcg

SEQ ID NO: 1577749 - RNA, 16 nt, Pseudomonas putida KT2440
gcgccuucgcccgacc

SEQ ID NO: 1577750 - RNA, 20 nt, Pseudomonas putida KT2440
gcgccuucgcccgaccgcca

SEQ ID NO: 1577751 - RNA, 18 nt, Pseudomonas putida KT2440
gcgccugcugguacagcc

SEQ ID NO: 1577752 - RNA, 18 nt, Pseudomonas putida KT2440
gcgccugcucauccacca

SEQ ID NO: 1577753 - RNA, 13 nt, Pseudomonas putida KT2440
gcgccugcggcau

SEQ ID NO: 1577754 - RNA, 15 nt, Pseudomonas putida KT2440
gcgccugcggcauca

SEQ ID NO: 1577755 - RNA, 14 nt, Pseudomonas putida KT2440
gcgccugccuggcc

SEQ ID NO: 1577756 - RNA, 22 nt, Pseudomonas putida KT2440
gcgccugauuacccugcgccag

SEQ ID NO: 1577757 - RNA, 20 nt, Pseudomonas putida KT2440
gcgccugcaaacgcaggugc

SEQ ID NO: 1577758 - RNA, 21 nt, Pseudomonas putida KT2440
gcgccugcaaacgcaggugcg

SEQ ID NO: 1577759 - RNA, 19 nt, Pseudomonas putida KT2440
gcgccugccacgaugguca

SEQ ID NO: 1577760 - RNA, 14 nt, Pseudomonas putida KT2440
gcgccugcagcgcg

SEQ ID NO: 1577761 - RNA, 14 nt, Pseudomonas putida KT2440
gcgccugcaggccc

SEQ ID NO: 1577762 - RNA, 13 nt, Pseudomonas putida KT2440
gcgccugacacaa

SEQ ID NO: 1577763 - RNA, 17 nt, Pseudomonas putida KT2440
gcgccugacgcagugca

SEQ ID NO: 1577764 - RNA, 16 nt, Pseudomonas putida KT2440
gcgccucuuugcccug

SEQ ID NO: 1577765 - RNA, 23 nt, Pseudomonas putida KT2440
gcgccugaaagcguauugccaga

SEQ ID NO: 1577766 - RNA, 14 nt, Pseudomonas putida KT2440
gcgccugaacagca

SEQ ID NO: 1577767 - RNA, 18 nt, Pseudomonas putida KT2440
gcgccugaacagcaucag

SEQ ID NO: 1577768 - RNA, 21 nt, Pseudomonas putida KT2440
gcgccugaacagcaucagcca

SEQ ID NO: 1577769 - RNA, 14 nt, Pseudomonas putida KT2440
gcgccucgcccuug

SEQ ID NO: 1577770 - RNA, 18 nt, Pseudomonas putida KT2440
gcgaucaacgcaggcuca

SEQ ID NO: 1577771 - RNA, 19 nt, Pseudomonas putida KT2440
gcgaucaaugggccgauca

SEQ ID NO: 1577772 - RNA, 16 nt, Pseudomonas putida KT2440
gcgauaucccaacgca

SEQ ID NO: 1577773 - RNA, 16 nt, Pseudomonas putida KT2440
gcgauacgccgacagc

SEQ ID NO: 1577774 - RNA, 23 nt, Pseudomonas putida KT2440
gcgauaccccgcugccugcgcuu

SEQ ID NO: 1577775 - RNA, 20 nt, Pseudomonas putida KT2440
gcgaguaaagccagcagccu

SEQ ID NO: 1577776 - RNA, 16 nt, Pseudomonas putida KT2440
gcgauaaaccagcagc

SEQ ID NO: 1577777 - RNA, 16 nt, Pseudomonas putida KT2440
gcgaggguuccaggcc

SEQ ID NO: 1577778 - RNA, 14 nt, Pseudomonas putida KT2440
gcgagguacggcaa

SEQ ID NO: 1577779 - RNA, 19 nt, Pseudomonas putida KT2440
gcgagguaggccgucagca

SEQ ID NO: 1577780 - RNA, 13 nt, Pseudomonas putida KT2440
gcgagccaagugu

SEQ ID NO: 1577781 - RNA, 21 nt, Pseudomonas putida KT2440
gcgagccaaguguuugaagcu

SEQ ID NO: 1577782 - RNA, 12 nt, Pseudomonas putida KT2440
gcgagcauggcg

SEQ ID NO: 1577783 - RNA, 18 nt, Pseudomonas putida KT2440
gcgagccagaucauggcg

SEQ ID NO: 1577784 - RNA, 17 nt, Pseudomonas putida KT2440
gcgagcccgcgcgcgau

SEQ ID NO: 1577785 - RNA, 13 nt, Pseudomonas putida KT2440
gcgagccgccaga

SEQ ID NO: 1577786 - RNA, 16 nt, Pseudomonas putida KT2440
gcgagccugggucacg

SEQ ID NO: 1577787 - RNA, 19 nt, Pseudomonas putida KT2440
gcgagccugggucacggca

SEQ ID NO: 1577788 - RNA, 19 nt, Pseudomonas putida KT2440
gcgagccuugccaacggca

SEQ ID NO: 1577789 - RNA, 21 nt, Pseudomonas putida KT2440
gcgagccuugccaacggcacu

SEQ ID NO: 1577790 - RNA, 23 nt, Pseudomonas putida KT2440
gcgagccucuguuugcuggucag

SEQ ID NO: 1577791 - RNA, 24 nt, Pseudomonas putida KT2440
gcgagcuugcucgcgaugcgccgc

SEQ ID NO: 1577792 - RNA, 20 nt, Pseudomonas putida KT2440
gcgaggaaacccgcgccuac

SEQ ID NO: 1577793 - RNA, 16 nt, Pseudomonas putida KT2440
gcgaggaucagcgcau

SEQ ID NO: 1577794 - RNA, 14 nt, Pseudomonas putida KT2440
gcgacugccaaugc

SEQ ID NO: 1577795 - RNA, 13 nt, Pseudomonas putida KT2440
gcgacggcgaggu

SEQ ID NO: 1577796 - RNA, 15 nt, Pseudomonas putida KT2440
gcgagcaggugaccc

SEQ ID NO: 1577797 - RNA, 13 nt, Pseudomonas putida KT2440
gcgagaucgacag

SEQ ID NO: 1577798 - RNA, 13 nt, Pseudomonas putida KT2440
gcgacuucgacca

SEQ ID NO: 1577799 - RNA, 16 nt, Pseudomonas putida KT2440
gcgacuucgaccacgg

SEQ ID NO: 1577800 - RNA, 13 nt, Pseudomonas putida KT2440
gcgacuucggcga

SEQ ID NO: 1577801 - RNA, 22 nt, Pseudomonas putida KT2440
gcgagaggcgcuuuucaccucc

SEQ ID NO: 1577802 - RNA, 17 nt, Pseudomonas putida KT2440
gcgagagcggcuucuac

SEQ ID NO: 1577803 - RNA, 12 nt, Pseudomonas putida KT2440
gcgaccgccauu

SEQ ID NO: 1577804 - RNA, 13 nt, Pseudomonas putida KT2440
gcgaccgccauug

SEQ ID NO: 1577805 - RNA, 16 nt, Pseudomonas putida KT2440
gcgacgcaaggccgcu

SEQ ID NO: 1577806 - RNA, 20 nt, Pseudomonas putida KT2440
gcgacgcaaggccgcuccca

SEQ ID NO: 1577807 - RNA, 12 nt, Pseudomonas putida KT2440
gcgacgaccgca

SEQ ID NO: 1577808 - RNA, 16 nt, Pseudomonas putida KT2440
gccuuccggcccggca

SEQ ID NO: 1577809 - RNA, 21 nt, Pseudomonas putida KT2440
gccuucccucuguaacugcgc

SEQ ID NO: 1577810 - RNA, 22 nt, Pseudomonas putida KT2440
gccuuccucggccaugcgcggg

SEQ ID NO: 1577811 - RNA, 15 nt, Pseudomonas putida KT2440
gccuucgcgggcuuu

SEQ ID NO: 1577812 - RNA, 13 nt, Pseudomonas putida KT2440
gccuucggccaug

SEQ ID NO: 1577813 - RNA, 17 nt, Pseudomonas putida KT2440
gccuucggacucgacgu

SEQ ID NO: 1577814 - RNA, 14 nt, Pseudomonas putida KT2440
gcgacaaucaggcg

SEQ ID NO: 1577815 - RNA, 20 nt, Pseudomonas putida KT2440
gcgacacaaggccgcuccca

SEQ ID NO: 1577816 - RNA, 21 nt, Pseudomonas putida KT2440
gcgacacaaggccgcucccac

SEQ ID NO: 1577817 - RNA, 14 nt, Pseudomonas putida KT2440
gcgacacccugguc

SEQ ID NO: 1577818 - RNA, 16 nt, Pseudomonas putida KT2440
gcgacacccuggucau

SEQ ID NO: 1577819 - RNA, 17 nt, Pseudomonas putida KT2440
gcgacaggcgucggggc

SEQ ID NO: 1577820 - RNA, 20 nt, Pseudomonas putida KT2440
gcgaugaucgagccgaucag

SEQ ID NO: 1577821 - RNA, 22 nt, Pseudomonas putida KT2440
gcgaugaagacgcucgacagca

SEQ ID NO: 1577822 - RNA, 20 nt, Pseudomonas putida KT2440
gcgaugaaagccuaaaggca

SEQ ID NO: 1577823 - RNA, 22 nt, Pseudomonas putida KT2440
gcgaugcgcacaccgcuggugg

SEQ ID NO: 1577824 - RNA, 13 nt, Pseudomonas putida KT2440
gcgaugaucgccu

SEQ ID NO: 1577825 - RNA, 19 nt, Pseudomonas putida KT2440
gcgaugaucgccuggccgg

SEQ ID NO: 1577826 - RNA, 22 nt, Pseudomonas putida KT2440
gcgaugcacgccagcaucaccc

SEQ ID NO: 1577827 - RNA, 15 nt, Pseudomonas putida KT2440
gcgaucaggcaggcc

SEQ ID NO: 1577828 - RNA, 19 nt, Pseudomonas putida KT2440
gcgaucaggcaggccagca

SEQ ID NO: 1577829 - RNA, 14 nt, Pseudomonas putida KT2440
gcgaucagcgcggu

SEQ ID NO: 1577830 - RNA, 16 nt, Pseudomonas putida KT2440
gcgaucacgcaggccc

SEQ ID NO: 1577831 - RNA, 17 nt, Pseudomonas putida KT2440
gcgaucacgcaggccca

SEQ ID NO: 1577832 - RNA, 13 nt, Pseudomonas putida KT2440
gcgaucaccagcc

SEQ ID NO: 1577833 - RNA, 21 nt, Pseudomonas putida KT2440
gcgauccaucuucaccuugcc

SEQ ID NO: 1577834 - RNA, 13 nt, Pseudomonas putida KT2440
gcgaucagugccu

SEQ ID NO: 1577835 - RNA, 22 nt, Pseudomonas putida KT2440
gcgaucgaugaacucacccgcc

SEQ ID NO: 1577836 - RNA, 19 nt, Pseudomonas putida KT2440
gcgaucgaacgcuugcccg

SEQ ID NO: 1577837 - RNA, 22 nt, Pseudomonas putida KT2440
gcgaucggcagcgaucagcgca

SEQ ID NO: 1577838 - RNA, 20 nt, Pseudomonas putida KT2440
gcgaucgccagguggaagcg

SEQ ID NO: 1577839 - RNA, 16 nt, Pseudomonas putida KT2440
gcgauugcccagcguu

SEQ ID NO: 1577840 - RNA, 22 nt, Pseudomonas putida KT2440
gcgauugcccagcguucggguc

SEQ ID NO: 1577841 - RNA, 23 nt, Pseudomonas putida KT2440
gcgcaacagcaaggcaucggcgc

SEQ ID NO: 1577842 - RNA, 14 nt, Pseudomonas putida KT2440
gcgcaacaccgcca

SEQ ID NO: 1577843 - RNA, 22 nt, Pseudomonas putida KT2440
gcgcaacaccgccagcgggcug

SEQ ID NO: 1577844 - RNA, 19 nt, Pseudomonas putida KT2440
gcgcaaccgauagcgugaa

SEQ ID NO: 1577845 - RNA, 13 nt, Pseudomonas putida KT2440
gcgcaaaucgccg

SEQ ID NO: 1577846 - RNA, 19 nt, Pseudomonas putida KT2440
gcgcaaauugcccggccag

SEQ ID NO: 1577847 - RNA, 21 nt, Pseudomonas putida KT2440
gcgcaaauugcccggccagcg

SEQ ID NO: 1577848 - RNA, 22 nt, Pseudomonas putida KT2440
gcgcaaauugcccggccagcga

SEQ ID NO: 1577849 - RNA, 21 nt, Pseudomonas putida KT2440
gcgcaacaaggccaaccacgc

SEQ ID NO: 1577850 - RNA, 13 nt, Pseudomonas putida KT2440
gcgcaaaggcggg

SEQ ID NO: 1577851 - RNA, 19 nt, Pseudomonas putida KT2440
gcgcaaaggcuuuggccgu

SEQ ID NO: 1577852 - RNA, 22 nt, Pseudomonas putida KT2440
gcgcaaaggcuuuggccguagc

SEQ ID NO: 1577853 - RNA, 14 nt, Pseudomonas putida KT2440
gcgauguugaucag

SEQ ID NO: 1577854 - RNA, 17 nt, Pseudomonas putida KT2440
gcgaugugcgcaucggc

SEQ ID NO: 1577855 - RNA, 17 nt, Pseudomonas putida KT2440
gcgauguaucagcgccu

SEQ ID NO: 1577856 - RNA, 20 nt, Pseudomonas putida KT2440
gcgauggcggaucagcgcgu

SEQ ID NO: 1577857 - RNA, 14 nt, Pseudomonas putida KT2440
gcgauggcgucgac

SEQ ID NO: 1577858 - RNA, 21 nt, Pseudomonas putida KT2440
gcgaugggugcaaaaccugcc

SEQ ID NO: 1577859 - RNA, 16 nt, Pseudomonas putida KT2440
gcgcaccgcugaccac

SEQ ID NO: 1577860 - RNA, 18 nt, Pseudomonas putida KT2440
gcgcaccgcuugcgcacg

SEQ ID NO: 1577861 - RNA, 23 nt, Pseudomonas putida KT2440
gcgcacgcaucugcaccggcagc

SEQ ID NO: 1577862 - RNA, 13 nt, Pseudomonas putida KT2440
gcgcacgcgcuuu

SEQ ID NO: 1577863 - RNA, 19 nt, Pseudomonas putida KT2440
gcgcaagguggcauuggcg

SEQ ID NO: 1577864 - RNA, 14 nt, Pseudomonas putida KT2440
gcgcaagcaggugc

SEQ ID NO: 1577865 - RNA, 13 nt, Pseudomonas putida KT2440
gcgcaagcaaccg

SEQ ID NO: 1577866 - RNA, 14 nt, Pseudomonas putida KT2440
gcgcaacugcccag

SEQ ID NO: 1577867 - RNA, 11 nt, Pseudomonas putida KT2440
gccggugaccc

SEQ ID NO: 1577868 - RNA, 18 nt, Pseudomonas putida KT2440
gccggucuguucggcaag

SEQ ID NO: 1577869 - RNA, 20 nt, Pseudomonas putida KT2440
gccgggaugguaacgggcaa

SEQ ID NO: 1577870 - RNA, 19 nt, Pseudomonas putida KT2440
gccggguuacccaucugcu

SEQ ID NO: 1577871 - RNA, 22 nt, Pseudomonas putida KT2440
gccggguuguggcuggcgucga

SEQ ID NO: 1577872 - RNA, 21 nt, Pseudomonas putida KT2440
gccgguagugaugcaucagcu

SEQ ID NO: 1577873 - RNA, 14 nt, Pseudomonas putida KT2440
gccgguauucgcga

SEQ ID NO: 1577874 - RNA, 22 nt, Pseudomonas putida KT2440
gccggucaagacgaagcgcuug

SEQ ID NO: 1577875 - RNA, 14 nt, Pseudomonas putida KT2440
gccguccaggucca

SEQ ID NO: 1577876 - RNA, 14 nt, Pseudomonas putida KT2440
gccguccaggaacg

SEQ ID NO: 1577877 - RNA, 19 nt, Pseudomonas putida KT2440
gccguccagcaggcuggcg

SEQ ID NO: 1577878 - RNA, 14 nt, Pseudomonas putida KT2440
gccguccaccaucu

SEQ ID NO: 1577879 - RNA, 13 nt, Pseudomonas putida KT2440
gccgucaucacca

SEQ ID NO: 1577880 - RNA, 20 nt, Pseudomonas putida KT2440
gccgucagcagcaggcgcga

SEQ ID NO: 1577881 - RNA, 15 nt, Pseudomonas putida KT2440
gccgucagccuuuga

SEQ ID NO: 1577882 - RNA, 15 nt, Pseudomonas putida KT2440
gccguaucgcgguua

SEQ ID NO: 1577883 - RNA, 22 nt, Pseudomonas putida KT2440
gccguauucaccgguagcggcg

SEQ ID NO: 1577884 - RNA, 20 nt, Pseudomonas putida KT2440
gccguauggcguugcucaac

SEQ ID NO: 1577885 - RNA, 21 nt, Pseudomonas putida KT2440
gccgucaacgaggccgccauu

SEQ ID NO: 1577886 - RNA, 21 nt, Pseudomonas putida KT2440
gccgguggugaaaugguugaa

SEQ ID NO: 1577887 - RNA, 20 nt, Pseudomonas putida KT2440
gccggugguaauuggccggc

SEQ ID NO: 1577888 - RNA, 17 nt, Pseudomonas putida KT2440
gccggugggcaacagcu

SEQ ID NO: 1577889 - RNA, 18 nt, Pseudomonas putida KT2440
gccguaguggcgccggau

SEQ ID NO: 1577890 - RNA, 15 nt, Pseudomonas putida KT2440
gccgucgaccaggca

SEQ ID NO: 1577891 - RNA, 13 nt, Pseudomonas putida KT2440
gccguccucgacc

SEQ ID NO: 1577892 - RNA, 17 nt, Pseudomonas putida KT2440
gccguccucgacccagu

SEQ ID NO: 1577893 - RNA, 16 nt, Pseudomonas putida KT2440
gccgucucugaccggc

SEQ ID NO: 1577894 - RNA, 15 nt, Pseudomonas putida KT2440
gccgucgccgcuucg

SEQ ID NO: 1577895 - RNA, 13 nt, Pseudomonas putida KT2440
gccgucgguaaac

SEQ ID NO: 1577896 - RNA, 14 nt, Pseudomonas putida KT2440
gccgucgguaaaca

SEQ ID NO: 1577897 - RNA, 14 nt, Pseudomonas putida KT2440
gccguggugccggu

SEQ ID NO: 1577898 - RNA, 16 nt, Pseudomonas putida KT2440
gccguggucgccuuca

SEQ ID NO: 1577899 - RNA, 18 nt, Pseudomonas putida KT2440
gccguugaaggcgaauga

SEQ ID NO: 1577900 - RNA, 17 nt, Pseudomonas putida KT2440
gccguugaucagcgaca

SEQ ID NO: 1577901 - RNA, 22 nt, Pseudomonas putida KT2440
gccgucuucccauccacuucgc

SEQ ID NO: 1577902 - RNA, 19 nt, Pseudomonas putida KT2440
gccugcaaacgcaggugcg

SEQ ID NO: 1577903 - RNA, 19 nt, Pseudomonas putida KT2440
gccugcaaacgccgcucga

SEQ ID NO: 1577904 - RNA, 16 nt, Pseudomonas putida KT2440
gccugccacgaugguc

SEQ ID NO: 1577905 - RNA, 15 nt, Pseudomonas putida KT2440
gccugcaagccggcg

SEQ ID NO: 1577906 - RNA, 22 nt, Pseudomonas putida KT2440
gccugcaagccggcgaacagca

SEQ ID NO: 1577907 - RNA, 14 nt, Pseudomonas putida KT2440
gccugccagguccg

SEQ ID NO: 1577908 - RNA, 15 nt, Pseudomonas putida KT2440
gccugccagguccga

SEQ ID NO: 1577909 - RNA, 19 nt, Pseudomonas putida KT2440
gccugaaucuugcgcgcca

SEQ ID NO: 1577910 - RNA, 17 nt, Pseudomonas putida KT2440
gccugacacuaggagug

SEQ ID NO: 1577911 - RNA, 21 nt, Pseudomonas putida KT2440
gccugacucagcccugagggc

SEQ ID NO: 1577912 - RNA, 19 nt, Pseudomonas putida KT2440
gccucggcgaucgccaggu

SEQ ID NO: 1577913 - RNA, 17 nt, Pseudomonas putida KT2440
aagccaugaucagcgcc

SEQ ID NO: 1577914 - RNA, 14 nt, Pseudomonas putida KT2440
aagccaugggcaga

SEQ ID NO: 1577915 - RNA, 23 nt, Pseudomonas putida KT2440
gccuaccgcccgcgcuucccggg

SEQ ID NO: 1577916 - RNA, 18 nt, Pseudomonas putida KT2440
aagccagcguaagcuggc

SEQ ID NO: 1577917 - RNA, 11 nt, Pseudomonas putida KT2440
gccuacaccgc

SEQ ID NO: 1577918 - RNA, 19 nt, Pseudomonas putida KT2440
gccuacaggcaaccgcauc

SEQ ID NO: 1577919 - RNA, 12 nt, Pseudomonas putida KT2440
gccuacaggccc

SEQ ID NO: 1577920 - RNA, 15 nt, Pseudomonas putida KT2440
gccuacagcggccug

SEQ ID NO: 1577921 - RNA, 20 nt, Pseudomonas putida KT2440
gccuacaaagcgcucgaagu

SEQ ID NO: 1577922 - RNA, 15 nt, Pseudomonas putida KT2440
gccguuggagcagcc

SEQ ID NO: 1577923 - RNA, 18 nt, Pseudomonas putida KT2440
gccguuggagcagccguu

SEQ ID NO: 1577924 - RNA, 18 nt, Pseudomonas putida KT2440
gccucggcaaagcggcug

SEQ ID NO: 1577925 - RNA, 19 nt, Pseudomonas putida KT2440
gccucgaucgucgacaacg

SEQ ID NO: 1577926 - RNA, 17 nt, Pseudomonas putida KT2440
gccucgcugaccaguug

SEQ ID NO: 1577927 - RNA, 12 nt, Pseudomonas putida KT2440
gccucgcuggcg

SEQ ID NO: 1577928 - RNA, 17 nt, Pseudomonas putida KT2440
aagcccauggcuggcag

SEQ ID NO: 1577929 - RNA, 18 nt, Pseudomonas putida KT2440
gccucgacccgcuggcga

SEQ ID NO: 1577930 - RNA, 17 nt, Pseudomonas putida KT2440
gccuggcgccugcgcca

SEQ ID NO: 1577931 - RNA, 18 nt, Pseudomonas putida KT2440
gccuggcgccugcgccag

SEQ ID NO: 1577932 - RNA, 13 nt, Pseudomonas putida KT2440
gccuggccugcag

SEQ ID NO: 1577933 - RNA, 22 nt, Pseudomonas putida KT2440
gccuggcucaccuuaucggccg

SEQ ID NO: 1577934 - RNA, 20 nt, Pseudomonas putida KT2440
gccuggguacgccgaaauua

SEQ ID NO: 1577935 - RNA, 23 nt, Pseudomonas putida KT2440
gccugggucaaccccaggugcug

SEQ ID NO: 1577936 - RNA, 15 nt, Pseudomonas putida KT2440
gccugggucaggcgu

SEQ ID NO: 1577937 - RNA, 23 nt, Pseudomonas putida KT2440
gccuggguuuuaaccggcccuga

SEQ ID NO: 1577938 - RNA, 20 nt, Pseudomonas putida KT2440
gccuggcucaggcgcuggcg

SEQ ID NO: 1577939 - RNA, 13 nt, Pseudomonas putida KT2440
gccuggugccagc

SEQ ID NO: 1577940 - RNA, 19 nt, Pseudomonas putida KT2440
gccuggucgccgccaccca

SEQ ID NO: 1577941 - RNA, 16 nt, Pseudomonas putida KT2440
gccuguacacagccca

SEQ ID NO: 1577942 - RNA, 20 nt, Pseudomonas putida KT2440
gccuguaccgaccucuucgc

SEQ ID NO: 1577943 - RNA, 22 nt, Pseudomonas putida KT2440
gccugguugcguucgucgaugu

SEQ ID NO: 1577944 - RNA, 17 nt, Pseudomonas putida KT2440
gccugguuuucgcucgc

SEQ ID NO: 1577945 - RNA, 21 nt, Pseudomonas putida KT2440
gccugucaguuccugaaccac

SEQ ID NO: 1577946 - RNA, 20 nt, Pseudomonas putida KT2440
gccuguaggaauuucggcgu

SEQ ID NO: 1577947 - RNA, 16 nt, Pseudomonas putida KT2440
gccugucgcgacgggc

SEQ ID NO: 1577948 - RNA, 21 nt, Pseudomonas putida KT2440
gccugcugguacagccggcug

SEQ ID NO: 1577949 - RNA, 17 nt, Pseudomonas putida KT2440
gccugcuggccgcgcag

SEQ ID NO: 1577950 - RNA, 15 nt, Pseudomonas putida KT2440
gccugcuggcgaaga

SEQ ID NO: 1577951 - RNA, 14 nt, Pseudomonas putida KT2440
gccugcugacgcag

SEQ ID NO: 1577952 - RNA, 15 nt, Pseudomonas putida KT2440
gccugcugacgcagg

SEQ ID NO: 1577953 - RNA, 14 nt, Pseudomonas putida KT2440
gccugcugccaggc

SEQ ID NO: 1577954 - RNA, 13 nt, Pseudomonas putida KT2440
gccuggccacugu

SEQ ID NO: 1577955 - RNA, 15 nt, Pseudomonas putida KT2440
gccuggaugcguugc

SEQ ID NO: 1577956 - RNA, 16 nt, Pseudomonas putida KT2440
gccugcggcaccgucg

SEQ ID NO: 1577957 - RNA, 20 nt, Pseudomonas putida KT2440
gccugcuccagcacccgcuu

SEQ ID NO: 1577958 - RNA, 18 nt, Pseudomonas putida KT2440
gccugcucacccgaccag

SEQ ID NO: 1577959 - RNA, 20 nt, Pseudomonas putida KT2440
gccugcucacccgaccagau

SEQ ID NO: 1577960 - RNA, 17 nt, Pseudomonas putida KT2440
gccugcggccaggccgg

SEQ ID NO: 1577961 - RNA, 16 nt, Pseudomonas putida KT2440
gccggccgcacuucug

SEQ ID NO: 1577962 - RNA, 18 nt, Pseudomonas putida KT2440
gccggcccugcuggccaa

SEQ ID NO: 1577963 - RNA, 16 nt, Pseudomonas putida KT2440
gccggcccuuucgcgg

SEQ ID NO: 1577964 - RNA, 13 nt, Pseudomonas putida KT2440
gccggccccugcu

SEQ ID NO: 1577965 - RNA, 13 nt, Pseudomonas putida KT2440
gccggccccggca

SEQ ID NO: 1577966 - RNA, 21 nt, Pseudomonas putida KT2440
gccggccccguauacccaucg

SEQ ID NO: 1577967 - RNA, 19 nt, Pseudomonas putida KT2440
gccggcccauucgcgggua

SEQ ID NO: 1577968 - RNA, 17 nt, Pseudomonas putida KT2440
gccggccccacgcaguu

SEQ ID NO: 1577969 - RNA, 14 nt, Pseudomonas putida KT2440
gccggccauaccgg

SEQ ID NO: 1577970 - RNA, 18 nt, Pseudomonas putida KT2440
gccggccauucaucaucg

SEQ ID NO: 1577971 - RNA, 17 nt, Pseudomonas putida KT2440
gccggcccaaggcacca

SEQ ID NO: 1577972 - RNA, 15 nt, Pseudomonas putida KT2440
aagcaggcgacgcag

SEQ ID NO: 1577973 - RNA, 18 nt, Pseudomonas putida KT2440
gccggccuguugcgcacu

SEQ ID NO: 1577974 - RNA, 15 nt, Pseudomonas putida KT2440
gccggccucuucgcg

SEQ ID NO: 1577975 - RNA, 20 nt, Pseudomonas putida KT2440
gccggccucuucgcgggcaa

SEQ ID NO: 1577976 - RNA, 16 nt, Pseudomonas putida KT2440
gccggccucagcagcg

SEQ ID NO: 1577977 - RNA, 13 nt, Pseudomonas putida KT2440
gccggccuugacc

SEQ ID NO: 1577978 - RNA, 22 nt, Pseudomonas putida KT2440
gccggccuugaccucgaccagg

SEQ ID NO: 1577979 - RNA, 14 nt, Pseudomonas putida KT2440
gccggcgaacagca

SEQ ID NO: 1577980 - RNA, 21 nt, Pseudomonas putida KT2440
gccggcugaacuucaaccgca

SEQ ID NO: 1577981 - RNA, 22 nt, Pseudomonas putida KT2440
gccggcggugaugccauugauc

SEQ ID NO: 1577982 - RNA, 13 nt, Pseudomonas putida KT2440
gccggcggauagc

SEQ ID NO: 1577983 - RNA, 14 nt, Pseudomonas putida KT2440
gccggcggccaucg

SEQ ID NO: 1577984 - RNA, 23 nt, Pseudomonas putida KT2440
gccggcgccgguggcggccgcag

SEQ ID NO: 1577985 - RNA, 14 nt, Pseudomonas putida KT2440
gccggcgcccugca

SEQ ID NO: 1577986 - RNA, 16 nt, Pseudomonas putida KT2440
gccggcaccgacagca

SEQ ID NO: 1577987 - RNA, 16 nt, Pseudomonas putida KT2440
gccggcacagacaccg

SEQ ID NO: 1577988 - RNA, 21 nt, Pseudomonas putida KT2440
gccggcacagacaccgcaaau

SEQ ID NO: 1577989 - RNA, 21 nt, Pseudomonas putida KT2440
gccggcacagaccgcaacagu

SEQ ID NO: 1577990 - RNA, 23 nt, Pseudomonas putida KT2440
gccggcacaggcuuacaacugcu

SEQ ID NO: 1577991 - RNA, 20 nt, Pseudomonas putida KT2440
gccggcaagcuggucaggug

SEQ ID NO: 1577992 - RNA, 22 nt, Pseudomonas putida KT2440
gccggcaagcuggucaggugca

SEQ ID NO: 1577993 - RNA, 21 nt, Pseudomonas putida KT2440
gccggcaacuccuccagccga

SEQ ID NO: 1577994 - RNA, 23 nt, Pseudomonas putida KT2440
gccggcaauaccggccacgcgcg

SEQ ID NO: 1577995 - RNA, 16 nt, Pseudomonas putida KT2440
gccggcaaccccugca

SEQ ID NO: 1577996 - RNA, 21 nt, Pseudomonas putida KT2440
gccggcaaacaaaaagcaccu

SEQ ID NO: 1577997 - RNA, 14 nt, Pseudomonas putida KT2440
gccggaucuggcag

SEQ ID NO: 1577998 - RNA, 22 nt, Pseudomonas putida KT2440
gccggauagagcccggcgcagc

SEQ ID NO: 1577999 - RNA, 15 nt, Pseudomonas putida KT2440
gccggccaccacacu

SEQ ID NO: 1578000 - RNA, 19 nt, Pseudomonas putida KT2440
gccggcagucacccaccgg

SEQ ID NO: 1578001 - RNA, 19 nt, Pseudomonas putida KT2440
gccggcaguccacuugcgu

SEQ ID NO: 1578002 - RNA, 23 nt, Pseudomonas putida KT2440
gccggcaguccacuugcguucgc

SEQ ID NO: 1578003 - RNA, 16 nt, Pseudomonas putida KT2440
gccggcauaacggcug

SEQ ID NO: 1578004 - RNA, 19 nt, Pseudomonas putida KT2440
gccggcauaacggcuggcg

SEQ ID NO: 1578005 - RNA, 14 nt, Pseudomonas putida KT2440
gccggcagcgcggc

SEQ ID NO: 1578006 - RNA, 19 nt, Pseudomonas putida KT2440
gccggcagcgcggccgggu

SEQ ID NO: 1578007 - RNA, 12 nt, Pseudomonas putida KT2440
gccggcagcgcg

SEQ ID NO: 1578008 - RNA, 22 nt, Pseudomonas putida KT2440
gccggcagccagggccugaccg

SEQ ID NO: 1578009 - RNA, 15 nt, Pseudomonas putida KT2440
gccggcagcaaggca

SEQ ID NO: 1578010 - RNA, 19 nt, Pseudomonas putida KT2440
gccggcagcacgucggcgc

SEQ ID NO: 1578011 - RNA, 16 nt, Pseudomonas putida KT2440
gccggcacugaccacu

SEQ ID NO: 1578012 - RNA, 17 nt, Pseudomonas putida KT2440
gccggcacgcuaccacc

SEQ ID NO: 1578013 - RNA, 13 nt, Pseudomonas putida KT2440
gccggcaccgcca

SEQ ID NO: 1578014 - RNA, 16 nt, Pseudomonas putida KT2440
gccggaccugccgcag

SEQ ID NO: 1578015 - RNA, 20 nt, Pseudomonas putida KT2440
gccggaccugccgcagcgau

SEQ ID NO: 1578016 - RNA, 22 nt, Pseudomonas putida KT2440
gccggacuucuucaacgcggcu

SEQ ID NO: 1578017 - RNA, 23 nt, Pseudomonas putida KT2440
gccggaacaaccccuugcucaac

SEQ ID NO: 1578018 - RNA, 15 nt, Pseudomonas putida KT2440
gccgcuuugcggccc

SEQ ID NO: 1578019 - RNA, 21 nt, Pseudomonas putida KT2440
gccgcugccaaaguccggcga

SEQ ID NO: 1578020 - RNA, 14 nt, Pseudomonas putida KT2440
gccgcugccaaccg

SEQ ID NO: 1578021 - RNA, 18 nt, Pseudomonas putida KT2440
gccgcugccacagguacu

SEQ ID NO: 1578022 - RNA, 19 nt, Pseudomonas putida KT2440
gccgcugccacagguacug

SEQ ID NO: 1578023 - RNA, 15 nt, Pseudomonas putida KT2440
gccgcugccagcagg

SEQ ID NO: 1578024 - RNA, 20 nt, Pseudomonas putida KT2440
gccgcugcugcgccucgcag

SEQ ID NO: 1578025 - RNA, 18 nt, Pseudomonas putida KT2440
gccgcugcgcgguaaacg

SEQ ID NO: 1578026 - RNA, 13 nt, Pseudomonas putida KT2440
gccgcugcgcccg

SEQ ID NO: 1578027 - RNA, 13 nt, Pseudomonas putida KT2440
gccgcugcgccug

SEQ ID NO: 1578028 - RNA, 17 nt, Pseudomonas putida KT2440
gccgcugcgccugccgg

SEQ ID NO: 1578029 - RNA, 21 nt, Pseudomonas putida KT2440
gccgcugggcuucacguccaa

SEQ ID NO: 1578030 - RNA, 15 nt, Pseudomonas putida KT2440
gccgcuguacaccag

SEQ ID NO: 1578031 - RNA, 24 nt, Pseudomonas putida KT2440
gccgcuggcauccaccaggucggu

SEQ ID NO: 1578032 - RNA, 17 nt, Pseudomonas putida KT2440
gccgcuucgaccauugg

SEQ ID NO: 1578033 - RNA, 12 nt, Pseudomonas putida KT2440
gccgcuucgcga

SEQ ID NO: 1578034 - RNA, 15 nt, Pseudomonas putida KT2440
gccgcuucgcggauc

SEQ ID NO: 1578035 - RNA, 16 nt, Pseudomonas putida KT2440
gccgcuucguccaggu

SEQ ID NO: 1578036 - RNA, 21 nt, Pseudomonas putida KT2440
gccgcuuacgaacggguuggc

SEQ ID NO: 1578037 - RNA, 14 nt, Pseudomonas putida KT2440
gccgcuucacuguc

SEQ ID NO: 1578038 - RNA, 14 nt, Pseudomonas putida KT2440
gcggccgcagcccc

SEQ ID NO: 1578039 - RNA, 19 nt, Pseudomonas putida KT2440
gcggcauuggcgcgcucga

SEQ ID NO: 1578040 - RNA, 13 nt, Pseudomonas putida KT2440
gcggccgcuggua

SEQ ID NO: 1578041 - RNA, 20 nt, Pseudomonas putida KT2440
gcggccggucacccccauca

SEQ ID NO: 1578042 - RNA, 12 nt, Pseudomonas putida KT2440
gcggcgaucagc

SEQ ID NO: 1578043 - RNA, 14 nt, Pseudomonas putida KT2440
gcggcgacagggcg

SEQ ID NO: 1578044 - RNA, 19 nt, Pseudomonas putida KT2440
gcggccucgugucgcgaaa

SEQ ID NO: 1578045 - RNA, 20 nt, Pseudomonas putida KT2440
gcggcgaaggauggaccgac

SEQ ID NO: 1578046 - RNA, 14 nt, Pseudomonas putida KT2440
aagcuccagggugc

SEQ ID NO: 1578047 - RNA, 21 nt, Pseudomonas putida KT2440
gcggcgguugucgucgaccgc

SEQ ID NO: 1578048 - RNA, 13 nt, Pseudomonas putida KT2440
aagcugcaccgcc

SEQ ID NO: 1578049 - RNA, 16 nt, Pseudomonas putida KT2440
gcggcgcaccgcuugc

SEQ ID NO: 1578050 - RNA, 13 nt, Pseudomonas putida KT2440
gcggcgcagcgca

SEQ ID NO: 1578051 - RNA, 14 nt, Pseudomonas putida KT2440
gcggcgcagcgcac

SEQ ID NO: 1578052 - RNA, 14 nt, Pseudomonas putida KT2440
gcggcgcagggccu

SEQ ID NO: 1578053 - RNA, 13 nt, Pseudomonas putida KT2440
gcggcggaacggu

SEQ ID NO: 1578054 - RNA, 14 nt, Pseudomonas putida KT2440
gcggcgcgggcgca

SEQ ID NO: 1578055 - RNA, 21 nt, Pseudomonas putida KT2440
aagcguucgcccuccugcagc

SEQ ID NO: 1578056 - RNA, 15 nt, Pseudomonas putida KT2440
gcgggucacugcgcg

SEQ ID NO: 1578057 - RNA, 20 nt, Pseudomonas putida KT2440
gcggguaagcccgcuccuac

SEQ ID NO: 1578058 - RNA, 16 nt, Pseudomonas putida KT2440
gcggguaaugucccgc

SEQ ID NO: 1578059 - RNA, 20 nt, Pseudomonas putida KT2440
gcggguaaugucccgcacga

SEQ ID NO: 1578060 - RNA, 16 nt, Pseudomonas putida KT2440
gcggguaaacccgcgc

SEQ ID NO: 1578061 - RNA, 22 nt, Pseudomonas putida KT2440
gcgggggccccaccaggcaccg

SEQ ID NO: 1578062 - RNA, 22 nt, Pseudomonas putida KT2440
gcgggugccguggguugaacag

SEQ ID NO: 1578063 - RNA, 14 nt, Pseudomonas putida KT2440
gcgggugaacccgc

SEQ ID NO: 1578064 - RNA, 20 nt, Pseudomonas putida KT2440
gcgggugaacccgcuccuac

SEQ ID NO: 1578065 - RNA, 20 nt, Pseudomonas putida KT2440
gcgggugaacccgcuccugc

SEQ ID NO: 1578066 - RNA, 18 nt, Pseudomonas putida KT2440
gcgggucagguggcugua

SEQ ID NO: 1578067 - RNA, 20 nt, Pseudomonas putida KT2440
gcggguccgauccgguggcc

SEQ ID NO: 1578068 - RNA, 16 nt, Pseudomonas putida KT2440
gcgggucaagcuggau

SEQ ID NO: 1578069 - RNA, 16 nt, Pseudomonas putida KT2440
gcgguaaacgucggca

SEQ ID NO: 1578070 - RNA, 20 nt, Pseudomonas putida KT2440
gcgguaaagaacaugaucaa

SEQ ID NO: 1578071 - RNA, 19 nt, Pseudomonas putida KT2440
gcggguuugcccgcgagga

SEQ ID NO: 1578072 - RNA, 18 nt, Pseudomonas putida KT2440
gcggguuuacccgcgaag

SEQ ID NO: 1578073 - RNA, 19 nt, Pseudomonas putida KT2440
gcggguuuacccgcgaagc

SEQ ID NO: 1578074 - RNA, 20 nt, Pseudomonas putida KT2440
gcggguuuacccgcgaauac

SEQ ID NO: 1578075 - RNA, 20 nt, Pseudomonas putida KT2440
gcggguuuaccugugaaugc

SEQ ID NO: 1578076 - RNA, 19 nt, Pseudomonas putida KT2440
gcggguucacccgcgaagc

SEQ ID NO: 1578077 - RNA, 20 nt, Pseudomonas putida KT2440
gcggguucacccgcgaauac

SEQ ID NO: 1578078 - RNA, 20 nt, Pseudomonas putida KT2440
gcggguucacccgcgaaugc

SEQ ID NO: 1578079 - RNA, 23 nt, Pseudomonas putida KT2440
gcggguguggccacacugcucag

SEQ ID NO: 1578080 - RNA, 17 nt, Pseudomonas putida KT2440
gcggguggagauuggcc

SEQ ID NO: 1578081 - RNA, 17 nt, Pseudomonas putida KT2440
gcggguggaaauuggcc

SEQ ID NO: 1578082 - RNA, 19 nt, Pseudomonas putida KT2440
gcgguauccaucaccauca

SEQ ID NO: 1578083 - RNA, 22 nt, Pseudomonas putida KT2440
gcgguacuggaagagcaggaag

SEQ ID NO: 1578084 - RNA, 14 nt, Pseudomonas putida KT2440
gcgguccaccgcca

SEQ ID NO: 1578085 - RNA, 23 nt, Pseudomonas putida KT2440
gcgggcgauugccagggugccag

SEQ ID NO: 1578086 - RNA, 18 nt, Pseudomonas putida KT2440
gcgggcggcgcucgaucu

SEQ ID NO: 1578087 - RNA, 22 nt, Pseudomonas putida KT2440
gcgggcucguuauccgcgagua

SEQ ID NO: 1578088 - RNA, 22 nt, Pseudomonas putida KT2440
gcgggcuaugcgauugaucugc

SEQ ID NO: 1578089 - RNA, 19 nt, Pseudomonas putida KT2440
gcgggcucgcccgcgaaga

SEQ ID NO: 1578090 - RNA, 17 nt, Pseudomonas putida KT2440
gcgggcgugcccgcgaa

SEQ ID NO: 1578091 - RNA, 20 nt, Pseudomonas putida KT2440
gcgggcgugccugcgaaugg

SEQ ID NO: 1578092 - RNA, 18 nt, Pseudomonas putida KT2440
gcgggcuuguccgcgaag

SEQ ID NO: 1578093 - RNA, 19 nt, Pseudomonas putida KT2440
gcgggcuuguccgcgaagc

SEQ ID NO: 1578094 - RNA, 14 nt, Pseudomonas putida KT2440
gcgggcuugcccgc

SEQ ID NO: 1578095 - RNA, 17 nt, Pseudomonas putida KT2440
gcgggcuugcccgcgaa

SEQ ID NO: 1578096 - RNA, 19 nt, Pseudomonas putida KT2440
gcgggcuugcccgcgaagc

SEQ ID NO: 1578097 - RNA, 20 nt, Pseudomonas putida KT2440
gcgggcuuuuucguuugcgc

SEQ ID NO: 1578098 - RNA, 14 nt, Pseudomonas putida KT2440
gcggggagcgaacu

SEQ ID NO: 1578099 - RNA, 23 nt, Pseudomonas putida KT2440
gcgggacucgaucugugggagcg

SEQ ID NO: 1578100 - RNA, 12 nt, Pseudomonas putida KT2440
gcgggaccagca

SEQ ID NO: 1578101 - RNA, 17 nt, Pseudomonas putida KT2440
gcgggagucgaaccugc

SEQ ID NO: 1578102 - RNA, 13 nt, Pseudomonas putida KT2440
gcggcuacgcucg

SEQ ID NO: 1578103 - RNA, 16 nt, Pseudomonas putida KT2440
aagcuggagucguugc

SEQ ID NO: 1578104 - RNA, 20 nt, Pseudomonas putida KT2440
aagcuggcgcaagccgugcc

SEQ ID NO: 1578105 - RNA, 22 nt, Pseudomonas putida KT2440
gcggcguuugcgagcgcgggca

SEQ ID NO: 1578106 - RNA, 17 nt, Pseudomonas putida KT2440
gcggaccaccugggcca

SEQ ID NO: 1578107 - RNA, 14 nt, Pseudomonas putida KT2440
gcggaccaggugca

SEQ ID NO: 1578108 - RNA, 11 nt, Pseudomonas putida KT2440
gcggaucggcc

SEQ ID NO: 1578109 - RNA, 15 nt, Pseudomonas putida KT2440
gcggaucggcguggu

SEQ ID NO: 1578110 - RNA, 17 nt, Pseudomonas putida KT2440
gcggaucugacggcgcu

SEQ ID NO: 1578111 - RNA, 21 nt, Pseudomonas putida KT2440
gcggaucaucggcacgcccag

SEQ ID NO: 1578112 - RNA, 17 nt, Pseudomonas putida KT2440
gcggaucaucuccauga

SEQ ID NO: 1578113 - RNA, 14 nt, Pseudomonas putida KT2440
gcggauacagcgcc

SEQ ID NO: 1578114 - RNA, 16 nt, Pseudomonas putida KT2440
gcggauaucaaagcgg

SEQ ID NO: 1578115 - RNA, 15 nt, Pseudomonas putida KT2440
gcggcaccgccagcu

SEQ ID NO: 1578116 - RNA, 18 nt, Pseudomonas putida KT2440
gcggcacaucucaaggcu

SEQ ID NO: 1578117 - RNA, 18 nt, Pseudomonas putida KT2440
gcggcaccgucgccugca

SEQ ID NO: 1578118 - RNA, 21 nt, Pseudomonas putida KT2440
gcggcaccucguccagguuga

SEQ ID NO: 1578119 - RNA, 19 nt, Pseudomonas putida KT2440
gcggcagauccugcagccg

SEQ ID NO: 1578120 - RNA, 18 nt, Pseudomonas putida KT2440
gcggcagcaucgaccugc

SEQ ID NO: 1578121 - RNA, 16 nt, Pseudomonas putida KT2440
gcggcagcaugaacag

SEQ ID NO: 1578122 - RNA, 17 nt, Pseudomonas putida KT2440
gcggcagcaugaacagc

SEQ ID NO: 1578123 - RNA, 15 nt, Pseudomonas putida KT2440
aagccuucggccaug

SEQ ID NO: 1578124 - RNA, 15 nt, Pseudomonas putida KT2440
aagccuugcugauca

SEQ ID NO: 1578125 - RNA, 15 nt, Pseudomonas putida KT2440
gcggcagcgauccca

SEQ ID NO: 1578126 - RNA, 22 nt, Pseudomonas putida KT2440
gcggcaaagguggcaccgccgc

SEQ ID NO: 1578127 - RNA, 14 nt, Pseudomonas putida KT2440
gcggauuugcccgc

SEQ ID NO: 1578128 - RNA, 16 nt, Pseudomonas putida KT2440
gcggcaaagaucgccc

SEQ ID NO: 1578129 - RNA, 14 nt, Pseudomonas putida KT2440
gcggcaagguagcc

SEQ ID NO: 1578130 - RNA, 17 nt, Pseudomonas putida KT2440
gcggcaaggucaacggc

SEQ ID NO: 1578131 - RNA, 19 nt, Pseudomonas putida KT2440
gcggcaagcccgcuccuac

SEQ ID NO: 1578132 - RNA, 20 nt, Pseudomonas putida KT2440
gcggcaagcccgcuccuaca

SEQ ID NO: 1578133 - RNA, 17 nt, Pseudomonas putida KT2440
gcggcaaucacgaacac

SEQ ID NO: 1578134 - RNA, 21 nt, Pseudomonas putida KT2440
aagccgccacaugaaggccgu

SEQ ID NO: 1578135 - RNA, 12 nt, Pseudomonas putida KT2440
aagccgcuggcc

SEQ ID NO: 1578136 - RNA, 17 nt, Pseudomonas putida KT2440
aagccgcugccacaggu

SEQ ID NO: 1578137 - RNA, 14 nt, Pseudomonas putida KT2440
aagccgcucacccc

SEQ ID NO: 1578138 - RNA, 16 nt, Pseudomonas putida KT2440
gcgcgcauccacaggc

SEQ ID NO: 1578139 - RNA, 14 nt, Pseudomonas putida KT2440
gcgcucgcgaaugu

SEQ ID NO: 1578140 - RNA, 22 nt, Pseudomonas putida KT2440
gcgcucgcgguucaucggcaaa

SEQ ID NO: 1578141 - RNA, 22 nt, Pseudomonas putida KT2440
gcgcucgguugaugcagcgccc

SEQ ID NO: 1578142 - RNA, 15 nt, Pseudomonas putida KT2440
gcgcucguaggcuuc

SEQ ID NO: 1578143 - RNA, 14 nt, Pseudomonas putida KT2440
gcgcucgucgaacu

SEQ ID NO: 1578144 - RNA, 14 nt, Pseudomonas putida KT2440
gcgcucugcgccug

SEQ ID NO: 1578145 - RNA, 20 nt, Pseudomonas putida KT2440
gcgcucggucucauaggcgc

SEQ ID NO: 1578146 - RNA, 19 nt, Pseudomonas putida KT2440
gcgcugaaguagcgcagau

SEQ ID NO: 1578147 - RNA, 15 nt, Pseudomonas putida KT2440
gcgcugaccauaccu

SEQ ID NO: 1578148 - RNA, 16 nt, Pseudomonas putida KT2440
gcgcugagcgacagca

SEQ ID NO: 1578149 - RNA, 19 nt, Pseudomonas putida KT2440
gcgcugaccaacaggcugg

SEQ ID NO: 1578150 - RNA, 19 nt, Pseudomonas putida KT2440
gcgcugacgaacaacgcca

SEQ ID NO: 1578151 - RNA, 17 nt, Pseudomonas putida KT2440
gcgcugacgcagggccu

SEQ ID NO: 1578152 - RNA, 18 nt, Pseudomonas putida KT2440
gcgcugacucagcggccu

SEQ ID NO: 1578153 - RNA, 16 nt, Pseudomonas putida KT2440
gcgcugacugccaggc

SEQ ID NO: 1578154 - RNA, 17 nt, Pseudomonas putida KT2440
gcgcugaucaucgacag

SEQ ID NO: 1578155 - RNA, 21 nt, Pseudomonas putida KT2440
gcgcugaucaucgacaggugc

SEQ ID NO: 1578156 - RNA, 22 nt, Pseudomonas putida KT2440
gcgcugaucgaaagcugcgcac

SEQ ID NO: 1578157 - RNA, 18 nt, Pseudomonas putida KT2440
gcgcugaugcggacccag

SEQ ID NO: 1578158 - RNA, 20 nt, Pseudomonas putida KT2440
gcgcugaugcggacccagcg

SEQ ID NO: 1578159 - RNA, 19 nt, Pseudomonas putida KT2440
gcgcugcaagcgcaccugc

SEQ ID NO: 1578160 - RNA, 22 nt, Pseudomonas putida KT2440
gcgcugcaagcgcaccugcagg

SEQ ID NO: 1578161 - RNA, 13 nt, Pseudomonas putida KT2440
gcgcugcauggcg

SEQ ID NO: 1578162 - RNA, 17 nt, Pseudomonas putida KT2440
gcgcugcauggcggcac

SEQ ID NO: 1578163 - RNA, 23 nt, Pseudomonas putida KT2440
gcgcugcgcaaggacgacguggu

SEQ ID NO: 1578164 - RNA, 15 nt, Pseudomonas putida KT2440
gcgcugcgcagguau

SEQ ID NO: 1578165 - RNA, 19 nt, Pseudomonas putida KT2440
gcgcugccucgucggacag

SEQ ID NO: 1578166 - RNA, 16 nt, Pseudomonas putida KT2440
gcgcuggacagguaga

SEQ ID NO: 1578167 - RNA, 15 nt, Pseudomonas putida KT2440
gcgcugcugggcguc

SEQ ID NO: 1578168 - RNA, 14 nt, Pseudomonas putida KT2440
gcgcugcguuggcc

SEQ ID NO: 1578169 - RNA, 17 nt, Pseudomonas putida KT2440
gcgcugccaggccgggu

SEQ ID NO: 1578170 - RNA, 17 nt, Pseudomonas putida KT2440
gcgcugcggguggcgua

SEQ ID NO: 1578171 - RNA, 13 nt, Pseudomonas putida KT2440
gcgcuggccacga

SEQ ID NO: 1578172 - RNA, 13 nt, Pseudomonas putida KT2440
gcgcuguccagcg

SEQ ID NO: 1578173 - RNA, 15 nt, Pseudomonas putida KT2440
gcgcuguccagcgca

SEQ ID NO: 1578174 - RNA, 18 nt, Pseudomonas putida KT2440
gcgcuguccagcgcauca

SEQ ID NO: 1578175 - RNA, 15 nt, Pseudomonas putida KT2440
gcgcuucgaucgccg

SEQ ID NO: 1578176 - RNA, 15 nt, Pseudomonas putida KT2440
gcgcuucauccagcg

SEQ ID NO: 1578177 - RNA, 19 nt, Pseudomonas putida KT2440
gcgcuugagcaggucgaac

SEQ ID NO: 1578178 - RNA, 13 nt, Pseudomonas putida KT2440
gcgcuugacccgg

SEQ ID NO: 1578179 - RNA, 20 nt, Pseudomonas putida KT2440
gcgcugggcguccagguagc

SEQ ID NO: 1578180 - RNA, 17 nt, Pseudomonas putida KT2440
gcgcugguuuaucagca

SEQ ID NO: 1578181 - RNA, 21 nt, Pseudomonas putida KT2440
gcgcuguaaacgguaggaacg

SEQ ID NO: 1578182 - RNA, 23 nt, Pseudomonas putida KT2440
gcgcuggucggcaaucugcucga

SEQ ID NO: 1578183 - RNA, 21 nt, Pseudomonas putida KT2440
gcgcuggcgggcaaacuggcg

SEQ ID NO: 1578184 - RNA, 17 nt, Pseudomonas putida KT2440
gcgcugggcgguaccca

SEQ ID NO: 1578185 - RNA, 19 nt, Pseudomonas putida KT2440
gcggaacagguugaccaac

SEQ ID NO: 1578186 - RNA, 23 nt, Pseudomonas putida KT2440
gcggaacauacgcaucagcgcag

SEQ ID NO: 1578187 - RNA, 19 nt, Pseudomonas putida KT2440
gcggaacuggcccuggcca

SEQ ID NO: 1578188 - RNA, 14 nt, Pseudomonas putida KT2440
gcggaagauacccg

SEQ ID NO: 1578189 - RNA, 17 nt, Pseudomonas putida KT2440
gcgcuugcccgcgaaug

SEQ ID NO: 1578190 - RNA, 19 nt, Pseudomonas putida KT2440
gcgcuuuucuucgcugcug

SEQ ID NO: 1578191 - RNA, 15 nt, Pseudomonas putida KT2440
gcucaccggccagcg

SEQ ID NO: 1578192 - RNA, 17 nt, Pseudomonas putida KT2440
gcucaccggccagcgcg

SEQ ID NO: 1578193 - RNA, 20 nt, Pseudomonas putida KT2440
gcucaccggccagcgcgcug

SEQ ID NO: 1578194 - RNA, 18 nt, Pseudomonas putida KT2440
gcucacgcaagcggcccu

SEQ ID NO: 1578195 - RNA, 24 nt, Pseudomonas putida KT2440
gcucacuggcauccagcgccacca

SEQ ID NO: 1578196 - RNA, 13 nt, Pseudomonas putida KT2440
gcucacugaccac

SEQ ID NO: 1578197 - RNA, 12 nt, Pseudomonas putida KT2440
gcuccgccacca

SEQ ID NO: 1578198 - RNA, 14 nt, Pseudomonas putida KT2440
gcucgacggcgcaa

SEQ ID NO: 1578199 - RNA, 23 nt, Pseudomonas putida KT2440
gcucgagaaacucacgcauggcc

SEQ ID NO: 1578200 - RNA, 17 nt, Pseudomonas putida KT2440
gcucgacgcgcgcagcc

SEQ ID NO: 1578201 - RNA, 17 nt, Pseudomonas putida KT2440
gcuccuacaaagcggcg

SEQ ID NO: 1578202 - RNA, 19 nt, Pseudomonas putida KT2440
gcuccuacaagguugcgca

SEQ ID NO: 1578203 - RNA, 21 nt, Pseudomonas putida KT2440
gcuccuacaagguugcgcaag

SEQ ID NO: 1578204 - RNA, 15 nt, Pseudomonas putida KT2440
gcuccuacaggccgc

SEQ ID NO: 1578205 - RNA, 18 nt, Pseudomonas putida KT2440
gcuccuaccacguacaca

SEQ ID NO: 1578206 - RNA, 16 nt, Pseudomonas putida KT2440
gcuccuacgacggccu

SEQ ID NO: 1578207 - RNA, 13 nt, Pseudomonas putida KT2440
gcuccuacgcggg

SEQ ID NO: 1578208 - RNA, 17 nt, Pseudomonas putida KT2440
gcuccuacgggcaaccg

SEQ ID NO: 1578209 - RNA, 21 nt, Pseudomonas putida KT2440
gcuccuacgggcgagcgcgca

SEQ ID NO: 1578210 - RNA, 16 nt, Pseudomonas putida KT2440
gcuccuacuacggccu

SEQ ID NO: 1578211 - RNA, 15 nt, Pseudomonas putida KT2440
gcucgcgcagggcau

SEQ ID NO: 1578212 - RNA, 19 nt, Pseudomonas putida KT2440
gcucgcgcagggcaucgcg

SEQ ID NO: 1578213 - RNA, 16 nt, Pseudomonas putida KT2440
gcucgcccgggucagg

SEQ ID NO: 1578214 - RNA, 14 nt, Pseudomonas putida KT2440
gcucgaucggcaag

SEQ ID NO: 1578215 - RNA, 12 nt, Pseudomonas putida KT2440
gcucggccagcu

SEQ ID NO: 1578216 - RNA, 19 nt, Pseudomonas putida KT2440
gcucggccaguaccagguc

SEQ ID NO: 1578217 - RNA, 15 nt, Pseudomonas putida KT2440
gcucgcuggccacca

SEQ ID NO: 1578218 - RNA, 23 nt, Pseudomonas putida KT2440
gcucgcuggccaccagcauggcg

SEQ ID NO: 1578219 - RNA, 13 nt, Pseudomonas putida KT2440
gcucgcgcgggua

SEQ ID NO: 1578220 - RNA, 14 nt, Pseudomonas putida KT2440
gcucgcgcugccag

SEQ ID NO: 1578221 - RNA, 13 nt, Pseudomonas putida KT2440
gcucgcgcugcgc

SEQ ID NO: 1578222 - RNA, 17 nt, Pseudomonas putida KT2440
gcucgcgcugcgcagcc

SEQ ID NO: 1578223 - RNA, 20 nt, Pseudomonas putida KT2440
gcucgcgcugcgcagccaac

SEQ ID NO: 1578224 - RNA, 22 nt, Pseudomonas putida KT2440
gcucgcuauuccgauacgccgc

SEQ ID NO: 1578225 - RNA, 16 nt, Pseudomonas putida KT2440
gcucgcuccagggcag

SEQ ID NO: 1578226 - RNA, 17 nt, Pseudomonas putida KT2440
gcucguccaucaccgcc

SEQ ID NO: 1578227 - RNA, 19 nt, Pseudomonas putida KT2440
gcucguacgucgccugguc

SEQ ID NO: 1578228 - RNA, 18 nt, Pseudomonas putida KT2440
gcucguaggcugcagcga

SEQ ID NO: 1578229 - RNA, 22 nt, Pseudomonas putida KT2440
gcucgucgagcaacuugcgcag

SEQ ID NO: 1578230 - RNA, 17 nt, Pseudomonas putida KT2440
gcucgucucuggccgca

SEQ ID NO: 1578231 - RNA, 15 nt, Pseudomonas putida KT2440
gcucggguucguaca

SEQ ID NO: 1578232 - RNA, 18 nt, Pseudomonas putida KT2440
gcucgguaucggccagcc

SEQ ID NO: 1578233 - RNA, 17 nt, Pseudomonas putida KT2440
gcucggcgaugccgcgc

SEQ ID NO: 1578234 - RNA, 18 nt, Pseudomonas putida KT2440
gcugaacuucaaccgcac

SEQ ID NO: 1578235 - RNA, 14 nt, Pseudomonas putida KT2440
gcugaccgggucga

SEQ ID NO: 1578236 - RNA, 20 nt, Pseudomonas putida KT2440
gcucugccgguguucgcggg

SEQ ID NO: 1578237 - RNA, 14 nt, Pseudomonas putida KT2440
gcucugcgccagca

SEQ ID NO: 1578238 - RNA, 17 nt, Pseudomonas putida KT2440
gcucugcgccagcaguu

SEQ ID NO: 1578239 - RNA, 16 nt, Pseudomonas putida KT2440
gcucuggcccgaacag

SEQ ID NO: 1578240 - RNA, 17 nt, Pseudomonas putida KT2440
gcucuggcccgaacagc

SEQ ID NO: 1578241 - RNA, 21 nt, Pseudomonas putida KT2440
gcucugcggcccauucgcggg

SEQ ID NO: 1578242 - RNA, 24 nt, Pseudomonas putida KT2440
gcucugcggcccauucgcgggcaa

SEQ ID NO: 1578243 - RNA, 23 nt, Pseudomonas putida KT2440
gcucugcuugagcgcagcgacga

SEQ ID NO: 1578244 - RNA, 16 nt, Pseudomonas putida KT2440
gcucuggcugagcgca

SEQ ID NO: 1578245 - RNA, 23 nt, Pseudomonas putida KT2440
gcucuggucgaucuucagcgcau

SEQ ID NO: 1578246 - RNA, 22 nt, Pseudomonas putida KT2440
gcucugggcaaaaucgaccagg

SEQ ID NO: 1578247 - RNA, 22 nt, Pseudomonas putida KT2440
gcucuucgacacugaucucgcg

SEQ ID NO: 1578248 - RNA, 21 nt, Pseudomonas putida KT2440
gcucuucaaccaguucagcgc

SEQ ID NO: 1578249 - RNA, 23 nt, Pseudomonas putida KT2440
gcucuucaaccaguucagcgccc

SEQ ID NO: 1578250 - RNA, 16 nt, Pseudomonas putida KT2440
gcucuucaucgcggua

SEQ ID NO: 1578251 - RNA, 14 nt, Pseudomonas putida KT2440
gcucuguaucgaac

SEQ ID NO: 1578252 - RNA, 18 nt, Pseudomonas putida KT2440
gcucuguaucgaacaggc

SEQ ID NO: 1578253 - RNA, 20 nt, Pseudomonas putida KT2440
gcucuguaucgaacaggcag

SEQ ID NO: 1578254 - RNA, 17 nt, Pseudomonas putida KT2440
gcucugugcaugcgccc

SEQ ID NO: 1578255 - RNA, 12 nt, Pseudomonas putida KT2440
gcucuguggauu

SEQ ID NO: 1578256 - RNA, 15 nt, Pseudomonas putida KT2440
gcucuguggauuuca

SEQ ID NO: 1578257 - RNA, 13 nt, Pseudomonas putida KT2440
gcucuucgcgggu

SEQ ID NO: 1578258 - RNA, 14 nt, Pseudomonas putida KT2440
gcucuucgcgggug

SEQ ID NO: 1578259 - RNA, 15 nt, Pseudomonas putida KT2440
gcucuucgcggguga

SEQ ID NO: 1578260 - RNA, 18 nt, Pseudomonas putida KT2440
gcucuucgauccgcgcca

SEQ ID NO: 1578261 - RNA, 17 nt, Pseudomonas putida KT2440
gcucuucucgucguagc

SEQ ID NO: 1578262 - RNA, 19 nt, Pseudomonas putida KT2440
gcugcggcaggcuggcacg

SEQ ID NO: 1578263 - RNA, 15 nt, Pseudomonas putida KT2440
gcugcggcagguagg

SEQ ID NO: 1578264 - RNA, 16 nt, Pseudomonas putida KT2440
gcugcggauacagcgc

SEQ ID NO: 1578265 - RNA, 21 nt, Pseudomonas putida KT2440
gcugcgaguaacuguacuguu

SEQ ID NO: 1578266 - RNA, 18 nt, Pseudomonas putida KT2440
gcugcgaguucaggcgcc

SEQ ID NO: 1578267 - RNA, 20 nt, Pseudomonas putida KT2440
gcugcgauagaacuccacca

SEQ ID NO: 1578268 - RNA, 21 nt, Pseudomonas putida KT2440
gcugcgauagaacuccaccag

SEQ ID NO: 1578269 - RNA, 17 nt, Pseudomonas putida KT2440
gcugcgaggaucagcgc

SEQ ID NO: 1578270 - RNA, 19 nt, Pseudomonas putida KT2440
gcugcgaggaucagcgcau

SEQ ID NO: 1578271 - RNA, 15 nt, Pseudomonas putida KT2440
gcugcgcaguacagg

SEQ ID NO: 1578272 - RNA, 20 nt, Pseudomonas putida KT2440
gcugcgcaguacaggcugcc

SEQ ID NO: 1578273 - RNA, 16 nt, Pseudomonas putida KT2440
gcugcgcagcuggucg

SEQ ID NO: 1578274 - RNA, 20 nt, Pseudomonas putida KT2440
gcugccuucgcucaggugca

SEQ ID NO: 1578275 - RNA, 16 nt, Pseudomonas putida KT2440
gcugccuugcccagcu

SEQ ID NO: 1578276 - RNA, 17 nt, Pseudomonas putida KT2440
gcugccuugcccagcuc

SEQ ID NO: 1578277 - RNA, 22 nt, Pseudomonas putida KT2440
gcugccuugcccagcuccagca

SEQ ID NO: 1578278 - RNA, 13 nt, Pseudomonas putida KT2440
gcugccugugccg

SEQ ID NO: 1578279 - RNA, 22 nt, Pseudomonas putida KT2440
gcugccugugccggccucuucg

SEQ ID NO: 1578280 - RNA, 14 nt, Pseudomonas putida KT2440
gcugccggucggcc

SEQ ID NO: 1578281 - RNA, 15 nt, Pseudomonas putida KT2440
gcugcccgcgugcgc

SEQ ID NO: 1578282 - RNA, 22 nt, Pseudomonas putida KT2440
gcugcacugccgcauucgcggg

SEQ ID NO: 1578283 - RNA, 15 nt, Pseudomonas putida KT2440
gcugcacuggcaugc

SEQ ID NO: 1578284 - RNA, 16 nt, Pseudomonas putida KT2440
gcugcacuggcaugcg

SEQ ID NO: 1578285 - RNA, 21 nt, Pseudomonas putida KT2440
gcugcacgucgcgcagggccu

SEQ ID NO: 1578286 - RNA, 20 nt, Pseudomonas putida KT2440
gcugcagggcacgccaauca

SEQ ID NO: 1578287 - RNA, 19 nt, Pseudomonas putida KT2440
gcugcagggcccagccacc

SEQ ID NO: 1578288 - RNA, 18 nt, Pseudomonas putida KT2440
gcugcaggucggccagcu

SEQ ID NO: 1578289 - RNA, 15 nt, Pseudomonas putida KT2440
gcugcagggcgccga

SEQ ID NO: 1578290 - RNA, 18 nt, Pseudomonas putida KT2440
gcugccagcguuuccggg

SEQ ID NO: 1578291 - RNA, 19 nt, Pseudomonas putida KT2440
gcugccagcguuuccgggu

SEQ ID NO: 1578292 - RNA, 21 nt, Pseudomonas putida KT2440
gcugccaggaagcucgcacgc

SEQ ID NO: 1578293 - RNA, 15 nt, Pseudomonas putida KT2440
gcugccagcagggca

SEQ ID NO: 1578294 - RNA, 16 nt, Pseudomonas putida KT2440
gcugccagcagggcag

SEQ ID NO: 1578295 - RNA, 16 nt, Pseudomonas putida KT2440
gcugccacggcggaag

SEQ ID NO: 1578296 - RNA, 13 nt, Pseudomonas putida KT2440
gcugccacgggca

SEQ ID NO: 1578297 - RNA, 14 nt, Pseudomonas putida KT2440
gcugccacgggcau

SEQ ID NO: 1578298 - RNA, 16 nt, Pseudomonas putida KT2440
gcugcaguucagggcg

SEQ ID NO: 1578299 - RNA, 23 nt, Pseudomonas putida KT2440
gcugcaucagguagcugggcccg

SEQ ID NO: 1578300 - RNA, 16 nt, Pseudomonas putida KT2440
gcugcauauaccgcgc

SEQ ID NO: 1578301 - RNA, 17 nt, Pseudomonas putida KT2440
gcugcauauaccgcgca

SEQ ID NO: 1578302 - RNA, 17 nt, Pseudomonas putida KT2440
gcugccauagcgcugca

SEQ ID NO: 1578303 - RNA, 14 nt, Pseudomonas putida KT2440
gcugccaugcgcug

SEQ ID NO: 1578304 - RNA, 21 nt, Pseudomonas putida KT2440
gcugcaccggccucuucgcgg

SEQ ID NO: 1578305 - RNA, 22 nt, Pseudomonas putida KT2440
gcugcaccggccucuucgcggg

SEQ ID NO: 1578306 - RNA, 18 nt, Pseudomonas putida KT2440
gcugauugagcagcuggg

SEQ ID NO: 1578307 - RNA, 15 nt, Pseudomonas putida KT2440
gcugcaacagcggcg

SEQ ID NO: 1578308 - RNA, 16 nt, Pseudomonas putida KT2440
gcugcaaagcagaccc

SEQ ID NO: 1578309 - RNA, 22 nt, Pseudomonas putida KT2440
gcugcaaagcagccccggcaau

SEQ ID NO: 1578310 - RNA, 14 nt, Pseudomonas putida KT2440
gcugauucaacgcc

SEQ ID NO: 1578311 - RNA, 18 nt, Pseudomonas putida KT2440
gcugauucagcacaccgc

SEQ ID NO: 1578312 - RNA, 20 nt, Pseudomonas putida KT2440
gcugauggauuccucgcgcu

SEQ ID NO: 1578313 - RNA, 12 nt, Pseudomonas putida KT2440
gcugaugcgccg

SEQ ID NO: 1578314 - RNA, 19 nt, Pseudomonas putida KT2440
gcugaugcgggaccagcac

SEQ ID NO: 1578315 - RNA, 20 nt, Pseudomonas putida KT2440
gcugaugguggucggcagcu

SEQ ID NO: 1578316 - RNA, 18 nt, Pseudomonas putida KT2440
gcuggccaucgacccgcu

SEQ ID NO: 1578317 - RNA, 16 nt, Pseudomonas putida KT2440
gcuggccauuucgcgg

SEQ ID NO: 1578318 - RNA, 21 nt, Pseudomonas putida KT2440
gcuggccauuucgcggcgcag

SEQ ID NO: 1578319 - RNA, 15 nt, Pseudomonas putida KT2440
gcuggcauucaacgc

SEQ ID NO: 1578320 - RNA, 14 nt, Pseudomonas putida KT2440
gcuggccaaggccu

SEQ ID NO: 1578321 - RNA, 15 nt, Pseudomonas putida KT2440
gcuggcacgccuuca

SEQ ID NO: 1578322 - RNA, 17 nt, Pseudomonas putida KT2440
gcuggcacccacgcgcu

SEQ ID NO: 1578323 - RNA, 17 nt, Pseudomonas putida KT2440
gcuggcacccgcaggac

SEQ ID NO: 1578324 - RNA, 14 nt, Pseudomonas putida KT2440
gcuggccaccauga

SEQ ID NO: 1578325 - RNA, 19 nt, Pseudomonas putida KT2440
gcuggccaccaugaacagc

SEQ ID NO: 1578326 - RNA, 18 nt, Pseudomonas putida KT2440
gcuggccuuguacaacgc

SEQ ID NO: 1578327 - RNA, 22 nt, Pseudomonas putida KT2440
gcuggccuguucguucccacaa

SEQ ID NO: 1578328 - RNA, 16 nt, Pseudomonas putida KT2440
gcuggccucuucgcgg

SEQ ID NO: 1578329 - RNA, 17 nt, Pseudomonas putida KT2440
gcuggccucuucgcggg

SEQ ID NO: 1578330 - RNA, 20 nt, Pseudomonas putida KT2440
gcuggccucacaucgcgcag

SEQ ID NO: 1578331 - RNA, 14 nt, Pseudomonas putida KT2440
gcuggcgaucggcu

SEQ ID NO: 1578332 - RNA, 19 nt, Pseudomonas putida KT2440
gcuggcgaucggcuggucc

SEQ ID NO: 1578333 - RNA, 18 nt, Pseudomonas putida KT2440
gcuggcgacgcugcccag

SEQ ID NO: 1578334 - RNA, 14 nt, Pseudomonas putida KT2440
gcuggcgaucaggc

SEQ ID NO: 1578335 - RNA, 21 nt, Pseudomonas putida KT2440
gcuggccgccacggugccgaa

SEQ ID NO: 1578336 - RNA, 14 nt, Pseudomonas putida KT2440
gcuggcccuucgcg

SEQ ID NO: 1578337 - RNA, 20 nt, Pseudomonas putida KT2440
gcuggcccgcgaugccgaca

SEQ ID NO: 1578338 - RNA, 23 nt, Pseudomonas putida KT2440
gcuggauaagaucacugcgcagc

SEQ ID NO: 1578339 - RNA, 16 nt, Pseudomonas putida KT2440
gcuggagcuauuuggc

SEQ ID NO: 1578340 - RNA, 16 nt, Pseudomonas putida KT2440
gcuggauuccgacaag

SEQ ID NO: 1578341 - RNA, 16 nt, Pseudomonas putida KT2440
gcuggauggucacgcc

SEQ ID NO: 1578342 - RNA, 14 nt, Pseudomonas putida KT2440
gcuggauacccagc

SEQ ID NO: 1578343 - RNA, 18 nt, Pseudomonas putida KT2440
gcuggauagaguacucgg

SEQ ID NO: 1578344 - RNA, 12 nt, Pseudomonas putida KT2440
gcuggaucacca

SEQ ID NO: 1578345 - RNA, 15 nt, Pseudomonas putida KT2440
gcuggaucaccaccg

SEQ ID NO: 1578346 - RNA, 18 nt, Pseudomonas putida KT2440
gcuggaccuggcuggcgg

SEQ ID NO: 1578347 - RNA, 12 nt, Pseudomonas putida KT2440
gcuggaccuggc

SEQ ID NO: 1578348 - RNA, 15 nt, Pseudomonas putida KT2440
gcuggacaugcacgc

SEQ ID NO: 1578349 - RNA, 16 nt, Pseudomonas putida KT2440
gcuggacaugcacgcc

SEQ ID NO: 1578350 - RNA, 15 nt, Pseudomonas putida KT2440
gcuggacccaaucgc

SEQ ID NO: 1578351 - RNA, 21 nt, Pseudomonas putida KT2440
gcuggacaccucccgcgcauc

SEQ ID NO: 1578352 - RNA, 15 nt, Pseudomonas putida KT2440
gcuggaacugcugca

SEQ ID NO: 1578353 - RNA, 17 nt, Pseudomonas putida KT2440
gcuggaacugcugcacu

SEQ ID NO: 1578354 - RNA, 12 nt, Pseudomonas putida KT2440
gcugcuggcacg

SEQ ID NO: 1578355 - RNA, 18 nt, Pseudomonas putida KT2440
gcugcuggcacgccuuca

SEQ ID NO: 1578356 - RNA, 16 nt, Pseudomonas putida KT2440
gcugcuuugcagccca

SEQ ID NO: 1578357 - RNA, 22 nt, Pseudomonas putida KT2440
gcugcuugaacacauagaacag

SEQ ID NO: 1578358 - RNA, 17 nt, Pseudomonas putida KT2440
gcugcuuccggcuggua

SEQ ID NO: 1578359 - RNA, 13 nt, Pseudomonas putida KT2440
gcugcuucacggg

SEQ ID NO: 1578360 - RNA, 12 nt, Pseudomonas putida KT2440
gcugcugcgcag

SEQ ID NO: 1578361 - RNA, 17 nt, Pseudomonas putida KT2440
gcugcugcgcagcccug

SEQ ID NO: 1578362 - RNA, 12 nt, Pseudomonas putida KT2440
gcgucucgccgc

SEQ ID NO: 1578363 - RNA, 15 nt, Pseudomonas putida KT2440
gcgucugacuggcag

SEQ ID NO: 1578364 - RNA, 20 nt, Pseudomonas putida KT2440
gcgucucuuccuccaucucg

SEQ ID NO: 1578365 - RNA, 19 nt, Pseudomonas putida KT2440
gcgugaacuugaucgcguu

SEQ ID NO: 1578366 - RNA, 20 nt, Pseudomonas putida KT2440
gcgugaagcggccaccugcc

SEQ ID NO: 1578367 - RNA, 22 nt, Pseudomonas putida KT2440
aagcuuggggcgauguuggccg

SEQ ID NO: 1578368 - RNA, 22 nt, Pseudomonas putida KT2440
aagcuuccaguuggccggcaug

SEQ ID NO: 1578369 - RNA, 15 nt, Pseudomonas putida KT2440
aagcuucagcgaccg

SEQ ID NO: 1578370 - RNA, 19 nt, Pseudomonas putida KT2440
gcgucguggccuucgcggg

SEQ ID NO: 1578371 - RNA, 18 nt, Pseudomonas putida KT2440
gcgucguuggggucgacc

SEQ ID NO: 1578372 - RNA, 13 nt, Pseudomonas putida KT2440
gcgucggcgacgu

SEQ ID NO: 1578373 - RNA, 14 nt, Pseudomonas putida KT2440
gcgugcgcccagau

SEQ ID NO: 1578374 - RNA, 23 nt, Pseudomonas putida KT2440
gcgugcgauguugaucagguacc

SEQ ID NO: 1578375 - RNA, 16 nt, Pseudomonas putida KT2440
gcgugccucagccagg

SEQ ID NO: 1578376 - RNA, 17 nt, Pseudomonas putida KT2440
gcgugccucgcccaggu

SEQ ID NO: 1578377 - RNA, 18 nt, Pseudomonas putida KT2440
gcgugcccgccacaccug

SEQ ID NO: 1578378 - RNA, 14 nt, Pseudomonas putida KT2440
gcgugccaggcuug

SEQ ID NO: 1578379 - RNA, 15 nt, Pseudomonas putida KT2440
gcgugcgcccggcaa

SEQ ID NO: 1578380 - RNA, 17 nt, Pseudomonas putida KT2440
gcguggccuguaccgac

SEQ ID NO: 1578381 - RNA, 17 nt, Pseudomonas putida KT2440
gcguggcggugaugcgc

SEQ ID NO: 1578382 - RNA, 21 nt, Pseudomonas putida KT2440
gcgucggccaccuggucgaau

SEQ ID NO: 1578383 - RNA, 12 nt, Pseudomonas putida KT2440
gcgucgccugca

SEQ ID NO: 1578384 - RNA, 15 nt, Pseudomonas putida KT2440
gcgucgcgaugggcu

SEQ ID NO: 1578385 - RNA, 18 nt, Pseudomonas putida KT2440
gcgucgaugcggccacag

SEQ ID NO: 1578386 - RNA, 16 nt, Pseudomonas putida KT2440
gcguccagcagugcca

SEQ ID NO: 1578387 - RNA, 22 nt, Pseudomonas putida KT2440
gcguccagcagugccaucgccu

SEQ ID NO: 1578388 - RNA, 20 nt, Pseudomonas putida KT2440
gcgucgaacacggcguggug

SEQ ID NO: 1578389 - RNA, 16 nt, Pseudomonas putida KT2440
gcgucacgcagggcca

SEQ ID NO: 1578390 - RNA, 16 nt, Pseudomonas putida KT2440
gcgucacugcaccucc

SEQ ID NO: 1578391 - RNA, 21 nt, Pseudomonas putida KT2440
gcgucacugcaccucccgcca

SEQ ID NO: 1578392 - RNA, 16 nt, Pseudomonas putida KT2440
gcgucagcaccggcag

SEQ ID NO: 1578393 - RNA, 15 nt, Pseudomonas putida KT2440
gcgucauacucuucg

SEQ ID NO: 1578394 - RNA, 17 nt, Pseudomonas putida KT2440
gcgguccuucaugccga

SEQ ID NO: 1578395 - RNA, 14 nt, Pseudomonas putida KT2440
gcgguccuggucgc

SEQ ID NO: 1578396 - RNA, 15 nt, Pseudomonas putida KT2440
gcgguccuccuuggc

SEQ ID NO: 1578397 - RNA, 19 nt, Pseudomonas putida KT2440
gcguauucgcccagcgcuc

SEQ ID NO: 1578398 - RNA, 13 nt, Pseudomonas putida KT2440
gcguauugcuggu

SEQ ID NO: 1578399 - RNA, 21 nt, Pseudomonas putida KT2440
gcguauguuuuguaggcgcgg

SEQ ID NO: 1578400 - RNA, 22 nt, Pseudomonas putida KT2440
gcguaggccugcgaaaggcgcu

SEQ ID NO: 1578401 - RNA, 23 nt, Pseudomonas putida KT2440
gcguaggggcggauuugcccgcu

SEQ ID NO: 1578402 - RNA, 15 nt, Pseudomonas putida KT2440
gcucaccgcagccca

SEQ ID NO: 1578403 - RNA, 17 nt, Pseudomonas putida KT2440
gcucacccuucucgaac

SEQ ID NO: 1578404 - RNA, 14 nt, Pseudomonas putida KT2440
gcucacacccaggc

SEQ ID NO: 1578405 - RNA, 14 nt, Pseudomonas putida KT2440
gcucacccaccagc

SEQ ID NO: 1578406 - RNA, 18 nt, Pseudomonas putida KT2440
gcucaccccauagggcca

SEQ ID NO: 1578407 - RNA, 22 nt, Pseudomonas putida KT2440
gcucaccccauagggccagcgg

SEQ ID NO: 1578408 - RNA, 18 nt, Pseudomonas putida KT2440
gcucaagucgugccggaa

SEQ ID NO: 1578409 - RNA, 14 nt, Pseudomonas putida KT2440
gcucaagcgcagcc

SEQ ID NO: 1578410 - RNA, 20 nt, Pseudomonas putida KT2440
gcucaagcgugacggccagc

SEQ ID NO: 1578411 - RNA, 22 nt, Pseudomonas putida KT2440
gcucaauuucuaaaagcuggcg

SEQ ID NO: 1578412 - RNA, 13 nt, Pseudomonas putida KT2440
gcucaauagcggc

SEQ ID NO: 1578413 - RNA, 20 nt, Pseudomonas putida KT2440
gcucaacggguuugccguga

SEQ ID NO: 1578414 - RNA, 16 nt, Pseudomonas putida KT2440
gcucaacuacccugaa

SEQ ID NO: 1578415 - RNA, 18 nt, Pseudomonas putida KT2440
gcucaacuccauggccag

SEQ ID NO: 1578416 - RNA, 23 nt, Pseudomonas putida KT2440
gcucaacgccagggcaaucgcca

SEQ ID NO: 1578417 - RNA, 17 nt, Pseudomonas putida KT2440
gcucaacagcaggugca

SEQ ID NO: 1578418 - RNA, 19 nt, Pseudomonas putida KT2440
gcucaacagguucgacagu

SEQ ID NO: 1578419 - RNA, 21 nt, Pseudomonas putida KT2440
gcuauuguggcaauugcaccc

SEQ ID NO: 1578420 - RNA, 14 nt, Pseudomonas putida KT2440
gcucaaaugcuggc

SEQ ID NO: 1578421 - RNA, 14 nt, Pseudomonas putida KT2440
gcuaucgccagcag

SEQ ID NO: 1578422 - RNA, 18 nt, Pseudomonas putida KT2440
gcuaucgccagcaggccg

SEQ ID NO: 1578423 - RNA, 21 nt, Pseudomonas putida KT2440
gcuaccugguucaucgacuug

SEQ ID NO: 1578424 - RNA, 22 nt, Pseudomonas putida KT2440
gcuaccagaaauggucgcgggc

SEQ ID NO: 1578425 - RNA, 16 nt, Pseudomonas putida KT2440
gcuaccagcaguuggc

SEQ ID NO: 1578426 - RNA, 22 nt, Pseudomonas putida KT2440
gcuaccccacaaccccugcaag

SEQ ID NO: 1578427 - RNA, 21 nt, Pseudomonas putida KT2440
gcuacccagccgggcaugcag

SEQ ID NO: 1578428 - RNA, 14 nt, Pseudomonas putida KT2440
gcuacacgcgcccu

SEQ ID NO: 1578429 - RNA, 19 nt, Pseudomonas putida KT2440
gcuacagccccuuccccag

SEQ ID NO: 1578430 - RNA, 18 nt, Pseudomonas putida KT2440
gcuagcuacucggcaauu

SEQ ID NO: 1578431 - RNA, 17 nt, Pseudomonas putida KT2440
gcuagcagcaucaccgc

SEQ ID NO: 1578432 - RNA, 23 nt, Pseudomonas putida KT2440
gcuacggccgugcagggcgccga

SEQ ID NO: 1578433 - RNA, 15 nt, Pseudomonas putida KT2440
gcuacgggauugccg

SEQ ID NO: 1578434 - RNA, 14 nt, Pseudomonas putida KT2440
gcguuucgcuggcc

SEQ ID NO: 1578435 - RNA, 15 nt, Pseudomonas putida KT2440
gcguuguguugcugg

SEQ ID NO: 1578436 - RNA, 19 nt, Pseudomonas putida KT2440
gcguuggcuuccacggcgc

SEQ ID NO: 1578437 - RNA, 15 nt, Pseudomonas putida KT2440
gcguugcucaacagg

SEQ ID NO: 1578438 - RNA, 17 nt, Pseudomonas putida KT2440
gcguugcggucagcgcu

SEQ ID NO: 1578439 - RNA, 19 nt, Pseudomonas putida KT2440
gcguuggccaggucgaccg

SEQ ID NO: 1578440 - RNA, 23 nt, Pseudomonas putida KT2440
gcguuggccaaaccguccaggua

SEQ ID NO: 1578441 - RNA, 22 nt, Pseudomonas putida KT2440
gcguuggccgaaggccguggca

SEQ ID NO: 1578442 - RNA, 18 nt, Pseudomonas putida KT2440
gcuaaccucugcaugcca

SEQ ID NO: 1578443 - RNA, 18 nt, Pseudomonas putida KT2440
gcuaaaggcauucgcggg

SEQ ID NO: 1578444 - RNA, 19 nt, Pseudomonas putida KT2440
gcuaaagccgcaccuacag

SEQ ID NO: 1578445 - RNA, 22 nt, Pseudomonas putida KT2440
gcguuuucuucaagcagcgaau

SEQ ID NO: 1578446 - RNA, 17 nt, Pseudomonas putida KT2440
gcguuugcgaaccucag

SEQ ID NO: 1578447 - RNA, 19 nt, Pseudomonas putida KT2440
gcguuugcgagcgcgggca

SEQ ID NO: 1578448 - RNA, 21 nt, Pseudomonas putida KT2440
gcguugcggaacauacgcauc

SEQ ID NO: 1578449 - RNA, 22 nt, Pseudomonas putida KT2440
gcguugcggcccuucgcgggca

SEQ ID NO: 1578450 - RNA, 14 nt, Pseudomonas putida KT2440
gcguugcaguccuu

SEQ ID NO: 1578451 - RNA, 13 nt, Pseudomonas putida KT2440
gcguugccuucgc

SEQ ID NO: 1578452 - RNA, 21 nt, Pseudomonas putida KT2440
gcguugccuucgcgaccgcca

SEQ ID NO: 1578453 - RNA, 16 nt, Pseudomonas putida KT2440
gcguugauccggcacu

SEQ ID NO: 1578454 - RNA, 22 nt, Pseudomonas putida KT2440
gcguugaugcgugauggugguc

SEQ ID NO: 1578455 - RNA, 18 nt, Pseudomonas putida KT2440
gcguugauuuagcaggca

SEQ ID NO: 1578456 - RNA, 21 nt, Pseudomonas putida KT2440
gcguucuuucucccaggccga

SEQ ID NO: 1578457 - RNA, 18 nt, Pseudomonas putida KT2440
gcguugaccgagguacca

SEQ ID NO: 1578458 - RNA, 19 nt, Pseudomonas putida KT2440
gcguucuagaacucggcga

SEQ ID NO: 1578459 - RNA, 21 nt, Pseudomonas putida KT2440
gcguuccagccaggcgucgau

SEQ ID NO: 1578460 - RNA, 18 nt, Pseudomonas putida KT2440
gcguucgcccuccugcag

SEQ ID NO: 1578461 - RNA, 17 nt, Pseudomonas putida KT2440
gucaccgcccagcuucu

SEQ ID NO: 1578462 - RNA, 18 nt, Pseudomonas putida KT2440
gucaccgagacgaucacc

SEQ ID NO: 1578463 - RNA, 21 nt, Pseudomonas putida KT2440
gucacccuuggucaggaucac

SEQ ID NO: 1578464 - RNA, 20 nt, Pseudomonas putida KT2440
gucaccgaacucguugacca

SEQ ID NO: 1578465 - RNA, 11 nt, Pseudomonas putida KT2440
gucacccgcgc

SEQ ID NO: 1578466 - RNA, 17 nt, Pseudomonas putida KT2440
gucaaccucaacgccau

SEQ ID NO: 1578467 - RNA, 17 nt, Pseudomonas putida KT2440
gucaaccaggcgcagca

SEQ ID NO: 1578468 - RNA, 22 nt, Pseudomonas putida KT2440
gucaacgguaacguuggccggg

SEQ ID NO: 1578469 - RNA, 18 nt, Pseudomonas putida KT2440
gucaaucuuguggcggau

SEQ ID NO: 1578470 - RNA, 20 nt, Pseudomonas putida KT2440
guauuaagggcauggccgcc

SEQ ID NO: 1578471 - RNA, 19 nt, Pseudomonas putida KT2440
guauggcaggcugacccgc

SEQ ID NO: 1578472 - RNA, 18 nt, Pseudomonas putida KT2440
guaucugccggcagggcu

SEQ ID NO: 1578473 - RNA, 19 nt, Pseudomonas putida KT2440
guauccacauacugcuucu

SEQ ID NO: 1578474 - RNA, 20 nt, Pseudomonas putida KT2440
gucaaacaaugcacagcgcu

SEQ ID NO: 1578475 - RNA, 22 nt, Pseudomonas putida KT2440
guauucgcggguaaacccgcuc

SEQ ID NO: 1578476 - RNA, 20 nt, Pseudomonas putida KT2440
guauuccagaaucugcacac

SEQ ID NO: 1578477 - RNA, 11 nt, Pseudomonas putida KT2440
guauucggcgg

SEQ ID NO: 1578478 - RNA, 19 nt, Pseudomonas putida KT2440
guauugccugugcuggccu

SEQ ID NO: 1578479 - RNA, 23 nt, Pseudomonas putida KT2440
gucagccacauccucugcccgca

SEQ ID NO: 1578480 - RNA, 17 nt, Pseudomonas putida KT2440
gucagccaccaccagcu

SEQ ID NO: 1578481 - RNA, 14 nt, Pseudomonas putida KT2440
gucagcagggccaa

SEQ ID NO: 1578482 - RNA, 13 nt, Pseudomonas putida KT2440
gucagcaguggcu

SEQ ID NO: 1578483 - RNA, 14 nt, Pseudomonas putida KT2440
gucagcaccggcag

SEQ ID NO: 1578484 - RNA, 21 nt, Pseudomonas putida KT2440
gucagcaccugggcgucauca

SEQ ID NO: 1578485 - RNA, 13 nt, Pseudomonas putida KT2440
gucagcagcaccg

SEQ ID NO: 1578486 - RNA, 22 nt, Pseudomonas putida KT2440
gucagcgaguugaacuuggcga

SEQ ID NO: 1578487 - RNA, 18 nt, Pseudomonas putida KT2440
gucagccuuucgagagcc

SEQ ID NO: 1578488 - RNA, 20 nt, Pseudomonas putida KT2440
gucagccuuucgagagccgg

SEQ ID NO: 1578489 - RNA, 15 nt, Pseudomonas putida KT2440
gucagccagaugcgc

SEQ ID NO: 1578490 - RNA, 13 nt, Pseudomonas putida KT2440
gucagccaggcgu

SEQ ID NO: 1578491 - RNA, 13 nt, Pseudomonas putida KT2440
gucagcucaagcg

SEQ ID NO: 1578492 - RNA, 14 nt, Pseudomonas putida KT2440
gucagcggaccagg

SEQ ID NO: 1578493 - RNA, 13 nt, Pseudomonas putida KT2440
gucagcggcaguu

SEQ ID NO: 1578494 - RNA, 21 nt, Pseudomonas putida KT2440
gucaggccgaugggcaggcca

SEQ ID NO: 1578495 - RNA, 20 nt, Pseudomonas putida KT2440
gucaggccauggugcacgcc

SEQ ID NO: 1578496 - RNA, 19 nt, Pseudomonas putida KT2440
gucauacucuucgcgggcu

SEQ ID NO: 1578497 - RNA, 13 nt, Pseudomonas putida KT2440
gucauaguucugg

SEQ ID NO: 1578498 - RNA, 20 nt, Pseudomonas putida KT2440
gucaccuugcuccaccaggc

SEQ ID NO: 1578499 - RNA, 17 nt, Pseudomonas putida KT2440
gucaccggccaugccga

SEQ ID NO: 1578500 - RNA, 22 nt, Pseudomonas putida KT2440
gucacgccauccccccagcccu

SEQ ID NO: 1578501 - RNA, 14 nt, Pseudomonas putida KT2440
gucacgcaccaugu

SEQ ID NO: 1578502 - RNA, 14 nt, Pseudomonas putida KT2440
gucacgcggccguc

SEQ ID NO: 1578503 - RNA, 13 nt, Pseudomonas putida KT2440
gucacguugcccg

SEQ ID NO: 1578504 - RNA, 16 nt, Pseudomonas putida KT2440
gucacuggcgacagcc

SEQ ID NO: 1578505 - RNA, 14 nt, Pseudomonas putida KT2440
gucacugagccagg

SEQ ID NO: 1578506 - RNA, 18 nt, Pseudomonas putida KT2440
gucacugagccaggccga

SEQ ID NO: 1578507 - RNA, 16 nt, Pseudomonas putida KT2440
guaaaggugcccugcu

SEQ ID NO: 1578508 - RNA, 23 nt, Pseudomonas putida KT2440
gguuuuagcguagugcaggcgca

SEQ ID NO: 1578509 - RNA, 15 nt, Pseudomonas putida KT2440
gguggcccugaccgc

SEQ ID NO: 1578510 - RNA, 19 nt, Pseudomonas putida KT2440
guacagguugcggccaucg

SEQ ID NO: 1578511 - RNA, 21 nt, Pseudomonas putida KT2440
guacaucggguaagccaugcg

SEQ ID NO: 1578512 - RNA, 14 nt, Pseudomonas putida KT2440
guacauugcgcacc

SEQ ID NO: 1578513 - RNA, 20 nt, Pseudomonas putida KT2440
guacaccuuggugcgcgcau

SEQ ID NO: 1578514 - RNA, 14 nt, Pseudomonas putida KT2440
guacacgccacgga

SEQ ID NO: 1578515 - RNA, 17 nt, Pseudomonas putida KT2440
guacacgccacggaaca

SEQ ID NO: 1578516 - RNA, 13 nt, Pseudomonas putida KT2440
guacaccggcagc

SEQ ID NO: 1578517 - RNA, 14 nt, Pseudomonas putida KT2440
guacaccgggaaca

SEQ ID NO: 1578518 - RNA, 23 nt, Pseudomonas putida KT2440
guaaucgaugaaauucaccugcc

SEQ ID NO: 1578519 - RNA, 14 nt, Pseudomonas putida KT2440
guacaacgcagccg

SEQ ID NO: 1578520 - RNA, 16 nt, Pseudomonas putida KT2440
guacaacgcagccggc

SEQ ID NO: 1578521 - RNA, 20 nt, Pseudomonas putida KT2440
guaaucuggcugucgugcuc

SEQ ID NO: 1578522 - RNA, 23 nt, Pseudomonas putida KT2440
guaauugguggugcugggcauga

SEQ ID NO: 1578523 - RNA, 15 nt, Pseudomonas putida KT2440
guacaccgacgccga

SEQ ID NO: 1578524 - RNA, 23 nt, Pseudomonas putida KT2440
guaccccuggcgcuuuccagcug

SEQ ID NO: 1578525 - RNA, 20 nt, Pseudomonas putida KT2440
guaccgaccucuucgcgggu

SEQ ID NO: 1578526 - RNA, 12 nt, Pseudomonas putida KT2440
guaccgugcugc

SEQ ID NO: 1578527 - RNA, 13 nt, Pseudomonas putida KT2440
guaccgugcugca

SEQ ID NO: 1578528 - RNA, 13 nt, Pseudomonas putida KT2440
guacggcuugccg

SEQ ID NO: 1578529 - RNA, 17 nt, Pseudomonas putida KT2440
guacggcuugccggcaa

SEQ ID NO: 1578530 - RNA, 18 nt, Pseudomonas putida KT2440
guacggcuugccggcaau

SEQ ID NO: 1578531 - RNA, 20 nt, Pseudomonas putida KT2440
guaccugugggagcgggcuu

SEQ ID NO: 1578532 - RNA, 15 nt, Pseudomonas putida KT2440
guaccuguggggcaa

SEQ ID NO: 1578533 - RNA, 20 nt, Pseudomonas putida KT2440
guaccuguggggcaacugcg

SEQ ID NO: 1578534 - RNA, 15 nt, Pseudomonas putida KT2440
guaccuggccgugcc

SEQ ID NO: 1578535 - RNA, 21 nt, Pseudomonas putida KT2440
guagcucagguagaccugcgu

SEQ ID NO: 1578536 - RNA, 22 nt, Pseudomonas putida KT2440
guagcgcaaaugguuguccacc

SEQ ID NO: 1578537 - RNA, 19 nt, Pseudomonas putida KT2440
guagccaaucaucuugcca

SEQ ID NO: 1578538 - RNA, 20 nt, Pseudomonas putida KT2440
guagccuucuucggucagcu

SEQ ID NO: 1578539 - RNA, 21 nt, Pseudomonas putida KT2440
guagccgugcggccaaagcug

SEQ ID NO: 1578540 - RNA, 20 nt, Pseudomonas putida KT2440
guagcacgggcgcugaagcc

SEQ ID NO: 1578541 - RNA, 16 nt, Pseudomonas putida KT2440
guagcagguacgcgca

SEQ ID NO: 1578542 - RNA, 23 nt, Pseudomonas putida KT2440
guagccaaccgagucaacacggc

SEQ ID NO: 1578543 - RNA, 16 nt, Pseudomonas putida KT2440
guacuggcugcacugg

SEQ ID NO: 1578544 - RNA, 13 nt, Pseudomonas putida KT2440
guacgucucaucg

SEQ ID NO: 1578545 - RNA, 19 nt, Pseudomonas putida KT2440
guagaucugcucuucgccg

SEQ ID NO: 1578546 - RNA, 21 nt, Pseudomonas putida KT2440
guagaucgccggcagcacguc

SEQ ID NO: 1578547 - RNA, 18 nt, Pseudomonas putida KT2440
aaguaguguucgccguug

SEQ ID NO: 1578548 - RNA, 16 nt, Pseudomonas putida KT2440
aagucaugcucgccgg

SEQ ID NO: 1578549 - RNA, 19 nt, Pseudomonas putida KT2440
aaguccacgaaccugugca

SEQ ID NO: 1578550 - RNA, 17 nt, Pseudomonas putida KT2440
aagucauccgccaggcu

SEQ ID NO: 1578551 - RNA, 15 nt, Pseudomonas putida KT2440
guaguacuccagcag

SEQ ID NO: 1578552 - RNA, 21 nt, Pseudomonas putida KT2440
guccuccugccgggguaaaac

SEQ ID NO: 1578553 - RNA, 20 nt, Pseudomonas putida KT2440
guccuccccuucccgccauu

SEQ ID NO: 1578554 - RNA, 18 nt, Pseudomonas putida KT2440
guccucaaucacauccac

SEQ ID NO: 1578555 - RNA, 21 nt, Pseudomonas putida KT2440
guccucguucagccaacggcg

SEQ ID NO: 1578556 - RNA, 17 nt, Pseudomonas putida KT2440
guccugcaacucggccu

SEQ ID NO: 1578557 - RNA, 21 nt, Pseudomonas putida KT2440
guccugccgacgccgcuucuc

SEQ ID NO: 1578558 - RNA, 15 nt, Pseudomonas putida KT2440
gucgacaaaugccgg

SEQ ID NO: 1578559 - RNA, 20 nt, Pseudomonas putida KT2440
guccugguaacccgguugcc

SEQ ID NO: 1578560 - RNA, 13 nt, Pseudomonas putida KT2440
gucgacucgaugc

SEQ ID NO: 1578561 - RNA, 13 nt, Pseudomonas putida KT2440
gucgagguugcgc

SEQ ID NO: 1578562 - RNA, 14 nt, Pseudomonas putida KT2440
gucgacguacagca

SEQ ID NO: 1578563 - RNA, 17 nt, Pseudomonas putida KT2440
gucgacguacagcagcu

SEQ ID NO: 1578564 - RNA, 20 nt, Pseudomonas putida KT2440
gucgaccgggcagaccugcu

SEQ ID NO: 1578565 - RNA, 14 nt, Pseudomonas putida KT2440
gucgaccgcgacca

SEQ ID NO: 1578566 - RNA, 22 nt, Pseudomonas putida KT2440
gucauccaggaaaagguagugc

SEQ ID NO: 1578567 - RNA, 22 nt, Pseudomonas putida KT2440
gucaucaccacccccagcgacc

SEQ ID NO: 1578568 - RNA, 18 nt, Pseudomonas putida KT2440
gucauccucaccggcaaa

SEQ ID NO: 1578569 - RNA, 23 nt, Pseudomonas putida KT2440
gucauccgggccgucaccgcugc

SEQ ID NO: 1578570 - RNA, 20 nt, Pseudomonas putida KT2440
gucauccggcgcggccugcu

SEQ ID NO: 1578571 - RNA, 17 nt, Pseudomonas putida KT2440
guccaucaggugcagca

SEQ ID NO: 1578572 - RNA, 15 nt, Pseudomonas putida KT2440
guccaguucgcgcaa

SEQ ID NO: 1578573 - RNA, 21 nt, Pseudomonas putida KT2440
guccaguucaaugccagcagu

SEQ ID NO: 1578574 - RNA, 22 nt, Pseudomonas putida KT2440
gucccgcccuccagccgcgaac

SEQ ID NO: 1578575 - RNA, 13 nt, Pseudomonas putida KT2440
gucccggccagcg

SEQ ID NO: 1578576 - RNA, 15 nt, Pseudomonas putida KT2440
guccccaaccggguu

SEQ ID NO: 1578577 - RNA, 17 nt, Pseudomonas putida KT2440
guccccuucgucgaugu

SEQ ID NO: 1578578 - RNA, 18 nt, Pseudomonas putida KT2440
gucccgaucagguucacc

SEQ ID NO: 1578579 - RNA, 23 nt, Pseudomonas putida KT2440
guccgcccuugccaccagugccg

SEQ ID NO: 1578580 - RNA, 18 nt, Pseudomonas putida KT2440
guccgccgccgucagguu

SEQ ID NO: 1578581 - RNA, 14 nt, Pseudomonas putida KT2440
guccgaagcgaaca

SEQ ID NO: 1578582 - RNA, 23 nt, Pseudomonas putida KT2440
guccgacagcuugcccagcugcg

SEQ ID NO: 1578583 - RNA, 14 nt, Pseudomonas putida KT2440
guccgguaacuggc

SEQ ID NO: 1578584 - RNA, 21 nt, Pseudomonas putida KT2440
guccgucucuucagccgucgc

SEQ ID NO: 1578585 - RNA, 13 nt, Pseudomonas putida KT2440
gucggccucgaua

SEQ ID NO: 1578586 - RNA, 15 nt, Pseudomonas putida KT2440
gucggccucgauagc

SEQ ID NO: 1578587 - RNA, 22 nt, Pseudomonas putida KT2440
gucggccagcucggcaguggcg

SEQ ID NO: 1578588 - RNA, 15 nt, Pseudomonas putida KT2440
gucggcaugcacuuc

SEQ ID NO: 1578589 - RNA, 17 nt, Pseudomonas putida KT2440
gucgcuguugcgcaccu

SEQ ID NO: 1578590 - RNA, 17 nt, Pseudomonas putida KT2440
gucgcuggccagcuucu

SEQ ID NO: 1578591 - RNA, 20 nt, Pseudomonas putida KT2440
gucgcugcggcacaccacgc

SEQ ID NO: 1578592 - RNA, 17 nt, Pseudomonas putida KT2440
gucgcugccgugcaggu

SEQ ID NO: 1578593 - RNA, 22 nt, Pseudomonas putida KT2440
gucgcucaacuccauggccagg

SEQ ID NO: 1578594 - RNA, 18 nt, Pseudomonas putida KT2440
gucggcaaucugcucgac

SEQ ID NO: 1578595 - RNA, 20 nt, Pseudomonas putida KT2440
gucggcaaucugcucgacga

SEQ ID NO: 1578596 - RNA, 17 nt, Pseudomonas putida KT2440
gucggcaccggcgacgc

SEQ ID NO: 1578597 - RNA, 16 nt, Pseudomonas putida KT2440
gucgcguuguucagca

SEQ ID NO: 1578598 - RNA, 19 nt, Pseudomonas putida KT2440
gucgcguuguucagcagcg

SEQ ID NO: 1578599 - RNA, 12 nt, Pseudomonas putida KT2440
gucgcuacgcgc

SEQ ID NO: 1578600 - RNA, 17 nt, Pseudomonas putida KT2440
gucgcuacugccgucgu

SEQ ID NO: 1578601 - RNA, 20 nt, Pseudomonas putida KT2440
gucgcguucuuucucccagg

SEQ ID NO: 1578602 - RNA, 20 nt, Pseudomonas putida KT2440
gucgcggcaaagaucgccca

SEQ ID NO: 1578603 - RNA, 18 nt, Pseudomonas putida KT2440
gucgcgauugaucagcgc

SEQ ID NO: 1578604 - RNA, 19 nt, Pseudomonas putida KT2440
gucgccuuuuuuccaguug

SEQ ID NO: 1578605 - RNA, 18 nt, Pseudomonas putida KT2440
gucgcgagucaggcugca

SEQ ID NO: 1578606 - RNA, 19 nt, Pseudomonas putida KT2440
gucgccccgccagcgccug

SEQ ID NO: 1578607 - RNA, 21 nt, Pseudomonas putida KT2440
gucgccccgccagcgccuggc

SEQ ID NO: 1578608 - RNA, 20 nt, Pseudomonas putida KT2440
gucgccgccgucgggugcgc

SEQ ID NO: 1578609 - RNA, 23 nt, Pseudomonas putida KT2440
gucgccgccgucgggugcgccag

SEQ ID NO: 1578610 - RNA, 14 nt, Pseudomonas putida KT2440
gucgcaucgacagg

SEQ ID NO: 1578611 - RNA, 18 nt, Pseudomonas putida KT2440
gucgcaucgacaggucca

SEQ ID NO: 1578612 - RNA, 13 nt, Pseudomonas putida KT2440
gucgccaggcuuc

SEQ ID NO: 1578613 - RNA, 14 nt, Pseudomonas putida KT2440
gucgaucagcggcu

SEQ ID NO: 1578614 - RNA, 16 nt, Pseudomonas putida KT2440
gucgauacccaggcgc

SEQ ID NO: 1578615 - RNA, 19 nt, Pseudomonas putida KT2440
gucgauagccagcccggua

SEQ ID NO: 1578616 - RNA, 19 nt, Pseudomonas putida KT2440
ggugccccgguccagcaca

SEQ ID NO: 1578617 - RNA, 13 nt, Pseudomonas putida KT2440
ggugcccaagcgg

SEQ ID NO: 1578618 - RNA, 15 nt, Pseudomonas putida KT2440
ggugcccaagcggca

SEQ ID NO: 1578619 - RNA, 20 nt, Pseudomonas putida KT2440
ggugccauagcaccagcggg

SEQ ID NO: 1578620 - RNA, 13 nt, Pseudomonas putida KT2440
ggugccaucaccg

SEQ ID NO: 1578621 - RNA, 13 nt, Pseudomonas putida KT2440
ggugccagcgcca

SEQ ID NO: 1578622 - RNA, 23 nt, Pseudomonas putida KT2440
ggugcaucgucacauccugcucg

SEQ ID NO: 1578623 - RNA, 13 nt, Pseudomonas putida KT2440
ggugccgaaguca

SEQ ID NO: 1578624 - RNA, 12 nt, Pseudomonas putida KT2440
ggugccgccaug

SEQ ID NO: 1578625 - RNA, 20 nt, Pseudomonas putida KT2440
ggugccguggguugaacagg

SEQ ID NO: 1578626 - RNA, 19 nt, Pseudomonas putida KT2440
ggugccguuggacgccgca

SEQ ID NO: 1578627 - RNA, 16 nt, Pseudomonas putida KT2440
ggugcguacucgacca

SEQ ID NO: 1578628 - RNA, 16 nt, Pseudomonas putida KT2440
ggugccguuccggcaa

SEQ ID NO: 1578629 - RNA, 14 nt, Pseudomonas putida KT2440
ggugccuucgagca

SEQ ID NO: 1578630 - RNA, 23 nt, Pseudomonas putida KT2440
ggugcgcucguaggcugcagcga

SEQ ID NO: 1578631 - RNA, 17 nt, Pseudomonas putida KT2440
ggugcgcggccgucaug

SEQ ID NO: 1578632 - RNA, 20 nt, Pseudomonas putida KT2440
ggugcgcgggucauccagga

SEQ ID NO: 1578633 - RNA, 16 nt, Pseudomonas putida KT2440
ggugcgcgguaccugg

SEQ ID NO: 1578634 - RNA, 17 nt, Pseudomonas putida KT2440
ggugcgcgguaccugga

SEQ ID NO: 1578635 - RNA, 20 nt, Pseudomonas putida KT2440
ggucgguagggaucaccgcc

SEQ ID NO: 1578636 - RNA, 18 nt, Pseudomonas putida KT2440
ggucggucagcaccguga

SEQ ID NO: 1578637 - RNA, 13 nt, Pseudomonas putida KT2440
ggucgugcgcgau

SEQ ID NO: 1578638 - RNA, 20 nt, Pseudomonas putida KT2440
ggucgugcgcgaucagcgca

SEQ ID NO: 1578639 - RNA, 17 nt, Pseudomonas putida KT2440
ggucguuacccagguag

SEQ ID NO: 1578640 - RNA, 16 nt, Pseudomonas putida KT2440
ggucguugaugcgcuu

SEQ ID NO: 1578641 - RNA, 15 nt, Pseudomonas putida KT2440
ggucgggcacaggcc

SEQ ID NO: 1578642 - RNA, 19 nt, Pseudomonas putida KT2440
ggucucacaggcgcugaaa

SEQ ID NO: 1578643 - RNA, 17 nt, Pseudomonas putida KT2440
ggucuaaccgcgcuggu

SEQ ID NO: 1578644 - RNA, 13 nt, Pseudomonas putida KT2440
ggucugguaaucc

SEQ ID NO: 1578645 - RNA, 23 nt, Pseudomonas putida KT2440
ggucugcgcuucaagcagguaac

SEQ ID NO: 1578646 - RNA, 17 nt, Pseudomonas putida KT2440
ggucuucucaggcacca

SEQ ID NO: 1578647 - RNA, 20 nt, Pseudomonas putida KT2440
ggucuucucaggcaccagcg

SEQ ID NO: 1578648 - RNA, 17 nt, Pseudomonas putida KT2440
ggucuuccaggaucagc

SEQ ID NO: 1578649 - RNA, 16 nt, Pseudomonas putida KT2440
ggucuugucugacagc

SEQ ID NO: 1578650 - RNA, 13 nt, Pseudomonas putida KT2440
ggucuugccgaua

SEQ ID NO: 1578651 - RNA, 22 nt, Pseudomonas putida KT2440
ggugaucgccucgugcagcugc

SEQ ID NO: 1578652 - RNA, 12 nt, Pseudomonas putida KT2440
ggugauugcagu

SEQ ID NO: 1578653 - RNA, 13 nt, Pseudomonas putida KT2440
ggugcacgggccg

SEQ ID NO: 1578654 - RNA, 21 nt, Pseudomonas putida KT2440
ggugcagacgaucagguuugc

SEQ ID NO: 1578655 - RNA, 11 nt, Pseudomonas putida KT2440
ggugcagaacg

SEQ ID NO: 1578656 - RNA, 15 nt, Pseudomonas putida KT2440
ggugagcaugccgau

SEQ ID NO: 1578657 - RNA, 16 nt, Pseudomonas putida KT2440
ggugagcgaaucccgc

SEQ ID NO: 1578658 - RNA, 14 nt, Pseudomonas putida KT2440
ggugaccaccagca

SEQ ID NO: 1578659 - RNA, 23 nt, Pseudomonas putida KT2440
ggucauacuccagcgucaccacc

SEQ ID NO: 1578660 - RNA, 14 nt, Pseudomonas putida KT2440
ggucaguucagcca

SEQ ID NO: 1578661 - RNA, 18 nt, Pseudomonas putida KT2440
ggucauccaggcuggcca

SEQ ID NO: 1578662 - RNA, 20 nt, Pseudomonas putida KT2440
gguccacgguucuggcagcu

SEQ ID NO: 1578663 - RNA, 11 nt, Pseudomonas putida KT2440
ggucagcaucc

SEQ ID NO: 1578664 - RNA, 11 nt, Pseudomonas putida KT2440
ggucagcgacu

SEQ ID NO: 1578665 - RNA, 11 nt, Pseudomonas putida KT2440
ggucagcgccu

SEQ ID NO: 1578666 - RNA, 22 nt, Pseudomonas putida KT2440
ggucagcaagccgccgaccagg

SEQ ID NO: 1578667 - RNA, 14 nt, Pseudomonas putida KT2440
ggucacugagccag

SEQ ID NO: 1578668 - RNA, 19 nt, Pseudomonas putida KT2440
ggucacgcccaucaggaac

SEQ ID NO: 1578669 - RNA, 23 nt, Pseudomonas putida KT2440
ggucacgcuccuucgccacgaac

SEQ ID NO: 1578670 - RNA, 14 nt, Pseudomonas putida KT2440
ggucaccuugucca

SEQ ID NO: 1578671 - RNA, 16 nt, Pseudomonas putida KT2440
ggucaccuuguccagc

SEQ ID NO: 1578672 - RNA, 19 nt, Pseudomonas putida KT2440
ggucacccuggucacgcag

SEQ ID NO: 1578673 - RNA, 21 nt, Pseudomonas putida KT2440
gguccccauagcuuuccagca

SEQ ID NO: 1578674 - RNA, 23 nt, Pseudomonas putida KT2440
gguccccggccgugucgaacugg

SEQ ID NO: 1578675 - RNA, 22 nt, Pseudomonas putida KT2440
ggucccugacucgaccgccgca

SEQ ID NO: 1578676 - RNA, 13 nt, Pseudomonas putida KT2440
ggucgacaggggc

SEQ ID NO: 1578677 - RNA, 12 nt, Pseudomonas putida KT2440
ggucgagccagg

SEQ ID NO: 1578678 - RNA, 19 nt, Pseudomonas putida KT2440
ggucgaugauggucgcgac

SEQ ID NO: 1578679 - RNA, 19 nt, Pseudomonas putida KT2440
ggucgaugcaggagcggcu

SEQ ID NO: 1578680 - RNA, 19 nt, Pseudomonas putida KT2440
ggucgaggcggcugucgca

SEQ ID NO: 1578681 - RNA, 21 nt, Pseudomonas putida KT2440
ggucgccgccgucgggugcgc

SEQ ID NO: 1578682 - RNA, 21 nt, Pseudomonas putida KT2440
gguaccccaccggccuggaac

SEQ ID NO: 1578683 - RNA, 12 nt, Pseudomonas putida KT2440
gguaauccacca

SEQ ID NO: 1578684 - RNA, 13 nt, Pseudomonas putida KT2440
gguaaugccaccu

SEQ ID NO: 1578685 - RNA, 13 nt, Pseudomonas putida KT2440
gguaagucagcga

SEQ ID NO: 1578686 - RNA, 16 nt, Pseudomonas putida KT2440
gguaaagcucgguauc

SEQ ID NO: 1578687 - RNA, 21 nt, Pseudomonas putida KT2440
gguaaacgucggcagccaugc

SEQ ID NO: 1578688 - RNA, 17 nt, Pseudomonas putida KT2440
gguaaacguggucagcc

SEQ ID NO: 1578689 - RNA, 18 nt, Pseudomonas putida KT2440
gguaaacguggucagcca

SEQ ID NO: 1578690 - RNA, 14 nt, Pseudomonas putida KT2440
gguaacacggugau

SEQ ID NO: 1578691 - RNA, 16 nt, Pseudomonas putida KT2440
aaguacggccagcagg

SEQ ID NO: 1578692 - RNA, 21 nt, Pseudomonas putida KT2440
ggguugcaauaccgugcuugc

SEQ ID NO: 1578693 - RNA, 20 nt, Pseudomonas putida KT2440
ggguugcaucgcgcacuugc

SEQ ID NO: 1578694 - RNA, 17 nt, Pseudomonas putida KT2440
gguaaacccgcgccugc

SEQ ID NO: 1578695 - RNA, 13 nt, Pseudomonas putida KT2440
gguaaacccgcuc

SEQ ID NO: 1578696 - RNA, 20 nt, Pseudomonas putida KT2440
gguaaacccgcuccuacagg

SEQ ID NO: 1578697 - RNA, 20 nt, Pseudomonas putida KT2440
gguaaacccgcuccuacaug

SEQ ID NO: 1578698 - RNA, 18 nt, Pseudomonas putida KT2440
gguaaacccgggucaggc

SEQ ID NO: 1578699 - RNA, 12 nt, Pseudomonas putida KT2440
ggguugacgcug

SEQ ID NO: 1578700 - RNA, 13 nt, Pseudomonas putida KT2440
ggguucagcguca

SEQ ID NO: 1578701 - RNA, 12 nt, Pseudomonas putida KT2440
ggguuccagccg

SEQ ID NO: 1578702 - RNA, 20 nt, Pseudomonas putida KT2440
ggguucgccaugacguugca

SEQ ID NO: 1578703 - RNA, 18 nt, Pseudomonas putida KT2440
ggguucgccgucagccuu

SEQ ID NO: 1578704 - RNA, 17 nt, Pseudomonas putida KT2440
gguaucacgcuccugca

SEQ ID NO: 1578705 - RNA, 21 nt, Pseudomonas putida KT2440
gguagcugggcccgcccagcu

SEQ ID NO: 1578706 - RNA, 19 nt, Pseudomonas putida KT2440
gguagcugucggucagcca

SEQ ID NO: 1578707 - RNA, 15 nt, Pseudomonas putida KT2440
gguagcucgacgccg

SEQ ID NO: 1578708 - RNA, 17 nt, Pseudomonas putida KT2440
gguaggccuugaccagc

SEQ ID NO: 1578709 - RNA, 16 nt, Pseudomonas putida KT2440
gguaggcacggucggu

SEQ ID NO: 1578710 - RNA, 23 nt, Pseudomonas putida KT2440
gguagcacgggcgcugaagccag

SEQ ID NO: 1578711 - RNA, 19 nt, Pseudomonas putida KT2440
gguauugaacggcgcaucc

SEQ ID NO: 1578712 - RNA, 21 nt, Pseudomonas putida KT2440
gguauucgaggaucagcgcag

SEQ ID NO: 1578713 - RNA, 23 nt, Pseudomonas putida KT2440
gguaugcgcccaucucaggccca

SEQ ID NO: 1578714 - RNA, 14 nt, Pseudomonas putida KT2440
gguaucgaucagga

SEQ ID NO: 1578715 - RNA, 20 nt, Pseudomonas putida KT2440
ggucaaggccagcgccugcu

SEQ ID NO: 1578716 - RNA, 17 nt, Pseudomonas putida KT2440
ggucaaaaaauccucaa

SEQ ID NO: 1578717 - RNA, 16 nt, Pseudomonas putida KT2440
ggucaaacaaugcaca

SEQ ID NO: 1578718 - RNA, 13 nt, Pseudomonas putida KT2440
gggcgcuccagca

SEQ ID NO: 1578719 - RNA, 22 nt, Pseudomonas putida KT2440
gggcgcguguagcccgcugaag

SEQ ID NO: 1578720 - RNA, 19 nt, Pseudomonas putida KT2440
gggcgcugaucaagcccgc

SEQ ID NO: 1578721 - RNA, 19 nt, Pseudomonas putida KT2440
gggcgcuuugcacccgcgc

SEQ ID NO: 1578722 - RNA, 23 nt, Pseudomonas putida KT2440
gggcgcuuggucggcgccccuuu

SEQ ID NO: 1578723 - RNA, 19 nt, Pseudomonas putida KT2440
gggcggccucgugucgcga

SEQ ID NO: 1578724 - RNA, 13 nt, Pseudomonas putida KT2440
gggcggcgcuuga

SEQ ID NO: 1578725 - RNA, 20 nt, Pseudomonas putida KT2440
gggcgcgcccgcucccacag

SEQ ID NO: 1578726 - RNA, 13 nt, Pseudomonas putida KT2440
gggcgcccggcag

SEQ ID NO: 1578727 - RNA, 16 nt, Pseudomonas putida KT2440
gggcgaugaucgccuu

SEQ ID NO: 1578728 - RNA, 14 nt, Pseudomonas putida KT2440
gggcgauugccagg

SEQ ID NO: 1578729 - RNA, 17 nt, Pseudomonas putida KT2440
gggcgaggacagcaucu

SEQ ID NO: 1578730 - RNA, 21 nt, Pseudomonas putida KT2440
gggcgaggacagcaucucggu

SEQ ID NO: 1578731 - RNA, 13 nt, Pseudomonas putida KT2440
gggcgaucuccug

SEQ ID NO: 1578732 - RNA, 15 nt, Pseudomonas putida KT2440
gggcgaucuccugca

SEQ ID NO: 1578733 - RNA, 23 nt, Pseudomonas putida KT2440
gggcgaccgaagucgcccuuugu

SEQ ID NO: 1578734 - RNA, 17 nt, Pseudomonas putida KT2440
gggcgaagucccgacag

SEQ ID NO: 1578735 - RNA, 13 nt, Pseudomonas putida KT2440
gggcgacaccggu

SEQ ID NO: 1578736 - RNA, 19 nt, Pseudomonas putida KT2440
gggccgucaccgcugccga

SEQ ID NO: 1578737 - RNA, 18 nt, Pseudomonas putida KT2440
gggccguuacucccacag

SEQ ID NO: 1578738 - RNA, 11 nt, Pseudomonas putida KT2440
gggccugugcc

SEQ ID NO: 1578739 - RNA, 16 nt, Pseudomonas putida KT2440
gggccuggagcaaggc

SEQ ID NO: 1578740 - RNA, 13 nt, Pseudomonas putida KT2440
gggcucgggauga

SEQ ID NO: 1578741 - RNA, 12 nt, Pseudomonas putida KT2440
gggcucaacgcc

SEQ ID NO: 1578742 - RNA, 19 nt, Pseudomonas putida KT2440
gggcugcgcggcagcccuu

SEQ ID NO: 1578743 - RNA, 22 nt, Pseudomonas putida KT2440
gggcugccuugcagccccugca

SEQ ID NO: 1578744 - RNA, 20 nt, Pseudomonas putida KT2440
gggcugcugcgcagcccauu

SEQ ID NO: 1578745 - RNA, 20 nt, Pseudomonas putida KT2440
gggcugcuuugcagcccauu

SEQ ID NO: 1578746 - RNA, 19 nt, Pseudomonas putida KT2440
gggcugcuuugcagcccuu

SEQ ID NO: 1578747 - RNA, 12 nt, Pseudomonas putida KT2440
gggcugcguugc

SEQ ID NO: 1578748 - RNA, 20 nt, Pseudomonas putida KT2440
gggcugcaagguguugguca

SEQ ID NO: 1578749 - RNA, 20 nt, Pseudomonas putida KT2440
gggcugcaaugcagccccuu

SEQ ID NO: 1578750 - RNA, 19 nt, Pseudomonas putida KT2440
gggcugcaaagcgggcaac

SEQ ID NO: 1578751 - RNA, 20 nt, Pseudomonas putida KT2440
gggcugcaaagcgggcaacu

SEQ ID NO: 1578752 - RNA, 22 nt, Pseudomonas putida KT2440
gggcugacgcgccgugccaggu

SEQ ID NO: 1578753 - RNA, 15 nt, Pseudomonas putida KT2440
gggcgggccgccgaa

SEQ ID NO: 1578754 - RNA, 13 nt, Pseudomonas putida KT2440
gggcgggccugcu

SEQ ID NO: 1578755 - RNA, 15 nt, Pseudomonas putida KT2440
gggcguauucgccca

SEQ ID NO: 1578756 - RNA, 17 nt, Pseudomonas putida KT2440
gggcguaccuggcugcu

SEQ ID NO: 1578757 - RNA, 14 nt, Pseudomonas putida KT2440
gggcgucgccugca

SEQ ID NO: 1578758 - RNA, 16 nt, Pseudomonas putida KT2440
gggcgugcccgcgaag

SEQ ID NO: 1578759 - RNA, 14 nt, Pseudomonas putida KT2440
gggcgugcgcugca

SEQ ID NO: 1578760 - RNA, 17 nt, Pseudomonas putida KT2440
gggcgucugcuccgcga

SEQ ID NO: 1578761 - RNA, 18 nt, Pseudomonas putida KT2440
gggcgucugcuccgcgau

SEQ ID NO: 1578762 - RNA, 14 nt, Pseudomonas putida KT2440
gggcgucuuccagg

SEQ ID NO: 1578763 - RNA, 18 nt, Pseudomonas putida KT2440
gggggcaaagaacagcgc

SEQ ID NO: 1578764 - RNA, 12 nt, Pseudomonas putida KT2440
ggggaaaugccu

SEQ ID NO: 1578765 - RNA, 16 nt, Pseudomonas putida KT2440
gggcuuuuucguuugc

SEQ ID NO: 1578766 - RNA, 15 nt, Pseudomonas putida KT2440
gggcuuguccgcgaa

SEQ ID NO: 1578767 - RNA, 14 nt, Pseudomonas putida KT2440
gggcugucgagcag

SEQ ID NO: 1578768 - RNA, 13 nt, Pseudomonas putida KT2440
gggcuugcccgcg

SEQ ID NO: 1578769 - RNA, 14 nt, Pseudomonas putida KT2440
gggcuugcccgcga

SEQ ID NO: 1578770 - RNA, 15 nt, Pseudomonas putida KT2440
gggcuucgagcagcu

SEQ ID NO: 1578771 - RNA, 17 nt, Pseudomonas putida KT2440
gggcuguuccagcagcg

SEQ ID NO: 1578772 - RNA, 22 nt, Pseudomonas putida KT2440
ggcgucauccugcgcggccacu

SEQ ID NO: 1578773 - RNA, 22 nt, Pseudomonas putida KT2440
ggcguauuugaccagcccgcug

SEQ ID NO: 1578774 - RNA, 19 nt, Pseudomonas putida KT2440
ggcguauggcuucacggcc

SEQ ID NO: 1578775 - RNA, 19 nt, Pseudomonas putida KT2440
ggcgucacccgcgccacca

SEQ ID NO: 1578776 - RNA, 14 nt, Pseudomonas putida KT2440
ggcgucaucacccg

SEQ ID NO: 1578777 - RNA, 22 nt, Pseudomonas putida KT2440
ggcgucaucacccgggaacagc

SEQ ID NO: 1578778 - RNA, 21 nt, Pseudomonas putida KT2440
ggcgucagcguugcuggcgau

SEQ ID NO: 1578779 - RNA, 19 nt, Pseudomonas putida KT2440
gggagggcuuugcccuccu

SEQ ID NO: 1578780 - RNA, 16 nt, Pseudomonas putida KT2440
gggaggauucggucac

SEQ ID NO: 1578781 - RNA, 17 nt, Pseudomonas putida KT2440
gggcacgcccgcuccca

SEQ ID NO: 1578782 - RNA, 15 nt, Pseudomonas putida KT2440
gggcacgaucagcag

SEQ ID NO: 1578783 - RNA, 17 nt, Pseudomonas putida KT2440
gggcacgggccagcgcg

SEQ ID NO: 1578784 - RNA, 23 nt, Pseudomonas putida KT2440
gggcagcaccgcguaucaggcau

SEQ ID NO: 1578785 - RNA, 14 nt, Pseudomonas putida KT2440
gggcaagcccgcga

SEQ ID NO: 1578786 - RNA, 16 nt, Pseudomonas putida KT2440
gggcaagcccgcgaag

SEQ ID NO: 1578787 - RNA, 19 nt, Pseudomonas putida KT2440
gggcaagcccgcucccaca

SEQ ID NO: 1578788 - RNA, 22 nt, Pseudomonas putida KT2440
gggcaagcccgcucccacaggg

SEQ ID NO: 1578789 - RNA, 18 nt, Pseudomonas putida KT2440
gggcaauguucgcugcca

SEQ ID NO: 1578790 - RNA, 17 nt, Pseudomonas putida KT2440
gggcaauggccacacgc

SEQ ID NO: 1578791 - RNA, 18 nt, Pseudomonas putida KT2440
gggcaauggcgcgaacag

SEQ ID NO: 1578792 - RNA, 22 nt, Pseudomonas putida KT2440
gggcacaccuggugcgccuuuu

SEQ ID NO: 1578793 - RNA, 19 nt, Pseudomonas putida KT2440
gggauuucggcggcgaugc

SEQ ID NO: 1578794 - RNA, 20 nt, Pseudomonas putida KT2440
gggcaaaaaaguggcgugga

SEQ ID NO: 1578795 - RNA, 15 nt, Pseudomonas putida KT2440
gggcaaaaucgacca

SEQ ID NO: 1578796 - RNA, 14 nt, Pseudomonas putida KT2440
gggcaacaccgcca

SEQ ID NO: 1578797 - RNA, 13 nt, Pseudomonas putida KT2440
gggcaaacccgcg

SEQ ID NO: 1578798 - RNA, 19 nt, Pseudomonas putida KT2440
gggcaaacccgcgccuaca

SEQ ID NO: 1578799 - RNA, 13 nt, Pseudomonas putida KT2440
gggcaaacuggcg

SEQ ID NO: 1578800 - RNA, 18 nt, Pseudomonas putida KT2440
gggcaacagcugcgcgaa

SEQ ID NO: 1578801 - RNA, 18 nt, Pseudomonas putida KT2440
gggaucgcgcaagccuuu

SEQ ID NO: 1578802 - RNA, 14 nt, Pseudomonas putida KT2440
gggauggcaccggc

SEQ ID NO: 1578803 - RNA, 22 nt, Pseudomonas putida KT2440
gggauggcaccggcagugcgaa

SEQ ID NO: 1578804 - RNA, 18 nt, Pseudomonas putida KT2440
gggccgaaaggugcagca

SEQ ID NO: 1578805 - RNA, 20 nt, Pseudomonas putida KT2440
gggccgcaaagcggccccuu

SEQ ID NO: 1578806 - RNA, 12 nt, Pseudomonas putida KT2440
gggccgcaaggc

SEQ ID NO: 1578807 - RNA, 22 nt, Pseudomonas putida KT2440
gggccggugggcaacagcugcg

SEQ ID NO: 1578808 - RNA, 14 nt, Pseudomonas putida KT2440
gggccggcccugcu

SEQ ID NO: 1578809 - RNA, 14 nt, Pseudomonas putida KT2440
gggccggcacaggc

SEQ ID NO: 1578810 - RNA, 14 nt, Pseudomonas putida KT2440
gggccgcuucgcga

SEQ ID NO: 1578811 - RNA, 15 nt, Pseudomonas putida KT2440
gggccgcuucgcgac

SEQ ID NO: 1578812 - RNA, 20 nt, Pseudomonas putida KT2440
gggccgcuuggcggcccauu

SEQ ID NO: 1578813 - RNA, 20 nt, Pseudomonas putida KT2440
gggccgcuuggcggcccuau

SEQ ID NO: 1578814 - RNA, 20 nt, Pseudomonas putida KT2440
gggccgcuuugcggccccuu

SEQ ID NO: 1578815 - RNA, 20 nt, Pseudomonas putida KT2440
gggccgcucugcggcccauu

SEQ ID NO: 1578816 - RNA, 17 nt, Pseudomonas putida KT2440
gggccgccguggugccg

SEQ ID NO: 1578817 - RNA, 16 nt, Pseudomonas putida KT2440
gggccgcgcagccuuu

SEQ ID NO: 1578818 - RNA, 15 nt, Pseudomonas putida KT2440
gggccgcgcagcggc

SEQ ID NO: 1578819 - RNA, 20 nt, Pseudomonas putida KT2440
gggccgcgcagcggccccuu

SEQ ID NO: 1578820 - RNA, 14 nt, Pseudomonas putida KT2440
gggccgcccuuucg

SEQ ID NO: 1578821 - RNA, 17 nt, Pseudomonas putida KT2440
gggcauuuuuugagcaa

SEQ ID NO: 1578822 - RNA, 16 nt, Pseudomonas putida KT2440
gggccaccaggccuuu

SEQ ID NO: 1578823 - RNA, 18 nt, Pseudomonas putida KT2440
gggccagccgcgccaggu

SEQ ID NO: 1578824 - RNA, 12 nt, Pseudomonas putida KT2440
gggccaggcccc

SEQ ID NO: 1578825 - RNA, 15 nt, Pseudomonas putida KT2440
gggccagguggccuu

SEQ ID NO: 1578826 - RNA, 15 nt, Pseudomonas putida KT2440
gggcauugcgcuggu

SEQ ID NO: 1578827 - RNA, 18 nt, Pseudomonas putida KT2440
gggcaugagccuggccgg

SEQ ID NO: 1578828 - RNA, 19 nt, Pseudomonas putida KT2440
gggcaugcccgcucccaca

SEQ ID NO: 1578829 - RNA, 17 nt, Pseudomonas putida KT2440
gggcaguucgaugcgaa

SEQ ID NO: 1578830 - RNA, 17 nt, Pseudomonas putida KT2440
gggcauccagcuugcca

SEQ ID NO: 1578831 - RNA, 17 nt, Pseudomonas putida KT2440
gggcauccgucgacuca

SEQ ID NO: 1578832 - RNA, 15 nt, Pseudomonas putida KT2440
gggcaggucgacccg

SEQ ID NO: 1578833 - RNA, 14 nt, Pseudomonas putida KT2440
gggcaggucguuga

SEQ ID NO: 1578834 - RNA, 22 nt, Pseudomonas putida KT2440
ggacccuacgaacaaauccgcg

SEQ ID NO: 1578835 - RNA, 19 nt, Pseudomonas putida KT2440
ggacgacgcgaaugaugaa

SEQ ID NO: 1578836 - RNA, 13 nt, Pseudomonas putida KT2440
ggaccuggcuggc

SEQ ID NO: 1578837 - RNA, 13 nt, Pseudomonas putida KT2440
ggaccuugcgggu

SEQ ID NO: 1578838 - RNA, 14 nt, Pseudomonas putida KT2440
ggacgaacccuuga

SEQ ID NO: 1578839 - RNA, 17 nt, Pseudomonas putida KT2440
ggacgaacccuugaccu

SEQ ID NO: 1578840 - RNA, 14 nt, Pseudomonas putida KT2440
ggacaggcgcuuga

SEQ ID NO: 1578841 - RNA, 22 nt, Pseudomonas putida KT2440
ggacauaccacacaccccagaa

SEQ ID NO: 1578842 - RNA, 12 nt, Pseudomonas putida KT2440
ggacaucaccag

SEQ ID NO: 1578843 - RNA, 15 nt, Pseudomonas putida KT2440
ggaccaggccgaugu

SEQ ID NO: 1578844 - RNA, 20 nt, Pseudomonas putida KT2440
ggacaaauccaggucgguga

SEQ ID NO: 1578845 - RNA, 14 nt, Pseudomonas putida KT2440
ggacacgucacuga

SEQ ID NO: 1578846 - RNA, 23 nt, Pseudomonas putida KT2440
ggacacgucacugaugcgccagu

SEQ ID NO: 1578847 - RNA, 13 nt, Pseudomonas putida KT2440
ggacacugccgug

SEQ ID NO: 1578848 - RNA, 14 nt, Pseudomonas putida KT2440
ggacaccaggcugg

SEQ ID NO: 1578849 - RNA, 17 nt, Pseudomonas putida KT2440
ggacaccaggcugguga

SEQ ID NO: 1578850 - RNA, 14 nt, Pseudomonas putida KT2440
ggacaccauggccu

SEQ ID NO: 1578851 - RNA, 15 nt, Pseudomonas putida KT2440
ggacaccucccgcgc

SEQ ID NO: 1578852 - RNA, 16 nt, Pseudomonas putida KT2440
ggacagcccaaggccu

SEQ ID NO: 1578853 - RNA, 19 nt, Pseudomonas putida KT2440
ggaacggcuggcugccguc

SEQ ID NO: 1578854 - RNA, 18 nt, Pseudomonas putida KT2440
ggaacggugaacggcggg

SEQ ID NO: 1578855 - RNA, 15 nt, Pseudomonas putida KT2440
ggaacggcccgcgga

SEQ ID NO: 1578856 - RNA, 15 nt, Pseudomonas putida KT2440
ggaaccccauccaca

SEQ ID NO: 1578857 - RNA, 23 nt, Pseudomonas putida KT2440
ggaaccccauccacaucgccagg

SEQ ID NO: 1578858 - RNA, 13 nt, Pseudomonas putida KT2440
ggaaccgcuccca

SEQ ID NO: 1578859 - RNA, 17 nt, Pseudomonas putida KT2440
gcuggcgccugcggcau

SEQ ID NO: 1578860 - RNA, 13 nt, Pseudomonas putida KT2440
gcuggcgcgacca

SEQ ID NO: 1578861 - RNA, 16 nt, Pseudomonas putida KT2440
gcuggcgcuggucaau

SEQ ID NO: 1578862 - RNA, 17 nt, Pseudomonas putida KT2440
gcuggcgccagcgaugc

SEQ ID NO: 1578863 - RNA, 23 nt, Pseudomonas putida KT2440
ggaagaucaccuggucgaccgac

SEQ ID NO: 1578864 - RNA, 14 nt, Pseudomonas putida KT2440
ggaagaauugcugg

SEQ ID NO: 1578865 - RNA, 17 nt, Pseudomonas putida KT2440
ggaaggcgucguacagg

SEQ ID NO: 1578866 - RNA, 21 nt, Pseudomonas putida KT2440
ggaaugcucgucaccaucggu

SEQ ID NO: 1578867 - RNA, 18 nt, Pseudomonas putida KT2440
ggaucagccgcgccauug

SEQ ID NO: 1578868 - RNA, 18 nt, Pseudomonas putida KT2440
ggaucagugucugcgccu

SEQ ID NO: 1578869 - RNA, 21 nt, Pseudomonas putida KT2440
ggaucagugucugcgccugcu

SEQ ID NO: 1578870 - RNA, 23 nt, Pseudomonas putida KT2440
ggauacaucgcauacagcgcacu

SEQ ID NO: 1578871 - RNA, 22 nt, Pseudomonas putida KT2440
ggaucaagccugacucagcccu

SEQ ID NO: 1578872 - RNA, 12 nt, Pseudomonas putida KT2440
ggaucaccuggc

SEQ ID NO: 1578873 - RNA, 15 nt, Pseudomonas putida KT2440
ggaucaccgccagca

SEQ ID NO: 1578874 - RNA, 16 nt, Pseudomonas putida KT2440
ggaucaccgccagcag

SEQ ID NO: 1578875 - RNA, 22 nt, Pseudomonas putida KT2440
ggaguugcucgagugcgaaggc

SEQ ID NO: 1578876 - RNA, 18 nt, Pseudomonas putida KT2440
ggaggcuguuucagcccu

SEQ ID NO: 1578877 - RNA, 18 nt, Pseudomonas putida KT2440
ggagucgaaccugcccgg

SEQ ID NO: 1578878 - RNA, 18 nt, Pseudomonas putida KT2440
ggaguccccaccggcacc

SEQ ID NO: 1578879 - RNA, 16 nt, Pseudomonas putida KT2440
aaggccguggcaaggc

SEQ ID NO: 1578880 - RNA, 19 nt, Pseudomonas putida KT2440
aaggccguggcaaggcccg

SEQ ID NO: 1578881 - RNA, 18 nt, Pseudomonas putida KT2440
aaggccucacgcaucugc

SEQ ID NO: 1578882 - RNA, 21 nt, Pseudomonas putida KT2440
ggagcggccuugcgucgcgaa

SEQ ID NO: 1578883 - RNA, 20 nt, Pseudomonas putida KT2440
ggagcggccuugugucgcga

SEQ ID NO: 1578884 - RNA, 18 nt, Pseudomonas putida KT2440
ggagcggaacucgcccgg

SEQ ID NO: 1578885 - RNA, 21 nt, Pseudomonas putida KT2440
ggagcggcuuugcgucccgaa

SEQ ID NO: 1578886 - RNA, 20 nt, Pseudomonas putida KT2440
ggagcgggcaugcccgcgaa

SEQ ID NO: 1578887 - RNA, 19 nt, Pseudomonas putida KT2440
ggagcgggcgcgcccgcga

SEQ ID NO: 1578888 - RNA, 20 nt, Pseudomonas putida KT2440
ggagcgggcgcgcccgcgaa

SEQ ID NO: 1578889 - RNA, 19 nt, Pseudomonas putida KT2440
ggagcgggcgugcccgcga

SEQ ID NO: 1578890 - RNA, 20 nt, Pseudomonas putida KT2440
ggagcgggcgugcccgcgaa

SEQ ID NO: 1578891 - RNA, 20 nt, Pseudomonas putida KT2440
ggagcgggcgugccugcgaa

SEQ ID NO: 1578892 - RNA, 19 nt, Pseudomonas putida KT2440
ggagcgggcuuacccgcga

SEQ ID NO: 1578893 - RNA, 20 nt, Pseudomonas putida KT2440
ggagcgggcuuacccgcgaa

SEQ ID NO: 1578894 - RNA, 19 nt, Pseudomonas putida KT2440
ggagcgggcuugcccgcga

SEQ ID NO: 1578895 - RNA, 20 nt, Pseudomonas putida KT2440
ggagcgggcuugcccgcgaa

SEQ ID NO: 1578896 - RNA, 21 nt, Pseudomonas putida KT2440
ggagcgggcuugcccgcgaau

SEQ ID NO: 1578897 - RNA, 16 nt, Pseudomonas putida KT2440
ggaggccgucaggccu

SEQ ID NO: 1578898 - RNA, 16 nt, Pseudomonas putida KT2440
ggagcguggaugaagc

SEQ ID NO: 1578899 - RNA, 19 nt, Pseudomonas putida KT2440
ggagcgggucuacccgcga

SEQ ID NO: 1578900 - RNA, 19 nt, Pseudomonas putida KT2440
ggagcggguucacccgcga

SEQ ID NO: 1578901 - RNA, 20 nt, Pseudomonas putida KT2440
ggagcggguucacccgcgaa

SEQ ID NO: 1578902 - RNA, 20 nt, Pseudomonas putida KT2440
ggagcggguuuacccgcgaa

SEQ ID NO: 1578903 - RNA, 19 nt, Pseudomonas putida KT2440
ggagcggguuuucucgcga

SEQ ID NO: 1578904 - RNA, 20 nt, Pseudomonas putida KT2440
ggagcggguuuucucgcgaa

SEQ ID NO: 1578905 - RNA, 15 nt, Pseudomonas putida KT2440
ggacggguuucgccg

SEQ ID NO: 1578906 - RNA, 18 nt, Pseudomonas putida KT2440
ggacucauagcucagcug

SEQ ID NO: 1578907 - RNA, 15 nt, Pseudomonas putida KT2440
ggacgucgcgcuggc

SEQ ID NO: 1578908 - RNA, 16 nt, Pseudomonas putida KT2440
ggacgucgcgcuggcc

SEQ ID NO: 1578909 - RNA, 17 nt, Pseudomonas putida KT2440
ggacgucgcgcuggccg

SEQ ID NO: 1578910 - RNA, 19 nt, Pseudomonas putida KT2440
ggacgucgcgcuggccgcc

SEQ ID NO: 1578911 - RNA, 17 nt, Pseudomonas putida KT2440
ggacugugggagcgggc

SEQ ID NO: 1578912 - RNA, 16 nt, Pseudomonas putida KT2440
ggacugcaccaggucc

SEQ ID NO: 1578913 - RNA, 17 nt, Pseudomonas putida KT2440
ggagaucgagugcucga

SEQ ID NO: 1578914 - RNA, 16 nt, Pseudomonas putida KT2440
ggagauucuauggccg

SEQ ID NO: 1578915 - RNA, 17 nt, Pseudomonas putida KT2440
ggagauucuauggccgg

SEQ ID NO: 1578916 - RNA, 13 nt, Pseudomonas putida KT2440
ggagacgaacagc

SEQ ID NO: 1578917 - RNA, 11 nt, Pseudomonas putida KT2440
ggagccggcug

SEQ ID NO: 1578918 - RNA, 16 nt, Pseudomonas putida KT2440
aaggacugccugauca

SEQ ID NO: 1578919 - RNA, 19 nt, Pseudomonas putida KT2440
aaggccgcucccacagggc

SEQ ID NO: 1578920 - RNA, 14 nt, Pseudomonas putida KT2440
aaggccggcaccga

SEQ ID NO: 1578921 - RNA, 18 nt, Pseudomonas putida KT2440
aaggccggcagccagggc

SEQ ID NO: 1578922 - RNA, 14 nt, Pseudomonas putida KT2440
aaggccgccaccuc

SEQ ID NO: 1578923 - RNA, 16 nt, Pseudomonas putida KT2440
aaggccagcgccugcu

SEQ ID NO: 1578924 - RNA, 11 nt, Pseudomonas putida KT2440
aaggcccugca

SEQ ID NO: 1578925 - RNA, 17 nt, Pseudomonas putida KT2440
aaggcaucgggcaaggc

SEQ ID NO: 1578926 - RNA, 20 nt, Pseudomonas putida KT2440
aaggcaucguuguaagccau

SEQ ID NO: 1578927 - RNA, 17 nt, Pseudomonas putida KT2440
ggccaccggcagcaccu

SEQ ID NO: 1578928 - RNA, 24 nt, Pseudomonas putida KT2440
ggccacugguaguucaucgcccau

SEQ ID NO: 1578929 - RNA, 14 nt, Pseudomonas putida KT2440
ggccacugcgcagu

SEQ ID NO: 1578930 - RNA, 19 nt, Pseudomonas putida KT2440
ggccacguugaucgucggc

SEQ ID NO: 1578931 - RNA, 17 nt, Pseudomonas putida KT2440
ggccacggugucggaca

SEQ ID NO: 1578932 - RNA, 18 nt, Pseudomonas putida KT2440
ggccacggugucggacag

SEQ ID NO: 1578933 - RNA, 23 nt, Pseudomonas putida KT2440
ggccacgcccaaccccagcgcgu

SEQ ID NO: 1578934 - RNA, 22 nt, Pseudomonas putida KT2440
ggcaugcccgccccugccagca

SEQ ID NO: 1578935 - RNA, 21 nt, Pseudomonas putida KT2440
ggcaugcccgcucccacaggu

SEQ ID NO: 1578936 - RNA, 19 nt, Pseudomonas putida KT2440
ggcaugcccaguucgcgug

SEQ ID NO: 1578937 - RNA, 23 nt, Pseudomonas putida KT2440
ggcaucggccuggggcaggcccg

SEQ ID NO: 1578938 - RNA, 18 nt, Pseudomonas putida KT2440
ggcaucgcucaacuggcu

SEQ ID NO: 1578939 - RNA, 13 nt, Pseudomonas putida KT2440
ggccaccacggua

SEQ ID NO: 1578940 - RNA, 16 nt, Pseudomonas putida KT2440
ggccaccaccagcaac

SEQ ID NO: 1578941 - RNA, 13 nt, Pseudomonas putida KT2440
ggccagcgcaucg

SEQ ID NO: 1578942 - RNA, 16 nt, Pseudomonas putida KT2440
ggccagcuucgacgaa

SEQ ID NO: 1578943 - RNA, 21 nt, Pseudomonas putida KT2440
ggccagcuuggcuuucggcgc

SEQ ID NO: 1578944 - RNA, 21 nt, Pseudomonas putida KT2440
ggccagccagguauggccaga

SEQ ID NO: 1578945 - RNA, 18 nt, Pseudomonas putida KT2440
ggccagcaguucgucgag

SEQ ID NO: 1578946 - RNA, 20 nt, Pseudomonas putida KT2440
ggccagcaguucgucgagca

SEQ ID NO: 1578947 - RNA, 13 nt, Pseudomonas putida KT2440
ggccagcagguca

SEQ ID NO: 1578948 - RNA, 17 nt, Pseudomonas putida KT2440
ggccagcaggucagcac

SEQ ID NO: 1578949 - RNA, 20 nt, Pseudomonas putida KT2440
ggccagcagauggcucaucg

SEQ ID NO: 1578950 - RNA, 20 nt, Pseudomonas putida KT2440
ggccagcacggccagcaccg

SEQ ID NO: 1578951 - RNA, 22 nt, Pseudomonas putida KT2440
ggccaguaaggaucgcgcagca

SEQ ID NO: 1578952 - RNA, 21 nt, Pseudomonas putida KT2440
ggccaguaccaggucgccagc

SEQ ID NO: 1578953 - RNA, 19 nt, Pseudomonas putida KT2440
ggccagugagccucacaca

SEQ ID NO: 1578954 - RNA, 23 nt, Pseudomonas putida KT2440
ggccagggauuccuuggucaggu

SEQ ID NO: 1578955 - RNA, 17 nt, Pseudomonas putida KT2440
ggccagggcaucggaca

SEQ ID NO: 1578956 - RNA, 18 nt, Pseudomonas putida KT2440
ggccagggcaucggacag

SEQ ID NO: 1578957 - RNA, 16 nt, Pseudomonas putida KT2440
ggccaggaacagcgcc

SEQ ID NO: 1578958 - RNA, 12 nt, Pseudomonas putida KT2440
ggccaucagcaa

SEQ ID NO: 1578959 - RNA, 20 nt, Pseudomonas putida KT2440
ggccauauugcugagccagu

SEQ ID NO: 1578960 - RNA, 18 nt, Pseudomonas putida KT2440
ggccauaguugaccagca

SEQ ID NO: 1578961 - RNA, 18 nt, Pseudomonas putida KT2440
ggccauagcccucggcaa

SEQ ID NO: 1578962 - RNA, 20 nt, Pseudomonas putida KT2440
ggccauacagggccuggcgc

SEQ ID NO: 1578963 - RNA, 14 nt, Pseudomonas putida KT2440
ggccaguugcccca

SEQ ID NO: 1578964 - RNA, 13 nt, Pseudomonas putida KT2440
ggccaguuguccg

SEQ ID NO: 1578965 - RNA, 18 nt, Pseudomonas putida KT2440
ggccaguuguucgucgag

SEQ ID NO: 1578966 - RNA, 21 nt, Pseudomonas putida KT2440
ggccaguuguucgucgagcac

SEQ ID NO: 1578967 - RNA, 13 nt, Pseudomonas putida KT2440
ggccaucgacccg

SEQ ID NO: 1578968 - RNA, 23 nt, Pseudomonas putida KT2440
ggccauccagucgaucagcgaca

SEQ ID NO: 1578969 - RNA, 22 nt, Pseudomonas putida KT2440
ggcccacgccuuccaccgguac

SEQ ID NO: 1578970 - RNA, 23 nt, Pseudomonas putida KT2440
ggcccagccaggcacuggccagc

SEQ ID NO: 1578971 - RNA, 13 nt, Pseudomonas putida KT2440
ggcccagccaccg

SEQ ID NO: 1578972 - RNA, 16 nt, Pseudomonas putida KT2440
ggcccagccaccgacg

SEQ ID NO: 1578973 - RNA, 17 nt, Pseudomonas putida KT2440
ggccauugagguugacg

SEQ ID NO: 1578974 - RNA, 14 nt, Pseudomonas putida KT2440
ggccaugugcucgg

SEQ ID NO: 1578975 - RNA, 21 nt, Pseudomonas putida KT2440
ggcccaacgaaaaaggcccug

SEQ ID NO: 1578976 - RNA, 15 nt, Pseudomonas putida KT2440
ggcccaaggcgaugu

SEQ ID NO: 1578977 - RNA, 13 nt, Pseudomonas putida KT2440
ggcccacagugcu

SEQ ID NO: 1578978 - RNA, 20 nt, Pseudomonas putida KT2440
ggccauggcgcggacgauca

SEQ ID NO: 1578979 - RNA, 17 nt, Pseudomonas putida KT2440
ggccaugcugcgccagg

SEQ ID NO: 1578980 - RNA, 13 nt, Pseudomonas putida KT2440
ggccaugccaccc

SEQ ID NO: 1578981 - RNA, 18 nt, Pseudomonas putida KT2440
ggccaugauuacgcugaa

SEQ ID NO: 1578982 - RNA, 21 nt, Pseudomonas putida KT2440
ggcaccgacccggccgcucca

SEQ ID NO: 1578983 - RNA, 21 nt, Pseudomonas putida KT2440
ggcaccgacagcaacgcgaua

SEQ ID NO: 1578984 - RNA, 18 nt, Pseudomonas putida KT2440
ggcaccgacggcggugau

SEQ ID NO: 1578985 - RNA, 16 nt, Pseudomonas putida KT2440
ggcaccggcgaacagc

SEQ ID NO: 1578986 - RNA, 18 nt, Pseudomonas putida KT2440
ggcaccggcgaacagcaa

SEQ ID NO: 1578987 - RNA, 15 nt, Pseudomonas putida KT2440
ggcaccggcagcagc

SEQ ID NO: 1578988 - RNA, 17 nt, Pseudomonas putida KT2440
ggcaccggccaccaggc

SEQ ID NO: 1578989 - RNA, 20 nt, Pseudomonas putida KT2440
ggcaccggccaccaggcgcg

SEQ ID NO: 1578990 - RNA, 14 nt, Pseudomonas putida KT2440
ggcacacuucgccg

SEQ ID NO: 1578991 - RNA, 22 nt, Pseudomonas putida KT2440
ggcagaacaucgcccauugccg

SEQ ID NO: 1578992 - RNA, 22 nt, Pseudomonas putida KT2440
ggcagaacacaucgguacgccg

SEQ ID NO: 1578993 - RNA, 22 nt, Pseudomonas putida KT2440
ggcacuuguugguguggcagcu

SEQ ID NO: 1578994 - RNA, 18 nt, Pseudomonas putida KT2440
ggcacgggccagcgcggu

SEQ ID NO: 1578995 - RNA, 11 nt, Pseudomonas putida KT2440
ggcacgcccau

SEQ ID NO: 1578996 - RNA, 22 nt, Pseudomonas putida KT2440
ggcacgcccauuuccgggcaau

SEQ ID NO: 1578997 - RNA, 21 nt, Pseudomonas putida KT2440
ggcacgcccgcucccacaggu

SEQ ID NO: 1578998 - RNA, 16 nt, Pseudomonas putida KT2440
ggcacgaucagcagca

SEQ ID NO: 1578999 - RNA, 17 nt, Pseudomonas putida KT2440
ggcacgaucagcagcaa

SEQ ID NO: 1579000 - RNA, 20 nt, Pseudomonas putida KT2440
ggcacacaccggguguugga

SEQ ID NO: 1579001 - RNA, 22 nt, Pseudomonas putida KT2440
ggcaauuacuuugucgccuacc

SEQ ID NO: 1579002 - RNA, 14 nt, Pseudomonas putida KT2440
ggcaauugccaccg

SEQ ID NO: 1579003 - RNA, 16 nt, Pseudomonas putida KT2440
ggcaauacaacgauca

SEQ ID NO: 1579004 - RNA, 22 nt, Pseudomonas putida KT2440
ggcaauaaaaaaccccggcaca

SEQ ID NO: 1579005 - RNA, 23 nt, Pseudomonas putida KT2440
ggcaauaaaaaaccggcgcuugg

SEQ ID NO: 1579006 - RNA, 16 nt, Pseudomonas putida KT2440
ggcaaucagcgacaac

SEQ ID NO: 1579007 - RNA, 22 nt, Pseudomonas putida KT2440
ggcaaucagcaggucggcguca

SEQ ID NO: 1579008 - RNA, 20 nt, Pseudomonas putida KT2440
ggcaaucaggcugaucaccg

SEQ ID NO: 1579009 - RNA, 16 nt, Pseudomonas putida KT2440
ggcaauaccggccacg

SEQ ID NO: 1579010 - RNA, 19 nt, Pseudomonas putida KT2440
ggcaauaugggucgacuga

SEQ ID NO: 1579011 - RNA, 17 nt, Pseudomonas putida KT2440
ggcaacggugaacggcg

SEQ ID NO: 1579012 - RNA, 18 nt, Pseudomonas putida KT2440
ggcaacggcaauggccgg

SEQ ID NO: 1579013 - RNA, 16 nt, Pseudomonas putida KT2440
ggcaacuccuccagcc

SEQ ID NO: 1579014 - RNA, 15 nt, Pseudomonas putida KT2440
ggcaaggcauccaga

SEQ ID NO: 1579015 - RNA, 16 nt, Pseudomonas putida KT2440
ggcaacaccgccagaa

SEQ ID NO: 1579016 - RNA, 22 nt, Pseudomonas putida KT2440
ggcaacaccagcagccacgggu

SEQ ID NO: 1579017 - RNA, 22 nt, Pseudomonas putida KT2440
ggcaacagcucaacccgccuga

SEQ ID NO: 1579018 - RNA, 14 nt, Pseudomonas putida KT2440
ggcaacagcugcgc

SEQ ID NO: 1579019 - RNA, 15 nt, Pseudomonas putida KT2440
ggcaucacgcuggcc

SEQ ID NO: 1579020 - RNA, 20 nt, Pseudomonas putida KT2440
ggcaucacuacccaggccaa

SEQ ID NO: 1579021 - RNA, 19 nt, Pseudomonas putida KT2440
ggcaucaugauggucacgc

SEQ ID NO: 1579022 - RNA, 18 nt, Pseudomonas putida KT2440
ggcauccacaccguacug

SEQ ID NO: 1579023 - RNA, 13 nt, Pseudomonas putida KT2440
ggcauccacaccg

SEQ ID NO: 1579024 - RNA, 22 nt, Pseudomonas putida KT2440
ggcaucauccugcucgacaagc

SEQ ID NO: 1579025 - RNA, 14 nt, Pseudomonas putida KT2440
ggcauaggcuguca

SEQ ID NO: 1579026 - RNA, 21 nt, Pseudomonas putida KT2440
ggcauaguccaggaagcaggc

SEQ ID NO: 1579027 - RNA, 16 nt, Pseudomonas putida KT2440
ggcaguguggcaaggg

SEQ ID NO: 1579028 - RNA, 22 nt, Pseudomonas putida KT2440
ggcaucgaagcgcaccagugua

SEQ ID NO: 1579029 - RNA, 19 nt, Pseudomonas putida KT2440
ggcauccgccucauccucg

SEQ ID NO: 1579030 - RNA, 18 nt, Pseudomonas putida KT2440
ggcauccggcagcucacc

SEQ ID NO: 1579031 - RNA, 13 nt, Pseudomonas putida KT2440
ggcauccagcucg

SEQ ID NO: 1579032 - RNA, 21 nt, Pseudomonas putida KT2440
ggcauccagcucggcaaggcg

SEQ ID NO: 1579033 - RNA, 20 nt, Pseudomonas putida KT2440
ggcaggcucagggcagcaac

SEQ ID NO: 1579034 - RNA, 17 nt, Pseudomonas putida KT2440
ggcaggcgguccagcaa

SEQ ID NO: 1579035 - RNA, 18 nt, Pseudomonas putida KT2440
ggcagggugaucgcgcug

SEQ ID NO: 1579036 - RNA, 23 nt, Pseudomonas putida KT2440
ggcagggugaucgcgcuggcacu

SEQ ID NO: 1579037 - RNA, 16 nt, Pseudomonas putida KT2440
ggcaggucauuggcgc

SEQ ID NO: 1579038 - RNA, 19 nt, Pseudomonas putida KT2440
ggcagucagggucucggcc

SEQ ID NO: 1579039 - RNA, 20 nt, Pseudomonas putida KT2440
ggcaguccugcaacucggcc

SEQ ID NO: 1579040 - RNA, 21 nt, Pseudomonas putida KT2440
ggcaguccugcaacucggccu

SEQ ID NO: 1579041 - RNA, 16 nt, Pseudomonas putida KT2440
ggcaguggcggugacc

SEQ ID NO: 1579042 - RNA, 15 nt, Pseudomonas putida KT2440
ggcagccaccucgac

SEQ ID NO: 1579043 - RNA, 16 nt, Pseudomonas putida KT2440
ggcagccacgauagcg

SEQ ID NO: 1579044 - RNA, 23 nt, Pseudomonas putida KT2440
ggcagccacgcuccagucguggc

SEQ ID NO: 1579045 - RNA, 19 nt, Pseudomonas putida KT2440
ggcagccagggccugaccg

SEQ ID NO: 1579046 - RNA, 19 nt, Pseudomonas putida KT2440
ggcagcccuucgcgggcac

SEQ ID NO: 1579047 - RNA, 15 nt, Pseudomonas putida KT2440
ggcagcaugaacagc

SEQ ID NO: 1579048 - RNA, 14 nt, Pseudomonas putida KT2440
ggcagcagcucuuu

SEQ ID NO: 1579049 - RNA, 17 nt, Pseudomonas putida KT2440
ggcagcacgucggcgcc

SEQ ID NO: 1579050 - RNA, 20 nt, Pseudomonas putida KT2440
ggcagcagcaaugccgaaca

SEQ ID NO: 1579051 - RNA, 13 nt, Pseudomonas putida KT2440
ggcagcaccacga

SEQ ID NO: 1579052 - RNA, 16 nt, Pseudomonas putida KT2440
ggcagacacaggcgcu

SEQ ID NO: 1579053 - RNA, 17 nt, Pseudomonas putida KT2440
ggcagacacaggcgcuc

SEQ ID NO: 1579054 - RNA, 19 nt, Pseudomonas putida KT2440
ggcagcaaguugaagaaca

SEQ ID NO: 1579055 - RNA, 14 nt, Pseudomonas putida KT2440
ggcagcaaucgccg

SEQ ID NO: 1579056 - RNA, 22 nt, Pseudomonas putida KT2440
ggccgucacauaguugggcugu

SEQ ID NO: 1579057 - RNA, 21 nt, Pseudomonas putida KT2440
ggccguaggccagguacaggc

SEQ ID NO: 1579058 - RNA, 16 nt, Pseudomonas putida KT2440
ggccguaguaggagcg

SEQ ID NO: 1579059 - RNA, 21 nt, Pseudomonas putida KT2440
ggccgugcaggcggcgacaac

SEQ ID NO: 1579060 - RNA, 14 nt, Pseudomonas putida KT2440
ggccgugacgccgu

SEQ ID NO: 1579061 - RNA, 16 nt, Pseudomonas putida KT2440
ggccucgauagcagcg

SEQ ID NO: 1579062 - RNA, 13 nt, Pseudomonas putida KT2440
ggccuaugccggg

SEQ ID NO: 1579063 - RNA, 15 nt, Pseudomonas putida KT2440
ggccucaauuccagu

SEQ ID NO: 1579064 - RNA, 18 nt, Pseudomonas putida KT2440
ggccucacauucaccgcc

SEQ ID NO: 1579065 - RNA, 23 nt, Pseudomonas putida KT2440
ggccggguuguggcuggcgucga

SEQ ID NO: 1579066 - RNA, 18 nt, Pseudomonas putida KT2440
ggccgggcacgacacucc

SEQ ID NO: 1579067 - RNA, 15 nt, Pseudomonas putida KT2440
ggccgggauggcagu

SEQ ID NO: 1579068 - RNA, 15 nt, Pseudomonas putida KT2440
ggccggcucgaacug

SEQ ID NO: 1579069 - RNA, 16 nt, Pseudomonas putida KT2440
ggccggccccacgcag

SEQ ID NO: 1579070 - RNA, 16 nt, Pseudomonas putida KT2440
ggccggcccugccggc

SEQ ID NO: 1579071 - RNA, 14 nt, Pseudomonas putida KT2440
ggccggcccuuucg

SEQ ID NO: 1579072 - RNA, 16 nt, Pseudomonas putida KT2440
ggccgcuggcccuucg

SEQ ID NO: 1579073 - RNA, 18 nt, Pseudomonas putida KT2440
ggccgcgcaauugccggu

SEQ ID NO: 1579074 - RNA, 13 nt, Pseudomonas putida KT2440
ggccgccggcaac

SEQ ID NO: 1579075 - RNA, 20 nt, Pseudomonas putida KT2440
ggccgcguugcggcccuucg

SEQ ID NO: 1579076 - RNA, 15 nt, Pseudomonas putida KT2440
ggccgcuccagcucg

SEQ ID NO: 1579077 - RNA, 16 nt, Pseudomonas putida KT2440
ggccgcauauacgccg

SEQ ID NO: 1579078 - RNA, 20 nt, Pseudomonas putida KT2440
ggccgccaaggcgaugcuuu

SEQ ID NO: 1579079 - RNA, 15 nt, Pseudomonas putida KT2440
ggccgccaacagcgc

SEQ ID NO: 1579080 - RNA, 23 nt, Pseudomonas putida KT2440
ggccgccagacaacuggccaggg

SEQ ID NO: 1579081 - RNA, 15 nt, Pseudomonas putida KT2440
ggcccaguucuccgg

SEQ ID NO: 1579082 - RNA, 18 nt, Pseudomonas putida KT2440
ggcccaguucuccggcag

SEQ ID NO: 1579083 - RNA, 19 nt, Pseudomonas putida KT2440
ggccccugugggagcgggg

SEQ ID NO: 1579084 - RNA, 18 nt, Pseudomonas putida KT2440
ggccccuuggccaacggc

SEQ ID NO: 1579085 - RNA, 18 nt, Pseudomonas putida KT2440
ggcccgaacgcagcgccg

SEQ ID NO: 1579086 - RNA, 14 nt, Pseudomonas putida KT2440
ggccgccgaacagg

SEQ ID NO: 1579087 - RNA, 16 nt, Pseudomonas putida KT2440
ggccgccgaacaggcc

SEQ ID NO: 1579088 - RNA, 19 nt, Pseudomonas putida KT2440
ggccgccgaacaggccggc

SEQ ID NO: 1579089 - RNA, 22 nt, Pseudomonas putida KT2440
ggccgcccucuucgcgggcacg

SEQ ID NO: 1579090 - RNA, 14 nt, Pseudomonas putida KT2440
ggccgccagcggcg

SEQ ID NO: 1579091 - RNA, 14 nt, Pseudomonas putida KT2440
ggccgccagcggca

SEQ ID NO: 1579092 - RNA, 15 nt, Pseudomonas putida KT2440
ggccgccagcggcag

SEQ ID NO: 1579093 - RNA, 16 nt, Pseudomonas putida KT2440
ggccgccagcggcagu

SEQ ID NO: 1579094 - RNA, 18 nt, Pseudomonas putida KT2440
ggcgaccaacacggugau

SEQ ID NO: 1579095 - RNA, 15 nt, Pseudomonas putida KT2440
ggcgaauacgcucag

SEQ ID NO: 1579096 - RNA, 18 nt, Pseudomonas putida KT2440
ggcgaaugagaggcgggu

SEQ ID NO: 1579097 - RNA, 13 nt, Pseudomonas putida KT2440
ggcgaauccagca

SEQ ID NO: 1579098 - RNA, 21 nt, Pseudomonas putida KT2440
ggcgacaaccgaaaaggccaa

SEQ ID NO: 1579099 - RNA, 14 nt, Pseudomonas putida KT2440
ggcgaauggcaggu

SEQ ID NO: 1579100 - RNA, 14 nt, Pseudomonas putida KT2440
ggcgagaaggcgug

SEQ ID NO: 1579101 - RNA, 14 nt, Pseudomonas putida KT2440
ggcgacuucgugcg

SEQ ID NO: 1579102 - RNA, 15 nt, Pseudomonas putida KT2440
aagggagaguccugc

SEQ ID NO: 1579103 - RNA, 20 nt, Pseudomonas putida KT2440
aaggcuuuccaccuggccac

SEQ ID NO: 1579104 - RNA, 17 nt, Pseudomonas putida KT2440
aaggcucaggccuugcc

SEQ ID NO: 1579105 - RNA, 22 nt, Pseudomonas putida KT2440
aaggcucgcccucgcggcggcu

SEQ ID NO: 1579106 - RNA, 15 nt, Pseudomonas putida KT2440
aaggcugacgccagu

SEQ ID NO: 1579107 - RNA, 18 nt, Pseudomonas putida KT2440
aaggcugcccucgggcag

SEQ ID NO: 1579108 - RNA, 24 nt, Pseudomonas putida KT2440
aaggcugcuucguucacguagcug

SEQ ID NO: 1579109 - RNA, 13 nt, Pseudomonas putida KT2440
aaggcuucaaggu

SEQ ID NO: 1579110 - RNA, 16 nt, Pseudomonas putida KT2440
aaggcuagcagcauca

SEQ ID NO: 1579111 - RNA, 19 nt, Pseudomonas putida KT2440
aaggcguuuuccagguugu

SEQ ID NO: 1579112 - RNA, 19 nt, Pseudomonas putida KT2440
ggccuuucagcgcccagaa

SEQ ID NO: 1579113 - RNA, 17 nt, Pseudomonas putida KT2440
ggccuuguuauccaggc

SEQ ID NO: 1579114 - RNA, 23 nt, Pseudomonas putida KT2440
ggccuuggccagcucauccagcc

SEQ ID NO: 1579115 - RNA, 12 nt, Pseudomonas putida KT2440
ggccuuggccug

SEQ ID NO: 1579116 - RNA, 13 nt, Pseudomonas putida KT2440
ggcgaaccaggug

SEQ ID NO: 1579117 - RNA, 23 nt, Pseudomonas putida KT2440
ggcgaacacagcggccuugacca

SEQ ID NO: 1579118 - RNA, 22 nt, Pseudomonas putida KT2440
ggcgaagcacugucgauggcgg

SEQ ID NO: 1579119 - RNA, 23 nt, Pseudomonas putida KT2440
ggcgaagaccgccgcccagguca

SEQ ID NO: 1579120 - RNA, 22 nt, Pseudomonas putida KT2440
ggcgaacgccacggcggcaucc

SEQ ID NO: 1579121 - RNA, 14 nt, Pseudomonas putida KT2440
ggcgaacgauggug

SEQ ID NO: 1579122 - RNA, 15 nt, Pseudomonas putida KT2440
ggccuucgaagaaca

SEQ ID NO: 1579123 - RNA, 15 nt, Pseudomonas putida KT2440
ggccuuccagcugcg

SEQ ID NO: 1579124 - RNA, 21 nt, Pseudomonas putida KT2440
ggccuucccgccuggcgccug

SEQ ID NO: 1579125 - RNA, 12 nt, Pseudomonas putida KT2440
ggccuucaagcu

SEQ ID NO: 1579126 - RNA, 23 nt, Pseudomonas putida KT2440
ggccuucaagcuccccagcaacg

SEQ ID NO: 1579127 - RNA, 14 nt, Pseudomonas putida KT2440
ggccugucacgccu

SEQ ID NO: 1579128 - RNA, 13 nt, Pseudomonas putida KT2440
ggccugugccgaa

SEQ ID NO: 1579129 - RNA, 16 nt, Pseudomonas putida KT2440
ggccugugccgggcca

SEQ ID NO: 1579130 - RNA, 21 nt, Pseudomonas putida KT2440
ggccuugaccucgaccaggcg

SEQ ID NO: 1579131 - RNA, 13 nt, Pseudomonas putida KT2440
ggccuugaccagc

SEQ ID NO: 1579132 - RNA, 14 nt, Pseudomonas putida KT2440
ggccuugaccagca

SEQ ID NO: 1579133 - RNA, 14 nt, Pseudomonas putida KT2440
ggccuugcgcuggg

SEQ ID NO: 1579134 - RNA, 13 nt, Pseudomonas putida KT2440
ggccuugccgcuc

SEQ ID NO: 1579135 - RNA, 17 nt, Pseudomonas putida KT2440
ggccuugccgcuggcga

SEQ ID NO: 1579136 - RNA, 21 nt, Pseudomonas putida KT2440
ggccuugaucgcugcuacgcc

SEQ ID NO: 1579137 - RNA, 16 nt, Pseudomonas putida KT2440
ggccucuucgcgggca

SEQ ID NO: 1579138 - RNA, 16 nt, Pseudomonas putida KT2440
ggccucuucgcgggua

SEQ ID NO: 1579139 - RNA, 19 nt, Pseudomonas putida KT2440
ggccucuucgcggguaaac

SEQ ID NO: 1579140 - RNA, 16 nt, Pseudomonas putida KT2440
ggccucuucaggcaau

SEQ ID NO: 1579141 - RNA, 20 nt, Pseudomonas putida KT2440
ggccucuucaggcaauggcg

SEQ ID NO: 1579142 - RNA, 18 nt, Pseudomonas putida KT2440
ggccucucucagcaaccu

SEQ ID NO: 1579143 - RNA, 14 nt, Pseudomonas putida KT2440
ggccucgucgcggu

SEQ ID NO: 1579144 - RNA, 20 nt, Pseudomonas putida KT2440
ggccucgguacccgccagca

SEQ ID NO: 1579145 - RNA, 21 nt, Pseudomonas putida KT2440
aaggggguauuaagggcaugg

SEQ ID NO: 1579146 - RNA, 22 nt, Pseudomonas putida KT2440
aagguacugaucccuacccccu

SEQ ID NO: 1579147 - RNA, 14 nt, Pseudomonas putida KT2440
aagguaucggccau

SEQ ID NO: 1579148 - RNA, 13 nt, Pseudomonas putida KT2440
ggcgcaacucgcg

SEQ ID NO: 1579149 - RNA, 19 nt, Pseudomonas putida KT2440
aagggcucaacgccagggc

SEQ ID NO: 1579150 - RNA, 21 nt, Pseudomonas putida KT2440
aagggcucaacgccagggcaa

SEQ ID NO: 1579151 - RNA, 14 nt, Pseudomonas putida KT2440
aagggucgacacca

SEQ ID NO: 1579152 - RNA, 19 nt, Pseudomonas putida KT2440
aagggguacgaacgccagu

SEQ ID NO: 1579153 - RNA, 22 nt, Pseudomonas putida KT2440
aagggcaggccuggguacgccg

SEQ ID NO: 1579154 - RNA, 20 nt, Pseudomonas putida KT2440
aagggccugcaggcagcaua

SEQ ID NO: 1579155 - RNA, 13 nt, Pseudomonas putida KT2440
aagggccugugcc

SEQ ID NO: 1579156 - RNA, 16 nt, Pseudomonas putida KT2440
aagggccugugccgaa

SEQ ID NO: 1579157 - RNA, 19 nt, Pseudomonas putida KT2440
aagggccugugccgggcca

SEQ ID NO: 1579158 - RNA, 14 nt, Pseudomonas putida KT2440
aagggcgaccgaag

SEQ ID NO: 1579159 - RNA, 19 nt, Pseudomonas putida KT2440
ggcgagcgcgcaggcgguu

SEQ ID NO: 1579160 - RNA, 19 nt, Pseudomonas putida KT2440
ggcgagcgcaggaacaggc

SEQ ID NO: 1579161 - RNA, 12 nt, Pseudomonas putida KT2440
ggcgagccacuc

SEQ ID NO: 1579162 - RNA, 22 nt, Pseudomonas putida KT2440
ggcgcagggugucgguggcggc

SEQ ID NO: 1579163 - RNA, 17 nt, Pseudomonas putida KT2440
ggcgcaguucguccagg

SEQ ID NO: 1579164 - RNA, 18 nt, Pseudomonas putida KT2440
ggcgcaguucguccaggc

SEQ ID NO: 1579165 - RNA, 19 nt, Pseudomonas putida KT2440
ggcgccaaucaucgccagc

SEQ ID NO: 1579166 - RNA, 15 nt, Pseudomonas putida KT2440
ggcgcaggccgacaa

SEQ ID NO: 1579167 - RNA, 15 nt, Pseudomonas putida KT2440
ggcgcaggcagcaca

SEQ ID NO: 1579168 - RNA, 20 nt, Pseudomonas putida KT2440
ggcgcaauccgugagccagg

SEQ ID NO: 1579169 - RNA, 14 nt, Pseudomonas putida KT2440
ggcgccagcagugc

SEQ ID NO: 1579170 - RNA, 16 nt, Pseudomonas putida KT2440
ggcgccgccagcugcu

SEQ ID NO: 1579171 - RNA, 22 nt, Pseudomonas putida KT2440
ggcgcgcccugcucauccagca

SEQ ID NO: 1579172 - RNA, 17 nt, Pseudomonas putida KT2440
ggcgcgccuggcucgau

SEQ ID NO: 1579173 - RNA, 13 nt, Pseudomonas putida KT2440
ggcgcgcccgcuc

SEQ ID NO: 1579174 - RNA, 23 nt, Pseudomonas putida KT2440
ggcgcgcccgcgaagaggccggc

SEQ ID NO: 1579175 - RNA, 11 nt, Pseudomonas putida KT2440
ggcgcggcaca

SEQ ID NO: 1579176 - RNA, 22 nt, Pseudomonas putida KT2440
ggcgcggcccuguguaggagcg

SEQ ID NO: 1579177 - RNA, 22 nt, Pseudomonas putida KT2440
ggcgcgugccgcaugugccagg

SEQ ID NO: 1579178 - RNA, 23 nt, Pseudomonas putida KT2440
ggcgcgugccgcaugugccaggu

SEQ ID NO: 1579179 - RNA, 20 nt, Pseudomonas putida KT2440
ggcgcguguagcccgcugaa

SEQ ID NO: 1579180 - RNA, 21 nt, Pseudomonas putida KT2440
ggcgcguguagcccgcugaag

SEQ ID NO: 1579181 - RNA, 16 nt, Pseudomonas putida KT2440
ggcgcgugucaggagg

SEQ ID NO: 1579182 - RNA, 14 nt, Pseudomonas putida KT2440
ggcgcucaagguca

SEQ ID NO: 1579183 - RNA, 17 nt, Pseudomonas putida KT2440
aaggugauguugcccgg

SEQ ID NO: 1579184 - RNA, 12 nt, Pseudomonas putida KT2440
aaggucggccag

SEQ ID NO: 1579185 - RNA, 22 nt, Pseudomonas putida KT2440
ggcggguggagauuggccagca

SEQ ID NO: 1579186 - RNA, 13 nt, Pseudomonas putida KT2440
ggcgggcggagau

SEQ ID NO: 1579187 - RNA, 17 nt, Pseudomonas putida KT2440
ggcgguauucacaccug

SEQ ID NO: 1579188 - RNA, 13 nt, Pseudomonas putida KT2440
ggcgguccagcaa

SEQ ID NO: 1579189 - RNA, 15 nt, Pseudomonas putida KT2440
ggcgguccuucaugc

SEQ ID NO: 1579190 - RNA, 17 nt, Pseudomonas putida KT2440
ggcggucguagcccucg

SEQ ID NO: 1579191 - RNA, 16 nt, Pseudomonas putida KT2440
ggcgguguagaacggc

SEQ ID NO: 1579192 - RNA, 16 nt, Pseudomonas putida KT2440
ggcguacucucgucga

SEQ ID NO: 1579193 - RNA, 14 nt, Pseudomonas putida KT2440
ggcguaggcacacc

SEQ ID NO: 1579194 - RNA, 22 nt, Pseudomonas putida KT2440
ggcguaggccugcgaaaggcgc

SEQ ID NO: 1579195 - RNA, 18 nt, Pseudomonas putida KT2440
ggcguaauacugcuucca

SEQ ID NO: 1579196 - RNA, 14 nt, Pseudomonas putida KT2440
ggcgguugaccagg

SEQ ID NO: 1579197 - RNA, 17 nt, Pseudomonas putida KT2440
ggcgguugggcaagugc

SEQ ID NO: 1579198 - RNA, 18 nt, Pseudomonas putida KT2440
ggcgguugucgaccuggc

SEQ ID NO: 1579199 - RNA, 23 nt, Pseudomonas putida KT2440
ggcggcgugaccagcccggccca

SEQ ID NO: 1579200 - RNA, 17 nt, Pseudomonas putida KT2440
ggcggcgugagcaucgg

SEQ ID NO: 1579201 - RNA, 18 nt, Pseudomonas putida KT2440
ggcggcgugagcaucggc

SEQ ID NO: 1579202 - RNA, 20 nt, Pseudomonas putida KT2440
ggcggcuaagcgccagcaac

SEQ ID NO: 1579203 - RNA, 18 nt, Pseudomonas putida KT2440
ggcggcggaucggcgugg

SEQ ID NO: 1579204 - RNA, 18 nt, Pseudomonas putida KT2440
ggcggcgcgaaucagcgc

SEQ ID NO: 1579205 - RNA, 14 nt, Pseudomonas putida KT2440
ggcggcgcgagaac

SEQ ID NO: 1579206 - RNA, 21 nt, Pseudomonas putida KT2440
ggcggaggcuucgaugauccc

SEQ ID NO: 1579207 - RNA, 14 nt, Pseudomonas putida KT2440
ggcggagauuggcc

SEQ ID NO: 1579208 - RNA, 17 nt, Pseudomonas putida KT2440
ggcggagauuggccagc

SEQ ID NO: 1579209 - RNA, 18 nt, Pseudomonas putida KT2440
ggcggaacggugaacggc

SEQ ID NO: 1579210 - RNA, 12 nt, Pseudomonas putida KT2440
ggcggccagcac

SEQ ID NO: 1579211 - RNA, 14 nt, Pseudomonas putida KT2440
ggcggccagccaac

SEQ ID NO: 1579212 - RNA, 11 nt, Pseudomonas putida KT2440
ggcggccagcg

SEQ ID NO: 1579213 - RNA, 20 nt, Pseudomonas putida KT2440
ggcggcaagggcgaaccagg

SEQ ID NO: 1579214 - RNA, 12 nt, Pseudomonas putida KT2440
ggcggcaacggu

SEQ ID NO: 1579215 - RNA, 17 nt, Pseudomonas putida KT2440
gcaacuucucggucgcc

SEQ ID NO: 1579216 - RNA, 17 nt, Pseudomonas putida KT2440
gcaacuccucgaucacc

SEQ ID NO: 1579217 - RNA, 13 nt, Pseudomonas putida KT2440
gcaacucagcgca

SEQ ID NO: 1579218 - RNA, 13 nt, Pseudomonas putida KT2440
gcaacugcggccc

SEQ ID NO: 1579219 - RNA, 20 nt, Pseudomonas putida KT2440
gcaacugcccacccaaccgc

SEQ ID NO: 1579220 - RNA, 14 nt, Pseudomonas putida KT2440
gcaacugcccagga

SEQ ID NO: 1579221 - RNA, 15 nt, Pseudomonas putida KT2440
gcaagccacgccaga

SEQ ID NO: 1579222 - RNA, 16 nt, Pseudomonas putida KT2440
gcaagccacgccagaa

SEQ ID NO: 1579223 - RNA, 17 nt, Pseudomonas putida KT2440
gcaagccgccgaccagg

SEQ ID NO: 1579224 - RNA, 12 nt, Pseudomonas putida KT2440
gcaagcccgcuc

SEQ ID NO: 1579225 - RNA, 20 nt, Pseudomonas putida KT2440
gcaagcccgcucccacagga

SEQ ID NO: 1579226 - RNA, 20 nt, Pseudomonas putida KT2440
gcaagcccgcucccacaggg

SEQ ID NO: 1579227 - RNA, 20 nt, Pseudomonas putida KT2440
gcaagcccgcuccuacaggu

SEQ ID NO: 1579228 - RNA, 22 nt, Pseudomonas putida KT2440
gcaagcccgcuccuacagguuc

SEQ ID NO: 1579229 - RNA, 21 nt, Pseudomonas putida KT2440
gcaagccuucgucgcuggcca

SEQ ID NO: 1579230 - RNA, 16 nt, Pseudomonas putida KT2440
gcaagccuuugcgccu

SEQ ID NO: 1579231 - RNA, 11 nt, Pseudomonas putida KT2440
gcaagcgccga

SEQ ID NO: 1579232 - RNA, 17 nt, Pseudomonas putida KT2440
gcaagccggcgaacagc

SEQ ID NO: 1579233 - RNA, 12 nt, Pseudomonas putida KT2440
gcaagccugcuu

SEQ ID NO: 1579234 - RNA, 12 nt, Pseudomonas putida KT2440
gcaagccucagg

SEQ ID NO: 1579235 - RNA, 15 nt, Pseudomonas putida KT2440
gcaagcgcaccugca

SEQ ID NO: 1579236 - RNA, 20 nt, Pseudomonas putida KT2440
gcaagcuggcgcaagccgug

SEQ ID NO: 1579237 - RNA, 15 nt, Pseudomonas putida KT2440
gcaagcucaucacca

SEQ ID NO: 1579238 - RNA, 13 nt, Pseudomonas putida KT2440
gcaacgacaaggu

SEQ ID NO: 1579239 - RNA, 19 nt, Pseudomonas putida KT2440
gcaacgaacuugcggaacg

SEQ ID NO: 1579240 - RNA, 18 nt, Pseudomonas putida KT2440
gcaacccuucggccagca

SEQ ID NO: 1579241 - RNA, 14 nt, Pseudomonas putida KT2440
gcaacccggccuug

SEQ ID NO: 1579242 - RNA, 16 nt, Pseudomonas putida KT2440
gcaaccgggucggcgc

SEQ ID NO: 1579243 - RNA, 12 nt, Pseudomonas putida KT2440
gcaacgccacca

SEQ ID NO: 1579244 - RNA, 18 nt, Pseudomonas putida KT2440
gcaacgccuucaggcgaa

SEQ ID NO: 1579245 - RNA, 22 nt, Pseudomonas putida KT2440
gcaacggacgucccagcaggca

SEQ ID NO: 1579246 - RNA, 16 nt, Pseudomonas putida KT2440
gcaacggccacgcugc

SEQ ID NO: 1579247 - RNA, 17 nt, Pseudomonas putida KT2440
gcaacgguuuaccgccg

SEQ ID NO: 1579248 - RNA, 17 nt, Pseudomonas putida KT2440
gcaacguucaccgucga

SEQ ID NO: 1579249 - RNA, 15 nt, Pseudomonas putida KT2440
gcaaggucaacggca

SEQ ID NO: 1579250 - RNA, 18 nt, Pseudomonas putida KT2440
gcaagguagcggcggcaa

SEQ ID NO: 1579251 - RNA, 16 nt, Pseudomonas putida KT2440
gcaaggugccaacagg

SEQ ID NO: 1579252 - RNA, 14 nt, Pseudomonas putida KT2440
gcaaggcugcuuca

SEQ ID NO: 1579253 - RNA, 15 nt, Pseudomonas putida KT2440
gcaagggccugcagg

SEQ ID NO: 1579254 - RNA, 15 nt, Pseudomonas putida KT2440
gcaaggccagugccg

SEQ ID NO: 1579255 - RNA, 15 nt, Pseudomonas putida KT2440
gcaaggccgcuccca

SEQ ID NO: 1579256 - RNA, 17 nt, Pseudomonas putida KT2440
gcaaggcaucggcgccu

SEQ ID NO: 1579257 - RNA, 15 nt, Pseudomonas putida KT2440
gcaaggccagcggaa

SEQ ID NO: 1579258 - RNA, 15 nt, Pseudomonas putida KT2440
gcaaggcguaccggc

SEQ ID NO: 1579259 - RNA, 17 nt, Pseudomonas putida KT2440
gcaaggcguaccggcaa

SEQ ID NO: 1579260 - RNA, 20 nt, Pseudomonas putida KT2440
gcaaggcguaccggcaaccc

SEQ ID NO: 1579261 - RNA, 15 nt, Pseudomonas putida KT2440
gcaaggcgaccugcc

SEQ ID NO: 1579262 - RNA, 17 nt, Pseudomonas putida KT2440
gcaagucccccaucggc

SEQ ID NO: 1579263 - RNA, 21 nt, Pseudomonas putida KT2440
gcaauacaacgaucagcgccg

SEQ ID NO: 1579264 - RNA, 23 nt, Pseudomonas putida KT2440
gcaauacaacgaucagcgccgaa

SEQ ID NO: 1579265 - RNA, 21 nt, Pseudomonas putida KT2440
gcaaucggcaggccggccacc

SEQ ID NO: 1579266 - RNA, 18 nt, Pseudomonas putida KT2440
gcaaucgcugugcgugau

SEQ ID NO: 1579267 - RNA, 21 nt, Pseudomonas putida KT2440
gcaaucgccaggcgcaccgcc

SEQ ID NO: 1579268 - RNA, 19 nt, Pseudomonas putida KT2440
gcaaucgccgggcgcacca

SEQ ID NO: 1579269 - RNA, 20 nt, Pseudomonas putida KT2440
gcaaucaggcugaucaccgc

SEQ ID NO: 1579270 - RNA, 17 nt, Pseudomonas putida KT2440
gcaauaccgauggcccc

SEQ ID NO: 1579271 - RNA, 16 nt, Pseudomonas putida KT2440
gcaauaugggucgacu

SEQ ID NO: 1579272 - RNA, 16 nt, Pseudomonas putida KT2440
gcaaucagcaggucgg

SEQ ID NO: 1579273 - RNA, 18 nt, Pseudomonas putida KT2440
gcaaucacccgcaggguc

SEQ ID NO: 1579274 - RNA, 14 nt, Pseudomonas putida KT2440
gcacaccgcuggug

SEQ ID NO: 1579275 - RNA, 17 nt, Pseudomonas putida KT2440
gcacacgucgccugggc

SEQ ID NO: 1579276 - RNA, 15 nt, Pseudomonas putida KT2440
gcacacugagcacca

SEQ ID NO: 1579277 - RNA, 13 nt, Pseudomonas putida KT2440
gcacacccagcac

SEQ ID NO: 1579278 - RNA, 19 nt, Pseudomonas putida KT2440
gcacacccagcacgaaggc

SEQ ID NO: 1579279 - RNA, 21 nt, Pseudomonas putida KT2440
gcacacccagcacgaaggcca

SEQ ID NO: 1579280 - RNA, 17 nt, Pseudomonas putida KT2440
gcacaacgcgcgggcaa

SEQ ID NO: 1579281 - RNA, 23 nt, Pseudomonas putida KT2440
gcacaaguuucaaaaacggugca

SEQ ID NO: 1579282 - RNA, 22 nt, Pseudomonas putida KT2440
gcacaaggcucaagcgcagccu

SEQ ID NO: 1579283 - RNA, 15 nt, Pseudomonas putida KT2440
gcacaaggcugcgcu

SEQ ID NO: 1579284 - RNA, 16 nt, Pseudomonas putida KT2440
gcacaagcugcugaua

SEQ ID NO: 1579285 - RNA, 14 nt, Pseudomonas putida KT2440
gcaaugaucgggca

SEQ ID NO: 1579286 - RNA, 14 nt, Pseudomonas putida KT2440
gcaaucuugccacg

SEQ ID NO: 1579287 - RNA, 16 nt, Pseudomonas putida KT2440
gcaaucugcagcagca

SEQ ID NO: 1579288 - RNA, 18 nt, Pseudomonas putida KT2440
gcaaucugcagcagcauu

SEQ ID NO: 1579289 - RNA, 13 nt, Pseudomonas putida KT2440
gcaaucgggaugg

SEQ ID NO: 1579290 - RNA, 21 nt, Pseudomonas putida KT2440
gcaaugucguauugagcgacg

SEQ ID NO: 1579291 - RNA, 21 nt, Pseudomonas putida KT2440
gcaauguugaagaugacuggc

SEQ ID NO: 1579292 - RNA, 19 nt, Pseudomonas putida KT2440
gcaauggccacacgcugcu

SEQ ID NO: 1579293 - RNA, 23 nt, Pseudomonas putida KT2440
gcaauggccacacgcugcugcug

SEQ ID NO: 1579294 - RNA, 16 nt, Pseudomonas putida KT2440
gcaaugccgaacaguc

SEQ ID NO: 1579295 - RNA, 16 nt, Pseudomonas putida KT2440
gauuggcaucgcugcc

SEQ ID NO: 1579296 - RNA, 12 nt, Pseudomonas putida KT2440
gauuggucggca

SEQ ID NO: 1579297 - RNA, 20 nt, Pseudomonas putida KT2440
gauuuggcccgcugcgccga

SEQ ID NO: 1579298 - RNA, 20 nt, Pseudomonas putida KT2440
gauuucgugcacuuucgcgg

SEQ ID NO: 1579299 - RNA, 19 nt, Pseudomonas putida KT2440
gauuacgcgucaucugcgc

SEQ ID NO: 1579300 - RNA, 18 nt, Pseudomonas putida KT2440
gauuaucgagcuacagcc

SEQ ID NO: 1579301 - RNA, 16 nt, Pseudomonas putida KT2440
gauuccucgcgcuugc

SEQ ID NO: 1579302 - RNA, 15 nt, Pseudomonas putida KT2440
gauucuauggccgga

SEQ ID NO: 1579303 - RNA, 13 nt, Pseudomonas putida KT2440
gcaaagcgcagca

SEQ ID NO: 1579304 - RNA, 16 nt, Pseudomonas putida KT2440
gcaaagcccugccuca

SEQ ID NO: 1579305 - RNA, 13 nt, Pseudomonas putida KT2440
gcaaagcagcccc

SEQ ID NO: 1579306 - RNA, 20 nt, Pseudomonas putida KT2440
gcaaacccgacaacagcugc

SEQ ID NO: 1579307 - RNA, 12 nt, Pseudomonas putida KT2440
gcaaacccgcgc

SEQ ID NO: 1579308 - RNA, 18 nt, Pseudomonas putida KT2440
gcaaacccgcgccuacag

SEQ ID NO: 1579309 - RNA, 20 nt, Pseudomonas putida KT2440
gcaaagagugccccaaacgg

SEQ ID NO: 1579310 - RNA, 13 nt, Pseudomonas putida KT2440
gcaaagaucgccc

SEQ ID NO: 1579311 - RNA, 17 nt, Pseudomonas putida KT2440
gcaaacaccuugccccg

SEQ ID NO: 1579312 - RNA, 20 nt, Pseudomonas putida KT2440
gcaaaacaaaaagcgcagcg

SEQ ID NO: 1579313 - RNA, 19 nt, Pseudomonas putida KT2440
gcaacaaggucgccaggcg

SEQ ID NO: 1579314 - RNA, 14 nt, Pseudomonas putida KT2440
gcaaaggcaugggc

SEQ ID NO: 1579315 - RNA, 15 nt, Pseudomonas putida KT2440
gcaaaggcaugggcc

SEQ ID NO: 1579316 - RNA, 17 nt, Pseudomonas putida KT2440
gcaaaggcuuuggccgu

SEQ ID NO: 1579317 - RNA, 13 nt, Pseudomonas putida KT2440
gcaaagguggcac

SEQ ID NO: 1579318 - RNA, 20 nt, Pseudomonas putida KT2440
gcaaagcggcccccagcaau

SEQ ID NO: 1579319 - RNA, 12 nt, Pseudomonas putida KT2440
gcaacccgcauu

SEQ ID NO: 1579320 - RNA, 14 nt, Pseudomonas putida KT2440
gcaacauucaccag

SEQ ID NO: 1579321 - RNA, 20 nt, Pseudomonas putida KT2440
gcaacaugccggcccaaggc

SEQ ID NO: 1579322 - RNA, 12 nt, Pseudomonas putida KT2440
gcaacaucgccc

SEQ ID NO: 1579323 - RNA, 16 nt, Pseudomonas putida KT2440
gaugcuugcgcggcac

SEQ ID NO: 1579324 - RNA, 12 nt, Pseudomonas putida KT2440
gaugcuucgcgg

SEQ ID NO: 1579325 - RNA, 16 nt, Pseudomonas putida KT2440
gaugcguacggccuug

SEQ ID NO: 1579326 - RNA, 12 nt, Pseudomonas putida KT2440
gaugcugcugca

SEQ ID NO: 1579327 - RNA, 23 nt, Pseudomonas putida KT2440
gaugcgguggguguccugcaacu

SEQ ID NO: 1579328 - RNA, 19 nt, Pseudomonas putida KT2440
gauggccuugaucaggccc

SEQ ID NO: 1579329 - RNA, 18 nt, Pseudomonas putida KT2440
gauggccaggaacagcgc

SEQ ID NO: 1579330 - RNA, 15 nt, Pseudomonas putida KT2440
gaugcgggaccagca

SEQ ID NO: 1579331 - RNA, 14 nt, Pseudomonas putida KT2440
gaugggcgucgccu

SEQ ID NO: 1579332 - RNA, 19 nt, Pseudomonas putida KT2440
gaugucuacccacaagcgc

SEQ ID NO: 1579333 - RNA, 21 nt, Pseudomonas putida KT2440
gaugucuacccacaagcgcag

SEQ ID NO: 1579334 - RNA, 20 nt, Pseudomonas putida KT2440
gaugucuucgcggaaggccu

SEQ ID NO: 1579335 - RNA, 14 nt, Pseudomonas putida KT2440
gauguccucggcgu

SEQ ID NO: 1579336 - RNA, 17 nt, Pseudomonas putida KT2440
gaugguugacagcgcuu

SEQ ID NO: 1579337 - RNA, 13 nt, Pseudomonas putida KT2440
gcagcgagcgcug

SEQ ID NO: 1579338 - RNA, 15 nt, Pseudomonas putida KT2440
gcagccguugcuggg

SEQ ID NO: 1579339 - RNA, 12 nt, Pseudomonas putida KT2440
gcagccugacgc

SEQ ID NO: 1579340 - RNA, 21 nt, Pseudomonas putida KT2440
gcagccugccaggucaccgcc

SEQ ID NO: 1579341 - RNA, 15 nt, Pseudomonas putida KT2440
gcagccgcaccugcc

SEQ ID NO: 1579342 - RNA, 14 nt, Pseudomonas putida KT2440
gcagcccuucgcag

SEQ ID NO: 1579343 - RNA, 14 nt, Pseudomonas putida KT2440
gcagcccuucgcgg

SEQ ID NO: 1579344 - RNA, 18 nt, Pseudomonas putida KT2440
gcagcccuucgcggcaag

SEQ ID NO: 1579345 - RNA, 15 nt, Pseudomonas putida KT2440
gcagcccuucgcggg

SEQ ID NO: 1579346 - RNA, 18 nt, Pseudomonas putida KT2440
gcagccaguucgacaggu

SEQ ID NO: 1579347 - RNA, 19 nt, Pseudomonas putida KT2440
gcagccaguucgacagguu

SEQ ID NO: 1579348 - RNA, 14 nt, Pseudomonas putida KT2440
gcagcccagcgccg

SEQ ID NO: 1579349 - RNA, 15 nt, Pseudomonas putida KT2440
gcagcccagcgccgc

SEQ ID NO: 1579350 - RNA, 19 nt, Pseudomonas putida KT2440
gcagcauaugcuggucgcc

SEQ ID NO: 1579351 - RNA, 14 nt, Pseudomonas putida KT2440
gcagcaucaccacg

SEQ ID NO: 1579352 - RNA, 15 nt, Pseudomonas putida KT2440
gcagcaucaccacgc

SEQ ID NO: 1579353 - RNA, 18 nt, Pseudomonas putida KT2440
gcagcaucaccgcgucga

SEQ ID NO: 1579354 - RNA, 13 nt, Pseudomonas putida KT2440
gcagcaucgaccu

SEQ ID NO: 1579355 - RNA, 17 nt, Pseudomonas putida KT2440
gcagcagguugcuggug

SEQ ID NO: 1579356 - RNA, 17 nt, Pseudomonas putida KT2440
gcagcagcuugcagcgc

SEQ ID NO: 1579357 - RNA, 19 nt, Pseudomonas putida KT2440
gcagcagcuugcagcgccg

SEQ ID NO: 1579358 - RNA, 21 nt, Pseudomonas putida KT2440
gcagcagcucuuuugccggga

SEQ ID NO: 1579359 - RNA, 17 nt, Pseudomonas putida KT2440
gcagcaucuucuucacg

SEQ ID NO: 1579360 - RNA, 18 nt, Pseudomonas putida KT2440
gcagcaugaacagcgcug

SEQ ID NO: 1579361 - RNA, 13 nt, Pseudomonas putida KT2440
gcagcaugacccu

SEQ ID NO: 1579362 - RNA, 16 nt, Pseudomonas putida KT2440
gcagcaucugcacguc

SEQ ID NO: 1579363 - RNA, 19 nt, Pseudomonas putida KT2440
gcagcauuucuucgaccug

SEQ ID NO: 1579364 - RNA, 18 nt, Pseudomonas putida KT2440
gcagccaacgccccaggc

SEQ ID NO: 1579365 - RNA, 19 nt, Pseudomonas putida KT2440
gcagccagcaucucggcca

SEQ ID NO: 1579366 - RNA, 19 nt, Pseudomonas putida KT2440
gcagccagggccugaccgc

SEQ ID NO: 1579367 - RNA, 20 nt, Pseudomonas putida KT2440
gcagccagggccugaccgcc

SEQ ID NO: 1579368 - RNA, 16 nt, Pseudomonas putida KT2440
gcagauccugcagccg

SEQ ID NO: 1579369 - RNA, 18 nt, Pseudomonas putida KT2440
gcagauccugcagccgca

SEQ ID NO: 1579370 - RNA, 22 nt, Pseudomonas putida KT2440
gcagcaccgggcgggugcaugg

SEQ ID NO: 1579371 - RNA, 16 nt, Pseudomonas putida KT2440
gcagcaccgucgagga

SEQ ID NO: 1579372 - RNA, 16 nt, Pseudomonas putida KT2440
gcagcacccgcuuggc

SEQ ID NO: 1579373 - RNA, 22 nt, Pseudomonas putida KT2440
gcagcaccacgaagcgcggcaa

SEQ ID NO: 1579374 - RNA, 12 nt, Pseudomonas putida KT2440
gcagcaccagcu

SEQ ID NO: 1579375 - RNA, 18 nt, Pseudomonas putida KT2440
gcagcacaucacacagcg

SEQ ID NO: 1579376 - RNA, 16 nt, Pseudomonas putida KT2440
gcagaugguccggcau

SEQ ID NO: 1579377 - RNA, 19 nt, Pseudomonas putida KT2440
gcagaugguccggcaucac

SEQ ID NO: 1579378 - RNA, 19 nt, Pseudomonas putida KT2440
gcagauggcucaucgccgu

SEQ ID NO: 1579379 - RNA, 14 nt, Pseudomonas putida KT2440
gcagcagcgcaccg

SEQ ID NO: 1579380 - RNA, 14 nt, Pseudomonas putida KT2440
gcagcagcccuucg

SEQ ID NO: 1579381 - RNA, 12 nt, Pseudomonas putida KT2440
gcagcagcaaug

SEQ ID NO: 1579382 - RNA, 19 nt, Pseudomonas putida KT2440
gcagcacgucggcgccgaa

SEQ ID NO: 1579383 - RNA, 16 nt, Pseudomonas putida KT2440
gcagcacuucgaucag

SEQ ID NO: 1579384 - RNA, 18 nt, Pseudomonas putida KT2440
gcagcacuucgaucaggc

SEQ ID NO: 1579385 - RNA, 22 nt, Pseudomonas putida KT2440
gcagcacggaaucacgcggcgu

SEQ ID NO: 1579386 - RNA, 15 nt, Pseudomonas putida KT2440
gcagcaccuccugca

SEQ ID NO: 1579387 - RNA, 14 nt, Pseudomonas putida KT2440
gcagcacgaucucg

SEQ ID NO: 1579388 - RNA, 14 nt, Pseudomonas putida KT2440
gcacguugcugccu

SEQ ID NO: 1579389 - RNA, 22 nt, Pseudomonas putida KT2440
gcacguuggugccggucggcgu

SEQ ID NO: 1579390 - RNA, 14 nt, Pseudomonas putida KT2440
gcacguuuggagcg

SEQ ID NO: 1579391 - RNA, 20 nt, Pseudomonas putida KT2440
gcagagacaucuccauaggu

SEQ ID NO: 1579392 - RNA, 14 nt, Pseudomonas putida KT2440
gcagaucaccagcu

SEQ ID NO: 1579393 - RNA, 18 nt, Pseudomonas putida KT2440
gcagaucacgcaaccucg

SEQ ID NO: 1579394 - RNA, 12 nt, Pseudomonas putida KT2440
gcagacgaucag

SEQ ID NO: 1579395 - RNA, 22 nt, Pseudomonas putida KT2440
gcagacgacccggauaccgacc

SEQ ID NO: 1579396 - RNA, 17 nt, Pseudomonas putida KT2440
gcagaccugugggagcg

SEQ ID NO: 1579397 - RNA, 16 nt, Pseudomonas putida KT2440
gcagacgcgcagcacu

SEQ ID NO: 1579398 - RNA, 19 nt, Pseudomonas putida KT2440
gcacccuggcgguugacca

SEQ ID NO: 1579399 - RNA, 20 nt, Pseudomonas putida KT2440
gcacccugagggagcgggcu

SEQ ID NO: 1579400 - RNA, 21 nt, Pseudomonas putida KT2440
gcacccugaucgaugagcgag

SEQ ID NO: 1579401 - RNA, 17 nt, Pseudomonas putida KT2440
gcacccgcuuggccacc

SEQ ID NO: 1579402 - RNA, 14 nt, Pseudomonas putida KT2440
gcacccgcccaucg

SEQ ID NO: 1579403 - RNA, 16 nt, Pseudomonas putida KT2440
gcacccgccuccggcg

SEQ ID NO: 1579404 - RNA, 14 nt, Pseudomonas putida KT2440
gcacccgccagccg

SEQ ID NO: 1579405 - RNA, 19 nt, Pseudomonas putida KT2440
gcaccgaaccggcgaucag

SEQ ID NO: 1579406 - RNA, 19 nt, Pseudomonas putida KT2440
gcacagcaucacccgcgaa

SEQ ID NO: 1579407 - RNA, 23 nt, Pseudomonas putida KT2440
gcaccaucagagcgccagcaagc

SEQ ID NO: 1579408 - RNA, 23 nt, Pseudomonas putida KT2440
gcaccaguugcaggucggcacgc

SEQ ID NO: 1579409 - RNA, 17 nt, Pseudomonas putida KT2440
gcacagauaaaccugcc

SEQ ID NO: 1579410 - RNA, 17 nt, Pseudomonas putida KT2440
gcacagaucaacgccgc

SEQ ID NO: 1579411 - RNA, 12 nt, Pseudomonas putida KT2440
gcacagaccgca

SEQ ID NO: 1579412 - RNA, 20 nt, Pseudomonas putida KT2440
gcaccagguuugcugccuuc

SEQ ID NO: 1579413 - RNA, 19 nt, Pseudomonas putida KT2440
gcacagcacguucagcggg

SEQ ID NO: 1579414 - RNA, 18 nt, Pseudomonas putida KT2440
gcaccccgaacgcgguaa

SEQ ID NO: 1579415 - RNA, 14 nt, Pseudomonas putida KT2440
gcaccccagcacca

SEQ ID NO: 1579416 - RNA, 22 nt, Pseudomonas putida KT2440
gcacccaucggcgcgaagguca

SEQ ID NO: 1579417 - RNA, 14 nt, Pseudomonas putida KT2440
gcacccagcaggcc

SEQ ID NO: 1579418 - RNA, 15 nt, Pseudomonas putida KT2440
gcaccgccagcucca

SEQ ID NO: 1579419 - RNA, 17 nt, Pseudomonas putida KT2440
gcaccggcuucgccggu

SEQ ID NO: 1579420 - RNA, 12 nt, Pseudomonas putida KT2440
gcaccggcgacg

SEQ ID NO: 1579421 - RNA, 19 nt, Pseudomonas putida KT2440
gcaccgggugguauccggg

SEQ ID NO: 1579422 - RNA, 21 nt, Pseudomonas putida KT2440
gcaccgggaugcucugcagca

SEQ ID NO: 1579423 - RNA, 13 nt, Pseudomonas putida KT2440
gcaccgucgaugu

SEQ ID NO: 1579424 - RNA, 22 nt, Pseudomonas putida KT2440
gcaccgucuggaagucgcgagu

SEQ ID NO: 1579425 - RNA, 15 nt, Pseudomonas putida KT2440
gcaccgucuggacug

SEQ ID NO: 1579426 - RNA, 18 nt, Pseudomonas putida KT2440
gcaccgucuggacuggga

SEQ ID NO: 1579427 - RNA, 22 nt, Pseudomonas putida KT2440
gcaccgugcaccagcaccaccg

SEQ ID NO: 1579428 - RNA, 20 nt, Pseudomonas putida KT2440
gcaccuaaccagugggagcg

SEQ ID NO: 1579429 - RNA, 22 nt, Pseudomonas putida KT2440
gcaccucacaacgcgcaucccu

SEQ ID NO: 1579430 - RNA, 19 nt, Pseudomonas putida KT2440
gcacgauggcggucgaacc

SEQ ID NO: 1579431 - RNA, 18 nt, Pseudomonas putida KT2440
gcacgcaacaggucgacc

SEQ ID NO: 1579432 - RNA, 15 nt, Pseudomonas putida KT2440
gcacgcaggccagcg

SEQ ID NO: 1579433 - RNA, 13 nt, Pseudomonas putida KT2440
gcacgagcaugcc

SEQ ID NO: 1579434 - RNA, 19 nt, Pseudomonas putida KT2440
gcacgacugaacaccugcc

SEQ ID NO: 1579435 - RNA, 16 nt, Pseudomonas putida KT2440
gcacgaacagauggug

SEQ ID NO: 1579436 - RNA, 18 nt, Pseudomonas putida KT2440
gcacgaacagcaacacau

SEQ ID NO: 1579437 - RNA, 19 nt, Pseudomonas putida KT2440
gcacgaacacguccagccc

SEQ ID NO: 1579438 - RNA, 17 nt, Pseudomonas putida KT2440
gcacgaccauuggcguc

SEQ ID NO: 1579439 - RNA, 19 nt, Pseudomonas putida KT2440
gcacgaccauuggcgucag

SEQ ID NO: 1579440 - RNA, 18 nt, Pseudomonas putida KT2440
gcaccucauagaucagca

SEQ ID NO: 1579441 - RNA, 19 nt, Pseudomonas putida KT2440
gcaccucggaugccacgcu

SEQ ID NO: 1579442 - RNA, 16 nt, Pseudomonas putida KT2440
gcacgaaacugcgcug

SEQ ID NO: 1579443 - RNA, 15 nt, Pseudomonas putida KT2440
gcaccugccgggcau

SEQ ID NO: 1579444 - RNA, 16 nt, Pseudomonas putida KT2440
gcaccugccugacgcg

SEQ ID NO: 1579445 - RNA, 15 nt, Pseudomonas putida KT2440
gcaccugacgcaagc

SEQ ID NO: 1579446 - RNA, 17 nt, Pseudomonas putida KT2440
gcaccugcccgcccuca

SEQ ID NO: 1579447 - RNA, 18 nt, Pseudomonas putida KT2440
gcaccugcagguacagca

SEQ ID NO: 1579448 - RNA, 15 nt, Pseudomonas putida KT2440
gcacggcgugcucca

SEQ ID NO: 1579449 - RNA, 17 nt, Pseudomonas putida KT2440
gcacgggccagcgcggu

SEQ ID NO: 1579450 - RNA, 15 nt, Pseudomonas putida KT2440
gcacgcuucgauccg

SEQ ID NO: 1579451 - RNA, 21 nt, Pseudomonas putida KT2440
gcacgcuucgauccgcgccca

SEQ ID NO: 1579452 - RNA, 21 nt, Pseudomonas putida KT2440
gcacgcgggcgcgacaaucag

SEQ ID NO: 1579453 - RNA, 14 nt, Pseudomonas putida KT2440
gcacgcguaccccu

SEQ ID NO: 1579454 - RNA, 17 nt, Pseudomonas putida KT2440
gaucgagccgaucagga

SEQ ID NO: 1579455 - RNA, 18 nt, Pseudomonas putida KT2440
gaucgacuucaucaccuc

SEQ ID NO: 1579456 - RNA, 18 nt, Pseudomonas putida KT2440
gauccgcuuucggcagug

SEQ ID NO: 1579457 - RNA, 20 nt, Pseudomonas putida KT2440
gauccgcggcaugugcgggu

SEQ ID NO: 1579458 - RNA, 14 nt, Pseudomonas putida KT2440
gaucagcaaugcca

SEQ ID NO: 1579459 - RNA, 15 nt, Pseudomonas putida KT2440
gaucagcaccgaguc

SEQ ID NO: 1579460 - RNA, 14 nt, Pseudomonas putida KT2440
gaucaggucggcgg

SEQ ID NO: 1579461 - RNA, 19 nt, Pseudomonas putida KT2440
gaucacgcaggcccagcag

SEQ ID NO: 1579462 - RNA, 19 nt, Pseudomonas putida KT2440
gaucacgcccgggccaggc

SEQ ID NO: 1579463 - RNA, 13 nt, Pseudomonas putida KT2440
gaucacgggcaau

SEQ ID NO: 1579464 - RNA, 16 nt, Pseudomonas putida KT2440
gaucacgggcaggccc

SEQ ID NO: 1579465 - RNA, 17 nt, Pseudomonas putida KT2440
gaucacgggcaggcccc

SEQ ID NO: 1579466 - RNA, 22 nt, Pseudomonas putida KT2440
gaucacgggcaggccccugcaa

SEQ ID NO: 1579467 - RNA, 15 nt, Pseudomonas putida KT2440
gaucacugccagcac

SEQ ID NO: 1579468 - RNA, 19 nt, Pseudomonas putida KT2440
gaucacuccugguuggcca

SEQ ID NO: 1579469 - RNA, 17 nt, Pseudomonas putida KT2440
gaucacuuccaccugcg

SEQ ID NO: 1579470 - RNA, 13 nt, Pseudomonas putida KT2440
gaucccgccgcca

SEQ ID NO: 1579471 - RNA, 16 nt, Pseudomonas putida KT2440
gauccccggcgacggc

SEQ ID NO: 1579472 - RNA, 16 nt, Pseudomonas putida KT2440
gaucccgaggucagca

SEQ ID NO: 1579473 - RNA, 19 nt, Pseudomonas putida KT2440
gaucccgaggucagcagug

SEQ ID NO: 1579474 - RNA, 13 nt, Pseudomonas putida KT2440
gaucauucaggca

SEQ ID NO: 1579475 - RNA, 20 nt, Pseudomonas putida KT2440
gaucggcgugguccagcguu

SEQ ID NO: 1579476 - RNA, 17 nt, Pseudomonas putida KT2440
gaucggcgucgguguac

SEQ ID NO: 1579477 - RNA, 17 nt, Pseudomonas putida KT2440
gaucggcugguccgggc

SEQ ID NO: 1579478 - RNA, 21 nt, Pseudomonas putida KT2440
gaucggugcguaggagcgggu

SEQ ID NO: 1579479 - RNA, 19 nt, Pseudomonas putida KT2440
gaucggguuuacccgcgaa

SEQ ID NO: 1579480 - RNA, 20 nt, Pseudomonas putida KT2440
gaucggguuuacccgcgaag

SEQ ID NO: 1579481 - RNA, 12 nt, Pseudomonas putida KT2440
gaucgguacaug

SEQ ID NO: 1579482 - RNA, 15 nt, Pseudomonas putida KT2440
gaucgguacaugcga

SEQ ID NO: 1579483 - RNA, 20 nt, Pseudomonas putida KT2440
gaucgguacaugcgaacgca

SEQ ID NO: 1579484 - RNA, 19 nt, Pseudomonas putida KT2440
gaucgucguaggagcgggu

SEQ ID NO: 1579485 - RNA, 16 nt, Pseudomonas putida KT2440
gaucucggccagcagg

SEQ ID NO: 1579486 - RNA, 14 nt, Pseudomonas putida KT2440
gaucguugcgcgcc

SEQ ID NO: 1579487 - RNA, 14 nt, Pseudomonas putida KT2440
gaucucacaggcga

SEQ ID NO: 1579488 - RNA, 17 nt, Pseudomonas putida KT2440
gaucggcaagcccaaug

SEQ ID NO: 1579489 - RNA, 17 nt, Pseudomonas putida KT2440
gaucgcgccuucgcugg

SEQ ID NO: 1579490 - RNA, 19 nt, Pseudomonas putida KT2440
gauagaccuugccagcgcu

SEQ ID NO: 1579491 - RNA, 14 nt, Pseudomonas putida KT2440
gauacgcccaucca

SEQ ID NO: 1579492 - RNA, 14 nt, Pseudomonas putida KT2440
gauagcagcaccga

SEQ ID NO: 1579493 - RNA, 14 nt, Pseudomonas putida KT2440
gauagccgccagca

SEQ ID NO: 1579494 - RNA, 16 nt, Pseudomonas putida KT2440
gauagcucagucggua

SEQ ID NO: 1579495 - RNA, 19 nt, Pseudomonas putida KT2440
gaucaccgcaagcugcacc

SEQ ID NO: 1579496 - RNA, 17 nt, Pseudomonas putida KT2440
gaucaaagucgccuaca

SEQ ID NO: 1579497 - RNA, 23 nt, Pseudomonas putida KT2440
gauaugccgccguucaggcgccu

SEQ ID NO: 1579498 - RNA, 14 nt, Pseudomonas putida KT2440
gauaccgcccaggu

SEQ ID NO: 1579499 - RNA, 13 nt, Pseudomonas putida KT2440
gauacgcgcagau

SEQ ID NO: 1579500 - RNA, 14 nt, Pseudomonas putida KT2440
gaguuccguugcua

SEQ ID NO: 1579501 - RNA, 19 nt, Pseudomonas putida KT2440
gaggugcgcggcaggucga

SEQ ID NO: 1579502 - RNA, 19 nt, Pseudomonas putida KT2440
gaggugccauagcaccagc

SEQ ID NO: 1579503 - RNA, 17 nt, Pseudomonas putida KT2440
gagggcgacaccggucu

SEQ ID NO: 1579504 - RNA, 20 nt, Pseudomonas putida KT2440
gagugcgcggaacagguuga

SEQ ID NO: 1579505 - RNA, 16 nt, Pseudomonas putida KT2440
gagugcggcaggccga

SEQ ID NO: 1579506 - RNA, 19 nt, Pseudomonas putida KT2440
gagugcuggggccgcaaag

SEQ ID NO: 1579507 - RNA, 23 nt, Pseudomonas putida KT2440
gaguuagacauuagaaaauggcu

SEQ ID NO: 1579508 - RNA, 19 nt, Pseudomonas putida KT2440
gagucucggcuagcgccug

SEQ ID NO: 1579509 - RNA, 14 nt, Pseudomonas putida KT2440
gaggccgucguagg

SEQ ID NO: 1579510 - RNA, 21 nt, Pseudomonas putida KT2440
gaggccggcacagacaccgca

SEQ ID NO: 1579511 - RNA, 21 nt, Pseudomonas putida KT2440
gaggccgguacagccagcaaa

SEQ ID NO: 1579512 - RNA, 19 nt, Pseudomonas putida KT2440
gaggcgaauggcaggugau

SEQ ID NO: 1579513 - RNA, 13 nt, Pseudomonas putida KT2440
gaggcgauggcau

SEQ ID NO: 1579514 - RNA, 20 nt, Pseudomonas putida KT2440
gaggcgccgacgauaccgcc

SEQ ID NO: 1579515 - RNA, 23 nt, Pseudomonas putida KT2440
gaggcguagcacaagggccaggu

SEQ ID NO: 1579516 - RNA, 22 nt, Pseudomonas putida KT2440
gaggaugcguucguugcguugc

SEQ ID NO: 1579517 - RNA, 15 nt, Pseudomonas putida KT2440
gaggaugcugaagcu

SEQ ID NO: 1579518 - RNA, 22 nt, Pseudomonas putida KT2440
gagcgcgauuaaauugucggua

SEQ ID NO: 1579519 - RNA, 19 nt, Pseudomonas putida KT2440
gagcgcgccgccuucgcca

SEQ ID NO: 1579520 - RNA, 17 nt, Pseudomonas putida KT2440
gaggaaggcgacuuucg

SEQ ID NO: 1579521 - RNA, 14 nt, Pseudomonas putida KT2440
gacuuaaucaaugc

SEQ ID NO: 1579522 - RNA, 16 nt, Pseudomonas putida KT2440
gacugugggagcgggc

SEQ ID NO: 1579523 - RNA, 19 nt, Pseudomonas putida KT2440
gacugugggagcgggcuug

SEQ ID NO: 1579524 - RNA, 21 nt, Pseudomonas putida KT2440
aacuaaaccggugaagcggaa

SEQ ID NO: 1579525 - RNA, 21 nt, Pseudomonas putida KT2440
gacuuuggcgucggucagcga

SEQ ID NO: 1579526 - RNA, 18 nt, Pseudomonas putida KT2440
gacuuucaugcccgcguc

SEQ ID NO: 1579527 - RNA, 20 nt, Pseudomonas putida KT2440
gacuucccggcaccgcuugc

SEQ ID NO: 1579528 - RNA, 17 nt, Pseudomonas putida KT2440
gacuucauggucgaccg

SEQ ID NO: 1579529 - RNA, 20 nt, Pseudomonas putida KT2440
gacuuccagcuugccgucgc

SEQ ID NO: 1579530 - RNA, 19 nt, Pseudomonas putida KT2440
gacugguuuuccgaguugc

SEQ ID NO: 1579531 - RNA, 23 nt, Pseudomonas putida KT2440
gacuggugguugaggcggguuug

SEQ ID NO: 1579532 - RNA, 15 nt, Pseudomonas putida KT2440
gacugcuucaggccu

SEQ ID NO: 1579533 - RNA, 13 nt, Pseudomonas putida KT2440
gacugccaggccu

SEQ ID NO: 1579534 - RNA, 13 nt, Pseudomonas putida KT2440
gacugcacugcca

SEQ ID NO: 1579535 - RNA, 14 nt, Pseudomonas putida KT2440
gacugcaccagguc

SEQ ID NO: 1579536 - RNA, 24 nt, Pseudomonas putida KT2440
gacugcaccagguccagcguggcg

SEQ ID NO: 1579537 - RNA, 14 nt, Pseudomonas putida KT2440
gacgaccagcaugc

SEQ ID NO: 1579538 - RNA, 18 nt, Pseudomonas putida KT2440
gacgaccagcaugcgaag

SEQ ID NO: 1579539 - RNA, 23 nt, Pseudomonas putida KT2440
gacguugguagcgguggcguugc

SEQ ID NO: 1579540 - RNA, 18 nt, Pseudomonas putida KT2440
gacgugcgcggggcccga

SEQ ID NO: 1579541 - RNA, 14 nt, Pseudomonas putida KT2440
gacucagcgcuugc

SEQ ID NO: 1579542 - RNA, 19 nt, Pseudomonas putida KT2440
gacucagcgcuugccgcug

SEQ ID NO: 1579543 - RNA, 15 nt, Pseudomonas putida KT2440
gacucagcugcugcu

SEQ ID NO: 1579544 - RNA, 16 nt, Pseudomonas putida KT2440
gacucauagcucagcu

SEQ ID NO: 1579545 - RNA, 23 nt, Pseudomonas putida KT2440
gacuccgcuucaucaggucgccu

SEQ ID NO: 1579546 - RNA, 21 nt, Pseudomonas putida KT2440
gacuccggccggggcucacag

SEQ ID NO: 1579547 - RNA, 14 nt, Pseudomonas putida KT2440
gacucccgcugccu

SEQ ID NO: 1579548 - RNA, 17 nt, Pseudomonas putida KT2440
gacuacaucuucgcgcu

SEQ ID NO: 1579549 - RNA, 14 nt, Pseudomonas putida KT2440
gacuaccagguagc

SEQ ID NO: 1579550 - RNA, 16 nt, Pseudomonas putida KT2440
gagccggguccacccg

SEQ ID NO: 1579551 - RNA, 15 nt, Pseudomonas putida KT2440
gagccguccaggaac

SEQ ID NO: 1579552 - RNA, 22 nt, Pseudomonas putida KT2440
gagccguccaggaacgcugccu

SEQ ID NO: 1579553 - RNA, 15 nt, Pseudomonas putida KT2440
gagcccccgcugcuc

SEQ ID NO: 1579554 - RNA, 18 nt, Pseudomonas putida KT2440
gagccagaucauggcggu

SEQ ID NO: 1579555 - RNA, 21 nt, Pseudomonas putida KT2440
gagcccugugggagcgggcau

SEQ ID NO: 1579556 - RNA, 17 nt, Pseudomonas putida KT2440
aacuccacguucccgcc

SEQ ID NO: 1579557 - RNA, 17 nt, Pseudomonas putida KT2440
aacuccauggccagggc

SEQ ID NO: 1579558 - RNA, 11 nt, Pseudomonas putida KT2440
aacucacgcgc

SEQ ID NO: 1579559 - RNA, 17 nt, Pseudomonas putida KT2440
aacuccugcguacccag

SEQ ID NO: 1579560 - RNA, 20 nt, Pseudomonas putida KT2440
gagccaaguguuugaagcua

SEQ ID NO: 1579561 - RNA, 15 nt, Pseudomonas putida KT2440
gagcauuacaggcag

SEQ ID NO: 1579562 - RNA, 14 nt, Pseudomonas putida KT2440
gagcauggccagcc

SEQ ID NO: 1579563 - RNA, 13 nt, Pseudomonas putida KT2440
gagcagcgguggc

SEQ ID NO: 1579564 - RNA, 18 nt, Pseudomonas putida KT2440
gagcaguggugcucagcg

SEQ ID NO: 1579565 - RNA, 18 nt, Pseudomonas putida KT2440
gagcagggugccuucagg

SEQ ID NO: 1579566 - RNA, 18 nt, Pseudomonas putida KT2440
gagagccccaccaggaag

SEQ ID NO: 1579567 - RNA, 17 nt, Pseudomonas putida KT2440
gagaccgaggggccgcu

SEQ ID NO: 1579568 - RNA, 14 nt, Pseudomonas putida KT2440
gagaagguggccgu

SEQ ID NO: 1579569 - RNA, 17 nt, Pseudomonas putida KT2440
gagcacggcuucgacgc

SEQ ID NO: 1579570 - RNA, 17 nt, Pseudomonas putida KT2440
gagcacgaaguaacggc

SEQ ID NO: 1579571 - RNA, 16 nt, Pseudomonas putida KT2440
gagcaauacauccagg

SEQ ID NO: 1579572 - RNA, 13 nt, Pseudomonas putida KT2440
gagcaagcucgcu

SEQ ID NO: 1579573 - RNA, 15 nt, Pseudomonas putida KT2440
gagcaaggcguuguc

SEQ ID NO: 1579574 - RNA, 19 nt, Pseudomonas putida KT2440
gagcaaggcguugucggcc

SEQ ID NO: 1579575 - RNA, 17 nt, Pseudomonas putida KT2440
gagcaccacauacggcg

SEQ ID NO: 1579576 - RNA, 19 nt, Pseudomonas putida KT2440
gagcaacagaacgccuugu

SEQ ID NO: 1579577 - RNA, 16 nt, Pseudomonas putida KT2440
gcccgaccucacgcag

SEQ ID NO: 1579578 - RNA, 13 nt, Pseudomonas putida KT2440
gcccgaccuuggc

SEQ ID NO: 1579579 - RNA, 17 nt, Pseudomonas putida KT2440
gcccgaccuuggcgaca

SEQ ID NO: 1579580 - RNA, 17 nt, Pseudomonas putida KT2440
gcccgaagcuaucgcca

SEQ ID NO: 1579581 - RNA, 18 nt, Pseudomonas putida KT2440
gcccgacgcauauccgca

SEQ ID NO: 1579582 - RNA, 14 nt, Pseudomonas putida KT2440
aagaggccggcaca

SEQ ID NO: 1579583 - RNA, 16 nt, Pseudomonas putida KT2440
aagaggccggcacaga

SEQ ID NO: 1579584 - RNA, 20 nt, Pseudomonas putida KT2440
aagaggccgguacugcccau

SEQ ID NO: 1579585 - RNA, 22 nt, Pseudomonas putida KT2440
gccccggauucacggaucagcc

SEQ ID NO: 1579586 - RNA, 23 nt, Pseudomonas putida KT2440
gccccggauucacggaucagccg

SEQ ID NO: 1579587 - RNA, 20 nt, Pseudomonas putida KT2440
gccccgcuggucgcgcagau

SEQ ID NO: 1579588 - RNA, 21 nt, Pseudomonas putida KT2440
gccccuuccuuguaggccauu

SEQ ID NO: 1579589 - RNA, 16 nt, Pseudomonas putida KT2440
gccccuuucgcgacac

SEQ ID NO: 1579590 - RNA, 20 nt, Pseudomonas putida KT2440
gcccgaaacacccugcacca

SEQ ID NO: 1579591 - RNA, 22 nt, Pseudomonas putida KT2440
gcccgaaacugcgcucaaccag

SEQ ID NO: 1579592 - RNA, 17 nt, Pseudomonas putida KT2440
gccccuuggcacggcca

SEQ ID NO: 1579593 - RNA, 18 nt, Pseudomonas putida KT2440
gcccgaacaacaggucgg

SEQ ID NO: 1579594 - RNA, 19 nt, Pseudomonas putida KT2440
gcccgagcaaggcgcagcc

SEQ ID NO: 1579595 - RNA, 16 nt, Pseudomonas putida KT2440
gcccgccagcaggcca

SEQ ID NO: 1579596 - RNA, 13 nt, Pseudomonas putida KT2440
gcccgccagcagg

SEQ ID NO: 1579597 - RNA, 16 nt, Pseudomonas putida KT2440
gcccgccacaccugcc

SEQ ID NO: 1579598 - RNA, 22 nt, Pseudomonas putida KT2440
gcccgccacaccugccaggcca

SEQ ID NO: 1579599 - RNA, 21 nt, Pseudomonas putida KT2440
gcccgccaccgccucgcccag

SEQ ID NO: 1579600 - RNA, 23 nt, Pseudomonas putida KT2440
gcccgccccugccagcaccagcg

SEQ ID NO: 1579601 - RNA, 22 nt, Pseudomonas putida KT2440
gcccgccucgccauaagcuguc

SEQ ID NO: 1579602 - RNA, 18 nt, Pseudomonas putida KT2440
gcccgccgucaucgaacc

SEQ ID NO: 1579603 - RNA, 13 nt, Pseudomonas putida KT2440
gcccgccgccagu

SEQ ID NO: 1579604 - RNA, 14 nt, Pseudomonas putida KT2440
gcccgccgccaguu

SEQ ID NO: 1579605 - RNA, 16 nt, Pseudomonas putida KT2440
aagaggccagcacagg

SEQ ID NO: 1579606 - RNA, 15 nt, Pseudomonas putida KT2440
gccccgccagcgccu

SEQ ID NO: 1579607 - RNA, 13 nt, Pseudomonas putida KT2440
gccccgcaggccg

SEQ ID NO: 1579608 - RNA, 23 nt, Pseudomonas putida KT2440
gccccgcaugcucgcugcugccu

SEQ ID NO: 1579609 - RNA, 17 nt, Pseudomonas putida KT2440
gccccgcacaucacggc

SEQ ID NO: 1579610 - RNA, 20 nt, Pseudomonas putida KT2440
gccccgcacaucacggcgca

SEQ ID NO: 1579611 - RNA, 21 nt, Pseudomonas putida KT2440
gccccgcacaucacggcgcag

SEQ ID NO: 1579612 - RNA, 18 nt, Pseudomonas putida KT2440
aagacgcucgacagcaac

SEQ ID NO: 1579613 - RNA, 22 nt, Pseudomonas putida KT2440
gcccccagccggucauccagca

SEQ ID NO: 1579614 - RNA, 12 nt, Pseudomonas putida KT2440
gcccccagcaca

SEQ ID NO: 1579615 - RNA, 17 nt, Pseudomonas putida KT2440
gccccaugcgaccagua

SEQ ID NO: 1579616 - RNA, 23 nt, Pseudomonas putida KT2440
gccccauucgcugcgucaggcca

SEQ ID NO: 1579617 - RNA, 17 nt, Pseudomonas putida KT2440
gcccccaaugggcaccg

SEQ ID NO: 1579618 - RNA, 15 nt, Pseudomonas putida KT2440
gccccauagccugcu

SEQ ID NO: 1579619 - RNA, 23 nt, Pseudomonas putida KT2440
gccccagucuucguacaugcgcg

SEQ ID NO: 1579620 - RNA, 14 nt, Pseudomonas putida KT2440
gccccaagcgccug

SEQ ID NO: 1579621 - RNA, 19 nt, Pseudomonas putida KT2440
gccccaagcgggccaaggu

SEQ ID NO: 1579622 - RNA, 21 nt, Pseudomonas putida KT2440
gccccaagcgggccaagguca

SEQ ID NO: 1579623 - RNA, 22 nt, Pseudomonas putida KT2440
gccccaagcgggccaaggucau

SEQ ID NO: 1579624 - RNA, 13 nt, Pseudomonas putida KT2440
gcccauuccgggu

SEQ ID NO: 1579625 - RNA, 20 nt, Pseudomonas putida KT2440
gcccauuccgggucgccagu

SEQ ID NO: 1579626 - RNA, 21 nt, Pseudomonas putida KT2440
gcccauuccgggucgccagug

SEQ ID NO: 1579627 - RNA, 22 nt, Pseudomonas putida KT2440
gcccauuuccgggcaaugcagg

SEQ ID NO: 1579628 - RNA, 17 nt, Pseudomonas putida KT2440
gccccaaccuuccagca

SEQ ID NO: 1579629 - RNA, 12 nt, Pseudomonas putida KT2440
gcccauggccag

SEQ ID NO: 1579630 - RNA, 14 nt, Pseudomonas putida KT2440
gcccauggccagcg

SEQ ID NO: 1579631 - RNA, 17 nt, Pseudomonas putida KT2440
gcccauggcuccaccca

SEQ ID NO: 1579632 - RNA, 14 nt, Pseudomonas putida KT2440
gcccaugucgauca

SEQ ID NO: 1579633 - RNA, 17 nt, Pseudomonas putida KT2440
gcccaugucgaucagcg

SEQ ID NO: 1579634 - RNA, 19 nt, Pseudomonas putida KT2440
gccaugguuuugggcacga

SEQ ID NO: 1579635 - RNA, 21 nt, Pseudomonas putida KT2440
gccauguaccgggcggccacc

SEQ ID NO: 1579636 - RNA, 22 nt, Pseudomonas putida KT2440
gccauguaccgggcggccaccg

SEQ ID NO: 1579637 - RNA, 11 nt, Pseudomonas putida KT2440
gcccaggcugg

SEQ ID NO: 1579638 - RNA, 20 nt, Pseudomonas putida KT2440
gcccaguucggacaggcgcu

SEQ ID NO: 1579639 - RNA, 17 nt, Pseudomonas putida KT2440
gcccaguucuuggcggc

SEQ ID NO: 1579640 - RNA, 18 nt, Pseudomonas putida KT2440
gcccaguucuuggcggcu

SEQ ID NO: 1579641 - RNA, 19 nt, Pseudomonas putida KT2440
gcccaugaaguucauccag

SEQ ID NO: 1579642 - RNA, 22 nt, Pseudomonas putida KT2440
gcccaguggcacaccaugggca

SEQ ID NO: 1579643 - RNA, 16 nt, Pseudomonas putida KT2440
gcccaugaucgcggca

SEQ ID NO: 1579644 - RNA, 15 nt, Pseudomonas putida KT2440
gcccagguugccuca

SEQ ID NO: 1579645 - RNA, 17 nt, Pseudomonas putida KT2440
gcccaguagcgccacca

SEQ ID NO: 1579646 - RNA, 18 nt, Pseudomonas putida KT2440
gcccaguacgccacccag

SEQ ID NO: 1579647 - RNA, 18 nt, Pseudomonas putida KT2440
gcccaggugccaggcuca

SEQ ID NO: 1579648 - RNA, 19 nt, Pseudomonas putida KT2440
gcccaggugccaggcucag

SEQ ID NO: 1579649 - RNA, 22 nt, Pseudomonas putida KT2440
gcccagguaacugccgaccuug

SEQ ID NO: 1579650 - RNA, 21 nt, Pseudomonas putida KT2440
gcccagggcugcuucacgggu

SEQ ID NO: 1579651 - RNA, 23 nt, Pseudomonas putida KT2440
gcccggcaaucgggauggcaccg

SEQ ID NO: 1579652 - RNA, 21 nt, Pseudomonas putida KT2440
gcccggacugcaccaggucca

SEQ ID NO: 1579653 - RNA, 16 nt, Pseudomonas putida KT2440
gcccggauaguguucg

SEQ ID NO: 1579654 - RNA, 18 nt, Pseudomonas putida KT2440
gcccggauaguguucgag

SEQ ID NO: 1579655 - RNA, 17 nt, Pseudomonas putida KT2440
gcccggcagaucgagcg

SEQ ID NO: 1579656 - RNA, 17 nt, Pseudomonas putida KT2440
gcccggcacgguugcgc

SEQ ID NO: 1579657 - RNA, 14 nt, Pseudomonas putida KT2440
gcccggcaucgcuc

SEQ ID NO: 1579658 - RNA, 12 nt, Pseudomonas putida KT2440
gcccggccagca

SEQ ID NO: 1579659 - RNA, 12 nt, Pseudomonas putida KT2440
gcccggccaggu

SEQ ID NO: 1579660 - RNA, 14 nt, Pseudomonas putida KT2440
gcccggccagguca

SEQ ID NO: 1579661 - RNA, 13 nt, Pseudomonas putida KT2440
gcccgcugcgccg

SEQ ID NO: 1579662 - RNA, 15 nt, Pseudomonas putida KT2440
gcccgcugcgccgag

SEQ ID NO: 1579663 - RNA, 16 nt, Pseudomonas putida KT2440
gcccgcuucaacagcu

SEQ ID NO: 1579664 - RNA, 14 nt, Pseudomonas putida KT2440
gcccgcuugcccga

SEQ ID NO: 1579665 - RNA, 20 nt, Pseudomonas putida KT2440
gcccggacaacuuggcaccg

SEQ ID NO: 1579666 - RNA, 18 nt, Pseudomonas putida KT2440
gcccggaagcuucucgag

SEQ ID NO: 1579667 - RNA, 18 nt, Pseudomonas putida KT2440
gcccgccuucgcgggcuu

SEQ ID NO: 1579668 - RNA, 15 nt, Pseudomonas putida KT2440
gcccgccugcucaau

SEQ ID NO: 1579669 - RNA, 22 nt, Pseudomonas putida KT2440
gcccgccugcucaaucaaccag

SEQ ID NO: 1579670 - RNA, 14 nt, Pseudomonas putida KT2440
gcccgccugcgcca

SEQ ID NO: 1579671 - RNA, 18 nt, Pseudomonas putida KT2440
gcccggccgcgccaccgg

SEQ ID NO: 1579672 - RNA, 16 nt, Pseudomonas putida KT2440
gcccggcccuuucgcg

SEQ ID NO: 1579673 - RNA, 17 nt, Pseudomonas putida KT2440
gcccggcccuuucgcgg

SEQ ID NO: 1579674 - RNA, 19 nt, Pseudomonas putida KT2440
gcccggcccuuucgcgggu

SEQ ID NO: 1579675 - RNA, 22 nt, Pseudomonas putida KT2440
gcccggcgcagcauaugcuggu

SEQ ID NO: 1579676 - RNA, 15 nt, Pseudomonas putida KT2440
gcccggcgagcgcag

SEQ ID NO: 1579677 - RNA, 13 nt, Pseudomonas putida KT2440
gcccggcguucga

SEQ ID NO: 1579678 - RNA, 23 nt, Pseudomonas putida KT2440
gcccggcuccgcgcaagcgguug

SEQ ID NO: 1579679 - RNA, 20 nt, Pseudomonas putida KT2440
gcccggcugaaaccgcgaau

SEQ ID NO: 1579680 - RNA, 17 nt, Pseudomonas putida KT2440
gcccggcgcuggugcag

SEQ ID NO: 1579681 - RNA, 18 nt, Pseudomonas putida KT2440
gcccgggaacggcugccg

SEQ ID NO: 1579682 - RNA, 16 nt, Pseudomonas putida KT2440
gcccgggcgcaggcag

SEQ ID NO: 1579683 - RNA, 20 nt, Pseudomonas putida KT2440
gcccggggaucuugcuggcc

SEQ ID NO: 1579684 - RNA, 17 nt, Pseudomonas putida KT2440
gcccggucauacagccc

SEQ ID NO: 1579685 - RNA, 15 nt, Pseudomonas putida KT2440
gcccggugcaagcca

SEQ ID NO: 1579686 - RNA, 14 nt, Pseudomonas putida KT2440
gcccggugcaaggu

SEQ ID NO: 1579687 - RNA, 13 nt, Pseudomonas putida KT2440
gcccguaggagcg

SEQ ID NO: 1579688 - RNA, 17 nt, Pseudomonas putida KT2440
gcccgguaauagcggcg

SEQ ID NO: 1579689 - RNA, 14 nt, Pseudomonas putida KT2440
gcccgguuccagcg

SEQ ID NO: 1579690 - RNA, 19 nt, Pseudomonas putida KT2440
gcccgguuccagcgcaccg

SEQ ID NO: 1579691 - RNA, 20 nt, Pseudomonas putida KT2440
gcccgguugcaccgagaagc

SEQ ID NO: 1579692 - RNA, 15 nt, Pseudomonas putida KT2440
gcccgucagcuugcc

SEQ ID NO: 1579693 - RNA, 18 nt, Pseudomonas putida KT2440
gcccgucacgugccuuca

SEQ ID NO: 1579694 - RNA, 22 nt, Pseudomonas putida KT2440
gcccgucacgugccuucaccag

SEQ ID NO: 1579695 - RNA, 14 nt, Pseudomonas putida KT2440
gcccguccggcaug

SEQ ID NO: 1579696 - RNA, 19 nt, Pseudomonas putida KT2440
gcccgucugcgugcaccca

SEQ ID NO: 1579697 - RNA, 19 nt, Pseudomonas putida KT2440
gcccucaacccucgcccag

SEQ ID NO: 1579698 - RNA, 18 nt, Pseudomonas putida KT2440
gcccucaagggauuggca

SEQ ID NO: 1579699 - RNA, 13 nt, Pseudomonas putida KT2440
gcccguucuggcc

SEQ ID NO: 1579700 - RNA, 14 nt, Pseudomonas putida KT2440
gcccgugcugucgg

SEQ ID NO: 1579701 - RNA, 16 nt, Pseudomonas putida KT2440
gcccguguucgcgggc

SEQ ID NO: 1579702 - RNA, 17 nt, Pseudomonas putida KT2440
gcccguguucgcgggca

SEQ ID NO: 1579703 - RNA, 19 nt, Pseudomonas putida KT2440
gcccguguucgcgggcaag

SEQ ID NO: 1579704 - RNA, 16 nt, Pseudomonas putida KT2440
gcccgugguuggagcg

SEQ ID NO: 1579705 - RNA, 19 nt, Pseudomonas putida KT2440
gcccguggcccucagccca

SEQ ID NO: 1579706 - RNA, 13 nt, Pseudomonas putida KT2440
gccgaacauggug

SEQ ID NO: 1579707 - RNA, 18 nt, Pseudomonas putida KT2440
gccgaaaccgcccgggau

SEQ ID NO: 1579708 - RNA, 11 nt, Pseudomonas putida KT2440
gcccuccagcc

SEQ ID NO: 1579709 - RNA, 13 nt, Pseudomonas putida KT2440
gcccuccagccgc

SEQ ID NO: 1579710 - RNA, 22 nt, Pseudomonas putida KT2440
gcccuccaucaaucgcucgaaa

SEQ ID NO: 1579711 - RNA, 16 nt, Pseudomonas putida KT2440
gccgaacgggccacca

SEQ ID NO: 1579712 - RNA, 20 nt, Pseudomonas putida KT2440
gccgaacgcaagaaggcugc

SEQ ID NO: 1579713 - RNA, 15 nt, Pseudomonas putida KT2440
gccgaagcccagcga

SEQ ID NO: 1579714 - RNA, 13 nt, Pseudomonas putida KT2440
gccgacaacagca

SEQ ID NO: 1579715 - RNA, 16 nt, Pseudomonas putida KT2440
gccgacccgccuggug

SEQ ID NO: 1579716 - RNA, 21 nt, Pseudomonas putida KT2440
gccgacccgccuggugccagc

SEQ ID NO: 1579717 - RNA, 16 nt, Pseudomonas putida KT2440
gccgacccgggccagc

SEQ ID NO: 1579718 - RNA, 21 nt, Pseudomonas putida KT2440
gccgacaacgguguggccagu

SEQ ID NO: 1579719 - RNA, 17 nt, Pseudomonas putida KT2440
gccgaccaagcgcccca

SEQ ID NO: 1579720 - RNA, 18 nt, Pseudomonas putida KT2440
gccgagucgguggcgaag

SEQ ID NO: 1579721 - RNA, 16 nt, Pseudomonas putida KT2440
gccgaggucugguacu

SEQ ID NO: 1579722 - RNA, 14 nt, Pseudomonas putida KT2440
gccgaguuggcuuc

SEQ ID NO: 1579723 - RNA, 16 nt, Pseudomonas putida KT2440
gccgaguuggcuucuu

SEQ ID NO: 1579724 - RNA, 20 nt, Pseudomonas putida KT2440
gccgaguuggcuucuugacg

SEQ ID NO: 1579725 - RNA, 20 nt, Pseudomonas putida KT2440
gccgagggugaggugcugca

SEQ ID NO: 1579726 - RNA, 18 nt, Pseudomonas putida KT2440
gccgaucauugcugcggu

SEQ ID NO: 1579727 - RNA, 18 nt, Pseudomonas putida KT2440
gccgaucagguugcccag

SEQ ID NO: 1579728 - RNA, 23 nt, Pseudomonas putida KT2440
gccgaucaucuuggugugggcga

SEQ ID NO: 1579729 - RNA, 22 nt, Pseudomonas putida KT2440
gccgaucagcuuaacgcuuggc

SEQ ID NO: 1579730 - RNA, 15 nt, Pseudomonas putida KT2440
gccgauaccgaacac

SEQ ID NO: 1579731 - RNA, 18 nt, Pseudomonas putida KT2440
gccgauacggugccaaua

SEQ ID NO: 1579732 - RNA, 22 nt, Pseudomonas putida KT2440
gccgauagcagcaccgaucagc

SEQ ID NO: 1579733 - RNA, 20 nt, Pseudomonas putida KT2440
gccgagcauuacaggcagau

SEQ ID NO: 1579734 - RNA, 15 nt, Pseudomonas putida KT2440
gccgagccaaccgcu

SEQ ID NO: 1579735 - RNA, 23 nt, Pseudomonas putida KT2440
gccgagccaaccgcuucaccgcg

SEQ ID NO: 1579736 - RNA, 22 nt, Pseudomonas putida KT2440
gccgagcaucuuccagccugca

SEQ ID NO: 1579737 - RNA, 17 nt, Pseudomonas putida KT2440
gccgcccuuucgcgggu

SEQ ID NO: 1579738 - RNA, 17 nt, Pseudomonas putida KT2440
gccgccgaacaggccgg

SEQ ID NO: 1579739 - RNA, 23 nt, Pseudomonas putida KT2440
gccgccgaacucuggcaacagcu

SEQ ID NO: 1579740 - RNA, 15 nt, Pseudomonas putida KT2440
gccgccgacgaugcc

SEQ ID NO: 1579741 - RNA, 22 nt, Pseudomonas putida KT2440
gccgccgacgaucaguaccggc

SEQ ID NO: 1579742 - RNA, 13 nt, Pseudomonas putida KT2440
gccgccgccagac

SEQ ID NO: 1579743 - RNA, 17 nt, Pseudomonas putida KT2440
gccgccgagcugaugcc

SEQ ID NO: 1579744 - RNA, 19 nt, Pseudomonas putida KT2440
gccgccgauguuggucacc

SEQ ID NO: 1579745 - RNA, 14 nt, Pseudomonas putida KT2440
gccgcccugcggcu

SEQ ID NO: 1579746 - RNA, 20 nt, Pseudomonas putida KT2440
gccgcccucuucgcgggcac

SEQ ID NO: 1579747 - RNA, 22 nt, Pseudomonas putida KT2440
gccgcccucuugcugcaacagc

SEQ ID NO: 1579748 - RNA, 19 nt, Pseudomonas putida KT2440
gccgcccuuggugcaccag

SEQ ID NO: 1579749 - RNA, 21 nt, Pseudomonas putida KT2440
gccgcccuuggugcaccagcu

SEQ ID NO: 1579750 - RNA, 14 nt, Pseudomonas putida KT2440
gccgcccgcuugug

SEQ ID NO: 1579751 - RNA, 20 nt, Pseudomonas putida KT2440
gccgcccggucauacagccc

SEQ ID NO: 1579752 - RNA, 21 nt, Pseudomonas putida KT2440
gccgcccggucauacagcccu

SEQ ID NO: 1579753 - RNA, 14 nt, Pseudomonas putida KT2440
gccgcccgcggcga

SEQ ID NO: 1579754 - RNA, 23 nt, Pseudomonas putida KT2440
gccgccauugaugccgaaggccu

SEQ ID NO: 1579755 - RNA, 17 nt, Pseudomonas putida KT2440
gccgcccacgccggcaa

SEQ ID NO: 1579756 - RNA, 18 nt, Pseudomonas putida KT2440
gccgcccacgccggcaac

SEQ ID NO: 1579757 - RNA, 16 nt, Pseudomonas putida KT2440
gccgccaugcagcccg

SEQ ID NO: 1579758 - RNA, 18 nt, Pseudomonas putida KT2440
gccgccauguacguugcc

SEQ ID NO: 1579759 - RNA, 14 nt, Pseudomonas putida KT2440
gccgcccaggucau

SEQ ID NO: 1579760 - RNA, 14 nt, Pseudomonas putida KT2440
gccgcccagguugc

SEQ ID NO: 1579761 - RNA, 23 nt, Pseudomonas putida KT2440
gccgccccgcaccagaccagcag

SEQ ID NO: 1579762 - RNA, 21 nt, Pseudomonas putida KT2440
gccgccccgugcccgaucacc

SEQ ID NO: 1579763 - RNA, 16 nt, Pseudomonas putida KT2440
gccgcauuggccgggu

SEQ ID NO: 1579764 - RNA, 15 nt, Pseudomonas putida KT2440
gccgcauucgcgggu

SEQ ID NO: 1579765 - RNA, 16 nt, Pseudomonas putida KT2440
gccgcauucgcgggua

SEQ ID NO: 1579766 - RNA, 19 nt, Pseudomonas putida KT2440
gccgcauauacgccggcgu

SEQ ID NO: 1579767 - RNA, 13 nt, Pseudomonas putida KT2440
gccgcaucagccg

SEQ ID NO: 1579768 - RNA, 16 nt, Pseudomonas putida KT2440
gccgcagccccgccaa

SEQ ID NO: 1579769 - RNA, 21 nt, Pseudomonas putida KT2440
gccgcagccucuucggccagc

SEQ ID NO: 1579770 - RNA, 22 nt, Pseudomonas putida KT2440
gccgcagccucuucggccagca

SEQ ID NO: 1579771 - RNA, 14 nt, Pseudomonas putida KT2440
gccgccagcggcuc

SEQ ID NO: 1579772 - RNA, 13 nt, Pseudomonas putida KT2440
gccgccagcggcg

SEQ ID NO: 1579773 - RNA, 18 nt, Pseudomonas putida KT2440
gccgccagcgcuccagca

SEQ ID NO: 1579774 - RNA, 15 nt, Pseudomonas putida KT2440
gccgccagcggcagu

SEQ ID NO: 1579775 - RNA, 13 nt, Pseudomonas putida KT2440
gccgccaggccca

SEQ ID NO: 1579776 - RNA, 14 nt, Pseudomonas putida KT2440
gccgccagcugcug

SEQ ID NO: 1579777 - RNA, 14 nt, Pseudomonas putida KT2440
gccgccaaggcgau

SEQ ID NO: 1579778 - RNA, 20 nt, Pseudomonas putida KT2440
gccgccaagcggccccaaug

SEQ ID NO: 1579779 - RNA, 15 nt, Pseudomonas putida KT2440
gccgcagcaguuggc

SEQ ID NO: 1579780 - RNA, 17 nt, Pseudomonas putida KT2440
gccgauugcugccgacc

SEQ ID NO: 1579781 - RNA, 21 nt, Pseudomonas putida KT2440
gccgcaaagcggccccuucga

SEQ ID NO: 1579782 - RNA, 20 nt, Pseudomonas putida KT2440
gccgcaaagacugccaagua

SEQ ID NO: 1579783 - RNA, 19 nt, Pseudomonas putida KT2440
gccgcaauggucuuaccag

SEQ ID NO: 1579784 - RNA, 18 nt, Pseudomonas putida KT2440
gccaggcgucgaucagau

SEQ ID NO: 1579785 - RNA, 15 nt, Pseudomonas putida KT2440
gccaggcgucguugu

SEQ ID NO: 1579786 - RNA, 19 nt, Pseudomonas putida KT2440
gccaggccuuucagcgccc

SEQ ID NO: 1579787 - RNA, 15 nt, Pseudomonas putida KT2440
gccaggccucaagcc

SEQ ID NO: 1579788 - RNA, 15 nt, Pseudomonas putida KT2440
gccaggcgcaagccu

SEQ ID NO: 1579789 - RNA, 12 nt, Pseudomonas putida KT2440
gccaggccccga

SEQ ID NO: 1579790 - RNA, 18 nt, Pseudomonas putida KT2440
gccaggcccaccaccggu

SEQ ID NO: 1579791 - RNA, 21 nt, Pseudomonas putida KT2440
gccagcgucguguucgccugu

SEQ ID NO: 1579792 - RNA, 13 nt, Pseudomonas putida KT2440
gccagcggccgcu

SEQ ID NO: 1579793 - RNA, 20 nt, Pseudomonas putida KT2440
gccagcgucuuuggccugcu

SEQ ID NO: 1579794 - RNA, 15 nt, Pseudomonas putida KT2440
gccaggaccgcggaa

SEQ ID NO: 1579795 - RNA, 22 nt, Pseudomonas putida KT2440
gccaggcauugcccgcgauagc

SEQ ID NO: 1579796 - RNA, 22 nt, Pseudomonas putida KT2440
gccaggcauuccccggucagca

SEQ ID NO: 1579797 - RNA, 20 nt, Pseudomonas putida KT2440
gccaggugcucagccacgcu

SEQ ID NO: 1579798 - RNA, 11 nt, Pseudomonas putida KT2440
gccagguggcc

SEQ ID NO: 1579799 - RNA, 15 nt, Pseudomonas putida KT2440
gccaguaccagcagc

SEQ ID NO: 1579800 - RNA, 16 nt, Pseudomonas putida KT2440
gccaguaccagcagca

SEQ ID NO: 1579801 - RNA, 17 nt, Pseudomonas putida KT2440
gccaguaccagcagcac

SEQ ID NO: 1579802 - RNA, 15 nt, Pseudomonas putida KT2440
gccaguaggcugcag

SEQ ID NO: 1579803 - RNA, 22 nt, Pseudomonas putida KT2440
gccaguaccaggucgccagcac

SEQ ID NO: 1579804 - RNA, 20 nt, Pseudomonas putida KT2440
gccaguaccuuggcguaggc

SEQ ID NO: 1579805 - RNA, 22 nt, Pseudomonas putida KT2440
gccaguacgcgccugcaccugg

SEQ ID NO: 1579806 - RNA, 16 nt, Pseudomonas putida KT2440
gccaguacggccauca

SEQ ID NO: 1579807 - RNA, 18 nt, Pseudomonas putida KT2440
gccaguacggccaucagc

SEQ ID NO: 1579808 - RNA, 20 nt, Pseudomonas putida KT2440
gccaggcguugugggugaag

SEQ ID NO: 1579809 - RNA, 18 nt, Pseudomonas putida KT2440
gccaggcugagcccggca

SEQ ID NO: 1579810 - RNA, 20 nt, Pseudomonas putida KT2440
gccaggguuaccugcgcgag

SEQ ID NO: 1579811 - RNA, 21 nt, Pseudomonas putida KT2440
gccagguagcgauugcggccu

SEQ ID NO: 1579812 - RNA, 21 nt, Pseudomonas putida KT2440
gccaggguugcaucgcgcacu

SEQ ID NO: 1579813 - RNA, 17 nt, Pseudomonas putida KT2440
gccaguucgacgcugcu

SEQ ID NO: 1579814 - RNA, 19 nt, Pseudomonas putida KT2440
gccaguuacccuguacccg

SEQ ID NO: 1579815 - RNA, 22 nt, Pseudomonas putida KT2440
gccaguuacccuguacccgcug

SEQ ID NO: 1579816 - RNA, 18 nt, Pseudomonas putida KT2440
gccaguguucgaacgggc

SEQ ID NO: 1579817 - RNA, 22 nt, Pseudomonas putida KT2440
gccaguucgcggcgcaccgcuu

SEQ ID NO: 1579818 - RNA, 17 nt, Pseudomonas putida KT2440
gccagugaagcucgauc

SEQ ID NO: 1579819 - RNA, 15 nt, Pseudomonas putida KT2440
gccagugauccggcg

SEQ ID NO: 1579820 - RNA, 16 nt, Pseudomonas putida KT2440
gccagugcggugaccg

SEQ ID NO: 1579821 - RNA, 19 nt, Pseudomonas putida KT2440
gccagugggcacgguuggc

SEQ ID NO: 1579822 - RNA, 15 nt, Pseudomonas putida KT2440
gccagugccgcaagc

SEQ ID NO: 1579823 - RNA, 16 nt, Pseudomonas putida KT2440
gccagugccgcaagca

SEQ ID NO: 1579824 - RNA, 17 nt, Pseudomonas putida KT2440
gccauccuugaagaaca

SEQ ID NO: 1579825 - RNA, 21 nt, Pseudomonas putida KT2440
gccauccugcuguagcgccca

SEQ ID NO: 1579826 - RNA, 14 nt, Pseudomonas putida KT2440
gccaucgagcaccg

SEQ ID NO: 1579827 - RNA, 15 nt, Pseudomonas putida KT2440
gccauccgguaugcc

SEQ ID NO: 1579828 - RNA, 15 nt, Pseudomonas putida KT2440
gccaucggcacgcca

SEQ ID NO: 1579829 - RNA, 11 nt, Pseudomonas putida KT2440
gccaucggccu

SEQ ID NO: 1579830 - RNA, 14 nt, Pseudomonas putida KT2440
gccaucggccucuc

SEQ ID NO: 1579831 - RNA, 17 nt, Pseudomonas putida KT2440
gccaucgcccacggcga

SEQ ID NO: 1579832 - RNA, 17 nt, Pseudomonas putida KT2440
gccaugcaggucgacga

SEQ ID NO: 1579833 - RNA, 20 nt, Pseudomonas putida KT2440
gccaugccgaauugaacugg

SEQ ID NO: 1579834 - RNA, 14 nt, Pseudomonas putida KT2440
gccaugccggcaac

SEQ ID NO: 1579835 - RNA, 18 nt, Pseudomonas putida KT2440
gccaucugguugcuggcg

SEQ ID NO: 1579836 - RNA, 15 nt, Pseudomonas putida KT2440
gccaucuucacggca

SEQ ID NO: 1579837 - RNA, 19 nt, Pseudomonas putida KT2440
gccaucuucacggcaagcc

SEQ ID NO: 1579838 - RNA, 21 nt, Pseudomonas putida KT2440
gccaucuggcguugcgaaggc

SEQ ID NO: 1579839 - RNA, 20 nt, Pseudomonas putida KT2440
gccaugaacaccaccgcgaa

SEQ ID NO: 1579840 - RNA, 13 nt, Pseudomonas putida KT2440
gccauccagcggc

SEQ ID NO: 1579841 - RNA, 18 nt, Pseudomonas putida KT2440
gccauccagcggcgacag

SEQ ID NO: 1579842 - RNA, 14 nt, Pseudomonas putida KT2440
gccaucaucugcug

SEQ ID NO: 1579843 - RNA, 16 nt, Pseudomonas putida KT2440
gccaucaucagguacg

SEQ ID NO: 1579844 - RNA, 19 nt, Pseudomonas putida KT2440
gccauccccccagcccuug

SEQ ID NO: 1579845 - RNA, 15 nt, Pseudomonas putida KT2440
gccaucagggcgaug

SEQ ID NO: 1579846 - RNA, 16 nt, Pseudomonas putida KT2440
gccaucagggcgaugc

SEQ ID NO: 1579847 - RNA, 19 nt, Pseudomonas putida KT2440
gccaucagggcgaugcgca

SEQ ID NO: 1579848 - RNA, 19 nt, Pseudomonas putida KT2440
gccaucagcugcggaauac

SEQ ID NO: 1579849 - RNA, 19 nt, Pseudomonas putida KT2440
gccaucacuucacggguca

SEQ ID NO: 1579850 - RNA, 16 nt, Pseudomonas putida KT2440
gccaucagaggcgaug

SEQ ID NO: 1579851 - RNA, 18 nt, Pseudomonas putida KT2440
gccaucagaggcgauggc

SEQ ID NO: 1579852 - RNA, 21 nt, Pseudomonas putida KT2440
gccauaugaaaaggcccugca

SEQ ID NO: 1579853 - RNA, 17 nt, Pseudomonas putida KT2440
gccauauucagcuucaa

SEQ ID NO: 1579854 - RNA, 18 nt, Pseudomonas putida KT2440
gccaucaauaccggcaug

SEQ ID NO: 1579855 - RNA, 19 nt, Pseudomonas putida KT2440
gccaucaauaccggcaugc

SEQ ID NO: 1579856 - RNA, 22 nt, Pseudomonas putida KT2440
gccaucaauaccggcaugccca

SEQ ID NO: 1579857 - RNA, 22 nt, Pseudomonas putida KT2440
gccauacagggccuggcgcgaa

SEQ ID NO: 1579858 - RNA, 16 nt, Pseudomonas putida KT2440
gccauaccgcauccca

SEQ ID NO: 1579859 - RNA, 14 nt, Pseudomonas putida KT2440
gccauagcgcugca

SEQ ID NO: 1579860 - RNA, 16 nt, Pseudomonas putida KT2440
gccauagcgcugcacc

SEQ ID NO: 1579861 - RNA, 18 nt, Pseudomonas putida KT2440
gccauagcgcugcaccga

SEQ ID NO: 1579862 - RNA, 20 nt, Pseudomonas putida KT2440
gccauaguuuugugccaccu

SEQ ID NO: 1579863 - RNA, 17 nt, Pseudomonas putida KT2440
gccauaucccgccaggu

SEQ ID NO: 1579864 - RNA, 22 nt, Pseudomonas putida KT2440
gccaguuguucgucgagcacca

SEQ ID NO: 1579865 - RNA, 18 nt, Pseudomonas putida KT2440
gccauacaagaucaagcc

SEQ ID NO: 1579866 - RNA, 17 nt, Pseudomonas putida KT2440
gccauaagcugucagca

SEQ ID NO: 1579867 - RNA, 19 nt, Pseudomonas putida KT2440
gccauaagcugucagcacc

SEQ ID NO: 1579868 - RNA, 14 nt, Pseudomonas putida KT2440
gccagacucagcug

SEQ ID NO: 1579869 - RNA, 20 nt, Pseudomonas putida KT2440
gccagagaauuucuccccag

SEQ ID NO: 1579870 - RNA, 16 nt, Pseudomonas putida KT2440
gccagaccauaagcgg

SEQ ID NO: 1579871 - RNA, 14 nt, Pseudomonas putida KT2440
gccagaaggcucag

SEQ ID NO: 1579872 - RNA, 17 nt, Pseudomonas putida KT2440
gccagaaccugacaagc

SEQ ID NO: 1579873 - RNA, 19 nt, Pseudomonas putida KT2440
gccacugcgcuacgaccca

SEQ ID NO: 1579874 - RNA, 20 nt, Pseudomonas putida KT2440
gccagaaagccacugcacca

SEQ ID NO: 1579875 - RNA, 22 nt, Pseudomonas putida KT2440
gccagaaagccacugcaccaau

SEQ ID NO: 1579876 - RNA, 15 nt, Pseudomonas putida KT2440
gccacucuucaccau

SEQ ID NO: 1579877 - RNA, 20 nt, Pseudomonas putida KT2440
gccacucuucaccaugggcc

SEQ ID NO: 1579878 - RNA, 16 nt, Pseudomonas putida KT2440
gccacggugucggaca

SEQ ID NO: 1579879 - RNA, 12 nt, Pseudomonas putida KT2440
gccacucggcaa

SEQ ID NO: 1579880 - RNA, 16 nt, Pseudomonas putida KT2440
gccacggugccgaaca

SEQ ID NO: 1579881 - RNA, 16 nt, Pseudomonas putida KT2440
gccacgguacgggcaa

SEQ ID NO: 1579882 - RNA, 22 nt, Pseudomonas putida KT2440
gccacgguaggccuugaccagc

SEQ ID NO: 1579883 - RNA, 13 nt, Pseudomonas putida KT2440
gccacggcggcau

SEQ ID NO: 1579884 - RNA, 17 nt, Pseudomonas putida KT2440
gccacgggcaaacaggc

SEQ ID NO: 1579885 - RNA, 21 nt, Pseudomonas putida KT2440
gccacggcggaaggcgucacg

SEQ ID NO: 1579886 - RNA, 16 nt, Pseudomonas putida KT2440
gccacggcguggagcg

SEQ ID NO: 1579887 - RNA, 22 nt, Pseudomonas putida KT2440
gccacgcccaaccccagcgcgu

SEQ ID NO: 1579888 - RNA, 19 nt, Pseudomonas putida KT2440
gccacgcaucugcaccugg

SEQ ID NO: 1579889 - RNA, 20 nt, Pseudomonas putida KT2440
gccacggaucaccuggccgu

SEQ ID NO: 1579890 - RNA, 17 nt, Pseudomonas putida KT2440
gccacgaucucuucacc

SEQ ID NO: 1579891 - RNA, 18 nt, Pseudomonas putida KT2440
gccacgaucucuucaccg

SEQ ID NO: 1579892 - RNA, 23 nt, Pseudomonas putida KT2440
gccacgaucucuucaccguacuu

SEQ ID NO: 1579893 - RNA, 17 nt, Pseudomonas putida KT2440
gccacgaugaucugccg

SEQ ID NO: 1579894 - RNA, 20 nt, Pseudomonas putida KT2440
gccacgccagaaccugacaa

SEQ ID NO: 1579895 - RNA, 22 nt, Pseudomonas putida KT2440
gccacgccagaaccugacaagc

SEQ ID NO: 1579896 - RNA, 13 nt, Pseudomonas putida KT2440
gccacgaugguca

SEQ ID NO: 1579897 - RNA, 23 nt, Pseudomonas putida KT2440
gccacgcaccagggcuggcagcg

SEQ ID NO: 1579898 - RNA, 18 nt, Pseudomonas putida KT2440
gccacauagcuggcacug

SEQ ID NO: 1579899 - RNA, 19 nt, Pseudomonas putida KT2440
gccacauagcuggcacugc

SEQ ID NO: 1579900 - RNA, 21 nt, Pseudomonas putida KT2440
gccacauaguaggcaaugccu

SEQ ID NO: 1579901 - RNA, 19 nt, Pseudomonas putida KT2440
gccacauccucugcccgca

SEQ ID NO: 1579902 - RNA, 14 nt, Pseudomonas putida KT2440
gccacauccagcgc

SEQ ID NO: 1579903 - RNA, 14 nt, Pseudomonas putida KT2440
gccacgaaggccgg

SEQ ID NO: 1579904 - RNA, 14 nt, Pseudomonas putida KT2440
gccacgacggaagc

SEQ ID NO: 1579905 - RNA, 15 nt, Pseudomonas putida KT2440
gccacgaacaggcgc

SEQ ID NO: 1579906 - RNA, 16 nt, Pseudomonas putida KT2440
gccacgaacaggcgcu

SEQ ID NO: 1579907 - RNA, 14 nt, Pseudomonas putida KT2440
gccagaucauggcg

SEQ ID NO: 1579908 - RNA, 15 nt, Pseudomonas putida KT2440
gccagaucauggcgg

SEQ ID NO: 1579909 - RNA, 21 nt, Pseudomonas putida KT2440
gccagcaauugcgagguaccg

SEQ ID NO: 1579910 - RNA, 16 nt, Pseudomonas putida KT2440
gccagaucggccagcu

SEQ ID NO: 1579911 - RNA, 17 nt, Pseudomonas putida KT2440
gccagcaccagcgcgau

SEQ ID NO: 1579912 - RNA, 14 nt, Pseudomonas putida KT2440
gccagcacaagccg

SEQ ID NO: 1579913 - RNA, 14 nt, Pseudomonas putida KT2440
gccagcacaggcgg

SEQ ID NO: 1579914 - RNA, 17 nt, Pseudomonas putida KT2440
gccagcagcgcauggcu

SEQ ID NO: 1579915 - RNA, 12 nt, Pseudomonas putida KT2440
gccagcagcgca

SEQ ID NO: 1579916 - RNA, 15 nt, Pseudomonas putida KT2440
gccagcacgaacagc

SEQ ID NO: 1579917 - RNA, 16 nt, Pseudomonas putida KT2440
gccagcacgaacagca

SEQ ID NO: 1579918 - RNA, 18 nt, Pseudomonas putida KT2440
gccagcacgaucaugggg

SEQ ID NO: 1579919 - RNA, 21 nt, Pseudomonas putida KT2440
gccagcacgaucauggggaug

SEQ ID NO: 1579920 - RNA, 16 nt, Pseudomonas putida KT2440
gccagcacgcaggcca

SEQ ID NO: 1579921 - RNA, 21 nt, Pseudomonas putida KT2440
gccagcacgcaggccagcgca

SEQ ID NO: 1579922 - RNA, 15 nt, Pseudomonas putida KT2440
gccagcaggucagca

SEQ ID NO: 1579923 - RNA, 16 nt, Pseudomonas putida KT2440
gccagcaggucagcac

SEQ ID NO: 1579924 - RNA, 15 nt, Pseudomonas putida KT2440
gccagcaggucaggc

SEQ ID NO: 1579925 - RNA, 16 nt, Pseudomonas putida KT2440
gccagcaggucaggcc

SEQ ID NO: 1579926 - RNA, 18 nt, Pseudomonas putida KT2440
gccagcaggucaggcccu

SEQ ID NO: 1579927 - RNA, 23 nt, Pseudomonas putida KT2440
gccagcaggucaggcccuuucgc

SEQ ID NO: 1579928 - RNA, 20 nt, Pseudomonas putida KT2440
gccagcagcggguuccccag

SEQ ID NO: 1579929 - RNA, 23 nt, Pseudomonas putida KT2440
gccagcagcggguuccccagcaa

SEQ ID NO: 1579930 - RNA, 18 nt, Pseudomonas putida KT2440
gccagcaguucgcagcca

SEQ ID NO: 1579931 - RNA, 14 nt, Pseudomonas putida KT2440
gccagcccauggcg

SEQ ID NO: 1579932 - RNA, 17 nt, Pseudomonas putida KT2440
gccagcccauggcgcug

SEQ ID NO: 1579933 - RNA, 14 nt, Pseudomonas putida KT2440
gccagccggcagca

SEQ ID NO: 1579934 - RNA, 13 nt, Pseudomonas putida KT2440
gccagccgcggca

SEQ ID NO: 1579935 - RNA, 17 nt, Pseudomonas putida KT2440
gccagcccgccacaccg

SEQ ID NO: 1579936 - RNA, 16 nt, Pseudomonas putida KT2440
gccagcccggcggcca

SEQ ID NO: 1579937 - RNA, 15 nt, Pseudomonas putida KT2440
gccagcgcaugcauc

SEQ ID NO: 1579938 - RNA, 13 nt, Pseudomonas putida KT2440
gccagcgaggcaa

SEQ ID NO: 1579939 - RNA, 17 nt, Pseudomonas putida KT2440
gccagcgcacagcugcc

SEQ ID NO: 1579940 - RNA, 20 nt, Pseudomonas putida KT2440
gccagcgcuccagcaacgga

SEQ ID NO: 1579941 - RNA, 22 nt, Pseudomonas putida KT2440
gccagcggcaguugcaggcgca

SEQ ID NO: 1579942 - RNA, 15 nt, Pseudomonas putida KT2440
gccagcggaaucacc

SEQ ID NO: 1579943 - RNA, 18 nt, Pseudomonas putida KT2440
gcaucgcugcccgggcaa

SEQ ID NO: 1579944 - RNA, 19 nt, Pseudomonas putida KT2440
gcaucgcugcccgggcaaa

SEQ ID NO: 1579945 - RNA, 16 nt, Pseudomonas putida KT2440
gcaucgcgagcaagcu

SEQ ID NO: 1579946 - RNA, 16 nt, Pseudomonas putida KT2440
gcaucgcgcacuugcc

SEQ ID NO: 1579947 - RNA, 15 nt, Pseudomonas putida KT2440
gcaucucggucgaca

SEQ ID NO: 1579948 - RNA, 19 nt, Pseudomonas putida KT2440
gcaucgguugccuugucgg

SEQ ID NO: 1579949 - RNA, 22 nt, Pseudomonas putida KT2440
gcaucgggugaaaucaguucac

SEQ ID NO: 1579950 - RNA, 16 nt, Pseudomonas putida KT2440
gcaucgggcgcgucgu

SEQ ID NO: 1579951 - RNA, 21 nt, Pseudomonas putida KT2440
gcaucgggcgcgucgucaugg

SEQ ID NO: 1579952 - RNA, 12 nt, Pseudomonas putida KT2440
gcaucggcguug

SEQ ID NO: 1579953 - RNA, 20 nt, Pseudomonas putida KT2440
gcaucggcguugcggugcag

SEQ ID NO: 1579954 - RNA, 17 nt, Pseudomonas putida KT2440
gcaucagggcaucggcg

SEQ ID NO: 1579955 - RNA, 15 nt, Pseudomonas putida KT2440
gcaucaucacgcgca

SEQ ID NO: 1579956 - RNA, 22 nt, Pseudomonas putida KT2440
gcauccacaccagcggcgcgau

SEQ ID NO: 1579957 - RNA, 24 nt, Pseudomonas putida KT2440
gcauccaaagccaauuugccagcg

SEQ ID NO: 1579958 - RNA, 16 nt, Pseudomonas putida KT2440
gcauccaccaggucgg

SEQ ID NO: 1579959 - RNA, 12 nt, Pseudomonas putida KT2440
gcauccaccugc

SEQ ID NO: 1579960 - RNA, 16 nt, Pseudomonas putida KT2440
gcauccagcacugccu

SEQ ID NO: 1579961 - RNA, 22 nt, Pseudomonas putida KT2440
gcauccccggccuccucgcggg

SEQ ID NO: 1579962 - RNA, 23 nt, Pseudomonas putida KT2440
gcaucgaccggcaggcgcuucag

SEQ ID NO: 1579963 - RNA, 18 nt, Pseudomonas putida KT2440
gcaucgaggaaggcaucg

SEQ ID NO: 1579964 - RNA, 21 nt, Pseudomonas putida KT2440
gcaucgaggaaggcaucgggc

SEQ ID NO: 1579965 - RNA, 16 nt, Pseudomonas putida KT2440
gcaucgauguacaccc

SEQ ID NO: 1579966 - RNA, 15 nt, Pseudomonas putida KT2440
gcaucgaagcgcacc

SEQ ID NO: 1579967 - RNA, 14 nt, Pseudomonas putida KT2440
gcaucgaacgccgc

SEQ ID NO: 1579968 - RNA, 19 nt, Pseudomonas putida KT2440
gcaucgaacgccgccugcc

SEQ ID NO: 1579969 - RNA, 18 nt, Pseudomonas putida KT2440
gcauccucggugcgcggu

SEQ ID NO: 1579970 - RNA, 19 nt, Pseudomonas putida KT2440
gcauccucggugcgcggua

SEQ ID NO: 1579971 - RNA, 18 nt, Pseudomonas putida KT2440
gcauccggcagcucaccg

SEQ ID NO: 1579972 - RNA, 17 nt, Pseudomonas putida KT2440
gcauccuccgcccugcc

SEQ ID NO: 1579973 - RNA, 18 nt, Pseudomonas putida KT2440
gcaucacgccgcgcuggc

SEQ ID NO: 1579974 - RNA, 16 nt, Pseudomonas putida KT2440
gcaucacgcuggccau

SEQ ID NO: 1579975 - RNA, 16 nt, Pseudomonas putida KT2440
gcaucagccgcgcccu

SEQ ID NO: 1579976 - RNA, 12 nt, Pseudomonas putida KT2440
gcaucagccggc

SEQ ID NO: 1579977 - RNA, 13 nt, Pseudomonas putida KT2440
gcaucagccggcu

SEQ ID NO: 1579978 - RNA, 21 nt, Pseudomonas putida KT2440
gcaucagccggcuuccagcga

SEQ ID NO: 1579979 - RNA, 22 nt, Pseudomonas putida KT2440
gcaucagcgugugacccaguuc

SEQ ID NO: 1579980 - RNA, 23 nt, Pseudomonas putida KT2440
gcaucaaacgaugcgggcuuucu

SEQ ID NO: 1579981 - RNA, 14 nt, Pseudomonas putida KT2440
gcauaggccaaggu

SEQ ID NO: 1579982 - RNA, 22 nt, Pseudomonas putida KT2440
gcauaggccaagguugccacca

SEQ ID NO: 1579983 - RNA, 19 nt, Pseudomonas putida KT2440
gcauaccgcaacaccugcc

SEQ ID NO: 1579984 - RNA, 16 nt, Pseudomonas putida KT2440
gcauacgaggccgucg

SEQ ID NO: 1579985 - RNA, 21 nt, Pseudomonas putida KT2440
gcauaccaucuucugcagcca

SEQ ID NO: 1579986 - RNA, 19 nt, Pseudomonas putida KT2440
gcagugcaucgaagcaggc

SEQ ID NO: 1579987 - RNA, 21 nt, Pseudomonas putida KT2440
gcagugcaucgaagcaggccg

SEQ ID NO: 1579988 - RNA, 12 nt, Pseudomonas putida KT2440
gcagcgccuggu

SEQ ID NO: 1579989 - RNA, 14 nt, Pseudomonas putida KT2440
gcagcgccugcagc

SEQ ID NO: 1579990 - RNA, 22 nt, Pseudomonas putida KT2440
gcaguuacucggcuaccgcauu

SEQ ID NO: 1579991 - RNA, 21 nt, Pseudomonas putida KT2440
gcaguucagggcguggugaau

SEQ ID NO: 1579992 - RNA, 23 nt, Pseudomonas putida KT2440
gcagugcggcaaccaccaacagc

SEQ ID NO: 1579993 - RNA, 13 nt, Pseudomonas putida KT2440
gcagugaugccgu

SEQ ID NO: 1579994 - RNA, 22 nt, Pseudomonas putida KT2440
gcagugccucgaccaccaucgc

SEQ ID NO: 1579995 - RNA, 13 nt, Pseudomonas putida KT2440
gcagugccagcaa

SEQ ID NO: 1579996 - RNA, 19 nt, Pseudomonas putida KT2440
gcagugccagcaacaagcu

SEQ ID NO: 1579997 - RNA, 15 nt, Pseudomonas putida KT2440
gcagugcccagucga

SEQ ID NO: 1579998 - RNA, 18 nt, Pseudomonas putida KT2440
gcagugcccagucgaugg

SEQ ID NO: 1579999 - RNA, 23 nt, Pseudomonas putida KT2440
gcagugcccccgucagcggcaac

SEQ ID NO: 1580000 - RNA, 21 nt, Pseudomonas putida KT2440
gcagugccgugaguggccucg

SEQ ID NO: 1580001 - RNA, 15 nt, Pseudomonas putida KT2440
gcagugccguggcag

SEQ ID NO: 1580002 - RNA, 18 nt, Pseudomonas putida KT2440
gcauaacgccccagcagu

SEQ ID NO: 1580003 - RNA, 18 nt, Pseudomonas putida KT2440
gcaguuggcugccggccu

SEQ ID NO: 1580004 - RNA, 22 nt, Pseudomonas putida KT2440
gcaguuucuuuuaccgguugca

SEQ ID NO: 1580005 - RNA, 15 nt, Pseudomonas putida KT2440
gcaguugcugcugcc

SEQ ID NO: 1580006 - RNA, 16 nt, Pseudomonas putida KT2440
gcaguucgcggucgcc

SEQ ID NO: 1580007 - RNA, 16 nt, Pseudomonas putida KT2440
gcaguucgagcgccug

SEQ ID NO: 1580008 - RNA, 13 nt, Pseudomonas putida KT2440
gcaugaacagcgc

SEQ ID NO: 1580009 - RNA, 19 nt, Pseudomonas putida KT2440
gcaugaaggacaucaccag

SEQ ID NO: 1580010 - RNA, 14 nt, Pseudomonas putida KT2440
gcaugaaggcccag

SEQ ID NO: 1580011 - RNA, 22 nt, Pseudomonas putida KT2440
gcaucugcaccaggaagcuggg

SEQ ID NO: 1580012 - RNA, 19 nt, Pseudomonas putida KT2440
gcaucugcgccccgcucgc

SEQ ID NO: 1580013 - RNA, 19 nt, Pseudomonas putida KT2440
gcaucugcugcggcaggcu

SEQ ID NO: 1580014 - RNA, 17 nt, Pseudomonas putida KT2440
gcaugacgacguugcgc

SEQ ID NO: 1580015 - RNA, 16 nt, Pseudomonas putida KT2440
gcaugagccuggccgg

SEQ ID NO: 1580016 - RNA, 17 nt, Pseudomonas putida KT2440
gcaugagccuggccggu

SEQ ID NO: 1580017 - RNA, 19 nt, Pseudomonas putida KT2440
gcaugagccuggccggugu

SEQ ID NO: 1580018 - RNA, 22 nt, Pseudomonas putida KT2440
gcaugaugaaguggcgcaggcu

SEQ ID NO: 1580019 - RNA, 19 nt, Pseudomonas putida KT2440
gcaugcgcgacagcaucau

SEQ ID NO: 1580020 - RNA, 11 nt, Pseudomonas putida KT2440
gcaugcgcacg

SEQ ID NO: 1580021 - RNA, 15 nt, Pseudomonas putida KT2440
gcaugcgaagccgcc

SEQ ID NO: 1580022 - RNA, 16 nt, Pseudomonas putida KT2440
gcaugcaucagggucu

SEQ ID NO: 1580023 - RNA, 16 nt, Pseudomonas putida KT2440
gcaugcaugcguugca

SEQ ID NO: 1580024 - RNA, 21 nt, Pseudomonas putida KT2440
gcaugcaggucgaccugccag

SEQ ID NO: 1580025 - RNA, 14 nt, Pseudomonas putida KT2440
gcaugcaacccgca

SEQ ID NO: 1580026 - RNA, 17 nt, Pseudomonas putida KT2440
gcaugauugcgggcuuu

SEQ ID NO: 1580027 - RNA, 18 nt, Pseudomonas putida KT2440
gcaugcccaguucgcgug

SEQ ID NO: 1580028 - RNA, 16 nt, Pseudomonas putida KT2440
gcaugcccagcgccac

SEQ ID NO: 1580029 - RNA, 22 nt, Pseudomonas putida KT2440
gcaugccccucgaacagcgccg

SEQ ID NO: 1580030 - RNA, 20 nt, Pseudomonas putida KT2440
gcaugcccgcucccacaggu

SEQ ID NO: 1580031 - RNA, 23 nt, Pseudomonas putida KT2440
gcaugcccgcucccacaggucca

SEQ ID NO: 1580032 - RNA, 15 nt, Pseudomonas putida KT2440
gcaugcccgcgcaaa

SEQ ID NO: 1580033 - RNA, 16 nt, Pseudomonas putida KT2440
gcaugugcacuggcag

SEQ ID NO: 1580034 - RNA, 15 nt, Pseudomonas putida KT2440
gcauguucaggucgu

SEQ ID NO: 1580035 - RNA, 21 nt, Pseudomonas putida KT2440
gcaugucaggggugccuucga

SEQ ID NO: 1580036 - RNA, 15 nt, Pseudomonas putida KT2440
gcauguccugcugca

SEQ ID NO: 1580037 - RNA, 17 nt, Pseudomonas putida KT2440
gcauguacucuucgacg

SEQ ID NO: 1580038 - RNA, 18 nt, Pseudomonas putida KT2440
gcauguagccacgcugcc

SEQ ID NO: 1580039 - RNA, 19 nt, Pseudomonas putida KT2440
gcauuacgcggcagcagca

SEQ ID NO: 1580040 - RNA, 18 nt, Pseudomonas putida KT2440
gcauuaccagcaccauca

SEQ ID NO: 1580041 - RNA, 15 nt, Pseudomonas putida KT2440
gcauucccggcgcca

SEQ ID NO: 1580042 - RNA, 19 nt, Pseudomonas putida KT2440
gcauggcgugcccggcaau

SEQ ID NO: 1580043 - RNA, 17 nt, Pseudomonas putida KT2440
gcauggcguuguccagc

SEQ ID NO: 1580044 - RNA, 20 nt, Pseudomonas putida KT2440
gcauggcguuguccagcagg

SEQ ID NO: 1580045 - RNA, 17 nt, Pseudomonas putida KT2440
gcauggcucaacuggca

SEQ ID NO: 1580046 - RNA, 15 nt, Pseudomonas putida KT2440
gcauggcgucggcga

SEQ ID NO: 1580047 - RNA, 15 nt, Pseudomonas putida KT2440
gcaugggugagcacg

SEQ ID NO: 1580048 - RNA, 21 nt, Pseudomonas putida KT2440
gcauggucacguagaacaggc

SEQ ID NO: 1580049 - RNA, 23 nt, Pseudomonas putida KT2440
gcauggucacguagaacaggccu

SEQ ID NO: 1580050 - RNA, 18 nt, Pseudomonas putida KT2440
gcauggaagggcggguug

SEQ ID NO: 1580051 - RNA, 17 nt, Pseudomonas putida KT2440
gcauggcaaucaaugac

SEQ ID NO: 1580052 - RNA, 15 nt, Pseudomonas putida KT2440
gcauggccaguuccu

SEQ ID NO: 1580053 - RNA, 20 nt, Pseudomonas putida KT2440
gcauggccaguuccuggcac

SEQ ID NO: 1580054 - RNA, 17 nt, Pseudomonas putida KT2440
gcaugcugccaggcaaa

SEQ ID NO: 1580055 - RNA, 20 nt, Pseudomonas putida KT2440
gcauggcggcaccgaaggca

SEQ ID NO: 1580056 - RNA, 21 nt, Pseudomonas putida KT2440
gcauggccgaaaccagccccu

SEQ ID NO: 1580057 - RNA, 21 nt, Pseudomonas putida KT2440
gcauggccagccggcagcaag

SEQ ID NO: 1580058 - RNA, 13 nt, Pseudomonas putida KT2440
gccaaugaucgag

SEQ ID NO: 1580059 - RNA, 20 nt, Pseudomonas putida KT2440
gccaaugaucgagcgcaccu

SEQ ID NO: 1580060 - RNA, 13 nt, Pseudomonas putida KT2440
gccaaucaucgcc

SEQ ID NO: 1580061 - RNA, 19 nt, Pseudomonas putida KT2440
gccaaucaucgccagcagc

SEQ ID NO: 1580062 - RNA, 15 nt, Pseudomonas putida KT2440
gccaaggcgcauccu

SEQ ID NO: 1580063 - RNA, 17 nt, Pseudomonas putida KT2440
gccaauaccgcgcauca

SEQ ID NO: 1580064 - RNA, 18 nt, Pseudomonas putida KT2440
gccacaccugccaggcca

SEQ ID NO: 1580065 - RNA, 17 nt, Pseudomonas putida KT2440
gccacaccacagcugca

SEQ ID NO: 1580066 - RNA, 20 nt, Pseudomonas putida KT2440
gccacaccacagcugcacau

SEQ ID NO: 1580067 - RNA, 17 nt, Pseudomonas putida KT2440
gccacaauggcgcacag

SEQ ID NO: 1580068 - RNA, 12 nt, Pseudomonas putida KT2440
gccaacggcacu

SEQ ID NO: 1580069 - RNA, 15 nt, Pseudomonas putida KT2440
gccaacggcaucacg

SEQ ID NO: 1580070 - RNA, 22 nt, Pseudomonas putida KT2440
gccaacggcaucacgcuggcca

SEQ ID NO: 1580071 - RNA, 17 nt, Pseudomonas putida KT2440
gccaacggucgaucagc

SEQ ID NO: 1580072 - RNA, 12 nt, Pseudomonas putida KT2440
gccaacgggaua

SEQ ID NO: 1580073 - RNA, 15 nt, Pseudomonas putida KT2440
gccaacgcugcucgg

SEQ ID NO: 1580074 - RNA, 16 nt, Pseudomonas putida KT2440
gccaagcgccgucgaa

SEQ ID NO: 1580075 - RNA, 15 nt, Pseudomonas putida KT2440
gccaagcgacgugca

SEQ ID NO: 1580076 - RNA, 20 nt, Pseudomonas putida KT2440
gccaagccgcugccacaggu

SEQ ID NO: 1580077 - RNA, 16 nt, Pseudomonas putida KT2440
gccaaccccuccuuca

SEQ ID NO: 1580078 - RNA, 16 nt, Pseudomonas putida KT2440
gccaacccgaucccga

SEQ ID NO: 1580079 - RNA, 14 nt, Pseudomonas putida KT2440
gccaacgauuggca

SEQ ID NO: 1580080 - RNA, 19 nt, Pseudomonas putida KT2440
gccaacgccccacccgcuc

SEQ ID NO: 1580081 - RNA, 16 nt, Pseudomonas putida KT2440
gcauugcaggccagcg

SEQ ID NO: 1580082 - RNA, 17 nt, Pseudomonas putida KT2440
gcauucuucuccaacug

SEQ ID NO: 1580083 - RNA, 18 nt, Pseudomonas putida KT2440
gcauucgcgggugaaccc

SEQ ID NO: 1580084 - RNA, 22 nt, Pseudomonas putida KT2440
gcauucgcgggugaacccgcuc

SEQ ID NO: 1580085 - RNA, 15 nt, Pseudomonas putida KT2440
gcauuggguggcccc

SEQ ID NO: 1580086 - RNA, 23 nt, Pseudomonas putida KT2440
gccaaaaaaaccccagggcaucg

SEQ ID NO: 1580087 - RNA, 16 nt, Pseudomonas putida KT2440
gccaaccacgccugcg

SEQ ID NO: 1580088 - RNA, 18 nt, Pseudomonas putida KT2440
gccaacacccucacccac

SEQ ID NO: 1580089 - RNA, 19 nt, Pseudomonas putida KT2440
gccaaauucgaccagcagu

SEQ ID NO: 1580090 - RNA, 14 nt, Pseudomonas putida KT2440
gccaaagccugagc

SEQ ID NO: 1580091 - RNA, 18 nt, Pseudomonas putida KT2440
gccaaaguccggcgaagc

SEQ ID NO: 1580092 - RNA, 21 nt, Pseudomonas putida KT2440
gccaaaccguccagguagcgc

SEQ ID NO: 1580093 - RNA, 21 nt, Pseudomonas putida KT2440
gccaaaccucaaaugcgcccu

SEQ ID NO: 1580094 - RNA, 16 nt, Pseudomonas putida KT2440
gccaaaaggcccgaaa

SEQ ID NO: 1580095 - RNA, 21 nt, Pseudomonas putida KT2440
gaaacugucguuuggcgcgau

SEQ ID NO: 1580096 - RNA, 16 nt, Pseudomonas putida KT2440
gaaagcaagguagcgg

SEQ ID NO: 1580097 - RNA, 19 nt, Pseudomonas putida KT2440
gaaagccacugcaccaaug

SEQ ID NO: 1580098 - RNA, 15 nt, Pseudomonas putida KT2440
gaaagcgauugccca

SEQ ID NO: 1580099 - RNA, 16 nt, Pseudomonas putida KT2440
gaaagucgaccagcag

SEQ ID NO: 1580100 - RNA, 20 nt, Pseudomonas putida KT2440
gaaagggccaguacaggcaa

SEQ ID NO: 1580101 - RNA, 14 nt, Pseudomonas putida KT2440
gaaaggggcgcaau

SEQ ID NO: 1580102 - RNA, 16 nt, Pseudomonas putida KT2440
gaaaguccaucugcuu

SEQ ID NO: 1580103 - RNA, 14 nt, Pseudomonas putida KT2440
cuuguuggucaggc

SEQ ID NO: 1580104 - RNA, 14 nt, Pseudomonas putida KT2440
cuugugccgcggcu

SEQ ID NO: 1580105 - RNA, 19 nt, Pseudomonas putida KT2440
cuuguagcggucgaacaug

SEQ ID NO: 1580106 - RNA, 17 nt, Pseudomonas putida KT2440
cuuguaggagcggguuu

SEQ ID NO: 1580107 - RNA, 16 nt, Pseudomonas putida KT2440
cuuguaggccauuucc

SEQ ID NO: 1580108 - RNA, 13 nt, Pseudomonas putida KT2440
cuuguucagcugg

SEQ ID NO: 1580109 - RNA, 23 nt, Pseudomonas putida KT2440
cuugugcugcgaguucaggcgcc

SEQ ID NO: 1580110 - RNA, 19 nt, Pseudomonas putida KT2440
gaaacgauacuccggcaac

SEQ ID NO: 1580111 - RNA, 15 nt, Pseudomonas putida KT2440
gaaacgccacgccca

SEQ ID NO: 1580112 - RNA, 23 nt, Pseudomonas putida KT2440
gaaacgccaggcacccagccagc

SEQ ID NO: 1580113 - RNA, 20 nt, Pseudomonas putida KT2440
gaacagcucuggcagcagug

SEQ ID NO: 1580114 - RNA, 13 nt, Pseudomonas putida KT2440
gaacagccagaug

SEQ ID NO: 1580115 - RNA, 20 nt, Pseudomonas putida KT2440
gaacagcuggauggucacgc

SEQ ID NO: 1580116 - RNA, 20 nt, Pseudomonas putida KT2440
gaacaucaggucugccagug

SEQ ID NO: 1580117 - RNA, 18 nt, Pseudomonas putida KT2440
gaacagucauccagaaag

SEQ ID NO: 1580118 - RNA, 19 nt, Pseudomonas putida KT2440
gaacaccaguucgccaucg

SEQ ID NO: 1580119 - RNA, 21 nt, Pseudomonas putida KT2440
gaacaccacugucagccagcg

SEQ ID NO: 1580120 - RNA, 22 nt, Pseudomonas putida KT2440
gaacagcaacacauacuccacc

SEQ ID NO: 1580121 - RNA, 16 nt, Pseudomonas putida KT2440
gaacagcacgauggcg

SEQ ID NO: 1580122 - RNA, 16 nt, Pseudomonas putida KT2440
gaacagcacugccagc

SEQ ID NO: 1580123 - RNA, 11 nt, Pseudomonas putida KT2440
gaacagcagca

SEQ ID NO: 1580124 - RNA, 16 nt, Pseudomonas putida KT2440
gaacaccaccgcgaaa

SEQ ID NO: 1580125 - RNA, 15 nt, Pseudomonas putida KT2440
gaaauccaccagcuc

SEQ ID NO: 1580126 - RNA, 12 nt, Pseudomonas putida KT2440
gaacgccccgaa

SEQ ID NO: 1580127 - RNA, 18 nt, Pseudomonas putida KT2440
gaacgauucugccagcuc

SEQ ID NO: 1580128 - RNA, 22 nt, Pseudomonas putida KT2440
gaacgcaaggguaauggcgaag

SEQ ID NO: 1580129 - RNA, 14 nt, Pseudomonas putida KT2440
gaaccgccagcacc

SEQ ID NO: 1580130 - RNA, 15 nt, Pseudomonas putida KT2440
gaaccgccagcacca

SEQ ID NO: 1580131 - RNA, 14 nt, Pseudomonas putida KT2440
gaaccgcuccgggu

SEQ ID NO: 1580132 - RNA, 15 nt, Pseudomonas putida KT2440
gaacauggccgagcu

SEQ ID NO: 1580133 - RNA, 16 nt, Pseudomonas putida KT2440
gaaccuguugaagcga

SEQ ID NO: 1580134 - RNA, 16 nt, Pseudomonas putida KT2440
gaacuuguuggccacc

SEQ ID NO: 1580135 - RNA, 23 nt, Pseudomonas putida KT2440
gaacuucuucgggucuucggcgu

SEQ ID NO: 1580136 - RNA, 20 nt, Pseudomonas putida KT2440
gaacuuccaguccgccucgu

SEQ ID NO: 1580137 - RNA, 21 nt, Pseudomonas putida KT2440
gaacuuacuucggcgguugca

SEQ ID NO: 1580138 - RNA, 13 nt, Pseudomonas putida KT2440
gaagaagaucagg

SEQ ID NO: 1580139 - RNA, 18 nt, Pseudomonas putida KT2440
gaagaccgccgcccaggu

SEQ ID NO: 1580140 - RNA, 19 nt, Pseudomonas putida KT2440
gaagaccgccgcccagguc

SEQ ID NO: 1580141 - RNA, 18 nt, Pseudomonas putida KT2440
gaacucuuccagcucgcu

SEQ ID NO: 1580142 - RNA, 15 nt, Pseudomonas putida KT2440
gaacggcuucgaugu

SEQ ID NO: 1580143 - RNA, 22 nt, Pseudomonas putida KT2440
gaacggcgcauccaccacgaac

SEQ ID NO: 1580144 - RNA, 16 nt, Pseudomonas putida KT2440
gaacggcgccagcagu

SEQ ID NO: 1580145 - RNA, 17 nt, Pseudomonas putida KT2440
gaacggcgccagcagug

SEQ ID NO: 1580146 - RNA, 22 nt, Pseudomonas putida KT2440
gaaucagccagccuucgccaac

SEQ ID NO: 1580147 - RNA, 12 nt, Pseudomonas putida KT2440
gaauagccgguc

SEQ ID NO: 1580148 - RNA, 19 nt, Pseudomonas putida KT2440
gaauagcgcacugagcaac

SEQ ID NO: 1580149 - RNA, 15 nt, Pseudomonas putida KT2440
gaauagcaagcgcca

SEQ ID NO: 1580150 - RNA, 15 nt, Pseudomonas putida KT2440
gaauggcccagccag

SEQ ID NO: 1580151 - RNA, 19 nt, Pseudomonas putida KT2440
gaaucggcuccaggcacag

SEQ ID NO: 1580152 - RNA, 19 nt, Pseudomonas putida KT2440
gaaucgcucaugccccgca

SEQ ID NO: 1580153 - RNA, 19 nt, Pseudomonas putida KT2440
gaagguggccggcaacggc

SEQ ID NO: 1580154 - RNA, 14 nt, Pseudomonas putida KT2440
gaagguugagcagu

SEQ ID NO: 1580155 - RNA, 23 nt, Pseudomonas putida KT2440
gaagguguucaccacgcccugca

SEQ ID NO: 1580156 - RNA, 18 nt, Pseudomonas putida KT2440
gaagucaggggaaucccg

SEQ ID NO: 1580157 - RNA, 19 nt, Pseudomonas putida KT2440
gaagucaggggaaucccgc

SEQ ID NO: 1580158 - RNA, 17 nt, Pseudomonas putida KT2440
gaagucgaacuugacgu

SEQ ID NO: 1580159 - RNA, 19 nt, Pseudomonas putida KT2440
gaagucgcacaugaagccg

SEQ ID NO: 1580160 - RNA, 23 nt, Pseudomonas putida KT2440
gaagucagccagguuuuugaugu

SEQ ID NO: 1580161 - RNA, 23 nt, Pseudomonas putida KT2440
gaagucaccgaacucguugacca

SEQ ID NO: 1580162 - RNA, 15 nt, Pseudomonas putida KT2440
gaaguacucggcacg

SEQ ID NO: 1580163 - RNA, 18 nt, Pseudomonas putida KT2440
gaaggccguaggccaggu

SEQ ID NO: 1580164 - RNA, 21 nt, Pseudomonas putida KT2440
gaaggccucgccguacucggu

SEQ ID NO: 1580165 - RNA, 14 nt, Pseudomonas putida KT2440
gaaggggccgcaaa

SEQ ID NO: 1580166 - RNA, 15 nt, Pseudomonas putida KT2440
gaaggggccggcaca

SEQ ID NO: 1580167 - RNA, 15 nt, Pseudomonas putida KT2440
gaaggcgucacccgc

SEQ ID NO: 1580168 - RNA, 17 nt, Pseudomonas putida KT2440
gaaggcgucacccgcgc

SEQ ID NO: 1580169 - RNA, 14 nt, Pseudomonas putida KT2440
gaagcgcgccuggu

SEQ ID NO: 1580170 - RNA, 20 nt, Pseudomonas putida KT2440
gaagcgggcgugcccgcgaa

SEQ ID NO: 1580171 - RNA, 23 nt, Pseudomonas putida KT2440
gaagcggcugccuacccaggcaa

SEQ ID NO: 1580172 - RNA, 18 nt, Pseudomonas putida KT2440
gaagcggccgaggccgau

SEQ ID NO: 1580173 - RNA, 14 nt, Pseudomonas putida KT2440
gaagcgaccgguuu

SEQ ID NO: 1580174 - RNA, 22 nt, Pseudomonas putida KT2440
gaagccuacaaagcgcucgaag

SEQ ID NO: 1580175 - RNA, 23 nt, Pseudomonas putida KT2440
gaagccuggugaguggcccugga

SEQ ID NO: 1580176 - RNA, 13 nt, Pseudomonas putida KT2440
gaagccuucacgg

SEQ ID NO: 1580177 - RNA, 19 nt, Pseudomonas putida KT2440
gaagccuuggccuuggcag

SEQ ID NO: 1580178 - RNA, 21 nt, Pseudomonas putida KT2440
gaagcuucaugaaaaacccgg

SEQ ID NO: 1580179 - RNA, 18 nt, Pseudomonas putida KT2440
gaaggaacgacuugaugu

SEQ ID NO: 1580180 - RNA, 14 nt, Pseudomonas putida KT2440
gaaggacaucacca

SEQ ID NO: 1580181 - RNA, 19 nt, Pseudomonas putida KT2440
gaaggcaaucgcgcccggu

SEQ ID NO: 1580182 - RNA, 11 nt, Pseudomonas putida KT2440
gaagcuggccg

SEQ ID NO: 1580183 - RNA, 14 nt, Pseudomonas putida KT2440
gaagcuaucgccag

SEQ ID NO: 1580184 - RNA, 20 nt, Pseudomonas putida KT2440
gaagcggucguuacccaggu

SEQ ID NO: 1580185 - RNA, 19 nt, Pseudomonas putida KT2440
gaagcggucguugaugcgc

SEQ ID NO: 1580186 - RNA, 22 nt, Pseudomonas putida KT2440
gaagcaggccgaguaaccggcg

SEQ ID NO: 1580187 - RNA, 15 nt, Pseudomonas putida KT2440
gaagcaccgccacaa

SEQ ID NO: 1580188 - RNA, 16 nt, Pseudomonas putida KT2440
gaagcaagcgcauggu

SEQ ID NO: 1580189 - RNA, 17 nt, Pseudomonas putida KT2440
gaagcaagcgcauggug

SEQ ID NO: 1580190 - RNA, 14 nt, Pseudomonas putida KT2440
gaagaucaggucgc

SEQ ID NO: 1580191 - RNA, 20 nt, Pseudomonas putida KT2440
gaagaucagguucagcagga

SEQ ID NO: 1580192 - RNA, 19 nt, Pseudomonas putida KT2440
gaagaggccccgacagcaa

SEQ ID NO: 1580193 - RNA, 19 nt, Pseudomonas putida KT2440
gaagaggcccgucaggcaa

SEQ ID NO: 1580194 - RNA, 14 nt, Pseudomonas putida KT2440
gaagagguccugac

SEQ ID NO: 1580195 - RNA, 20 nt, Pseudomonas putida KT2440
gaagagguccugacaggcuu

SEQ ID NO: 1580196 - RNA, 21 nt, Pseudomonas putida KT2440
gaagaggccggaccugcuggc

SEQ ID NO: 1580197 - RNA, 19 nt, Pseudomonas putida KT2440
gaagaggccggcacaggaa

SEQ ID NO: 1580198 - RNA, 18 nt, Pseudomonas putida KT2440
gaagccaagcgccgucga

SEQ ID NO: 1580199 - RNA, 15 nt, Pseudomonas putida KT2440
gaagcccugcugcug

SEQ ID NO: 1580200 - RNA, 18 nt, Pseudomonas putida KT2440
gaagcccugcugcuggca

SEQ ID NO: 1580201 - RNA, 20 nt, Pseudomonas putida KT2440
gaagccauaucccgccaggu

SEQ ID NO: 1580202 - RNA, 17 nt, Pseudomonas putida KT2440
gaagccggcauggcggu

SEQ ID NO: 1580203 - RNA, 15 nt, Pseudomonas putida KT2440
gacagccucaaggcc

SEQ ID NO: 1580204 - RNA, 17 nt, Pseudomonas putida KT2440
aacgacagcuuguugcc

SEQ ID NO: 1580205 - RNA, 14 nt, Pseudomonas putida KT2440
gaauggcgcaccga

SEQ ID NO: 1580206 - RNA, 18 nt, Pseudomonas putida KT2440
gaauggccuuuacaccga

SEQ ID NO: 1580207 - RNA, 14 nt, Pseudomonas putida KT2440
gaauggguggcagc

SEQ ID NO: 1580208 - RNA, 15 nt, Pseudomonas putida KT2440
gaaugugcucggccu

SEQ ID NO: 1580209 - RNA, 18 nt, Pseudomonas putida KT2440
gaauuacgcaggcuccaa

SEQ ID NO: 1580210 - RNA, 15 nt, Pseudomonas putida KT2440
gaauuccuugcuggu

SEQ ID NO: 1580211 - RNA, 23 nt, Pseudomonas putida KT2440
gaauucgagcuggucaucgucca

SEQ ID NO: 1580212 - RNA, 20 nt, Pseudomonas putida KT2440
gacagcaucaucaggccgau

SEQ ID NO: 1580213 - RNA, 19 nt, Pseudomonas putida KT2440
gacauuguaggcggcaagg

SEQ ID NO: 1580214 - RNA, 15 nt, Pseudomonas putida KT2440
gacauugaucggcgu

SEQ ID NO: 1580215 - RNA, 20 nt, Pseudomonas putida KT2440
gacaguggaaacgacaaggu

SEQ ID NO: 1580216 - RNA, 15 nt, Pseudomonas putida KT2440
gacagugcccgcuga

SEQ ID NO: 1580217 - RNA, 18 nt, Pseudomonas putida KT2440
gacagguaguuggccggg

SEQ ID NO: 1580218 - RNA, 17 nt, Pseudomonas putida KT2440
gacaggucggcgauggu

SEQ ID NO: 1580219 - RNA, 16 nt, Pseudomonas putida KT2440
gacagguccaccgcuu

SEQ ID NO: 1580220 - RNA, 22 nt, Pseudomonas putida KT2440
gacagguccauguugugcuggc

SEQ ID NO: 1580221 - RNA, 23 nt, Pseudomonas putida KT2440
gacagguccauguugugcuggcg

SEQ ID NO: 1580222 - RNA, 16 nt, Pseudomonas putida KT2440
gacaggugccucugcu

SEQ ID NO: 1580223 - RNA, 22 nt, Pseudomonas putida KT2440
gacaggugcggcagcucgccgu

SEQ ID NO: 1580224 - RNA, 21 nt, Pseudomonas putida KT2440
gaccaacaggcuggcaucgcc

SEQ ID NO: 1580225 - RNA, 11 nt, Pseudomonas putida KT2440
gaccaccugcc

SEQ ID NO: 1580226 - RNA, 17 nt, Pseudomonas putida KT2440
gaccaccugcucggcgc

SEQ ID NO: 1580227 - RNA, 13 nt, Pseudomonas putida KT2440
aacgcaggcucug

SEQ ID NO: 1580228 - RNA, 12 nt, Pseudomonas putida KT2440
aacgcagcgccg

SEQ ID NO: 1580229 - RNA, 14 nt, Pseudomonas putida KT2440
gaccacgccgaagc

SEQ ID NO: 1580230 - RNA, 12 nt, Pseudomonas putida KT2440
gaccacgaugcc

SEQ ID NO: 1580231 - RNA, 23 nt, Pseudomonas putida KT2440
gaccacgaugccuucgaccacca

SEQ ID NO: 1580232 - RNA, 19 nt, Pseudomonas putida KT2440
aacgcaaugggcacaauug

SEQ ID NO: 1580233 - RNA, 15 nt, Pseudomonas putida KT2440
gaccacgguaccggc

SEQ ID NO: 1580234 - RNA, 21 nt, Pseudomonas putida KT2440
aacgcccuucauacagcgccu

SEQ ID NO: 1580235 - RNA, 14 nt, Pseudomonas putida KT2440
gaccaggugcaggu

SEQ ID NO: 1580236 - RNA, 14 nt, Pseudomonas putida KT2440
gaccaucagccugu

SEQ ID NO: 1580237 - RNA, 23 nt, Pseudomonas putida KT2440
gaccaucggcaggcgguccagca

SEQ ID NO: 1580238 - RNA, 15 nt, Pseudomonas putida KT2440
aacgcgccgcugccu

SEQ ID NO: 1580239 - RNA, 19 nt, Pseudomonas putida KT2440
aacgcgccauggccuggcg

SEQ ID NO: 1580240 - RNA, 24 nt, Pseudomonas putida KT2440
aacgcgauauucagugcgcaggua

SEQ ID NO: 1580241 - RNA, 19 nt, Pseudomonas putida KT2440
gaccaggcauuguugcaac

SEQ ID NO: 1580242 - RNA, 19 nt, Pseudomonas putida KT2440
gaccagcggaucaccgacg

SEQ ID NO: 1580243 - RNA, 17 nt, Pseudomonas putida KT2440
gaccugauacacccgcu

SEQ ID NO: 1580244 - RNA, 16 nt, Pseudomonas putida KT2440
gaccucuuagcgggca

SEQ ID NO: 1580245 - RNA, 23 nt, Pseudomonas putida KT2440
gaccuggcucuucaacaccagca

SEQ ID NO: 1580246 - RNA, 18 nt, Pseudomonas putida KT2440
gaccuuguucaucgcauu

SEQ ID NO: 1580247 - RNA, 14 nt, Pseudomonas putida KT2440
gaccuggaucgcca

SEQ ID NO: 1580248 - RNA, 16 nt, Pseudomonas putida KT2440
gaccuggaucgccagg

SEQ ID NO: 1580249 - RNA, 16 nt, Pseudomonas putida KT2440
gaccgguggcgccuug

SEQ ID NO: 1580250 - RNA, 20 nt, Pseudomonas putida KT2440
aacggcuugaacccgugcau

SEQ ID NO: 1580251 - RNA, 19 nt, Pseudomonas putida KT2440
gaccguguugcagcggguu

SEQ ID NO: 1580252 - RNA, 16 nt, Pseudomonas putida KT2440
gaccguuucauugccg

SEQ ID NO: 1580253 - RNA, 17 nt, Pseudomonas putida KT2440
gaccguuucauugccgu

SEQ ID NO: 1580254 - RNA, 19 nt, Pseudomonas putida KT2440
aacggucacugagccaggc

SEQ ID NO: 1580255 - RNA, 21 nt, Pseudomonas putida KT2440
aacggucagacgcggaacugg

SEQ ID NO: 1580256 - RNA, 14 nt, Pseudomonas putida KT2440
aacggcuggcgcau

SEQ ID NO: 1580257 - RNA, 16 nt, Pseudomonas putida KT2440
gaccgagaacaggcgg

SEQ ID NO: 1580258 - RNA, 18 nt, Pseudomonas putida KT2440
gaccgagaacaggcggcc

SEQ ID NO: 1580259 - RNA, 23 nt, Pseudomonas putida KT2440
gaccgcacuccccaucagcagcu

SEQ ID NO: 1580260 - RNA, 20 nt, Pseudomonas putida KT2440
aacgcuguuggcagccacga

SEQ ID NO: 1580261 - RNA, 13 nt, Pseudomonas putida KT2440
gaccgccugcgca

SEQ ID NO: 1580262 - RNA, 15 nt, Pseudomonas putida KT2440
gaccgcuguuaccag

SEQ ID NO: 1580263 - RNA, 14 nt, Pseudomonas putida KT2440
gaccggccgggcuu

SEQ ID NO: 1580264 - RNA, 15 nt, Pseudomonas putida KT2440
gaccggccgggcuuc

SEQ ID NO: 1580265 - RNA, 14 nt, Pseudomonas putida KT2440
gaccggguccagca

SEQ ID NO: 1580266 - RNA, 16 nt, Pseudomonas putida KT2440
gaccggucagcccggc

SEQ ID NO: 1580267 - RNA, 17 nt, Pseudomonas putida KT2440
aacggcggauguuggcc

SEQ ID NO: 1580268 - RNA, 20 nt, Pseudomonas putida KT2440
cugcuucgcgggcacgcccg

SEQ ID NO: 1580269 - RNA, 14 nt, Pseudomonas putida KT2440
cugcuucagcucga

SEQ ID NO: 1580270 - RNA, 20 nt, Pseudomonas putida KT2440
cugcuguggaacagccuugu

SEQ ID NO: 1580271 - RNA, 16 nt, Pseudomonas putida KT2440
cugcugguucaucgac

SEQ ID NO: 1580272 - RNA, 22 nt, Pseudomonas putida KT2440
cugcugguucaucgacuggaug

SEQ ID NO: 1580273 - RNA, 15 nt, Pseudomonas putida KT2440
cugcugucggucagg

SEQ ID NO: 1580274 - RNA, 18 nt, Pseudomonas putida KT2440
cugcuggcgcgaccauca

SEQ ID NO: 1580275 - RNA, 23 nt, Pseudomonas putida KT2440
cugcuggcgcgaccaucaccgcc

SEQ ID NO: 1580276 - RNA, 14 nt, Pseudomonas putida KT2440
cugcugggcgauga

SEQ ID NO: 1580277 - RNA, 14 nt, Pseudomonas putida KT2440
cugcuggccgcgca

SEQ ID NO: 1580278 - RNA, 17 nt, Pseudomonas putida KT2440
cugcuggcccgcgaugc

SEQ ID NO: 1580279 - RNA, 19 nt, Pseudomonas putida KT2440
cugcuggauacccagcgcc

SEQ ID NO: 1580280 - RNA, 18 nt, Pseudomonas putida KT2440
cuggaauuauuggccagc

SEQ ID NO: 1580281 - RNA, 19 nt, Pseudomonas putida KT2440
cuggaauuauuggccagca

SEQ ID NO: 1580282 - RNA, 16 nt, Pseudomonas putida KT2440
cuggacaccucccgcg

SEQ ID NO: 1580283 - RNA, 22 nt, Pseudomonas putida KT2440
cuggaacgugcgggcuuguccg

SEQ ID NO: 1580284 - RNA, 18 nt, Pseudomonas putida KT2440
cuggaacucgaucggcac

SEQ ID NO: 1580285 - RNA, 22 nt, Pseudomonas putida KT2440
cugcuuggccgacuggcgcacc

SEQ ID NO: 1580286 - RNA, 12 nt, Pseudomonas putida KT2440
cugcuuggcacc

SEQ ID NO: 1580287 - RNA, 16 nt, Pseudomonas putida KT2440
cugcuucugccguuca

SEQ ID NO: 1580288 - RNA, 15 nt, Pseudomonas putida KT2440
cugcuugagcgcagc

SEQ ID NO: 1580289 - RNA, 21 nt, Pseudomonas putida KT2440
cugcuugagcgcagcgacgac

SEQ ID NO: 1580290 - RNA, 16 nt, Pseudomonas putida KT2440
cugcuuugcagcccuu

SEQ ID NO: 1580291 - RNA, 19 nt, Pseudomonas putida KT2440
cuggccaguuguucgucga

SEQ ID NO: 1580292 - RNA, 22 nt, Pseudomonas putida KT2440
cuggccaguuguucgucgagca

SEQ ID NO: 1580293 - RNA, 24 nt, Pseudomonas putida KT2440
cuggccaguuguucgucgagcacc

SEQ ID NO: 1580294 - RNA, 17 nt, Pseudomonas putida KT2440
cuggccauaguugacca

SEQ ID NO: 1580295 - RNA, 20 nt, Pseudomonas putida KT2440
cuggccauaguugaccagca

SEQ ID NO: 1580296 - RNA, 16 nt, Pseudomonas putida KT2440
cuggccauccagucga

SEQ ID NO: 1580297 - RNA, 13 nt, Pseudomonas putida KT2440
cuggcaucaaugc

SEQ ID NO: 1580298 - RNA, 23 nt, Pseudomonas putida KT2440
cuggccgaugcccaccuuggcgg

SEQ ID NO: 1580299 - RNA, 13 nt, Pseudomonas putida KT2440
cuggcccacccgg

SEQ ID NO: 1580300 - RNA, 14 nt, Pseudomonas putida KT2440
cuggaugcucgaua

SEQ ID NO: 1580301 - RNA, 14 nt, Pseudomonas putida KT2440
cuggauggugcgcu

SEQ ID NO: 1580302 - RNA, 15 nt, Pseudomonas putida KT2440
cuggcagcaaggcca

SEQ ID NO: 1580303 - RNA, 14 nt, Pseudomonas putida KT2440
cuggcagcagugca

SEQ ID NO: 1580304 - RNA, 14 nt, Pseudomonas putida KT2440
cuggcagcggguag

SEQ ID NO: 1580305 - RNA, 13 nt, Pseudomonas putida KT2440
cugcucgacgaag

SEQ ID NO: 1580306 - RNA, 20 nt, Pseudomonas putida KT2440
aaccgcuucaccgcgcaccu

SEQ ID NO: 1580307 - RNA, 14 nt, Pseudomonas putida KT2440
aaccgcucccaggu

SEQ ID NO: 1580308 - RNA, 12 nt, Pseudomonas putida KT2440
cugcucgcuggc

SEQ ID NO: 1580309 - RNA, 16 nt, Pseudomonas putida KT2440
cugcucgccucaccgc

SEQ ID NO: 1580310 - RNA, 17 nt, Pseudomonas putida KT2440
cugcucgaucagguuga

SEQ ID NO: 1580311 - RNA, 19 nt, Pseudomonas putida KT2440
cugcucuggcccgaacagc

SEQ ID NO: 1580312 - RNA, 12 nt, Pseudomonas putida KT2440
cugcucuucgag

SEQ ID NO: 1580313 - RNA, 21 nt, Pseudomonas putida KT2440
cugcucuucgauccgcgccau

SEQ ID NO: 1580314 - RNA, 15 nt, Pseudomonas putida KT2440
cugcucuucgccgcc

SEQ ID NO: 1580315 - RNA, 14 nt, Pseudomonas putida KT2440
cugcucuuugaucg

SEQ ID NO: 1580316 - RNA, 22 nt, Pseudomonas putida KT2440
cugcugaugcgggaccagcacc

SEQ ID NO: 1580317 - RNA, 21 nt, Pseudomonas putida KT2440
cugcugcagggcccagccacc

SEQ ID NO: 1580318 - RNA, 24 nt, Pseudomonas putida KT2440
cugcugcaguucuuccagcggcaa

SEQ ID NO: 1580319 - RNA, 17 nt, Pseudomonas putida KT2440
cugcugcauacgcacca

SEQ ID NO: 1580320 - RNA, 17 nt, Pseudomonas putida KT2440
cugcugccaaucgauca

SEQ ID NO: 1580321 - RNA, 16 nt, Pseudomonas putida KT2440
cugcugccaggccgca

SEQ ID NO: 1580322 - RNA, 19 nt, Pseudomonas putida KT2440
cugcugcggauacagcgcc

SEQ ID NO: 1580323 - RNA, 21 nt, Pseudomonas putida KT2440
cugcugcggauacagcgccca

SEQ ID NO: 1580324 - RNA, 16 nt, Pseudomonas putida KT2440
cugcugcggcaccucg

SEQ ID NO: 1580325 - RNA, 14 nt, Pseudomonas putida KT2440
cugcugcgucagca

SEQ ID NO: 1580326 - RNA, 19 nt, Pseudomonas putida KT2440
cugcguauuuuugcgccag

SEQ ID NO: 1580327 - RNA, 23 nt, Pseudomonas putida KT2440
cugcgguggucugguugaccgag

SEQ ID NO: 1580328 - RNA, 14 nt, Pseudomonas putida KT2440
cugcgucaggaccu

SEQ ID NO: 1580329 - RNA, 17 nt, Pseudomonas putida KT2440
cugcgggcugaggaagu

SEQ ID NO: 1580330 - RNA, 18 nt, Pseudomonas putida KT2440
cugcggggugcucugccg

SEQ ID NO: 1580331 - RNA, 17 nt, Pseudomonas putida KT2440
cugcggguaaugccacc

SEQ ID NO: 1580332 - RNA, 16 nt, Pseudomonas putida KT2440
cugcucagugcuggcg

SEQ ID NO: 1580333 - RNA, 17 nt, Pseudomonas putida KT2440
cugcuccacaaucucgc

SEQ ID NO: 1580334 - RNA, 12 nt, Pseudomonas putida KT2440
cugcucagccaa

SEQ ID NO: 1580335 - RNA, 12 nt, Pseudomonas putida KT2440
cugcuccaggca

SEQ ID NO: 1580336 - RNA, 13 nt, Pseudomonas putida KT2440
cugcuccaggcag

SEQ ID NO: 1580337 - RNA, 24 nt, Pseudomonas putida KT2440
cugcuccaggcagccugccagguc

SEQ ID NO: 1580338 - RNA, 17 nt, Pseudomonas putida KT2440
cugcucccgcaggggcu

SEQ ID NO: 1580339 - RNA, 19 nt, Pseudomonas putida KT2440
cugcuaaaggcauucgcgg

SEQ ID NO: 1580340 - RNA, 14 nt, Pseudomonas putida KT2440
cugcguuggccauc

SEQ ID NO: 1580341 - RNA, 22 nt, Pseudomonas putida KT2440
cugcguuggcuucuucgcgggc

SEQ ID NO: 1580342 - RNA, 11 nt, Pseudomonas putida KT2440
cugcguuguug

SEQ ID NO: 1580343 - RNA, 16 nt, Pseudomonas putida KT2440
cugcguuuaccggcac

SEQ ID NO: 1580344 - RNA, 14 nt, Pseudomonas putida KT2440
cugcgugaccgccc

SEQ ID NO: 1580345 - RNA, 20 nt, Pseudomonas putida KT2440
cugcgugcacccaaccugcc

SEQ ID NO: 1580346 - RNA, 13 nt, Pseudomonas putida KT2440
cugccgcuucgcg

SEQ ID NO: 1580347 - RNA, 21 nt, Pseudomonas putida KT2440
cugccgcuucgcggaacucgg

SEQ ID NO: 1580348 - RNA, 20 nt, Pseudomonas putida KT2440
cugccggaacguuuccagca

SEQ ID NO: 1580349 - RNA, 17 nt, Pseudomonas putida KT2440
cugccggaucuggcagc

SEQ ID NO: 1580350 - RNA, 18 nt, Pseudomonas putida KT2440
cugccggaccugccgcag

SEQ ID NO: 1580351 - RNA, 13 nt, Pseudomonas putida KT2440
cugccgcugacca

SEQ ID NO: 1580352 - RNA, 18 nt, Pseudomonas putida KT2440
cugccgcggguggcuucg

SEQ ID NO: 1580353 - RNA, 23 nt, Pseudomonas putida KT2440
cugccgccuucuccagcucgcca

SEQ ID NO: 1580354 - RNA, 15 nt, Pseudomonas putida KT2440
cugccgccuugugca

SEQ ID NO: 1580355 - RNA, 23 nt, Pseudomonas putida KT2440
cugccgcgauaagcgcgauaggg

SEQ ID NO: 1580356 - RNA, 20 nt, Pseudomonas putida KT2440
cugccgggucggccugcucg

SEQ ID NO: 1580357 - RNA, 19 nt, Pseudomonas putida KT2440
cugccggccuguugcgcac

SEQ ID NO: 1580358 - RNA, 13 nt, Pseudomonas putida KT2440
cugccgggccagg

SEQ ID NO: 1580359 - RNA, 15 nt, Pseudomonas putida KT2440
cugccgggccgggca

SEQ ID NO: 1580360 - RNA, 23 nt, Pseudomonas putida KT2440
cugccggcaaacagacggugcgc

SEQ ID NO: 1580361 - RNA, 19 nt, Pseudomonas putida KT2440
cugccggcauaacggcugg

SEQ ID NO: 1580362 - RNA, 23 nt, Pseudomonas putida KT2440
cugccggcauaacggcuggcgca

SEQ ID NO: 1580363 - RNA, 14 nt, Pseudomonas putida KT2440
cugccgcagcgauc

SEQ ID NO: 1580364 - RNA, 17 nt, Pseudomonas putida KT2440
cugccgccaaccagcuc

SEQ ID NO: 1580365 - RNA, 13 nt, Pseudomonas putida KT2440
cugccgaugcgcg

SEQ ID NO: 1580366 - RNA, 17 nt, Pseudomonas putida KT2440
cugccgaugcgcgugca

SEQ ID NO: 1580367 - RNA, 17 nt, Pseudomonas putida KT2440
cugccgaucaccgugcc

SEQ ID NO: 1580368 - RNA, 15 nt, Pseudomonas putida KT2440
cugccgcaccugccu

SEQ ID NO: 1580369 - RNA, 14 nt, Pseudomonas putida KT2440
cucuugagcuggcc

SEQ ID NO: 1580370 - RNA, 19 nt, Pseudomonas putida KT2440
cugcgauagaacuccacca

SEQ ID NO: 1580371 - RNA, 13 nt, Pseudomonas putida KT2440
cugcgacacgcga

SEQ ID NO: 1580372 - RNA, 21 nt, Pseudomonas putida KT2440
cugcgacacgcgaaucgccag

SEQ ID NO: 1580373 - RNA, 13 nt, Pseudomonas putida KT2440
cugccuugcccug

SEQ ID NO: 1580374 - RNA, 20 nt, Pseudomonas putida KT2440
cugcgaauggguggcggcaa

SEQ ID NO: 1580375 - RNA, 15 nt, Pseudomonas putida KT2440
cugccugugccggug

SEQ ID NO: 1580376 - RNA, 16 nt, Pseudomonas putida KT2440
cugccuuagaacagau

SEQ ID NO: 1580377 - RNA, 19 nt, Pseudomonas putida KT2440
cugccuuuuccugcugcaa

SEQ ID NO: 1580378 - RNA, 12 nt, Pseudomonas putida KT2440
cugccugggcac

SEQ ID NO: 1580379 - RNA, 12 nt, Pseudomonas putida KT2440
cugccugcugca

SEQ ID NO: 1580380 - RNA, 16 nt, Pseudomonas putida KT2440
cugccguuguucggca

SEQ ID NO: 1580381 - RNA, 22 nt, Pseudomonas putida KT2440
cugccguuguucggcaaaggcc

SEQ ID NO: 1580382 - RNA, 14 nt, Pseudomonas putida KT2440
cugccguuggcccg

SEQ ID NO: 1580383 - RNA, 16 nt, Pseudomonas putida KT2440
cugccuccgccaagca

SEQ ID NO: 1580384 - RNA, 17 nt, Pseudomonas putida KT2440
cugccggucggccugca

SEQ ID NO: 1580385 - RNA, 23 nt, Pseudomonas putida KT2440
cugccggugcgcgggcgucgguc

SEQ ID NO: 1580386 - RNA, 18 nt, Pseudomonas putida KT2440
cugccgguguucgcgggu

SEQ ID NO: 1580387 - RNA, 16 nt, Pseudomonas putida KT2440
cugccguucacugaug

SEQ ID NO: 1580388 - RNA, 15 nt, Pseudomonas putida KT2440
cugccgugcagguca

SEQ ID NO: 1580389 - RNA, 19 nt, Pseudomonas putida KT2440
cugccgugcaggucagcgu

SEQ ID NO: 1580390 - RNA, 14 nt, Pseudomonas putida KT2440
cugccgucucguca

SEQ ID NO: 1580391 - RNA, 20 nt, Pseudomonas putida KT2440
cugcgccgguguucgcgggc

SEQ ID NO: 1580392 - RNA, 14 nt, Pseudomonas putida KT2440
cugcgccugcgggu

SEQ ID NO: 1580393 - RNA, 15 nt, Pseudomonas putida KT2440
cugcgccucgcaggu

SEQ ID NO: 1580394 - RNA, 19 nt, Pseudomonas putida KT2440
cugcgccuugcuuggcagc

SEQ ID NO: 1580395 - RNA, 23 nt, Pseudomonas putida KT2440
cugcgcgaaguggauauccagcg

SEQ ID NO: 1580396 - RNA, 12 nt, Pseudomonas putida KT2440
cugcgcgaucgc

SEQ ID NO: 1580397 - RNA, 22 nt, Pseudomonas putida KT2440
cugcgcgauagccuguggggca

SEQ ID NO: 1580398 - RNA, 14 nt, Pseudomonas putida KT2440
cugcgcacggcgcu

SEQ ID NO: 1580399 - RNA, 14 nt, Pseudomonas putida KT2440
cugcgcagcccugu

SEQ ID NO: 1580400 - RNA, 21 nt, Pseudomonas putida KT2440
cugcgcaccggcuucgucggc

SEQ ID NO: 1580401 - RNA, 15 nt, Pseudomonas putida KT2440
cugcgcaguacaggc

SEQ ID NO: 1580402 - RNA, 21 nt, Pseudomonas putida KT2440
cugcgcagucauuuucaugca

SEQ ID NO: 1580403 - RNA, 14 nt, Pseudomonas putida KT2440
cugcgcaucacccg

SEQ ID NO: 1580404 - RNA, 18 nt, Pseudomonas putida KT2440
cugcgcaugaaacucgcg

SEQ ID NO: 1580405 - RNA, 23 nt, Pseudomonas putida KT2440
cugcgccaaaaccuguuccagcc

SEQ ID NO: 1580406 - RNA, 17 nt, Pseudomonas putida KT2440
cugcgccagccgcgggu

SEQ ID NO: 1580407 - RNA, 18 nt, Pseudomonas putida KT2440
cugcgccaggaucaacug

SEQ ID NO: 1580408 - RNA, 19 nt, Pseudomonas putida KT2440
cugcgccccgcucgccugg

SEQ ID NO: 1580409 - RNA, 12 nt, Pseudomonas putida KT2440
cugcgccaggca

SEQ ID NO: 1580410 - RNA, 22 nt, Pseudomonas putida KT2440
cugcggcagcacgaugacgaac

SEQ ID NO: 1580411 - RNA, 17 nt, Pseudomonas putida KT2440
cugcggcagauccugca

SEQ ID NO: 1580412 - RNA, 20 nt, Pseudomonas putida KT2440
cugcggcagauccugcagcc

SEQ ID NO: 1580413 - RNA, 22 nt, Pseudomonas putida KT2440
cugcggccaccgccucggcuac

SEQ ID NO: 1580414 - RNA, 17 nt, Pseudomonas putida KT2440
cugcggcaugaaggccc

SEQ ID NO: 1580415 - RNA, 21 nt, Pseudomonas putida KT2440
cugcggcccauucgcgggcaa

SEQ ID NO: 1580416 - RNA, 15 nt, Pseudomonas putida KT2440
cugcggcgaaagcca

SEQ ID NO: 1580417 - RNA, 16 nt, Pseudomonas putida KT2440
cugcggcugcucgauc

SEQ ID NO: 1580418 - RNA, 16 nt, Pseudomonas putida KT2440
cugcgggagcgggcgu

SEQ ID NO: 1580419 - RNA, 12 nt, Pseudomonas putida KT2440
cugcgcugguac

SEQ ID NO: 1580420 - RNA, 20 nt, Pseudomonas putida KT2440
cugcgcugugccgauagaca

SEQ ID NO: 1580421 - RNA, 15 nt, Pseudomonas putida KT2440
cugcgcugcccagcu

SEQ ID NO: 1580422 - RNA, 22 nt, Pseudomonas putida KT2440
cugcgcucgauccuguggaagc

SEQ ID NO: 1580423 - RNA, 19 nt, Pseudomonas putida KT2440
cugcgcuccaacuggcgca

SEQ ID NO: 1580424 - RNA, 13 nt, Pseudomonas putida KT2440
cugcgcuacaccc

SEQ ID NO: 1580425 - RNA, 21 nt, Pseudomonas putida KT2440
cugcgcgucgacaaaccgcac

SEQ ID NO: 1580426 - RNA, 14 nt, Pseudomonas putida KT2440
cugcgcggcagccc

SEQ ID NO: 1580427 - RNA, 18 nt, Pseudomonas putida KT2440
cugcgcggcagcccuucg

SEQ ID NO: 1580428 - RNA, 14 nt, Pseudomonas putida KT2440
cuucucccgggcaa

SEQ ID NO: 1580429 - RNA, 19 nt, Pseudomonas putida KT2440
cuucucgccucagcgccaa

SEQ ID NO: 1580430 - RNA, 19 nt, Pseudomonas putida KT2440
cuucucgcgcaggcggucg

SEQ ID NO: 1580431 - RNA, 19 nt, Pseudomonas putida KT2440
cuucucggcaaagcguucg

SEQ ID NO: 1580432 - RNA, 20 nt, Pseudomonas putida KT2440
cuucucggccucagccggcu

SEQ ID NO: 1580433 - RNA, 21 nt, Pseudomonas putida KT2440
cuucuggugaaagucgaccag

SEQ ID NO: 1580434 - RNA, 20 nt, Pseudomonas putida KT2440
cuucuggacaagaagcggcu

SEQ ID NO: 1580435 - RNA, 21 nt, Pseudomonas putida KT2440
cuucuguggaaaaccgcucga

SEQ ID NO: 1580436 - RNA, 15 nt, Pseudomonas putida KT2440
cuucugccagaggcg

SEQ ID NO: 1580437 - RNA, 14 nt, Pseudomonas putida KT2440
cuucucuuccgcca

SEQ ID NO: 1580438 - RNA, 20 nt, Pseudomonas putida KT2440
cuucucuuccggcagguaag

SEQ ID NO: 1580439 - RNA, 13 nt, Pseudomonas putida KT2440
cuugaagaagccu

SEQ ID NO: 1580440 - RNA, 16 nt, Pseudomonas putida KT2440
cuugaagaacaccugc

SEQ ID NO: 1580441 - RNA, 20 nt, Pseudomonas putida KT2440
cuucuucgcgggcaugcccg

SEQ ID NO: 1580442 - RNA, 20 nt, Pseudomonas putida KT2440
cuugaccaccagggacgaac

SEQ ID NO: 1580443 - RNA, 21 nt, Pseudomonas putida KT2440
cuugaccaccagggacgaacc

SEQ ID NO: 1580444 - RNA, 19 nt, Pseudomonas putida KT2440
cuugaccacuucgacaugg

SEQ ID NO: 1580445 - RNA, 19 nt, Pseudomonas putida KT2440
cuugaccauggcgaugaac

SEQ ID NO: 1580446 - RNA, 19 nt, Pseudomonas putida KT2440
cuugaagcgcggcaugccc

SEQ ID NO: 1580447 - RNA, 13 nt, Pseudomonas putida KT2440
cuugacgaugacc

SEQ ID NO: 1580448 - RNA, 20 nt, Pseudomonas putida KT2440
cuugaccucgaccaggcgcu

SEQ ID NO: 1580449 - RNA, 21 nt, Pseudomonas putida KT2440
cuuccucgaacgacagcugca

SEQ ID NO: 1580450 - RNA, 16 nt, Pseudomonas putida KT2440
cuuccuggcuggcagc

SEQ ID NO: 1580451 - RNA, 16 nt, Pseudomonas putida KT2440
cuuccugaagacgcuu

SEQ ID NO: 1580452 - RNA, 18 nt, Pseudomonas putida KT2440
cuucccgggaaaagccug

SEQ ID NO: 1580453 - RNA, 22 nt, Pseudomonas putida KT2440
cuucccggccuggcgcagguac

SEQ ID NO: 1580454 - RNA, 14 nt, Pseudomonas putida KT2440
cuucccgccuggcg

SEQ ID NO: 1580455 - RNA, 18 nt, Pseudomonas putida KT2440
cuucccgccuggcgccug

SEQ ID NO: 1580456 - RNA, 15 nt, Pseudomonas putida KT2440
cuucccgcguccagg

SEQ ID NO: 1580457 - RNA, 13 nt, Pseudomonas putida KT2440
cuucagcaguucg

SEQ ID NO: 1580458 - RNA, 16 nt, Pseudomonas putida KT2440
cuuccccccuggccug

SEQ ID NO: 1580459 - RNA, 15 nt, Pseudomonas putida KT2440
cuucagaagccuugg

SEQ ID NO: 1580460 - RNA, 18 nt, Pseudomonas putida KT2440
cuucggcgacaggugccu

SEQ ID NO: 1580461 - RNA, 12 nt, Pseudomonas putida KT2440
cuucggccaguu

SEQ ID NO: 1580462 - RNA, 17 nt, Pseudomonas putida KT2440
cuucggccagcaguucg

SEQ ID NO: 1580463 - RNA, 18 nt, Pseudomonas putida KT2440
cuucggccagcaguucgu

SEQ ID NO: 1580464 - RNA, 23 nt, Pseudomonas putida KT2440
cuucggccagcaguucgucgagc

SEQ ID NO: 1580465 - RNA, 17 nt, Pseudomonas putida KT2440
cuucgcggaaggcgacc

SEQ ID NO: 1580466 - RNA, 19 nt, Pseudomonas putida KT2440
cuucgcggcaagcccgcuc

SEQ ID NO: 1580467 - RNA, 18 nt, Pseudomonas putida KT2440
cuucgcggccaagccgcu

SEQ ID NO: 1580468 - RNA, 19 nt, Pseudomonas putida KT2440
cuucgcggaucaacccgcg

SEQ ID NO: 1580469 - RNA, 21 nt, Pseudomonas putida KT2440
cuucgcgcauuucguccaggc

SEQ ID NO: 1580470 - RNA, 20 nt, Pseudomonas putida KT2440
cuucgccggcacgcccgcuc

SEQ ID NO: 1580471 - RNA, 17 nt, Pseudomonas putida KT2440
cuucgccguacuggcug

SEQ ID NO: 1580472 - RNA, 16 nt, Pseudomonas putida KT2440
cuucgaggaugcggcu

SEQ ID NO: 1580473 - RNA, 15 nt, Pseudomonas putida KT2440
cuucgaucagcgccu

SEQ ID NO: 1580474 - RNA, 19 nt, Pseudomonas putida KT2440
cuucgauacuugcagcgga

SEQ ID NO: 1580475 - RNA, 21 nt, Pseudomonas putida KT2440
cuucgaucucggccagcaggc

SEQ ID NO: 1580476 - RNA, 14 nt, Pseudomonas putida KT2440
cuucgaugaaggcu

SEQ ID NO: 1580477 - RNA, 20 nt, Pseudomonas putida KT2440
cuugccgcuggcauccacca

SEQ ID NO: 1580478 - RNA, 12 nt, Pseudomonas putida KT2440
cuugccuuccgg

SEQ ID NO: 1580479 - RNA, 13 nt, Pseudomonas putida KT2440
cuugccuuccucg

SEQ ID NO: 1580480 - RNA, 16 nt, Pseudomonas putida KT2440
cuugcgauaccccgcu

SEQ ID NO: 1580481 - RNA, 16 nt, Pseudomonas putida KT2440
cuugccuaccugauca

SEQ ID NO: 1580482 - RNA, 17 nt, Pseudomonas putida KT2440
cuugcgcgccagcgcau

SEQ ID NO: 1580483 - RNA, 20 nt, Pseudomonas putida KT2440
cuugcgcacggccuccacca

SEQ ID NO: 1580484 - RNA, 13 nt, Pseudomonas putida KT2440
cuuguaccgagag

SEQ ID NO: 1580485 - RNA, 14 nt, Pseudomonas putida KT2440
cuuggugcgcgcau

SEQ ID NO: 1580486 - RNA, 16 nt, Pseudomonas putida KT2440
cuuggugcaccagcuu

SEQ ID NO: 1580487 - RNA, 17 nt, Pseudomonas putida KT2440
cuuggucucgaucagcg

SEQ ID NO: 1580488 - RNA, 22 nt, Pseudomonas putida KT2440
cuuggccucacauucaccgcca

SEQ ID NO: 1580489 - RNA, 14 nt, Pseudomonas putida KT2440
cuuggccugggcuu

SEQ ID NO: 1580490 - RNA, 15 nt, Pseudomonas putida KT2440
cuuggccuggggcuu

SEQ ID NO: 1580491 - RNA, 17 nt, Pseudomonas putida KT2440
cuugcgcugggcaucga

SEQ ID NO: 1580492 - RNA, 18 nt, Pseudomonas putida KT2440
cuugcggaacguuuccag

SEQ ID NO: 1580493 - RNA, 19 nt, Pseudomonas putida KT2440
cuugcggaucacuuccaug

SEQ ID NO: 1580494 - RNA, 20 nt, Pseudomonas putida KT2440
cuugcgggcccaguuccaug

SEQ ID NO: 1580495 - RNA, 17 nt, Pseudomonas putida KT2440
cuuggcccaguacgccu

SEQ ID NO: 1580496 - RNA, 19 nt, Pseudomonas putida KT2440
cuuggcccaguucuccggc

SEQ ID NO: 1580497 - RNA, 14 nt, Pseudomonas putida KT2440
cuuggccccaggga

SEQ ID NO: 1580498 - RNA, 14 nt, Pseudomonas putida KT2440
cuuggccagggccu

SEQ ID NO: 1580499 - RNA, 14 nt, Pseudomonas putida KT2440
cuugcgggucagca

SEQ ID NO: 1580500 - RNA, 18 nt, Pseudomonas putida KT2440
cuuggccgcaauggcgcc

SEQ ID NO: 1580501 - RNA, 24 nt, Pseudomonas putida KT2440
cuugccauaacuccagcgccagca

SEQ ID NO: 1580502 - RNA, 14 nt, Pseudomonas putida KT2440
cuugccaucgacca

SEQ ID NO: 1580503 - RNA, 17 nt, Pseudomonas putida KT2440
cuugcccagcuccagca

SEQ ID NO: 1580504 - RNA, 22 nt, Pseudomonas putida KT2440
cuugcacaguucgaaaaccugc

SEQ ID NO: 1580505 - RNA, 17 nt, Pseudomonas putida KT2440
cuugcacuuugccgccc

SEQ ID NO: 1580506 - RNA, 21 nt, Pseudomonas putida KT2440
cuugccaaggcuagccacggc

SEQ ID NO: 1580507 - RNA, 17 nt, Pseudomonas putida KT2440
cuugcaguuguccaggc

SEQ ID NO: 1580508 - RNA, 16 nt, Pseudomonas putida KT2440
cuugcaguaucgcccc

SEQ ID NO: 1580509 - RNA, 15 nt, Pseudomonas putida KT2440
cuugcagucaccugg

SEQ ID NO: 1580510 - RNA, 20 nt, Pseudomonas putida KT2440
cuugcagucaccuggcccac

SEQ ID NO: 1580511 - RNA, 21 nt, Pseudomonas putida KT2440
cuugcccgcgaagcagccacc

SEQ ID NO: 1580512 - RNA, 20 nt, Pseudomonas putida KT2440
cuugcccugcagcuucccgg

SEQ ID NO: 1580513 - RNA, 15 nt, Pseudomonas putida KT2440
cuugccgagcagcgc

SEQ ID NO: 1580514 - RNA, 17 nt, Pseudomonas putida KT2440
cuugccgaucagcgagu

SEQ ID NO: 1580515 - RNA, 22 nt, Pseudomonas putida KT2440
cuugccgccccgugcccgauca

SEQ ID NO: 1580516 - RNA, 22 nt, Pseudomonas putida KT2440
cuugacguccagcucaacgcga

SEQ ID NO: 1580517 - RNA, 19 nt, Pseudomonas putida KT2440
cuugacuuccagcuugccg

SEQ ID NO: 1580518 - RNA, 16 nt, Pseudomonas putida KT2440
cuugaguucccaggca

SEQ ID NO: 1580519 - RNA, 21 nt, Pseudomonas putida KT2440
cuugagggccucuucgcgggu

SEQ ID NO: 1580520 - RNA, 21 nt, Pseudomonas putida KT2440
cuugagguccgccucgaucau

SEQ ID NO: 1580521 - RNA, 17 nt, Pseudomonas putida KT2440
cuugagcuccgaagggu

SEQ ID NO: 1580522 - RNA, 14 nt, Pseudomonas putida KT2440
cuugagcucgaucu

SEQ ID NO: 1580523 - RNA, 13 nt, Pseudomonas putida KT2440
cuugagcuggccg

SEQ ID NO: 1580524 - RNA, 20 nt, Pseudomonas putida KT2440
cuugagcgaaacccggcgca

SEQ ID NO: 1580525 - RNA, 13 nt, Pseudomonas putida KT2440
cuugagcgcagcg

SEQ ID NO: 1580526 - RNA, 15 nt, Pseudomonas putida KT2440
cuugagcgcagcgac

SEQ ID NO: 1580527 - RNA, 18 nt, Pseudomonas putida KT2440
cuugagcgcagcgacgac

SEQ ID NO: 1580528 - RNA, 22 nt, Pseudomonas putida KT2440
cuugagcaggucgaacagcccc

SEQ ID NO: 1580529 - RNA, 20 nt, Pseudomonas putida KT2440
cuugaugaucaggucggcgg

SEQ ID NO: 1580530 - RNA, 15 nt, Pseudomonas putida KT2440
cuugaucugcugcga

SEQ ID NO: 1580531 - RNA, 23 nt, Pseudomonas putida KT2440
cuugaucaggguuugcagcucac

SEQ ID NO: 1580532 - RNA, 17 nt, Pseudomonas putida KT2440
cuugaucugccaggcac

SEQ ID NO: 1580533 - RNA, 13 nt, Pseudomonas putida KT2440
cuugagguugccg

SEQ ID NO: 1580534 - RNA, 17 nt, Pseudomonas putida KT2440
cuuaccagcuuggcgcc

SEQ ID NO: 1580535 - RNA, 22 nt, Pseudomonas putida KT2440
cuuaccaguaguucucgacagc

SEQ ID NO: 1580536 - RNA, 12 nt, Pseudomonas putida KT2440
cuuagcgggcaa

SEQ ID NO: 1580537 - RNA, 22 nt, Pseudomonas putida KT2440
cuuagacgguuacgugcaggcg

SEQ ID NO: 1580538 - RNA, 13 nt, Pseudomonas putida KT2440
cuguugcagcgcc

SEQ ID NO: 1580539 - RNA, 14 nt, Pseudomonas putida KT2440
cuguugcugcaggu

SEQ ID NO: 1580540 - RNA, 15 nt, Pseudomonas putida KT2440
cuguuggcgcgacau

SEQ ID NO: 1580541 - RNA, 14 nt, Pseudomonas putida KT2440
cuucacccgcagca

SEQ ID NO: 1580542 - RNA, 14 nt, Pseudomonas putida KT2440
cuucacauccaccg

SEQ ID NO: 1580543 - RNA, 22 nt, Pseudomonas putida KT2440
cuucaccagcucguucaacacc

SEQ ID NO: 1580544 - RNA, 14 nt, Pseudomonas putida KT2440
cuucaccaugggcc

SEQ ID NO: 1580545 - RNA, 14 nt, Pseudomonas putida KT2440
cuucacguccagcc

SEQ ID NO: 1580546 - RNA, 18 nt, Pseudomonas putida KT2440
cuucacgggucaggugcg

SEQ ID NO: 1580547 - RNA, 24 nt, Pseudomonas putida KT2440
cuucacgggucaggugcggggcaa

SEQ ID NO: 1580548 - RNA, 19 nt, Pseudomonas putida KT2440
cugucgagcuuggcgucca

SEQ ID NO: 1580549 - RNA, 14 nt, Pseudomonas putida KT2440
cugucgaagcgcuc

SEQ ID NO: 1580550 - RNA, 15 nt, Pseudomonas putida KT2440
cugucgagcagguuc

SEQ ID NO: 1580551 - RNA, 18 nt, Pseudomonas putida KT2440
cugucgagcagguucagg

SEQ ID NO: 1580552 - RNA, 22 nt, Pseudomonas putida KT2440
cugucgagcagguucaggcgca

SEQ ID NO: 1580553 - RNA, 17 nt, Pseudomonas putida KT2440
cugucgagcauccaggu

SEQ ID NO: 1580554 - RNA, 14 nt, Pseudomonas putida KT2440
cuguccuccugccg

SEQ ID NO: 1580555 - RNA, 18 nt, Pseudomonas putida KT2440
cugguuuuccaccggcac

SEQ ID NO: 1580556 - RNA, 23 nt, Pseudomonas putida KT2440
cuguucagguaggccgcagccau

SEQ ID NO: 1580557 - RNA, 14 nt, Pseudomonas putida KT2440
cuguuccagcagcg

SEQ ID NO: 1580558 - RNA, 16 nt, Pseudomonas putida KT2440
cuguuccucgccaugg

SEQ ID NO: 1580559 - RNA, 22 nt, Pseudomonas putida KT2440
cuguuccagaagcggcuaccgc

SEQ ID NO: 1580560 - RNA, 19 nt, Pseudomonas putida KT2440
cugucggguuggucgccag

SEQ ID NO: 1580561 - RNA, 22 nt, Pseudomonas putida KT2440
cugucgguaccuggccgugccg

SEQ ID NO: 1580562 - RNA, 13 nt, Pseudomonas putida KT2440
cugucguccagcu

SEQ ID NO: 1580563 - RNA, 18 nt, Pseudomonas putida KT2440
cugucgaucacgggcaau

SEQ ID NO: 1580564 - RNA, 17 nt, Pseudomonas putida KT2440
cugucgauuuccagugc

SEQ ID NO: 1580565 - RNA, 22 nt, Pseudomonas putida KT2440
cugucgcagaagcgugcgaagu

SEQ ID NO: 1580566 - RNA, 17 nt, Pseudomonas putida KT2440
cugucuuccagggcaau

SEQ ID NO: 1580567 - RNA, 21 nt, Pseudomonas putida KT2440
cuggggccagccggcgcugga

SEQ ID NO: 1580568 - RNA, 15 nt, Pseudomonas putida KT2440
cuggggccgcaaagc

SEQ ID NO: 1580569 - RNA, 17 nt, Pseudomonas putida KT2440
cugggcgcuuugcaccc

SEQ ID NO: 1580570 - RNA, 20 nt, Pseudomonas putida KT2440
cugggcgcuuugcacccgcg

SEQ ID NO: 1580571 - RNA, 17 nt, Pseudomonas putida KT2440
cugggcgcggcgggcau

SEQ ID NO: 1580572 - RNA, 20 nt, Pseudomonas putida KT2440
cuggguaucguucuccagcu

SEQ ID NO: 1580573 - RNA, 21 nt, Pseudomonas putida KT2440
cugguaccccucgacgccuug

SEQ ID NO: 1580574 - RNA, 17 nt, Pseudomonas putida KT2440
cugggcacccugaucga

SEQ ID NO: 1580575 - RNA, 17 nt, Pseudomonas putida KT2440
cugggcaaaaucgacca

SEQ ID NO: 1580576 - RNA, 20 nt, Pseudomonas putida KT2440
cugggcaccaaacacgcccu

SEQ ID NO: 1580577 - RNA, 17 nt, Pseudomonas putida KT2440
cuggccguguucgacga

SEQ ID NO: 1580578 - RNA, 12 nt, Pseudomonas putida KT2440
cuggccgguggc

SEQ ID NO: 1580579 - RNA, 24 nt, Pseudomonas putida KT2440
cuggccguccagcugagcgccauc

SEQ ID NO: 1580580 - RNA, 16 nt, Pseudomonas putida KT2440
cugggccccaggcggu

SEQ ID NO: 1580581 - RNA, 19 nt, Pseudomonas putida KT2440
cugggccccaggcggugca

SEQ ID NO: 1580582 - RNA, 16 nt, Pseudomonas putida KT2440
cugggcccgcccagcu

SEQ ID NO: 1580583 - RNA, 19 nt, Pseudomonas putida KT2440
cugggcccgcccagcuggc

SEQ ID NO: 1580584 - RNA, 19 nt, Pseudomonas putida KT2440
cugggcauccagcuugcca

SEQ ID NO: 1580585 - RNA, 15 nt, Pseudomonas putida KT2440
cugggcaugagccug

SEQ ID NO: 1580586 - RNA, 17 nt, Pseudomonas putida KT2440
cuggugaaagucgacca

SEQ ID NO: 1580587 - RNA, 22 nt, Pseudomonas putida KT2440
cuggugaaggcaggucagcgag

SEQ ID NO: 1580588 - RNA, 18 nt, Pseudomonas putida KT2440
cuggucggcuauggcgcg

SEQ ID NO: 1580589 - RNA, 14 nt, Pseudomonas putida KT2440
cuggucgcgugccg

SEQ ID NO: 1580590 - RNA, 14 nt, Pseudomonas putida KT2440
cuggucgccgugca

SEQ ID NO: 1580591 - RNA, 18 nt, Pseudomonas putida KT2440
cuggucgaucuucagcgc

SEQ ID NO: 1580592 - RNA, 18 nt, Pseudomonas putida KT2440
cuggucgccucgacgcag

SEQ ID NO: 1580593 - RNA, 14 nt, Pseudomonas putida KT2440
cugguggacacugc

SEQ ID NO: 1580594 - RNA, 14 nt, Pseudomonas putida KT2440
cuggugcagguuga

SEQ ID NO: 1580595 - RNA, 19 nt, Pseudomonas putida KT2440
cuggugccugucgucagcu

SEQ ID NO: 1580596 - RNA, 21 nt, Pseudomonas putida KT2440
cuggugcucugcaggcacacc

SEQ ID NO: 1580597 - RNA, 13 nt, Pseudomonas putida KT2440
cugguugaacugc

SEQ ID NO: 1580598 - RNA, 17 nt, Pseudomonas putida KT2440
cugguucugcugcagcc

SEQ ID NO: 1580599 - RNA, 18 nt, Pseudomonas putida KT2440
cugguucugcugcagcca

SEQ ID NO: 1580600 - RNA, 21 nt, Pseudomonas putida KT2440
cugguucuucgcuguaaccug

SEQ ID NO: 1580601 - RNA, 17 nt, Pseudomonas putida KT2440
cugguucgaguccaggu

SEQ ID NO: 1580602 - RNA, 18 nt, Pseudomonas putida KT2440
cugguuagcgucgaugcg

SEQ ID NO: 1580603 - RNA, 15 nt, Pseudomonas putida KT2440
cugguugcuggcgcc

SEQ ID NO: 1580604 - RNA, 15 nt, Pseudomonas putida KT2440
cugguugaucaacug

SEQ ID NO: 1580605 - RNA, 19 nt, Pseudomonas putida KT2440
cugguuguaagcgucugga

SEQ ID NO: 1580606 - RNA, 18 nt, Pseudomonas putida KT2440
cugguuguagcccgggca

SEQ ID NO: 1580607 - RNA, 15 nt, Pseudomonas putida KT2440
cgucgaugccugugu

SEQ ID NO: 1580608 - RNA, 21 nt, Pseudomonas putida KT2440
cgucgcgugaggcauggaagg

SEQ ID NO: 1580609 - RNA, 21 nt, Pseudomonas putida KT2440
cgucgcgaucacgcaggccca

SEQ ID NO: 1580610 - RNA, 20 nt, Pseudomonas putida KT2440
cgucgggcacgaucagcagc

SEQ ID NO: 1580611 - RNA, 13 nt, Pseudomonas putida KT2440
cgucggucgcugg

SEQ ID NO: 1580612 - RNA, 16 nt, Pseudomonas putida KT2440
cgucggcguggaacaa

SEQ ID NO: 1580613 - RNA, 14 nt, Pseudomonas putida KT2440
cgucggcgucagcc

SEQ ID NO: 1580614 - RNA, 22 nt, Pseudomonas putida KT2440
cgucggcgcugaugcggaccca

SEQ ID NO: 1580615 - RNA, 13 nt, Pseudomonas putida KT2440
cgucgucacugcc

SEQ ID NO: 1580616 - RNA, 16 nt, Pseudomonas putida KT2440
cgucguaggagcgggu

SEQ ID NO: 1580617 - RNA, 22 nt, Pseudomonas putida KT2440
cgucguaggagcggguucaccc

SEQ ID NO: 1580618 - RNA, 13 nt, Pseudomonas putida KT2440
cgucgguugcccc

SEQ ID NO: 1580619 - RNA, 20 nt, Pseudomonas putida KT2440
cgucgguuuucaaguccuga

SEQ ID NO: 1580620 - RNA, 18 nt, Pseudomonas putida KT2440
cgucguacgccgauccuc

SEQ ID NO: 1580621 - RNA, 21 nt, Pseudomonas putida KT2440
cguccagggcauugcgcaugc

SEQ ID NO: 1580622 - RNA, 20 nt, Pseudomonas putida KT2440
cguccaguuggcggcgcagc

SEQ ID NO: 1580623 - RNA, 20 nt, Pseudomonas putida KT2440
cguccaguucaaugccagca

SEQ ID NO: 1580624 - RNA, 18 nt, Pseudomonas putida KT2440
cgucccgaaagggccgca

SEQ ID NO: 1580625 - RNA, 13 nt, Pseudomonas putida KT2440
cguccacagcgau

SEQ ID NO: 1580626 - RNA, 21 nt, Pseudomonas putida KT2440
cgucaguugcagacgcgcagc

SEQ ID NO: 1580627 - RNA, 19 nt, Pseudomonas putida KT2440
cguccaaugccgccuugca

SEQ ID NO: 1580628 - RNA, 15 nt, Pseudomonas putida KT2440
cgucauccaccgccc

SEQ ID NO: 1580629 - RNA, 15 nt, Pseudomonas putida KT2440
cgucauccgccaaca

SEQ ID NO: 1580630 - RNA, 17 nt, Pseudomonas putida KT2440
cguccgacaaugccagc

SEQ ID NO: 1580631 - RNA, 16 nt, Pseudomonas putida KT2440
cguccgccgcgcugac

SEQ ID NO: 1580632 - RNA, 16 nt, Pseudomonas putida KT2440
cguccgcaaaucccug

SEQ ID NO: 1580633 - RNA, 23 nt, Pseudomonas putida KT2440
cguccggugccgccugggucagg

SEQ ID NO: 1580634 - RNA, 20 nt, Pseudomonas putida KT2440
cguccuggaaaagcaaggcu

SEQ ID NO: 1580635 - RNA, 20 nt, Pseudomonas putida KT2440
cgucacguuuuuugggagcg

SEQ ID NO: 1580636 - RNA, 14 nt, Pseudomonas putida KT2440
cgucacugaugcgc

SEQ ID NO: 1580637 - RNA, 16 nt, Pseudomonas putida KT2440
cgucacauccugcucg

SEQ ID NO: 1580638 - RNA, 21 nt, Pseudomonas putida KT2440
cgucacggguauagccaugca

SEQ ID NO: 1580639 - RNA, 21 nt, Pseudomonas putida KT2440
cgucaauaccggugccccggu

SEQ ID NO: 1580640 - RNA, 15 nt, Pseudomonas putida KT2440
cgucacagccaagcc

SEQ ID NO: 1580641 - RNA, 21 nt, Pseudomonas putida KT2440
cgucagccgaaacgauacucc

SEQ ID NO: 1580642 - RNA, 22 nt, Pseudomonas putida KT2440
cgucagccccuagcgcauccug

SEQ ID NO: 1580643 - RNA, 16 nt, Pseudomonas putida KT2440
cgucagcagcaggcgc

SEQ ID NO: 1580644 - RNA, 17 nt, Pseudomonas putida KT2440
cgucagcuuccgcugcc

SEQ ID NO: 1580645 - RNA, 16 nt, Pseudomonas putida KT2440
cgucagcuacgcgagu

SEQ ID NO: 1580646 - RNA, 17 nt, Pseudomonas putida KT2440
cgucagcguugcuggcg

SEQ ID NO: 1580647 - RNA, 14 nt, Pseudomonas putida KT2440
cgucaggcuucauc

SEQ ID NO: 1580648 - RNA, 22 nt, Pseudomonas putida KT2440
cgucagguucaagccuacgccc

SEQ ID NO: 1580649 - RNA, 13 nt, Pseudomonas putida KT2440
cguauagccaccg

SEQ ID NO: 1580650 - RNA, 14 nt, Pseudomonas putida KT2440
cguauggcguugcu

SEQ ID NO: 1580651 - RNA, 12 nt, Pseudomonas putida KT2440
cguauucgcggg

SEQ ID NO: 1580652 - RNA, 15 nt, Pseudomonas putida KT2440
cguauucgcggguaa

SEQ ID NO: 1580653 - RNA, 18 nt, Pseudomonas putida KT2440
cguauucgcggguaaacc

SEQ ID NO: 1580654 - RNA, 20 nt, Pseudomonas putida KT2440
cguauucgcggguaaacccg

SEQ ID NO: 1580655 - RNA, 20 nt, Pseudomonas putida KT2440
cguauggcuucacggccaau

SEQ ID NO: 1580656 - RNA, 18 nt, Pseudomonas putida KT2440
aacccgggucaggcgcaa

SEQ ID NO: 1580657 - RNA, 12 nt, Pseudomonas putida KT2440
aacccggguugc

SEQ ID NO: 1580658 - RNA, 19 nt, Pseudomonas putida KT2440
aacccggccuuggccgcug

SEQ ID NO: 1580659 - RNA, 19 nt, Pseudomonas putida KT2440
cgucaagagcgacuggugu

SEQ ID NO: 1580660 - RNA, 19 nt, Pseudomonas putida KT2440
cgucaaguacuugcaggug

SEQ ID NO: 1580661 - RNA, 13 nt, Pseudomonas putida KT2440
cgucaaccgugcc

SEQ ID NO: 1580662 - RNA, 15 nt, Pseudomonas putida KT2440
cguagugcaggcgca

SEQ ID NO: 1580663 - RNA, 15 nt, Pseudomonas putida KT2440
cguagugcuucugcc

SEQ ID NO: 1580664 - RNA, 15 nt, Pseudomonas putida KT2440
cguagugacgcggau

SEQ ID NO: 1580665 - RNA, 21 nt, Pseudomonas putida KT2440
cgguuccagcgcaccgaugcg

SEQ ID NO: 1580666 - RNA, 23 nt, Pseudomonas putida KT2440
cgguguuuccacagguaccaggc

SEQ ID NO: 1580667 - RNA, 17 nt, Pseudomonas putida KT2440
cgguugaccacgaugcc

SEQ ID NO: 1580668 - RNA, 22 nt, Pseudomonas putida KT2440
cgguugaccgccgccaccaucg

SEQ ID NO: 1580669 - RNA, 19 nt, Pseudomonas putida KT2440
cgguucuggucacccagcg

SEQ ID NO: 1580670 - RNA, 16 nt, Pseudomonas putida KT2440
cgguucuucgccugca

SEQ ID NO: 1580671 - RNA, 13 nt, Pseudomonas putida KT2440
cgguucuggcagc

SEQ ID NO: 1580672 - RNA, 19 nt, Pseudomonas putida KT2440
cgguuggcgauccauucac

SEQ ID NO: 1580673 - RNA, 18 nt, Pseudomonas putida KT2440
cgguuguagaucgccggc

SEQ ID NO: 1580674 - RNA, 22 nt, Pseudomonas putida KT2440
cgguuguagaucgccggcagca

SEQ ID NO: 1580675 - RNA, 22 nt, Pseudomonas putida KT2440
cgguuggugcgccuccagcagc

SEQ ID NO: 1580676 - RNA, 17 nt, Pseudomonas putida KT2440
cgguguaggagcggguu

SEQ ID NO: 1580677 - RNA, 18 nt, Pseudomonas putida KT2440
cggugguuggacacaggc

SEQ ID NO: 1580678 - RNA, 21 nt, Pseudomonas putida KT2440
cggugugcuccagcuccaggc

SEQ ID NO: 1580679 - RNA, 13 nt, Pseudomonas putida KT2440
cgguguggccaag

SEQ ID NO: 1580680 - RNA, 15 nt, Pseudomonas putida KT2440
cgguguggccaaggc

SEQ ID NO: 1580681 - RNA, 13 nt, Pseudomonas putida KT2440
cgguguggccagu

SEQ ID NO: 1580682 - RNA, 12 nt, Pseudomonas putida KT2440
cgguguucgcgg

SEQ ID NO: 1580683 - RNA, 16 nt, Pseudomonas putida KT2440
cgguguucgcgggcac

SEQ ID NO: 1580684 - RNA, 16 nt, Pseudomonas putida KT2440
cgguguucgcgggcau

SEQ ID NO: 1580685 - RNA, 13 nt, Pseudomonas putida KT2440
cggugucggccag

SEQ ID NO: 1580686 - RNA, 19 nt, Pseudomonas putida KT2440
cggugucuucuucgcgggu

SEQ ID NO: 1580687 - RNA, 16 nt, Pseudomonas putida KT2440
cggugucuuccggcau

SEQ ID NO: 1580688 - RNA, 14 nt, Pseudomonas putida KT2440
cgguggcugccagc

SEQ ID NO: 1580689 - RNA, 15 nt, Pseudomonas putida KT2440
cgguggucaccagca

SEQ ID NO: 1580690 - RNA, 17 nt, Pseudomonas putida KT2440
cggugccuucaggcgcu

SEQ ID NO: 1580691 - RNA, 15 nt, Pseudomonas putida KT2440
cggugcgcgccagcg

SEQ ID NO: 1580692 - RNA, 16 nt, Pseudomonas putida KT2440
cgguggcaaaucgaaa

SEQ ID NO: 1580693 - RNA, 17 nt, Pseudomonas putida KT2440
cggugcguacucgacca

SEQ ID NO: 1580694 - RNA, 20 nt, Pseudomonas putida KT2440
cggugcguaggagcgggucu

SEQ ID NO: 1580695 - RNA, 20 nt, Pseudomonas putida KT2440
cggugccccgguccagcaca

SEQ ID NO: 1580696 - RNA, 13 nt, Pseudomonas putida KT2440
cggugcccacugc

SEQ ID NO: 1580697 - RNA, 14 nt, Pseudomonas putida KT2440
cggugcccacugca

SEQ ID NO: 1580698 - RNA, 17 nt, Pseudomonas putida KT2440
cggugcccacugcagcc

SEQ ID NO: 1580699 - RNA, 22 nt, Pseudomonas putida KT2440
cggugcccacugcagccauuca

SEQ ID NO: 1580700 - RNA, 17 nt, Pseudomonas putida KT2440
cggugccauccaccgcg

SEQ ID NO: 1580701 - RNA, 18 nt, Pseudomonas putida KT2440
cggugccauccaccgcgc

SEQ ID NO: 1580702 - RNA, 14 nt, Pseudomonas putida KT2440
cggugcaugcgcac

SEQ ID NO: 1580703 - RNA, 21 nt, Pseudomonas putida KT2440
cggugccacccaaggcaucca

SEQ ID NO: 1580704 - RNA, 21 nt, Pseudomonas putida KT2440
cggugcagaacguacuggccg

SEQ ID NO: 1580705 - RNA, 17 nt, Pseudomonas putida KT2440
cggugcagguuggagcg

SEQ ID NO: 1580706 - RNA, 15 nt, Pseudomonas putida KT2440
cggugccggccaauc

SEQ ID NO: 1580707 - RNA, 22 nt, Pseudomonas putida KT2440
cggugccggccaaucgaucugc

SEQ ID NO: 1580708 - RNA, 14 nt, Pseudomonas putida KT2440
cggugccggcgagu

SEQ ID NO: 1580709 - RNA, 18 nt, Pseudomonas putida KT2440
cggugccgccugggucag

SEQ ID NO: 1580710 - RNA, 15 nt, Pseudomonas putida KT2440
cggugccugcagccc

SEQ ID NO: 1580711 - RNA, 13 nt, Pseudomonas putida KT2440
cggucugccggca

SEQ ID NO: 1580712 - RNA, 17 nt, Pseudomonas putida KT2440
cggucugcugcgucagc

SEQ ID NO: 1580713 - RNA, 20 nt, Pseudomonas putida KT2440
cggucuuggccgcaauggcg

SEQ ID NO: 1580714 - RNA, 17 nt, Pseudomonas putida KT2440
cggucucacaggcgcug

SEQ ID NO: 1580715 - RNA, 15 nt, Pseudomonas putida KT2440
cggugaagccgacca

SEQ ID NO: 1580716 - RNA, 22 nt, Pseudomonas putida KT2440
cggugacaaaggccggcaccga

SEQ ID NO: 1580717 - RNA, 23 nt, Pseudomonas putida KT2440
cggguacuucucgaccagcgcca

SEQ ID NO: 1580718 - RNA, 19 nt, Pseudomonas putida KT2440
cggguaccaccugggcgcu

SEQ ID NO: 1580719 - RNA, 15 nt, Pseudomonas putida KT2440
cggguacccgcguug

SEQ ID NO: 1580720 - RNA, 17 nt, Pseudomonas putida KT2440
cggguacccgcguuggc

SEQ ID NO: 1580721 - RNA, 17 nt, Pseudomonas putida KT2440
cggguacagccccugca

SEQ ID NO: 1580722 - RNA, 17 nt, Pseudomonas putida KT2440
cggucggccagcggcac

SEQ ID NO: 1580723 - RNA, 15 nt, Pseudomonas putida KT2440
cguuugggcggcgug

SEQ ID NO: 1580724 - RNA, 14 nt, Pseudomonas putida KT2440
cguuugggguccug

SEQ ID NO: 1580725 - RNA, 15 nt, Pseudomonas putida KT2440
cguuuuuugggagcg

SEQ ID NO: 1580726 - RNA, 19 nt, Pseudomonas putida KT2440
cuaaccgcgcugguaagcc

SEQ ID NO: 1580727 - RNA, 17 nt, Pseudomonas putida KT2440
cuaacgcaaccaucagu

SEQ ID NO: 1580728 - RNA, 17 nt, Pseudomonas putida KT2440
cuaacaggugcucacca

SEQ ID NO: 1580729 - RNA, 16 nt, Pseudomonas putida KT2440
cuaaaagcuggcgcga

SEQ ID NO: 1580730 - RNA, 17 nt, Pseudomonas putida KT2440
cguuguacaagcuggca

SEQ ID NO: 1580731 - RNA, 17 nt, Pseudomonas putida KT2440
cguugucagccuucaga

SEQ ID NO: 1580732 - RNA, 22 nt, Pseudomonas putida KT2440
cguuguagcggccaucgcagaa

SEQ ID NO: 1580733 - RNA, 16 nt, Pseudomonas putida KT2440
cguuggcuuccacggc

SEQ ID NO: 1580734 - RNA, 13 nt, Pseudomonas putida KT2440
cguuggcugcuga

SEQ ID NO: 1580735 - RNA, 15 nt, Pseudomonas putida KT2440
cguuggccgccagcg

SEQ ID NO: 1580736 - RNA, 15 nt, Pseudomonas putida KT2440
cguuggccggguuua

SEQ ID NO: 1580737 - RNA, 20 nt, Pseudomonas putida KT2440
cguuguuguugaacaugcgg

SEQ ID NO: 1580738 - RNA, 15 nt, Pseudomonas putida KT2440
cguuguucagcagcg

SEQ ID NO: 1580739 - RNA, 18 nt, Pseudomonas putida KT2440
cguuguccagcagcagcg

SEQ ID NO: 1580740 - RNA, 17 nt, Pseudomonas putida KT2440
cguuuacugcugaugcg

SEQ ID NO: 1580741 - RNA, 17 nt, Pseudomonas putida KT2440
cguuucaguacagccgu

SEQ ID NO: 1580742 - RNA, 18 nt, Pseudomonas putida KT2440
cguuucaugauguacgcc

SEQ ID NO: 1580743 - RNA, 14 nt, Pseudomonas putida KT2440
cuagcuaucucaag

SEQ ID NO: 1580744 - RNA, 13 nt, Pseudomonas putida KT2440
cuacggccgacaa

SEQ ID NO: 1580745 - RNA, 22 nt, Pseudomonas putida KT2440
cuaccgcaaaugcugccaugca

SEQ ID NO: 1580746 - RNA, 21 nt, Pseudomonas putida KT2440
cuaccgcguuggacaccaggu

SEQ ID NO: 1580747 - RNA, 17 nt, Pseudomonas putida KT2440
cuacgagacgguggcug

SEQ ID NO: 1580748 - RNA, 18 nt, Pseudomonas putida KT2440
cuacgcccccagccuuga

SEQ ID NO: 1580749 - RNA, 15 nt, Pseudomonas putida KT2440
cuacgccguacugcu

SEQ ID NO: 1580750 - RNA, 16 nt, Pseudomonas putida KT2440
cuacgcucguccaggc

SEQ ID NO: 1580751 - RNA, 21 nt, Pseudomonas putida KT2440
cuacgcggggcagcgcacguc

SEQ ID NO: 1580752 - RNA, 20 nt, Pseudomonas putida KT2440
cuaaggggaagguugcaggu

SEQ ID NO: 1580753 - RNA, 22 nt, Pseudomonas putida KT2440
cuaagcgaaacaccagcaacau

SEQ ID NO: 1580754 - RNA, 14 nt, Pseudomonas putida KT2440
cuaccagcuugccg

SEQ ID NO: 1580755 - RNA, 15 nt, Pseudomonas putida KT2440
cuaccagcuugccgc

SEQ ID NO: 1580756 - RNA, 21 nt, Pseudomonas putida KT2440
cuaccagaaauggucgcgggc

SEQ ID NO: 1580757 - RNA, 13 nt, Pseudomonas putida KT2440
cuacccaggccaa

SEQ ID NO: 1580758 - RNA, 17 nt, Pseudomonas putida KT2440
cuaccccuucauccgcg

SEQ ID NO: 1580759 - RNA, 20 nt, Pseudomonas putida KT2440
cuacauggaucgcauugccc

SEQ ID NO: 1580760 - RNA, 21 nt, Pseudomonas putida KT2440
cuacaggaaucugucagccuu

SEQ ID NO: 1580761 - RNA, 16 nt, Pseudomonas putida KT2440
cuacaggauggccgca

SEQ ID NO: 1580762 - RNA, 12 nt, Pseudomonas putida KT2440
cuacaaggguga

SEQ ID NO: 1580763 - RNA, 15 nt, Pseudomonas putida KT2440
cuacaagguacccca

SEQ ID NO: 1580764 - RNA, 21 nt, Pseudomonas putida KT2440
cuacaacauaccgcugggcac

SEQ ID NO: 1580765 - RNA, 22 nt, Pseudomonas putida KT2440
cuacaacauaccgcugggcacc

SEQ ID NO: 1580766 - RNA, 15 nt, Pseudomonas putida KT2440
cgugguacgcguggu

SEQ ID NO: 1580767 - RNA, 19 nt, Pseudomonas putida KT2440
cgugggggaucucuucguc

SEQ ID NO: 1580768 - RNA, 22 nt, Pseudomonas putida KT2440
cguggggucugcccggccagca

SEQ ID NO: 1580769 - RNA, 17 nt, Pseudomonas putida KT2440
cgugggucaucuugccg

SEQ ID NO: 1580770 - RNA, 20 nt, Pseudomonas putida KT2440
cguggguauugucggucagg

SEQ ID NO: 1580771 - RNA, 16 nt, Pseudomonas putida KT2440
cguggcggugaugcgc

SEQ ID NO: 1580772 - RNA, 15 nt, Pseudomonas putida KT2440
cguggccuguaccga

SEQ ID NO: 1580773 - RNA, 17 nt, Pseudomonas putida KT2440
cguggccuucucuuccg

SEQ ID NO: 1580774 - RNA, 15 nt, Pseudomonas putida KT2440
cguggccggcaucgc

SEQ ID NO: 1580775 - RNA, 14 nt, Pseudomonas putida KT2440
cguggccgccaaca

SEQ ID NO: 1580776 - RNA, 17 nt, Pseudomonas putida KT2440
cgugcgcuccuggucau

SEQ ID NO: 1580777 - RNA, 20 nt, Pseudomonas putida KT2440
cgugcgcugcauggcggcac

SEQ ID NO: 1580778 - RNA, 12 nt, Pseudomonas putida KT2440
cgugcgcggcau

SEQ ID NO: 1580779 - RNA, 23 nt, Pseudomonas putida KT2440
cgugcgcggggcccgaccucacg

SEQ ID NO: 1580780 - RNA, 21 nt, Pseudomonas putida KT2440
cgucucgggaauuguacgacc

SEQ ID NO: 1580781 - RNA, 18 nt, Pseudomonas putida KT2440
cgugcucaggcggccaaa

SEQ ID NO: 1580782 - RNA, 21 nt, Pseudomonas putida KT2440
cguggcaaacccggccagcag

SEQ ID NO: 1580783 - RNA, 19 nt, Pseudomonas putida KT2440
cguggcaaucuucuugccg

SEQ ID NO: 1580784 - RNA, 20 nt, Pseudomonas putida KT2440
cguggcaaucuucuugccgg

SEQ ID NO: 1580785 - RNA, 23 nt, Pseudomonas putida KT2440
cguggcaaggcccgcgccgacag

SEQ ID NO: 1580786 - RNA, 19 nt, Pseudomonas putida KT2440
cguggcagcccccccagca

SEQ ID NO: 1580787 - RNA, 21 nt, Pseudomonas putida KT2440
cguggcagcaaucggcagcgc

SEQ ID NO: 1580788 - RNA, 17 nt, Pseudomonas putida KT2440
cguggcaccggcgaaga

SEQ ID NO: 1580789 - RNA, 22 nt, Pseudomonas putida KT2440
cgugcuguugagccagggcgcu

SEQ ID NO: 1580790 - RNA, 14 nt, Pseudomonas putida KT2440
aaccgcacccaggu

SEQ ID NO: 1580791 - RNA, 16 nt, Pseudomonas putida KT2440
cguuacuguuccagcg

SEQ ID NO: 1580792 - RNA, 13 nt, Pseudomonas putida KT2440
cguucaugccggc

SEQ ID NO: 1580793 - RNA, 14 nt, Pseudomonas putida KT2440
cguucgcccugcgc

SEQ ID NO: 1580794 - RNA, 15 nt, Pseudomonas putida KT2440
cguucgcccugcgcc

SEQ ID NO: 1580795 - RNA, 22 nt, Pseudomonas putida KT2440
cguucgaaagcccauaaacccc

SEQ ID NO: 1580796 - RNA, 13 nt, Pseudomonas putida KT2440
cguucgaacuccg

SEQ ID NO: 1580797 - RNA, 15 nt, Pseudomonas putida KT2440
cguucgaacuccgcg

SEQ ID NO: 1580798 - RNA, 16 nt, Pseudomonas putida KT2440
cguucgcggucgguca

SEQ ID NO: 1580799 - RNA, 18 nt, Pseudomonas putida KT2440
cguucgcgggcacgcccg

SEQ ID NO: 1580800 - RNA, 15 nt, Pseudomonas putida KT2440
cguugcgcucgagcc

SEQ ID NO: 1580801 - RNA, 21 nt, Pseudomonas putida KT2440
cguugcgcuugagcaggucga

SEQ ID NO: 1580802 - RNA, 16 nt, Pseudomonas putida KT2440
cguugcguugcagcuu

SEQ ID NO: 1580803 - RNA, 17 nt, Pseudomonas putida KT2440
cguugcgggucagcucg

SEQ ID NO: 1580804 - RNA, 23 nt, Pseudomonas putida KT2440
cguugcggucgguggucagcucg

SEQ ID NO: 1580805 - RNA, 18 nt, Pseudomonas putida KT2440
cguugcugccugugccgg

SEQ ID NO: 1580806 - RNA, 15 nt, Pseudomonas putida KT2440
cguuggccaggucga

SEQ ID NO: 1580807 - RNA, 21 nt, Pseudomonas putida KT2440
cguuggccaaaccguccaggu

SEQ ID NO: 1580808 - RNA, 15 nt, Pseudomonas putida KT2440
cguuggacgccgcac

SEQ ID NO: 1580809 - RNA, 13 nt, Pseudomonas putida KT2440
cguugaggccgaa

SEQ ID NO: 1580810 - RNA, 14 nt, Pseudomonas putida KT2440
cguugaggccgaac

SEQ ID NO: 1580811 - RNA, 22 nt, Pseudomonas putida KT2440
cguugauccaggcuuggcgaac

SEQ ID NO: 1580812 - RNA, 17 nt, Pseudomonas putida KT2440
cguugcagccccagccu

SEQ ID NO: 1580813 - RNA, 19 nt, Pseudomonas putida KT2440
cguucugccgguuugcgcu

SEQ ID NO: 1580814 - RNA, 18 nt, Pseudomonas putida KT2440
cguucuccagcuccuggc

SEQ ID NO: 1580815 - RNA, 15 nt, Pseudomonas putida KT2440
cguucggccagcacu

SEQ ID NO: 1580816 - RNA, 16 nt, Pseudomonas putida KT2440
cguucggcaucgacga

SEQ ID NO: 1580817 - RNA, 15 nt, Pseudomonas putida KT2440
cguucgcuacggcgg

SEQ ID NO: 1580818 - RNA, 13 nt, Pseudomonas putida KT2440
cuccccaucagca

SEQ ID NO: 1580819 - RNA, 15 nt, Pseudomonas putida KT2440
cuccagccgcugcug

SEQ ID NO: 1580820 - RNA, 15 nt, Pseudomonas putida KT2440
cucccccagcgcggu

SEQ ID NO: 1580821 - RNA, 14 nt, Pseudomonas putida KT2440
cuccccucagacag

SEQ ID NO: 1580822 - RNA, 14 nt, Pseudomonas putida KT2440
cuccagcagcucca

SEQ ID NO: 1580823 - RNA, 18 nt, Pseudomonas putida KT2440
cuccagcccggcuucaca

SEQ ID NO: 1580824 - RNA, 15 nt, Pseudomonas putida KT2440
cuccagcccagcgcc

SEQ ID NO: 1580825 - RNA, 16 nt, Pseudomonas putida KT2440
cuccagcccagcgcca

SEQ ID NO: 1580826 - RNA, 17 nt, Pseudomonas putida KT2440
cuccagcccagcgccag

SEQ ID NO: 1580827 - RNA, 17 nt, Pseudomonas putida KT2440
cuccagcauggcgauca

SEQ ID NO: 1580828 - RNA, 20 nt, Pseudomonas putida KT2440
cuccagccaacggucgauca

SEQ ID NO: 1580829 - RNA, 19 nt, Pseudomonas putida KT2440
cuccagcagugccguggca

SEQ ID NO: 1580830 - RNA, 14 nt, Pseudomonas putida KT2440
cuccagcagcgcau

SEQ ID NO: 1580831 - RNA, 19 nt, Pseudomonas putida KT2440
cuccagcaccugacgcaag

SEQ ID NO: 1580832 - RNA, 22 nt, Pseudomonas putida KT2440
cuccagcagcgacaccagcgca

SEQ ID NO: 1580833 - RNA, 21 nt, Pseudomonas putida KT2440
cuccagcaacaucugccgaaa

SEQ ID NO: 1580834 - RNA, 14 nt, Pseudomonas putida KT2440
cuccagcaagcgcu

SEQ ID NO: 1580835 - RNA, 22 nt, Pseudomonas putida KT2440
cuccagcacaccgcgcaccucg

SEQ ID NO: 1580836 - RNA, 14 nt, Pseudomonas putida KT2440
cuccgacagcgcag

SEQ ID NO: 1580837 - RNA, 17 nt, Pseudomonas putida KT2440
cucccgcgcaugcugcc

SEQ ID NO: 1580838 - RNA, 13 nt, Pseudomonas putida KT2440
cucccgcacugcu

SEQ ID NO: 1580839 - RNA, 18 nt, Pseudomonas putida KT2440
cucccuuacagaugcugc

SEQ ID NO: 1580840 - RNA, 19 nt, Pseudomonas putida KT2440
cucccggcucaucaggcga

SEQ ID NO: 1580841 - RNA, 13 nt, Pseudomonas putida KT2440
cucagccgccaca

SEQ ID NO: 1580842 - RNA, 22 nt, Pseudomonas putida KT2440
cucagccgcugcgccugccggg

SEQ ID NO: 1580843 - RNA, 21 nt, Pseudomonas putida KT2440
cucagcgcagcuucucaagca

SEQ ID NO: 1580844 - RNA, 21 nt, Pseudomonas putida KT2440
cucagcgcccgcugcgccgcu

SEQ ID NO: 1580845 - RNA, 16 nt, Pseudomonas putida KT2440
cucaggcucagcucca

SEQ ID NO: 1580846 - RNA, 22 nt, Pseudomonas putida KT2440
cucagggcagcaacgccgagca

SEQ ID NO: 1580847 - RNA, 18 nt, Pseudomonas putida KT2440
cucagggguaaugcccca

SEQ ID NO: 1580848 - RNA, 19 nt, Pseudomonas putida KT2440
cucaggggcauugcgcugg

SEQ ID NO: 1580849 - RNA, 22 nt, Pseudomonas putida KT2440
cucaggggcauugcgcuggucg

SEQ ID NO: 1580850 - RNA, 16 nt, Pseudomonas putida KT2440
cucagcggcuggcccu

SEQ ID NO: 1580851 - RNA, 17 nt, Pseudomonas putida KT2440
cucagcggcuggcccug

SEQ ID NO: 1580852 - RNA, 14 nt, Pseudomonas putida KT2440
cucagucgcaucga

SEQ ID NO: 1580853 - RNA, 18 nt, Pseudomonas putida KT2440
cucagugccuggcgugcu

SEQ ID NO: 1580854 - RNA, 18 nt, Pseudomonas putida KT2440
cucaucacucuugcgcca

SEQ ID NO: 1580855 - RNA, 22 nt, Pseudomonas putida KT2440
cucauagcuuucaggcgcagca

SEQ ID NO: 1580856 - RNA, 18 nt, Pseudomonas putida KT2440
cucaucgcggccgaaggc

SEQ ID NO: 1580857 - RNA, 20 nt, Pseudomonas putida KT2440
cucaucuaccugagccugca

SEQ ID NO: 1580858 - RNA, 17 nt, Pseudomonas putida KT2440
cucaucguccaccgcgc

SEQ ID NO: 1580859 - RNA, 23 nt, Pseudomonas putida KT2440
cucaugcugguuuggcagcaccg

SEQ ID NO: 1580860 - RNA, 21 nt, Pseudomonas putida KT2440
cucaugggcuucgagcagcuu

SEQ ID NO: 1580861 - RNA, 20 nt, Pseudomonas putida KT2440
cucaugugugccgagugcca

SEQ ID NO: 1580862 - RNA, 21 nt, Pseudomonas putida KT2440
cucaugugugccgagugccaa

SEQ ID NO: 1580863 - RNA, 18 nt, Pseudomonas putida KT2440
cuccacacucgacgcugc

SEQ ID NO: 1580864 - RNA, 13 nt, Pseudomonas putida KT2440
cuccaccaccugc

SEQ ID NO: 1580865 - RNA, 23 nt, Pseudomonas putida KT2440
cuccaccaaggcuucaaggucgg

SEQ ID NO: 1580866 - RNA, 20 nt, Pseudomonas putida KT2440
cuccaccacagcugcgccag

SEQ ID NO: 1580867 - RNA, 16 nt, Pseudomonas putida KT2440
cuccacccgccguuca

SEQ ID NO: 1580868 - RNA, 22 nt, Pseudomonas putida KT2440
cuccaccgggauggcggcgccu

SEQ ID NO: 1580869 - RNA, 20 nt, Pseudomonas putida KT2440
cuccagagcccgcucgguca

SEQ ID NO: 1580870 - RNA, 20 nt, Pseudomonas putida KT2440
cucgacgucguaggcuuugc

SEQ ID NO: 1580871 - RNA, 21 nt, Pseudomonas putida KT2440
cucgacgccccggccugcaca

SEQ ID NO: 1580872 - RNA, 17 nt, Pseudomonas putida KT2440
cucgagaaacgccagcu

SEQ ID NO: 1580873 - RNA, 15 nt, Pseudomonas putida KT2440
cucgaccagcgccag

SEQ ID NO: 1580874 - RNA, 17 nt, Pseudomonas putida KT2440
cucgacgaccaguucga

SEQ ID NO: 1580875 - RNA, 20 nt, Pseudomonas putida KT2440
cucgaucacgaaucgggucc

SEQ ID NO: 1580876 - RNA, 22 nt, Pseudomonas putida KT2440
cucgagcccgccagcaggccac

SEQ ID NO: 1580877 - RNA, 19 nt, Pseudomonas putida KT2440
cucgaugucuuccagacca

SEQ ID NO: 1580878 - RNA, 22 nt, Pseudomonas putida KT2440
cucgauggccaggaacagcgcc

SEQ ID NO: 1580879 - RNA, 19 nt, Pseudomonas putida KT2440
cuccgccugcggcaccguc

SEQ ID NO: 1580880 - RNA, 14 nt, Pseudomonas putida KT2440
cuccggcgacagcu

SEQ ID NO: 1580881 - RNA, 15 nt, Pseudomonas putida KT2440
cuccggcguguccag

SEQ ID NO: 1580882 - RNA, 18 nt, Pseudomonas putida KT2440
cucgaacgacagcugcaa

SEQ ID NO: 1580883 - RNA, 22 nt, Pseudomonas putida KT2440
cucgaacgacagcugcaacaga

SEQ ID NO: 1580884 - RNA, 20 nt, Pseudomonas putida KT2440
cucgaaccaaggugcuaccg

SEQ ID NO: 1580885 - RNA, 16 nt, Pseudomonas putida KT2440
cucgaacagcaguucg

SEQ ID NO: 1580886 - RNA, 15 nt, Pseudomonas putida KT2440
cuccugccgggguaa

SEQ ID NO: 1580887 - RNA, 23 nt, Pseudomonas putida KT2440
cuccugauguaggagcggguuua

SEQ ID NO: 1580888 - RNA, 13 nt, Pseudomonas putida KT2440
cuccugcagggaa

SEQ ID NO: 1580889 - RNA, 22 nt, Pseudomonas putida KT2440
cuccugcagggaacugcgcgag

SEQ ID NO: 1580890 - RNA, 13 nt, Pseudomonas putida KT2440
cuccuuggccggu

SEQ ID NO: 1580891 - RNA, 22 nt, Pseudomonas putida KT2440
cucgaaaaucucguucaugccc

SEQ ID NO: 1580892 - RNA, 17 nt, Pseudomonas putida KT2440
cuccuugucgcaaugga

SEQ ID NO: 1580893 - RNA, 16 nt, Pseudomonas putida KT2440
cucgaacaagcgcgac

SEQ ID NO: 1580894 - RNA, 15 nt, Pseudomonas putida KT2440
cucgcucagguaggc

SEQ ID NO: 1580895 - RNA, 16 nt, Pseudomonas putida KT2440
cucgcucagcguacgc

SEQ ID NO: 1580896 - RNA, 14 nt, Pseudomonas putida KT2440
cucgcugcgaucga

SEQ ID NO: 1580897 - RNA, 21 nt, Pseudomonas putida KT2440
cucgccauaagcugucagcac

SEQ ID NO: 1580898 - RNA, 17 nt, Pseudomonas putida KT2440
cucgauuuccaccggcu

SEQ ID NO: 1580899 - RNA, 13 nt, Pseudomonas putida KT2440
cucgauugacccc

SEQ ID NO: 1580900 - RNA, 24 nt, Pseudomonas putida KT2440
cucggcgccauaggcuugcgcuga

SEQ ID NO: 1580901 - RNA, 14 nt, Pseudomonas putida KT2440
cucggcgaucgcca

SEQ ID NO: 1580902 - RNA, 20 nt, Pseudomonas putida KT2440
cucggcgaucgccaggugga

SEQ ID NO: 1580903 - RNA, 20 nt, Pseudomonas putida KT2440
cucggcaucuuuggcuucgc

SEQ ID NO: 1580904 - RNA, 11 nt, Pseudomonas putida KT2440
cucggccagca

SEQ ID NO: 1580905 - RNA, 11 nt, Pseudomonas putida KT2440
cucggccagcg

SEQ ID NO: 1580906 - RNA, 21 nt, Pseudomonas putida KT2440
cucgggggugcacagcgucca

SEQ ID NO: 1580907 - RNA, 23 nt, Pseudomonas putida KT2440
cucggcuacgaaccgagcggucg

SEQ ID NO: 1580908 - RNA, 20 nt, Pseudomonas putida KT2440
cucggcguucagcucguaca

SEQ ID NO: 1580909 - RNA, 13 nt, Pseudomonas putida KT2440
cucguccaggccc

SEQ ID NO: 1580910 - RNA, 14 nt, Pseudomonas putida KT2440
cucguccagcucgu

SEQ ID NO: 1580911 - RNA, 20 nt, Pseudomonas putida KT2440
cucgucacuggcugcugcgg

SEQ ID NO: 1580912 - RNA, 17 nt, Pseudomonas putida KT2440
cucgucaaccacagccc

SEQ ID NO: 1580913 - RNA, 23 nt, Pseudomonas putida KT2440
cucgucaaguacuugcaggugca

SEQ ID NO: 1580914 - RNA, 17 nt, Pseudomonas putida KT2440
cucguccaucaccgcca

SEQ ID NO: 1580915 - RNA, 20 nt, Pseudomonas putida KT2440
cucgucgagcaacuugcgca

SEQ ID NO: 1580916 - RNA, 15 nt, Pseudomonas putida KT2440
cucgggugcgcucaa

SEQ ID NO: 1580917 - RNA, 22 nt, Pseudomonas putida KT2440
cucgguaccguucgccagcuug

SEQ ID NO: 1580918 - RNA, 12 nt, Pseudomonas putida KT2440
cucgguaccacg

SEQ ID NO: 1580919 - RNA, 22 nt, Pseudomonas putida KT2440
cucggucggcuggcacuccacu

SEQ ID NO: 1580920 - RNA, 17 nt, Pseudomonas putida KT2440
cucguuguccagcagca

SEQ ID NO: 1580921 - RNA, 23 nt, Pseudomonas putida KT2440
cucucccgcagccgauacggugc

SEQ ID NO: 1580922 - RNA, 23 nt, Pseudomonas putida KT2440
cucucgaucaugcggcaagccaa

SEQ ID NO: 1580923 - RNA, 14 nt, Pseudomonas putida KT2440
cucucgauugaccc

SEQ ID NO: 1580924 - RNA, 17 nt, Pseudomonas putida KT2440
cucguuucccgcuccaa

SEQ ID NO: 1580925 - RNA, 13 nt, Pseudomonas putida KT2440
cucguugcgccag

SEQ ID NO: 1580926 - RNA, 15 nt, Pseudomonas putida KT2440
cucguucgcgggcac

SEQ ID NO: 1580927 - RNA, 19 nt, Pseudomonas putida KT2440
cucguugaacacauccuca

SEQ ID NO: 1580928 - RNA, 18 nt, Pseudomonas putida KT2440
cucuucccaccaccagcg

SEQ ID NO: 1580929 - RNA, 17 nt, Pseudomonas putida KT2440
cucuuccugcaccuggu

SEQ ID NO: 1580930 - RNA, 22 nt, Pseudomonas putida KT2440
cucuuccugcaccugguugcca

SEQ ID NO: 1580931 - RNA, 18 nt, Pseudomonas putida KT2440
cucugaccggcacugcac

SEQ ID NO: 1580932 - RNA, 22 nt, Pseudomonas putida KT2440
cucuucgcggccuugcccgcga

SEQ ID NO: 1580933 - RNA, 17 nt, Pseudomonas putida KT2440
cucuucgcgggcucgcc

SEQ ID NO: 1580934 - RNA, 19 nt, Pseudomonas putida KT2440
cucuucgcgggugaacccg

SEQ ID NO: 1580935 - RNA, 22 nt, Pseudomonas putida KT2440
cucuucgauccgcgccaucagc

SEQ ID NO: 1580936 - RNA, 19 nt, Pseudomonas putida KT2440
cucuucgaucucuucggua

SEQ ID NO: 1580937 - RNA, 23 nt, Pseudomonas putida KT2440
cucgucggcgcgguucuucgccu

SEQ ID NO: 1580938 - RNA, 22 nt, Pseudomonas putida KT2440
cucgugacagguaggcgccacg

SEQ ID NO: 1580939 - RNA, 13 nt, Pseudomonas putida KT2440
uuggcguccagca

SEQ ID NO: 1580940 - RNA, 21 nt, Pseudomonas putida KT2440
uuggcgcgacauguucagcuu

SEQ ID NO: 1580941 - RNA, 13 nt, Pseudomonas putida KT2440
uugaaaccggcaa

SEQ ID NO: 1580942 - RNA, 13 nt, Pseudomonas putida KT2440
uuguaggcggcaa

SEQ ID NO: 1580943 - RNA, 18 nt, Pseudomonas putida KT2440
uuguaggagcggguuuac

SEQ ID NO: 1580944 - RNA, 20 nt, Pseudomonas putida KT2440
uuguaggagcugauucagca

SEQ ID NO: 1580945 - RNA, 22 nt, Pseudomonas putida KT2440
uugucggcgcgcggcucggcca

SEQ ID NO: 1580946 - RNA, 11 nt, Pseudomonas putida KT2440
uugucgaccug

SEQ ID NO: 1580947 - RNA, 12 nt, Pseudomonas putida KT2440
uugucgaccugg

SEQ ID NO: 1580948 - RNA, 23 nt, Pseudomonas putida KT2440
uuguccgccaagauccgcggcau

SEQ ID NO: 1580949 - RNA, 12 nt, Pseudomonas putida KT2440
uugucgaacagc

SEQ ID NO: 1580950 - RNA, 13 nt, Pseudomonas putida KT2440
uugucgaacagca

SEQ ID NO: 1580951 - RNA, 15 nt, Pseudomonas putida KT2440
uugggaagcgggcua

SEQ ID NO: 1580952 - RNA, 13 nt, Pseudomonas putida KT2440
uuggcuucgccgg

SEQ ID NO: 1580953 - RNA, 15 nt, Pseudomonas putida KT2440
uuggcuuguccagcc

SEQ ID NO: 1580954 - RNA, 14 nt, Pseudomonas putida KT2440
uuguucgcgcagga

SEQ ID NO: 1580955 - RNA, 14 nt, Pseudomonas putida KT2440
uuguucgucgagca

SEQ ID NO: 1580956 - RNA, 22 nt, Pseudomonas putida KT2440
uuuaccggccgcucaccggcca

SEQ ID NO: 1580957 - RNA, 17 nt, Pseudomonas putida KT2440
uuuccagcucggccuug

SEQ ID NO: 1580958 - RNA, 14 nt, Pseudomonas putida KT2440
uuucguuggccagc

SEQ ID NO: 1580959 - RNA, 22 nt, Pseudomonas putida KT2440
uuugaucagcgguucgaccgac

SEQ ID NO: 1580960 - RNA, 17 nt, Pseudomonas putida KT2440
uuugaugccaacuucca

SEQ ID NO: 1580961 - RNA, 13 nt, Pseudomonas putida KT2440
uuuuggcucaggu

SEQ ID NO: 1580962 - RNA, 19 nt, Pseudomonas putida KT2440
uuuugugccggacucaccc

SEQ ID NO: 1580963 - RNA, 22 nt, Pseudomonas putida KT2440
uuuucgucaagguugcucaggg

SEQ ID NO: 1580964 - RNA, 19 nt, Pseudomonas putida KT2440
uucgaauccugcugagucc

SEQ ID NO: 1580965 - RNA, 19 nt, Pseudomonas putida KT2440
uucgaaucgcucaugcccc

SEQ ID NO: 1580966 - RNA, 15 nt, Pseudomonas putida KT2440
uucgaacacccgcuu

SEQ ID NO: 1580967 - RNA, 21 nt, Pseudomonas putida KT2440
uucgacgcugcugucggucag

SEQ ID NO: 1580968 - RNA, 20 nt, Pseudomonas putida KT2440
uucgacgaucgacuucauca

SEQ ID NO: 1580969 - RNA, 13 nt, Pseudomonas putida KT2440
uucgaccugcgug

SEQ ID NO: 1580970 - RNA, 17 nt, Pseudomonas putida KT2440
uucgaccacugcaggug

SEQ ID NO: 1580971 - RNA, 13 nt, Pseudomonas putida KT2440
uucgaugaaggcu

SEQ ID NO: 1580972 - RNA, 18 nt, Pseudomonas putida KT2440
uucgaucagccgugacag

SEQ ID NO: 1580973 - RNA, 13 nt, Pseudomonas putida KT2440
uuccuugcagcuc

SEQ ID NO: 1580974 - RNA, 15 nt, Pseudomonas putida KT2440
uuccugagcggugaa

SEQ ID NO: 1580975 - RNA, 16 nt, Pseudomonas putida KT2440
uuccgccaccacgaac

SEQ ID NO: 1580976 - RNA, 17 nt, Pseudomonas putida KT2440
uucccauccacuucgca

SEQ ID NO: 1580977 - RNA, 20 nt, Pseudomonas putida KT2440
uuccccgcccaagcggcaga

SEQ ID NO: 1580978 - RNA, 23 nt, Pseudomonas putida KT2440
uucgcuggccugccccagcauca

SEQ ID NO: 1580979 - RNA, 14 nt, Pseudomonas putida KT2440
uucgcugcgcauca

SEQ ID NO: 1580980 - RNA, 20 nt, Pseudomonas putida KT2440
uucgcugcgcaucacccgcc

SEQ ID NO: 1580981 - RNA, 17 nt, Pseudomonas putida KT2440
uucggcagcacccgcuu

SEQ ID NO: 1580982 - RNA, 16 nt, Pseudomonas putida KT2440
uucggaucgucuggca

SEQ ID NO: 1580983 - RNA, 16 nt, Pseudomonas putida KT2440
uucgcgggcucgcccg

SEQ ID NO: 1580984 - RNA, 18 nt, Pseudomonas putida KT2440
uucgcggguaaacccccu

SEQ ID NO: 1580985 - RNA, 19 nt, Pseudomonas putida KT2440
uucgcggguaaacccgcgc

SEQ ID NO: 1580986 - RNA, 19 nt, Pseudomonas putida KT2440
uucgcggguaaacccgcuc

SEQ ID NO: 1580987 - RNA, 18 nt, Pseudomonas putida KT2440
uucgcgggugaacccgcu

SEQ ID NO: 1580988 - RNA, 19 nt, Pseudomonas putida KT2440
uucgcgggugaacccgcuc

SEQ ID NO: 1580989 - RNA, 13 nt, Pseudomonas putida KT2440
uucgcgggcaagc

SEQ ID NO: 1580990 - RNA, 18 nt, Pseudomonas putida KT2440
uucgcgggcaagcccgcu

SEQ ID NO: 1580991 - RNA, 19 nt, Pseudomonas putida KT2440
uucgcgggcacgcccgcuc

SEQ ID NO: 1580992 - RNA, 19 nt, Pseudomonas putida KT2440
uucgcgggcaugcccgcuc

SEQ ID NO: 1580993 - RNA, 15 nt, Pseudomonas putida KT2440
uucgcggaaggcgac

SEQ ID NO: 1580994 - RNA, 18 nt, Pseudomonas putida KT2440
uucgcgcauuuucaccga

SEQ ID NO: 1580995 - RNA, 14 nt, Pseudomonas putida KT2440
uucgcucaaccguu

SEQ ID NO: 1580996 - RNA, 23 nt, Pseudomonas putida KT2440
uucgcccugggcgagcaggugac

SEQ ID NO: 1580997 - RNA, 22 nt, Pseudomonas putida KT2440
uucgcccgguuccagcgcaccg

SEQ ID NO: 1580998 - RNA, 17 nt, Pseudomonas putida KT2440
uucgccaacuucgccga

SEQ ID NO: 1580999 - RNA, 17 nt, Pseudomonas putida KT2440
uucgccaagguccagcc

SEQ ID NO: 1581000 - RNA, 21 nt, Pseudomonas putida KT2440
uucgccacaacccaucacggc

SEQ ID NO: 1581001 - RNA, 11 nt, Pseudomonas putida KT2440
uucgccacugc

SEQ ID NO: 1581002 - RNA, 18 nt, Pseudomonas putida KT2440
uucgcauuaccagcacca

SEQ ID NO: 1581003 - RNA, 19 nt, Pseudomonas putida KT2440
uucgccguuguucacgguc

SEQ ID NO: 1581004 - RNA, 19 nt, Pseudomonas putida KT2440
uucgccggcaagcugguca

SEQ ID NO: 1581005 - RNA, 13 nt, Pseudomonas putida KT2440
uucgcgaacugca

SEQ ID NO: 1581006 - RNA, 19 nt, Pseudomonas putida KT2440
uucgcgaggaaacccgcgc

SEQ ID NO: 1581007 - RNA, 19 nt, Pseudomonas putida KT2440
uucgccguagccaaccgag

SEQ ID NO: 1581008 - RNA, 18 nt, Pseudomonas putida KT2440
uucggccaugaucucgcc

SEQ ID NO: 1581009 - RNA, 23 nt, Pseudomonas putida KT2440
uucggccagcacuacgccggcca

SEQ ID NO: 1581010 - RNA, 20 nt, Pseudomonas putida KT2440
uucggccagcaguucgucga

SEQ ID NO: 1581011 - RNA, 23 nt, Pseudomonas putida KT2440
uucggccagcaguucgucgagca

SEQ ID NO: 1581012 - RNA, 21 nt, Pseudomonas putida KT2440
uucggcgcacccggcuggucg

SEQ ID NO: 1581013 - RNA, 20 nt, Pseudomonas putida KT2440
uucgguaaugcccgcaggug

SEQ ID NO: 1581014 - RNA, 14 nt, Pseudomonas putida KT2440
uucggcggcgguac

SEQ ID NO: 1581015 - RNA, 17 nt, Pseudomonas putida KT2440
uucggcggccugcagcu

SEQ ID NO: 1581016 - RNA, 17 nt, Pseudomonas putida KT2440
uucgucgauguccagcg

SEQ ID NO: 1581017 - RNA, 16 nt, Pseudomonas putida KT2440
uucuucgccugcagca

SEQ ID NO: 1581018 - RNA, 16 nt, Pseudomonas putida KT2440
uucuccaacuggcgaa

SEQ ID NO: 1581019 - RNA, 17 nt, Pseudomonas putida KT2440
uucucgcagcagcaccg

SEQ ID NO: 1581020 - RNA, 19 nt, Pseudomonas putida KT2440
uucucgcagcagcaccggc

SEQ ID NO: 1581021 - RNA, 16 nt, Pseudomonas putida KT2440
uucuccggcagguuga

SEQ ID NO: 1581022 - RNA, 15 nt, Pseudomonas putida KT2440
uucuccagcucgcca

SEQ ID NO: 1581023 - RNA, 21 nt, Pseudomonas putida KT2440
uucucgcucagguaggcagca

SEQ ID NO: 1581024 - RNA, 19 nt, Pseudomonas putida KT2440
uucugcaacagcuccagca

SEQ ID NO: 1581025 - RNA, 19 nt, Pseudomonas putida KT2440
uuacguaagucaggccgau

SEQ ID NO: 1581026 - RNA, 12 nt, Pseudomonas putida KT2440
uuacgcccggga

SEQ ID NO: 1581027 - RNA, 21 nt, Pseudomonas putida KT2440
uuagcgucgaugcggccacag

SEQ ID NO: 1581028 - RNA, 18 nt, Pseudomonas putida KT2440
ugugcguucaccggcacc

SEQ ID NO: 1581029 - RNA, 18 nt, Pseudomonas putida KT2440
ugugcgugaacacugcca

SEQ ID NO: 1581030 - RNA, 15 nt, Pseudomonas putida KT2440
ugugcuggcggcugc

SEQ ID NO: 1581031 - RNA, 20 nt, Pseudomonas putida KT2440
ugugcuccagcuccaggcga

SEQ ID NO: 1581032 - RNA, 13 nt, Pseudomonas putida KT2440
ugugcucccacag

SEQ ID NO: 1581033 - RNA, 20 nt, Pseudomonas putida KT2440
uguggcagcggcuuggccgc

SEQ ID NO: 1581034 - RNA, 20 nt, Pseudomonas putida KT2440
uguggcagcucugcgacuga

SEQ ID NO: 1581035 - RNA, 15 nt, Pseudomonas putida KT2440
ugugcuuugagcagg

SEQ ID NO: 1581036 - RNA, 21 nt, Pseudomonas putida KT2440
ugugcuuugagcaggcgcucg

SEQ ID NO: 1581037 - RNA, 17 nt, Pseudomonas putida KT2440
uucagcacgggcagcuu

SEQ ID NO: 1581038 - RNA, 12 nt, Pseudomonas putida KT2440
uucacgcacggc

SEQ ID NO: 1581039 - RNA, 12 nt, Pseudomonas putida KT2440
uucacgcagguc

SEQ ID NO: 1581040 - RNA, 20 nt, Pseudomonas putida KT2440
uucaaugccagcaguucgca

SEQ ID NO: 1581041 - RNA, 16 nt, Pseudomonas putida KT2440
uucaccgagcugccca

SEQ ID NO: 1581042 - RNA, 18 nt, Pseudomonas putida KT2440
uucaaggccgccaccucg

SEQ ID NO: 1581043 - RNA, 22 nt, Pseudomonas putida KT2440
uuauccgcgaguaaagccagca

SEQ ID NO: 1581044 - RNA, 16 nt, Pseudomonas putida KT2440
uuauccuucaggcgcu

SEQ ID NO: 1581045 - RNA, 16 nt, Pseudomonas putida KT2440
uuauccugcagcacca

SEQ ID NO: 1581046 - RNA, 12 nt, Pseudomonas putida KT2440
uucccagcaccc

SEQ ID NO: 1581047 - RNA, 21 nt, Pseudomonas putida KT2440
uuccaugcgcgcgcgguucac

SEQ ID NO: 1581048 - RNA, 12 nt, Pseudomonas putida KT2440
uuccaucaugcg

SEQ ID NO: 1581049 - RNA, 15 nt, Pseudomonas putida KT2440
uucaugguguccggc

SEQ ID NO: 1581050 - RNA, 14 nt, Pseudomonas putida KT2440
uuccagucggccug

SEQ ID NO: 1581051 - RNA, 18 nt, Pseudomonas putida KT2440
uuccaggcuuuugaaguc

SEQ ID NO: 1581052 - RNA, 21 nt, Pseudomonas putida KT2440
uucaucgaacugcaagcucga

SEQ ID NO: 1581053 - RNA, 22 nt, Pseudomonas putida KT2440
uucaugcacaacgcgcgggcaa

SEQ ID NO: 1581054 - RNA, 16 nt, Pseudomonas putida KT2440
uucagcucggccaccc

SEQ ID NO: 1581055 - RNA, 20 nt, Pseudomonas putida KT2440
uucagcgcggcaaccugcuc

SEQ ID NO: 1581056 - RNA, 14 nt, Pseudomonas putida KT2440
ugucguucgaacuc

SEQ ID NO: 1581057 - RNA, 23 nt, Pseudomonas putida KT2440
ugugccuggcgcuugaucagccu

SEQ ID NO: 1581058 - RNA, 22 nt, Pseudomonas putida KT2440
ugugccggccucuucgcgggca

SEQ ID NO: 1581059 - RNA, 23 nt, Pseudomonas putida KT2440
ugugccggccucuucgcggguaa

SEQ ID NO: 1581060 - RNA, 15 nt, Pseudomonas putida KT2440
ugucuuccggcaggu

SEQ ID NO: 1581061 - RNA, 17 nt, Pseudomonas putida KT2440
ugucuuccggcaggucg

SEQ ID NO: 1581062 - RNA, 20 nt, Pseudomonas putida KT2440
ugucuucgcggaaggccuca

SEQ ID NO: 1581063 - RNA, 14 nt, Pseudomonas putida KT2440
ugucggagcgggcu

SEQ ID NO: 1581064 - RNA, 20 nt, Pseudomonas putida KT2440
ugucggcacgcgccagcagc

SEQ ID NO: 1581065 - RNA, 18 nt, Pseudomonas putida KT2440
ugucggcgaaggcuggcc

SEQ ID NO: 1581066 - RNA, 22 nt, Pseudomonas putida KT2440
ugucggcgcggaugugacgcug

SEQ ID NO: 1581067 - RNA, 23 nt, Pseudomonas putida KT2440
ugucgucaagcucuuccuugauc

SEQ ID NO: 1581068 - RNA, 15 nt, Pseudomonas putida KT2440
ugucgggcaguucga

SEQ ID NO: 1581069 - RNA, 14 nt, Pseudomonas putida KT2440
ugucggcgugcacc

SEQ ID NO: 1581070 - RNA, 21 nt, Pseudomonas putida KT2440
ugucggucagggcacggcugc

SEQ ID NO: 1581071 - RNA, 13 nt, Pseudomonas putida KT2440
ugucgguacuggc

SEQ ID NO: 1581072 - RNA, 17 nt, Pseudomonas putida KT2440
ugucggucacagcagug

SEQ ID NO: 1581073 - RNA, 19 nt, Pseudomonas putida KT2440
uguccugcaacugggcaau

SEQ ID NO: 1581074 - RNA, 20 nt, Pseudomonas putida KT2440
ugucgaacuucuccagcguc

SEQ ID NO: 1581075 - RNA, 21 nt, Pseudomonas putida KT2440
ugucgaacagcugaucgccgu

SEQ ID NO: 1581076 - RNA, 16 nt, Pseudomonas putida KT2440
uguccuggaucagccg

SEQ ID NO: 1581077 - RNA, 15 nt, Pseudomonas putida KT2440
ugucgaugccugcua

SEQ ID NO: 1581078 - RNA, 15 nt, Pseudomonas putida KT2440
ugucccaggccauca

SEQ ID NO: 1581079 - RNA, 14 nt, Pseudomonas putida KT2440
uguaggcgcggguu

SEQ ID NO: 1581080 - RNA, 20 nt, Pseudomonas putida KT2440
uguaggcgcggguuuacccg

SEQ ID NO: 1581081 - RNA, 20 nt, Pseudomonas putida KT2440
uguaggugcggcuuuagccg

SEQ ID NO: 1581082 - RNA, 16 nt, Pseudomonas putida KT2440
ugucaacaggcuggcc

SEQ ID NO: 1581083 - RNA, 19 nt, Pseudomonas putida KT2440
uguauuuagucaggguguc

SEQ ID NO: 1581084 - RNA, 21 nt, Pseudomonas putida KT2440
uggucaccacguugcgcuuga

SEQ ID NO: 1581085 - RNA, 12 nt, Pseudomonas putida KT2440
uggucaccggga

SEQ ID NO: 1581086 - RNA, 15 nt, Pseudomonas putida KT2440
uggucacggccaccc

SEQ ID NO: 1581087 - RNA, 16 nt, Pseudomonas putida KT2440
ugguauugcccgacaa

SEQ ID NO: 1581088 - RNA, 18 nt, Pseudomonas putida KT2440
ugguccagcuucaccuca

SEQ ID NO: 1581089 - RNA, 19 nt, Pseudomonas putida KT2440
ugguccagcguucggccag

SEQ ID NO: 1581090 - RNA, 18 nt, Pseudomonas putida KT2440
ugguccagggccauggcg

SEQ ID NO: 1581091 - RNA, 15 nt, Pseudomonas putida KT2440
uggucaggaucaccc

SEQ ID NO: 1581092 - RNA, 21 nt, Pseudomonas putida KT2440
uggucagcgcuucgcucauca

SEQ ID NO: 1581093 - RNA, 11 nt, Pseudomonas putida KT2440
uggucagcgga

SEQ ID NO: 1581094 - RNA, 16 nt, Pseudomonas putida KT2440
uggucauccaggcugg

SEQ ID NO: 1581095 - RNA, 23 nt, Pseudomonas putida KT2440
uggucgaggcaaagaacagcgug

SEQ ID NO: 1581096 - RNA, 19 nt, Pseudomonas putida KT2440
uggucgaaccgcaacuggc

SEQ ID NO: 1581097 - RNA, 17 nt, Pseudomonas putida KT2440
uggucgcaguacaacgu

SEQ ID NO: 1581098 - RNA, 17 nt, Pseudomonas putida KT2440
ugguccggucacugcgc

SEQ ID NO: 1581099 - RNA, 19 nt, Pseudomonas putida KT2440
uggucgccgugcagcaccg

SEQ ID NO: 1581100 - RNA, 16 nt, Pseudomonas putida KT2440
uggucgcggcgcuggc

SEQ ID NO: 1581101 - RNA, 17 nt, Pseudomonas putida KT2440
uggucgcggcgcuggcc

SEQ ID NO: 1581102 - RNA, 12 nt, Pseudomonas putida KT2440
uggucgcggcaa

SEQ ID NO: 1581103 - RNA, 19 nt, Pseudomonas putida KT2440
uggucgcugcggcacacca

SEQ ID NO: 1581104 - RNA, 20 nt, Pseudomonas putida KT2440
uggucgcgucgcccagacgg

SEQ ID NO: 1581105 - RNA, 21 nt, Pseudomonas putida KT2440
uggucgcgugccgccaguucg

SEQ ID NO: 1581106 - RNA, 20 nt, Pseudomonas putida KT2440
uggugaguggcccuggagcg

SEQ ID NO: 1581107 - RNA, 20 nt, Pseudomonas putida KT2440
uggugagcccugugggagcg

SEQ ID NO: 1581108 - RNA, 20 nt, Pseudomonas putida KT2440
uggugaagaagcaacuguug

SEQ ID NO: 1581109 - RNA, 14 nt, Pseudomonas putida KT2440
uggugaccucgaug

SEQ ID NO: 1581110 - RNA, 23 nt, Pseudomonas putida KT2440
uggugaccucgaugcccuccagc

SEQ ID NO: 1581111 - RNA, 21 nt, Pseudomonas putida KT2440
uggucucgaacugaugaccgg

SEQ ID NO: 1581112 - RNA, 20 nt, Pseudomonas putida KT2440
uggugaaagucgaccagcag

SEQ ID NO: 1581113 - RNA, 15 nt, Pseudomonas putida KT2440
uggugaaggccagga

SEQ ID NO: 1581114 - RNA, 21 nt, Pseudomonas putida KT2440
uggugaaggccaggaacagcg

SEQ ID NO: 1581115 - RNA, 17 nt, Pseudomonas putida KT2440
uggugcgccuccagcag

SEQ ID NO: 1581116 - RNA, 11 nt, Pseudomonas putida KT2440
uggugcgcgca

SEQ ID NO: 1581117 - RNA, 13 nt, Pseudomonas putida KT2440
uggugccggcacg

SEQ ID NO: 1581118 - RNA, 20 nt, Pseudomonas putida KT2440
uggugccguuggacgccgca

SEQ ID NO: 1581119 - RNA, 13 nt, Pseudomonas putida KT2440
uggugucggccag

SEQ ID NO: 1581120 - RNA, 13 nt, Pseudomonas putida KT2440
ugguguccggcau

SEQ ID NO: 1581121 - RNA, 22 nt, Pseudomonas putida KT2440
ugguguucugguugaacugcuu

SEQ ID NO: 1581122 - RNA, 18 nt, Pseudomonas putida KT2440
ugguuuuccaccggcacg

SEQ ID NO: 1581123 - RNA, 13 nt, Pseudomonas putida KT2440
ugguuuucgcggu

SEQ ID NO: 1581124 - RNA, 15 nt, Pseudomonas putida KT2440
ugguuccugggaagc

SEQ ID NO: 1581125 - RNA, 12 nt, Pseudomonas putida KT2440
uggcgcaaaccc

SEQ ID NO: 1581126 - RNA, 14 nt, Pseudomonas putida KT2440
uggcgaugaacugc

SEQ ID NO: 1581127 - RNA, 17 nt, Pseudomonas putida KT2440
uggcgauccacagcggg

SEQ ID NO: 1581128 - RNA, 20 nt, Pseudomonas putida KT2440
uggcgaucgaacaacugucc

SEQ ID NO: 1581129 - RNA, 22 nt, Pseudomonas putida KT2440
uggcgaucgaacaacuguccug

SEQ ID NO: 1581130 - RNA, 13 nt, Pseudomonas putida KT2440
uggcgaucgaacg

SEQ ID NO: 1581131 - RNA, 15 nt, Pseudomonas putida KT2440
uggcgaucggcuggu

SEQ ID NO: 1581132 - RNA, 20 nt, Pseudomonas putida KT2440
uggcgaucccuguaggagcg

SEQ ID NO: 1581133 - RNA, 14 nt, Pseudomonas putida KT2440
uggcgcucaauggc

SEQ ID NO: 1581134 - RNA, 14 nt, Pseudomonas putida KT2440
uggcgccugacacu

SEQ ID NO: 1581135 - RNA, 21 nt, Pseudomonas putida KT2440
uggcgccugacacuaggagug

SEQ ID NO: 1581136 - RNA, 17 nt, Pseudomonas putida KT2440
uggcgccugcggcauca

SEQ ID NO: 1581137 - RNA, 20 nt, Pseudomonas putida KT2440
uggcgccuugauuaccagcg

SEQ ID NO: 1581138 - RNA, 23 nt, Pseudomonas putida KT2440
uggccggucuguucggcaaggua

SEQ ID NO: 1581139 - RNA, 15 nt, Pseudomonas putida KT2440
uggccguagccaggc

SEQ ID NO: 1581140 - RNA, 13 nt, Pseudomonas putida KT2440
uggccgcgcgggu

SEQ ID NO: 1581141 - RNA, 23 nt, Pseudomonas putida KT2440
ugcuugucauaagccuuucaucg

SEQ ID NO: 1581142 - RNA, 15 nt, Pseudomonas putida KT2440
ugcuuuuuugugccu

SEQ ID NO: 1581143 - RNA, 12 nt, Pseudomonas putida KT2440
uggaaaacagcg

SEQ ID NO: 1581144 - RNA, 14 nt, Pseudomonas putida KT2440
uggaaaacagcgcg

SEQ ID NO: 1581145 - RNA, 14 nt, Pseudomonas putida KT2440
uggaaaauccgcuu

SEQ ID NO: 1581146 - RNA, 13 nt, Pseudomonas putida KT2440
uggaaaucgccug

SEQ ID NO: 1581147 - RNA, 19 nt, Pseudomonas putida KT2440
uggccugcagccguugcug

SEQ ID NO: 1581148 - RNA, 16 nt, Pseudomonas putida KT2440
uggccugcaugcucau

SEQ ID NO: 1581149 - RNA, 13 nt, Pseudomonas putida KT2440
uggccugcauguc

SEQ ID NO: 1581150 - RNA, 18 nt, Pseudomonas putida KT2440
uggccucggcgaucgcca

SEQ ID NO: 1581151 - RNA, 19 nt, Pseudomonas putida KT2440
uggccucggcgaucgccag

SEQ ID NO: 1581152 - RNA, 21 nt, Pseudomonas putida KT2440
uggccucacauucaccgccac

SEQ ID NO: 1581153 - RNA, 16 nt, Pseudomonas putida KT2440
uggccguguucgacga

SEQ ID NO: 1581154 - RNA, 13 nt, Pseudomonas putida KT2440
uggccugagccgg

SEQ ID NO: 1581155 - RNA, 15 nt, Pseudomonas putida KT2440
uggccucuucgcggg

SEQ ID NO: 1581156 - RNA, 22 nt, Pseudomonas putida KT2440
uggcgacagcccauagcgccau

SEQ ID NO: 1581157 - RNA, 19 nt, Pseudomonas putida KT2440
uggcgaaucagcaugccca

SEQ ID NO: 1581158 - RNA, 23 nt, Pseudomonas putida KT2440
uggcgaccggcguguugccgcug

SEQ ID NO: 1581159 - RNA, 18 nt, Pseudomonas putida KT2440
uggcgacgcugcccagca

SEQ ID NO: 1581160 - RNA, 23 nt, Pseudomonas putida KT2440
uggcgacgaguuuaccuccauca

SEQ ID NO: 1581161 - RNA, 16 nt, Pseudomonas putida KT2440
uggggcaacugcgcga

SEQ ID NO: 1581162 - RNA, 17 nt, Pseudomonas putida KT2440
uggggcaacugcgcgau

SEQ ID NO: 1581163 - RNA, 18 nt, Pseudomonas putida KT2440
uggggccgcugugggagu

SEQ ID NO: 1581164 - RNA, 16 nt, Pseudomonas putida KT2440
uggggccgcuuggcgg

SEQ ID NO: 1581165 - RNA, 19 nt, Pseudomonas putida KT2440
uggggccgcuuugcggccc

SEQ ID NO: 1581166 - RNA, 14 nt, Pseudomonas putida KT2440
uggguccaggcaca

SEQ ID NO: 1581167 - RNA, 15 nt, Pseudomonas putida KT2440
ugggucaggaugccg

SEQ ID NO: 1581168 - RNA, 15 nt, Pseudomonas putida KT2440
ugggucacggcaucc

SEQ ID NO: 1581169 - RNA, 15 nt, Pseudomonas putida KT2440
ugggucacccaggug

SEQ ID NO: 1581170 - RNA, 23 nt, Pseudomonas putida KT2440
ugggucgccacgccggucgggca

SEQ ID NO: 1581171 - RNA, 16 nt, Pseudomonas putida KT2440
ugguaguuguccaccu

SEQ ID NO: 1581172 - RNA, 15 nt, Pseudomonas putida KT2440
ugggcgcuuugcacc

SEQ ID NO: 1581173 - RNA, 20 nt, Pseudomonas putida KT2440
ugggcgcuuugcacccgcgc

SEQ ID NO: 1581174 - RNA, 23 nt, Pseudomonas putida KT2440
ugggcucagccgccacaugcccg

SEQ ID NO: 1581175 - RNA, 17 nt, Pseudomonas putida KT2440
ugggcuguuccagcagc

SEQ ID NO: 1581176 - RNA, 18 nt, Pseudomonas putida KT2440
ugggcuguuccagcagcg

SEQ ID NO: 1581177 - RNA, 15 nt, Pseudomonas putida KT2440
ugggcugcaaagcag

SEQ ID NO: 1581178 - RNA, 20 nt, Pseudomonas putida KT2440
ugggcuuuucguuggccagc

SEQ ID NO: 1581179 - RNA, 23 nt, Pseudomonas putida KT2440
ugggcuuuucguuggccagcuug

SEQ ID NO: 1581180 - RNA, 20 nt, Pseudomonas putida KT2440
ugggcuucaugcugcugcag

SEQ ID NO: 1581181 - RNA, 15 nt, Pseudomonas putida KT2440
ugggcuuugggagca

SEQ ID NO: 1581182 - RNA, 13 nt, Pseudomonas putida KT2440
ugggcuugauccg

SEQ ID NO: 1581183 - RNA, 17 nt, Pseudomonas putida KT2440
uggcuuccggcgcuggu

SEQ ID NO: 1581184 - RNA, 20 nt, Pseudomonas putida KT2440
uggcuuccacggcgcgcuuc

SEQ ID NO: 1581185 - RNA, 23 nt, Pseudomonas putida KT2440
uggcuuacaucaugccgcccaug

SEQ ID NO: 1581186 - RNA, 23 nt, Pseudomonas putida KT2440
uggcugugauacagcacgcgcau

SEQ ID NO: 1581187 - RNA, 23 nt, Pseudomonas putida KT2440
uggcugugcacccgugccugccu

SEQ ID NO: 1581188 - RNA, 16 nt, Pseudomonas putida KT2440
uggcuguucaggccgg

SEQ ID NO: 1581189 - RNA, 19 nt, Pseudomonas putida KT2440
uggcuguucgucggccuug

SEQ ID NO: 1581190 - RNA, 14 nt, Pseudomonas putida KT2440
uggcugucugcagc

SEQ ID NO: 1581191 - RNA, 22 nt, Pseudomonas putida KT2440
uggcugggggcgcuuugcgccc

SEQ ID NO: 1581192 - RNA, 15 nt, Pseudomonas putida KT2440
uggcuucgccggcca

SEQ ID NO: 1581193 - RNA, 11 nt, Pseudomonas putida KT2440
uggcuugcguu

SEQ ID NO: 1581194 - RNA, 15 nt, Pseudomonas putida KT2440
uggcuuguccagcca

SEQ ID NO: 1581195 - RNA, 17 nt, Pseudomonas putida KT2440
uggcuuguucggcaucg

SEQ ID NO: 1581196 - RNA, 14 nt, Pseudomonas putida KT2440
ugggcaaggccguu

SEQ ID NO: 1581197 - RNA, 18 nt, Pseudomonas putida KT2440
ugggcaagggccugcagg

SEQ ID NO: 1581198 - RNA, 13 nt, Pseudomonas putida KT2440
ugggcaaccaggu

SEQ ID NO: 1581199 - RNA, 17 nt, Pseudomonas putida KT2440
ugggcacaauugugccg

SEQ ID NO: 1581200 - RNA, 16 nt, Pseudomonas putida KT2440
ugggcaauguccagcc

SEQ ID NO: 1581201 - RNA, 17 nt, Pseudomonas putida KT2440
ugggcaauguccagccc

SEQ ID NO: 1581202 - RNA, 16 nt, Pseudomonas putida KT2440
ugggccgccaagcggc

SEQ ID NO: 1581203 - RNA, 15 nt, Pseudomonas putida KT2440
uggcuagccucauca

SEQ ID NO: 1581204 - RNA, 19 nt, Pseudomonas putida KT2440
uggcguugucagcaaccgg

SEQ ID NO: 1581205 - RNA, 15 nt, Pseudomonas putida KT2440
uggcguuguccagca

SEQ ID NO: 1581206 - RNA, 16 nt, Pseudomonas putida KT2440
uggcucagcucggcau

SEQ ID NO: 1581207 - RNA, 13 nt, Pseudomonas putida KT2440
uggcucaucaccg

SEQ ID NO: 1581208 - RNA, 19 nt, Pseudomonas putida KT2440
uggcucaucaccggcguug

SEQ ID NO: 1581209 - RNA, 22 nt, Pseudomonas putida KT2440
uggcucaucagcaacccggcca

SEQ ID NO: 1581210 - RNA, 19 nt, Pseudomonas putida KT2440
uggcuagggucguccuggg

SEQ ID NO: 1581211 - RNA, 13 nt, Pseudomonas putida KT2440
uggcuaucagccg

SEQ ID NO: 1581212 - RNA, 19 nt, Pseudomonas putida KT2440
uggcucaccuuaucggccg

SEQ ID NO: 1581213 - RNA, 18 nt, Pseudomonas putida KT2440
uggcucgaaucaagccug

SEQ ID NO: 1581214 - RNA, 13 nt, Pseudomonas putida KT2440
uggcgguccaccg

SEQ ID NO: 1581215 - RNA, 16 nt, Pseudomonas putida KT2440
uggcgguccaccgcca

SEQ ID NO: 1581216 - RNA, 18 nt, Pseudomonas putida KT2440
uggcgguauucacaccug

SEQ ID NO: 1581217 - RNA, 16 nt, Pseudomonas putida KT2440
uggcgggcaaacuggc

SEQ ID NO: 1581218 - RNA, 17 nt, Pseudomonas putida KT2440
uggcgggcaaacuggcg

SEQ ID NO: 1581219 - RNA, 13 nt, Pseudomonas putida KT2440
uggcggcugcccg

SEQ ID NO: 1581220 - RNA, 20 nt, Pseudomonas putida KT2440
uaaacaauucccagccuuuc

SEQ ID NO: 1581221 - RNA, 22 nt, Pseudomonas putida KT2440
uaaccgcgcugguaagccucga

SEQ ID NO: 1581222 - RNA, 12 nt, Pseudomonas putida KT2440
uaacaugcuggc

SEQ ID NO: 1581223 - RNA, 21 nt, Pseudomonas putida KT2440
uaagcuucagcgaccgacacg

SEQ ID NO: 1581224 - RNA, 16 nt, Pseudomonas putida KT2440
uaaggaucgcgcagca

SEQ ID NO: 1581225 - RNA, 15 nt, Pseudomonas putida KT2440
uaagauacgcgcaga

SEQ ID NO: 1581226 - RNA, 16 nt, Pseudomonas putida KT2440
uaaugcgcacggcuuc

SEQ ID NO: 1581227 - RNA, 19 nt, Pseudomonas putida KT2440
uacaggccccacaacggcc

SEQ ID NO: 1581228 - RNA, 14 nt, Pseudomonas putida KT2440
uacagggguagcgu

SEQ ID NO: 1581229 - RNA, 13 nt, Pseudomonas putida KT2440
uacagcucccgcg

SEQ ID NO: 1581230 - RNA, 19 nt, Pseudomonas putida KT2440
uacagcgugguauugcgcg

SEQ ID NO: 1581231 - RNA, 18 nt, Pseudomonas putida KT2440
uacaacgcagccggcacc

SEQ ID NO: 1581232 - RNA, 20 nt, Pseudomonas putida KT2440
uacaagcuggcacgugcagg

SEQ ID NO: 1581233 - RNA, 14 nt, Pseudomonas putida KT2440
uacaaggaccucaa

SEQ ID NO: 1581234 - RNA, 16 nt, Pseudomonas putida KT2440
uacacugcaggagcgg

SEQ ID NO: 1581235 - RNA, 15 nt, Pseudomonas putida KT2440
guuuuccaccggcac

SEQ ID NO: 1581236 - RNA, 13 nt, Pseudomonas putida KT2440
guuuucgcugauc

SEQ ID NO: 1581237 - RNA, 16 nt, Pseudomonas putida KT2440
guuuggccugacgcuu

SEQ ID NO: 1581238 - RNA, 16 nt, Pseudomonas putida KT2440
guuugcaacuggcgca

SEQ ID NO: 1581239 - RNA, 16 nt, Pseudomonas putida KT2440
guuugacagcccugca

SEQ ID NO: 1581240 - RNA, 13 nt, Pseudomonas putida KT2440
guuucucgcagca

SEQ ID NO: 1581241 - RNA, 15 nt, Pseudomonas putida KT2440
guuguagaucgccgg

SEQ ID NO: 1581242 - RNA, 23 nt, Pseudomonas putida KT2440
guuguaaagaaaagccgcuggcc

SEQ ID NO: 1581243 - RNA, 13 nt, Pseudomonas putida KT2440
guuguccaccuga

SEQ ID NO: 1581244 - RNA, 15 nt, Pseudomonas putida KT2440
guugucccgcccuga

SEQ ID NO: 1581245 - RNA, 15 nt, Pseudomonas putida KT2440
guuguccagcagcag

SEQ ID NO: 1581246 - RNA, 13 nt, Pseudomonas putida KT2440
guugucgcgagug

SEQ ID NO: 1581247 - RNA, 13 nt, Pseudomonas putida KT2440
guuggugggcaac

SEQ ID NO: 1581248 - RNA, 16 nt, Pseudomonas putida KT2440
guugguggugcgcccg

SEQ ID NO: 1581249 - RNA, 14 nt, Pseudomonas putida KT2440
guuggccgaaggcc

SEQ ID NO: 1581250 - RNA, 23 nt, Pseudomonas putida KT2440
guuggcccgccaauacccacguc

SEQ ID NO: 1581251 - RNA, 19 nt, Pseudomonas putida KT2440
guuggccaccaucgccggc

SEQ ID NO: 1581252 - RNA, 16 nt, Pseudomonas putida KT2440
guuuaccuccaucacc

SEQ ID NO: 1581253 - RNA, 20 nt, Pseudomonas putida KT2440
guuuacccgcgaaagggcca

SEQ ID NO: 1581254 - RNA, 20 nt, Pseudomonas putida KT2440
guuuacccgcgaagaggcca

SEQ ID NO: 1581255 - RNA, 20 nt, Pseudomonas putida KT2440
guuuacccgcgaagaggccc

SEQ ID NO: 1581256 - RNA, 20 nt, Pseudomonas putida KT2440
guuuacccgcgaaggggccg

SEQ ID NO: 1581257 - RNA, 20 nt, Pseudomonas putida KT2440
guuuacccgcgaaugggccg

SEQ ID NO: 1581258 - RNA, 19 nt, Pseudomonas putida KT2440
guuuaguccugcagcggca

SEQ ID NO: 1581259 - RNA, 22 nt, Pseudomonas putida KT2440
guuuccuguguaggagcggguu

SEQ ID NO: 1581260 - RNA, 16 nt, Pseudomonas putida KT2440
guuuccgguuggucga

SEQ ID NO: 1581261 - RNA, 14 nt, Pseudomonas putida KT2440
guugcaggucggca

SEQ ID NO: 1581262 - RNA, 16 nt, Pseudomonas putida KT2440
guugcaggucggcacg

SEQ ID NO: 1581263 - RNA, 12 nt, Pseudomonas putida KT2440
guugcaucgcgc

SEQ ID NO: 1581264 - RNA, 13 nt, Pseudomonas putida KT2440
guugccaccagca

SEQ ID NO: 1581265 - RNA, 15 nt, Pseudomonas putida KT2440
guugaggccgaacac

SEQ ID NO: 1581266 - RNA, 23 nt, Pseudomonas putida KT2440
guugagggugacccagcgcuggu

SEQ ID NO: 1581267 - RNA, 20 nt, Pseudomonas putida KT2440
guugcaacgcagcgcgugcu

SEQ ID NO: 1581268 - RNA, 19 nt, Pseudomonas putida KT2440
guugccggcgagcgcgugc

SEQ ID NO: 1581269 - RNA, 16 nt, Pseudomonas putida KT2440
guugcgcucgucgaac

SEQ ID NO: 1581270 - RNA, 20 nt, Pseudomonas putida KT2440
guugcggaacauacgcauca

SEQ ID NO: 1581271 - RNA, 18 nt, Pseudomonas putida KT2440
guugccugugagaucgag

SEQ ID NO: 1581272 - RNA, 16 nt, Pseudomonas putida KT2440
guugccugugcuggcc

SEQ ID NO: 1581273 - RNA, 20 nt, Pseudomonas putida KT2440
guugccuguaggcgcggguu

SEQ ID NO: 1581274 - RNA, 17 nt, Pseudomonas putida KT2440
guugcugccgaucaccg

SEQ ID NO: 1581275 - RNA, 18 nt, Pseudomonas putida KT2440
guugcuggcgacgcugcc

SEQ ID NO: 1581276 - RNA, 17 nt, Pseudomonas putida KT2440
guugcuggcgaucggcu

SEQ ID NO: 1581277 - RNA, 17 nt, Pseudomonas putida KT2440
guugcuggcgccagcga

SEQ ID NO: 1581278 - RNA, 14 nt, Pseudomonas putida KT2440
guucuccggcaggu

SEQ ID NO: 1581279 - RNA, 12 nt, Pseudomonas putida KT2440
guucgugcaccc

SEQ ID NO: 1581280 - RNA, 14 nt, Pseudomonas putida KT2440
guggucuucaaggc

SEQ ID NO: 1581281 - RNA, 21 nt, Pseudomonas putida KT2440
guggucuucaaggccaccacg

SEQ ID NO: 1581282 - RNA, 16 nt, Pseudomonas putida KT2440
guggugaaacgggucu

SEQ ID NO: 1581283 - RNA, 12 nt, Pseudomonas putida KT2440
guucguccaggc

SEQ ID NO: 1581284 - RNA, 15 nt, Pseudomonas putida KT2440
guugagcaccggcag

SEQ ID NO: 1581285 - RNA, 24 nt, Pseudomonas putida KT2440
guugacguuguagcggccaucgca

SEQ ID NO: 1581286 - RNA, 12 nt, Pseudomonas putida KT2440
guugagcgccgc

SEQ ID NO: 1581287 - RNA, 15 nt, Pseudomonas putida KT2440
guugaaggcgaauga

SEQ ID NO: 1581288 - RNA, 16 nt, Pseudomonas putida KT2440
guugaaggcgaaugag

SEQ ID NO: 1581289 - RNA, 17 nt, Pseudomonas putida KT2440
guugacacccucuugaa

SEQ ID NO: 1581290 - RNA, 20 nt, Pseudomonas putida KT2440
guugaauguugacgaacagc

SEQ ID NO: 1581291 - RNA, 21 nt, Pseudomonas putida KT2440
guugaccaaggaacugcgcug

SEQ ID NO: 1581292 - RNA, 22 nt, Pseudomonas putida KT2440
guugaagcgccgguauucgcga

SEQ ID NO: 1581293 - RNA, 16 nt, Pseudomonas putida KT2440
guucugcagccugacg

SEQ ID NO: 1581294 - RNA, 22 nt, Pseudomonas putida KT2440
uaggucacguuguagcccacca

SEQ ID NO: 1581295 - RNA, 10 nt, Pseudomonas putida KT2440
uaggucaggu

SEQ ID NO: 1581296 - RNA, 16 nt, Pseudomonas putida KT2440
uaguccugcagcggca

SEQ ID NO: 1581297 - RNA, 15 nt, Pseudomonas putida KT2440
uagugaugcaucagc

SEQ ID NO: 1581298 - RNA, 15 nt, Pseudomonas putida KT2440
uagugcaggcgcagg

SEQ ID NO: 1581299 - RNA, 17 nt, Pseudomonas putida KT2440
uaguucacuggccagca

SEQ ID NO: 1581300 - RNA, 20 nt, Pseudomonas putida KT2440
uauaccgcgcacgcaucugc

SEQ ID NO: 1581301 - RNA, 16 nt, Pseudomonas putida KT2440
uaguuugacagcccug

SEQ ID NO: 1581302 - RNA, 18 nt, Pseudomonas putida KT2440
uauacagcaggcucaggg

SEQ ID NO: 1581303 - RNA, 20 nt, Pseudomonas putida KT2440
uaucgguguucccgcucguu

SEQ ID NO: 1581304 - RNA, 13 nt, Pseudomonas putida KT2440
uaucggccagcaa

SEQ ID NO: 1581305 - RNA, 14 nt, Pseudomonas putida KT2440
uaucggccauggcc

SEQ ID NO: 1581306 - RNA, 20 nt, Pseudomonas putida KT2440
uauccgacacagucgucggc

SEQ ID NO: 1581307 - RNA, 22 nt, Pseudomonas putida KT2440
uauccagcugcaacagcggcga

SEQ ID NO: 1581308 - RNA, 16 nt, Pseudomonas putida KT2440
uauccagcaccggcgu

SEQ ID NO: 1581309 - RNA, 13 nt, Pseudomonas putida KT2440
uaugggcagcacc

SEQ ID NO: 1581310 - RNA, 21 nt, Pseudomonas putida KT2440
uaugagccuacagcaaccgcg

SEQ ID NO: 1581311 - RNA, 13 nt, Pseudomonas putida KT2440
uauuggccagcaa

SEQ ID NO: 1581312 - RNA, 20 nt, Pseudomonas putida KT2440
uauucgcggguaaacccgcu

SEQ ID NO: 1581313 - RNA, 22 nt, Pseudomonas putida KT2440
uagccguggggcucgcgcaaca

SEQ ID NO: 1581314 - RNA, 18 nt, Pseudomonas putida KT2440
uagccggccucagcagcg

SEQ ID NO: 1581315 - RNA, 14 nt, Pseudomonas putida KT2440
uagaucagcgaugc

SEQ ID NO: 1581316 - RNA, 18 nt, Pseudomonas putida KT2440
uagaucgccggcagcacg

SEQ ID NO: 1581317 - RNA, 13 nt, Pseudomonas putida KT2440
uagauggcugucu

SEQ ID NO: 1581318 - RNA, 18 nt, Pseudomonas putida KT2440
uagcguagugcaggcgca

SEQ ID NO: 1581319 - RNA, 19 nt, Pseudomonas putida KT2440
uagcgucgaugcggccaca

SEQ ID NO: 1581320 - RNA, 19 nt, Pseudomonas putida KT2440
uagccugcacuggccucuu

SEQ ID NO: 1581321 - RNA, 15 nt, Pseudomonas putida KT2440
uagccuguggggcaa

SEQ ID NO: 1581322 - RNA, 21 nt, Pseudomonas putida KT2440
uagccuucagcggccgcgcaa

SEQ ID NO: 1581323 - RNA, 21 nt, Pseudomonas putida KT2440
uagccuucuucggucagcugg

SEQ ID NO: 1581324 - RNA, 18 nt, Pseudomonas putida KT2440
uaggcuccaucuccagcu

SEQ ID NO: 1581325 - RNA, 20 nt, Pseudomonas putida KT2440
uaggcgcggguuugcccgcg

SEQ ID NO: 1581326 - RNA, 18 nt, Pseudomonas putida KT2440
uaggcgaacuuuucgcca

SEQ ID NO: 1581327 - RNA, 11 nt, Pseudomonas putida KT2440
uagcugaccuu

SEQ ID NO: 1581328 - RNA, 20 nt, Pseudomonas putida KT2440
uagcuccagcccagcgccag

SEQ ID NO: 1581329 - RNA, 19 nt, Pseudomonas putida KT2440
uagcuguugcgcugggcgu

SEQ ID NO: 1581330 - RNA, 20 nt, Pseudomonas putida KT2440
uagcuuucaggcgcagcaca

SEQ ID NO: 1581331 - RNA, 14 nt, Pseudomonas putida KT2440
uagcuuuccagcau

SEQ ID NO: 1581332 - RNA, 16 nt, Pseudomonas putida KT2440
uaggcagccaccucga

SEQ ID NO: 1581333 - RNA, 18 nt, Pseudomonas putida KT2440
uaggcccagcccagcccg

SEQ ID NO: 1581334 - RNA, 19 nt, Pseudomonas putida KT2440
uaggccaagguugccacca

SEQ ID NO: 1581335 - RNA, 20 nt, Pseudomonas putida KT2440
uaggaucggguuuacccgcg

SEQ ID NO: 1581336 - RNA, 21 nt, Pseudomonas putida KT2440
uaggagcgagcuugcucgcga

SEQ ID NO: 1581337 - RNA, 21 nt, Pseudomonas putida KT2440
uaggagcgggcuuacccgcga

SEQ ID NO: 1581338 - RNA, 21 nt, Pseudomonas putida KT2440
uaggagcgggcuugcccgcga

SEQ ID NO: 1581339 - RNA, 20 nt, Pseudomonas putida KT2440
uaggagcgggucuacccgcg

SEQ ID NO: 1581340 - RNA, 21 nt, Pseudomonas putida KT2440
uaggagcgggucuacccgcga

SEQ ID NO: 1581341 - RNA, 22 nt, Pseudomonas putida KT2440
uaggagcgggucuacccgcgaa

SEQ ID NO: 1581342 - RNA, 19 nt, Pseudomonas putida KT2440
uaggagcggguucacccgc

SEQ ID NO: 1581343 - RNA, 20 nt, Pseudomonas putida KT2440
uaggagcggguucacccgcg

SEQ ID NO: 1581344 - RNA, 21 nt, Pseudomonas putida KT2440
uaggagcggguuuacccgcga

SEQ ID NO: 1581345 - RNA, 20 nt, Pseudomonas putida KT2440
uacucggccagguacucgcg

SEQ ID NO: 1581346 - RNA, 19 nt, Pseudomonas putida KT2440
uacucggcgcucaagcgug

SEQ ID NO: 1581347 - RNA, 24 nt, Pseudomonas putida KT2440
uacucggcacgcgcccggugcaag

SEQ ID NO: 1581348 - RNA, 14 nt, Pseudomonas putida KT2440
uacuccaccgccag

SEQ ID NO: 1581349 - RNA, 21 nt, Pseudomonas putida KT2440
uagaacagauccaucggcguc

SEQ ID NO: 1581350 - RNA, 18 nt, Pseudomonas putida KT2440
uagaaaguccaucugcuu

SEQ ID NO: 1581351 - RNA, 18 nt, Pseudomonas putida KT2440
uacggccuguguccaaca

SEQ ID NO: 1581352 - RNA, 18 nt, Pseudomonas putida KT2440
uacgggcgagcgcgcagg

SEQ ID NO: 1581353 - RNA, 17 nt, Pseudomonas putida KT2440
uacggggguucacagcc

SEQ ID NO: 1581354 - RNA, 21 nt, Pseudomonas putida KT2440
uacggggguucacagccggca

SEQ ID NO: 1581355 - RNA, 20 nt, Pseudomonas putida KT2440
uacggucgaucuucgccggc

SEQ ID NO: 1581356 - RNA, 17 nt, Pseudomonas putida KT2440
uacgcgacaguucgcca

SEQ ID NO: 1581357 - RNA, 14 nt, Pseudomonas putida KT2440
uacgcgccagcaug

SEQ ID NO: 1581358 - RNA, 17 nt, Pseudomonas putida KT2440
uacgcgucaucugcgca

SEQ ID NO: 1581359 - RNA, 14 nt, Pseudomonas putida KT2440
uacgcguggucgcc

SEQ ID NO: 1581360 - RNA, 21 nt, Pseudomonas putida KT2440
uacgcucgaccagaucagccg

SEQ ID NO: 1581361 - RNA, 17 nt, Pseudomonas putida KT2440
uacggaacugcucuucg

SEQ ID NO: 1581362 - RNA, 18 nt, Pseudomonas putida KT2440
uacggacgggcguugauc

SEQ ID NO: 1581363 - RNA, 22 nt, Pseudomonas putida KT2440
uacgaacaaauccgcgccgauc

SEQ ID NO: 1581364 - RNA, 18 nt, Pseudomonas putida KT2440
uaccugugggagcgggcg

SEQ ID NO: 1581365 - RNA, 23 nt, Pseudomonas putida KT2440
uaccugugggagcgggcgugccu

SEQ ID NO: 1581366 - RNA, 17 nt, Pseudomonas putida KT2440
uaccucacugacagcau

SEQ ID NO: 1581367 - RNA, 21 nt, Pseudomonas putida KT2440
uccugggaagcugcagcagcu

SEQ ID NO: 1581368 - RNA, 17 nt, Pseudomonas putida KT2440
uccuggaaaagcaaggc

SEQ ID NO: 1581369 - RNA, 17 nt, Pseudomonas putida KT2440
uccugguuuucgcggua

SEQ ID NO: 1581370 - RNA, 19 nt, Pseudomonas putida KT2440
uccugggugaccaccagca

SEQ ID NO: 1581371 - RNA, 20 nt, Pseudomonas putida KT2440
uccuggguaacccgcuaacg

SEQ ID NO: 1581372 - RNA, 20 nt, Pseudomonas putida KT2440
uccuggguaaucaguaccag

SEQ ID NO: 1581373 - RNA, 16 nt, Pseudomonas putida KT2440
uccuugcccucgccca

SEQ ID NO: 1581374 - RNA, 20 nt, Pseudomonas putida KT2440
uccuugcgcaucaagcggcu

SEQ ID NO: 1581375 - RNA, 21 nt, Pseudomonas putida KT2440
uccuucaucugucagcgccag

SEQ ID NO: 1581376 - RNA, 21 nt, Pseudomonas putida KT2440
uccuucuccggauucaacuug

SEQ ID NO: 1581377 - RNA, 18 nt, Pseudomonas putida KT2440
uccugugggagcgggcgu

SEQ ID NO: 1581378 - RNA, 17 nt, Pseudomonas putida KT2440
uccugugggagcgggcu

SEQ ID NO: 1581379 - RNA, 18 nt, Pseudomonas putida KT2440
uccugugggagcgggcuu

SEQ ID NO: 1581380 - RNA, 20 nt, Pseudomonas putida KT2440
uccugugccgcuuuggcagc

SEQ ID NO: 1581381 - RNA, 18 nt, Pseudomonas putida KT2440
ucgaaaaccugcugacac

SEQ ID NO: 1581382 - RNA, 24 nt, Pseudomonas putida KT2440
ucgaaaacgauaucgacuucggcc

SEQ ID NO: 1581383 - RNA, 19 nt, Pseudomonas putida KT2440
uccuugcuguugcugcagu

SEQ ID NO: 1581384 - RNA, 19 nt, Pseudomonas putida KT2440
uccuuggccaaugccagga

SEQ ID NO: 1581385 - RNA, 12 nt, Pseudomonas putida KT2440
uccuugcagcgc

SEQ ID NO: 1581386 - RNA, 14 nt, Pseudomonas putida KT2440
uccuugcagcgccg

SEQ ID NO: 1581387 - RNA, 19 nt, Pseudomonas putida KT2440
uccuuguagauauugacca

SEQ ID NO: 1581388 - RNA, 13 nt, Pseudomonas putida KT2440
uccuuggucaggu

SEQ ID NO: 1581389 - RNA, 19 nt, Pseudomonas putida KT2440
ucgaaccaaggugcuaccg

SEQ ID NO: 1581390 - RNA, 12 nt, Pseudomonas putida KT2440
ucgaaaccggcc

SEQ ID NO: 1581391 - RNA, 18 nt, Pseudomonas putida KT2440
ucgaacaacggcagcgac

SEQ ID NO: 1581392 - RNA, 19 nt, Pseudomonas putida KT2440
uccucggccguaaaguccg

SEQ ID NO: 1581393 - RNA, 14 nt, Pseudomonas putida KT2440
uccucgcgggcaaa

SEQ ID NO: 1581394 - RNA, 16 nt, Pseudomonas putida KT2440
uccucgaucaccugcg

SEQ ID NO: 1581395 - RNA, 12 nt, Pseudomonas putida KT2440
uccucgugaccg

SEQ ID NO: 1581396 - RNA, 16 nt, Pseudomonas putida KT2440
uccucucccaccagca

SEQ ID NO: 1581397 - RNA, 21 nt, Pseudomonas putida KT2440
uccucugugggagcggccuug

SEQ ID NO: 1581398 - RNA, 22 nt, Pseudomonas putida KT2440
uccugaagggccgaaaggugca

SEQ ID NO: 1581399 - RNA, 14 nt, Pseudomonas putida KT2440
uccugaccaacuuu

SEQ ID NO: 1581400 - RNA, 13 nt, Pseudomonas putida KT2440
uccugaacgaugc

SEQ ID NO: 1581401 - RNA, 12 nt, Pseudomonas putida KT2440
uccugcuugccg

SEQ ID NO: 1581402 - RNA, 20 nt, Pseudomonas putida KT2440
uccugcgcaugcaacggcac

SEQ ID NO: 1581403 - RNA, 15 nt, Pseudomonas putida KT2440
uccugcagcaccagc

SEQ ID NO: 1581404 - RNA, 13 nt, Pseudomonas putida KT2440
uccugcagcggca

SEQ ID NO: 1581405 - RNA, 18 nt, Pseudomonas putida KT2440
uccugcaacucggccuug

SEQ ID NO: 1581406 - RNA, 22 nt, Pseudomonas putida KT2440
uccugcacugcaacaccgguca

SEQ ID NO: 1581407 - RNA, 21 nt, Pseudomonas putida KT2440
uccugcaccugguugccaggg

SEQ ID NO: 1581408 - RNA, 21 nt, Pseudomonas putida KT2440
uccugcaccuuguuacccgca

SEQ ID NO: 1581409 - RNA, 16 nt, Pseudomonas putida KT2440
uccugcauacgcaucg

SEQ ID NO: 1581410 - RNA, 15 nt, Pseudomonas putida KT2440
ucgacauccagcgcc

SEQ ID NO: 1581411 - RNA, 14 nt, Pseudomonas putida KT2440
ucgacagugaauuc

SEQ ID NO: 1581412 - RNA, 21 nt, Pseudomonas putida KT2440
ucgaauacaccgccgcauucg

SEQ ID NO: 1581413 - RNA, 13 nt, Pseudomonas putida KT2440
ucgacaacccgcg

SEQ ID NO: 1581414 - RNA, 18 nt, Pseudomonas putida KT2440
ucgacaacccgcgcugcc

SEQ ID NO: 1581415 - RNA, 19 nt, Pseudomonas putida KT2440
ucgaagaacacggcuucgc

SEQ ID NO: 1581416 - RNA, 16 nt, Pseudomonas putida KT2440
ucgaacgcugccugca

SEQ ID NO: 1581417 - RNA, 13 nt, Pseudomonas putida KT2440
ucgaagcagcagc

SEQ ID NO: 1581418 - RNA, 14 nt, Pseudomonas putida KT2440
ucgaagaucagcuc

SEQ ID NO: 1581419 - RNA, 23 nt, Pseudomonas putida KT2440
ucgaagaucagcucaugggcuuc

SEQ ID NO: 1581420 - RNA, 20 nt, Pseudomonas putida KT2440
ucgaagcgcaccucggccag

SEQ ID NO: 1581421 - RNA, 13 nt, Pseudomonas putida KT2440
ucgaaggcuucgu

SEQ ID NO: 1581422 - RNA, 17 nt, Pseudomonas putida KT2440
ucgaccaccaucgccag

SEQ ID NO: 1581423 - RNA, 23 nt, Pseudomonas putida KT2440
ucgaccaggaucuucucggcgcg

SEQ ID NO: 1581424 - RNA, 16 nt, Pseudomonas putida KT2440
ucgaccagaucagccg

SEQ ID NO: 1581425 - RNA, 21 nt, Pseudomonas putida KT2440
ucgaccacgaucuuggccagg

SEQ ID NO: 1581426 - RNA, 15 nt, Pseudomonas putida KT2440
ucgacccccuugcca

SEQ ID NO: 1581427 - RNA, 18 nt, Pseudomonas putida KT2440
ucgacccccuugccagca

SEQ ID NO: 1581428 - RNA, 13 nt, Pseudomonas putida KT2440
ucgaccgccgccu

SEQ ID NO: 1581429 - RNA, 15 nt, Pseudomonas putida KT2440
ucgacgaucgacuuc

SEQ ID NO: 1581430 - RNA, 23 nt, Pseudomonas putida KT2440
ucgacgaucgacuucaucaccuc

SEQ ID NO: 1581431 - RNA, 19 nt, Pseudomonas putida KT2440
ucgacgauacccagcgcgc

SEQ ID NO: 1581432 - RNA, 19 nt, Pseudomonas putida KT2440
ucgacgaccaguucgacgc

SEQ ID NO: 1581433 - RNA, 13 nt, Pseudomonas putida KT2440
ucgacgacacggc

SEQ ID NO: 1581434 - RNA, 16 nt, Pseudomonas putida KT2440
ucgacgacacggcugc

SEQ ID NO: 1581435 - RNA, 15 nt, Pseudomonas putida KT2440
ucgaccgggcagacc

SEQ ID NO: 1581436 - RNA, 12 nt, Pseudomonas putida KT2440
ucgaccuggcuc

SEQ ID NO: 1581437 - RNA, 14 nt, Pseudomonas putida KT2440
ucgaccugcguggu

SEQ ID NO: 1581438 - RNA, 12 nt, Pseudomonas putida KT2440
uccgucgccggc

SEQ ID NO: 1581439 - RNA, 13 nt, Pseudomonas putida KT2440
uccucaucgaugc

SEQ ID NO: 1581440 - RNA, 17 nt, Pseudomonas putida KT2440
uccuacaggauggccgc

SEQ ID NO: 1581441 - RNA, 13 nt, Pseudomonas putida KT2440
uccuacgggcaac

SEQ ID NO: 1581442 - RNA, 15 nt, Pseudomonas putida KT2440
uccuacgggcaaccg

SEQ ID NO: 1581443 - RNA, 19 nt, Pseudomonas putida KT2440
uccuacgcaggcaccgcac

SEQ ID NO: 1581444 - RNA, 20 nt, Pseudomonas putida KT2440
uccguuacaauaccgacaag

SEQ ID NO: 1581445 - RNA, 16 nt, Pseudomonas putida KT2440
uccguucggcgcgcug

SEQ ID NO: 1581446 - RNA, 21 nt, Pseudomonas putida KT2440
uccggcuugcugugagauucc

SEQ ID NO: 1581447 - RNA, 18 nt, Pseudomonas putida KT2440
uccggcgcggccugcucc

SEQ ID NO: 1581448 - RNA, 22 nt, Pseudomonas putida KT2440
uccgcuucaucaggucgccuug

SEQ ID NO: 1581449 - RNA, 21 nt, Pseudomonas putida KT2440
uccggaauccgcacacgcucc

SEQ ID NO: 1581450 - RNA, 13 nt, Pseudomonas putida KT2440
uccggccagcaac

SEQ ID NO: 1581451 - RNA, 21 nt, Pseudomonas putida KT2440
uccggcagggugaaguugauc

SEQ ID NO: 1581452 - RNA, 22 nt, Pseudomonas putida KT2440
uccggcaggucgaugaucgccg

SEQ ID NO: 1581453 - RNA, 17 nt, Pseudomonas putida KT2440
uccauguuacggcccag

SEQ ID NO: 1581454 - RNA, 15 nt, Pseudomonas putida KT2440
uccauguucaccgua

SEQ ID NO: 1581455 - RNA, 20 nt, Pseudomonas putida KT2440
uccaugucggaagccugcau

SEQ ID NO: 1581456 - RNA, 17 nt, Pseudomonas putida KT2440
uccauggcaaucagcga

SEQ ID NO: 1581457 - RNA, 15 nt, Pseudomonas putida KT2440
uccauugaagguuga

SEQ ID NO: 1581458 - RNA, 15 nt, Pseudomonas putida KT2440
uccauugagcacuca

SEQ ID NO: 1581459 - RNA, 20 nt, Pseudomonas putida KT2440
ucccgcacauuucacagcaa

SEQ ID NO: 1581460 - RNA, 20 nt, Pseudomonas putida KT2440
ucccgccgagcauccgcgcc

SEQ ID NO: 1581461 - RNA, 16 nt, Pseudomonas putida KT2440
ucccucguaggagcgg

SEQ ID NO: 1581462 - RNA, 18 nt, Pseudomonas putida KT2440
ucccucguaggagcgggu

SEQ ID NO: 1581463 - RNA, 13 nt, Pseudomonas putida KT2440
ucccgugcgccua

SEQ ID NO: 1581464 - RNA, 16 nt, Pseudomonas putida KT2440
ucccgucgagccgggu

SEQ ID NO: 1581465 - RNA, 18 nt, Pseudomonas putida KT2440
ucccggccagcgacccug

SEQ ID NO: 1581466 - RNA, 22 nt, Pseudomonas putida KT2440
ucccgcgcaugcugccaggcaa

SEQ ID NO: 1581467 - RNA, 16 nt, Pseudomonas putida KT2440
ucccggcgccaugccc

SEQ ID NO: 1581468 - RNA, 16 nt, Pseudomonas putida KT2440
ucccggcucaucaggc

SEQ ID NO: 1581469 - RNA, 15 nt, Pseudomonas putida KT2440
uccgccuggccgcug

SEQ ID NO: 1581470 - RNA, 14 nt, Pseudomonas putida KT2440
uccgcaccgggcaa

SEQ ID NO: 1581471 - RNA, 18 nt, Pseudomonas putida KT2440
ucccuggcacgcccggca

SEQ ID NO: 1581472 - RNA, 21 nt, Pseudomonas putida KT2440
ucccugacucgaccgccgcac

SEQ ID NO: 1581473 - RNA, 14 nt, Pseudomonas putida KT2440
ucccuguaggagcg

SEQ ID NO: 1581474 - RNA, 19 nt, Pseudomonas putida KT2440
ucccugugggagcgggcuu

SEQ ID NO: 1581475 - RNA, 21 nt, Pseudomonas putida KT2440
uccgcacacgcuccagguagu

SEQ ID NO: 1581476 - RNA, 20 nt, Pseudomonas putida KT2440
uccgaggucagcaccagcuc

SEQ ID NO: 1581477 - RNA, 21 nt, Pseudomonas putida KT2440
uccgaggucagcaccagcuca

SEQ ID NO: 1581478 - RNA, 13 nt, Pseudomonas putida KT2440
uccgacggauugg

SEQ ID NO: 1581479 - RNA, 21 nt, Pseudomonas putida KT2440
uccgaacuccccaccaggcaa

SEQ ID NO: 1581480 - RNA, 17 nt, Pseudomonas putida KT2440
uccaggugcgcaccuug

SEQ ID NO: 1581481 - RNA, 17 nt, Pseudomonas putida KT2440
uccaucuucaccuugcc

SEQ ID NO: 1581482 - RNA, 16 nt, Pseudomonas putida KT2440
uccaucuccagcucaa

SEQ ID NO: 1581483 - RNA, 17 nt, Pseudomonas putida KT2440
uccaugaaggccggcau

SEQ ID NO: 1581484 - RNA, 15 nt, Pseudomonas putida KT2440
uccaucuugcugcuc

SEQ ID NO: 1581485 - RNA, 19 nt, Pseudomonas putida KT2440
uccaucuugcugcucugca

SEQ ID NO: 1581486 - RNA, 16 nt, Pseudomonas putida KT2440
uccaucgucugcauca

SEQ ID NO: 1581487 - RNA, 22 nt, Pseudomonas putida KT2440
uccaggcguucaucgaaggccu

SEQ ID NO: 1581488 - RNA, 23 nt, Pseudomonas putida KT2440
uccaggcucagcucgucgagcau

SEQ ID NO: 1581489 - RNA, 16 nt, Pseudomonas putida KT2440
uccaggcuggccagca

SEQ ID NO: 1581490 - RNA, 17 nt, Pseudomonas putida KT2440
uccaggcuggccagcaa

SEQ ID NO: 1581491 - RNA, 18 nt, Pseudomonas putida KT2440
uccaggcuggccagcaag

SEQ ID NO: 1581492 - RNA, 15 nt, Pseudomonas putida KT2440
uccaggcuggcgcuu

SEQ ID NO: 1581493 - RNA, 16 nt, Pseudomonas putida KT2440
uccaggcuuucgaccu

SEQ ID NO: 1581494 - RNA, 21 nt, Pseudomonas putida KT2440
uccaggcgcaaguagaaccac

SEQ ID NO: 1581495 - RNA, 19 nt, Pseudomonas putida KT2440
uccaggcgaccaugcggcu

SEQ ID NO: 1581496 - RNA, 13 nt, Pseudomonas putida KT2440
uccaggcggccag

SEQ ID NO: 1581497 - RNA, 17 nt, Pseudomonas putida KT2440
uccaggcugcacuggca

SEQ ID NO: 1581498 - RNA, 22 nt, Pseudomonas putida KT2440
uccaggucgcggagccagacau

SEQ ID NO: 1581499 - RNA, 23 nt, Pseudomonas putida KT2440
uccagguacucgcgacugaagcg

SEQ ID NO: 1581500 - RNA, 18 nt, Pseudomonas putida KT2440
uccagcguucggccagca

SEQ ID NO: 1581501 - RNA, 21 nt, Pseudomonas putida KT2440
uccaggcccauuucgcggguc

SEQ ID NO: 1581502 - RNA, 15 nt, Pseudomonas putida KT2440
uccaggcccugcagc

SEQ ID NO: 1581503 - RNA, 17 nt, Pseudomonas putida KT2440
uccaggccgaaaccgcc

SEQ ID NO: 1581504 - RNA, 12 nt, Pseudomonas putida KT2440
uccagcguagcc

SEQ ID NO: 1581505 - RNA, 17 nt, Pseudomonas putida KT2440
uccagcccgccugcuca

SEQ ID NO: 1581506 - RNA, 13 nt, Pseudomonas putida KT2440
uccagcaccggcg

SEQ ID NO: 1581507 - RNA, 13 nt, Pseudomonas putida KT2440
uccagcacccgcu

SEQ ID NO: 1581508 - RNA, 21 nt, Pseudomonas putida KT2440
uccagcaccgccccggccagu

SEQ ID NO: 1581509 - RNA, 23 nt, Pseudomonas putida KT2440
uccagcaggguggccagcaaggc

SEQ ID NO: 1581510 - RNA, 13 nt, Pseudomonas putida KT2440
uccagcagugccg

SEQ ID NO: 1581511 - RNA, 23 nt, Pseudomonas putida KT2440
uccagcauguaagcuucagcgac

SEQ ID NO: 1581512 - RNA, 17 nt, Pseudomonas putida KT2440
uccagcaucagcacacc

SEQ ID NO: 1581513 - RNA, 15 nt, Pseudomonas putida KT2440
uccagcccaccacga

SEQ ID NO: 1581514 - RNA, 14 nt, Pseudomonas putida KT2440
uccagcccggucca

SEQ ID NO: 1581515 - RNA, 20 nt, Pseudomonas putida KT2440
uccagcccgauuucgugcac

SEQ ID NO: 1581516 - RNA, 16 nt, Pseudomonas putida KT2440
uccaccggcuugcccg

SEQ ID NO: 1581517 - RNA, 17 nt, Pseudomonas putida KT2440
uccaccgguacauugcg

SEQ ID NO: 1581518 - RNA, 20 nt, Pseudomonas putida KT2440
uccaccgccccaagcgccug

SEQ ID NO: 1581519 - RNA, 12 nt, Pseudomonas putida KT2440
uccaccggcacg

SEQ ID NO: 1581520 - RNA, 20 nt, Pseudomonas putida KT2440
uccaccgaaaucagcaacgc

SEQ ID NO: 1581521 - RNA, 18 nt, Pseudomonas putida KT2440
uccaccgcgcaacgcgcc

SEQ ID NO: 1581522 - RNA, 12 nt, Pseudomonas putida KT2440
uccaccacagcu

SEQ ID NO: 1581523 - RNA, 18 nt, Pseudomonas putida KT2440
uccaccacagcugcgcca

SEQ ID NO: 1581524 - RNA, 14 nt, Pseudomonas putida KT2440
uccaacgggcggaa

SEQ ID NO: 1581525 - RNA, 20 nt, Pseudomonas putida KT2440
uccaacgggcggaacuggcc

SEQ ID NO: 1581526 - RNA, 20 nt, Pseudomonas putida KT2440
uccaacuggaccaucacgga

SEQ ID NO: 1581527 - RNA, 12 nt, Pseudomonas putida KT2440
uccacaccagcg

SEQ ID NO: 1581528 - RNA, 14 nt, Pseudomonas putida KT2440
uccacguucccgcc

SEQ ID NO: 1581529 - RNA, 20 nt, Pseudomonas putida KT2440
uccacgcgcaggccacggua

SEQ ID NO: 1581530 - RNA, 13 nt, Pseudomonas putida KT2440
uccagcaacagcu

SEQ ID NO: 1581531 - RNA, 14 nt, Pseudomonas putida KT2440
uccagcaacagcug

SEQ ID NO: 1581532 - RNA, 13 nt, Pseudomonas putida KT2440
uccagcaagcgcu

SEQ ID NO: 1581533 - RNA, 14 nt, Pseudomonas putida KT2440
uccagcaagcgcuc

SEQ ID NO: 1581534 - RNA, 22 nt, Pseudomonas putida KT2440
uccagcaagcucaucaccaggc

SEQ ID NO: 1581535 - RNA, 17 nt, Pseudomonas putida KT2440
uccagaaagcgauugcc

SEQ ID NO: 1581536 - RNA, 17 nt, Pseudomonas putida KT2440
ucagugcccccgccaca

SEQ ID NO: 1581537 - RNA, 23 nt, Pseudomonas putida KT2440
ucagugccugcuccaugggcagg

SEQ ID NO: 1581538 - RNA, 17 nt, Pseudomonas putida KT2440
ucagugacaggcaguca

SEQ ID NO: 1581539 - RNA, 16 nt, Pseudomonas putida KT2440
ucaggugagccaugcc

SEQ ID NO: 1581540 - RNA, 15 nt, Pseudomonas putida KT2440
ucaggccuucgccac

SEQ ID NO: 1581541 - RNA, 18 nt, Pseudomonas putida KT2440
ucaggucaaagcguucgc

SEQ ID NO: 1581542 - RNA, 18 nt, Pseudomonas putida KT2440
ucagguaauccaccagcc

SEQ ID NO: 1581543 - RNA, 15 nt, Pseudomonas putida KT2440
ucagguacagcagcu

SEQ ID NO: 1581544 - RNA, 20 nt, Pseudomonas putida KT2440
ucaggccguagcgcugacca

SEQ ID NO: 1581545 - RNA, 16 nt, Pseudomonas putida KT2440
ucaucaccggccagca

SEQ ID NO: 1581546 - RNA, 12 nt, Pseudomonas putida KT2440
ucaucaccggcg

SEQ ID NO: 1581547 - RNA, 17 nt, Pseudomonas putida KT2440
ucaucacguuacgccag

SEQ ID NO: 1581548 - RNA, 16 nt, Pseudomonas putida KT2440
ucaucagaccgccgau

SEQ ID NO: 1581549 - RNA, 14 nt, Pseudomonas putida KT2440
ucaucacacucgcc

SEQ ID NO: 1581550 - RNA, 16 nt, Pseudomonas putida KT2440
ucaucacacucgcccc

SEQ ID NO: 1581551 - RNA, 20 nt, Pseudomonas putida KT2440
ucaguuccgcguccuugacg

SEQ ID NO: 1581552 - RNA, 16 nt, Pseudomonas putida KT2440
ucagugcgucggccac

SEQ ID NO: 1581553 - RNA, 18 nt, Pseudomonas putida KT2440
ucaguguccucguucagc

SEQ ID NO: 1581554 - RNA, 20 nt, Pseudomonas putida KT2440
ucagugugggggcggccucg

SEQ ID NO: 1581555 - RNA, 16 nt, Pseudomonas putida KT2440
ucaugaagucagccag

SEQ ID NO: 1581556 - RNA, 13 nt, Pseudomonas putida KT2440
ucaugcagcgggu

SEQ ID NO: 1581557 - RNA, 20 nt, Pseudomonas putida KT2440
ucaugcagcgucggcagagc

SEQ ID NO: 1581558 - RNA, 17 nt, Pseudomonas putida KT2440
ucaugcccauggccagc

SEQ ID NO: 1581559 - RNA, 14 nt, Pseudomonas putida KT2440
ucaugcccaccgcu

SEQ ID NO: 1581560 - RNA, 17 nt, Pseudomonas putida KT2440
ucaugcccaccgcugca

SEQ ID NO: 1581561 - RNA, 14 nt, Pseudomonas putida KT2440
ucaugcacgcagca

SEQ ID NO: 1581562 - RNA, 15 nt, Pseudomonas putida KT2440
ucaugcacgcagcaa

SEQ ID NO: 1581563 - RNA, 21 nt, Pseudomonas putida KT2440
ucaucgggaucagcacgccca

SEQ ID NO: 1581564 - RNA, 23 nt, Pseudomonas putida KT2440
ucaucggcaaaugaucaccgcgu

SEQ ID NO: 1581565 - RNA, 15 nt, Pseudomonas putida KT2440
ucaucgcgccgacca

SEQ ID NO: 1581566 - RNA, 21 nt, Pseudomonas putida KT2440
ucauccagaucggcagugccg

SEQ ID NO: 1581567 - RNA, 17 nt, Pseudomonas putida KT2440
ucaucaucucgcgaugc

SEQ ID NO: 1581568 - RNA, 13 nt, Pseudomonas putida KT2440
ucaugggccaugc

SEQ ID NO: 1581569 - RNA, 23 nt, Pseudomonas putida KT2440
ucauguaggcauauccggccuuu

SEQ ID NO: 1581570 - RNA, 23 nt, Pseudomonas putida KT2440
ucaugguggauggucagcgcuuc

SEQ ID NO: 1581571 - RNA, 15 nt, Pseudomonas putida KT2440
ucauggucaacagcc

SEQ ID NO: 1581572 - RNA, 14 nt, Pseudomonas putida KT2440
ucauggucagccgg

SEQ ID NO: 1581573 - RNA, 14 nt, Pseudomonas putida KT2440
ucauggcucacacc

SEQ ID NO: 1581574 - RNA, 20 nt, Pseudomonas putida KT2440
ucauucgcccgcaccgccgc

SEQ ID NO: 1581575 - RNA, 16 nt, Pseudomonas putida KT2440
ucauugaguuggugag

SEQ ID NO: 1581576 - RNA, 21 nt, Pseudomonas putida KT2440
ucaccgggaucgagaucaggu

SEQ ID NO: 1581577 - RNA, 11 nt, Pseudomonas putida KT2440
ucaccggcacc

SEQ ID NO: 1581578 - RNA, 14 nt, Pseudomonas putida KT2440
ucaccugcggccug

SEQ ID NO: 1581579 - RNA, 13 nt, Pseudomonas putida KT2440
ucaccuggcccac

SEQ ID NO: 1581580 - RNA, 13 nt, Pseudomonas putida KT2440
ucaccuuggccgc

SEQ ID NO: 1581581 - RNA, 21 nt, Pseudomonas putida KT2440
ucaccuguucccccaccggcc

SEQ ID NO: 1581582 - RNA, 15 nt, Pseudomonas putida KT2440
ucaccuucguccuug

SEQ ID NO: 1581583 - RNA, 22 nt, Pseudomonas putida KT2440
ucaccuugaugcgcgagcuggg

SEQ ID NO: 1581584 - RNA, 22 nt, Pseudomonas putida KT2440
ucacgacuuugaugccaacuuc

SEQ ID NO: 1581585 - RNA, 19 nt, Pseudomonas putida KT2440
ucacgaagguguucaccac

SEQ ID NO: 1581586 - RNA, 21 nt, Pseudomonas putida KT2440
ucacgaagccguugaggccga

SEQ ID NO: 1581587 - RNA, 20 nt, Pseudomonas putida KT2440
ucacgaugacccuuccagcc

SEQ ID NO: 1581588 - RNA, 18 nt, Pseudomonas putida KT2440
ucacgauccccaccagca

SEQ ID NO: 1581589 - RNA, 15 nt, Pseudomonas putida KT2440
ucacgcacggccuuc

SEQ ID NO: 1581590 - RNA, 21 nt, Pseudomonas putida KT2440
ucacgcagcccuuucagggua

SEQ ID NO: 1581591 - RNA, 16 nt, Pseudomonas putida KT2440
ucaccgccagcggcaa

SEQ ID NO: 1581592 - RNA, 15 nt, Pseudomonas putida KT2440
ucaccgacgugcagg

SEQ ID NO: 1581593 - RNA, 17 nt, Pseudomonas putida KT2440
uauuugaccagcccgcu

SEQ ID NO: 1581594 - RNA, 22 nt, Pseudomonas putida KT2440
uauuguggcaauugcacccgcg

SEQ ID NO: 1581595 - RNA, 12 nt, Pseudomonas putida KT2440
ucacguggcuga

SEQ ID NO: 1581596 - RNA, 16 nt, Pseudomonas putida KT2440
ucacguggcugaugcc

SEQ ID NO: 1581597 - RNA, 15 nt, Pseudomonas putida KT2440
ucacgcucggccagu

SEQ ID NO: 1581598 - RNA, 23 nt, Pseudomonas putida KT2440
ucacgcucguuguccagcagcag

SEQ ID NO: 1581599 - RNA, 17 nt, Pseudomonas putida KT2440
ucacgcuccuucgccac

SEQ ID NO: 1581600 - RNA, 21 nt, Pseudomonas putida KT2440
ucacugcguauuuuugcgcca

SEQ ID NO: 1581601 - RNA, 19 nt, Pseudomonas putida KT2440
ucacuguggucauccaggc

SEQ ID NO: 1581602 - RNA, 17 nt, Pseudomonas putida KT2440
ucacugaucgggauuac

SEQ ID NO: 1581603 - RNA, 21 nt, Pseudomonas putida KT2440
ucacugccaccgugagcaugg

SEQ ID NO: 1581604 - RNA, 19 nt, Pseudomonas putida KT2440
ucacugccagcaccuggcg

SEQ ID NO: 1581605 - RNA, 14 nt, Pseudomonas putida KT2440
ucacgucuggcacc

SEQ ID NO: 1581606 - RNA, 19 nt, Pseudomonas putida KT2440
ucacugagccaggccgaca

SEQ ID NO: 1581607 - RNA, 14 nt, Pseudomonas putida KT2440
ucacuguugccgcc

SEQ ID NO: 1581608 - RNA, 22 nt, Pseudomonas putida KT2440
ucacuugcagcucguugugcac

SEQ ID NO: 1581609 - RNA, 22 nt, Pseudomonas putida KT2440
ucagcaaugccaguugaucacc

SEQ ID NO: 1581610 - RNA, 18 nt, Pseudomonas putida KT2440
ucagcaagccgccgacca

SEQ ID NO: 1581611 - RNA, 16 nt, Pseudomonas putida KT2440
ucagcaagccgccgau

SEQ ID NO: 1581612 - RNA, 17 nt, Pseudomonas putida KT2440
ucagcaacgccaccagu

SEQ ID NO: 1581613 - RNA, 12 nt, Pseudomonas putida KT2440
ucagcggcaguu

SEQ ID NO: 1581614 - RNA, 22 nt, Pseudomonas putida KT2440
ucagcgcggugaccagcggcag

SEQ ID NO: 1581615 - RNA, 15 nt, Pseudomonas putida KT2440
ucagcgccucgcccu

SEQ ID NO: 1581616 - RNA, 15 nt, Pseudomonas putida KT2440
ucagcgccagcggcu

SEQ ID NO: 1581617 - RNA, 12 nt, Pseudomonas putida KT2440
ucagcgcggcaa

SEQ ID NO: 1581618 - RNA, 22 nt, Pseudomonas putida KT2440
ucagcgcggcaaagguggcacc

SEQ ID NO: 1581619 - RNA, 21 nt, Pseudomonas putida KT2440
ucagcgcgccaucuucacggc

SEQ ID NO: 1581620 - RNA, 16 nt, Pseudomonas putida KT2440
ucagccgccgcugcga

SEQ ID NO: 1581621 - RNA, 12 nt, Pseudomonas putida KT2440
ucagccgccaca

SEQ ID NO: 1581622 - RNA, 20 nt, Pseudomonas putida KT2440
ucagccgagccaaccgcuuc

SEQ ID NO: 1581623 - RNA, 21 nt, Pseudomonas putida KT2440
ucagcccuugccagugauccg

SEQ ID NO: 1581624 - RNA, 15 nt, Pseudomonas putida KT2440
ucagcacacccagca

SEQ ID NO: 1581625 - RNA, 13 nt, Pseudomonas putida KT2440
ucagcacaccgcu

SEQ ID NO: 1581626 - RNA, 22 nt, Pseudomonas putida KT2440
ucagccaaccgccccacccauu

SEQ ID NO: 1581627 - RNA, 16 nt, Pseudomonas putida KT2440
ucagccaacggcguga

SEQ ID NO: 1581628 - RNA, 17 nt, Pseudomonas putida KT2440
ucagccacauccucugc

SEQ ID NO: 1581629 - RNA, 15 nt, Pseudomonas putida KT2440
ucagccacgucgcca

SEQ ID NO: 1581630 - RNA, 18 nt, Pseudomonas putida KT2440
ucagccacgucgccagcg

SEQ ID NO: 1581631 - RNA, 23 nt, Pseudomonas putida KT2440
ucagcgggcgauugccagggugc

SEQ ID NO: 1581632 - RNA, 17 nt, Pseudomonas putida KT2440
ucagcggcuuguucagc

SEQ ID NO: 1581633 - RNA, 20 nt, Pseudomonas putida KT2440
ucagcgugacgauggccacc

SEQ ID NO: 1581634 - RNA, 17 nt, Pseudomonas putida KT2440
ucagcucgaucaggcuc

SEQ ID NO: 1581635 - RNA, 15 nt, Pseudomonas putida KT2440
ucagcguugcuggcg

SEQ ID NO: 1581636 - RNA, 16 nt, Pseudomonas putida KT2440
ucagcucaaucagcca

SEQ ID NO: 1581637 - RNA, 21 nt, Pseudomonas putida KT2440
ucagcugggagagcgccugca

SEQ ID NO: 1581638 - RNA, 15 nt, Pseudomonas putida KT2440
ucagcuggucgaggc

SEQ ID NO: 1581639 - RNA, 15 nt, Pseudomonas putida KT2440
ucagcuggccuucga

SEQ ID NO: 1581640 - RNA, 14 nt, Pseudomonas putida KT2440
ucagcucggcaugu

SEQ ID NO: 1581641 - RNA, 13 nt, Pseudomonas putida KT2440
ucagcucggccac

SEQ ID NO: 1581642 - RNA, 13 nt, Pseudomonas putida KT2440
ucaggccgccuug

SEQ ID NO: 1581643 - RNA, 17 nt, Pseudomonas putida KT2440
ucaggccgaugggcagg

SEQ ID NO: 1581644 - RNA, 21 nt, Pseudomonas putida KT2440
ucaggccaaguacggccagca

SEQ ID NO: 1581645 - RNA, 16 nt, Pseudomonas putida KT2440
ucaggcaggccagcac

SEQ ID NO: 1581646 - RNA, 19 nt, Pseudomonas putida KT2440
ucaggcaggccagcacggc

SEQ ID NO: 1581647 - RNA, 13 nt, Pseudomonas putida KT2440
ucaggcaccagcg

SEQ ID NO: 1581648 - RNA, 18 nt, Pseudomonas putida KT2440
ucaggcacggcaccagca

SEQ ID NO: 1581649 - RNA, 19 nt, Pseudomonas putida KT2440
ucagcuucauggcgccgau

SEQ ID NO: 1581650 - RNA, 23 nt, Pseudomonas putida KT2440
ucagcuucaaaauagucgaaggc

SEQ ID NO: 1581651 - RNA, 14 nt, Pseudomonas putida KT2440
ucagcuuguagcgg

SEQ ID NO: 1581652 - RNA, 16 nt, Pseudomonas putida KT2440
ucagcuugugccgcgg

SEQ ID NO: 1581653 - RNA, 22 nt, Pseudomonas putida KT2440
ugcucaaccggugcaacugcca

SEQ ID NO: 1581654 - RNA, 15 nt, Pseudomonas putida KT2440
ugcucaagcgccagg

SEQ ID NO: 1581655 - RNA, 23 nt, Pseudomonas putida KT2440
ugcucaaggcacuugggaucgau

SEQ ID NO: 1581656 - RNA, 23 nt, Pseudomonas putida KT2440
ugcuacagaagccucaccgccgc

SEQ ID NO: 1581657 - RNA, 13 nt, Pseudomonas putida KT2440
ugcuccagcaccu

SEQ ID NO: 1581658 - RNA, 14 nt, Pseudomonas putida KT2440
ugcucauacugcug

SEQ ID NO: 1581659 - RNA, 12 nt, Pseudomonas putida KT2440
ugcucaugcgcg

SEQ ID NO: 1581660 - RNA, 14 nt, Pseudomonas putida KT2440
ugcuccaaccccag

SEQ ID NO: 1581661 - RNA, 17 nt, Pseudomonas putida KT2440
ugcuccaccaaggcuga

SEQ ID NO: 1581662 - RNA, 11 nt, Pseudomonas putida KT2440
ugcuccagcac

SEQ ID NO: 1581663 - RNA, 15 nt, Pseudomonas putida KT2440
ugcucaggcgggcag

SEQ ID NO: 1581664 - RNA, 15 nt, Pseudomonas putida KT2440
ugcucacugaccacc

SEQ ID NO: 1581665 - RNA, 17 nt, Pseudomonas putida KT2440
ugcucgccucacagcgc

SEQ ID NO: 1581666 - RNA, 11 nt, Pseudomonas putida KT2440
ugcucggccag

SEQ ID NO: 1581667 - RNA, 13 nt, Pseudomonas putida KT2440
ugcucgcgcuuga

SEQ ID NO: 1581668 - RNA, 16 nt, Pseudomonas putida KT2440
ugcucgcagacuucga

SEQ ID NO: 1581669 - RNA, 19 nt, Pseudomonas putida KT2440
ugcucgaugcgcacggcau

SEQ ID NO: 1581670 - RNA, 15 nt, Pseudomonas putida KT2440
ugcucgccaucuggc

SEQ ID NO: 1581671 - RNA, 23 nt, Pseudomonas putida KT2440
ugcucccagaaaggccgcugugc

SEQ ID NO: 1581672 - RNA, 18 nt, Pseudomonas putida KT2440
ugcuccagcuccaggcga

SEQ ID NO: 1581673 - RNA, 16 nt, Pseudomonas putida KT2440
ugcucgaaugccgcug

SEQ ID NO: 1581674 - RNA, 17 nt, Pseudomonas putida KT2440
ugcucgacaagccgcug

SEQ ID NO: 1581675 - RNA, 20 nt, Pseudomonas putida KT2440
ugcucgaacucuuccagcuc

SEQ ID NO: 1581676 - RNA, 20 nt, Pseudomonas putida KT2440
ugcgguugcccguaggagcg

SEQ ID NO: 1581677 - RNA, 16 nt, Pseudomonas putida KT2440
ugcggugaccgaggcg

SEQ ID NO: 1581678 - RNA, 15 nt, Pseudomonas putida KT2440
ugcggugcagcaccu

SEQ ID NO: 1581679 - RNA, 23 nt, Pseudomonas putida KT2440
ugcggucgaaguauuccagaauc

SEQ ID NO: 1581680 - RNA, 20 nt, Pseudomonas putida KT2440
ugcgguugccuguaggcgcg

SEQ ID NO: 1581681 - RNA, 22 nt, Pseudomonas putida KT2440
ugcgugaccgccccgcccgaag

SEQ ID NO: 1581682 - RNA, 17 nt, Pseudomonas putida KT2440
ugcgugcaguguguugc

SEQ ID NO: 1581683 - RNA, 21 nt, Pseudomonas putida KT2440
ugcgucaucaucagcaggcag

SEQ ID NO: 1581684 - RNA, 17 nt, Pseudomonas putida KT2440
ugcgucgacucuuccca

SEQ ID NO: 1581685 - RNA, 19 nt, Pseudomonas putida KT2440
ugcguuguucgaucagccg

SEQ ID NO: 1581686 - RNA, 18 nt, Pseudomonas putida KT2440
ugcguuuaccggcaccgc

SEQ ID NO: 1581687 - RNA, 21 nt, Pseudomonas putida KT2440
ugcguugcggucagcgcugcg

SEQ ID NO: 1581688 - RNA, 20 nt, Pseudomonas putida KT2440
ugcguugcagccccagccuc

SEQ ID NO: 1581689 - RNA, 19 nt, Pseudomonas putida KT2440
ugcugaagcucuccagcag

SEQ ID NO: 1581690 - RNA, 23 nt, Pseudomonas putida KT2440
ugcucugcagcagcgcgccgaac

SEQ ID NO: 1581691 - RNA, 22 nt, Pseudomonas putida KT2440
ugcugagaucucugugggagcg

SEQ ID NO: 1581692 - RNA, 15 nt, Pseudomonas putida KT2440
ugcugacgcagggua

SEQ ID NO: 1581693 - RNA, 15 nt, Pseudomonas putida KT2440
ugcugaccucgaccc

SEQ ID NO: 1581694 - RNA, 14 nt, Pseudomonas putida KT2440
ugcugaccaccgug

SEQ ID NO: 1581695 - RNA, 14 nt, Pseudomonas putida KT2440
ugcucuaccaacug

SEQ ID NO: 1581696 - RNA, 17 nt, Pseudomonas putida KT2440
ugcucguccaguuccag

SEQ ID NO: 1581697 - RNA, 18 nt, Pseudomonas putida KT2440
ugcucggugcugcugcca

SEQ ID NO: 1581698 - RNA, 14 nt, Pseudomonas putida KT2440
ugcucggccagcuc

SEQ ID NO: 1581699 - RNA, 17 nt, Pseudomonas putida KT2440
ugcucggcguacuccag

SEQ ID NO: 1581700 - RNA, 14 nt, Pseudomonas putida KT2440
ugcugcuggcacgc

SEQ ID NO: 1581701 - RNA, 13 nt, Pseudomonas putida KT2440
ugcugcuggccgc

SEQ ID NO: 1581702 - RNA, 19 nt, Pseudomonas putida KT2440
ugcugcugccagugggcac

SEQ ID NO: 1581703 - RNA, 17 nt, Pseudomonas putida KT2440
ugcugcgguaccggcca

SEQ ID NO: 1581704 - RNA, 21 nt, Pseudomonas putida KT2440
ugcugcgguaccggccagcug

SEQ ID NO: 1581705 - RNA, 20 nt, Pseudomonas putida KT2440
ugcugcgugccuugccuggg

SEQ ID NO: 1581706 - RNA, 16 nt, Pseudomonas putida KT2440
ugcugcggcaggcugg

SEQ ID NO: 1581707 - RNA, 14 nt, Pseudomonas putida KT2440
ugcugcgaguucag

SEQ ID NO: 1581708 - RNA, 23 nt, Pseudomonas putida KT2440
ugcugcgaguucaggcgcccugc

SEQ ID NO: 1581709 - RNA, 17 nt, Pseudomonas putida KT2440
ugcugccugugccggug

SEQ ID NO: 1581710 - RNA, 20 nt, Pseudomonas putida KT2440
ugcugcagaaccgccagcac

SEQ ID NO: 1581711 - RNA, 16 nt, Pseudomonas putida KT2440
ugcugcagcacugccu

SEQ ID NO: 1581712 - RNA, 14 nt, Pseudomonas putida KT2440
ugcugcaacagcuc

SEQ ID NO: 1581713 - RNA, 22 nt, Pseudomonas putida KT2440
ugcugcaacagcucauccaggc

SEQ ID NO: 1581714 - RNA, 19 nt, Pseudomonas putida KT2440
ugcugaugcccaaacgcca

SEQ ID NO: 1581715 - RNA, 11 nt, Pseudomonas putida KT2440
ugcugcagguu

SEQ ID NO: 1581716 - RNA, 20 nt, Pseudomonas putida KT2440
ugcugcauacgcaccaacug

SEQ ID NO: 1581717 - RNA, 22 nt, Pseudomonas putida KT2440
ugcugccaggccgcacgcgccu

SEQ ID NO: 1581718 - RNA, 13 nt, Pseudomonas putida KT2440
ugcugccgaggcg

SEQ ID NO: 1581719 - RNA, 16 nt, Pseudomonas putida KT2440
ugcuggcggugaucgu

SEQ ID NO: 1581720 - RNA, 19 nt, Pseudomonas putida KT2440
ugcuggcgucauccugcgc

SEQ ID NO: 1581721 - RNA, 17 nt, Pseudomonas putida KT2440
ugcuggcgccagcgaug

SEQ ID NO: 1581722 - RNA, 15 nt, Pseudomonas putida KT2440
ugcuggccgcgcagg

SEQ ID NO: 1581723 - RNA, 20 nt, Pseudomonas putida KT2440
ugcuggccucuucgcgggua

SEQ ID NO: 1581724 - RNA, 22 nt, Pseudomonas putida KT2440
ugcuggccaaggucuccagcac

SEQ ID NO: 1581725 - RNA, 22 nt, Pseudomonas putida KT2440
ugcuggccaauuucuacccgcc

SEQ ID NO: 1581726 - RNA, 22 nt, Pseudomonas putida KT2440
ugcuggccgccagacaacuggc

SEQ ID NO: 1581727 - RNA, 18 nt, Pseudomonas putida KT2440
ugcuguggaacagccuug

SEQ ID NO: 1581728 - RNA, 14 nt, Pseudomonas putida KT2440
ugcuguggcgcaca

SEQ ID NO: 1581729 - RNA, 15 nt, Pseudomonas putida KT2440
ugcugguuuggcagc

SEQ ID NO: 1581730 - RNA, 18 nt, Pseudomonas putida KT2440
ugcugguggccacgccga

SEQ ID NO: 1581731 - RNA, 14 nt, Pseudomonas putida KT2440
ugcugggucagcac

SEQ ID NO: 1581732 - RNA, 17 nt, Pseudomonas putida KT2440
ugcugguacagccggcu

SEQ ID NO: 1581733 - RNA, 17 nt, Pseudomonas putida KT2440
ugcugguacaugccgcc

SEQ ID NO: 1581734 - RNA, 19 nt, Pseudomonas putida KT2440
ugcuggucagugcacuugc

SEQ ID NO: 1581735 - RNA, 20 nt, Pseudomonas putida KT2440
ugcugguccuccccuucccg

SEQ ID NO: 1581736 - RNA, 16 nt, Pseudomonas putida KT2440
ugcuucgcgggcacgc

SEQ ID NO: 1581737 - RNA, 14 nt, Pseudomonas putida KT2440
ugcuucgcugccag

SEQ ID NO: 1581738 - RNA, 15 nt, Pseudomonas putida KT2440
ugcuucaccuugccu

SEQ ID NO: 1581739 - RNA, 21 nt, Pseudomonas putida KT2440
ugcuguuugggcugcgcggca

SEQ ID NO: 1581740 - RNA, 15 nt, Pseudomonas putida KT2440
ugcuugagcgcagcg

SEQ ID NO: 1581741 - RNA, 21 nt, Pseudomonas putida KT2440
ugcuugccgggugcaucggca

SEQ ID NO: 1581742 - RNA, 18 nt, Pseudomonas putida KT2440
ugcuugcgggcaaggucg

SEQ ID NO: 1581743 - RNA, 14 nt, Pseudomonas putida KT2440
ugcgcacgccggua

SEQ ID NO: 1581744 - RNA, 23 nt, Pseudomonas putida KT2440
ugcgcaccuuggcguccagguaa

SEQ ID NO: 1581745 - RNA, 16 nt, Pseudomonas putida KT2440
ugcgcacgcugcccag

SEQ ID NO: 1581746 - RNA, 16 nt, Pseudomonas putida KT2440
ugcgcacggcgcuggg

SEQ ID NO: 1581747 - RNA, 20 nt, Pseudomonas putida KT2440
ugcgcacggucuccggcgaa

SEQ ID NO: 1581748 - RNA, 23 nt, Pseudomonas putida KT2440
ugcgcaaggacgacgugguacgc

SEQ ID NO: 1581749 - RNA, 14 nt, Pseudomonas putida KT2440
ugcgcaaggccgcg

SEQ ID NO: 1581750 - RNA, 19 nt, Pseudomonas putida KT2440
ugcgaucaguaaucugccg

SEQ ID NO: 1581751 - RNA, 14 nt, Pseudomonas putida KT2440
ugcgaggaucagcg

SEQ ID NO: 1581752 - RNA, 14 nt, Pseudomonas putida KT2440
ugcgagucgaucga

SEQ ID NO: 1581753 - RNA, 15 nt, Pseudomonas putida KT2440
ugcgagcgcgggcag

SEQ ID NO: 1581754 - RNA, 17 nt, Pseudomonas putida KT2440
ugcgaagguaaccuggu

SEQ ID NO: 1581755 - RNA, 22 nt, Pseudomonas putida KT2440
ugcgaaccucaguaccggucau

SEQ ID NO: 1581756 - RNA, 16 nt, Pseudomonas putida KT2440
ugcgccaaagcgagca

SEQ ID NO: 1581757 - RNA, 19 nt, Pseudomonas putida KT2440
ugcgccaaagcgagcaugg

SEQ ID NO: 1581758 - RNA, 22 nt, Pseudomonas putida KT2440
ugcgccacacccgcuacaccgg

SEQ ID NO: 1581759 - RNA, 21 nt, Pseudomonas putida KT2440
ugcgcagcccauucgcgggua

SEQ ID NO: 1581760 - RNA, 12 nt, Pseudomonas putida KT2440
ugcgcagcagca

SEQ ID NO: 1581761 - RNA, 17 nt, Pseudomonas putida KT2440
ugcgcccaaugcagccg

SEQ ID NO: 1581762 - RNA, 22 nt, Pseudomonas putida KT2440
ugcgcccaguagcgccaccauc

SEQ ID NO: 1581763 - RNA, 21 nt, Pseudomonas putida KT2440
ugcgccagcaguuucagcggc

SEQ ID NO: 1581764 - RNA, 15 nt, Pseudomonas putida KT2440
ugcgccaucagaggc

SEQ ID NO: 1581765 - RNA, 18 nt, Pseudomonas putida KT2440
ugccuugcccagcuccag

SEQ ID NO: 1581766 - RNA, 14 nt, Pseudomonas putida KT2440
ugccuugcccugca

SEQ ID NO: 1581767 - RNA, 16 nt, Pseudomonas putida KT2440
ugccuuccucggccau

SEQ ID NO: 1581768 - RNA, 17 nt, Pseudomonas putida KT2440
ugccuuccucggccaug

SEQ ID NO: 1581769 - RNA, 22 nt, Pseudomonas putida KT2440
ugccuucugugauuuccagcgu

SEQ ID NO: 1581770 - RNA, 20 nt, Pseudomonas putida KT2440
ugccuugagcggcucgcgcu

SEQ ID NO: 1581771 - RNA, 17 nt, Pseudomonas putida KT2440
ugccuucaggcgcuggu

SEQ ID NO: 1581772 - RNA, 14 nt, Pseudomonas putida KT2440
ugccguuugcuggc

SEQ ID NO: 1581773 - RNA, 20 nt, Pseudomonas putida KT2440
ugccuaccaccgcauccgca

SEQ ID NO: 1581774 - RNA, 15 nt, Pseudomonas putida KT2440
ugccuacccaggcaa

SEQ ID NO: 1581775 - RNA, 14 nt, Pseudomonas putida KT2440
ugccgugcgcggca

SEQ ID NO: 1581776 - RNA, 20 nt, Pseudomonas putida KT2440
ugccgugcgcggcaucagcu

SEQ ID NO: 1581777 - RNA, 13 nt, Pseudomonas putida KT2440
ugccgucucguca

SEQ ID NO: 1581778 - RNA, 23 nt, Pseudomonas putida KT2440
ugccgucucgucacuggcugcug

SEQ ID NO: 1581779 - RNA, 13 nt, Pseudomonas putida KT2440
ugccgucagccga

SEQ ID NO: 1581780 - RNA, 23 nt, Pseudomonas putida KT2440
ugcgggcaaggucgaugcugcug

SEQ ID NO: 1581781 - RNA, 21 nt, Pseudomonas putida KT2440
ugcgggucagcagcaccgcca

SEQ ID NO: 1581782 - RNA, 17 nt, Pseudomonas putida KT2440
ugcgggugagcaugccg

SEQ ID NO: 1581783 - RNA, 19 nt, Pseudomonas putida KT2440
ugcgggaaguccgccagga

SEQ ID NO: 1581784 - RNA, 16 nt, Pseudomonas putida KT2440
ugcgggaccagcacca

SEQ ID NO: 1581785 - RNA, 13 nt, Pseudomonas putida KT2440
ugcgguagcggcu

SEQ ID NO: 1581786 - RNA, 15 nt, Pseudomonas putida KT2440
ugcgguagugcaggc

SEQ ID NO: 1581787 - RNA, 17 nt, Pseudomonas putida KT2440
ugcggguuucgucgauc

SEQ ID NO: 1581788 - RNA, 21 nt, Pseudomonas putida KT2440
ugcgguauaggccgcaagccc

SEQ ID NO: 1581789 - RNA, 14 nt, Pseudomonas putida KT2440
ugcggucaggccaa

SEQ ID NO: 1581790 - RNA, 18 nt, Pseudomonas putida KT2440
ugcggguucucccccauc

SEQ ID NO: 1581791 - RNA, 16 nt, Pseudomonas putida KT2440
ugcggcgccaucggca

SEQ ID NO: 1581792 - RNA, 22 nt, Pseudomonas putida KT2440
ugcggccuucguaguaauggcc

SEQ ID NO: 1581793 - RNA, 16 nt, Pseudomonas putida KT2440
ugcggcccuuggcagc

SEQ ID NO: 1581794 - RNA, 16 nt, Pseudomonas putida KT2440
ugcggcccuugcucag

SEQ ID NO: 1581795 - RNA, 21 nt, Pseudomonas putida KT2440
ugcggcccuucgcgggcacgc

SEQ ID NO: 1581796 - RNA, 16 nt, Pseudomonas putida KT2440
ugcggccccuuccgac

SEQ ID NO: 1581797 - RNA, 21 nt, Pseudomonas putida KT2440
ugcggaccaccugggccagua

SEQ ID NO: 1581798 - RNA, 20 nt, Pseudomonas putida KT2440
ugcggaaaaggccggccaua

SEQ ID NO: 1581799 - RNA, 23 nt, Pseudomonas putida KT2440
ugcggaacauacgcaucagcgca

SEQ ID NO: 1581800 - RNA, 12 nt, Pseudomonas putida KT2440
ugcgcgauagcc

SEQ ID NO: 1581801 - RNA, 17 nt, Pseudomonas putida KT2440
ugcgcgagccaauuuca

SEQ ID NO: 1581802 - RNA, 15 nt, Pseudomonas putida KT2440
ugcgcgagaaugcug

SEQ ID NO: 1581803 - RNA, 22 nt, Pseudomonas putida KT2440
ugcgcgaucgcuuguaggagcg

SEQ ID NO: 1581804 - RNA, 19 nt, Pseudomonas putida KT2440
ugcgcgauucggggaugau

SEQ ID NO: 1581805 - RNA, 20 nt, Pseudomonas putida KT2440
ugcgccccccaggcggugag

SEQ ID NO: 1581806 - RNA, 15 nt, Pseudomonas putida KT2440
ugcgccccguccaca

SEQ ID NO: 1581807 - RNA, 14 nt, Pseudomonas putida KT2440
ugcgccccgcucgc

SEQ ID NO: 1581808 - RNA, 18 nt, Pseudomonas putida KT2440
ugcgccccgcucgccugg

SEQ ID NO: 1581809 - RNA, 22 nt, Pseudomonas putida KT2440
ugcgccccgcucgccuggccau

SEQ ID NO: 1581810 - RNA, 15 nt, Pseudomonas putida KT2440
ugcgcccgaucaccg

SEQ ID NO: 1581811 - RNA, 11 nt, Pseudomonas putida KT2440
ugcgcccugcu

SEQ ID NO: 1581812 - RNA, 15 nt, Pseudomonas putida KT2440
ugcgcccuucgcgga

SEQ ID NO: 1581813 - RNA, 18 nt, Pseudomonas putida KT2440
ugcgccgagaccuguggu

SEQ ID NO: 1581814 - RNA, 23 nt, Pseudomonas putida KT2440
ugcgcgaaguggauauccagcga

SEQ ID NO: 1581815 - RNA, 19 nt, Pseudomonas putida KT2440
ugcgcugaucgugcaccgu

SEQ ID NO: 1581816 - RNA, 14 nt, Pseudomonas putida KT2440
ugcgcugauucaac

SEQ ID NO: 1581817 - RNA, 21 nt, Pseudomonas putida KT2440
ugcgcugcagcgucgccucgg

SEQ ID NO: 1581818 - RNA, 14 nt, Pseudomonas putida KT2440
ugcgcugcauggcg

SEQ ID NO: 1581819 - RNA, 20 nt, Pseudomonas putida KT2440
ugcgcugcauggcggcaccg

SEQ ID NO: 1581820 - RNA, 16 nt, Pseudomonas putida KT2440
ugcgcuggcugccgcg

SEQ ID NO: 1581821 - RNA, 14 nt, Pseudomonas putida KT2440
ugcgcggccguggu

SEQ ID NO: 1581822 - RNA, 19 nt, Pseudomonas putida KT2440
ugcgcggcucgcugcgcug

SEQ ID NO: 1581823 - RNA, 14 nt, Pseudomonas putida KT2440
ugccgcaucagccg

SEQ ID NO: 1581824 - RNA, 15 nt, Pseudomonas putida KT2440
ugccgcaucagccgg

SEQ ID NO: 1581825 - RNA, 22 nt, Pseudomonas putida KT2440
ugccgccaaccagcucaccggc

SEQ ID NO: 1581826 - RNA, 16 nt, Pseudomonas putida KT2440
ugccgaugaugcgggc

SEQ ID NO: 1581827 - RNA, 16 nt, Pseudomonas putida KT2440
ugccgaugcgcgugca

SEQ ID NO: 1581828 - RNA, 15 nt, Pseudomonas putida KT2440
ugccgaugaccugcg

SEQ ID NO: 1581829 - RNA, 18 nt, Pseudomonas putida KT2440
ugccgaugaccugcguca

SEQ ID NO: 1581830 - RNA, 19 nt, Pseudomonas putida KT2440
ugccgaagucauccauggc

SEQ ID NO: 1581831 - RNA, 21 nt, Pseudomonas putida KT2440
ugccgaucagguugcccagca

SEQ ID NO: 1581832 - RNA, 23 nt, Pseudomonas putida KT2440
ugccgaagcccagcgaggccgcg

SEQ ID NO: 1581833 - RNA, 18 nt, Pseudomonas putida KT2440
ugccgccgcugccagcag

SEQ ID NO: 1581834 - RNA, 18 nt, Pseudomonas putida KT2440
ugccgccuucuccagcuc

SEQ ID NO: 1581835 - RNA, 16 nt, Pseudomonas putida KT2440
ugccgcgaauggguca

SEQ ID NO: 1581836 - RNA, 21 nt, Pseudomonas putida KT2440
ugccgcgcccgcaaccucggc

SEQ ID NO: 1581837 - RNA, 14 nt, Pseudomonas putida KT2440
ugccgcgccagcuc

SEQ ID NO: 1581838 - RNA, 17 nt, Pseudomonas putida KT2440
ugccauccucggccagg

SEQ ID NO: 1581839 - RNA, 16 nt, Pseudomonas putida KT2440
ugccauccaccggauc

SEQ ID NO: 1581840 - RNA, 18 nt, Pseudomonas putida KT2440
ugccaucucgccaagcau

SEQ ID NO: 1581841 - RNA, 13 nt, Pseudomonas putida KT2440
ugcccgaucaccg

SEQ ID NO: 1581842 - RNA, 17 nt, Pseudomonas putida KT2440
ugcccgaucaccgcgaa

SEQ ID NO: 1581843 - RNA, 15 nt, Pseudomonas putida KT2440
ugccauucucgccgc

SEQ ID NO: 1581844 - RNA, 15 nt, Pseudomonas putida KT2440
ugccauucuugucca

SEQ ID NO: 1581845 - RNA, 24 nt, Pseudomonas putida KT2440
ugcccgcagcaacugugucucgaa

SEQ ID NO: 1581846 - RNA, 20 nt, Pseudomonas putida KT2440
ugcccgaucgccucgcuggc

SEQ ID NO: 1581847 - RNA, 18 nt, Pseudomonas putida KT2440
ugcccgccccccaccugg

SEQ ID NO: 1581848 - RNA, 16 nt, Pseudomonas putida KT2440
ugcccgccaggcgcaa

SEQ ID NO: 1581849 - RNA, 21 nt, Pseudomonas putida KT2440
ugcccgcccacgccgcuggua

SEQ ID NO: 1581850 - RNA, 22 nt, Pseudomonas putida KT2440
ugcccgcucccacagguccagc

SEQ ID NO: 1581851 - RNA, 15 nt, Pseudomonas putida KT2440
ugcccgcucgcugcg

SEQ ID NO: 1581852 - RNA, 18 nt, Pseudomonas putida KT2440
ugcccgcguacucggcca

SEQ ID NO: 1581853 - RNA, 21 nt, Pseudomonas putida KT2440
ugcccgccccugccagcacca

SEQ ID NO: 1581854 - RNA, 20 nt, Pseudomonas putida KT2440
ugcccgcgaagaggccagca

SEQ ID NO: 1581855 - RNA, 22 nt, Pseudomonas putida KT2440
ugcccgcgaagaggccgguaca

SEQ ID NO: 1581856 - RNA, 20 nt, Pseudomonas putida KT2440
ugcccgcgaagcagccacca

SEQ ID NO: 1581857 - RNA, 17 nt, Pseudomonas putida KT2440
ugcccgcgaaggcucca

SEQ ID NO: 1581858 - RNA, 21 nt, Pseudomonas putida KT2440
ugcccgcgaagggcugccgcg

SEQ ID NO: 1581859 - RNA, 20 nt, Pseudomonas putida KT2440
ugcccgcgaauggccuuuac

SEQ ID NO: 1581860 - RNA, 19 nt, Pseudomonas putida KT2440
ugcccgcgauagcaaaccg

SEQ ID NO: 1581861 - RNA, 17 nt, Pseudomonas putida KT2440
ugcccguaggagcgggu

SEQ ID NO: 1581862 - RNA, 15 nt, Pseudomonas putida KT2440
ugcccgucaccguca

SEQ ID NO: 1581863 - RNA, 13 nt, Pseudomonas putida KT2440
ugcccgucaucga

SEQ ID NO: 1581864 - RNA, 19 nt, Pseudomonas putida KT2440
ugcccgcuguugagcagca

SEQ ID NO: 1581865 - RNA, 20 nt, Pseudomonas putida KT2440
ugcccuuaccggaugcgcug

SEQ ID NO: 1581866 - RNA, 13 nt, Pseudomonas putida KT2440
ugcccuguggcug

SEQ ID NO: 1581867 - RNA, 16 nt, Pseudomonas putida KT2440
ugcccucgggcagccu

SEQ ID NO: 1581868 - RNA, 19 nt, Pseudomonas putida KT2440
ugcccucgacaaucgccag

SEQ ID NO: 1581869 - RNA, 19 nt, Pseudomonas putida KT2440
ugcccuccuaucgcgacac

SEQ ID NO: 1581870 - RNA, 20 nt, Pseudomonas putida KT2440
ugcagccugacgcgccgcca

SEQ ID NO: 1581871 - RNA, 22 nt, Pseudomonas putida KT2440
ugcagcgcgucauccgccaaca

SEQ ID NO: 1581872 - RNA, 14 nt, Pseudomonas putida KT2440
ugcagcgaacacug

SEQ ID NO: 1581873 - RNA, 18 nt, Pseudomonas putida KT2440
ugcagcgaacacugacug

SEQ ID NO: 1581874 - RNA, 14 nt, Pseudomonas putida KT2440
ugcagcgccgcauc

SEQ ID NO: 1581875 - RNA, 20 nt, Pseudomonas putida KT2440
ugcagcgccgcauccagcac

SEQ ID NO: 1581876 - RNA, 23 nt, Pseudomonas putida KT2440
ugcagccaccacgucacgcacca

SEQ ID NO: 1581877 - RNA, 12 nt, Pseudomonas putida KT2440
ugcagcccgcag

SEQ ID NO: 1581878 - RNA, 22 nt, Pseudomonas putida KT2440
ugcagcccuucgcaggcacgcc

SEQ ID NO: 1581879 - RNA, 18 nt, Pseudomonas putida KT2440
ugcagcccuucgccggca

SEQ ID NO: 1581880 - RNA, 15 nt, Pseudomonas putida KT2440
ugcagcaagcuggca

SEQ ID NO: 1581881 - RNA, 15 nt, Pseudomonas putida KT2440
ugcagaugguccggc

SEQ ID NO: 1581882 - RNA, 17 nt, Pseudomonas putida KT2440
ugcagcagugccagcaa

SEQ ID NO: 1581883 - RNA, 13 nt, Pseudomonas putida KT2440
ugcagcacuucga

SEQ ID NO: 1581884 - RNA, 16 nt, Pseudomonas putida KT2440
ugcagcacuucgauca

SEQ ID NO: 1581885 - RNA, 17 nt, Pseudomonas putida KT2440
ugcagcaccgacuggcg

SEQ ID NO: 1581886 - RNA, 23 nt, Pseudomonas putida KT2440
ugcagcagcgcgccgaacuugcc

SEQ ID NO: 1581887 - RNA, 15 nt, Pseudomonas putida KT2440
ugcaggggcugcaag

SEQ ID NO: 1581888 - RNA, 17 nt, Pseudomonas putida KT2440
ugcagggaacugcgcga

SEQ ID NO: 1581889 - RNA, 13 nt, Pseudomonas putida KT2440
ugcagggccugga

SEQ ID NO: 1581890 - RNA, 12 nt, Pseudomonas putida KT2440
ugcaggcguucg

SEQ ID NO: 1581891 - RNA, 20 nt, Pseudomonas putida KT2440
ugcagcgucgccucggggua

SEQ ID NO: 1581892 - RNA, 16 nt, Pseudomonas putida KT2440
ugcagcuucccggccu

SEQ ID NO: 1581893 - RNA, 19 nt, Pseudomonas putida KT2440
ugcagcuucccggccuggc

SEQ ID NO: 1581894 - RNA, 21 nt, Pseudomonas putida KT2440
ugcaggaacuccugcugcagc

SEQ ID NO: 1581895 - RNA, 15 nt, Pseudomonas putida KT2440
ugccaguaaggcuug

SEQ ID NO: 1581896 - RNA, 18 nt, Pseudomonas putida KT2440
ugccagguguuugggcuu

SEQ ID NO: 1581897 - RNA, 20 nt, Pseudomonas putida KT2440
ugccaggcucaggccuucgc

SEQ ID NO: 1581898 - RNA, 20 nt, Pseudomonas putida KT2440
ugccaggcuuggcgugcggc

SEQ ID NO: 1581899 - RNA, 16 nt, Pseudomonas putida KT2440
ugccagggugccagac

SEQ ID NO: 1581900 - RNA, 15 nt, Pseudomonas putida KT2440
ugccaguugcuucug

SEQ ID NO: 1581901 - RNA, 19 nt, Pseudomonas putida KT2440
ugccaguucaugcagcgug

SEQ ID NO: 1581902 - RNA, 17 nt, Pseudomonas putida KT2440
ugccauagcaccagcgg

SEQ ID NO: 1581903 - RNA, 14 nt, Pseudomonas putida KT2440
ugccacuucaccca

SEQ ID NO: 1581904 - RNA, 14 nt, Pseudomonas putida KT2440
ugccacucagcggg

SEQ ID NO: 1581905 - RNA, 16 nt, Pseudomonas putida KT2440
ugccacucaggcgcaa

SEQ ID NO: 1581906 - RNA, 18 nt, Pseudomonas putida KT2440
ugccagcugcgcugccug

SEQ ID NO: 1581907 - RNA, 23 nt, Pseudomonas putida KT2440
ugccagcugcgcugccugcuggc

SEQ ID NO: 1581908 - RNA, 23 nt, Pseudomonas putida KT2440
ugccagcuuggucagggcaaagc

SEQ ID NO: 1581909 - RNA, 23 nt, Pseudomonas putida KT2440
ugccaggcaccacaagaacugcg

SEQ ID NO: 1581910 - RNA, 13 nt, Pseudomonas putida KT2440
ugccaggccaaac

SEQ ID NO: 1581911 - RNA, 15 nt, Pseudomonas putida KT2440
ugcauguccugaagc

SEQ ID NO: 1581912 - RNA, 21 nt, Pseudomonas putida KT2440
ugcaugugccgcucguacugg

SEQ ID NO: 1581913 - RNA, 17 nt, Pseudomonas putida KT2440
ugcauuacgucagcuac

SEQ ID NO: 1581914 - RNA, 21 nt, Pseudomonas putida KT2440
ugcauuuaacggcugucgcga

SEQ ID NO: 1581915 - RNA, 21 nt, Pseudomonas putida KT2440
ugcauuggcggcaggcgcagc

SEQ ID NO: 1581916 - RNA, 13 nt, Pseudomonas putida KT2440
ugcauuuucggca

SEQ ID NO: 1581917 - RNA, 17 nt, Pseudomonas putida KT2440
ugccaaggaucagcucg

SEQ ID NO: 1581918 - RNA, 16 nt, Pseudomonas putida KT2440
ugccaacgcaccgacc

SEQ ID NO: 1581919 - RNA, 19 nt, Pseudomonas putida KT2440
ugccaaaguccggcgaagc

SEQ ID NO: 1581920 - RNA, 20 nt, Pseudomonas putida KT2440
ugccaauuuccauaccaaug

SEQ ID NO: 1581921 - RNA, 17 nt, Pseudomonas putida KT2440
ugccaauaaccggcaca

SEQ ID NO: 1581922 - RNA, 20 nt, Pseudomonas putida KT2440
ugauacgcgacaguucgcca

SEQ ID NO: 1581923 - RNA, 23 nt, Pseudomonas putida KT2440
ugauagcgagccgcauuggccgg

SEQ ID NO: 1581924 - RNA, 19 nt, Pseudomonas putida KT2440
ugauaacgcgccgcugccu

SEQ ID NO: 1581925 - RNA, 18 nt, Pseudomonas putida KT2440
ugagccguccggcaaucu

SEQ ID NO: 1581926 - RNA, 15 nt, Pseudomonas putida KT2440
ugagccggcgcuggg

SEQ ID NO: 1581927 - RNA, 17 nt, Pseudomonas putida KT2440
ugagcgacgcugccgca

SEQ ID NO: 1581928 - RNA, 14 nt, Pseudomonas putida KT2440
ugaggaugugcgcu

SEQ ID NO: 1581929 - RNA, 22 nt, Pseudomonas putida KT2440
ugaggucuucgaucucggccag

SEQ ID NO: 1581930 - RNA, 21 nt, Pseudomonas putida KT2440
ugaggugccauagcaccagcg

SEQ ID NO: 1581931 - RNA, 15 nt, Pseudomonas putida KT2440
ugaggugcucgacga

SEQ ID NO: 1581932 - RNA, 22 nt, Pseudomonas putida KT2440
ugagugcuucgcccagugccug

SEQ ID NO: 1581933 - RNA, 23 nt, Pseudomonas putida KT2440
ugaacggcggguggaaauuggcc

SEQ ID NO: 1581934 - RNA, 20 nt, Pseudomonas putida KT2440
ugaacggcauuuccagcguc

SEQ ID NO: 1581935 - RNA, 18 nt, Pseudomonas putida KT2440
ugaagcccggccgcgcca

SEQ ID NO: 1581936 - RNA, 18 nt, Pseudomonas putida KT2440
ugacguuggccgccagcg

SEQ ID NO: 1581937 - RNA, 19 nt, Pseudomonas putida KT2440
ugacguuguagcggccauc

SEQ ID NO: 1581938 - RNA, 21 nt, Pseudomonas putida KT2440
ugacguuguagcggccaucgc

SEQ ID NO: 1581939 - RNA, 23 nt, Pseudomonas putida KT2440
ugacgugcgcggggcccgaccuc

SEQ ID NO: 1581940 - RNA, 17 nt, Pseudomonas putida KT2440
ugagaugaugguugaca

SEQ ID NO: 1581941 - RNA, 15 nt, Pseudomonas putida KT2440
ugacuaguggccacu

SEQ ID NO: 1581942 - RNA, 20 nt, Pseudomonas putida KT2440
ugcacgucauaguuguggca

SEQ ID NO: 1581943 - RNA, 16 nt, Pseudomonas putida KT2440
ugcacgcgugccuggu

SEQ ID NO: 1581944 - RNA, 15 nt, Pseudomonas putida KT2440
ugcacggccugcauc

SEQ ID NO: 1581945 - RNA, 19 nt, Pseudomonas putida KT2440
ugcacggccguuggccagc

SEQ ID NO: 1581946 - RNA, 20 nt, Pseudomonas putida KT2440
ugcacggccguuggccagca

SEQ ID NO: 1581947 - RNA, 19 nt, Pseudomonas putida KT2440
ugcacgcuuucgccgauca

SEQ ID NO: 1581948 - RNA, 21 nt, Pseudomonas putida KT2440
ugcacggacgucgcgcuggcc

SEQ ID NO: 1581949 - RNA, 21 nt, Pseudomonas putida KT2440
ugcagagcucagcgugacgau

SEQ ID NO: 1581950 - RNA, 23 nt, Pseudomonas putida KT2440
ugcagaaagugcguuggcugcug

SEQ ID NO: 1581951 - RNA, 13 nt, Pseudomonas putida KT2440
ugcacuguugcug

SEQ ID NO: 1581952 - RNA, 15 nt, Pseudomonas putida KT2440
ugcacuggccucuuc

SEQ ID NO: 1581953 - RNA, 15 nt, Pseudomonas putida KT2440
ugcagaaacgccauc

SEQ ID NO: 1581954 - RNA, 16 nt, Pseudomonas putida KT2440
ugcacugcaacaccgg

SEQ ID NO: 1581955 - RNA, 21 nt, Pseudomonas putida KT2440
ugcacugccugcacggcaaag

SEQ ID NO: 1581956 - RNA, 13 nt, Pseudomonas putida KT2440
ugcacugccuggc

SEQ ID NO: 1581957 - RNA, 14 nt, Pseudomonas putida KT2440
ugcaccaaugacuc

SEQ ID NO: 1581958 - RNA, 23 nt, Pseudomonas putida KT2440
ugcaccacgcgcaaaugcuugcc

SEQ ID NO: 1581959 - RNA, 13 nt, Pseudomonas putida KT2440
ugcaccaccugcu

SEQ ID NO: 1581960 - RNA, 17 nt, Pseudomonas putida KT2440
ugcaccagcuugugccg

SEQ ID NO: 1581961 - RNA, 23 nt, Pseudomonas putida KT2440
ugcacaucacgcgaccucagccg

SEQ ID NO: 1581962 - RNA, 19 nt, Pseudomonas putida KT2440
ugcacaucuccacugcgcc

SEQ ID NO: 1581963 - RNA, 20 nt, Pseudomonas putida KT2440
ugcaccaacggcuucacauc

SEQ ID NO: 1581964 - RNA, 23 nt, Pseudomonas putida KT2440
ugcaacccgucagugcucggcaa

SEQ ID NO: 1581965 - RNA, 24 nt, Pseudomonas putida KT2440
ugcaacagcuccagcaacugcgcc

SEQ ID NO: 1581966 - RNA, 20 nt, Pseudomonas putida KT2440
ugcaacaaggucgccaggcg

SEQ ID NO: 1581967 - RNA, 20 nt, Pseudomonas putida KT2440
ugauugcagucaccuucgau

SEQ ID NO: 1581968 - RNA, 17 nt, Pseudomonas putida KT2440
ugaugcccgucggcgua

SEQ ID NO: 1581969 - RNA, 17 nt, Pseudomonas putida KT2440
ugaugcagccagccucu

SEQ ID NO: 1581970 - RNA, 15 nt, Pseudomonas putida KT2440
ugaucagguaccccu

SEQ ID NO: 1581971 - RNA, 23 nt, Pseudomonas putida KT2440
ugaucagguaccccucgcugccc

SEQ ID NO: 1581972 - RNA, 13 nt, Pseudomonas putida KT2440
ugaucagcgacac

SEQ ID NO: 1581973 - RNA, 15 nt, Pseudomonas putida KT2440
ugaucagcgccugcu

SEQ ID NO: 1581974 - RNA, 15 nt, Pseudomonas putida KT2440
ugauggcgcauggcc

SEQ ID NO: 1581975 - RNA, 20 nt, Pseudomonas putida KT2440
ugaugguaucugccagcacg

SEQ ID NO: 1581976 - RNA, 15 nt, Pseudomonas putida KT2440
ugaugucuucgcgga

SEQ ID NO: 1581977 - RNA, 15 nt, Pseudomonas putida KT2440
ugauguccgcgccag

SEQ ID NO: 1581978 - RNA, 13 nt, Pseudomonas putida KT2440
ugaacagcgccca

SEQ ID NO: 1581979 - RNA, 23 nt, Pseudomonas putida KT2440
ugaacagcgccuugaagcuggcc

SEQ ID NO: 1581980 - RNA, 22 nt, Pseudomonas putida KT2440
ugaacaggcguacaucagccuc

SEQ ID NO: 1581981 - RNA, 15 nt, Pseudomonas putida KT2440
ugaacaccugccagc

SEQ ID NO: 1581982 - RNA, 18 nt, Pseudomonas putida KT2440
ugaacacgccgucgaccu

SEQ ID NO: 1581983 - RNA, 22 nt, Pseudomonas putida KT2440
ugaacacgcucaugaacagcgc

SEQ ID NO: 1581984 - RNA, 19 nt, Pseudomonas putida KT2440
ugaaaaacgccgggcacug

SEQ ID NO: 1581985 - RNA, 13 nt, Pseudomonas putida KT2440
ugaacaaggccug

SEQ ID NO: 1581986 - RNA, 18 nt, Pseudomonas putida KT2440
ucuugucuccgaacgccu

SEQ ID NO: 1581987 - RNA, 21 nt, Pseudomonas putida KT2440
ucuugucuuuacgcauugccg

SEQ ID NO: 1581988 - RNA, 15 nt, Pseudomonas putida KT2440
ucuuguggcucaugu

SEQ ID NO: 1581989 - RNA, 22 nt, Pseudomonas putida KT2440
ucuugagcuggccguccagcug

SEQ ID NO: 1581990 - RNA, 23 nt, Pseudomonas putida KT2440
ucuugaacugggcauccagcuug

SEQ ID NO: 1581991 - RNA, 17 nt, Pseudomonas putida KT2440
ucuugaagaagcucccg

SEQ ID NO: 1581992 - RNA, 19 nt, Pseudomonas putida KT2440
ucuugcgcgccagcgcaug

SEQ ID NO: 1581993 - RNA, 15 nt, Pseudomonas putida KT2440
ucuugccgagcagcg

SEQ ID NO: 1581994 - RNA, 14 nt, Pseudomonas putida KT2440
ucuucgcggccuug

SEQ ID NO: 1581995 - RNA, 20 nt, Pseudomonas putida KT2440
ucuucgcgggugaacccgcu

SEQ ID NO: 1581996 - RNA, 22 nt, Pseudomonas putida KT2440
ucuucggcuuugaacagcucga

SEQ ID NO: 1581997 - RNA, 16 nt, Pseudomonas putida KT2440
ucuucggccagcaacu

SEQ ID NO: 1581998 - RNA, 17 nt, Pseudomonas putida KT2440
ucuucgcuguaaccugg

SEQ ID NO: 1581999 - RNA, 21 nt, Pseudomonas putida KT2440
ucuucagccgucgccgcuucg

SEQ ID NO: 1582000 - RNA, 16 nt, Pseudomonas putida KT2440
ucuucaaccaguucag

SEQ ID NO: 1582001 - RNA, 19 nt, Pseudomonas putida KT2440
ucuucaagcucgaagcgcu

SEQ ID NO: 1582002 - RNA, 21 nt, Pseudomonas putida KT2440
ucuucaaggccgccaccucgc

SEQ ID NO: 1582003 - RNA, 21 nt, Pseudomonas putida KT2440
ucuuccaccgccucgaccugg

SEQ ID NO: 1582004 - RNA, 19 nt, Pseudomonas putida KT2440
ucuucgauccgcgccauca

SEQ ID NO: 1582005 - RNA, 16 nt, Pseudomonas putida KT2440
ucuucgaucucggcca

SEQ ID NO: 1582006 - RNA, 17 nt, Pseudomonas putida KT2440
ucuuccucgacccagcc

SEQ ID NO: 1582007 - RNA, 14 nt, Pseudomonas putida KT2440
ucuggcagcuccag

SEQ ID NO: 1582008 - RNA, 22 nt, Pseudomonas putida KT2440
ucuggcaccaguuccagggcgg

SEQ ID NO: 1582009 - RNA, 16 nt, Pseudomonas putida KT2440
ucuggcugcaaggucc

SEQ ID NO: 1582010 - RNA, 13 nt, Pseudomonas putida KT2440
ucuggcggaaugu

SEQ ID NO: 1582011 - RNA, 12 nt, Pseudomonas putida KT2440
ucuggcgcagcg

SEQ ID NO: 1582012 - RNA, 20 nt, Pseudomonas putida KT2440
ucugcugcggcaggcuggca

SEQ ID NO: 1582013 - RNA, 20 nt, Pseudomonas putida KT2440
ucuggaggaguccagcugca

SEQ ID NO: 1582014 - RNA, 15 nt, Pseudomonas putida KT2440
ucugcuucgcugcca

SEQ ID NO: 1582015 - RNA, 15 nt, Pseudomonas putida KT2440
ucugcuugaggccca

SEQ ID NO: 1582016 - RNA, 13 nt, Pseudomonas putida KT2440
ucugguugaacug

SEQ ID NO: 1582017 - RNA, 14 nt, Pseudomonas putida KT2440
ucugucagcgccag

SEQ ID NO: 1582018 - RNA, 16 nt, Pseudomonas putida KT2440
ucuguaugacgaugcc

SEQ ID NO: 1582019 - RNA, 21 nt, Pseudomonas putida KT2440
ucuguuacuauuaaccgcuug

SEQ ID NO: 1582020 - RNA, 18 nt, Pseudomonas putida KT2440
ucugugggagcggccuug

SEQ ID NO: 1582021 - RNA, 18 nt, Pseudomonas putida KT2440
ucugugggagcgggcuug

SEQ ID NO: 1582022 - RNA, 20 nt, Pseudomonas putida KT2440
ucugugaggccagcgggaag

SEQ ID NO: 1582023 - RNA, 15 nt, Pseudomonas putida KT2440
ucugcgccaccggcc

SEQ ID NO: 1582024 - RNA, 13 nt, Pseudomonas putida KT2440
ucugccgcaccag

SEQ ID NO: 1582025 - RNA, 22 nt, Pseudomonas putida KT2440
ucugccgccccuccacccaccu

SEQ ID NO: 1582026 - RNA, 14 nt, Pseudomonas putida KT2440
ucugccgcuucguc

SEQ ID NO: 1582027 - RNA, 20 nt, Pseudomonas putida KT2440
ucugccgacaaacguaccag

SEQ ID NO: 1582028 - RNA, 23 nt, Pseudomonas putida KT2440
ucugccguuugcuggccugcagc

SEQ ID NO: 1582029 - RNA, 12 nt, Pseudomonas putida KT2440
ucugccugccca

SEQ ID NO: 1582030 - RNA, 20 nt, Pseudomonas putida KT2440
ucugccagaggcgcguagua

SEQ ID NO: 1582031 - RNA, 20 nt, Pseudomonas putida KT2440
ucugccagcuccuggcucag

SEQ ID NO: 1582032 - RNA, 14 nt, Pseudomonas putida KT2440
ucugccaggcacca

SEQ ID NO: 1582033 - RNA, 12 nt, Pseudomonas putida KT2440
ucugcagguggu

SEQ ID NO: 1582034 - RNA, 11 nt, Pseudomonas putida KT2440
ucugcaugcca

SEQ ID NO: 1582035 - RNA, 19 nt, Pseudomonas putida KT2440
ucugacagcaggaacagcg

SEQ ID NO: 1582036 - RNA, 17 nt, Pseudomonas putida KT2440
ucugaccggcacugcac

SEQ ID NO: 1582037 - RNA, 13 nt, Pseudomonas putida KT2440
ucugcaccggcag

SEQ ID NO: 1582038 - RNA, 22 nt, Pseudomonas putida KT2440
ucugaugcuucugcuucagcuc

SEQ ID NO: 1582039 - RNA, 22 nt, Pseudomonas putida KT2440
ucugaguugcguggggccugcc

SEQ ID NO: 1582040 - RNA, 20 nt, Pseudomonas putida KT2440
ucucgcucagguaggcagca

SEQ ID NO: 1582041 - RNA, 22 nt, Pseudomonas putida KT2440
ucucgcugucguccagcucgcg

SEQ ID NO: 1582042 - RNA, 18 nt, Pseudomonas putida KT2440
ucucggccagugcgugca

SEQ ID NO: 1582043 - RNA, 15 nt, Pseudomonas putida KT2440
ucucgcccuugucca

SEQ ID NO: 1582044 - RNA, 15 nt, Pseudomonas putida KT2440
ucucguucaugcccu

SEQ ID NO: 1582045 - RNA, 18 nt, Pseudomonas putida KT2440
ucucgggguguagcgcag

SEQ ID NO: 1582046 - RNA, 21 nt, Pseudomonas putida KT2440
ucucaacguucauccccucga

SEQ ID NO: 1582047 - RNA, 15 nt, Pseudomonas putida KT2440
ucucgaacagcuggc

SEQ ID NO: 1582048 - RNA, 20 nt, Pseudomonas putida KT2440
ucucgaacauuuccagcaug

SEQ ID NO: 1582049 - RNA, 14 nt, Pseudomonas putida KT2440
ucucgacaagcgca

SEQ ID NO: 1582050 - RNA, 16 nt, Pseudomonas putida KT2440
ucucgacaagcgcauu

SEQ ID NO: 1582051 - RNA, 20 nt, Pseudomonas putida KT2440
ucucgacaagcgcauugauc

SEQ ID NO: 1582052 - RNA, 18 nt, Pseudomonas putida KT2440
ucucgaccagcgccagcc

SEQ ID NO: 1582053 - RNA, 14 nt, Pseudomonas putida KT2440
ucucgcacuugauc

SEQ ID NO: 1582054 - RNA, 15 nt, Pseudomonas putida KT2440
ucucgcagcagcacc

SEQ ID NO: 1582055 - RNA, 17 nt, Pseudomonas putida KT2440
ucucgcagcagcaccgg

SEQ ID NO: 1582056 - RNA, 14 nt, Pseudomonas putida KT2440
ucuaccugagcuuc

SEQ ID NO: 1582057 - RNA, 18 nt, Pseudomonas putida KT2440
ucguugaccccgccgcug

SEQ ID NO: 1582058 - RNA, 18 nt, Pseudomonas putida KT2440
ucgucguaggcgcggguu

SEQ ID NO: 1582059 - RNA, 20 nt, Pseudomonas putida KT2440
ucgucggugaugaucaggga

SEQ ID NO: 1582060 - RNA, 14 nt, Pseudomonas putida KT2440
ucguucgcgggcac

SEQ ID NO: 1582061 - RNA, 20 nt, Pseudomonas putida KT2440
ucgggucgcugccgugcagg

SEQ ID NO: 1582062 - RNA, 19 nt, Pseudomonas putida KT2440
ucggguaguccuccaacaa

SEQ ID NO: 1582063 - RNA, 20 nt, Pseudomonas putida KT2440
ucggcucacgccccgugaag

SEQ ID NO: 1582064 - RNA, 14 nt, Pseudomonas putida KT2440
ucggcuagcgccug

SEQ ID NO: 1582065 - RNA, 12 nt, Pseudomonas putida KT2440
ucggcuacgccg

SEQ ID NO: 1582066 - RNA, 18 nt, Pseudomonas putida KT2440
ucggcuacgccgccgcug

SEQ ID NO: 1582067 - RNA, 21 nt, Pseudomonas putida KT2440
ucggugaacagguugcgcgcc

SEQ ID NO: 1582068 - RNA, 19 nt, Pseudomonas putida KT2440
ucggugauauagcaccggu

SEQ ID NO: 1582069 - RNA, 23 nt, Pseudomonas putida KT2440
ucggugcacggccguuggccagc

SEQ ID NO: 1582070 - RNA, 16 nt, Pseudomonas putida KT2440
ucgguggucagcucgu

SEQ ID NO: 1582071 - RNA, 13 nt, Pseudomonas putida KT2440
ucguccagggcau

SEQ ID NO: 1582072 - RNA, 15 nt, Pseudomonas putida KT2440
ucguacaucggguaa

SEQ ID NO: 1582073 - RNA, 19 nt, Pseudomonas putida KT2440
ucguacaucugcgccagau

SEQ ID NO: 1582074 - RNA, 17 nt, Pseudomonas putida KT2440
ucgucgagcaucugcug

SEQ ID NO: 1582075 - RNA, 21 nt, Pseudomonas putida KT2440
ucgucgagcaacuugcgcagc

SEQ ID NO: 1582076 - RNA, 22 nt, Pseudomonas putida KT2440
ucgucgagcaacuugcgcagcu

SEQ ID NO: 1582077 - RNA, 19 nt, Pseudomonas putida KT2440
ucguccgacaaugccagca

SEQ ID NO: 1582078 - RNA, 17 nt, Pseudomonas putida KT2440
ucgucgaucccgaugcg

SEQ ID NO: 1582079 - RNA, 21 nt, Pseudomonas putida KT2440
ucgucgcugucaccgguaucg

SEQ ID NO: 1582080 - RNA, 12 nt, Pseudomonas putida KT2440
ucggccagggcc

SEQ ID NO: 1582081 - RNA, 17 nt, Pseudomonas putida KT2440
ucggccagguacucgcg

SEQ ID NO: 1582082 - RNA, 18 nt, Pseudomonas putida KT2440
ucggccagugcgugcagu

SEQ ID NO: 1582083 - RNA, 16 nt, Pseudomonas putida KT2440
ucggccagcugcgcac

SEQ ID NO: 1582084 - RNA, 17 nt, Pseudomonas putida KT2440
ucggccagcugcugcgg

SEQ ID NO: 1582085 - RNA, 12 nt, Pseudomonas putida KT2440
ucggccggcagc

SEQ ID NO: 1582086 - RNA, 14 nt, Pseudomonas putida KT2440
ucggcgagccuuuc

SEQ ID NO: 1582087 - RNA, 20 nt, Pseudomonas putida KT2440
ucggcgagccgccagacuuc

SEQ ID NO: 1582088 - RNA, 18 nt, Pseudomonas putida KT2440
ucggccucuucgcgggua

SEQ ID NO: 1582089 - RNA, 19 nt, Pseudomonas putida KT2440
ucggccugcccgguacgca

SEQ ID NO: 1582090 - RNA, 22 nt, Pseudomonas putida KT2440
ucggcgccgaacgaauagccgg

SEQ ID NO: 1582091 - RNA, 12 nt, Pseudomonas putida KT2440
ucggcggcuucc

SEQ ID NO: 1582092 - RNA, 19 nt, Pseudomonas putida KT2440
ucggcggcuuucagcgccg

SEQ ID NO: 1582093 - RNA, 15 nt, Pseudomonas putida KT2440
ucggcguagcgcuug

SEQ ID NO: 1582094 - RNA, 17 nt, Pseudomonas putida KT2440
ucggcguacugcacgcu

SEQ ID NO: 1582095 - RNA, 12 nt, Pseudomonas putida KT2440
ucggcgguugca

SEQ ID NO: 1582096 - RNA, 20 nt, Pseudomonas putida KT2440
ucggcggugccugcagcccg

SEQ ID NO: 1582097 - RNA, 14 nt, Pseudomonas putida KT2440
ucgcgucagcaccg

SEQ ID NO: 1582098 - RNA, 23 nt, Pseudomonas putida KT2440
ucgcggugcaacauguccacacc

SEQ ID NO: 1582099 - RNA, 15 nt, Pseudomonas putida KT2440
ucgcgguccuugccg

SEQ ID NO: 1582100 - RNA, 17 nt, Pseudomonas putida KT2440
ucgcuggguacuggcuu

SEQ ID NO: 1582101 - RNA, 11 nt, Pseudomonas putida KT2440
ucgcgucgccc

SEQ ID NO: 1582102 - RNA, 17 nt, Pseudomonas putida KT2440
ucgcuccaguggugcaa

SEQ ID NO: 1582103 - RNA, 21 nt, Pseudomonas putida KT2440
ucgcuaaccucugcaugccag

SEQ ID NO: 1582104 - RNA, 15 nt, Pseudomonas putida KT2440
ucgcugucguccagc

SEQ ID NO: 1582105 - RNA, 19 nt, Pseudomonas putida KT2440
ucgcugugcaacagcgccu

SEQ ID NO: 1582106 - RNA, 13 nt, Pseudomonas putida KT2440
ucgcugugcguga

SEQ ID NO: 1582107 - RNA, 22 nt, Pseudomonas putida KT2440
ucgcugucaccgguaucgaugc

SEQ ID NO: 1582108 - RNA, 23 nt, Pseudomonas putida KT2440
ucgcuucggcgcgggcacccugg

SEQ ID NO: 1582109 - RNA, 23 nt, Pseudomonas putida KT2440
ucgcuucugcacucccgcugcug

SEQ ID NO: 1582110 - RNA, 17 nt, Pseudomonas putida KT2440
ucggauuggcgcggcug

SEQ ID NO: 1582111 - RNA, 23 nt, Pseudomonas putida KT2440
ucggcaaacacauccagcgccgc

SEQ ID NO: 1582112 - RNA, 20 nt, Pseudomonas putida KT2440
ucggauccaauguuagcccg

SEQ ID NO: 1582113 - RNA, 20 nt, Pseudomonas putida KT2440
ucggauacuccgggaacagc

SEQ ID NO: 1582114 - RNA, 11 nt, Pseudomonas putida KT2440
ucggcagccau

SEQ ID NO: 1582115 - RNA, 17 nt, Pseudomonas putida KT2440
ucggcagcgaucagcgc

SEQ ID NO: 1582116 - RNA, 23 nt, Pseudomonas putida KT2440
ucggcacacgguuuccaggcgua

SEQ ID NO: 1582117 - RNA, 14 nt, Pseudomonas putida KT2440
ucggcaaagcggcu

SEQ ID NO: 1582118 - RNA, 21 nt, Pseudomonas putida KT2440
ucggcaaucacccgcaggguc

SEQ ID NO: 1582119 - RNA, 13 nt, Pseudomonas putida KT2440
ucggcaaucagca

SEQ ID NO: 1582120 - RNA, 14 nt, Pseudomonas putida KT2440
ucggcaaucagcag

SEQ ID NO: 1582121 - RNA, 18 nt, Pseudomonas putida KT2440
ucggcaaucagcaggucg

SEQ ID NO: 1582122 - RNA, 14 nt, Pseudomonas putida KT2440
ucggcaaucagcau

SEQ ID NO: 1582123 - RNA, 16 nt, Pseudomonas putida KT2440
ucggcaacgauggucg

SEQ ID NO: 1582124 - RNA, 18 nt, Pseudomonas putida KT2440
ucggcaacggccgugcgc

SEQ ID NO: 1582125 - RNA, 20 nt, Pseudomonas putida KT2440
ucggccaccuggucgaaugc

SEQ ID NO: 1582126 - RNA, 14 nt, Pseudomonas putida KT2440
ucggccacccgcgu

SEQ ID NO: 1582127 - RNA, 22 nt, Pseudomonas putida KT2440
ucggccacccggaccagcgccg

SEQ ID NO: 1582128 - RNA, 18 nt, Pseudomonas putida KT2440
ucggcaggcgguccagca

SEQ ID NO: 1582129 - RNA, 21 nt, Pseudomonas putida KT2440
ucggccacacgggcguucagc

SEQ ID NO: 1582130 - RNA, 13 nt, Pseudomonas putida KT2440
ucggcagucuugc

SEQ ID NO: 1582131 - RNA, 19 nt, Pseudomonas putida KT2440
ucggcaguggcucgugcac

SEQ ID NO: 1582132 - RNA, 19 nt, Pseudomonas putida KT2440
ucgccgcggguaccaccug

SEQ ID NO: 1582133 - RNA, 22 nt, Pseudomonas putida KT2440
ucgccgccgguuucucgcagca

SEQ ID NO: 1582134 - RNA, 17 nt, Pseudomonas putida KT2440
ucgcccgccagguagcg

SEQ ID NO: 1582135 - RNA, 22 nt, Pseudomonas putida KT2440
ucgcccgccagguagcgauugc

SEQ ID NO: 1582136 - RNA, 19 nt, Pseudomonas putida KT2440
ucgccgaaccccaccagca

SEQ ID NO: 1582137 - RNA, 21 nt, Pseudomonas putida KT2440
ucgcgggcaugcccgcuccca

SEQ ID NO: 1582138 - RNA, 13 nt, Pseudomonas putida KT2440
ucgcgggcacgcc

SEQ ID NO: 1582139 - RNA, 16 nt, Pseudomonas putida KT2440
ucgcgggcacgcccgc

SEQ ID NO: 1582140 - RNA, 13 nt, Pseudomonas putida KT2440
ucgcgggcaaacc

SEQ ID NO: 1582141 - RNA, 21 nt, Pseudomonas putida KT2440
ucgcgggcaaacccgcgccua

SEQ ID NO: 1582142 - RNA, 18 nt, Pseudomonas putida KT2440
ucgcgggcaagcccgcga

SEQ ID NO: 1582143 - RNA, 21 nt, Pseudomonas putida KT2440
ucgcgggcaagcccgcuccga

SEQ ID NO: 1582144 - RNA, 21 nt, Pseudomonas putida KT2440
ucgcgggcaagcccgcuccua

SEQ ID NO: 1582145 - RNA, 20 nt, Pseudomonas putida KT2440
ucgcgggagacccguuccua

SEQ ID NO: 1582146 - RNA, 22 nt, Pseudomonas putida KT2440
ucgcggcggcuaagcgccagca

SEQ ID NO: 1582147 - RNA, 15 nt, Pseudomonas putida KT2440
ucgcgggcucgccca

SEQ ID NO: 1582148 - RNA, 17 nt, Pseudomonas putida KT2440
ucgcgggugaacccgcu

SEQ ID NO: 1582149 - RNA, 21 nt, Pseudomonas putida KT2440
ucgcgggugaacccgcuccua

SEQ ID NO: 1582150 - RNA, 21 nt, Pseudomonas putida KT2440
ucgcgggugaacccgcuccug

SEQ ID NO: 1582151 - RNA, 17 nt, Pseudomonas putida KT2440
ucgcggguaaacccgcc

SEQ ID NO: 1582152 - RNA, 21 nt, Pseudomonas putida KT2440
ucgcggguaaacccgggucag

SEQ ID NO: 1582153 - RNA, 21 nt, Pseudomonas putida KT2440
ucgcggguaagcccgcuccua

SEQ ID NO: 1582154 - RNA, 22 nt, Pseudomonas putida KT2440
ucgcggccuacccgggcgcagg

SEQ ID NO: 1582155 - RNA, 12 nt, Pseudomonas putida KT2440
ucgcgcggguaa

SEQ ID NO: 1582156 - RNA, 17 nt, Pseudomonas putida KT2440
ucgcggaucaacccgcg

SEQ ID NO: 1582157 - RNA, 18 nt, Pseudomonas putida KT2440
ucgcgcagcagcucccga

SEQ ID NO: 1582158 - RNA, 22 nt, Pseudomonas putida KT2440
ucgcgcacugaauacaccagcu

SEQ ID NO: 1582159 - RNA, 14 nt, Pseudomonas putida KT2440
ucgcgcacuugcca

SEQ ID NO: 1582160 - RNA, 15 nt, Pseudomonas putida KT2440
ucgcgaugggcugca

SEQ ID NO: 1582161 - RNA, 12 nt, Pseudomonas putida KT2440
ucgcgcauggcc

SEQ ID NO: 1582162 - RNA, 20 nt, Pseudomonas putida KT2440
ucgcgcauuuucaccgagcu

SEQ ID NO: 1582163 - RNA, 17 nt, Pseudomonas putida KT2440
ucgcgagucaggcugca

SEQ ID NO: 1582164 - RNA, 15 nt, Pseudomonas putida KT2440
ucgcgauccaucuuc

SEQ ID NO: 1582165 - RNA, 14 nt, Pseudomonas putida KT2440
ucgcgagccagauc

SEQ ID NO: 1582166 - RNA, 21 nt, Pseudomonas putida KT2440
ucgcgagcaagcucgcuccua

SEQ ID NO: 1582167 - RNA, 17 nt, Pseudomonas putida KT2440
ucgcgaggaaacccgcg

SEQ ID NO: 1582168 - RNA, 18 nt, Pseudomonas putida KT2440
ucgcgaggaaacccgcgc

SEQ ID NO: 1582169 - RNA, 13 nt, Pseudomonas putida KT2440
ucgccgguguucg

SEQ ID NO: 1582170 - RNA, 16 nt, Pseudomonas putida KT2440
ucgccguacucggucu

SEQ ID NO: 1582171 - RNA, 22 nt, Pseudomonas putida KT2440
ucgccguacuggcugcacuggg

SEQ ID NO: 1582172 - RNA, 13 nt, Pseudomonas putida KT2440
ucgccgucagccu

SEQ ID NO: 1582173 - RNA, 17 nt, Pseudomonas putida KT2440
gcuuguagccggcaguc

SEQ ID NO: 1582174 - RNA, 14 nt, Pseudomonas putida KT2440
gcuuguacacgccu

SEQ ID NO: 1582175 - RNA, 18 nt, Pseudomonas putida KT2440
gcuugucccaggccauca

SEQ ID NO: 1582176 - RNA, 21 nt, Pseudomonas putida KT2440
gcuuggucagcggaccaggug

SEQ ID NO: 1582177 - RNA, 21 nt, Pseudomonas putida KT2440
gcuugguaccgucgaucagcu

SEQ ID NO: 1582178 - RNA, 20 nt, Pseudomonas putida KT2440
gcuuggcggcccauucgcgg

SEQ ID NO: 1582179 - RNA, 22 nt, Pseudomonas putida KT2440
gcuuggcuuucggcgcacccgg

SEQ ID NO: 1582180 - RNA, 17 nt, Pseudomonas putida KT2440
gcuuggaguugcucgag

SEQ ID NO: 1582181 - RNA, 18 nt, Pseudomonas putida KT2440
gcuuggccagacucagcu

SEQ ID NO: 1582182 - RNA, 17 nt, Pseudomonas putida KT2440
gcuuggcaccggcagca

SEQ ID NO: 1582183 - RNA, 12 nt, Pseudomonas putida KT2440
gcuuggcaggcu

SEQ ID NO: 1582184 - RNA, 17 nt, Pseudomonas putida KT2440
gcuuuuccaguuccugg

SEQ ID NO: 1582185 - RNA, 20 nt, Pseudomonas putida KT2440
gcuuuuccaguuccuggcgg

SEQ ID NO: 1582186 - RNA, 16 nt, Pseudomonas putida KT2440
gcuugucgagguugcg

SEQ ID NO: 1582187 - RNA, 17 nt, Pseudomonas putida KT2440
gcuugucgagguugcgc

SEQ ID NO: 1582188 - RNA, 21 nt, Pseudomonas putida KT2440
gcuuuccagcuguacgcuggc

SEQ ID NO: 1582189 - RNA, 14 nt, Pseudomonas putida KT2440
gcuuucagcgccgc

SEQ ID NO: 1582190 - RNA, 16 nt, Pseudomonas putida KT2440
gcuuucaccuugcugg

SEQ ID NO: 1582191 - RNA, 19 nt, Pseudomonas putida KT2440
gcuugccggcaauaccggc

SEQ ID NO: 1582192 - RNA, 10 nt, Pseudomonas putida KT2440
gcuugccgga

SEQ ID NO: 1582193 - RNA, 19 nt, Pseudomonas putida KT2440
gcuugccggaagaucaggc

SEQ ID NO: 1582194 - RNA, 13 nt, Pseudomonas putida KT2440
gcuugccuuccgg

SEQ ID NO: 1582195 - RNA, 13 nt, Pseudomonas putida KT2440
gcuugccagcguu

SEQ ID NO: 1582196 - RNA, 20 nt, Pseudomonas putida KT2440
gcuugcacagguaucgccgc

SEQ ID NO: 1582197 - RNA, 13 nt, Pseudomonas putida KT2440
gcuugcaccgaca

SEQ ID NO: 1582198 - RNA, 15 nt, Pseudomonas putida KT2440
gcuugccgcgugcga

SEQ ID NO: 1582199 - RNA, 18 nt, Pseudomonas putida KT2440
gcuugcccgcgaacacgg

SEQ ID NO: 1582200 - RNA, 20 nt, Pseudomonas putida KT2440
gcuugcccgcgaacacgggc

SEQ ID NO: 1582201 - RNA, 15 nt, Pseudomonas putida KT2440
gcuugcccgcgaaga

SEQ ID NO: 1582202 - RNA, 16 nt, Pseudomonas putida KT2440
gcuugagaccaggccu

SEQ ID NO: 1582203 - RNA, 21 nt, Pseudomonas putida KT2440
gcuugagcgaaacccggcgca

SEQ ID NO: 1582204 - RNA, 16 nt, Pseudomonas putida KT2440
gcuugaggucgccagg

SEQ ID NO: 1582205 - RNA, 16 nt, Pseudomonas putida KT2440
gcuugaggugcucgac

SEQ ID NO: 1582206 - RNA, 13 nt, Pseudomonas putida KT2440
gcuugagcuccga

SEQ ID NO: 1582207 - RNA, 16 nt, Pseudomonas putida KT2440
gcuugagcucggcaaa

SEQ ID NO: 1582208 - RNA, 15 nt, Pseudomonas putida KT2440
gcuugaggcccaugu

SEQ ID NO: 1582209 - RNA, 20 nt, Pseudomonas putida KT2440
gcuugauauccagcaccggc

SEQ ID NO: 1582210 - RNA, 13 nt, Pseudomonas putida KT2440
gcuugaucagccu

SEQ ID NO: 1582211 - RNA, 23 nt, Pseudomonas putida KT2440
gcuguugagcagcagcccuucgc

SEQ ID NO: 1582212 - RNA, 15 nt, Pseudomonas putida KT2440
gcuugaccauggcga

SEQ ID NO: 1582213 - RNA, 19 nt, Pseudomonas putida KT2440
ggaaucacgcggcgucacc

SEQ ID NO: 1582214 - RNA, 21 nt, Pseudomonas putida KT2440
ggaaggcaccacggaaggcca

SEQ ID NO: 1582215 - RNA, 17 nt, Pseudomonas putida KT2440
ggaaggucuucagcuca

SEQ ID NO: 1582216 - RNA, 13 nt, Pseudomonas putida KT2440
ggacacaggccgu

SEQ ID NO: 1582217 - RNA, 20 nt, Pseudomonas putida KT2440
ggacacaucgaucaggucga

SEQ ID NO: 1582218 - RNA, 14 nt, Pseudomonas putida KT2440
ggaacucgaucggc

SEQ ID NO: 1582219 - RNA, 13 nt, Pseudomonas putida KT2440
ggaagcugggaau

SEQ ID NO: 1582220 - RNA, 18 nt, Pseudomonas putida KT2440
ggaagcuguacagcgcau

SEQ ID NO: 1582221 - RNA, 19 nt, Pseudomonas putida KT2440
ggaagcuguacagcgcaua

SEQ ID NO: 1582222 - RNA, 13 nt, Pseudomonas putida KT2440
ggaacgcugccuc

SEQ ID NO: 1582223 - RNA, 13 nt, Pseudomonas putida KT2440
ggaaaacucgguc

SEQ ID NO: 1582224 - RNA, 14 nt, Pseudomonas putida KT2440
ggaaaaccgcucga

SEQ ID NO: 1582225 - RNA, 12 nt, Pseudomonas putida KT2440
ggaccagcgccg

SEQ ID NO: 1582226 - RNA, 18 nt, Pseudomonas putida KT2440
ggacagcaucucggucga

SEQ ID NO: 1582227 - RNA, 20 nt, Pseudomonas putida KT2440
ggacagcgcccggcgcagca

SEQ ID NO: 1582228 - RNA, 14 nt, Pseudomonas putida KT2440
ggagauuggccagc

SEQ ID NO: 1582229 - RNA, 18 nt, Pseudomonas putida KT2440
ggagccggcuguggcaau

SEQ ID NO: 1582230 - RNA, 21 nt, Pseudomonas putida KT2440
ggagcgagcuugcucgcgaug

SEQ ID NO: 1582231 - RNA, 21 nt, Pseudomonas putida KT2440
ggagcgggcgugcccgcgaau

SEQ ID NO: 1582232 - RNA, 18 nt, Pseudomonas putida KT2440
ggagcgggucagccugcc

SEQ ID NO: 1582233 - RNA, 21 nt, Pseudomonas putida KT2440
ggagcggguucacccgcgaau

SEQ ID NO: 1582234 - RNA, 19 nt, Pseudomonas putida KT2440
ggagcggguuuacccgcga

SEQ ID NO: 1582235 - RNA, 21 nt, Pseudomonas putida KT2440
ggagcggguuuacccgcgaau

SEQ ID NO: 1582236 - RNA, 19 nt, Pseudomonas putida KT2440
ggagcgggcaugcccgcga

SEQ ID NO: 1582237 - RNA, 20 nt, Pseudomonas putida KT2440
ggagcggccuugcgucgcga

SEQ ID NO: 1582238 - RNA, 22 nt, Pseudomonas putida KT2440
ggagcggccuugcgucgcgaug

SEQ ID NO: 1582239 - RNA, 20 nt, Pseudomonas putida KT2440
ggagcggccuugugucucga

SEQ ID NO: 1582240 - RNA, 18 nt, Pseudomonas putida KT2440
ggaguucugcacagcgcg

SEQ ID NO: 1582241 - RNA, 19 nt, Pseudomonas putida KT2440
ggaguugcucgagugcgaa

SEQ ID NO: 1582242 - RNA, 15 nt, Pseudomonas putida KT2440
ggaguccccaccggc

SEQ ID NO: 1582243 - RNA, 12 nt, Pseudomonas putida KT2440
ggagcuggagcc

SEQ ID NO: 1582244 - RNA, 15 nt, Pseudomonas putida KT2440
ggagcugauucagca

SEQ ID NO: 1582245 - RNA, 20 nt, Pseudomonas putida KT2440
ggagcgggucuacccgcgaa

SEQ ID NO: 1582246 - RNA, 19 nt, Pseudomonas putida KT2440
ggagcguggaugaagcggu

SEQ ID NO: 1582247 - RNA, 15 nt, Pseudomonas putida KT2440
ggaucgccaggacgg

SEQ ID NO: 1582248 - RNA, 18 nt, Pseudomonas putida KT2440
ggaucagcgcguccagca

SEQ ID NO: 1582249 - RNA, 16 nt, Pseudomonas putida KT2440
ggaucagccgcgcuga

SEQ ID NO: 1582250 - RNA, 18 nt, Pseudomonas putida KT2440
ggaucacugccagcaccu

SEQ ID NO: 1582251 - RNA, 16 nt, Pseudomonas putida KT2440
ggaucaccgacgugca

SEQ ID NO: 1582252 - RNA, 14 nt, Pseudomonas putida KT2440
ggauaucaggcccu

SEQ ID NO: 1582253 - RNA, 18 nt, Pseudomonas putida KT2440
ggaugccaaggaucagcu

SEQ ID NO: 1582254 - RNA, 21 nt, Pseudomonas putida KT2440
ggaugccuggaaaauccgcuu

SEQ ID NO: 1582255 - RNA, 19 nt, Pseudomonas putida KT2440
ggaugccgugguaucgcuu

SEQ ID NO: 1582256 - RNA, 21 nt, Pseudomonas putida KT2440
ggaugcgggcuuuccacgccu

SEQ ID NO: 1582257 - RNA, 21 nt, Pseudomonas putida KT2440
ggaucggugccacccaaggca

SEQ ID NO: 1582258 - RNA, 23 nt, Pseudomonas putida KT2440
ggaucugaauguacaaugcacuu

SEQ ID NO: 1582259 - RNA, 20 nt, Pseudomonas putida KT2440
ggaucuuuucgggcaaggca

SEQ ID NO: 1582260 - RNA, 16 nt, Pseudomonas putida KT2440
ggaucuugcuggccgg

SEQ ID NO: 1582261 - RNA, 19 nt, Pseudomonas putida KT2440
ggaucuugcuggccggugg

SEQ ID NO: 1582262 - RNA, 18 nt, Pseudomonas putida KT2440
ggaugacuuucaugcccg

SEQ ID NO: 1582263 - RNA, 13 nt, Pseudomonas putida KT2440
gcugucgggucga

SEQ ID NO: 1582264 - RNA, 17 nt, Pseudomonas putida KT2440
gcugucgcuacgcgcca

SEQ ID NO: 1582265 - RNA, 20 nt, Pseudomonas putida KT2440
gcugucauuacccggcagaa

SEQ ID NO: 1582266 - RNA, 20 nt, Pseudomonas putida KT2440
gcuguaggggcgggccugcu

SEQ ID NO: 1582267 - RNA, 17 nt, Pseudomonas putida KT2440
gcuguaguugaccguga

SEQ ID NO: 1582268 - RNA, 14 nt, Pseudomonas putida KT2440
gcugucuccauucc

SEQ ID NO: 1582269 - RNA, 14 nt, Pseudomonas putida KT2440
gcugucuucugcca

SEQ ID NO: 1582270 - RNA, 16 nt, Pseudomonas putida KT2440
gcugucguccagcucg

SEQ ID NO: 1582271 - RNA, 18 nt, Pseudomonas putida KT2440
gcugucguccagcucgcg

SEQ ID NO: 1582272 - RNA, 16 nt, Pseudomonas putida KT2440
gcugucggucagccag

SEQ ID NO: 1582273 - RNA, 21 nt, Pseudomonas putida KT2440
gcugucggucagggcacggcu

SEQ ID NO: 1582274 - RNA, 12 nt, Pseudomonas putida KT2440
gcugugcacugc

SEQ ID NO: 1582275 - RNA, 16 nt, Pseudomonas putida KT2440
gcugugcagcgcucgc

SEQ ID NO: 1582276 - RNA, 20 nt, Pseudomonas putida KT2440
gcugugauacagcacgcgca

SEQ ID NO: 1582277 - RNA, 22 nt, Pseudomonas putida KT2440
gcugugcggcguauacccgguc

SEQ ID NO: 1582278 - RNA, 19 nt, Pseudomonas putida KT2440
gcuggugcaguggcuguac

SEQ ID NO: 1582279 - RNA, 18 nt, Pseudomonas putida KT2440
gcuggugaaggcagguca

SEQ ID NO: 1582280 - RNA, 23 nt, Pseudomonas putida KT2440
gcuggugacaacgcccgccguca

SEQ ID NO: 1582281 - RNA, 17 nt, Pseudomonas putida KT2440
gcugggcuuugggagca

SEQ ID NO: 1582282 - RNA, 22 nt, Pseudomonas putida KT2440
gcugguccgggcccaugccacg

SEQ ID NO: 1582283 - RNA, 23 nt, Pseudomonas putida KT2440
gcuggccuuguacaacgccuuga

SEQ ID NO: 1582284 - RNA, 17 nt, Pseudomonas putida KT2440
gcuggccuuuucgcggg

SEQ ID NO: 1582285 - RNA, 19 nt, Pseudomonas putida KT2440
gcuggccuuuucgcgggua

SEQ ID NO: 1582286 - RNA, 21 nt, Pseudomonas putida KT2440
gcuggccuucgaacagcgaag

SEQ ID NO: 1582287 - RNA, 15 nt, Pseudomonas putida KT2440
gcuggcgacgaagcu

SEQ ID NO: 1582288 - RNA, 19 nt, Pseudomonas putida KT2440
gcuggccuugcggcaagcu

SEQ ID NO: 1582289 - RNA, 15 nt, Pseudomonas putida KT2440
gcuggccguccagcu

SEQ ID NO: 1582290 - RNA, 16 nt, Pseudomonas putida KT2440
gcuggccgguggcuuc

SEQ ID NO: 1582291 - RNA, 13 nt, Pseudomonas putida KT2440
gcuggcgaucagg

SEQ ID NO: 1582292 - RNA, 16 nt, Pseudomonas putida KT2440
gcuggcgaucaggcag

SEQ ID NO: 1582293 - RNA, 20 nt, Pseudomonas putida KT2440
gcuggcgaucaggcaggcca

SEQ ID NO: 1582294 - RNA, 17 nt, Pseudomonas putida KT2440
gcuggcgcagagggucu

SEQ ID NO: 1582295 - RNA, 20 nt, Pseudomonas putida KT2440
gcuggcgcgaccaucaccgc

SEQ ID NO: 1582296 - RNA, 19 nt, Pseudomonas putida KT2440
gcugggcuucgacaaccgg

SEQ ID NO: 1582297 - RNA, 17 nt, Pseudomonas putida KT2440
gcugcgguaccggccag

SEQ ID NO: 1582298 - RNA, 19 nt, Pseudomonas putida KT2440
gcugcgguaccggccagcu

SEQ ID NO: 1582299 - RNA, 18 nt, Pseudomonas putida KT2440
gcugcucgaucagguuga

SEQ ID NO: 1582300 - RNA, 23 nt, Pseudomonas putida KT2440
gcugcucugcaaugccgccaacu

SEQ ID NO: 1582301 - RNA, 23 nt, Pseudomonas putida KT2440
gcugcgggcguuguguugcuggg

SEQ ID NO: 1582302 - RNA, 16 nt, Pseudomonas putida KT2440
gcugcggggcagcccc

SEQ ID NO: 1582303 - RNA, 15 nt, Pseudomonas putida KT2440
gcugccgcuucgcgg

SEQ ID NO: 1582304 - RNA, 14 nt, Pseudomonas putida KT2440
gcugcugucgguca

SEQ ID NO: 1582305 - RNA, 18 nt, Pseudomonas putida KT2440
gcugcugugcggcuggcg

SEQ ID NO: 1582306 - RNA, 19 nt, Pseudomonas putida KT2440
gcugcuuaccagcuuggcg

SEQ ID NO: 1582307 - RNA, 18 nt, Pseudomonas putida KT2440
gcuggaaaaagaacagac

SEQ ID NO: 1582308 - RNA, 18 nt, Pseudomonas putida KT2440
gcugcuuugcagcccauu

SEQ ID NO: 1582309 - RNA, 16 nt, Pseudomonas putida KT2440
gcugcuuugcagcccu

SEQ ID NO: 1582310 - RNA, 21 nt, Pseudomonas putida KT2440
gcugcuuugcagcccuucgcg

SEQ ID NO: 1582311 - RNA, 15 nt, Pseudomonas putida KT2440
gcugcuggcacgccu

SEQ ID NO: 1582312 - RNA, 22 nt, Pseudomonas putida KT2440
gcugcugguacaugccgccgau

SEQ ID NO: 1582313 - RNA, 20 nt, Pseudomonas putida KT2440
gcugcuguccagacgccgca

SEQ ID NO: 1582314 - RNA, 21 nt, Pseudomonas putida KT2440
gcuggacccaaucgcugugca

SEQ ID NO: 1582315 - RNA, 20 nt, Pseudomonas putida KT2440
gcuggaauuauuggccagca

SEQ ID NO: 1582316 - RNA, 23 nt, Pseudomonas putida KT2440
gcuggacagcggcagcaucgacc

SEQ ID NO: 1582317 - RNA, 19 nt, Pseudomonas putida KT2440
gcuggaagcuucgcggaua

SEQ ID NO: 1582318 - RNA, 22 nt, Pseudomonas putida KT2440
gcuggccaccaccaucucgccc

SEQ ID NO: 1582319 - RNA, 23 nt, Pseudomonas putida KT2440
gcuggccgcacccagcaggccga

SEQ ID NO: 1582320 - RNA, 14 nt, Pseudomonas putida KT2440
gcuggccgacguca

SEQ ID NO: 1582321 - RNA, 15 nt, Pseudomonas putida KT2440
gcuggcccuucgcgg

SEQ ID NO: 1582322 - RNA, 16 nt, Pseudomonas putida KT2440
gcuggcccuucgcgga

SEQ ID NO: 1582323 - RNA, 17 nt, Pseudomonas putida KT2440
gcuggcccuuucgcggg

SEQ ID NO: 1582324 - RNA, 13 nt, Pseudomonas putida KT2440
gcuggcccgcgau

SEQ ID NO: 1582325 - RNA, 18 nt, Pseudomonas putida KT2440
gcuggauacccagcgccg

SEQ ID NO: 1582326 - RNA, 13 nt, Pseudomonas putida KT2440
gcuggaucaccac

SEQ ID NO: 1582327 - RNA, 20 nt, Pseudomonas putida KT2440
gcuggaucaccaccgucgaa

SEQ ID NO: 1582328 - RNA, 19 nt, Pseudomonas putida KT2440
gcuggaucagugucugcgc

SEQ ID NO: 1582329 - RNA, 19 nt, Pseudomonas putida KT2440
gcuggaucugaugcuucug

SEQ ID NO: 1582330 - RNA, 13 nt, Pseudomonas putida KT2440
gcuggcaccggcg

SEQ ID NO: 1582331 - RNA, 18 nt, Pseudomonas putida KT2440
gcuggcaauccagcguga

SEQ ID NO: 1582332 - RNA, 16 nt, Pseudomonas putida KT2440
gcuggcagcacgauca

SEQ ID NO: 1582333 - RNA, 18 nt, Pseudomonas putida KT2440
gcuggcagcuugcccugc

SEQ ID NO: 1582334 - RNA, 14 nt, Pseudomonas putida KT2440
gcuggcagcuuggc

SEQ ID NO: 1582335 - RNA, 20 nt, Pseudomonas putida KT2440
gcuggccaaggucuccagca

SEQ ID NO: 1582336 - RNA, 19 nt, Pseudomonas putida KT2440
gcuggcaucgccucguacc

SEQ ID NO: 1582337 - RNA, 13 nt, Pseudomonas putida KT2440
gcucgucacgggu

SEQ ID NO: 1582338 - RNA, 15 nt, Pseudomonas putida KT2440
gcucgucacggguau

SEQ ID NO: 1582339 - RNA, 13 nt, Pseudomonas putida KT2440
gcucgucagcccc

SEQ ID NO: 1582340 - RNA, 14 nt, Pseudomonas putida KT2440
gcucgucaccaucg

SEQ ID NO: 1582341 - RNA, 17 nt, Pseudomonas putida KT2440
gcucguaggcuucacgc

SEQ ID NO: 1582342 - RNA, 18 nt, Pseudomonas putida KT2440
gcucguccaucaccgcca

SEQ ID NO: 1582343 - RNA, 18 nt, Pseudomonas putida KT2440
gcucguccugcagggcga

SEQ ID NO: 1582344 - RNA, 21 nt, Pseudomonas putida KT2440
gcucguccugcagggcgagca

SEQ ID NO: 1582345 - RNA, 15 nt, Pseudomonas putida KT2440
gcucgucgagcaacu

SEQ ID NO: 1582346 - RNA, 17 nt, Pseudomonas putida KT2440
gcucggugugcaccugg

SEQ ID NO: 1582347 - RNA, 18 nt, Pseudomonas putida KT2440
gcucguacaugguguagu

SEQ ID NO: 1582348 - RNA, 21 nt, Pseudomonas putida KT2440
gcucguacgaguugccuucga

SEQ ID NO: 1582349 - RNA, 19 nt, Pseudomonas putida KT2440
gcucugcgccugcgggugc

SEQ ID NO: 1582350 - RNA, 20 nt, Pseudomonas putida KT2440
gcucugcggcccauucgcgg

SEQ ID NO: 1582351 - RNA, 17 nt, Pseudomonas putida KT2440
gcucugcuugagcgcag

SEQ ID NO: 1582352 - RNA, 16 nt, Pseudomonas putida KT2440
gcucugcaggcacacc

SEQ ID NO: 1582353 - RNA, 21 nt, Pseudomonas putida KT2440
gcucugcuccagcugcucgua

SEQ ID NO: 1582354 - RNA, 14 nt, Pseudomonas putida KT2440
gcucuguucgcugg

SEQ ID NO: 1582355 - RNA, 17 nt, Pseudomonas putida KT2440
gcucuguaucgaacagg

SEQ ID NO: 1582356 - RNA, 12 nt, Pseudomonas putida KT2440
gcucuucgcggg

SEQ ID NO: 1582357 - RNA, 19 nt, Pseudomonas putida KT2440
gcucuucgcgggugaaccc

SEQ ID NO: 1582358 - RNA, 14 nt, Pseudomonas putida KT2440
gcucuugcggauca

SEQ ID NO: 1582359 - RNA, 21 nt, Pseudomonas putida KT2440
gcucuucgaguuuggccagcc

SEQ ID NO: 1582360 - RNA, 23 nt, Pseudomonas putida KT2440
gcucuucgaguuuggccagccga

SEQ ID NO: 1582361 - RNA, 24 nt, Pseudomonas putida KT2440
gcucuucgacacugaucucgcgca

SEQ ID NO: 1582362 - RNA, 21 nt, Pseudomonas putida KT2440
gcuccaguugcaagccuucgu

SEQ ID NO: 1582363 - RNA, 17 nt, Pseudomonas putida KT2440
gcuccaucuccagcuca

SEQ ID NO: 1582364 - RNA, 15 nt, Pseudomonas putida KT2440
gcuccagguacucgc

SEQ ID NO: 1582365 - RNA, 22 nt, Pseudomonas putida KT2440
gcuccaggugaaucagcggcag

SEQ ID NO: 1582366 - RNA, 20 nt, Pseudomonas putida KT2440
gcucggcaaggcguaccggc

SEQ ID NO: 1582367 - RNA, 22 nt, Pseudomonas putida KT2440
gcucggcaaggcguaccggcaa

SEQ ID NO: 1582368 - RNA, 14 nt, Pseudomonas putida KT2440
gcucggcaccaccg

SEQ ID NO: 1582369 - RNA, 18 nt, Pseudomonas putida KT2440
gcucggcaaacagguucu

SEQ ID NO: 1582370 - RNA, 19 nt, Pseudomonas putida KT2440
gcuccaugcggcuacccag

SEQ ID NO: 1582371 - RNA, 15 nt, Pseudomonas putida KT2440
gcucggcaugcaugc

SEQ ID NO: 1582372 - RNA, 21 nt, Pseudomonas putida KT2440
gcucggccggggcaaccuggg

SEQ ID NO: 1582373 - RNA, 18 nt, Pseudomonas putida KT2440
gcucggccaccacccgcu

SEQ ID NO: 1582374 - RNA, 17 nt, Pseudomonas putida KT2440
gcucggccaccacuucu

SEQ ID NO: 1582375 - RNA, 21 nt, Pseudomonas putida KT2440
gcucggcauguucaucaccgg

SEQ ID NO: 1582376 - RNA, 22 nt, Pseudomonas putida KT2440
gcucggcauguucaucaccggc

SEQ ID NO: 1582377 - RNA, 17 nt, Pseudomonas putida KT2440
gcugcagggcacgccaa

SEQ ID NO: 1582378 - RNA, 16 nt, Pseudomonas putida KT2440
gcugcaggucggccag

SEQ ID NO: 1582379 - RNA, 21 nt, Pseudomonas putida KT2440
gcugcagggcccagccaccga

SEQ ID NO: 1582380 - RNA, 17 nt, Pseudomonas putida KT2440
gcugcagugcugggcau

SEQ ID NO: 1582381 - RNA, 22 nt, Pseudomonas putida KT2440
gcugcaguagucgccaggccgu

SEQ ID NO: 1582382 - RNA, 15 nt, Pseudomonas putida KT2440
gcugcauaugggcga

SEQ ID NO: 1582383 - RNA, 21 nt, Pseudomonas putida KT2440
gcugcauuggcggcaggcgca

SEQ ID NO: 1582384 - RNA, 21 nt, Pseudomonas putida KT2440
gcugccaaucaacccguucag

SEQ ID NO: 1582385 - RNA, 13 nt, Pseudomonas putida KT2440
gcugcaugcucgg

SEQ ID NO: 1582386 - RNA, 20 nt, Pseudomonas putida KT2440
gcugcacuggcaugcggcau

SEQ ID NO: 1582387 - RNA, 12 nt, Pseudomonas putida KT2440
gcugcacuggcg

SEQ ID NO: 1582388 - RNA, 15 nt, Pseudomonas putida KT2440
gcugcagacccgcga

SEQ ID NO: 1582389 - RNA, 19 nt, Pseudomonas putida KT2440
gcugcacuucgauacccag

SEQ ID NO: 1582390 - RNA, 17 nt, Pseudomonas putida KT2440
gcugcagcacugccugc

SEQ ID NO: 1582391 - RNA, 15 nt, Pseudomonas putida KT2440
gcugcagauugcauc

SEQ ID NO: 1582392 - RNA, 19 nt, Pseudomonas putida KT2440
gcugcagauugcaucacug

SEQ ID NO: 1582393 - RNA, 18 nt, Pseudomonas putida KT2440
gcugcccguugcgcauca

SEQ ID NO: 1582394 - RNA, 15 nt, Pseudomonas putida KT2440
gcugcccgugcuguc

SEQ ID NO: 1582395 - RNA, 18 nt, Pseudomonas putida KT2440
gcugccgcguucacaucg

SEQ ID NO: 1582396 - RNA, 20 nt, Pseudomonas putida KT2440
gcugccgaucagcacgccgc

SEQ ID NO: 1582397 - RNA, 16 nt, Pseudomonas putida KT2440
gcugccgaggcgccga

SEQ ID NO: 1582398 - RNA, 17 nt, Pseudomonas putida KT2440
gcugccgaccugcgccg

SEQ ID NO: 1582399 - RNA, 12 nt, Pseudomonas putida KT2440
gcugccagcgcg

SEQ ID NO: 1582400 - RNA, 14 nt, Pseudomonas putida KT2440
gcugccagcgcgcu

SEQ ID NO: 1582401 - RNA, 16 nt, Pseudomonas putida KT2440
gcugccagcgcgcugc

SEQ ID NO: 1582402 - RNA, 21 nt, Pseudomonas putida KT2440
gcugaucagcaugucccgggu

SEQ ID NO: 1582403 - RNA, 21 nt, Pseudomonas putida KT2440
gcugaucagguugcccgcaug

SEQ ID NO: 1582404 - RNA, 14 nt, Pseudomonas putida KT2440
gcugagcgccaucc

SEQ ID NO: 1582405 - RNA, 13 nt, Pseudomonas putida KT2440
gcugaucgcgggu

SEQ ID NO: 1582406 - RNA, 17 nt, Pseudomonas putida KT2440
gcugauguuggccauca

SEQ ID NO: 1582407 - RNA, 17 nt, Pseudomonas putida KT2440
gcugaucgaaagcugcg

SEQ ID NO: 1582408 - RNA, 21 nt, Pseudomonas putida KT2440
gcugaucgccgucgaccaggc

SEQ ID NO: 1582409 - RNA, 22 nt, Pseudomonas putida KT2440
gcugaucgccgucgaccaggca

SEQ ID NO: 1582410 - RNA, 19 nt, Pseudomonas putida KT2440
gcugcaaaugggucgcgaa

SEQ ID NO: 1582411 - RNA, 19 nt, Pseudomonas putida KT2440
gcugcaacagcucauccag

SEQ ID NO: 1582412 - RNA, 21 nt, Pseudomonas putida KT2440
gcugcaacagcuccagcaacu

SEQ ID NO: 1582413 - RNA, 16 nt, Pseudomonas putida KT2440
gcugcaaagcgggcaa

SEQ ID NO: 1582414 - RNA, 18 nt, Pseudomonas putida KT2440
gcugcaaagcgggcaacu

SEQ ID NO: 1582415 - RNA, 21 nt, Pseudomonas putida KT2440
gcugaaagucgucggcaagcu

SEQ ID NO: 1582416 - RNA, 18 nt, Pseudomonas putida KT2440
gcugaacuuccaggucgg

SEQ ID NO: 1582417 - RNA, 21 nt, Pseudomonas putida KT2440
gcugaacuuccaggucggggu

SEQ ID NO: 1582418 - RNA, 17 nt, Pseudomonas putida KT2440
gcuagggucguccuggg

SEQ ID NO: 1582419 - RNA, 16 nt, Pseudomonas putida KT2440
gcuagcuacucggcaa

SEQ ID NO: 1582420 - RNA, 14 nt, Pseudomonas putida KT2440
gcuaucucaggcca

SEQ ID NO: 1582421 - RNA, 18 nt, Pseudomonas putida KT2440
gcuaugccggucagcagc

SEQ ID NO: 1582422 - RNA, 19 nt, Pseudomonas putida KT2440
gcuaugccggucagcagca

SEQ ID NO: 1582423 - RNA, 21 nt, Pseudomonas putida KT2440
gcucacccgaccagaucaggc

SEQ ID NO: 1582424 - RNA, 23 nt, Pseudomonas putida KT2440
gcucaaaaugcuuuuaugauccu

SEQ ID NO: 1582425 - RNA, 19 nt, Pseudomonas putida KT2440
gcucaagcgccagggcauc

SEQ ID NO: 1582426 - RNA, 17 nt, Pseudomonas putida KT2440
gcucacagcccgggcau

SEQ ID NO: 1582427 - RNA, 13 nt, Pseudomonas putida KT2440
gcucacaggcuca

SEQ ID NO: 1582428 - RNA, 15 nt, Pseudomonas putida KT2440
gcucaacuccauggc

SEQ ID NO: 1582429 - RNA, 16 nt, Pseudomonas putida KT2440
gcucaaccccaucacc

SEQ ID NO: 1582430 - RNA, 15 nt, Pseudomonas putida KT2440
gcucaacccgccuga

SEQ ID NO: 1582431 - RNA, 20 nt, Pseudomonas putida KT2440
gcucaacgccagggcaaucg

SEQ ID NO: 1582432 - RNA, 23 nt, Pseudomonas putida KT2440
gcguugcaggcgcuccaucaugc

SEQ ID NO: 1582433 - RNA, 20 nt, Pseudomonas putida KT2440
gcuaccgaggucugcgcggg

SEQ ID NO: 1582434 - RNA, 22 nt, Pseudomonas putida KT2440
gcuaccgcugcgcaccaaggcg

SEQ ID NO: 1582435 - RNA, 20 nt, Pseudomonas putida KT2440
gcuaccccacaaccccugca

SEQ ID NO: 1582436 - RNA, 18 nt, Pseudomonas putida KT2440
gcuacccacaguugcggg

SEQ ID NO: 1582437 - RNA, 14 nt, Pseudomonas putida KT2440
gcuagccggucacc

SEQ ID NO: 1582438 - RNA, 15 nt, Pseudomonas putida KT2440
gcuaccugugggagc

SEQ ID NO: 1582439 - RNA, 22 nt, Pseudomonas putida KT2440
gcuacgagacgguggcugccag

SEQ ID NO: 1582440 - RNA, 20 nt, Pseudomonas putida KT2440
gcuacgagagaucgcagcga

SEQ ID NO: 1582441 - RNA, 16 nt, Pseudomonas putida KT2440
gcuacgcagcacccgg

SEQ ID NO: 1582442 - RNA, 17 nt, Pseudomonas putida KT2440
gcuacgaaaccgucaug

SEQ ID NO: 1582443 - RNA, 19 nt, Pseudomonas putida KT2440
gcuacgacccugaagcccu

SEQ ID NO: 1582444 - RNA, 19 nt, Pseudomonas putida KT2440
gcuacgcuggacuugccuu

SEQ ID NO: 1582445 - RNA, 21 nt, Pseudomonas putida KT2440
gcucagcagguugaacagcag

SEQ ID NO: 1582446 - RNA, 17 nt, Pseudomonas putida KT2440
gcucagccacgcuggca

SEQ ID NO: 1582447 - RNA, 13 nt, Pseudomonas putida KT2440
gcucagccagcaa

SEQ ID NO: 1582448 - RNA, 15 nt, Pseudomonas putida KT2440
gcucagccagcaagc

SEQ ID NO: 1582449 - RNA, 13 nt, Pseudomonas putida KT2440
gcucacuggccaa

SEQ ID NO: 1582450 - RNA, 16 nt, Pseudomonas putida KT2440
gcucaccggccagcgc

SEQ ID NO: 1582451 - RNA, 13 nt, Pseudomonas putida KT2440
gcucaccgugguc

SEQ ID NO: 1582452 - RNA, 20 nt, Pseudomonas putida KT2440
gcucacgcaagcggcccuga

SEQ ID NO: 1582453 - RNA, 16 nt, Pseudomonas putida KT2440
gcucacgcagcucggu

SEQ ID NO: 1582454 - RNA, 18 nt, Pseudomonas putida KT2440
gcucacgcagcucgguga

SEQ ID NO: 1582455 - RNA, 13 nt, Pseudomonas putida KT2440
gcucacgcagcca

SEQ ID NO: 1582456 - RNA, 14 nt, Pseudomonas putida KT2440
gcucacgcagccag

SEQ ID NO: 1582457 - RNA, 16 nt, Pseudomonas putida KT2440
gcucacgcagcccuuu

SEQ ID NO: 1582458 - RNA, 17 nt, Pseudomonas putida KT2440
gcucaccugguaccccu

SEQ ID NO: 1582459 - RNA, 16 nt, Pseudomonas putida KT2440
gcucagggcagcaacg

SEQ ID NO: 1582460 - RNA, 14 nt, Pseudomonas putida KT2440
gcucaggcgcucca

SEQ ID NO: 1582461 - RNA, 15 nt, Pseudomonas putida KT2440
gcucaggcggcgcag

SEQ ID NO: 1582462 - RNA, 17 nt, Pseudomonas putida KT2440
gcucaggccuugccgcu

SEQ ID NO: 1582463 - RNA, 13 nt, Pseudomonas putida KT2440
gcucaggccaugc

SEQ ID NO: 1582464 - RNA, 23 nt, Pseudomonas putida KT2440
gcucagcugggagagcgccugca

SEQ ID NO: 1582465 - RNA, 15 nt, Pseudomonas putida KT2440
gcucagcuacgcugg

SEQ ID NO: 1582466 - RNA, 13 nt, Pseudomonas putida KT2440
gcuccagcgcacg

SEQ ID NO: 1582467 - RNA, 15 nt, Pseudomonas putida KT2440
gcuccagcgcacgca

SEQ ID NO: 1582468 - RNA, 13 nt, Pseudomonas putida KT2440
gcuccaggcacag

SEQ ID NO: 1582469 - RNA, 19 nt, Pseudomonas putida KT2440
gcuccaggcagccugccag

SEQ ID NO: 1582470 - RNA, 15 nt, Pseudomonas putida KT2440
gcuccagcguguuca

SEQ ID NO: 1582471 - RNA, 18 nt, Pseudomonas putida KT2440
gcuccagcguuugcacgg

SEQ ID NO: 1582472 - RNA, 13 nt, Pseudomonas putida KT2440
gcuccagcucaca

SEQ ID NO: 1582473 - RNA, 20 nt, Pseudomonas putida KT2440
gcuccagcagggucgccuga

SEQ ID NO: 1582474 - RNA, 21 nt, Pseudomonas putida KT2440
gcuccagcacuuuugccacca

SEQ ID NO: 1582475 - RNA, 17 nt, Pseudomonas putida KT2440
gcuccagcagcuccaca

SEQ ID NO: 1582476 - RNA, 12 nt, Pseudomonas putida KT2440
gcuccaccugcc

SEQ ID NO: 1582477 - RNA, 20 nt, Pseudomonas putida KT2440
gcuccaccugccaccccgca

SEQ ID NO: 1582478 - RNA, 19 nt, Pseudomonas putida KT2440
gcuccaccugcuccagcac

SEQ ID NO: 1582479 - RNA, 17 nt, Pseudomonas putida KT2440
gcuccaagugccgugca

SEQ ID NO: 1582480 - RNA, 18 nt, Pseudomonas putida KT2440
gcuccaaccccagcgcau

SEQ ID NO: 1582481 - RNA, 18 nt, Pseudomonas putida KT2440
gcucaugggcuucgagca

SEQ ID NO: 1582482 - RNA, 20 nt, Pseudomonas putida KT2440
gcucaugguucuggcgcacg

SEQ ID NO: 1582483 - RNA, 18 nt, Pseudomonas putida KT2440
gcucaugaacagcgccca

SEQ ID NO: 1582484 - RNA, 13 nt, Pseudomonas putida KT2440
gcucaugcacucg

SEQ ID NO: 1582485 - RNA, 14 nt, Pseudomonas putida KT2440
gcucaugccccgca

SEQ ID NO: 1582486 - RNA, 16 nt, Pseudomonas putida KT2440
gcucaucugccggcga

SEQ ID NO: 1582487 - RNA, 15 nt, Pseudomonas putida KT2440
gcucaucuaccagcu

SEQ ID NO: 1582488 - RNA, 16 nt, Pseudomonas putida KT2440
gcucaucgaggcguug

SEQ ID NO: 1582489 - RNA, 21 nt, Pseudomonas putida KT2440
gcucaucgcggccgaaggcgc

SEQ ID NO: 1582490 - RNA, 15 nt, Pseudomonas putida KT2440
gcucauccaucaccu

SEQ ID NO: 1582491 - RNA, 16 nt, Pseudomonas putida KT2440
gcucaucaccggcguu

SEQ ID NO: 1582492 - RNA, 14 nt, Pseudomonas putida KT2440
gcucauccagccgc

SEQ ID NO: 1582493 - RNA, 18 nt, Pseudomonas putida KT2440
gcucagucgcaucgacag

SEQ ID NO: 1582494 - RNA, 20 nt, Pseudomonas putida KT2440
gcucagugucagcggcgcag

SEQ ID NO: 1582495 - RNA, 17 nt, Pseudomonas putida KT2440
gcucaguugguagagca

SEQ ID NO: 1582496 - RNA, 21 nt, Pseudomonas putida KT2440
gcucauacccuuugccaucca

SEQ ID NO: 1582497 - RNA, 22 nt, Pseudomonas putida KT2440
gcgucgcuucaucggcuggcag

SEQ ID NO: 1582498 - RNA, 13 nt, Pseudomonas putida KT2440
gcgucgcccagac

SEQ ID NO: 1582499 - RNA, 21 nt, Pseudomonas putida KT2440
gcgucgccaaucucguugcgc

SEQ ID NO: 1582500 - RNA, 22 nt, Pseudomonas putida KT2440
gcgucgaacaacggcagcgaca

SEQ ID NO: 1582501 - RNA, 23 nt, Pseudomonas putida KT2440
gcgucgaacaacggcagcgacag

SEQ ID NO: 1582502 - RNA, 16 nt, Pseudomonas putida KT2440
gcguccuucagguaga

SEQ ID NO: 1582503 - RNA, 15 nt, Pseudomonas putida KT2440
gcguccuugacgggg

SEQ ID NO: 1582504 - RNA, 16 nt, Pseudomonas putida KT2440
gcguccuggacccgca

SEQ ID NO: 1582505 - RNA, 12 nt, Pseudomonas putida KT2440
gcgguucgaccg

SEQ ID NO: 1582506 - RNA, 13 nt, Pseudomonas putida KT2440
gcgguucgaccga

SEQ ID NO: 1582507 - RNA, 20 nt, Pseudomonas putida KT2440
gcgguugaccagggcgucga

SEQ ID NO: 1582508 - RNA, 14 nt, Pseudomonas putida KT2440
gcgguucugcgcac

SEQ ID NO: 1582509 - RNA, 20 nt, Pseudomonas putida KT2440
gcgguuucugcaaccacgac

SEQ ID NO: 1582510 - RNA, 14 nt, Pseudomonas putida KT2440
gcgguugucgaccu

SEQ ID NO: 1582511 - RNA, 14 nt, Pseudomonas putida KT2440
gcguaaagcgcccc

SEQ ID NO: 1582512 - RNA, 15 nt, Pseudomonas putida KT2440
gcgugguggcaccgg

SEQ ID NO: 1582513 - RNA, 21 nt, Pseudomonas putida KT2440
gcguggugcugcauaugggcg

SEQ ID NO: 1582514 - RNA, 20 nt, Pseudomonas putida KT2440
gcgugguuguguagguauca

SEQ ID NO: 1582515 - RNA, 17 nt, Pseudomonas putida KT2440
gcguggugaauggcgag

SEQ ID NO: 1582516 - RNA, 23 nt, Pseudomonas putida KT2440
gcguuccagccaggcgucgauca

SEQ ID NO: 1582517 - RNA, 22 nt, Pseudomonas putida KT2440
gcguucagcuugucgaccagga

SEQ ID NO: 1582518 - RNA, 17 nt, Pseudomonas putida KT2440
gcguucaggcaggaacu

SEQ ID NO: 1582519 - RNA, 15 nt, Pseudomonas putida KT2440
gcguucggccagcac

SEQ ID NO: 1582520 - RNA, 21 nt, Pseudomonas putida KT2440
gcgucucgaugcaauccgcca

SEQ ID NO: 1582521 - RNA, 22 nt, Pseudomonas putida KT2440
gcgugcuugugcucccacaggg

SEQ ID NO: 1582522 - RNA, 12 nt, Pseudomonas putida KT2440
gcguggcgaggu

SEQ ID NO: 1582523 - RNA, 15 nt, Pseudomonas putida KT2440
gcgugcucggcaugc

SEQ ID NO: 1582524 - RNA, 19 nt, Pseudomonas putida KT2440
gcgugcccgccacaccugc

SEQ ID NO: 1582525 - RNA, 22 nt, Pseudomonas putida KT2440
gcgugcccgccacaccugccag

SEQ ID NO: 1582526 - RNA, 15 nt, Pseudomonas putida KT2440
gcgugccaggcuugg

SEQ ID NO: 1582527 - RNA, 23 nt, Pseudomonas putida KT2440
gcggcgcuugaucugccaggcac

SEQ ID NO: 1582528 - RNA, 15 nt, Pseudomonas putida KT2440
gcggcgaucagcgcg

SEQ ID NO: 1582529 - RNA, 15 nt, Pseudomonas putida KT2440
gcggcgcaucgcgag

SEQ ID NO: 1582530 - RNA, 13 nt, Pseudomonas putida KT2440
gcggcagguaggc

SEQ ID NO: 1582531 - RNA, 22 nt, Pseudomonas putida KT2440
gcggcagguaggcccagcccag

SEQ ID NO: 1582532 - RNA, 14 nt, Pseudomonas putida KT2440
gcggcaggcuggcg

SEQ ID NO: 1582533 - RNA, 14 nt, Pseudomonas putida KT2440
gcggcgacaggugc

SEQ ID NO: 1582534 - RNA, 23 nt, Pseudomonas putida KT2440
gcggcgacaaccgaaaaggccaa

SEQ ID NO: 1582535 - RNA, 22 nt, Pseudomonas putida KT2440
gcggcgauagggaacagggcag

SEQ ID NO: 1582536 - RNA, 16 nt, Pseudomonas putida KT2440
gcggcgaucaacgcag

SEQ ID NO: 1582537 - RNA, 18 nt, Pseudomonas putida KT2440
gcggcugacgaagcgccu

SEQ ID NO: 1582538 - RNA, 12 nt, Pseudomonas putida KT2440
gcggcuacgcuc

SEQ ID NO: 1582539 - RNA, 17 nt, Pseudomonas putida KT2440
gcggcuaagcgccagca

SEQ ID NO: 1582540 - RNA, 21 nt, Pseudomonas putida KT2440
gcggcgcuuuucuucgcugcu

SEQ ID NO: 1582541 - RNA, 12 nt, Pseudomonas putida KT2440
gcggcggcaacg

SEQ ID NO: 1582542 - RNA, 15 nt, Pseudomonas putida KT2440
gcggcggaucggcgu

SEQ ID NO: 1582543 - RNA, 19 nt, Pseudomonas putida KT2440
gcggcgguugucgucgacc

SEQ ID NO: 1582544 - RNA, 20 nt, Pseudomonas putida KT2440
gcggcgguugucgucgaccg

SEQ ID NO: 1582545 - RNA, 13 nt, Pseudomonas putida KT2440
gcggcuuucagcg

SEQ ID NO: 1582546 - RNA, 18 nt, Pseudomonas putida KT2440
gcggcuuucagcgccgcu

SEQ ID NO: 1582547 - RNA, 16 nt, Pseudomonas putida KT2440
gcggcuguucgcagca

SEQ ID NO: 1582548 - RNA, 13 nt, Pseudomonas putida KT2440
gcggcugggcgcg

SEQ ID NO: 1582549 - RNA, 17 nt, Pseudomonas putida KT2440
gcggcugggugccauca

SEQ ID NO: 1582550 - RNA, 13 nt, Pseudomonas putida KT2440
gcggcuggucgcc

SEQ ID NO: 1582551 - RNA, 17 nt, Pseudomonas putida KT2440
gcggcugucgcagaagc

SEQ ID NO: 1582552 - RNA, 20 nt, Pseudomonas putida KT2440
gcggcugcgacggcgaauga

SEQ ID NO: 1582553 - RNA, 20 nt, Pseudomonas putida KT2440
gcgggcaauguccaggugcu

SEQ ID NO: 1582554 - RNA, 22 nt, Pseudomonas putida KT2440
gcgggcacaggccgcgcaugau

SEQ ID NO: 1582555 - RNA, 16 nt, Pseudomonas putida KT2440
gcgggcacgggcagcg

SEQ ID NO: 1582556 - RNA, 14 nt, Pseudomonas putida KT2440
gcgggcacgcccgc

SEQ ID NO: 1582557 - RNA, 20 nt, Pseudomonas putida KT2440
gcgggcacgcccgcucccac

SEQ ID NO: 1582558 - RNA, 20 nt, Pseudomonas putida KT2440
gcgggauuguucccacaggg

SEQ ID NO: 1582559 - RNA, 22 nt, Pseudomonas putida KT2440
gcgggauuugccgucgcgccca

SEQ ID NO: 1582560 - RNA, 18 nt, Pseudomonas putida KT2440
gcgggcaaacccgcgccu

SEQ ID NO: 1582561 - RNA, 20 nt, Pseudomonas putida KT2440
gcgggcaaacccgcgccuac

SEQ ID NO: 1582562 - RNA, 22 nt, Pseudomonas putida KT2440
gcgggcaaacuggcgcccggca

SEQ ID NO: 1582563 - RNA, 17 nt, Pseudomonas putida KT2440
gcgggcaacugcgccug

SEQ ID NO: 1582564 - RNA, 17 nt, Pseudomonas putida KT2440
gcgggaugcgguugacc

SEQ ID NO: 1582565 - RNA, 20 nt, Pseudomonas putida KT2440
gcgggcaaauccgccccuac

SEQ ID NO: 1582566 - RNA, 14 nt, Pseudomonas putida KT2440
gcgggcaagcccgc

SEQ ID NO: 1582567 - RNA, 16 nt, Pseudomonas putida KT2440
gcgggcaagcccgcga

SEQ ID NO: 1582568 - RNA, 17 nt, Pseudomonas putida KT2440
gcgggcaagcccgcgaa

SEQ ID NO: 1582569 - RNA, 18 nt, Pseudomonas putida KT2440
gcgggcaagcccgcgaag

SEQ ID NO: 1582570 - RNA, 19 nt, Pseudomonas putida KT2440
gcgggcaagcccgcgaaga

SEQ ID NO: 1582571 - RNA, 20 nt, Pseudomonas putida KT2440
gcgggcaagcccgcucccac

SEQ ID NO: 1582572 - RNA, 20 nt, Pseudomonas putida KT2440
gcgggcaagcccgcuccgac

SEQ ID NO: 1582573 - RNA, 20 nt, Pseudomonas putida KT2440
gcgggcaagcccgcuccuac

SEQ ID NO: 1582574 - RNA, 20 nt, Pseudomonas putida KT2440
gcgggcucgcccacacggca

SEQ ID NO: 1582575 - RNA, 14 nt, Pseudomonas putida KT2440
gcggggcauucggc

SEQ ID NO: 1582576 - RNA, 11 nt, Pseudomonas putida KT2440
gcgggccagcc

SEQ ID NO: 1582577 - RNA, 14 nt, Pseudomonas putida KT2440
gcgggcgugcccgc

SEQ ID NO: 1582578 - RNA, 20 nt, Pseudomonas putida KT2440
gcgggcgugcccgcgaaugc

SEQ ID NO: 1582579 - RNA, 16 nt, Pseudomonas putida KT2440
gcgggcgucgcgauca

SEQ ID NO: 1582580 - RNA, 14 nt, Pseudomonas putida KT2440
gcggguaagcccgc

SEQ ID NO: 1582581 - RNA, 20 nt, Pseudomonas putida KT2440
gcggguaaacccgcgccuac

SEQ ID NO: 1582582 - RNA, 21 nt, Pseudomonas putida KT2440
gcggguaaacccgcgccuaca

SEQ ID NO: 1582583 - RNA, 22 nt, Pseudomonas putida KT2440
gcggguaaacccgcgccuacga

SEQ ID NO: 1582584 - RNA, 20 nt, Pseudomonas putida KT2440
gcggguaaacccgcuccuac

SEQ ID NO: 1582585 - RNA, 20 nt, Pseudomonas putida KT2440
gcggguagacccgcuccuac

SEQ ID NO: 1582586 - RNA, 18 nt, Pseudomonas putida KT2440
gcggguucacccgcgaau

SEQ ID NO: 1582587 - RNA, 20 nt, Pseudomonas putida KT2440
gcggguucacccgcgaaugg

SEQ ID NO: 1582588 - RNA, 19 nt, Pseudomonas putida KT2440
gcggguggcuucgucgcgu

SEQ ID NO: 1582589 - RNA, 21 nt, Pseudomonas putida KT2440
gcggguuugggcagugacuuu

SEQ ID NO: 1582590 - RNA, 20 nt, Pseudomonas putida KT2440
gcggguuuucucgcgaaugc

SEQ ID NO: 1582591 - RNA, 14 nt, Pseudomonas putida KT2440
gcggguuugcccgc

SEQ ID NO: 1582592 - RNA, 20 nt, Pseudomonas putida KT2440
gcggguuuacccgcgaaagg

SEQ ID NO: 1582593 - RNA, 20 nt, Pseudomonas putida KT2440
gcggguuuacccgcgaacac

SEQ ID NO: 1582594 - RNA, 21 nt, Pseudomonas putida KT2440
gcggguuuacccgcgaacagg

SEQ ID NO: 1582595 - RNA, 20 nt, Pseudomonas putida KT2440
gcggguuuacccgcgaaugg

SEQ ID NO: 1582596 - RNA, 14 nt, Pseudomonas putida KT2440
gcggguuggaucgg

SEQ ID NO: 1582597 - RNA, 20 nt, Pseudomonas putida KT2440
gcggguugcacagggucagg

SEQ ID NO: 1582598 - RNA, 21 nt, Pseudomonas putida KT2440
gcggguugcacagggucaggu

SEQ ID NO: 1582599 - RNA, 23 nt, Pseudomonas putida KT2440
gcgguaaacgucggcagccaugc

SEQ ID NO: 1582600 - RNA, 17 nt, Pseudomonas putida KT2440
gcgggucgcacucggca

SEQ ID NO: 1582601 - RNA, 17 nt, Pseudomonas putida KT2440
gcgggucagcagcaccg

SEQ ID NO: 1582602 - RNA, 18 nt, Pseudomonas putida KT2440
gcgggucagcucgaucag

SEQ ID NO: 1582603 - RNA, 19 nt, Pseudomonas putida KT2440
gcgggucagcucgaucagg

SEQ ID NO: 1582604 - RNA, 21 nt, Pseudomonas putida KT2440
gcgggucuuccaccaccucca

SEQ ID NO: 1582605 - RNA, 14 nt, Pseudomonas putida KT2440
gcgggugcauggcu

SEQ ID NO: 1582606 - RNA, 12 nt, Pseudomonas putida KT2440
gcggugaccagc

SEQ ID NO: 1582607 - RNA, 16 nt, Pseudomonas putida KT2440
gcggugaauagcaggc

SEQ ID NO: 1582608 - RNA, 16 nt, Pseudomonas putida KT2440
gcggugaccgaggcga

SEQ ID NO: 1582609 - RNA, 16 nt, Pseudomonas putida KT2440
gcggugaggcaacggc

SEQ ID NO: 1582610 - RNA, 21 nt, Pseudomonas putida KT2440
gcggucuuguaucccaggcgc

SEQ ID NO: 1582611 - RNA, 15 nt, Pseudomonas putida KT2440
gcgguuacgacgugc

SEQ ID NO: 1582612 - RNA, 15 nt, Pseudomonas putida KT2440
gcggugggucgacga

SEQ ID NO: 1582613 - RNA, 13 nt, Pseudomonas putida KT2440
gcgguggcguugc

SEQ ID NO: 1582614 - RNA, 14 nt, Pseudomonas putida KT2440
gcggugccggcagc

SEQ ID NO: 1582615 - RNA, 19 nt, Pseudomonas putida KT2440
gcggucaagcucguccugc

SEQ ID NO: 1582616 - RNA, 21 nt, Pseudomonas putida KT2440
gcggucgcgcguaaaucccgc

SEQ ID NO: 1582617 - RNA, 22 nt, Pseudomonas putida KT2440
gcggucgccaaauucgaccagc

SEQ ID NO: 1582618 - RNA, 12 nt, Pseudomonas putida KT2440
gcgguagcggcu

SEQ ID NO: 1582619 - RNA, 13 nt, Pseudomonas putida KT2440
gcgguagccgaac

SEQ ID NO: 1582620 - RNA, 12 nt, Pseudomonas putida KT2440
gcgguacgccgu

SEQ ID NO: 1582621 - RNA, 21 nt, Pseudomonas putida KT2440
gcgguaccuguggggcaacug

SEQ ID NO: 1582622 - RNA, 22 nt, Pseudomonas putida KT2440
gcgguaccggccagcugcgcac

SEQ ID NO: 1582623 - RNA, 20 nt, Pseudomonas putida KT2440
gcgguaccccgccuguuggc

SEQ ID NO: 1582624 - RNA, 12 nt, Pseudomonas putida KT2440
gcgguacagcac

SEQ ID NO: 1582625 - RNA, 21 nt, Pseudomonas putida KT2440
gcgguacaccucaucacgcga

SEQ ID NO: 1582626 - RNA, 22 nt, Pseudomonas putida KT2440
gcgcgguaagauugcaggccau

SEQ ID NO: 1582627 - RNA, 19 nt, Pseudomonas putida KT2440
gcgcggguuuacccgcgaa

SEQ ID NO: 1582628 - RNA, 15 nt, Pseudomonas putida KT2440
gcgcggguuugcccg

SEQ ID NO: 1582629 - RNA, 19 nt, Pseudomonas putida KT2440
gcgcggguuugcccgcgaa

SEQ ID NO: 1582630 - RNA, 20 nt, Pseudomonas putida KT2440
gcgcggguuugcccgcgaag

SEQ ID NO: 1582631 - RNA, 19 nt, Pseudomonas putida KT2440
gcgcggguuugcccgcgag

SEQ ID NO: 1582632 - RNA, 18 nt, Pseudomonas putida KT2440
gcgcgucauccgccaaca

SEQ ID NO: 1582633 - RNA, 15 nt, Pseudomonas putida KT2440
gcgcggccacgcccu

SEQ ID NO: 1582634 - RNA, 20 nt, Pseudomonas putida KT2440
gcgcgcccccgaccacccgg

SEQ ID NO: 1582635 - RNA, 15 nt, Pseudomonas putida KT2440
gcgcgcccaggccca

SEQ ID NO: 1582636 - RNA, 22 nt, Pseudomonas putida KT2440
gcgcgcccaggcccaacgggcg

SEQ ID NO: 1582637 - RNA, 21 nt, Pseudomonas putida KT2440
gcgcgccaugccccuaccgcc

SEQ ID NO: 1582638 - RNA, 15 nt, Pseudomonas putida KT2440
gcgcgccagggcaac

SEQ ID NO: 1582639 - RNA, 22 nt, Pseudomonas putida KT2440
gcgcuaccgaggucugcgcggg

SEQ ID NO: 1582640 - RNA, 18 nt, Pseudomonas putida KT2440
gcgcuaccugugggagcg

SEQ ID NO: 1582641 - RNA, 14 nt, Pseudomonas putida KT2440
gcgcguugcagcca

SEQ ID NO: 1582642 - RNA, 15 nt, Pseudomonas putida KT2440
gcgcguuaggcgaga

SEQ ID NO: 1582643 - RNA, 16 nt, Pseudomonas putida KT2440
gcgcguuaggcgagau

SEQ ID NO: 1582644 - RNA, 12 nt, Pseudomonas putida KT2440
gcgcguccagca

SEQ ID NO: 1582645 - RNA, 14 nt, Pseudomonas putida KT2440
gcgcguccagcaac

SEQ ID NO: 1582646 - RNA, 18 nt, Pseudomonas putida KT2440
gcgcguccagcaacagcu

SEQ ID NO: 1582647 - RNA, 17 nt, Pseudomonas putida KT2440
gcgcucgaacaacgccu

SEQ ID NO: 1582648 - RNA, 16 nt, Pseudomonas putida KT2440
gcgcuccuggucaucg

SEQ ID NO: 1582649 - RNA, 16 nt, Pseudomonas putida KT2440
gcgcuccagcaacgga

SEQ ID NO: 1582650 - RNA, 15 nt, Pseudomonas putida KT2440
gcgcucgacauccag

SEQ ID NO: 1582651 - RNA, 13 nt, Pseudomonas putida KT2440
gcgcucgaagucg

SEQ ID NO: 1582652 - RNA, 23 nt, Pseudomonas putida KT2440
gcgcucaggcguggaaaaggcgc

SEQ ID NO: 1582653 - RNA, 18 nt, Pseudomonas putida KT2440
gcgcuggaauuauuggcc

SEQ ID NO: 1582654 - RNA, 22 nt, Pseudomonas putida KT2440
gcgcuggaauuauuggccagca

SEQ ID NO: 1582655 - RNA, 16 nt, Pseudomonas putida KT2440
gcgcuggacagcggca

SEQ ID NO: 1582656 - RNA, 14 nt, Pseudomonas putida KT2440
gcgcugcagcuccu

SEQ ID NO: 1582657 - RNA, 15 nt, Pseudomonas putida KT2440
gcgcugccaggccgg

SEQ ID NO: 1582658 - RNA, 21 nt, Pseudomonas putida KT2440
gcgcucgcugccggcguggcg

SEQ ID NO: 1582659 - RNA, 20 nt, Pseudomonas putida KT2440
gcgcucgaucucacaggcga

SEQ ID NO: 1582660 - RNA, 23 nt, Pseudomonas putida KT2440
gcgcugaaggaauuaccaggcgc

SEQ ID NO: 1582661 - RNA, 14 nt, Pseudomonas putida KT2440
gcggcagauccugc

SEQ ID NO: 1582662 - RNA, 22 nt, Pseudomonas putida KT2440
gcggcacugaugcccaugccaa

SEQ ID NO: 1582663 - RNA, 22 nt, Pseudomonas putida KT2440
gcggcagcaucgaccugccacu

SEQ ID NO: 1582664 - RNA, 23 nt, Pseudomonas putida KT2440
gcggcagcaucgaccugccacug

SEQ ID NO: 1582665 - RNA, 21 nt, Pseudomonas putida KT2440
gcggcagcaugaacagcgcug

SEQ ID NO: 1582666 - RNA, 12 nt, Pseudomonas putida KT2440
gcggcaccgcca

SEQ ID NO: 1582667 - RNA, 21 nt, Pseudomonas putida KT2440
gcggcaaugcgccggucgcgu

SEQ ID NO: 1582668 - RNA, 22 nt, Pseudomonas putida KT2440
gcggcaaugcgccggucgcguu

SEQ ID NO: 1582669 - RNA, 16 nt, Pseudomonas putida KT2440
gcggcaaucacgaaca

SEQ ID NO: 1582670 - RNA, 23 nt, Pseudomonas putida KT2440
gcggcaaucacgaacaccagccc

SEQ ID NO: 1582671 - RNA, 19 nt, Pseudomonas putida KT2440
gcggcaaccaccaacagca

SEQ ID NO: 1582672 - RNA, 15 nt, Pseudomonas putida KT2440
gcggcaacaccagca

SEQ ID NO: 1582673 - RNA, 16 nt, Pseudomonas putida KT2440
gcggcaacaccagcag

SEQ ID NO: 1582674 - RNA, 20 nt, Pseudomonas putida KT2440
gcggcaaagaucgcccagcu

SEQ ID NO: 1582675 - RNA, 23 nt, Pseudomonas putida KT2440
gcggcaaacacacccucgacguu

SEQ ID NO: 1582676 - RNA, 20 nt, Pseudomonas putida KT2440
gcggaucgcgccuucgcugg

SEQ ID NO: 1582677 - RNA, 22 nt, Pseudomonas putida KT2440
gcggaucgcgccuucgcuggcg

SEQ ID NO: 1582678 - RNA, 16 nt, Pseudomonas putida KT2440
gcggauguucuugacc

SEQ ID NO: 1582679 - RNA, 17 nt, Pseudomonas putida KT2440
gcggauguuggccacga

SEQ ID NO: 1582680 - RNA, 11 nt, Pseudomonas putida KT2440
gcggaucaccg

SEQ ID NO: 1582681 - RNA, 17 nt, Pseudomonas putida KT2440
gcggaucaacccgcgaa

SEQ ID NO: 1582682 - RNA, 16 nt, Pseudomonas putida KT2440
gcggaucagcgcgucc

SEQ ID NO: 1582683 - RNA, 21 nt, Pseudomonas putida KT2440
gcggauccgugcaccgcucag

SEQ ID NO: 1582684 - RNA, 14 nt, Pseudomonas putida KT2440
gcggaucaucggca

SEQ ID NO: 1582685 - RNA, 13 nt, Pseudomonas putida KT2440
gcggaucgccgcc

SEQ ID NO: 1582686 - RNA, 15 nt, Pseudomonas putida KT2440
gcggauacagcgccc

SEQ ID NO: 1582687 - RNA, 16 nt, Pseudomonas putida KT2440
gcggauacagcgccca

SEQ ID NO: 1582688 - RNA, 17 nt, Pseudomonas putida KT2440
gcggagauuggccagca

SEQ ID NO: 1582689 - RNA, 22 nt, Pseudomonas putida KT2440
gcgcuggcgggcaaacuggcgc

SEQ ID NO: 1582690 - RNA, 23 nt, Pseudomonas putida KT2440
gcggaaguucacacucagccgcu

SEQ ID NO: 1582691 - RNA, 15 nt, Pseudomonas putida KT2440
gcggaagauacccgc

SEQ ID NO: 1582692 - RNA, 15 nt, Pseudomonas putida KT2440
gcggaacuggcugac

SEQ ID NO: 1582693 - RNA, 13 nt, Pseudomonas putida KT2440
gcggaacucgccc

SEQ ID NO: 1582694 - RNA, 14 nt, Pseudomonas putida KT2440
gcggaacucggcga

SEQ ID NO: 1582695 - RNA, 17 nt, Pseudomonas putida KT2440
gcgccgauaaagguugc

SEQ ID NO: 1582696 - RNA, 15 nt, Pseudomonas putida KT2440
gcgcccuugcggacc

SEQ ID NO: 1582697 - RNA, 16 nt, Pseudomonas putida KT2440
gcgcccugugggagcg

SEQ ID NO: 1582698 - RNA, 14 nt, Pseudomonas putida KT2440
gcgccgccaggcag

SEQ ID NO: 1582699 - RNA, 12 nt, Pseudomonas putida KT2440
gcgccgccagcu

SEQ ID NO: 1582700 - RNA, 15 nt, Pseudomonas putida KT2440
gcgccgccaggccca

SEQ ID NO: 1582701 - RNA, 11 nt, Pseudomonas putida KT2440
gcgccgccaug

SEQ ID NO: 1582702 - RNA, 16 nt, Pseudomonas putida KT2440
gcgccgccacauccag

SEQ ID NO: 1582703 - RNA, 21 nt, Pseudomonas putida KT2440
gcgccgccacauccagcgccu

SEQ ID NO: 1582704 - RNA, 21 nt, Pseudomonas putida KT2440
gcgccauggccucgucgcggu

SEQ ID NO: 1582705 - RNA, 14 nt, Pseudomonas putida KT2440
gcgccauggcuugc

SEQ ID NO: 1582706 - RNA, 12 nt, Pseudomonas putida KT2440
gcgccccggcga

SEQ ID NO: 1582707 - RNA, 14 nt, Pseudomonas putida KT2440
gcgccccggcgaua

SEQ ID NO: 1582708 - RNA, 23 nt, Pseudomonas putida KT2440
gcgccccgccgcauccuggucac

SEQ ID NO: 1582709 - RNA, 16 nt, Pseudomonas putida KT2440
gcgcccggcgcagcau

SEQ ID NO: 1582710 - RNA, 20 nt, Pseudomonas putida KT2440
gcgcccgcccaccaccagcc

SEQ ID NO: 1582711 - RNA, 22 nt, Pseudomonas putida KT2440
gcgcccuccaucaaucgcucga

SEQ ID NO: 1582712 - RNA, 17 nt, Pseudomonas putida KT2440
gcgcccuggcaugcuga

SEQ ID NO: 1582713 - RNA, 16 nt, Pseudomonas putida KT2440
gcgcccguaacgguca

SEQ ID NO: 1582714 - RNA, 15 nt, Pseudomonas putida KT2440
gcgccagcuccgaca

SEQ ID NO: 1582715 - RNA, 21 nt, Pseudomonas putida KT2440
gcgccagggcaucgaccagua

SEQ ID NO: 1582716 - RNA, 21 nt, Pseudomonas putida KT2440
gcgccaggccuuucagcgccc

SEQ ID NO: 1582717 - RNA, 13 nt, Pseudomonas putida KT2440
gcgccaucgccca

SEQ ID NO: 1582718 - RNA, 18 nt, Pseudomonas putida KT2440
gcgccaucgcccacggcg

SEQ ID NO: 1582719 - RNA, 13 nt, Pseudomonas putida KT2440
gcgccauccgcca

SEQ ID NO: 1582720 - RNA, 23 nt, Pseudomonas putida KT2440
gcgccaucaaaugggucguuagc

SEQ ID NO: 1582721 - RNA, 19 nt, Pseudomonas putida KT2440
gcgccaucagaggcgaugg

SEQ ID NO: 1582722 - RNA, 12 nt, Pseudomonas putida KT2440
gcgccaggucgg

SEQ ID NO: 1582723 - RNA, 14 nt, Pseudomonas putida KT2440
gcgccagcagugca

SEQ ID NO: 1582724 - RNA, 16 nt, Pseudomonas putida KT2440
gcgccagcagguccag

SEQ ID NO: 1582725 - RNA, 19 nt, Pseudomonas putida KT2440
gcgccagcauggaccauca

SEQ ID NO: 1582726 - RNA, 16 nt, Pseudomonas putida KT2440
gcgccaccucggcgaa

SEQ ID NO: 1582727 - RNA, 16 nt, Pseudomonas putida KT2440
gcgccacgccgccaga

SEQ ID NO: 1582728 - RNA, 21 nt, Pseudomonas putida KT2440
gcgccaccgggcgcgauugcc

SEQ ID NO: 1582729 - RNA, 16 nt, Pseudomonas putida KT2440
gcgccaccggucgccu

SEQ ID NO: 1582730 - RNA, 15 nt, Pseudomonas putida KT2440
gcgcaugaucagcug

SEQ ID NO: 1582731 - RNA, 16 nt, Pseudomonas putida KT2440
gcgcaugaucagcugc

SEQ ID NO: 1582732 - RNA, 18 nt, Pseudomonas putida KT2440
gcgcaugaucagcugcca

SEQ ID NO: 1582733 - RNA, 23 nt, Pseudomonas putida KT2440
gcgcaugaaaaagccggcaacga

SEQ ID NO: 1582734 - RNA, 22 nt, Pseudomonas putida KT2440
gcgcaugacuuccagguagcgu

SEQ ID NO: 1582735 - RNA, 16 nt, Pseudomonas putida KT2440
gcgcauguucaggucg

SEQ ID NO: 1582736 - RNA, 13 nt, Pseudomonas putida KT2440
gcgcauggccgcc

SEQ ID NO: 1582737 - RNA, 12 nt, Pseudomonas putida KT2440
gcgcaugcucgc

SEQ ID NO: 1582738 - RNA, 13 nt, Pseudomonas putida KT2440
gcgcaugcucgcg

SEQ ID NO: 1582739 - RNA, 16 nt, Pseudomonas putida KT2440
gcgccaaucaucgcca

SEQ ID NO: 1582740 - RNA, 14 nt, Pseudomonas putida KT2440
gcgccaaccgcgcc

SEQ ID NO: 1582741 - RNA, 18 nt, Pseudomonas putida KT2440
gcgccaaccgcgccagca

SEQ ID NO: 1582742 - RNA, 21 nt, Pseudomonas putida KT2440
gcgccaaccgcgccagcaaug

SEQ ID NO: 1582743 - RNA, 15 nt, Pseudomonas putida KT2440
gcgcauuucguccag

SEQ ID NO: 1582744 - RNA, 13 nt, Pseudomonas putida KT2440
gcgccaaaggcgc

SEQ ID NO: 1582745 - RNA, 14 nt, Pseudomonas putida KT2440
gcgcauugaucgcc

SEQ ID NO: 1582746 - RNA, 15 nt, Pseudomonas putida KT2440
gcgcauugaucgccg

SEQ ID NO: 1582747 - RNA, 18 nt, Pseudomonas putida KT2440
gcgccgucaccagcguca

SEQ ID NO: 1582748 - RNA, 12 nt, Pseudomonas putida KT2440
gcgccgucgccu

SEQ ID NO: 1582749 - RNA, 13 nt, Pseudomonas putida KT2440
gcgccgccgcauc

SEQ ID NO: 1582750 - RNA, 18 nt, Pseudomonas putida KT2440
gcgccgccgcauccucgu

SEQ ID NO: 1582751 - RNA, 14 nt, Pseudomonas putida KT2440
gcgccgccgauagc

SEQ ID NO: 1582752 - RNA, 21 nt, Pseudomonas putida KT2440
gcgccgccgauagcagcaccg

SEQ ID NO: 1582753 - RNA, 21 nt, Pseudomonas putida KT2440
gcgccugcaguucgcugcgca

SEQ ID NO: 1582754 - RNA, 15 nt, Pseudomonas putida KT2440
gcgccugcagcgcgu

SEQ ID NO: 1582755 - RNA, 15 nt, Pseudomonas putida KT2440
gcgccugccggguca

SEQ ID NO: 1582756 - RNA, 18 nt, Pseudomonas putida KT2440
gcgccugccuggcccucu

SEQ ID NO: 1582757 - RNA, 18 nt, Pseudomonas putida KT2440
gcgccuggcccgcagcgc

SEQ ID NO: 1582758 - RNA, 17 nt, Pseudomonas putida KT2440
gcgccugcgggugccgu

SEQ ID NO: 1582759 - RNA, 17 nt, Pseudomonas putida KT2440
gcgccugaaagcguauu

SEQ ID NO: 1582760 - RNA, 15 nt, Pseudomonas putida KT2440
gcgccuugucggcac

SEQ ID NO: 1582761 - RNA, 21 nt, Pseudomonas putida KT2440
gcgccuugucggcacgcgcca

SEQ ID NO: 1582762 - RNA, 20 nt, Pseudomonas putida KT2440
gcgcgaaacccucacgcgcc

SEQ ID NO: 1582763 - RNA, 21 nt, Pseudomonas putida KT2440
gcgcgaaacccucacgcgcca

SEQ ID NO: 1582764 - RNA, 21 nt, Pseudomonas putida KT2440
gcgcgaaguggauauccagcg

SEQ ID NO: 1582765 - RNA, 14 nt, Pseudomonas putida KT2440
gcgcgaaucaccac

SEQ ID NO: 1582766 - RNA, 19 nt, Pseudomonas putida KT2440
gcgcgaaucagcgccucca

SEQ ID NO: 1582767 - RNA, 15 nt, Pseudomonas putida KT2440
gcgcgaacagggccu

SEQ ID NO: 1582768 - RNA, 18 nt, Pseudomonas putida KT2440
gcgcgaacagggccucga

SEQ ID NO: 1582769 - RNA, 16 nt, Pseudomonas putida KT2440
gcgcgcaacagugccc

SEQ ID NO: 1582770 - RNA, 18 nt, Pseudomonas putida KT2440
gcgcgauucguagcgguu

SEQ ID NO: 1582771 - RNA, 16 nt, Pseudomonas putida KT2440
gcgcgccagcgcaugc

SEQ ID NO: 1582772 - RNA, 14 nt, Pseudomonas putida KT2440
gcgcgccaguucgc

SEQ ID NO: 1582773 - RNA, 15 nt, Pseudomonas putida KT2440
gcgcgccacgcacca

SEQ ID NO: 1582774 - RNA, 17 nt, Pseudomonas putida KT2440
gcgcgaucaucgaagcc

SEQ ID NO: 1582775 - RNA, 18 nt, Pseudomonas putida KT2440
gcgcgaucaucgaagcca

SEQ ID NO: 1582776 - RNA, 13 nt, Pseudomonas putida KT2440
gcgcgaucagcgc

SEQ ID NO: 1582777 - RNA, 11 nt, Pseudomonas putida KT2440
gcgcgaucacg

SEQ ID NO: 1582778 - RNA, 13 nt, Pseudomonas putida KT2440
gcgcgaucaccag

SEQ ID NO: 1582779 - RNA, 14 nt, Pseudomonas putida KT2440
gcgcgaucaccagc

SEQ ID NO: 1582780 - RNA, 16 nt, Pseudomonas putida KT2440
gcgcgaggcgcguucu

SEQ ID NO: 1582781 - RNA, 21 nt, Pseudomonas putida KT2440
gcgcgacagcaucaucaggcc

SEQ ID NO: 1582782 - RNA, 22 nt, Pseudomonas putida KT2440
gcgcgacagcaucaucaggccg

SEQ ID NO: 1582783 - RNA, 20 nt, Pseudomonas putida KT2440
gcgaccggcguguugccgcu

SEQ ID NO: 1582784 - RNA, 19 nt, Pseudomonas putida KT2440
gcgaccaucaccgccagca

SEQ ID NO: 1582785 - RNA, 14 nt, Pseudomonas putida KT2440
gcgaccaugcggcu

SEQ ID NO: 1582786 - RNA, 15 nt, Pseudomonas putida KT2440
gcgacaugaucagcg

SEQ ID NO: 1582787 - RNA, 21 nt, Pseudomonas putida KT2440
gcgacagcaucaucaggccga

SEQ ID NO: 1582788 - RNA, 20 nt, Pseudomonas putida KT2440
gcgacagcaucggcagguca

SEQ ID NO: 1582789 - RNA, 16 nt, Pseudomonas putida KT2440
gcgacagacagggccu

SEQ ID NO: 1582790 - RNA, 15 nt, Pseudomonas putida KT2440
gcgaauggcagguga

SEQ ID NO: 1582791 - RNA, 13 nt, Pseudomonas putida KT2440
gcgaauggccgca

SEQ ID NO: 1582792 - RNA, 20 nt, Pseudomonas putida KT2440
gcgaauacgagggugaaccc

SEQ ID NO: 1582793 - RNA, 15 nt, Pseudomonas putida KT2440
gcgaauacgauagcg

SEQ ID NO: 1582794 - RNA, 23 nt, Pseudomonas putida KT2440
gcgaauacgauauccgcagcccc

SEQ ID NO: 1582795 - RNA, 14 nt, Pseudomonas putida KT2440
gcgaauacgcucag

SEQ ID NO: 1582796 - RNA, 16 nt, Pseudomonas putida KT2440
gcgaauccagccggcc

SEQ ID NO: 1582797 - RNA, 17 nt, Pseudomonas putida KT2440
gcgaaucagcaugccca

SEQ ID NO: 1582798 - RNA, 22 nt, Pseudomonas putida KT2440
gcgaaucagcgccuccagggcg

SEQ ID NO: 1582799 - RNA, 18 nt, Pseudomonas putida KT2440
gcgaagggcucaacgcca

SEQ ID NO: 1582800 - RNA, 17 nt, Pseudomonas putida KT2440
gcgaaggggccggcccu

SEQ ID NO: 1582801 - RNA, 20 nt, Pseudomonas putida KT2440
gcgaaggggccggcccugcc

SEQ ID NO: 1582802 - RNA, 20 nt, Pseudomonas putida KT2440
gccuuguaauacggcgccga

SEQ ID NO: 1582803 - RNA, 22 nt, Pseudomonas putida KT2440
gccuugggcaacaccgccagaa

SEQ ID NO: 1582804 - RNA, 14 nt, Pseudomonas putida KT2440
gccuugugggagcg

SEQ ID NO: 1582805 - RNA, 20 nt, Pseudomonas putida KT2440
gcgacgggaagugcacugcc

SEQ ID NO: 1582806 - RNA, 15 nt, Pseudomonas putida KT2440
gcgacggucauaccu

SEQ ID NO: 1582807 - RNA, 15 nt, Pseudomonas putida KT2440
gcgacgguugacagc

SEQ ID NO: 1582808 - RNA, 20 nt, Pseudomonas putida KT2440
gcgacguucuugccgguggu

SEQ ID NO: 1582809 - RNA, 23 nt, Pseudomonas putida KT2440
gcgagguaggccgucagcagcag

SEQ ID NO: 1582810 - RNA, 21 nt, Pseudomonas putida KT2440
gcgagguacggcaagguacug

SEQ ID NO: 1582811 - RNA, 15 nt, Pseudomonas putida KT2440
gcgaggcgggccgca

SEQ ID NO: 1582812 - RNA, 13 nt, Pseudomonas putida KT2440
gcgagcaccggca

SEQ ID NO: 1582813 - RNA, 14 nt, Pseudomonas putida KT2440
gcgagcgcgggcag

SEQ ID NO: 1582814 - RNA, 14 nt, Pseudomonas putida KT2440
gcgagcucaaccag

SEQ ID NO: 1582815 - RNA, 14 nt, Pseudomonas putida KT2440
gcgagcuaccugac

SEQ ID NO: 1582816 - RNA, 17 nt, Pseudomonas putida KT2440
gcgagaaugcugcgcag

SEQ ID NO: 1582817 - RNA, 21 nt, Pseudomonas putida KT2440
gcgagaaugcugcgcagcugg

SEQ ID NO: 1582818 - RNA, 20 nt, Pseudomonas putida KT2440
gcgagcaagcucgcuccuac

SEQ ID NO: 1582819 - RNA, 21 nt, Pseudomonas putida KT2440
gcgagcaagcucgcuccuaca

SEQ ID NO: 1582820 - RNA, 17 nt, Pseudomonas putida KT2440
gcgagaucgacaggggu

SEQ ID NO: 1582821 - RNA, 17 nt, Pseudomonas putida KT2440
gcgauugaucagcgccu

SEQ ID NO: 1582822 - RNA, 21 nt, Pseudomonas putida KT2440
gcgauugcggccuagcaaggc

SEQ ID NO: 1582823 - RNA, 18 nt, Pseudomonas putida KT2440
gcgcaaaaaacgccgcaa

SEQ ID NO: 1582824 - RNA, 16 nt, Pseudomonas putida KT2440
gcgauggucaaccggc

SEQ ID NO: 1582825 - RNA, 19 nt, Pseudomonas putida KT2440
gcgauguagcaauggcccu

SEQ ID NO: 1582826 - RNA, 13 nt, Pseudomonas putida KT2440
gcgaugcugucgg

SEQ ID NO: 1582827 - RNA, 19 nt, Pseudomonas putida KT2440
gcgauggcggaucagcgcg

SEQ ID NO: 1582828 - RNA, 15 nt, Pseudomonas putida KT2440
gcgcaaccgauagcg

SEQ ID NO: 1582829 - RNA, 14 nt, Pseudomonas putida KT2440
gcgcaacgcgccau

SEQ ID NO: 1582830 - RNA, 19 nt, Pseudomonas putida KT2440
gcgcaaacugauucacgcc

SEQ ID NO: 1582831 - RNA, 21 nt, Pseudomonas putida KT2440
gcgcaaacugauucacgcccu

SEQ ID NO: 1582832 - RNA, 14 nt, Pseudomonas putida KT2440
gcgcaaaucgccgc

SEQ ID NO: 1582833 - RNA, 17 nt, Pseudomonas putida KT2440
gcgcaaaugguugucca

SEQ ID NO: 1582834 - RNA, 16 nt, Pseudomonas putida KT2440
gcgcaaggccgcggcu

SEQ ID NO: 1582835 - RNA, 14 nt, Pseudomonas putida KT2440
gcgcaaggcgaggu

SEQ ID NO: 1582836 - RNA, 14 nt, Pseudomonas putida KT2440
gcgcaaggcauuca

SEQ ID NO: 1582837 - RNA, 19 nt, Pseudomonas putida KT2440
gcgcaaggacgacguggua

SEQ ID NO: 1582838 - RNA, 13 nt, Pseudomonas putida KT2440
gcgcaagccgggu

SEQ ID NO: 1582839 - RNA, 14 nt, Pseudomonas putida KT2440
gcgcaagccuuugc

SEQ ID NO: 1582840 - RNA, 17 nt, Pseudomonas putida KT2440
gcgcacacuucgccggu

SEQ ID NO: 1582841 - RNA, 14 nt, Pseudomonas putida KT2440
gcgcaaucaccgcc

SEQ ID NO: 1582842 - RNA, 20 nt, Pseudomonas putida KT2440
gcgaucacgcaggcccagca

SEQ ID NO: 1582843 - RNA, 20 nt, Pseudomonas putida KT2440
gcgaucaggcaggccagcac

SEQ ID NO: 1582844 - RNA, 16 nt, Pseudomonas putida KT2440
gcgaucagcgcgguga

SEQ ID NO: 1582845 - RNA, 22 nt, Pseudomonas putida KT2440
gcgaucagcgcggugaccagcg

SEQ ID NO: 1582846 - RNA, 13 nt, Pseudomonas putida KT2440
gcgaucgccaggu

SEQ ID NO: 1582847 - RNA, 16 nt, Pseudomonas putida KT2440
gcgaucggcugguccg

SEQ ID NO: 1582848 - RNA, 17 nt, Pseudomonas putida KT2440
gcgaucggcugguccgg

SEQ ID NO: 1582849 - RNA, 15 nt, Pseudomonas putida KT2440
gcgaucggcagcgau

SEQ ID NO: 1582850 - RNA, 17 nt, Pseudomonas putida KT2440
gcgaucccugugggagc

SEQ ID NO: 1582851 - RNA, 17 nt, Pseudomonas putida KT2440
gcgaucuggucgaagcu

SEQ ID NO: 1582852 - RNA, 21 nt, Pseudomonas putida KT2440
gcgaugaugauaccgaacagc

SEQ ID NO: 1582853 - RNA, 22 nt, Pseudomonas putida KT2440
gcgaugaugauaccgaacagca

SEQ ID NO: 1582854 - RNA, 21 nt, Pseudomonas putida KT2440
gcgaugagguagaucacaccg

SEQ ID NO: 1582855 - RNA, 13 nt, Pseudomonas putida KT2440
gcgaugcacgcca

SEQ ID NO: 1582856 - RNA, 16 nt, Pseudomonas putida KT2440
gcgaugcacgccagca

SEQ ID NO: 1582857 - RNA, 17 nt, Pseudomonas putida KT2440
gcgaugcacgccagcau

SEQ ID NO: 1582858 - RNA, 19 nt, Pseudomonas putida KT2440
gcgaugcgguugcaggacu

SEQ ID NO: 1582859 - RNA, 19 nt, Pseudomonas putida KT2440
gcgaugcccuucaggcccc

SEQ ID NO: 1582860 - RNA, 16 nt, Pseudomonas putida KT2440
gcgaugccgacagcca

SEQ ID NO: 1582861 - RNA, 16 nt, Pseudomonas putida KT2440
gccuggacgcgugcaa

SEQ ID NO: 1582862 - RNA, 18 nt, Pseudomonas putida KT2440
gccuggauauccagugcu

SEQ ID NO: 1582863 - RNA, 20 nt, Pseudomonas putida KT2440
gccugggcgguccuucaugc

SEQ ID NO: 1582864 - RNA, 20 nt, Pseudomonas putida KT2440
gccugggcgugaaagcagga

SEQ ID NO: 1582865 - RNA, 15 nt, Pseudomonas putida KT2440
gccuggggcaggccc

SEQ ID NO: 1582866 - RNA, 12 nt, Pseudomonas putida KT2440
gccuggccaagc

SEQ ID NO: 1582867 - RNA, 22 nt, Pseudomonas putida KT2440
gccugcgggugccguggguuga

SEQ ID NO: 1582868 - RNA, 14 nt, Pseudomonas putida KT2440
gccugcuccagcac

SEQ ID NO: 1582869 - RNA, 22 nt, Pseudomonas putida KT2440
gccugcuccaugggcaggccca

SEQ ID NO: 1582870 - RNA, 20 nt, Pseudomonas putida KT2440
gccugcuuggccgacuggcg

SEQ ID NO: 1582871 - RNA, 18 nt, Pseudomonas putida KT2440
gccugcgggaaguccgcc

SEQ ID NO: 1582872 - RNA, 13 nt, Pseudomonas putida KT2440
gccugccagguca

SEQ ID NO: 1582873 - RNA, 22 nt, Pseudomonas putida KT2440
gccugcauccacaccagcggcg

SEQ ID NO: 1582874 - RNA, 15 nt, Pseudomonas putida KT2440
gccugcaugucggca

SEQ ID NO: 1582875 - RNA, 20 nt, Pseudomonas putida KT2440
gccugcaugcucaucgcggc

SEQ ID NO: 1582876 - RNA, 16 nt, Pseudomonas putida KT2440
gccuucggugcuggcg

SEQ ID NO: 1582877 - RNA, 14 nt, Pseudomonas putida KT2440
gccuucgucgcugg

SEQ ID NO: 1582878 - RNA, 15 nt, Pseudomonas putida KT2440
gccuucgucgcuggc

SEQ ID NO: 1582879 - RNA, 16 nt, Pseudomonas putida KT2440
gccuucgucgcuggcc

SEQ ID NO: 1582880 - RNA, 22 nt, Pseudomonas putida KT2440
gccuucgcucaggugcaccucc

SEQ ID NO: 1582881 - RNA, 14 nt, Pseudomonas putida KT2440
gccuucgccacugc

SEQ ID NO: 1582882 - RNA, 15 nt, Pseudomonas putida KT2440
gccuucgccacugcc

SEQ ID NO: 1582883 - RNA, 22 nt, Pseudomonas putida KT2440
gccuugcgcucgacgcgcgcag

SEQ ID NO: 1582884 - RNA, 16 nt, Pseudomonas putida KT2440
gccuucucuguguucu

SEQ ID NO: 1582885 - RNA, 13 nt, Pseudomonas putida KT2440
gccuuggccagcg

SEQ ID NO: 1582886 - RNA, 16 nt, Pseudomonas putida KT2440
gccuuggccagcguca

SEQ ID NO: 1582887 - RNA, 18 nt, Pseudomonas putida KT2440
gccuuggccuggcgaguc

SEQ ID NO: 1582888 - RNA, 19 nt, Pseudomonas putida KT2440
gccuugcuuggcagcggcu

SEQ ID NO: 1582889 - RNA, 23 nt, Pseudomonas putida KT2440
gccuugcuuggcagcggcuggcg

SEQ ID NO: 1582890 - RNA, 19 nt, Pseudomonas putida KT2440
gccuguuucucacguucgc

SEQ ID NO: 1582891 - RNA, 21 nt, Pseudomonas putida KT2440
gccuguucgauuucaccggcu

SEQ ID NO: 1582892 - RNA, 19 nt, Pseudomonas putida KT2440
gccugggugguaucugccg

SEQ ID NO: 1582893 - RNA, 19 nt, Pseudomonas putida KT2440
gccuccauacgcuggugca

SEQ ID NO: 1582894 - RNA, 13 nt, Pseudomonas putida KT2440
gccucccaggacu

SEQ ID NO: 1582895 - RNA, 15 nt, Pseudomonas putida KT2440
gccuccaggcguugc

SEQ ID NO: 1582896 - RNA, 15 nt, Pseudomonas putida KT2440
gccuccagcuggcca

SEQ ID NO: 1582897 - RNA, 21 nt, Pseudomonas putida KT2440
gccuccagcuggccaucgacc

SEQ ID NO: 1582898 - RNA, 13 nt, Pseudomonas putida KT2440
gccuccagcagcg

SEQ ID NO: 1582899 - RNA, 16 nt, Pseudomonas putida KT2440
gccuccagcagcgaca

SEQ ID NO: 1582900 - RNA, 16 nt, Pseudomonas putida KT2440
gccuccagcaggggca

SEQ ID NO: 1582901 - RNA, 20 nt, Pseudomonas putida KT2440
gccucggcgaucgccaggug

SEQ ID NO: 1582902 - RNA, 16 nt, Pseudomonas putida KT2440
gccucggucagguacu

SEQ ID NO: 1582903 - RNA, 16 nt, Pseudomonas putida KT2440
gccucgggguagaaca

SEQ ID NO: 1582904 - RNA, 11 nt, Pseudomonas putida KT2440
gccucgucgau

SEQ ID NO: 1582905 - RNA, 20 nt, Pseudomonas putida KT2440
gccucguugaaguagcgggu

SEQ ID NO: 1582906 - RNA, 20 nt, Pseudomonas putida KT2440
gccucuugcaccugucccag

SEQ ID NO: 1582907 - RNA, 16 nt, Pseudomonas putida KT2440
gccucuucuucaaggc

SEQ ID NO: 1582908 - RNA, 13 nt, Pseudomonas putida KT2440
gccucuucgcggg

SEQ ID NO: 1582909 - RNA, 17 nt, Pseudomonas putida KT2440
gccucuucgcgggcaag

SEQ ID NO: 1582910 - RNA, 19 nt, Pseudomonas putida KT2440
gccucuucgcgggcaagcc

SEQ ID NO: 1582911 - RNA, 16 nt, Pseudomonas putida KT2440
gccucuucgcggguaa

SEQ ID NO: 1582912 - RNA, 18 nt, Pseudomonas putida KT2440
gccucuucgcggguaaac

SEQ ID NO: 1582913 - RNA, 19 nt, Pseudomonas putida KT2440
gccucuucgcggguaaacc

SEQ ID NO: 1582914 - RNA, 21 nt, Pseudomonas putida KT2440
gccugagggucgugagccugc

SEQ ID NO: 1582915 - RNA, 22 nt, Pseudomonas putida KT2440
gccugagggucgugagccugca

SEQ ID NO: 1582916 - RNA, 16 nt, Pseudomonas putida KT2440
gccugacgggccucuu

SEQ ID NO: 1582917 - RNA, 20 nt, Pseudomonas putida KT2440
gccugacgggccucuucgcg

SEQ ID NO: 1582918 - RNA, 16 nt, Pseudomonas putida KT2440
gccugaacgcugcgcg

SEQ ID NO: 1582919 - RNA, 18 nt, Pseudomonas putida KT2440
gccugaacagcaucagcc

SEQ ID NO: 1582920 - RNA, 22 nt, Pseudomonas putida KT2440
gccugaucaagguuucagcagc

SEQ ID NO: 1582921 - RNA, 23 nt, Pseudomonas putida KT2440
gccugaucaagguuucagcagcg

SEQ ID NO: 1582922 - RNA, 12 nt, Pseudomonas putida KT2440
gccugaucagac

SEQ ID NO: 1582923 - RNA, 22 nt, Pseudomonas putida KT2440
gccugcacuaagggcaggccug

SEQ ID NO: 1582924 - RNA, 17 nt, Pseudomonas putida KT2440
gccugcacuggccucuu

SEQ ID NO: 1582925 - RNA, 21 nt, Pseudomonas putida KT2440
gccugcacuggccucuucgcg

SEQ ID NO: 1582926 - RNA, 16 nt, Pseudomonas putida KT2440
gccugcacgaucgacc

SEQ ID NO: 1582927 - RNA, 13 nt, Pseudomonas putida KT2440
gccugcacggcaa

SEQ ID NO: 1582928 - RNA, 12 nt, Pseudomonas putida KT2440
gccugcagcccg

SEQ ID NO: 1582929 - RNA, 16 nt, Pseudomonas putida KT2440
gccugcagcccggcaa

SEQ ID NO: 1582930 - RNA, 14 nt, Pseudomonas putida KT2440
gccugcagcacccu

SEQ ID NO: 1582931 - RNA, 16 nt, Pseudomonas putida KT2440
gccugcagcgcggcga

SEQ ID NO: 1582932 - RNA, 14 nt, Pseudomonas putida KT2440
gccugcaggcagca

SEQ ID NO: 1582933 - RNA, 23 nt, Pseudomonas putida KT2440
gccugcagucgaucccgagguca

SEQ ID NO: 1582934 - RNA, 15 nt, Pseudomonas putida KT2440
gccugcaguucgcug

SEQ ID NO: 1582935 - RNA, 19 nt, Pseudomonas putida KT2440
gccugcaguucgcugcgca

SEQ ID NO: 1582936 - RNA, 23 nt, Pseudomonas putida KT2440
gccugcaaucagcucacaggcuc

SEQ ID NO: 1582937 - RNA, 14 nt, Pseudomonas putida KT2440
gccugcaccaguuc

SEQ ID NO: 1582938 - RNA, 17 nt, Pseudomonas putida KT2440
gccugcacccaggcucu

SEQ ID NO: 1582939 - RNA, 19 nt, Pseudomonas putida KT2440
gccugauuggcaucgcugc

SEQ ID NO: 1582940 - RNA, 15 nt, Pseudomonas putida KT2440
gccugcaaacgccgc

SEQ ID NO: 1582941 - RNA, 20 nt, Pseudomonas putida KT2440
gccugauuacccugcgccag

SEQ ID NO: 1582942 - RNA, 21 nt, Pseudomonas putida KT2440
gccugauuacccugcgccagg

SEQ ID NO: 1582943 - RNA, 20 nt, Pseudomonas putida KT2440
gccguaguagccuucuucgg

SEQ ID NO: 1582944 - RNA, 19 nt, Pseudomonas putida KT2440
gccguaguaggagcggguu

SEQ ID NO: 1582945 - RNA, 17 nt, Pseudomonas putida KT2440
gccguaguccuuggugu

SEQ ID NO: 1582946 - RNA, 21 nt, Pseudomonas putida KT2440
gccguaggccagguacaggca

SEQ ID NO: 1582947 - RNA, 20 nt, Pseudomonas putida KT2440
gccguccagguccaggccag

SEQ ID NO: 1582948 - RNA, 22 nt, Pseudomonas putida KT2440
gccguccagguccaggccagcu

SEQ ID NO: 1582949 - RNA, 22 nt, Pseudomonas putida KT2440
gccgucgccucccccuccacug

SEQ ID NO: 1582950 - RNA, 18 nt, Pseudomonas putida KT2440
gccgucgacgacgaucuc

SEQ ID NO: 1582951 - RNA, 16 nt, Pseudomonas putida KT2440
gccgggacagcaccau

SEQ ID NO: 1582952 - RNA, 17 nt, Pseudomonas putida KT2440
gccgggacagcaccaug

SEQ ID NO: 1582953 - RNA, 13 nt, Pseudomonas putida KT2440
gccgguugcgcag

SEQ ID NO: 1582954 - RNA, 19 nt, Pseudomonas putida KT2440
gccgguugcgcagccggcc

SEQ ID NO: 1582955 - RNA, 20 nt, Pseudomonas putida KT2440
gccgguuucucgcagcagca

SEQ ID NO: 1582956 - RNA, 12 nt, Pseudomonas putida KT2440
gccguaccuucg

SEQ ID NO: 1582957 - RNA, 19 nt, Pseudomonas putida KT2440
gccguacggcccaugucga

SEQ ID NO: 1582958 - RNA, 19 nt, Pseudomonas putida KT2440
gccguagccaggcauugcc

SEQ ID NO: 1582959 - RNA, 14 nt, Pseudomonas putida KT2440
gccguacuggcugc

SEQ ID NO: 1582960 - RNA, 18 nt, Pseudomonas putida KT2440
gccuaccgcgucgccaau

SEQ ID NO: 1582961 - RNA, 16 nt, Pseudomonas putida KT2440
gccuaccugaucaccg

SEQ ID NO: 1582962 - RNA, 11 nt, Pseudomonas putida KT2440
gccuaccgccc

SEQ ID NO: 1582963 - RNA, 15 nt, Pseudomonas putida KT2440
gccuacaggcaaccg

SEQ ID NO: 1582964 - RNA, 16 nt, Pseudomonas putida KT2440
gccuaccaacgcagca

SEQ ID NO: 1582965 - RNA, 18 nt, Pseudomonas putida KT2440
gccucaggugcacagggc

SEQ ID NO: 1582966 - RNA, 19 nt, Pseudomonas putida KT2440
gccucaggugcacagggcg

SEQ ID NO: 1582967 - RNA, 16 nt, Pseudomonas putida KT2440
gccucagcuggccggc

SEQ ID NO: 1582968 - RNA, 12 nt, Pseudomonas putida KT2440
gccucagccggc

SEQ ID NO: 1582969 - RNA, 12 nt, Pseudomonas putida KT2440
gccucagcgcca

SEQ ID NO: 1582970 - RNA, 21 nt, Pseudomonas putida KT2440
gccucagcgccaauaccgcgc

SEQ ID NO: 1582971 - RNA, 12 nt, Pseudomonas putida KT2440
gccucagcgccc

SEQ ID NO: 1582972 - RNA, 14 nt, Pseudomonas putida KT2440
gccuacugcuggcg

SEQ ID NO: 1582973 - RNA, 17 nt, Pseudomonas putida KT2440
gccucagccaggcugag

SEQ ID NO: 1582974 - RNA, 20 nt, Pseudomonas putida KT2440
gccucauagcuuucaggcgc

SEQ ID NO: 1582975 - RNA, 22 nt, Pseudomonas putida KT2440
gccucaucaucgaaauacaggc

SEQ ID NO: 1582976 - RNA, 12 nt, Pseudomonas putida KT2440
gccucaggcccc

SEQ ID NO: 1582977 - RNA, 21 nt, Pseudomonas putida KT2440
gccuccaccuggaauucgcug

SEQ ID NO: 1582978 - RNA, 18 nt, Pseudomonas putida KT2440
gccguuuuuuuugcccgu

SEQ ID NO: 1582979 - RNA, 17 nt, Pseudomonas putida KT2440
gccuaaaggcaugcguc

SEQ ID NO: 1582980 - RNA, 19 nt, Pseudomonas putida KT2440
gccuaagguugcuccugca

SEQ ID NO: 1582981 - RNA, 17 nt, Pseudomonas putida KT2440
gccuacaaagcgcucga

SEQ ID NO: 1582982 - RNA, 19 nt, Pseudomonas putida KT2440
gccuacaaagcgcucgaag

SEQ ID NO: 1582983 - RNA, 24 nt, Pseudomonas putida KT2440
gccgugccagguguuugggcuuga

SEQ ID NO: 1582984 - RNA, 16 nt, Pseudomonas putida KT2440
gccgugcccaccagcg

SEQ ID NO: 1582985 - RNA, 15 nt, Pseudomonas putida KT2440
gccguggcaacgcca

SEQ ID NO: 1582986 - RNA, 20 nt, Pseudomonas putida KT2440
gccgugcaggucagcguugc

SEQ ID NO: 1582987 - RNA, 19 nt, Pseudomonas putida KT2440
gccgugcaggcggcgacaa

SEQ ID NO: 1582988 - RNA, 17 nt, Pseudomonas putida KT2440
gccgugcagggcgccga

SEQ ID NO: 1582989 - RNA, 17 nt, Pseudomonas putida KT2440
gccgucgggcacgauca

SEQ ID NO: 1582990 - RNA, 20 nt, Pseudomonas putida KT2440
gccgucgggcacgaucagca

SEQ ID NO: 1582991 - RNA, 18 nt, Pseudomonas putida KT2440
gccguggguugaacaggu

SEQ ID NO: 1582992 - RNA, 23 nt, Pseudomonas putida KT2440
gccguguucgacgaucgacuuca

SEQ ID NO: 1582993 - RNA, 19 nt, Pseudomonas putida KT2440
gccgugguucaucaccagc

SEQ ID NO: 1582994 - RNA, 20 nt, Pseudomonas putida KT2440
gccgugguucaucaccagcc

SEQ ID NO: 1582995 - RNA, 22 nt, Pseudomonas putida KT2440
gccgugguuucgaagucgaaca

SEQ ID NO: 1582996 - RNA, 17 nt, Pseudomonas putida KT2440
gggccuuuuucguuggg

SEQ ID NO: 1582997 - RNA, 16 nt, Pseudomonas putida KT2440
gggccuuuucggucau

SEQ ID NO: 1582998 - RNA, 14 nt, Pseudomonas putida KT2440
gggccuugaccagc

SEQ ID NO: 1582999 - RNA, 19 nt, Pseudomonas putida KT2440
gggccguaguggcgccgga

SEQ ID NO: 1583000 - RNA, 19 nt, Pseudomonas putida KT2440
gggccguuacucccacagc

SEQ ID NO: 1583001 - RNA, 22 nt, Pseudomonas putida KT2440
gggccguuacucccacagcggc

SEQ ID NO: 1583002 - RNA, 21 nt, Pseudomonas putida KT2440
gggccgugcaggcggcgacaa

SEQ ID NO: 1583003 - RNA, 12 nt, Pseudomonas putida KT2440
gggccugugccg

SEQ ID NO: 1583004 - RNA, 22 nt, Pseudomonas putida KT2440
gggcgcauuuuucgaggcaaaa

SEQ ID NO: 1583005 - RNA, 21 nt, Pseudomonas putida KT2440
gggcgaugaucgccuggccgg

SEQ ID NO: 1583006 - RNA, 20 nt, Pseudomonas putida KT2440
gggccagcacaaccacugca

SEQ ID NO: 1583007 - RNA, 14 nt, Pseudomonas putida KT2440
gggccccaccaggc

SEQ ID NO: 1583008 - RNA, 15 nt, Pseudomonas putida KT2440
gggccaucaucugcu

SEQ ID NO: 1583009 - RNA, 20 nt, Pseudomonas putida KT2440
gggcaagcccgcucccacag

SEQ ID NO: 1583010 - RNA, 19 nt, Pseudomonas putida KT2440
gggcaagcccgcuccuaca

SEQ ID NO: 1583011 - RNA, 21 nt, Pseudomonas putida KT2440
gggcaauagccacaauggcgc

SEQ ID NO: 1583012 - RNA, 22 nt, Pseudomonas putida KT2440
gggcaaucgccaaggucccguu

SEQ ID NO: 1583013 - RNA, 17 nt, Pseudomonas putida KT2440
gggcaugcccgcuccca

SEQ ID NO: 1583014 - RNA, 20 nt, Pseudomonas putida KT2440
gggcaugcccgcucccacag

SEQ ID NO: 1583015 - RNA, 16 nt, Pseudomonas putida KT2440
gggccaaguggcugga

SEQ ID NO: 1583016 - RNA, 18 nt, Pseudomonas putida KT2440
gggccaccaggccuuuga

SEQ ID NO: 1583017 - RNA, 15 nt, Pseudomonas putida KT2440
ggcugucacgaugau

SEQ ID NO: 1583018 - RNA, 16 nt, Pseudomonas putida KT2440
ggcucggugugcaccu

SEQ ID NO: 1583019 - RNA, 18 nt, Pseudomonas putida KT2440
ggcucgucacugccguca

SEQ ID NO: 1583020 - RNA, 15 nt, Pseudomonas putida KT2440
ggcugugccgaacca

SEQ ID NO: 1583021 - RNA, 14 nt, Pseudomonas putida KT2440
ggcugucgugcuca

SEQ ID NO: 1583022 - RNA, 19 nt, Pseudomonas putida KT2440
ggcuguuccagcagcgaca

SEQ ID NO: 1583023 - RNA, 17 nt, Pseudomonas putida KT2440
ggcuguuccucgccaug

SEQ ID NO: 1583024 - RNA, 15 nt, Pseudomonas putida KT2440
ggcugucccaugcug

SEQ ID NO: 1583025 - RNA, 15 nt, Pseudomonas putida KT2440
ggcugucgaacaggc

SEQ ID NO: 1583026 - RNA, 22 nt, Pseudomonas putida KT2440
ggcugucgaacaggcugccgcg

SEQ ID NO: 1583027 - RNA, 18 nt, Pseudomonas putida KT2440
ggcuucgaugaaggcugc

SEQ ID NO: 1583028 - RNA, 14 nt, Pseudomonas putida KT2440
ggcuucgagcagcu

SEQ ID NO: 1583029 - RNA, 12 nt, Pseudomonas putida KT2440
ggcuugcccggg

SEQ ID NO: 1583030 - RNA, 19 nt, Pseudomonas putida KT2440
ggcuugcccgcgaagaggc

SEQ ID NO: 1583031 - RNA, 17 nt, Pseudomonas putida KT2440
ggcuugcccgcgaagca

SEQ ID NO: 1583032 - RNA, 16 nt, Pseudomonas putida KT2440
ggcuguucgucggccu

SEQ ID NO: 1583033 - RNA, 17 nt, Pseudomonas putida KT2440
ggcuguucgucggccuu

SEQ ID NO: 1583034 - RNA, 12 nt, Pseudomonas putida KT2440
ggcuuccagucg

SEQ ID NO: 1583035 - RNA, 17 nt, Pseudomonas putida KT2440
ggcuucaugcugcugca

SEQ ID NO: 1583036 - RNA, 13 nt, Pseudomonas putida KT2440
ggcuuccggcgcu

SEQ ID NO: 1583037 - RNA, 14 nt, Pseudomonas putida KT2440
ggcuuccagcgaug

SEQ ID NO: 1583038 - RNA, 20 nt, Pseudomonas putida KT2440
ggcuuccagcgauggcggau

SEQ ID NO: 1583039 - RNA, 13 nt, Pseudomonas putida KT2440
ggcuucaaggucg

SEQ ID NO: 1583040 - RNA, 17 nt, Pseudomonas putida KT2440
gggaccacuaucgccag

SEQ ID NO: 1583041 - RNA, 20 nt, Pseudomonas putida KT2440
gggagacccguuccuacgca

SEQ ID NO: 1583042 - RNA, 12 nt, Pseudomonas putida KT2440
ggcuuggcacgc

SEQ ID NO: 1583043 - RNA, 17 nt, Pseudomonas putida KT2440
ggcuuggcacgcuggcu

SEQ ID NO: 1583044 - RNA, 22 nt, Pseudomonas putida KT2440
gggagucgaaccugcccgggaa

SEQ ID NO: 1583045 - RNA, 18 nt, Pseudomonas putida KT2440
gggauacugcgcacgaau

SEQ ID NO: 1583046 - RNA, 13 nt, Pseudomonas putida KT2440
gggagcgggcaug

SEQ ID NO: 1583047 - RNA, 19 nt, Pseudomonas putida KT2440
gggagcaggcaugcccgcu

SEQ ID NO: 1583048 - RNA, 12 nt, Pseudomonas putida KT2440
gggagcaguggu

SEQ ID NO: 1583049 - RNA, 17 nt, Pseudomonas putida KT2440
gggcaacugcgccuggg

SEQ ID NO: 1583050 - RNA, 15 nt, Pseudomonas putida KT2440
gggucggcgccaggc

SEQ ID NO: 1583051 - RNA, 13 nt, Pseudomonas putida KT2440
gggucgacaccag

SEQ ID NO: 1583052 - RNA, 22 nt, Pseudomonas putida KT2440
gggucgacaccaggaucaggua

SEQ ID NO: 1583053 - RNA, 22 nt, Pseudomonas putida KT2440
gggucugcgcuucaagcaggua

SEQ ID NO: 1583054 - RNA, 13 nt, Pseudomonas putida KT2440
gggucaagcugga

SEQ ID NO: 1583055 - RNA, 21 nt, Pseudomonas putida KT2440
ggguagcgucaacugccaggc

SEQ ID NO: 1583056 - RNA, 14 nt, Pseudomonas putida KT2440
ggguaguccuccaa

SEQ ID NO: 1583057 - RNA, 14 nt, Pseudomonas putida KT2440
ggguauagccaugc

SEQ ID NO: 1583058 - RNA, 21 nt, Pseudomonas putida KT2440
ggguauugucggucagguagc

SEQ ID NO: 1583059 - RNA, 20 nt, Pseudomonas putida KT2440
ggguaugccacgacaccggg

SEQ ID NO: 1583060 - RNA, 19 nt, Pseudomonas putida KT2440
gggucacggucaguaccug

SEQ ID NO: 1583061 - RNA, 19 nt, Pseudomonas putida KT2440
gggucaggaaccgcuccca

SEQ ID NO: 1583062 - RNA, 24 nt, Pseudomonas putida KT2440
ggguccugcgccaggcauugcucg

SEQ ID NO: 1583063 - RNA, 23 nt, Pseudomonas putida KT2440
ggggcugcaaggcagccccugca

SEQ ID NO: 1583064 - RNA, 20 nt, Pseudomonas putida KT2440
ggggcugccuugcagcccuu

SEQ ID NO: 1583065 - RNA, 20 nt, Pseudomonas putida KT2440
ggggcugcuuugcagcccuu

SEQ ID NO: 1583066 - RNA, 18 nt, Pseudomonas putida KT2440
ggggcuagcuacucggca

SEQ ID NO: 1583067 - RNA, 14 nt, Pseudomonas putida KT2440
ggggcuuguguggc

SEQ ID NO: 1583068 - RNA, 23 nt, Pseudomonas putida KT2440
ggggguauuaagggcauggccgc

SEQ ID NO: 1583069 - RNA, 15 nt, Pseudomonas putida KT2440
gggguaaccgccuga

SEQ ID NO: 1583070 - RNA, 13 nt, Pseudomonas putida KT2440
gggggcucagccc

SEQ ID NO: 1583071 - RNA, 15 nt, Pseudomonas putida KT2440
gggggcucagcccgc

SEQ ID NO: 1583072 - RNA, 10 nt, Pseudomonas putida KT2440
ggguacugcu

SEQ ID NO: 1583073 - RNA, 18 nt, Pseudomonas putida KT2440
ggguaccgccguccacca

SEQ ID NO: 1583074 - RNA, 18 nt, Pseudomonas putida KT2440
ggguaaucaguaccaggc

SEQ ID NO: 1583075 - RNA, 15 nt, Pseudomonas putida KT2440
ggguaaucgccaggc

SEQ ID NO: 1583076 - RNA, 20 nt, Pseudomonas putida KT2440
ggguaaugccccagccgaac

SEQ ID NO: 1583077 - RNA, 14 nt, Pseudomonas putida KT2440
ggguaauggcgaag

SEQ ID NO: 1583078 - RNA, 12 nt, Pseudomonas putida KT2440
ggguaagccggc

SEQ ID NO: 1583079 - RNA, 20 nt, Pseudomonas putida KT2440
ggguaaacccauuccuacag

SEQ ID NO: 1583080 - RNA, 20 nt, Pseudomonas putida KT2440
ggguaaacccgcgccuacga

SEQ ID NO: 1583081 - RNA, 19 nt, Pseudomonas putida KT2440
ggguaaacccgcuccuaca

SEQ ID NO: 1583082 - RNA, 20 nt, Pseudomonas putida KT2440
ggguaaacccgcuccuacaa

SEQ ID NO: 1583083 - RNA, 20 nt, Pseudomonas putida KT2440
ggguaaacccgcuccuacac

SEQ ID NO: 1583084 - RNA, 20 nt, Pseudomonas putida KT2440
ggguaaacccgcuccuacga

SEQ ID NO: 1583085 - RNA, 20 nt, Pseudomonas putida KT2440
ggguaaacccgcuccuacgg

SEQ ID NO: 1583086 - RNA, 20 nt, Pseudomonas putida KT2440
ggguaaacccgcuccuacua

SEQ ID NO: 1583087 - RNA, 12 nt, Pseudomonas putida KT2440
ggggugcucugc

SEQ ID NO: 1583088 - RNA, 20 nt, Pseudomonas putida KT2440
ggggugcugcgcacguagcg

SEQ ID NO: 1583089 - RNA, 20 nt, Pseudomonas putida KT2440
ggggucgcccgcaacaccag

SEQ ID NO: 1583090 - RNA, 21 nt, Pseudomonas putida KT2440
ggggucugcuuugcagcccuu

SEQ ID NO: 1583091 - RNA, 13 nt, Pseudomonas putida KT2440
ggggugagcggcu

SEQ ID NO: 1583092 - RNA, 14 nt, Pseudomonas putida KT2440
gggguugacgcugu

SEQ ID NO: 1583093 - RNA, 23 nt, Pseudomonas putida KT2440
gggcuccggcgaauccagcaggc

SEQ ID NO: 1583094 - RNA, 13 nt, Pseudomonas putida KT2440
gggcuaugcgauu

SEQ ID NO: 1583095 - RNA, 23 nt, Pseudomonas putida KT2440
gggcguugaucuguugcugcagg

SEQ ID NO: 1583096 - RNA, 12 nt, Pseudomonas putida KT2440
gggcguucagca

SEQ ID NO: 1583097 - RNA, 16 nt, Pseudomonas putida KT2440
gggcuacacgcgcccu

SEQ ID NO: 1583098 - RNA, 15 nt, Pseudomonas putida KT2440
gggcgugccugcgaa

SEQ ID NO: 1583099 - RNA, 14 nt, Pseudomonas putida KT2440
gggcgugcccgcga

SEQ ID NO: 1583100 - RNA, 17 nt, Pseudomonas putida KT2440
gggcucgcccacacggc

SEQ ID NO: 1583101 - RNA, 20 nt, Pseudomonas putida KT2440
gggcucgcccacucccacag

SEQ ID NO: 1583102 - RNA, 19 nt, Pseudomonas putida KT2440
gggcugcccggugccgcgc

SEQ ID NO: 1583103 - RNA, 21 nt, Pseudomonas putida KT2440
gggcugcccggugccgcgcca

SEQ ID NO: 1583104 - RNA, 19 nt, Pseudomonas putida KT2440
gggcugccuugcagcccuu

SEQ ID NO: 1583105 - RNA, 20 nt, Pseudomonas putida KT2440
gggcugcugcgcagcccugu

SEQ ID NO: 1583106 - RNA, 20 nt, Pseudomonas putida KT2440
gggcuugauccgcgcuaccu

SEQ ID NO: 1583107 - RNA, 13 nt, Pseudomonas putida KT2440
gggcuucgagcag

SEQ ID NO: 1583108 - RNA, 18 nt, Pseudomonas putida KT2440
gggcuguauagcccugcc

SEQ ID NO: 1583109 - RNA, 20 nt, Pseudomonas putida KT2440
ggggauggcaccggcucugc

SEQ ID NO: 1583110 - RNA, 21 nt, Pseudomonas putida KT2440
gggcuuuaucgaugaucucga

SEQ ID NO: 1583111 - RNA, 18 nt, Pseudomonas putida KT2440
gggcuuggugaugggcgu

SEQ ID NO: 1583112 - RNA, 14 nt, Pseudomonas putida KT2440
gggcuuugggagca

SEQ ID NO: 1583113 - RNA, 18 nt, Pseudomonas putida KT2440
gggcuuuuuccagcgcca

SEQ ID NO: 1583114 - RNA, 16 nt, Pseudomonas putida KT2440
ggggcgcuuugcaccc

SEQ ID NO: 1583115 - RNA, 16 nt, Pseudomonas putida KT2440
ggggcgcaaugcgccc

SEQ ID NO: 1583116 - RNA, 17 nt, Pseudomonas putida KT2440
ggggcgacgcaucugca

SEQ ID NO: 1583117 - RNA, 16 nt, Pseudomonas putida KT2440
ggggccgcgcagccuu

SEQ ID NO: 1583118 - RNA, 18 nt, Pseudomonas putida KT2440
ggggccgcuuugcgucgc

SEQ ID NO: 1583119 - RNA, 17 nt, Pseudomonas putida KT2440
ggggcagaugcuccaac

SEQ ID NO: 1583120 - RNA, 17 nt, Pseudomonas putida KT2440
ggcgucgaacacggcgu

SEQ ID NO: 1583121 - RNA, 20 nt, Pseudomonas putida KT2440
ggcgucgacgaugaugcggu

SEQ ID NO: 1583122 - RNA, 21 nt, Pseudomonas putida KT2440
ggcgucgacgaugaugcgguc

SEQ ID NO: 1583123 - RNA, 19 nt, Pseudomonas putida KT2440
ggcgucccggccagcgacc

SEQ ID NO: 1583124 - RNA, 23 nt, Pseudomonas putida KT2440
ggcgucacccgcgccaccagccc

SEQ ID NO: 1583125 - RNA, 23 nt, Pseudomonas putida KT2440
ggcgucaaccgaacccgcuggcg

SEQ ID NO: 1583126 - RNA, 18 nt, Pseudomonas putida KT2440
ggcgucaguucgacgcgg

SEQ ID NO: 1583127 - RNA, 20 nt, Pseudomonas putida KT2440
ggcgucaguucgacgcggac

SEQ ID NO: 1583128 - RNA, 13 nt, Pseudomonas putida KT2440
ggcgucaucaccc

SEQ ID NO: 1583129 - RNA, 21 nt, Pseudomonas putida KT2440
ggcgucauccugcgcggccac

SEQ ID NO: 1583130 - RNA, 18 nt, Pseudomonas putida KT2440
ggcgggcaaacuggcgcc

SEQ ID NO: 1583131 - RNA, 15 nt, Pseudomonas putida KT2440
ggcguacaucagccu

SEQ ID NO: 1583132 - RNA, 20 nt, Pseudomonas putida KT2440
ggcguacaucagccucgguc

SEQ ID NO: 1583133 - RNA, 17 nt, Pseudomonas putida KT2440
ggcguacuggacguggu

SEQ ID NO: 1583134 - RNA, 20 nt, Pseudomonas putida KT2440
ggcguaguaauguucggagu

SEQ ID NO: 1583135 - RNA, 21 nt, Pseudomonas putida KT2440
ggcgguugucgaccuggcucu

SEQ ID NO: 1583136 - RNA, 16 nt, Pseudomonas putida KT2440
ggcgguugucgucgac

SEQ ID NO: 1583137 - RNA, 17 nt, Pseudomonas putida KT2440
ggcguaacucagcaacg

SEQ ID NO: 1583138 - RNA, 18 nt, Pseudomonas putida KT2440
ggcucgacgcggacccgg

SEQ ID NO: 1583139 - RNA, 16 nt, Pseudomonas putida KT2440
ggcucgaccaagccug

SEQ ID NO: 1583140 - RNA, 21 nt, Pseudomonas putida KT2440
ggcuccuucucgaacagcugg

SEQ ID NO: 1583141 - RNA, 18 nt, Pseudomonas putida KT2440
ggcucgaaucaagccugc

SEQ ID NO: 1583142 - RNA, 21 nt, Pseudomonas putida KT2440
ggcucgaaucaagccugcgca

SEQ ID NO: 1583143 - RNA, 15 nt, Pseudomonas putida KT2440
ggcucgcgauccauc

SEQ ID NO: 1583144 - RNA, 14 nt, Pseudomonas putida KT2440
ggcucgcugcccca

SEQ ID NO: 1583145 - RNA, 14 nt, Pseudomonas putida KT2440
ggcuaccgcugcgc

SEQ ID NO: 1583146 - RNA, 11 nt, Pseudomonas putida KT2440
ggcucagcccg

SEQ ID NO: 1583147 - RNA, 15 nt, Pseudomonas putida KT2440
ggcucagccgccaca

SEQ ID NO: 1583148 - RNA, 15 nt, Pseudomonas putida KT2440
ggcucagcucggcau

SEQ ID NO: 1583149 - RNA, 17 nt, Pseudomonas putida KT2440
ggcucagggcagcaacg

SEQ ID NO: 1583150 - RNA, 15 nt, Pseudomonas putida KT2440
ggcucagcucgucga

SEQ ID NO: 1583151 - RNA, 16 nt, Pseudomonas putida KT2440
ggcucaucaggcgauu

SEQ ID NO: 1583152 - RNA, 13 nt, Pseudomonas putida KT2440
ggcuccaaagcca

SEQ ID NO: 1583153 - RNA, 19 nt, Pseudomonas putida KT2440
ggcuccaaagccagcgcua

SEQ ID NO: 1583154 - RNA, 22 nt, Pseudomonas putida KT2440
ggcuccaccgaaaucagcaacg

SEQ ID NO: 1583155 - RNA, 22 nt, Pseudomonas putida KT2440
ggcuccacccaacgaacggaac

SEQ ID NO: 1583156 - RNA, 20 nt, Pseudomonas putida KT2440
ggcuccaccugcuccagcac

SEQ ID NO: 1583157 - RNA, 17 nt, Pseudomonas putida KT2440
ggcucaucugccggcga

SEQ ID NO: 1583158 - RNA, 13 nt, Pseudomonas putida KT2440
ggcuccaggcaca

SEQ ID NO: 1583159 - RNA, 14 nt, Pseudomonas putida KT2440
ggcgugaucacccg

SEQ ID NO: 1583160 - RNA, 17 nt, Pseudomonas putida KT2440
ggcgugagcaucggcgu

SEQ ID NO: 1583161 - RNA, 16 nt, Pseudomonas putida KT2440
ggcgugccaggcuugg

SEQ ID NO: 1583162 - RNA, 16 nt, Pseudomonas putida KT2440
ggcguucaucgaaggc

SEQ ID NO: 1583163 - RNA, 16 nt, Pseudomonas putida KT2440
ggcuacagaucagcca

SEQ ID NO: 1583164 - RNA, 20 nt, Pseudomonas putida KT2440
ggcuaccccgaugcgcugau

SEQ ID NO: 1583165 - RNA, 23 nt, Pseudomonas putida KT2440
ggcuaccccgaugcgcugaucgu

SEQ ID NO: 1583166 - RNA, 21 nt, Pseudomonas putida KT2440
ggcguuggccaaaccguccag

SEQ ID NO: 1583167 - RNA, 14 nt, Pseudomonas putida KT2440
ggcguuggcaguga

SEQ ID NO: 1583168 - RNA, 15 nt, Pseudomonas putida KT2440
ggcgcgaucaucgaa

SEQ ID NO: 1583169 - RNA, 22 nt, Pseudomonas putida KT2440
ggcgcgaucaucgaagccagua

SEQ ID NO: 1583170 - RNA, 22 nt, Pseudomonas putida KT2440
ggcgcgcaacagcaaggcaucg

SEQ ID NO: 1583171 - RNA, 12 nt, Pseudomonas putida KT2440
ggcgcgcugcug

SEQ ID NO: 1583172 - RNA, 22 nt, Pseudomonas putida KT2440
ggcgcgcccuccuuggguaucg

SEQ ID NO: 1583173 - RNA, 14 nt, Pseudomonas putida KT2440
ggcgcgcccgcgaa

SEQ ID NO: 1583174 - RNA, 16 nt, Pseudomonas putida KT2440
ggcgcgcccgcuccca

SEQ ID NO: 1583175 - RNA, 21 nt, Pseudomonas putida KT2440
ggcgcgcccgcucccacaggu

SEQ ID NO: 1583176 - RNA, 15 nt, Pseudomonas putida KT2440
ggcgcguuucgaucu

SEQ ID NO: 1583177 - RNA, 17 nt, Pseudomonas putida KT2440
ggcgcugaucagcuggu

SEQ ID NO: 1583178 - RNA, 13 nt, Pseudomonas putida KT2440
ggcgcugggcuua

SEQ ID NO: 1583179 - RNA, 18 nt, Pseudomonas putida KT2440
ggcgcugguaggcgagua

SEQ ID NO: 1583180 - RNA, 21 nt, Pseudomonas putida KT2440
ggcgcuguccagcgcaucaac

SEQ ID NO: 1583181 - RNA, 19 nt, Pseudomonas putida KT2440
ggcgcuuuucuucgcugcu

SEQ ID NO: 1583182 - RNA, 20 nt, Pseudomonas putida KT2440
ggcgcuuuucuucgcugcug

SEQ ID NO: 1583183 - RNA, 23 nt, Pseudomonas putida KT2440
ggcgcuuuucuucgcugcugugc

SEQ ID NO: 1583184 - RNA, 21 nt, Pseudomonas putida KT2440
ggcggccaaggcguggcuugc

SEQ ID NO: 1583185 - RNA, 18 nt, Pseudomonas putida KT2440
ggcggccagcacgaacag

SEQ ID NO: 1583186 - RNA, 19 nt, Pseudomonas putida KT2440
ggcggccagcacgaacagc

SEQ ID NO: 1583187 - RNA, 14 nt, Pseudomonas putida KT2440
ggcggcccggcaca

SEQ ID NO: 1583188 - RNA, 15 nt, Pseudomonas putida KT2440
ggcggcauccaggcg

SEQ ID NO: 1583189 - RNA, 16 nt, Pseudomonas putida KT2440
ggcggcaauguugaag

SEQ ID NO: 1583190 - RNA, 15 nt, Pseudomonas putida KT2440
ggcggaacuggcccu

SEQ ID NO: 1583191 - RNA, 17 nt, Pseudomonas putida KT2440
ggcggcgaacaucugcu

SEQ ID NO: 1583192 - RNA, 19 nt, Pseudomonas putida KT2440
ggcggcucgcugaacacgc

SEQ ID NO: 1583193 - RNA, 18 nt, Pseudomonas putida KT2440
ggccgacucuucaccagc

SEQ ID NO: 1583194 - RNA, 13 nt, Pseudomonas putida KT2440
ggccgacauggcg

SEQ ID NO: 1583195 - RNA, 14 nt, Pseudomonas putida KT2440
ggccgacauggcgc

SEQ ID NO: 1583196 - RNA, 21 nt, Pseudomonas putida KT2440
ggccgacacgggguguugcuu

SEQ ID NO: 1583197 - RNA, 21 nt, Pseudomonas putida KT2440
ggcccuauggggugagcggcu

SEQ ID NO: 1583198 - RNA, 14 nt, Pseudomonas putida KT2440
ggcccucaagggcg

SEQ ID NO: 1583199 - RNA, 19 nt, Pseudomonas putida KT2440
ggcccucaagggcgcugau

SEQ ID NO: 1583200 - RNA, 15 nt, Pseudomonas putida KT2440
ggcccgucaggcaaa

SEQ ID NO: 1583201 - RNA, 14 nt, Pseudomonas putida KT2440
ggccccagggggca

SEQ ID NO: 1583202 - RNA, 19 nt, Pseudomonas putida KT2440
ggcccgaagguguuugacc

SEQ ID NO: 1583203 - RNA, 22 nt, Pseudomonas putida KT2440
ggccccuucgauucaggccuuu

SEQ ID NO: 1583204 - RNA, 13 nt, Pseudomonas putida KT2440
ggcccgcagcgcu

SEQ ID NO: 1583205 - RNA, 16 nt, Pseudomonas putida KT2440
ggccccccagccagca

SEQ ID NO: 1583206 - RNA, 21 nt, Pseudomonas putida KT2440
ggccccaggccauccagcggc

SEQ ID NO: 1583207 - RNA, 17 nt, Pseudomonas putida KT2440
ggcccagcccagcccgg

SEQ ID NO: 1583208 - RNA, 20 nt, Pseudomonas putida KT2440
ggcccagccaggcacuggcc

SEQ ID NO: 1583209 - RNA, 22 nt, Pseudomonas putida KT2440
ggcccagccaucgagcaccggc

SEQ ID NO: 1583210 - RNA, 20 nt, Pseudomonas putida KT2440
ggcccggcccuuucgcgggu

SEQ ID NO: 1583211 - RNA, 14 nt, Pseudomonas putida KT2440
ggcccgccggcaac

SEQ ID NO: 1583212 - RNA, 19 nt, Pseudomonas putida KT2440
ggcccgccgcgcggcuugc

SEQ ID NO: 1583213 - RNA, 16 nt, Pseudomonas putida KT2440
ggcccgcccagcuggc

SEQ ID NO: 1583214 - RNA, 17 nt, Pseudomonas putida KT2440
ggcccgcccagcuggcu

SEQ ID NO: 1583215 - RNA, 23 nt, Pseudomonas putida KT2440
ggcccgccccuuuagcaggcaag

SEQ ID NO: 1583216 - RNA, 21 nt, Pseudomonas putida KT2440
ggcccgccauucuucuccagg

SEQ ID NO: 1583217 - RNA, 14 nt, Pseudomonas putida KT2440
ggccagggcaaaca

SEQ ID NO: 1583218 - RNA, 22 nt, Pseudomonas putida KT2440
ggccagguagacgaucgagccg

SEQ ID NO: 1583219 - RNA, 17 nt, Pseudomonas putida KT2440
ggccagguacaggcaaa

SEQ ID NO: 1583220 - RNA, 15 nt, Pseudomonas putida KT2440
ggccaggucgaccga

SEQ ID NO: 1583221 - RNA, 13 nt, Pseudomonas putida KT2440
ggccagccguugu

SEQ ID NO: 1583222 - RNA, 17 nt, Pseudomonas putida KT2440
ggccagcgcacagcugc

SEQ ID NO: 1583223 - RNA, 17 nt, Pseudomonas putida KT2440
ggccauccagucgauca

SEQ ID NO: 1583224 - RNA, 18 nt, Pseudomonas putida KT2440
ggccaucacuucacgggu

SEQ ID NO: 1583225 - RNA, 16 nt, Pseudomonas putida KT2440
ggccaucagcaagccg

SEQ ID NO: 1583226 - RNA, 18 nt, Pseudomonas putida KT2440
ggccaucaauaccggcau

SEQ ID NO: 1583227 - RNA, 19 nt, Pseudomonas putida KT2440
ggccauaguugaccagcac

SEQ ID NO: 1583228 - RNA, 14 nt, Pseudomonas putida KT2440
ggccauugccgcgc

SEQ ID NO: 1583229 - RNA, 17 nt, Pseudomonas putida KT2440
ggccauucgcgggcaug

SEQ ID NO: 1583230 - RNA, 22 nt, Pseudomonas putida KT2440
ggccauggugcacgccagccag

SEQ ID NO: 1583231 - RNA, 23 nt, Pseudomonas putida KT2440
ggcccaaggugcacaccuugggc

SEQ ID NO: 1583232 - RNA, 14 nt, Pseudomonas putida KT2440
ggcccaacagcgcg

SEQ ID NO: 1583233 - RNA, 15 nt, Pseudomonas putida KT2440
ggcccaacagcgcgg

SEQ ID NO: 1583234 - RNA, 13 nt, Pseudomonas putida KT2440
ggcccagcaacag

SEQ ID NO: 1583235 - RNA, 15 nt, Pseudomonas putida KT2440
ggcccacugcacggc

SEQ ID NO: 1583236 - RNA, 20 nt, Pseudomonas putida KT2440
ggcccacgcucuguaucgaa

SEQ ID NO: 1583237 - RNA, 23 nt, Pseudomonas putida KT2440
ggcccacgcucuguaucgaacag

SEQ ID NO: 1583238 - RNA, 16 nt, Pseudomonas putida KT2440
ggcccacccggcugaa

SEQ ID NO: 1583239 - RNA, 21 nt, Pseudomonas putida KT2440
ggccaucgacccgcugcccgu

SEQ ID NO: 1583240 - RNA, 15 nt, Pseudomonas putida KT2440
ggccauccugcugua

SEQ ID NO: 1583241 - RNA, 19 nt, Pseudomonas putida KT2440
ggccauccugcuguagcgc

SEQ ID NO: 1583242 - RNA, 19 nt, Pseudomonas putida KT2440
ggccaugcccuugccuucg

SEQ ID NO: 1583243 - RNA, 15 nt, Pseudomonas putida KT2440
ggccagaccuugcgc

SEQ ID NO: 1583244 - RNA, 12 nt, Pseudomonas putida KT2440
ggccacugguac

SEQ ID NO: 1583245 - RNA, 17 nt, Pseudomonas putida KT2440
ggccacuguugcagcgc

SEQ ID NO: 1583246 - RNA, 14 nt, Pseudomonas putida KT2440
ggccacuucgcgag

SEQ ID NO: 1583247 - RNA, 21 nt, Pseudomonas putida KT2440
ggccacuucgcgagcgagcgg

SEQ ID NO: 1583248 - RNA, 17 nt, Pseudomonas putida KT2440
ggccagccggcgcugga

SEQ ID NO: 1583249 - RNA, 21 nt, Pseudomonas putida KT2440
ggccagccgcuguucugcagu

SEQ ID NO: 1583250 - RNA, 21 nt, Pseudomonas putida KT2440
ggccagccggcagcaaggcau

SEQ ID NO: 1583251 - RNA, 16 nt, Pseudomonas putida KT2440
ggccagccgcgccagg

SEQ ID NO: 1583252 - RNA, 22 nt, Pseudomonas putida KT2440
ggccagccgcgccaggucggcg

SEQ ID NO: 1583253 - RNA, 21 nt, Pseudomonas putida KT2440
ggccagcaggccauacagggc

SEQ ID NO: 1583254 - RNA, 14 nt, Pseudomonas putida KT2440
ggccagcagggccg

SEQ ID NO: 1583255 - RNA, 13 nt, Pseudomonas putida KT2440
ggccaccuugugc

SEQ ID NO: 1583256 - RNA, 16 nt, Pseudomonas putida KT2440
ggccacgaaggccggu

SEQ ID NO: 1583257 - RNA, 23 nt, Pseudomonas putida KT2440
ggccacgaauuucaaggcgccga

SEQ ID NO: 1583258 - RNA, 15 nt, Pseudomonas putida KT2440
ggccaccaggccuuu

SEQ ID NO: 1583259 - RNA, 14 nt, Pseudomonas putida KT2440
ggccaccacgguac

SEQ ID NO: 1583260 - RNA, 20 nt, Pseudomonas putida KT2440
ggccaccagcauggcgucgg

SEQ ID NO: 1583261 - RNA, 22 nt, Pseudomonas putida KT2440
ggccaccaccgcguacagcugc

SEQ ID NO: 1583262 - RNA, 15 nt, Pseudomonas putida KT2440
ggcaugguggaaguc

SEQ ID NO: 1583263 - RNA, 16 nt, Pseudomonas putida KT2440
ggcauguucaucaccg

SEQ ID NO: 1583264 - RNA, 19 nt, Pseudomonas putida KT2440
ggcauaccgcaacaccugc

SEQ ID NO: 1583265 - RNA, 13 nt, Pseudomonas putida KT2440
ggcauacagcucc

SEQ ID NO: 1583266 - RNA, 13 nt, Pseudomonas putida KT2440
ggccacagcgcca

SEQ ID NO: 1583267 - RNA, 19 nt, Pseudomonas putida KT2440
ggccaagccaccgccacca

SEQ ID NO: 1583268 - RNA, 13 nt, Pseudomonas putida KT2440
ggccaagccgcug

SEQ ID NO: 1583269 - RNA, 16 nt, Pseudomonas putida KT2440
ggccaagccgcugcca

SEQ ID NO: 1583270 - RNA, 18 nt, Pseudomonas putida KT2440
ggccaaggucuccagcac

SEQ ID NO: 1583271 - RNA, 20 nt, Pseudomonas putida KT2440
ggccaagguugccaccagca

SEQ ID NO: 1583272 - RNA, 16 nt, Pseudomonas putida KT2440
ggccaacgauuggcag

SEQ ID NO: 1583273 - RNA, 16 nt, Pseudomonas putida KT2440
ggcauugagguugacg

SEQ ID NO: 1583274 - RNA, 19 nt, Pseudomonas putida KT2440
ggcagcuacgagacggugg

SEQ ID NO: 1583275 - RNA, 12 nt, Pseudomonas putida KT2440
ggcagcucaccg

SEQ ID NO: 1583276 - RNA, 15 nt, Pseudomonas putida KT2440
ggcagcucgccgugg

SEQ ID NO: 1583277 - RNA, 18 nt, Pseudomonas putida KT2440
ggcagcugcagugcuggg

SEQ ID NO: 1583278 - RNA, 12 nt, Pseudomonas putida KT2440
ggcagcgaugcc

SEQ ID NO: 1583279 - RNA, 14 nt, Pseudomonas putida KT2440
ggcagcgauggccg

SEQ ID NO: 1583280 - RNA, 22 nt, Pseudomonas putida KT2440
ggcagccgucggcgucaacggu

SEQ ID NO: 1583281 - RNA, 13 nt, Pseudomonas putida KT2440
ggcagugccugga

SEQ ID NO: 1583282 - RNA, 14 nt, Pseudomonas putida KT2440
ggcagguucgacca

SEQ ID NO: 1583283 - RNA, 16 nt, Pseudomonas putida KT2440
ggcaguuucaggcgcu

SEQ ID NO: 1583284 - RNA, 19 nt, Pseudomonas putida KT2440
ggcaguucgagcgccugau

SEQ ID NO: 1583285 - RNA, 17 nt, Pseudomonas putida KT2440
ggcaguguacauggccg

SEQ ID NO: 1583286 - RNA, 20 nt, Pseudomonas putida KT2440
ggcaguguacauggccgcca

SEQ ID NO: 1583287 - RNA, 21 nt, Pseudomonas putida KT2440
ggcaggucgacgucggcgacg

SEQ ID NO: 1583288 - RNA, 22 nt, Pseudomonas putida KT2440
ggcaggccccugcaacagggcg

SEQ ID NO: 1583289 - RNA, 14 nt, Pseudomonas putida KT2440
ggcaggcccaggua

SEQ ID NO: 1583290 - RNA, 12 nt, Pseudomonas putida KT2440
ggcagcaggcca

SEQ ID NO: 1583291 - RNA, 16 nt, Pseudomonas putida KT2440
ggcagcauauggcgcu

SEQ ID NO: 1583292 - RNA, 19 nt, Pseudomonas putida KT2440
ggcagcaucaccacgcccu

SEQ ID NO: 1583293 - RNA, 21 nt, Pseudomonas putida KT2440
ggcagcagcaaugccgaacag

SEQ ID NO: 1583294 - RNA, 14 nt, Pseudomonas putida KT2440
ggcagcagcagccc

SEQ ID NO: 1583295 - RNA, 22 nt, Pseudomonas putida KT2440
ggcagccaugcugucgaugucu

SEQ ID NO: 1583296 - RNA, 22 nt, Pseudomonas putida KT2440
ggcagccccaaccuuccagcaa

SEQ ID NO: 1583297 - RNA, 23 nt, Pseudomonas putida KT2440
ggcagccgcguccuugaucaggg

SEQ ID NO: 1583298 - RNA, 16 nt, Pseudomonas putida KT2440
ggcagcccuucgcggg

SEQ ID NO: 1583299 - RNA, 19 nt, Pseudomonas putida KT2440
ggcagccgaagcugucgaa

SEQ ID NO: 1583300 - RNA, 14 nt, Pseudomonas putida KT2440
ggcagccgcccuug

SEQ ID NO: 1583301 - RNA, 15 nt, Pseudomonas putida KT2440
ggcagaucaggcaau

SEQ ID NO: 1583302 - RNA, 19 nt, Pseudomonas putida KT2440
ggcagcaacacgacgaugg

SEQ ID NO: 1583303 - RNA, 21 nt, Pseudomonas putida KT2440
ggcagcaacacgacgauggcc

SEQ ID NO: 1583304 - RNA, 22 nt, Pseudomonas putida KT2440
ggcagcaacggugaacggcggg

SEQ ID NO: 1583305 - RNA, 20 nt, Pseudomonas putida KT2440
ggcagcaaggcauccagcgg

SEQ ID NO: 1583306 - RNA, 14 nt, Pseudomonas putida KT2440
ggcagcacccgcuu

SEQ ID NO: 1583307 - RNA, 18 nt, Pseudomonas putida KT2440
ggcagcaaucggcagcgc

SEQ ID NO: 1583308 - RNA, 18 nt, Pseudomonas putida KT2440
ggcagcacgaucagcgcg

SEQ ID NO: 1583309 - RNA, 13 nt, Pseudomonas putida KT2440
ggcagcaccgcug

SEQ ID NO: 1583310 - RNA, 19 nt, Pseudomonas putida KT2440
ggcagauacaaccccagau

SEQ ID NO: 1583311 - RNA, 17 nt, Pseudomonas putida KT2440
ggccuccauacgcuggu

SEQ ID NO: 1583312 - RNA, 15 nt, Pseudomonas putida KT2440
ggccuauucgcgggu

SEQ ID NO: 1583313 - RNA, 22 nt, Pseudomonas putida KT2440
ggccuagcaaggccuccaggua

SEQ ID NO: 1583314 - RNA, 15 nt, Pseudomonas putida KT2440
ggccguuggccagca

SEQ ID NO: 1583315 - RNA, 17 nt, Pseudomonas putida KT2440
ggccguugaaggcgaau

SEQ ID NO: 1583316 - RNA, 20 nt, Pseudomonas putida KT2440
ggccguucccacaaaguacg

SEQ ID NO: 1583317 - RNA, 19 nt, Pseudomonas putida KT2440
ggccguggguccugcgcca

SEQ ID NO: 1583318 - RNA, 23 nt, Pseudomonas putida KT2440
ggccguggugauguucucaucga

SEQ ID NO: 1583319 - RNA, 16 nt, Pseudomonas putida KT2440
ggccgugaacacgugg

SEQ ID NO: 1583320 - RNA, 17 nt, Pseudomonas putida KT2440
ggccgguaccggauagc

SEQ ID NO: 1583321 - RNA, 21 nt, Pseudomonas putida KT2440
ggccggguuguggcuggcguc

SEQ ID NO: 1583322 - RNA, 16 nt, Pseudomonas putida KT2440
ggccuggaugcguugc

SEQ ID NO: 1583323 - RNA, 16 nt, Pseudomonas putida KT2440
ggccugggucagcugg

SEQ ID NO: 1583324 - RNA, 23 nt, Pseudomonas putida KT2440
ggccuggggcaggcccggcaggu

SEQ ID NO: 1583325 - RNA, 15 nt, Pseudomonas putida KT2440
ggccuucccgccugg

SEQ ID NO: 1583326 - RNA, 17 nt, Pseudomonas putida KT2440
ggccuuccuugcccagc

SEQ ID NO: 1583327 - RNA, 18 nt, Pseudomonas putida KT2440
ggccuucgaacagcgaag

SEQ ID NO: 1583328 - RNA, 19 nt, Pseudomonas putida KT2440
ggccuucaaccucacuggc

SEQ ID NO: 1583329 - RNA, 13 nt, Pseudomonas putida KT2440
ggccuucagcgcg

SEQ ID NO: 1583330 - RNA, 16 nt, Pseudomonas putida KT2440
ggccuucagcgcggca

SEQ ID NO: 1583331 - RNA, 13 nt, Pseudomonas putida KT2440
ggccuuggccagc

SEQ ID NO: 1583332 - RNA, 17 nt, Pseudomonas putida KT2440
ggccuugaucaggcccu

SEQ ID NO: 1583333 - RNA, 14 nt, Pseudomonas putida KT2440
ggccuugaccagcu

SEQ ID NO: 1583334 - RNA, 20 nt, Pseudomonas putida KT2440
ggccuugaccucgaccaggc

SEQ ID NO: 1583335 - RNA, 23 nt, Pseudomonas putida KT2440
ggccuucucuuccgccagccaac

SEQ ID NO: 1583336 - RNA, 22 nt, Pseudomonas putida KT2440
ggccugcaagccggcgaacagc

SEQ ID NO: 1583337 - RNA, 21 nt, Pseudomonas putida KT2440
ggccuccuugauguacuccug

SEQ ID NO: 1583338 - RNA, 15 nt, Pseudomonas putida KT2440
ggccuccucgcgggc

SEQ ID NO: 1583339 - RNA, 21 nt, Pseudomonas putida KT2440
ggccucgaggaaugacucgcg

SEQ ID NO: 1583340 - RNA, 15 nt, Pseudomonas putida KT2440
ggccucuucgcgggc

SEQ ID NO: 1583341 - RNA, 15 nt, Pseudomonas putida KT2440
ggccucuucgcgggu

SEQ ID NO: 1583342 - RNA, 16 nt, Pseudomonas putida KT2440
ggccucuucucgggca

SEQ ID NO: 1583343 - RNA, 22 nt, Pseudomonas putida KT2440
ggccugaaacccauccacggcg

SEQ ID NO: 1583344 - RNA, 14 nt, Pseudomonas putida KT2440
ggccugaugccuca

SEQ ID NO: 1583345 - RNA, 14 nt, Pseudomonas putida KT2440
ggccugauccucac

SEQ ID NO: 1583346 - RNA, 15 nt, Pseudomonas putida KT2440
ggccggcccuuucgc

SEQ ID NO: 1583347 - RNA, 20 nt, Pseudomonas putida KT2440
ggccggcccuuucgcgggua

SEQ ID NO: 1583348 - RNA, 23 nt, Pseudomonas putida KT2440
ggccggauagagcccggcgcagc

SEQ ID NO: 1583349 - RNA, 20 nt, Pseudomonas putida KT2440
ggccggcccauucgcgggua

SEQ ID NO: 1583350 - RNA, 21 nt, Pseudomonas putida KT2440
ggccggagaacaugaaaguga

SEQ ID NO: 1583351 - RNA, 16 nt, Pseudomonas putida KT2440
ggccgggucgaaggca

SEQ ID NO: 1583352 - RNA, 17 nt, Pseudomonas putida KT2440
ggccggcugugcagaua

SEQ ID NO: 1583353 - RNA, 13 nt, Pseudomonas putida KT2440
ggccggcucgaac

SEQ ID NO: 1583354 - RNA, 16 nt, Pseudomonas putida KT2440
ggccgcgcaggcggcu

SEQ ID NO: 1583355 - RNA, 17 nt, Pseudomonas putida KT2440
ggccgcgcaggcggcug

SEQ ID NO: 1583356 - RNA, 12 nt, Pseudomonas putida KT2440
ggccgaucacga

SEQ ID NO: 1583357 - RNA, 17 nt, Pseudomonas putida KT2440
ggccgaucacucggcag

SEQ ID NO: 1583358 - RNA, 13 nt, Pseudomonas putida KT2440
ggccgagucggug

SEQ ID NO: 1583359 - RNA, 13 nt, Pseudomonas putida KT2440
ggccgaucaccag

SEQ ID NO: 1583360 - RNA, 18 nt, Pseudomonas putida KT2440
ggccgaucaccagcaccc

SEQ ID NO: 1583361 - RNA, 18 nt, Pseudomonas putida KT2440
ggccgcggcugaacacgc

SEQ ID NO: 1583362 - RNA, 20 nt, Pseudomonas putida KT2440
ggcgaugccgcgcgcccgcu

SEQ ID NO: 1583363 - RNA, 17 nt, Pseudomonas putida KT2440
ggcgaugaucgcggcgu

SEQ ID NO: 1583364 - RNA, 14 nt, Pseudomonas putida KT2440
ggcgaugaucgccu

SEQ ID NO: 1583365 - RNA, 23 nt, Pseudomonas putida KT2440
ggcgaugaucgagccgaucagga

SEQ ID NO: 1583366 - RNA, 21 nt, Pseudomonas putida KT2440
ggcgaucgccagguggaagcg

SEQ ID NO: 1583367 - RNA, 12 nt, Pseudomonas putida KT2440
ggcgaucgccag

SEQ ID NO: 1583368 - RNA, 22 nt, Pseudomonas putida KT2440
ggcgaugaacacgccgucgacc

SEQ ID NO: 1583369 - RNA, 16 nt, Pseudomonas putida KT2440
ggcgauacuuggccau

SEQ ID NO: 1583370 - RNA, 12 nt, Pseudomonas putida KT2440
ggcgagguagcu

SEQ ID NO: 1583371 - RNA, 13 nt, Pseudomonas putida KT2440
ggcgaguagauca

SEQ ID NO: 1583372 - RNA, 20 nt, Pseudomonas putida KT2440
ggcgaguagaucaucagcgc

SEQ ID NO: 1583373 - RNA, 23 nt, Pseudomonas putida KT2440
ggcgagugcauuacgucagcuac

SEQ ID NO: 1583374 - RNA, 22 nt, Pseudomonas putida KT2440
ggcgaucaggcaggccagcacg

SEQ ID NO: 1583375 - RNA, 13 nt, Pseudomonas putida KT2440
ggcgaucagcgcg

SEQ ID NO: 1583376 - RNA, 18 nt, Pseudomonas putida KT2440
ggcgauauggcuccacca

SEQ ID NO: 1583377 - RNA, 15 nt, Pseudomonas putida KT2440
ggcgagguucagcgc

SEQ ID NO: 1583378 - RNA, 17 nt, Pseudomonas putida KT2440
ggcgagggcuucgcccu

SEQ ID NO: 1583379 - RNA, 22 nt, Pseudomonas putida KT2440
ggcgagcgcgugcggggcaucg

SEQ ID NO: 1583380 - RNA, 16 nt, Pseudomonas putida KT2440
ggcgacaauggcgcgg

SEQ ID NO: 1583381 - RNA, 15 nt, Pseudomonas putida KT2440
ggcgaaauggcgaau

SEQ ID NO: 1583382 - RNA, 21 nt, Pseudomonas putida KT2440
ggcgaaauggcgaaucagcau

SEQ ID NO: 1583383 - RNA, 19 nt, Pseudomonas putida KT2440
ggcgaccaaaggucgccuu

SEQ ID NO: 1583384 - RNA, 17 nt, Pseudomonas putida KT2440
ggcgacagggcgaagau

SEQ ID NO: 1583385 - RNA, 18 nt, Pseudomonas putida KT2440
ggcgacgaaggccuuggc

SEQ ID NO: 1583386 - RNA, 15 nt, Pseudomonas putida KT2440
ggcgaccaugcggcu

SEQ ID NO: 1583387 - RNA, 16 nt, Pseudomonas putida KT2440
ggcgacggcgagguga

SEQ ID NO: 1583388 - RNA, 19 nt, Pseudomonas putida KT2440
ggcgacgcugcccagcaac

SEQ ID NO: 1583389 - RNA, 22 nt, Pseudomonas putida KT2440
ggcgacgcaguuacucggcuac

SEQ ID NO: 1583390 - RNA, 17 nt, Pseudomonas putida KT2440
ggcgacgcggugcucga

SEQ ID NO: 1583391 - RNA, 17 nt, Pseudomonas putida KT2440
ggcgacggaucggcaca

SEQ ID NO: 1583392 - RNA, 14 nt, Pseudomonas putida KT2440
ggcgacgcacuuca

SEQ ID NO: 1583393 - RNA, 13 nt, Pseudomonas putida KT2440
ggcgacuucggcg

SEQ ID NO: 1583394 - RNA, 17 nt, Pseudomonas putida KT2440
ggcgacuucggucgccc

SEQ ID NO: 1583395 - RNA, 15 nt, Pseudomonas putida KT2440
ggcgagcaggcccgc

SEQ ID NO: 1583396 - RNA, 16 nt, Pseudomonas putida KT2440
gguccgguaacuggcc

SEQ ID NO: 1583397 - RNA, 23 nt, Pseudomonas putida KT2440
ggucgacgucggcguccuucagg

SEQ ID NO: 1583398 - RNA, 21 nt, Pseudomonas putida KT2440
ggucgaccgagaagcagaaca

SEQ ID NO: 1583399 - RNA, 17 nt, Pseudomonas putida KT2440
ggucgaccggagcaucg

SEQ ID NO: 1583400 - RNA, 21 nt, Pseudomonas putida KT2440
ggucgcgccgacaucgaagca

SEQ ID NO: 1583401 - RNA, 14 nt, Pseudomonas putida KT2440
ggucgccgacggca

SEQ ID NO: 1583402 - RNA, 20 nt, Pseudomonas putida KT2440
ggucgccgacggcauggccg

SEQ ID NO: 1583403 - RNA, 23 nt, Pseudomonas putida KT2440
ggucccgcccuccagccgcgaac

SEQ ID NO: 1583404 - RNA, 23 nt, Pseudomonas putida KT2440
gguccccuucgucgauguccagc

SEQ ID NO: 1583405 - RNA, 20 nt, Pseudomonas putida KT2440
gguccagcguucggccagca

SEQ ID NO: 1583406 - RNA, 20 nt, Pseudomonas putida KT2440
gguccagcaagcucaucacc

SEQ ID NO: 1583407 - RNA, 18 nt, Pseudomonas putida KT2440
ggucaucgaagaucagca

SEQ ID NO: 1583408 - RNA, 13 nt, Pseudomonas putida KT2440
ggucaugccaccg

SEQ ID NO: 1583409 - RNA, 14 nt, Pseudomonas putida KT2440
ggucagggcgauga

SEQ ID NO: 1583410 - RNA, 21 nt, Pseudomonas putida KT2440
ggucagcuggccuucgaacag

SEQ ID NO: 1583411 - RNA, 14 nt, Pseudomonas putida KT2440
ggucagcucgauca

SEQ ID NO: 1583412 - RNA, 12 nt, Pseudomonas putida KT2440
gggugaccaggc

SEQ ID NO: 1583413 - RNA, 18 nt, Pseudomonas putida KT2440
gggucugguucuggucga

SEQ ID NO: 1583414 - RNA, 20 nt, Pseudomonas putida KT2440
gggugaacccgcuccuacaa

SEQ ID NO: 1583415 - RNA, 20 nt, Pseudomonas putida KT2440
gggugaacccgcuccuacac

SEQ ID NO: 1583416 - RNA, 20 nt, Pseudomonas putida KT2440
gggugaacccgcuccuacca

SEQ ID NO: 1583417 - RNA, 20 nt, Pseudomonas putida KT2440
gggugaacccgcuccuacgg

SEQ ID NO: 1583418 - RNA, 21 nt, Pseudomonas putida KT2440
gggugaacccgcuccugcagg

SEQ ID NO: 1583419 - RNA, 23 nt, Pseudomonas putida KT2440
ggugccaauaaccggcacaagcg

SEQ ID NO: 1583420 - RNA, 23 nt, Pseudomonas putida KT2440
ggugcaucggcaccgacggcggu

SEQ ID NO: 1583421 - RNA, 15 nt, Pseudomonas putida KT2440
ggugcaugcaagcag

SEQ ID NO: 1583422 - RNA, 14 nt, Pseudomonas putida KT2440
ggugccagcggcca

SEQ ID NO: 1583423 - RNA, 12 nt, Pseudomonas putida KT2440
ggugcaccagcu

SEQ ID NO: 1583424 - RNA, 17 nt, Pseudomonas putida KT2440
ggugaugaucagggaca

SEQ ID NO: 1583425 - RNA, 23 nt, Pseudomonas putida KT2440
ggucuugucugacagcaggaaca

SEQ ID NO: 1583426 - RNA, 13 nt, Pseudomonas putida KT2440
ggugaaacggcaa

SEQ ID NO: 1583427 - RNA, 22 nt, Pseudomonas putida KT2440
ggugaaagcgcaaucaaagcag

SEQ ID NO: 1583428 - RNA, 17 nt, Pseudomonas putida KT2440
ggugaaagucgaccagc

SEQ ID NO: 1583429 - RNA, 15 nt, Pseudomonas putida KT2440
ggugacaugcacugc

SEQ ID NO: 1583430 - RNA, 12 nt, Pseudomonas putida KT2440
ggugagcgcgau

SEQ ID NO: 1583431 - RNA, 14 nt, Pseudomonas putida KT2440
ggucggcgucagcg

SEQ ID NO: 1583432 - RNA, 15 nt, Pseudomonas putida KT2440
ggucggcguccacug

SEQ ID NO: 1583433 - RNA, 17 nt, Pseudomonas putida KT2440
ggucggccaucgacgug

SEQ ID NO: 1583434 - RNA, 12 nt, Pseudomonas putida KT2440
ggucggcaacca

SEQ ID NO: 1583435 - RNA, 15 nt, Pseudomonas putida KT2440
ggucgcggcggcaac

SEQ ID NO: 1583436 - RNA, 18 nt, Pseudomonas putida KT2440
ggucugcgcuucaagcag

SEQ ID NO: 1583437 - RNA, 21 nt, Pseudomonas putida KT2440
ggucucgaacugaugaccggc

SEQ ID NO: 1583438 - RNA, 12 nt, Pseudomonas putida KT2440
gguugaaacgua

SEQ ID NO: 1583439 - RNA, 21 nt, Pseudomonas putida KT2440
gguugaacagcagcgccgcca

SEQ ID NO: 1583440 - RNA, 13 nt, Pseudomonas putida KT2440
gguugcagguucu

SEQ ID NO: 1583441 - RNA, 16 nt, Pseudomonas putida KT2440
gguugauccagcccuu

SEQ ID NO: 1583442 - RNA, 15 nt, Pseudomonas putida KT2440
gguucucgcgaaccg

SEQ ID NO: 1583443 - RNA, 20 nt, Pseudomonas putida KT2440
gguucggcucacugaccagg

SEQ ID NO: 1583444 - RNA, 14 nt, Pseudomonas putida KT2440
gguguggcgccagg

SEQ ID NO: 1583445 - RNA, 14 nt, Pseudomonas putida KT2440
gguguuccagcacg

SEQ ID NO: 1583446 - RNA, 18 nt, Pseudomonas putida KT2440
gguguugcuugucccagg

SEQ ID NO: 1583447 - RNA, 22 nt, Pseudomonas putida KT2440
gguguucgcgggcaugcccgcu

SEQ ID NO: 1583448 - RNA, 18 nt, Pseudomonas putida KT2440
gguucgaugggcaugccg

SEQ ID NO: 1583449 - RNA, 22 nt, Pseudomonas putida KT2440
gguucagcgcaccgcugaccac

SEQ ID NO: 1583450 - RNA, 22 nt, Pseudomonas putida KT2440
gguucacagaaaagcugcacgc

SEQ ID NO: 1583451 - RNA, 20 nt, Pseudomonas putida KT2440
gguucacccgcgaagaggcc

SEQ ID NO: 1583452 - RNA, 21 nt, Pseudomonas putida KT2440
gguucaccguacccaggugau

SEQ ID NO: 1583453 - RNA, 20 nt, Pseudomonas putida KT2440
guaaagaacaugaucaagcu

SEQ ID NO: 1583454 - RNA, 19 nt, Pseudomonas putida KT2440
guaaacccauuccuacaga

SEQ ID NO: 1583455 - RNA, 12 nt, Pseudomonas putida KT2440
guaaacccgcgc

SEQ ID NO: 1583456 - RNA, 18 nt, Pseudomonas putida KT2440
guaaacccgcuccuacag

SEQ ID NO: 1583457 - RNA, 23 nt, Pseudomonas putida KT2440
guaaacaaagccccggcagcgau

SEQ ID NO: 1583458 - RNA, 19 nt, Pseudomonas putida KT2440
guaagccggcggccaucgc

SEQ ID NO: 1583459 - RNA, 20 nt, Pseudomonas putida KT2440
guaagccggcggccaucgcu

SEQ ID NO: 1583460 - RNA, 18 nt, Pseudomonas putida KT2440
guaaagccagcagccugu

SEQ ID NO: 1583461 - RNA, 16 nt, Pseudomonas putida KT2440
guaaagccgaucgacg

SEQ ID NO: 1583462 - RNA, 22 nt, Pseudomonas putida KT2440
gguugccaccagcaucaacagg

SEQ ID NO: 1583463 - RNA, 15 nt, Pseudomonas putida KT2440
gguuuagcgcuggcu

SEQ ID NO: 1583464 - RNA, 18 nt, Pseudomonas putida KT2440
gguuuacccgcgaacagg

SEQ ID NO: 1583465 - RNA, 20 nt, Pseudomonas putida KT2440
gguuuacccgcgaagaagcc

SEQ ID NO: 1583466 - RNA, 20 nt, Pseudomonas putida KT2440
gguuuacccgcgaaggggcc

SEQ ID NO: 1583467 - RNA, 16 nt, Pseudomonas putida KT2440
gguuuacccgcgaaua

SEQ ID NO: 1583468 - RNA, 20 nt, Pseudomonas putida KT2440
gguuuacccgcgaauacgau

SEQ ID NO: 1583469 - RNA, 20 nt, Pseudomonas putida KT2440
gguuuaccugcgaauacggu

SEQ ID NO: 1583470 - RNA, 16 nt, Pseudomonas putida KT2440
gguuuccagcccuucc

SEQ ID NO: 1583471 - RNA, 17 nt, Pseudomonas putida KT2440
gguuucgccguugucgg

SEQ ID NO: 1583472 - RNA, 16 nt, Pseudomonas putida KT2440
guaaaaacuggccagc

SEQ ID NO: 1583473 - RNA, 15 nt, Pseudomonas putida KT2440
gguuugacgcugcuc

SEQ ID NO: 1583474 - RNA, 18 nt, Pseudomonas putida KT2440
ggugccauagcaccagcg

SEQ ID NO: 1583475 - RNA, 22 nt, Pseudomonas putida KT2440
ggugccauagcaccagcgggcc

SEQ ID NO: 1583476 - RNA, 21 nt, Pseudomonas putida KT2440
ggugccaggcucaggccuucg

SEQ ID NO: 1583477 - RNA, 16 nt, Pseudomonas putida KT2440
ggugcccugcucuucg

SEQ ID NO: 1583478 - RNA, 13 nt, Pseudomonas putida KT2440
ggugccgaacagc

SEQ ID NO: 1583479 - RNA, 15 nt, Pseudomonas putida KT2440
ggugcgccuccagca

SEQ ID NO: 1583480 - RNA, 16 nt, Pseudomonas putida KT2440
ggugcgccugaacagc

SEQ ID NO: 1583481 - RNA, 17 nt, Pseudomonas putida KT2440
ggugcgaaucgacgcgu

SEQ ID NO: 1583482 - RNA, 19 nt, Pseudomonas putida KT2440
ggugcgauagauguccagc

SEQ ID NO: 1583483 - RNA, 16 nt, Pseudomonas putida KT2440
ggugcgagaggcgcuu

SEQ ID NO: 1583484 - RNA, 15 nt, Pseudomonas putida KT2440
gguggcgauccacag

SEQ ID NO: 1583485 - RNA, 19 nt, Pseudomonas putida KT2440
gguggccggcacugaccac

SEQ ID NO: 1583486 - RNA, 18 nt, Pseudomonas putida KT2440
gguggaacaggauggcaa

SEQ ID NO: 1583487 - RNA, 19 nt, Pseudomonas putida KT2440
gguggcauuggcgugcucg

SEQ ID NO: 1583488 - RNA, 17 nt, Pseudomonas putida KT2440
ggugcgcgcauccagca

SEQ ID NO: 1583489 - RNA, 20 nt, Pseudomonas putida KT2440
guacucucgucgaggcuguc

SEQ ID NO: 1583490 - RNA, 20 nt, Pseudomonas putida KT2440
guacucuucgacggucggca

SEQ ID NO: 1583491 - RNA, 20 nt, Pseudomonas putida KT2440
guagacgaagccgaaucgcu

SEQ ID NO: 1583492 - RNA, 18 nt, Pseudomonas putida KT2440
guagagccuuuggcugga

SEQ ID NO: 1583493 - RNA, 16 nt, Pseudomonas putida KT2440
guaauacggcgccgac

SEQ ID NO: 1583494 - RNA, 16 nt, Pseudomonas putida KT2440
guaagccagcccugcc

SEQ ID NO: 1583495 - RNA, 13 nt, Pseudomonas putida KT2440
guaaggcuggucg

SEQ ID NO: 1583496 - RNA, 17 nt, Pseudomonas putida KT2440
guacggcagaacggcuu

SEQ ID NO: 1583497 - RNA, 21 nt, Pseudomonas putida KT2440
guacggcagcucgagcaugcg

SEQ ID NO: 1583498 - RNA, 15 nt, Pseudomonas putida KT2440
guacggcccaugucg

SEQ ID NO: 1583499 - RNA, 13 nt, Pseudomonas putida KT2440
guacgggcacacc

SEQ ID NO: 1583500 - RNA, 20 nt, Pseudomonas putida KT2440
guacgggcacaccuggugcg

SEQ ID NO: 1583501 - RNA, 19 nt, Pseudomonas putida KT2440
guaggccagguacaggcaa

SEQ ID NO: 1583502 - RNA, 13 nt, Pseudomonas putida KT2440
guagggaucaccg

SEQ ID NO: 1583503 - RNA, 19 nt, Pseudomonas putida KT2440
guaggcgggagagcagggc

SEQ ID NO: 1583504 - RNA, 22 nt, Pseudomonas putida KT2440
guaggcgcggguuuacccgcga

SEQ ID NO: 1583505 - RNA, 22 nt, Pseudomonas putida KT2440
guaggcgcggguuugcccgcga

SEQ ID NO: 1583506 - RNA, 18 nt, Pseudomonas putida KT2440
guagaucauuaccugcag

SEQ ID NO: 1583507 - RNA, 24 nt, Pseudomonas putida KT2440
guagccgaaguugcccgaaccuug

SEQ ID NO: 1583508 - RNA, 23 nt, Pseudomonas putida KT2440
guagcucgacgccgugguagcac

SEQ ID NO: 1583509 - RNA, 13 nt, Pseudomonas putida KT2440
guaggagcgggcu

SEQ ID NO: 1583510 - RNA, 22 nt, Pseudomonas putida KT2440
guaggagcgggcuuacccgcga

SEQ ID NO: 1583511 - RNA, 20 nt, Pseudomonas putida KT2440
guaggagcgggcuugcccgc

SEQ ID NO: 1583512 - RNA, 22 nt, Pseudomonas putida KT2440
guaggagcggguuuacccgcga

SEQ ID NO: 1583513 - RNA, 15 nt, Pseudomonas putida KT2440
guaggcacggucggu

SEQ ID NO: 1583514 - RNA, 15 nt, Pseudomonas putida KT2440
guaggcaaugccuug

SEQ ID NO: 1583515 - RNA, 14 nt, Pseudomonas putida KT2440
guagcgguugcgca

SEQ ID NO: 1583516 - RNA, 13 nt, Pseudomonas putida KT2440
gucagccggcagu

SEQ ID NO: 1583517 - RNA, 20 nt, Pseudomonas putida KT2440
gucagccccuagcgcauccu

SEQ ID NO: 1583518 - RNA, 19 nt, Pseudomonas putida KT2440
gucagccagcgguccggcc

SEQ ID NO: 1583519 - RNA, 13 nt, Pseudomonas putida KT2440
gucagcaucaccg

SEQ ID NO: 1583520 - RNA, 17 nt, Pseudomonas putida KT2440
gucagcaucaccgcgcc

SEQ ID NO: 1583521 - RNA, 18 nt, Pseudomonas putida KT2440
gucacuucuuucagcuca

SEQ ID NO: 1583522 - RNA, 18 nt, Pseudomonas putida KT2440
gucagaaaaaacagugcc

SEQ ID NO: 1583523 - RNA, 19 nt, Pseudomonas putida KT2440
gucagaaaaaacagugccg

SEQ ID NO: 1583524 - RNA, 19 nt, Pseudomonas putida KT2440
gucacucaggugcacgacg

SEQ ID NO: 1583525 - RNA, 14 nt, Pseudomonas putida KT2440
gucacguugcccga

SEQ ID NO: 1583526 - RNA, 19 nt, Pseudomonas putida KT2440
gucacguuuuuugggagcg

SEQ ID NO: 1583527 - RNA, 14 nt, Pseudomonas putida KT2440
gucagcagcaggcg

SEQ ID NO: 1583528 - RNA, 18 nt, Pseudomonas putida KT2440
gucacgacaggggcgcag

SEQ ID NO: 1583529 - RNA, 21 nt, Pseudomonas putida KT2440
gucaccuuguccagcaggcca

SEQ ID NO: 1583530 - RNA, 12 nt, Pseudomonas putida KT2440
gucaccagcguc

SEQ ID NO: 1583531 - RNA, 20 nt, Pseudomonas putida KT2440
gucaaucuaaaaucaucggc

SEQ ID NO: 1583532 - RNA, 16 nt, Pseudomonas putida KT2440
gucaaucuugcgcacg

SEQ ID NO: 1583533 - RNA, 23 nt, Pseudomonas putida KT2440
gucaaggccagcgccugcugcca

SEQ ID NO: 1583534 - RNA, 15 nt, Pseudomonas putida KT2440
gucaacgguaacguu

SEQ ID NO: 1583535 - RNA, 22 nt, Pseudomonas putida KT2440
gucaacucgccaaaccauggcg

SEQ ID NO: 1583536 - RNA, 20 nt, Pseudomonas putida KT2440
guaggggcggauuugcccgc

SEQ ID NO: 1583537 - RNA, 17 nt, Pseudomonas putida KT2440
guaggucaccaucagcc

SEQ ID NO: 1583538 - RNA, 23 nt, Pseudomonas putida KT2440
guaggugcugaccgccugcgcac

SEQ ID NO: 1583539 - RNA, 17 nt, Pseudomonas putida KT2440
guaggugcaggcguaac

SEQ ID NO: 1583540 - RNA, 20 nt, Pseudomonas putida KT2440
guaucugccgaugcgcgugc

SEQ ID NO: 1583541 - RNA, 15 nt, Pseudomonas putida KT2440
guaucggccauggcc

SEQ ID NO: 1583542 - RNA, 15 nt, Pseudomonas putida KT2440
guccaggcucagcuc

SEQ ID NO: 1583543 - RNA, 14 nt, Pseudomonas putida KT2440
guccaggcugcgca

SEQ ID NO: 1583544 - RNA, 13 nt, Pseudomonas putida KT2440
guccagguagcgc

SEQ ID NO: 1583545 - RNA, 15 nt, Pseudomonas putida KT2440
guccagguagcgcuc

SEQ ID NO: 1583546 - RNA, 17 nt, Pseudomonas putida KT2440
guccauguuacggccca

SEQ ID NO: 1583547 - RNA, 14 nt, Pseudomonas putida KT2440
guccccaccggcac

SEQ ID NO: 1583548 - RNA, 15 nt, Pseudomonas putida KT2440
gucccagcaccgcga

SEQ ID NO: 1583549 - RNA, 15 nt, Pseudomonas putida KT2440
gucccagcaggcaca

SEQ ID NO: 1583550 - RNA, 13 nt, Pseudomonas putida KT2440
gucccagcuggca

SEQ ID NO: 1583551 - RNA, 18 nt, Pseudomonas putida KT2440
guccacuugcguucgccg

SEQ ID NO: 1583552 - RNA, 17 nt, Pseudomonas putida KT2440
guccacugcggacagca

SEQ ID NO: 1583553 - RNA, 15 nt, Pseudomonas putida KT2440
guccagcaagggccu

SEQ ID NO: 1583554 - RNA, 20 nt, Pseudomonas putida KT2440
guccagccccgcaccgcgga

SEQ ID NO: 1583555 - RNA, 19 nt, Pseudomonas putida KT2440
guccagcgcaucaacgccu

SEQ ID NO: 1583556 - RNA, 15 nt, Pseudomonas putida KT2440
guccagccccaaggu

SEQ ID NO: 1583557 - RNA, 21 nt, Pseudomonas putida KT2440
guccacgcgcaggccacggua

SEQ ID NO: 1583558 - RNA, 12 nt, Pseudomonas putida KT2440
guccaccgcgca

SEQ ID NO: 1583559 - RNA, 17 nt, Pseudomonas putida KT2440
guccaccgcgcaacgcg

SEQ ID NO: 1583560 - RNA, 16 nt, Pseudomonas putida KT2440
guccaccagcaggcug

SEQ ID NO: 1583561 - RNA, 17 nt, Pseudomonas putida KT2440
guccaacgggcggaacu

SEQ ID NO: 1583562 - RNA, 18 nt, Pseudomonas putida KT2440
guccaaauugggcugggc

SEQ ID NO: 1583563 - RNA, 17 nt, Pseudomonas putida KT2440
gucaggucgcuaucggc

SEQ ID NO: 1583564 - RNA, 22 nt, Pseudomonas putida KT2440
gucagguacucgcccgccaggu

SEQ ID NO: 1583565 - RNA, 16 nt, Pseudomonas putida KT2440
gucaggugcggggcaa

SEQ ID NO: 1583566 - RNA, 13 nt, Pseudomonas putida KT2440
gucagugacaggc

SEQ ID NO: 1583567 - RNA, 20 nt, Pseudomonas putida KT2440
gucaggcguuuuuccaugcg

SEQ ID NO: 1583568 - RNA, 22 nt, Pseudomonas putida KT2440
gucagggcuuuuuccagcgcca

SEQ ID NO: 1583569 - RNA, 13 nt, Pseudomonas putida KT2440
gucagggcugcaa

SEQ ID NO: 1583570 - RNA, 21 nt, Pseudomonas putida KT2440
gucagcuggccuucgaacagc

SEQ ID NO: 1583571 - RNA, 21 nt, Pseudomonas putida KT2440
gucagcuugccuuccgggaag

SEQ ID NO: 1583572 - RNA, 19 nt, Pseudomonas putida KT2440
gucagcucgaucaggcucu

SEQ ID NO: 1583573 - RNA, 14 nt, Pseudomonas putida KT2440
gucagcucaggccu

SEQ ID NO: 1583574 - RNA, 16 nt, Pseudomonas putida KT2440
gucagcgcucggguug

SEQ ID NO: 1583575 - RNA, 17 nt, Pseudomonas putida KT2440
gucagcgccagcggcuc

SEQ ID NO: 1583576 - RNA, 18 nt, Pseudomonas putida KT2440
gucagcgccgauggccaa

SEQ ID NO: 1583577 - RNA, 13 nt, Pseudomonas putida KT2440
gucagcgguucga

SEQ ID NO: 1583578 - RNA, 17 nt, Pseudomonas putida KT2440
gucagcguacacugcag

SEQ ID NO: 1583579 - RNA, 22 nt, Pseudomonas putida KT2440
gucagcguacacugcaggagcg

SEQ ID NO: 1583580 - RNA, 23 nt, Pseudomonas putida KT2440
gucagcgugguaguuguccaccu

SEQ ID NO: 1583581 - RNA, 14 nt, Pseudomonas putida KT2440
gucaucugcgcacg

SEQ ID NO: 1583582 - RNA, 15 nt, Pseudomonas putida KT2440
gucaugcagcgccaa

SEQ ID NO: 1583583 - RNA, 19 nt, Pseudomonas putida KT2440
gucaugcgguacagcacug

SEQ ID NO: 1583584 - RNA, 17 nt, Pseudomonas putida KT2440
gucauggcgcgccaugc

SEQ ID NO: 1583585 - RNA, 19 nt, Pseudomonas putida KT2440
gucaugguccuugaacggc

SEQ ID NO: 1583586 - RNA, 15 nt, Pseudomonas putida KT2440
gucauugcucaccgu

SEQ ID NO: 1583587 - RNA, 14 nt, Pseudomonas putida KT2440
gucauugaaggcca

SEQ ID NO: 1583588 - RNA, 16 nt, Pseudomonas putida KT2440
gucauccugcguggcg

SEQ ID NO: 1583589 - RNA, 22 nt, Pseudomonas putida KT2440
gucauccgggccgucaccgcug

SEQ ID NO: 1583590 - RNA, 12 nt, Pseudomonas putida KT2440
gucauccagcag

SEQ ID NO: 1583591 - RNA, 13 nt, Pseudomonas putida KT2440
gucauccagcagc

SEQ ID NO: 1583592 - RNA, 20 nt, Pseudomonas putida KT2440
gucauccaggcuggccagca

SEQ ID NO: 1583593 - RNA, 20 nt, Pseudomonas putida KT2440
gucaguucuaccccuucggc

SEQ ID NO: 1583594 - RNA, 21 nt, Pseudomonas putida KT2440
gucauacucuucgcgggcucg

SEQ ID NO: 1583595 - RNA, 17 nt, Pseudomonas putida KT2440
gucaguuugacggugaa

SEQ ID NO: 1583596 - RNA, 22 nt, Pseudomonas putida KT2440
gucauaccacacguugguacgc

SEQ ID NO: 1583597 - RNA, 13 nt, Pseudomonas putida KT2440
gugcauguccagu

SEQ ID NO: 1583598 - RNA, 16 nt, Pseudomonas putida KT2440
gugcaugggccaggga

SEQ ID NO: 1583599 - RNA, 15 nt, Pseudomonas putida KT2440
gugcauuggcaaacg

SEQ ID NO: 1583600 - RNA, 16 nt, Pseudomonas putida KT2440
gugccagcggccacuu

SEQ ID NO: 1583601 - RNA, 20 nt, Pseudomonas putida KT2440
gugccaucagggcgaugcgc

SEQ ID NO: 1583602 - RNA, 18 nt, Pseudomonas putida KT2440
gugccauccaccgcgcca

SEQ ID NO: 1583603 - RNA, 14 nt, Pseudomonas putida KT2440
gugcccgccaggcg

SEQ ID NO: 1583604 - RNA, 18 nt, Pseudomonas putida KT2440
gugcccgaucaccgcgaa

SEQ ID NO: 1583605 - RNA, 19 nt, Pseudomonas putida KT2440
gugcccgaucaccgcgaau

SEQ ID NO: 1583606 - RNA, 18 nt, Pseudomonas putida KT2440
gugccccgguccagcaca

SEQ ID NO: 1583607 - RNA, 13 nt, Pseudomonas putida KT2440
gugcaugcgcacg

SEQ ID NO: 1583608 - RNA, 18 nt, Pseudomonas putida KT2440
gugcaucgaagcaggccg

SEQ ID NO: 1583609 - RNA, 18 nt, Pseudomonas putida KT2440
gugcagcugcaccgaccg

SEQ ID NO: 1583610 - RNA, 14 nt, Pseudomonas putida KT2440
gugcacccacuggc

SEQ ID NO: 1583611 - RNA, 16 nt, Pseudomonas putida KT2440
gugcacccaucggcgc

SEQ ID NO: 1583612 - RNA, 23 nt, Pseudomonas putida KT2440
gugcaccaacacuuccagcaucg

SEQ ID NO: 1583613 - RNA, 16 nt, Pseudomonas putida KT2440
gugcacagggcggcca

SEQ ID NO: 1583614 - RNA, 16 nt, Pseudomonas putida KT2440
gugcacccgugccugc

SEQ ID NO: 1583615 - RNA, 20 nt, Pseudomonas putida KT2440
gugcagcgacggcgaaguca

SEQ ID NO: 1583616 - RNA, 15 nt, Pseudomonas putida KT2440
gugauaguccagcaa

SEQ ID NO: 1583617 - RNA, 22 nt, Pseudomonas putida KT2440
gugauaccugugggagcgggcg

SEQ ID NO: 1583618 - RNA, 13 nt, Pseudomonas putida KT2440
gugaacggcgggu

SEQ ID NO: 1583619 - RNA, 23 nt, Pseudomonas putida KT2440
gugaucagugcggucaggccaag

SEQ ID NO: 1583620 - RNA, 13 nt, Pseudomonas putida KT2440
gugaucccgcgag

SEQ ID NO: 1583621 - RNA, 15 nt, Pseudomonas putida KT2440
gugaucaugccgacg

SEQ ID NO: 1583622 - RNA, 19 nt, Pseudomonas putida KT2440
gugaucgccacaacggcgc

SEQ ID NO: 1583623 - RNA, 20 nt, Pseudomonas putida KT2440
gugaugccccugcgccgcca

SEQ ID NO: 1583624 - RNA, 18 nt, Pseudomonas putida KT2440
gugaugcgguaaccggaa

SEQ ID NO: 1583625 - RNA, 21 nt, Pseudomonas putida KT2440
gugcucggcacugcuauccgc

SEQ ID NO: 1583626 - RNA, 18 nt, Pseudomonas putida KT2440
gugcucgccucacagcgc

SEQ ID NO: 1583627 - RNA, 19 nt, Pseudomonas putida KT2440
gugcugcgaguucaggcgc

SEQ ID NO: 1583628 - RNA, 15 nt, Pseudomonas putida KT2440
gugcugaugcccaaa

SEQ ID NO: 1583629 - RNA, 13 nt, Pseudomonas putida KT2440
gugcucaggcuca

SEQ ID NO: 1583630 - RNA, 16 nt, Pseudomonas putida KT2440
gugcucaggcucagcu

SEQ ID NO: 1583631 - RNA, 16 nt, Pseudomonas putida KT2440
gugcucagcggcaccu

SEQ ID NO: 1583632 - RNA, 12 nt, Pseudomonas putida KT2440
gugcucagcaca

SEQ ID NO: 1583633 - RNA, 22 nt, Pseudomonas putida KT2440
gugcucagcacauucagcagcg

SEQ ID NO: 1583634 - RNA, 18 nt, Pseudomonas putida KT2440
gugcucagccacgcuggc

SEQ ID NO: 1583635 - RNA, 14 nt, Pseudomonas putida KT2440
gugcuccagcucca

SEQ ID NO: 1583636 - RNA, 16 nt, Pseudomonas putida KT2440
gugcuccagcuccagg

SEQ ID NO: 1583637 - RNA, 19 nt, Pseudomonas putida KT2440
gugcuccaggccugcggca

SEQ ID NO: 1583638 - RNA, 20 nt, Pseudomonas putida KT2440
gugcucgaucagauaggcgc

SEQ ID NO: 1583639 - RNA, 13 nt, Pseudomonas putida KT2440
gugcgcccggcaa

SEQ ID NO: 1583640 - RNA, 14 nt, Pseudomonas putida KT2440
gugcgcccggcaaa

SEQ ID NO: 1583641 - RNA, 16 nt, Pseudomonas putida KT2440
gugcgcccggcgcuga

SEQ ID NO: 1583642 - RNA, 17 nt, Pseudomonas putida KT2440
gugcgcccggcgcugau

SEQ ID NO: 1583643 - RNA, 21 nt, Pseudomonas putida KT2440
gugcgcccggcgcugaucagc

SEQ ID NO: 1583644 - RNA, 18 nt, Pseudomonas putida KT2440
gugcgggcuccacugcaa

SEQ ID NO: 1583645 - RNA, 20 nt, Pseudomonas putida KT2440
gugcggcugggccccaggcg

SEQ ID NO: 1583646 - RNA, 20 nt, Pseudomonas putida KT2440
gugcgggcuuguccgcgaag

SEQ ID NO: 1583647 - RNA, 15 nt, Pseudomonas putida KT2440
gugcggugaccgagg

SEQ ID NO: 1583648 - RNA, 15 nt, Pseudomonas putida KT2440
gugccuggcgcuuga

SEQ ID NO: 1583649 - RNA, 14 nt, Pseudomonas putida KT2440
gugccugggucagc

SEQ ID NO: 1583650 - RNA, 19 nt, Pseudomonas putida KT2440
gugcgacccgcuggccgga

SEQ ID NO: 1583651 - RNA, 22 nt, Pseudomonas putida KT2440
gugccuuggcggcggaucggcg

SEQ ID NO: 1583652 - RNA, 20 nt, Pseudomonas putida KT2440
gugcgagcccuuguccaggu

SEQ ID NO: 1583653 - RNA, 21 nt, Pseudomonas putida KT2440
gugcgccaccgacuccggcaa

SEQ ID NO: 1583654 - RNA, 15 nt, Pseudomonas putida KT2440
gugcgcagguacgcc

SEQ ID NO: 1583655 - RNA, 17 nt, Pseudomonas putida KT2440
gugccgcugcgcgguaa

SEQ ID NO: 1583656 - RNA, 14 nt, Pseudomonas putida KT2440
gugccggcagcgag

SEQ ID NO: 1583657 - RNA, 23 nt, Pseudomonas putida KT2440
gugccggcagcgagcgcuggauc

SEQ ID NO: 1583658 - RNA, 16 nt, Pseudomonas putida KT2440
gugccggccagcggca

SEQ ID NO: 1583659 - RNA, 23 nt, Pseudomonas putida KT2440
gugccucugcugcggauacagcg

SEQ ID NO: 1583660 - RNA, 16 nt, Pseudomonas putida KT2440
gugccgcgccagcucc

SEQ ID NO: 1583661 - RNA, 12 nt, Pseudomonas putida KT2440
guggucgccguc

SEQ ID NO: 1583662 - RNA, 15 nt, Pseudomonas putida KT2440
gugguaaugcgcuga

SEQ ID NO: 1583663 - RNA, 19 nt, Pseudomonas putida KT2440
gugguaaugcgcugauuca

SEQ ID NO: 1583664 - RNA, 23 nt, Pseudomonas putida KT2440
gugggucaugucggcagccaggg

SEQ ID NO: 1583665 - RNA, 13 nt, Pseudomonas putida KT2440
guggguguccugc

SEQ ID NO: 1583666 - RNA, 19 nt, Pseudomonas putida KT2440
guggguaauuucgcuaagu

SEQ ID NO: 1583667 - RNA, 23 nt, Pseudomonas putida KT2440
guggguaacccugcucgccaucg

SEQ ID NO: 1583668 - RNA, 20 nt, Pseudomonas putida KT2440
gugguaggagcggguucacc

SEQ ID NO: 1583669 - RNA, 17 nt, Pseudomonas putida KT2440
gugguaguccuugccgc

SEQ ID NO: 1583670 - RNA, 17 nt, Pseudomonas putida KT2440
gugggcuugcccgcgaa

SEQ ID NO: 1583671 - RNA, 17 nt, Pseudomonas putida KT2440
guggggcaacugcgcga

SEQ ID NO: 1583672 - RNA, 18 nt, Pseudomonas putida KT2440
guggcgcccggcgcuggu

SEQ ID NO: 1583673 - RNA, 22 nt, Pseudomonas putida KT2440
guggcgauccacagcgggucga

SEQ ID NO: 1583674 - RNA, 21 nt, Pseudomonas putida KT2440
guggcgaucccuguaggagcg

SEQ ID NO: 1583675 - RNA, 21 nt, Pseudomonas putida KT2440
guggcgccuugauuaccagcg

SEQ ID NO: 1583676 - RNA, 12 nt, Pseudomonas putida KT2440
guggcgcuggcg

SEQ ID NO: 1583677 - RNA, 19 nt, Pseudomonas putida KT2440
guggcgcugaccaacaggc

SEQ ID NO: 1583678 - RNA, 14 nt, Pseudomonas putida KT2440
guggcguggccacg

SEQ ID NO: 1583679 - RNA, 18 nt, Pseudomonas putida KT2440
guggcguggccacgcccg

SEQ ID NO: 1583680 - RNA, 16 nt, Pseudomonas putida KT2440
guggcguugucagcaa

SEQ ID NO: 1583681 - RNA, 19 nt, Pseudomonas putida KT2440
guggcguugucagcaaccg

SEQ ID NO: 1583682 - RNA, 22 nt, Pseudomonas putida KT2440
guggcuuucauaccccuccggc

SEQ ID NO: 1583683 - RNA, 17 nt, Pseudomonas putida KT2440
guggcuguugcgguugc

SEQ ID NO: 1583684 - RNA, 14 nt, Pseudomonas putida KT2440
guggcuuacagcgu

SEQ ID NO: 1583685 - RNA, 17 nt, Pseudomonas putida KT2440
guggcuggcaccggcug

SEQ ID NO: 1583686 - RNA, 19 nt, Pseudomonas putida KT2440
guggcugccagcgcgcugc

SEQ ID NO: 1583687 - RNA, 20 nt, Pseudomonas putida KT2440
gugggagcaggcaugcccgc

SEQ ID NO: 1583688 - RNA, 16 nt, Pseudomonas putida KT2440
gugggagcggccuugc

SEQ ID NO: 1583689 - RNA, 21 nt, Pseudomonas putida KT2440
gugggagcgggacugcccgcc

SEQ ID NO: 1583690 - RNA, 20 nt, Pseudomonas putida KT2440
gugggagcgggcuugcccgc

SEQ ID NO: 1583691 - RNA, 15 nt, Pseudomonas putida KT2440
guggcagguucgacc

SEQ ID NO: 1583692 - RNA, 22 nt, Pseudomonas putida KT2440
guggcaccgccgcccacgccgg

SEQ ID NO: 1583693 - RNA, 21 nt, Pseudomonas putida KT2440
guggcaccggcgaagacggca

SEQ ID NO: 1583694 - RNA, 13 nt, Pseudomonas putida KT2440
guggcccaaggcg

SEQ ID NO: 1583695 - RNA, 20 nt, Pseudomonas putida KT2440
guggcccugaccgcggugcu

SEQ ID NO: 1583696 - RNA, 15 nt, Pseudomonas putida KT2440
guggccucgaacaug

SEQ ID NO: 1583697 - RNA, 14 nt, Pseudomonas putida KT2440
gugcuguggcgcac

SEQ ID NO: 1583698 - RNA, 18 nt, Pseudomonas putida KT2440
gugcuucgcccagugccu

SEQ ID NO: 1583699 - RNA, 18 nt, Pseudomonas putida KT2440
gugcuucacagcguugca

SEQ ID NO: 1583700 - RNA, 15 nt, Pseudomonas putida KT2440
gugcugucacccuug

SEQ ID NO: 1583701 - RNA, 14 nt, Pseudomonas putida KT2440
gugcugugcacugc

SEQ ID NO: 1583702 - RNA, 16 nt, Pseudomonas putida KT2440
gugcugugcacugcga

SEQ ID NO: 1583703 - RNA, 13 nt, Pseudomonas putida KT2440
gugcuggcccuuu

SEQ ID NO: 1583704 - RNA, 17 nt, Pseudomonas putida KT2440
gugcuggcugaucagca

SEQ ID NO: 1583705 - RNA, 16 nt, Pseudomonas putida KT2440
gugcuggggccgcaaa

SEQ ID NO: 1583706 - RNA, 17 nt, Pseudomonas putida KT2440
gugcuggggccgcaaag

SEQ ID NO: 1583707 - RNA, 18 nt, Pseudomonas putida KT2440
gugcugggcaugagccug

SEQ ID NO: 1583708 - RNA, 16 nt, Pseudomonas putida KT2440
guggaaaucgccugcu

SEQ ID NO: 1583709 - RNA, 17 nt, Pseudomonas putida KT2440
guggaaauuggccagca

SEQ ID NO: 1583710 - RNA, 22 nt, Pseudomonas putida KT2440
gugcuuuacggcuuguggggcg

SEQ ID NO: 1583711 - RNA, 21 nt, Pseudomonas putida KT2440
guggagaucgucguaggagcg

SEQ ID NO: 1583712 - RNA, 11 nt, Pseudomonas putida KT2440
guggagcgcga

SEQ ID NO: 1583713 - RNA, 16 nt, Pseudomonas putida KT2440
guggagauuggccagc

SEQ ID NO: 1583714 - RNA, 15 nt, Pseudomonas putida KT2440
guggacaccauggcc

SEQ ID NO: 1583715 - RNA, 20 nt, Pseudomonas putida KT2440
guggcacccacagcgccugc

SEQ ID NO: 1583716 - RNA, 21 nt, Pseudomonas putida KT2440
guggcacccacagcgccugcu

SEQ ID NO: 1583717 - RNA, 13 nt, Pseudomonas putida KT2440
guggcacaccaug

SEQ ID NO: 1583718 - RNA, 19 nt, Pseudomonas putida KT2440
guggcaauugcacccgcgg

SEQ ID NO: 1583719 - RNA, 13 nt, Pseudomonas putida KT2440
guggcaauuggcg

SEQ ID NO: 1583720 - RNA, 18 nt, Pseudomonas putida KT2440
guggcaagggcggaggcu

SEQ ID NO: 1583721 - RNA, 15 nt, Pseudomonas putida KT2440
guggauggucagcgc

SEQ ID NO: 1583722 - RNA, 18 nt, Pseudomonas putida KT2440
guggaggauauaagccgc

SEQ ID NO: 1583723 - RNA, 18 nt, Pseudomonas putida KT2440
guggaucagccgcgcuga

SEQ ID NO: 1583724 - RNA, 18 nt, Pseudomonas putida KT2440
gucuuccuccgacagcgc

SEQ ID NO: 1583725 - RNA, 22 nt, Pseudomonas putida KT2440
gucuuccucgacccagccaccc

SEQ ID NO: 1583726 - RNA, 14 nt, Pseudomonas putida KT2440
gucuuccggcaggu

SEQ ID NO: 1583727 - RNA, 14 nt, Pseudomonas putida KT2440
gucuuccggcauga

SEQ ID NO: 1583728 - RNA, 18 nt, Pseudomonas putida KT2440
gucuuccagguggccgcc

SEQ ID NO: 1583729 - RNA, 19 nt, Pseudomonas putida KT2440
gucuuccugguuuucgcgg

SEQ ID NO: 1583730 - RNA, 17 nt, Pseudomonas putida KT2440
gucuucaaaucgcugcg

SEQ ID NO: 1583731 - RNA, 22 nt, Pseudomonas putida KT2440
gugaaaccgaaaaagccuacac

SEQ ID NO: 1583732 - RNA, 20 nt, Pseudomonas putida KT2440
gugaaaugcaaccgaugccc

SEQ ID NO: 1583733 - RNA, 17 nt, Pseudomonas putida KT2440
gugaaagucgaccagca

SEQ ID NO: 1583734 - RNA, 14 nt, Pseudomonas putida KT2440
gucuuuucuucgcc

SEQ ID NO: 1583735 - RNA, 22 nt, Pseudomonas putida KT2440
gucuuuuuucauucaggccauc

SEQ ID NO: 1583736 - RNA, 15 nt, Pseudomonas putida KT2440
gucugccggcaccgu

SEQ ID NO: 1583737 - RNA, 19 nt, Pseudomonas putida KT2440
gucugccaguucaugcagc

SEQ ID NO: 1583738 - RNA, 14 nt, Pseudomonas putida KT2440
gucuccgcgcuugc

SEQ ID NO: 1583739 - RNA, 22 nt, Pseudomonas putida KT2440
gucguccucgaacucaugcucc

SEQ ID NO: 1583740 - RNA, 17 nt, Pseudomonas putida KT2440
gucguuguccagguggu

SEQ ID NO: 1583741 - RNA, 17 nt, Pseudomonas putida KT2440
gucuaaccgcgcuggua

SEQ ID NO: 1583742 - RNA, 20 nt, Pseudomonas putida KT2440
gucucacaggcgcugaaacu

SEQ ID NO: 1583743 - RNA, 14 nt, Pseudomonas putida KT2440
gucggcgugcacca

SEQ ID NO: 1583744 - RNA, 16 nt, Pseudomonas putida KT2440
gucggcgcuggacagg

SEQ ID NO: 1583745 - RNA, 18 nt, Pseudomonas putida KT2440
gucggcgcuggacaggua

SEQ ID NO: 1583746 - RNA, 15 nt, Pseudomonas putida KT2440
gucggucagguagcc

SEQ ID NO: 1583747 - RNA, 14 nt, Pseudomonas putida KT2440
gucggccaucgacg

SEQ ID NO: 1583748 - RNA, 18 nt, Pseudomonas putida KT2440
gucggccugcucgcuggc

SEQ ID NO: 1583749 - RNA, 22 nt, Pseudomonas putida KT2440
gucggcgcgcaacagcaaggca

SEQ ID NO: 1583750 - RNA, 13 nt, Pseudomonas putida KT2440
gucggcgaaggcu

SEQ ID NO: 1583751 - RNA, 19 nt, Pseudomonas putida KT2440
gucgcgccccaagcgggcc

SEQ ID NO: 1583752 - RNA, 21 nt, Pseudomonas putida KT2440
gucgcgccaguuccacgaccg

SEQ ID NO: 1583753 - RNA, 19 nt, Pseudomonas putida KT2440
gucgccgugcaacgccggu

SEQ ID NO: 1583754 - RNA, 18 nt, Pseudomonas putida KT2440
gucgccgugcagcaccgc

SEQ ID NO: 1583755 - RNA, 16 nt, Pseudomonas putida KT2440
gucgccgacggcaugg

SEQ ID NO: 1583756 - RNA, 18 nt, Pseudomonas putida KT2440
gucgccgcuguucagccc

SEQ ID NO: 1583757 - RNA, 12 nt, Pseudomonas putida KT2440
gucgccgauacc

SEQ ID NO: 1583758 - RNA, 15 nt, Pseudomonas putida KT2440
gucgccgauacccgc

SEQ ID NO: 1583759 - RNA, 22 nt, Pseudomonas putida KT2440
gucgcugccgccaaccagcuca

SEQ ID NO: 1583760 - RNA, 16 nt, Pseudomonas putida KT2440
gucggcacgcgccagc

SEQ ID NO: 1583761 - RNA, 14 nt, Pseudomonas putida KT2440
gucggccagcugcu

SEQ ID NO: 1583762 - RNA, 16 nt, Pseudomonas putida KT2440
gucggcaaccgagauc

SEQ ID NO: 1583763 - RNA, 13 nt, Pseudomonas putida KT2440
gucgcuuugcggg

SEQ ID NO: 1583764 - RNA, 19 nt, Pseudomonas putida KT2440
gucgcuuuggggggcgaca

SEQ ID NO: 1583765 - RNA, 23 nt, Pseudomonas putida KT2440
gucgaucuucagcgcaucgaccg

SEQ ID NO: 1583766 - RNA, 22 nt, Pseudomonas putida KT2440
gucgaucuucgccggcaucgcc

SEQ ID NO: 1583767 - RNA, 20 nt, Pseudomonas putida KT2440
gucgaggcugucgaucagac

SEQ ID NO: 1583768 - RNA, 20 nt, Pseudomonas putida KT2440
gucgaugccuacugcuggcg

SEQ ID NO: 1583769 - RNA, 18 nt, Pseudomonas putida KT2440
gucgaugauggcugccag

SEQ ID NO: 1583770 - RNA, 14 nt, Pseudomonas putida KT2440
gucgcacucggcaa

SEQ ID NO: 1583771 - RNA, 14 nt, Pseudomonas putida KT2440
gucgcacaggucca

SEQ ID NO: 1583772 - RNA, 22 nt, Pseudomonas putida KT2440
gucgauuacccagcgcgaagcc

SEQ ID NO: 1583773 - RNA, 15 nt, Pseudomonas putida KT2440
gucgauuuucacgcc

SEQ ID NO: 1583774 - RNA, 20 nt, Pseudomonas putida KT2440
gucgccagugaacaccacug

SEQ ID NO: 1583775 - RNA, 18 nt, Pseudomonas putida KT2440
gucgagcucgaucggcaa

SEQ ID NO: 1583776 - RNA, 22 nt, Pseudomonas putida KT2440
cggcguacucucgucgaggcug

SEQ ID NO: 1583777 - RNA, 19 nt, Pseudomonas putida KT2440
cggcgguugucgucgaccg

SEQ ID NO: 1583778 - RNA, 16 nt, Pseudomonas putida KT2440
cggcgguaacaggggu

SEQ ID NO: 1583779 - RNA, 14 nt, Pseudomonas putida KT2440
cggcggcgaucagc

SEQ ID NO: 1583780 - RNA, 17 nt, Pseudomonas putida KT2440
cggcggcuuccagggcu

SEQ ID NO: 1583781 - RNA, 22 nt, Pseudomonas putida KT2440
cggcguuaccccguugcgcagc

SEQ ID NO: 1583782 - RNA, 12 nt, Pseudomonas putida KT2440
cggcguggcgag

SEQ ID NO: 1583783 - RNA, 23 nt, Pseudomonas putida KT2440
cggcguggaugaucggcuggcca

SEQ ID NO: 1583784 - RNA, 14 nt, Pseudomonas putida KT2440
cggcguauacccgg

SEQ ID NO: 1583785 - RNA, 22 nt, Pseudomonas putida KT2440
cggcguauacccggucagggug

SEQ ID NO: 1583786 - RNA, 23 nt, Pseudomonas putida KT2440
cggcguauacccggucaggguga

SEQ ID NO: 1583787 - RNA, 21 nt, Pseudomonas putida KT2440
cggcgucaccuuccugggcuu

SEQ ID NO: 1583788 - RNA, 14 nt, Pseudomonas putida KT2440
cggcgucagccgcg

SEQ ID NO: 1583789 - RNA, 17 nt, Pseudomonas putida KT2440
cggcguucgaaagccca

SEQ ID NO: 1583790 - RNA, 15 nt, Pseudomonas putida KT2440
cggcguucaggcgcg

SEQ ID NO: 1583791 - RNA, 18 nt, Pseudomonas putida KT2440
cggcuacccagccgggca

SEQ ID NO: 1583792 - RNA, 16 nt, Pseudomonas putida KT2440
cggcuaccccgaugcg

SEQ ID NO: 1583793 - RNA, 16 nt, Pseudomonas putida KT2440
cggcuaagcgccagca

SEQ ID NO: 1583794 - RNA, 20 nt, Pseudomonas putida KT2440
cggcuacgccgccgcuggcg

SEQ ID NO: 1583795 - RNA, 17 nt, Pseudomonas putida KT2440
cggcucacccaccagcc

SEQ ID NO: 1583796 - RNA, 18 nt, Pseudomonas putida KT2440
cggcucaccgcagcccag

SEQ ID NO: 1583797 - RNA, 20 nt, Pseudomonas putida KT2440
cggcucaccgcagcccagcg

SEQ ID NO: 1583798 - RNA, 20 nt, Pseudomonas putida KT2440
cggcuccggcguguccagca

SEQ ID NO: 1583799 - RNA, 20 nt, Pseudomonas putida KT2440
cggcucgccauugaugcuca

SEQ ID NO: 1583800 - RNA, 16 nt, Pseudomonas putida KT2440
cgggauggcaccggca

SEQ ID NO: 1583801 - RNA, 17 nt, Pseudomonas putida KT2440
cgggauggcaccggcag

SEQ ID NO: 1583802 - RNA, 13 nt, Pseudomonas putida KT2440
cgggcaaccgcau

SEQ ID NO: 1583803 - RNA, 20 nt, Pseudomonas putida KT2440
cgggcaaccgcauccccggc

SEQ ID NO: 1583804 - RNA, 16 nt, Pseudomonas putida KT2440
cgggcaaacuggcgcc

SEQ ID NO: 1583805 - RNA, 22 nt, Pseudomonas putida KT2440
cgggcaaacuggcgcccggcau

SEQ ID NO: 1583806 - RNA, 13 nt, Pseudomonas putida KT2440
cgggcaaagcacc

SEQ ID NO: 1583807 - RNA, 17 nt, Pseudomonas putida KT2440
cgggauguucaggucgc

SEQ ID NO: 1583808 - RNA, 16 nt, Pseudomonas putida KT2440
cgggcacgaucagcag

SEQ ID NO: 1583809 - RNA, 18 nt, Pseudomonas putida KT2440
cgggcacgaucagcagca

SEQ ID NO: 1583810 - RNA, 22 nt, Pseudomonas putida KT2440
cgggcacgaucagcagcaaagg

SEQ ID NO: 1583811 - RNA, 16 nt, Pseudomonas putida KT2440
cgggcaacugcgccug

SEQ ID NO: 1583812 - RNA, 17 nt, Pseudomonas putida KT2440
cgggcaacugcgccugg

SEQ ID NO: 1583813 - RNA, 14 nt, Pseudomonas putida KT2440
cgggcaagcccgca

SEQ ID NO: 1583814 - RNA, 15 nt, Pseudomonas putida KT2440
cgggcaagcccgcac

SEQ ID NO: 1583815 - RNA, 20 nt, Pseudomonas putida KT2440
cgggcaagcccgcuccgaca

SEQ ID NO: 1583816 - RNA, 20 nt, Pseudomonas putida KT2440
cgggcaagcccgcuccuaca

SEQ ID NO: 1583817 - RNA, 20 nt, Pseudomonas putida KT2440
cgggcaagcccgcuccuacg

SEQ ID NO: 1583818 - RNA, 21 nt, Pseudomonas putida KT2440
cgggcaagccgucucugaccg

SEQ ID NO: 1583819 - RNA, 16 nt, Pseudomonas putida KT2440
cgggccagcccaucca

SEQ ID NO: 1583820 - RNA, 23 nt, Pseudomonas putida KT2440
cgggccagccgcgccaggucggc

SEQ ID NO: 1583821 - RNA, 13 nt, Pseudomonas putida KT2440
cgggccagcgcgg

SEQ ID NO: 1583822 - RNA, 15 nt, Pseudomonas putida KT2440
cgggcccgcuugcgc

SEQ ID NO: 1583823 - RNA, 14 nt, Pseudomonas putida KT2440
cgggccaucugcuu

SEQ ID NO: 1583824 - RNA, 23 nt, Pseudomonas putida KT2440
cgggcagugcaauaccagccugg

SEQ ID NO: 1583825 - RNA, 17 nt, Pseudomonas putida KT2440
cgggccaccuugugcgc

SEQ ID NO: 1583826 - RNA, 20 nt, Pseudomonas putida KT2440
cgggcauaacgccccagcag

SEQ ID NO: 1583827 - RNA, 17 nt, Pseudomonas putida KT2440
cgggccucuucgcgggu

SEQ ID NO: 1583828 - RNA, 21 nt, Pseudomonas putida KT2440
cgggauacugcgcacgaauac

SEQ ID NO: 1583829 - RNA, 22 nt, Pseudomonas putida KT2440
cgggauacugcgcacgaauacg

SEQ ID NO: 1583830 - RNA, 20 nt, Pseudomonas putida KT2440
cgggagagcagggcugcgcg

SEQ ID NO: 1583831 - RNA, 19 nt, Pseudomonas putida KT2440
cggcuugaaaucauccaug

SEQ ID NO: 1583832 - RNA, 17 nt, Pseudomonas putida KT2440
cggcuucuaccacuggg

SEQ ID NO: 1583833 - RNA, 19 nt, Pseudomonas putida KT2440
cggcuugcccgggcgcggu

SEQ ID NO: 1583834 - RNA, 12 nt, Pseudomonas putida KT2440
cggcuugccggc

SEQ ID NO: 1583835 - RNA, 23 nt, Pseudomonas putida KT2440
cggcuugccggcaauaccggcca

SEQ ID NO: 1583836 - RNA, 12 nt, Pseudomonas putida KT2440
cggcugagccgg

SEQ ID NO: 1583837 - RNA, 19 nt, Pseudomonas putida KT2440
cggcuucgccgguguucgc

SEQ ID NO: 1583838 - RNA, 21 nt, Pseudomonas putida KT2440
cggcuucgccgguguucgcgg

SEQ ID NO: 1583839 - RNA, 18 nt, Pseudomonas putida KT2440
cgggaacagccgcgcaug

SEQ ID NO: 1583840 - RNA, 20 nt, Pseudomonas putida KT2440
cgggaacagcucuggcagca

SEQ ID NO: 1583841 - RNA, 22 nt, Pseudomonas putida KT2440
cgggaacagcucuggcagcagu

SEQ ID NO: 1583842 - RNA, 18 nt, Pseudomonas putida KT2440
cgggaacaggugcgcgcg

SEQ ID NO: 1583843 - RNA, 13 nt, Pseudomonas putida KT2440
cggcuugcgcccg

SEQ ID NO: 1583844 - RNA, 19 nt, Pseudomonas putida KT2440
cgggacagcaccaugcgcg

SEQ ID NO: 1583845 - RNA, 15 nt, Pseudomonas putida KT2440
cgggaauugcagccc

SEQ ID NO: 1583846 - RNA, 23 nt, Pseudomonas putida KT2440
cggucgaugauggucgcgacgau

SEQ ID NO: 1583847 - RNA, 21 nt, Pseudomonas putida KT2440
cggucgccaaauucgaccagc

SEQ ID NO: 1583848 - RNA, 15 nt, Pseudomonas putida KT2440
cggucgaucuucgcc

SEQ ID NO: 1583849 - RNA, 16 nt, Pseudomonas putida KT2440
cggucgaucuucgccg

SEQ ID NO: 1583850 - RNA, 17 nt, Pseudomonas putida KT2440
cggucgaucuucgccgg

SEQ ID NO: 1583851 - RNA, 19 nt, Pseudomonas putida KT2440
cggucgaucuucgccggca

SEQ ID NO: 1583852 - RNA, 20 nt, Pseudomonas putida KT2440
cggucgaucuucgccggcau

SEQ ID NO: 1583853 - RNA, 13 nt, Pseudomonas putida KT2440
cggucgaucagcu

SEQ ID NO: 1583854 - RNA, 17 nt, Pseudomonas putida KT2440
cggucgcggcggcaacg

SEQ ID NO: 1583855 - RNA, 13 nt, Pseudomonas putida KT2440
cggucggccugca

SEQ ID NO: 1583856 - RNA, 14 nt, Pseudomonas putida KT2440
cggucggccugcac

SEQ ID NO: 1583857 - RNA, 19 nt, Pseudomonas putida KT2440
cggucggccaucgacgugc

SEQ ID NO: 1583858 - RNA, 22 nt, Pseudomonas putida KT2440
cggucggccugcgcuccagcag

SEQ ID NO: 1583859 - RNA, 16 nt, Pseudomonas putida KT2440
cggucgggucgcugcc

SEQ ID NO: 1583860 - RNA, 19 nt, Pseudomonas putida KT2440
cggucguugaucggcuuga

SEQ ID NO: 1583861 - RNA, 19 nt, Pseudomonas putida KT2440
cggucguuacccaccagcu

SEQ ID NO: 1583862 - RNA, 23 nt, Pseudomonas putida KT2440
cggucccgaucuccccaccauca

SEQ ID NO: 1583863 - RNA, 20 nt, Pseudomonas putida KT2440
cggucauggucguguugagc

SEQ ID NO: 1583864 - RNA, 23 nt, Pseudomonas putida KT2440
cggucgaaguauuccagaaucug

SEQ ID NO: 1583865 - RNA, 13 nt, Pseudomonas putida KT2440
cgguccuggucgc

SEQ ID NO: 1583866 - RNA, 19 nt, Pseudomonas putida KT2440
cgguccuggucgcgggcca

SEQ ID NO: 1583867 - RNA, 12 nt, Pseudomonas putida KT2440
cggucagguagc

SEQ ID NO: 1583868 - RNA, 13 nt, Pseudomonas putida KT2440
cggucagguagcc

SEQ ID NO: 1583869 - RNA, 17 nt, Pseudomonas putida KT2440
cggucaguaccuggccg

SEQ ID NO: 1583870 - RNA, 19 nt, Pseudomonas putida KT2440
cggucagugaagcgaggug

SEQ ID NO: 1583871 - RNA, 13 nt, Pseudomonas putida KT2440
cggucaugcccgg

SEQ ID NO: 1583872 - RNA, 14 nt, Pseudomonas putida KT2440
cggucaugcccgga

SEQ ID NO: 1583873 - RNA, 17 nt, Pseudomonas putida KT2440
cggucaugcucagcugg

SEQ ID NO: 1583874 - RNA, 14 nt, Pseudomonas putida KT2440
cggucauacagccc

SEQ ID NO: 1583875 - RNA, 12 nt, Pseudomonas putida KT2440
cggucaggccug

SEQ ID NO: 1583876 - RNA, 17 nt, Pseudomonas putida KT2440
cggucagcggcaguugc

SEQ ID NO: 1583877 - RNA, 15 nt, Pseudomonas putida KT2440
cggucagcauccagc

SEQ ID NO: 1583878 - RNA, 18 nt, Pseudomonas putida KT2440
cggucagcaccuggcagc

SEQ ID NO: 1583879 - RNA, 16 nt, Pseudomonas putida KT2440
cgguagcgcgccugcu

SEQ ID NO: 1583880 - RNA, 14 nt, Pseudomonas putida KT2440
cgguagcggcuggg

SEQ ID NO: 1583881 - RNA, 21 nt, Pseudomonas putida KT2440
cgguagccugguuuucgcucg

SEQ ID NO: 1583882 - RNA, 20 nt, Pseudomonas putida KT2440
cgguaaugcuggugguggcc

SEQ ID NO: 1583883 - RNA, 19 nt, Pseudomonas putida KT2440
cgguacaaaucuucccgcg

SEQ ID NO: 1583884 - RNA, 22 nt, Pseudomonas putida KT2440
cgguaaugaccuggaucgccag

SEQ ID NO: 1583885 - RNA, 23 nt, Pseudomonas putida KT2440
cgguaaagaacaugaucaagcug

SEQ ID NO: 1583886 - RNA, 16 nt, Pseudomonas putida KT2440
cggguuucggugcgcu

SEQ ID NO: 1583887 - RNA, 14 nt, Pseudomonas putida KT2440
cggguuuacccgcg

SEQ ID NO: 1583888 - RNA, 19 nt, Pseudomonas putida KT2440
cggguuuacccgcgaagcg

SEQ ID NO: 1583889 - RNA, 20 nt, Pseudomonas putida KT2440
cggguuuaccugugaaugcg

SEQ ID NO: 1583890 - RNA, 14 nt, Pseudomonas putida KT2440
cggguucacccgcg

SEQ ID NO: 1583891 - RNA, 20 nt, Pseudomonas putida KT2440
cggguucacccgcgaauacg

SEQ ID NO: 1583892 - RNA, 20 nt, Pseudomonas putida KT2440
cggguucacccgcgaaugcg

SEQ ID NO: 1583893 - RNA, 20 nt, Pseudomonas putida KT2440
cggguucacccgcgaaugcu

SEQ ID NO: 1583894 - RNA, 20 nt, Pseudomonas putida KT2440
cggguggaaauuggccagca

SEQ ID NO: 1583895 - RNA, 19 nt, Pseudomonas putida KT2440
cggguggagauuggccagc

SEQ ID NO: 1583896 - RNA, 19 nt, Pseudomonas putida KT2440
cgggugcgggcuccacugc

SEQ ID NO: 1583897 - RNA, 17 nt, Pseudomonas putida KT2440
cggggucgaucuccagg

SEQ ID NO: 1583898 - RNA, 13 nt, Pseudomonas putida KT2440
cgggucagguggc

SEQ ID NO: 1583899 - RNA, 14 nt, Pseudomonas putida KT2440
cggguccgauccgg

SEQ ID NO: 1583900 - RNA, 16 nt, Pseudomonas putida KT2440
cgggucagcucgauca

SEQ ID NO: 1583901 - RNA, 13 nt, Pseudomonas putida KT2440
cgggucaggcgca

SEQ ID NO: 1583902 - RNA, 22 nt, Pseudomonas putida KT2440
cgggucagcagcaccgccacca

SEQ ID NO: 1583903 - RNA, 15 nt, Pseudomonas putida KT2440
cgggucacgcuccuu

SEQ ID NO: 1583904 - RNA, 16 nt, Pseudomonas putida KT2440
cgggucgcacucggca

SEQ ID NO: 1583905 - RNA, 19 nt, Pseudomonas putida KT2440
cgggucgagguggagacca

SEQ ID NO: 1583906 - RNA, 18 nt, Pseudomonas putida KT2440
cgggucgguggcaugcuc

SEQ ID NO: 1583907 - RNA, 18 nt, Pseudomonas putida KT2440
cgggugcaucggcaccga

SEQ ID NO: 1583908 - RNA, 15 nt, Pseudomonas putida KT2440
cggggcgcuccagca

SEQ ID NO: 1583909 - RNA, 14 nt, Pseudomonas putida KT2440
cggggccaggcgcg

SEQ ID NO: 1583910 - RNA, 12 nt, Pseudomonas putida KT2440
cgggcugagccc

SEQ ID NO: 1583911 - RNA, 21 nt, Pseudomonas putida KT2440
cgggccuuugggccaacccgg

SEQ ID NO: 1583912 - RNA, 22 nt, Pseudomonas putida KT2440
cgggcguucagcuugucgacca

SEQ ID NO: 1583913 - RNA, 23 nt, Pseudomonas putida KT2440
cgggcguugaucuguugcugcag

SEQ ID NO: 1583914 - RNA, 17 nt, Pseudomonas putida KT2440
cgggccugcuggcgaag

SEQ ID NO: 1583915 - RNA, 18 nt, Pseudomonas putida KT2440
cgggcuuccagucggccu

SEQ ID NO: 1583916 - RNA, 14 nt, Pseudomonas putida KT2440
cgggcuuacccgcg

SEQ ID NO: 1583917 - RNA, 14 nt, Pseudomonas putida KT2440
cgggcuugcccgcg

SEQ ID NO: 1583918 - RNA, 18 nt, Pseudomonas putida KT2440
cgggcuugcccgcgaaga

SEQ ID NO: 1583919 - RNA, 18 nt, Pseudomonas putida KT2440
cgggcuugcccgcgaagc

SEQ ID NO: 1583920 - RNA, 16 nt, Pseudomonas putida KT2440
cgggcuggcugcccga

SEQ ID NO: 1583921 - RNA, 20 nt, Pseudomonas putida KT2440
cgggcuuuuuuuguuggccu

SEQ ID NO: 1583922 - RNA, 18 nt, Pseudomonas putida KT2440
cgggcuuuggucgcggcg

SEQ ID NO: 1583923 - RNA, 19 nt, Pseudomonas putida KT2440
cgggcuuggcuucggcggc

SEQ ID NO: 1583924 - RNA, 17 nt, Pseudomonas putida KT2440
cggggaauggcccagcc

SEQ ID NO: 1583925 - RNA, 15 nt, Pseudomonas putida KT2440
cggauggugugcagc

SEQ ID NO: 1583926 - RNA, 14 nt, Pseudomonas putida KT2440
cggauggcggugau

SEQ ID NO: 1583927 - RNA, 16 nt, Pseudomonas putida KT2440
cggcaaagguggcacc

SEQ ID NO: 1583928 - RNA, 22 nt, Pseudomonas putida KT2440
cggcaaacagacggugcgccug

SEQ ID NO: 1583929 - RNA, 15 nt, Pseudomonas putida KT2440
cggcaaacgcgguca

SEQ ID NO: 1583930 - RNA, 19 nt, Pseudomonas putida KT2440
cggcaaacgcggucagcag

SEQ ID NO: 1583931 - RNA, 18 nt, Pseudomonas putida KT2440
cggcaacauucaccagcc

SEQ ID NO: 1583932 - RNA, 14 nt, Pseudomonas putida KT2440
cggauaccgggauu

SEQ ID NO: 1583933 - RNA, 17 nt, Pseudomonas putida KT2440
cggauaccgcuggccgc

SEQ ID NO: 1583934 - RNA, 18 nt, Pseudomonas putida KT2440
cggauagcgccgaucagc

SEQ ID NO: 1583935 - RNA, 23 nt, Pseudomonas putida KT2440
cggaucaucuccaugaaggccgg

SEQ ID NO: 1583936 - RNA, 20 nt, Pseudomonas putida KT2440
cggaaucacgcggcgucacc

SEQ ID NO: 1583937 - RNA, 17 nt, Pseudomonas putida KT2440
cggaauccgcacacgcu

SEQ ID NO: 1583938 - RNA, 21 nt, Pseudomonas putida KT2440
cggaauccgcacacgcuccag

SEQ ID NO: 1583939 - RNA, 14 nt, Pseudomonas putida KT2440
cggaaucaccggua

SEQ ID NO: 1583940 - RNA, 18 nt, Pseudomonas putida KT2440
cggaaucaccgguaccgg

SEQ ID NO: 1583941 - RNA, 12 nt, Pseudomonas putida KT2440
cggcaggccgaa

SEQ ID NO: 1583942 - RNA, 15 nt, Pseudomonas putida KT2440
cggcagcgaucagcg

SEQ ID NO: 1583943 - RNA, 18 nt, Pseudomonas putida KT2440
cggcagcaugaacagcgc

SEQ ID NO: 1583944 - RNA, 17 nt, Pseudomonas putida KT2440
cggcagcaucgaccugc

SEQ ID NO: 1583945 - RNA, 16 nt, Pseudomonas putida KT2440
cggcagauccugcagc

SEQ ID NO: 1583946 - RNA, 22 nt, Pseudomonas putida KT2440
cggcagaggcguagcaagcaga

SEQ ID NO: 1583947 - RNA, 13 nt, Pseudomonas putida KT2440
cggcagagcgcca

SEQ ID NO: 1583948 - RNA, 14 nt, Pseudomonas putida KT2440
cggcagagcgccag

SEQ ID NO: 1583949 - RNA, 23 nt, Pseudomonas putida KT2440
cggcagcaaacccgacaacagcu

SEQ ID NO: 1583950 - RNA, 17 nt, Pseudomonas putida KT2440
cggcagcacccgcuugg

SEQ ID NO: 1583951 - RNA, 22 nt, Pseudomonas putida KT2440
cggcagcacccgcuuggccacc

SEQ ID NO: 1583952 - RNA, 22 nt, Pseudomonas putida KT2440
cggcacuguaggcaaacagcuc

SEQ ID NO: 1583953 - RNA, 19 nt, Pseudomonas putida KT2440
cggcacuucguuacccucg

SEQ ID NO: 1583954 - RNA, 13 nt, Pseudomonas putida KT2440
cggcacgcgccag

SEQ ID NO: 1583955 - RNA, 19 nt, Pseudomonas putida KT2440
cggcacgcgccagcagcgc

SEQ ID NO: 1583956 - RNA, 17 nt, Pseudomonas putida KT2440
cggcaccucguccaggu

SEQ ID NO: 1583957 - RNA, 16 nt, Pseudomonas putida KT2440
cggcaccugcuugccg

SEQ ID NO: 1583958 - RNA, 22 nt, Pseudomonas putida KT2440
cggcaccugcuugccgcuggca

SEQ ID NO: 1583959 - RNA, 16 nt, Pseudomonas putida KT2440
cggcaccgucgccugc

SEQ ID NO: 1583960 - RNA, 17 nt, Pseudomonas putida KT2440
cggcaccgccauggucg

SEQ ID NO: 1583961 - RNA, 21 nt, Pseudomonas putida KT2440
cggcaccgccauggucgcguu

SEQ ID NO: 1583962 - RNA, 14 nt, Pseudomonas putida KT2440
cggcaccgccagcu

SEQ ID NO: 1583963 - RNA, 23 nt, Pseudomonas putida KT2440
cggcaccccuuucuccagcaaca

SEQ ID NO: 1583964 - RNA, 20 nt, Pseudomonas putida KT2440
cggcaccaccgauucgcgca

SEQ ID NO: 1583965 - RNA, 14 nt, Pseudomonas putida KT2440
cggcaccgaaggca

SEQ ID NO: 1583966 - RNA, 14 nt, Pseudomonas putida KT2440
cggcaacgccagca

SEQ ID NO: 1583967 - RNA, 15 nt, Pseudomonas putida KT2440
cggcaacgccagcaa

SEQ ID NO: 1583968 - RNA, 20 nt, Pseudomonas putida KT2440
cggcaacccuucggccagca

SEQ ID NO: 1583969 - RNA, 22 nt, Pseudomonas putida KT2440
cggcaacccuucggccagcagu

SEQ ID NO: 1583970 - RNA, 17 nt, Pseudomonas putida KT2440
cggcacagaccgcaaca

SEQ ID NO: 1583971 - RNA, 19 nt, Pseudomonas putida KT2440
cggcacacgguuuccaggc

SEQ ID NO: 1583972 - RNA, 13 nt, Pseudomonas putida KT2440
cggcacagugcca

SEQ ID NO: 1583973 - RNA, 13 nt, Pseudomonas putida KT2440
cggcaauggccgg

SEQ ID NO: 1583974 - RNA, 12 nt, Pseudomonas putida KT2440
cggcaauggcgg

SEQ ID NO: 1583975 - RNA, 18 nt, Pseudomonas putida KT2440
cggcaauucgccggcagc

SEQ ID NO: 1583976 - RNA, 23 nt, Pseudomonas putida KT2440
cggcacaaccgaacccgcugcca

SEQ ID NO: 1583977 - RNA, 14 nt, Pseudomonas putida KT2440
cggccagcgacccu

SEQ ID NO: 1583978 - RNA, 19 nt, Pseudomonas putida KT2440
cggccagcgauaaaccagc

SEQ ID NO: 1583979 - RNA, 15 nt, Pseudomonas putida KT2440
cggccagcgccugca

SEQ ID NO: 1583980 - RNA, 20 nt, Pseudomonas putida KT2440
cggccagcugcugcggcacc

SEQ ID NO: 1583981 - RNA, 14 nt, Pseudomonas putida KT2440
cggccagcugcgca

SEQ ID NO: 1583982 - RNA, 21 nt, Pseudomonas putida KT2440
cggccaucgacgugcuuggca

SEQ ID NO: 1583983 - RNA, 15 nt, Pseudomonas putida KT2440
cggccauggguguca

SEQ ID NO: 1583984 - RNA, 23 nt, Pseudomonas putida KT2440
cggccauccugcuguagcgccca

SEQ ID NO: 1583985 - RNA, 19 nt, Pseudomonas putida KT2440
cggcccccacgccgaccgc

SEQ ID NO: 1583986 - RNA, 12 nt, Pseudomonas putida KT2440
cggccccagggu

SEQ ID NO: 1583987 - RNA, 14 nt, Pseudomonas putida KT2440
cggccccaggugcc

SEQ ID NO: 1583988 - RNA, 13 nt, Pseudomonas putida KT2440
cggccccaguggc

SEQ ID NO: 1583989 - RNA, 23 nt, Pseudomonas putida KT2440
cggcccagcccaguagaucgcgc

SEQ ID NO: 1583990 - RNA, 20 nt, Pseudomonas putida KT2440
cggccaccggccacgcgcag

SEQ ID NO: 1583991 - RNA, 15 nt, Pseudomonas putida KT2440
cggccaccacccgcu

SEQ ID NO: 1583992 - RNA, 12 nt, Pseudomonas putida KT2440
cggccaccagcc

SEQ ID NO: 1583993 - RNA, 21 nt, Pseudomonas putida KT2440
cggccagcacuacgccggcca

SEQ ID NO: 1583994 - RNA, 17 nt, Pseudomonas putida KT2440
cggccagcaggucagca

SEQ ID NO: 1583995 - RNA, 15 nt, Pseudomonas putida KT2440
cggccagcagguuga

SEQ ID NO: 1583996 - RNA, 20 nt, Pseudomonas putida KT2440
cggccagcaggccauacagg

SEQ ID NO: 1583997 - RNA, 19 nt, Pseudomonas putida KT2440
cggccagcaggacgauacc

SEQ ID NO: 1583998 - RNA, 16 nt, Pseudomonas putida KT2440
cggccagccagcagcg

SEQ ID NO: 1583999 - RNA, 18 nt, Pseudomonas putida KT2440
cggccacuucgcggaagg

SEQ ID NO: 1584000 - RNA, 21 nt, Pseudomonas putida KT2440
cggccagaccuugcgcacggc

SEQ ID NO: 1584001 - RNA, 19 nt, Pseudomonas putida KT2440
cggccagcaccgaaccggc

SEQ ID NO: 1584002 - RNA, 22 nt, Pseudomonas putida KT2440
cggccagcaccgaaccggcgau

SEQ ID NO: 1584003 - RNA, 14 nt, Pseudomonas putida KT2440
cggcaucgcugccg

SEQ ID NO: 1584004 - RNA, 15 nt, Pseudomonas putida KT2440
cggcaucgcugccgg

SEQ ID NO: 1584005 - RNA, 13 nt, Pseudomonas putida KT2440
cggcaggcuggca

SEQ ID NO: 1584006 - RNA, 15 nt, Pseudomonas putida KT2440
cggcaggcgcagcug

SEQ ID NO: 1584007 - RNA, 14 nt, Pseudomonas putida KT2440
cggcaggcuggcgu

SEQ ID NO: 1584008 - RNA, 11 nt, Pseudomonas putida KT2440
cggcagggccg

SEQ ID NO: 1584009 - RNA, 21 nt, Pseudomonas putida KT2440
cggccaaguacaaacgccaga

SEQ ID NO: 1584010 - RNA, 15 nt, Pseudomonas putida KT2440
cggccaaucgaucug

SEQ ID NO: 1584011 - RNA, 18 nt, Pseudomonas putida KT2440
cggccaaucgcggccgaa

SEQ ID NO: 1584012 - RNA, 19 nt, Pseudomonas putida KT2440
cggccaaugcacgccuguc

SEQ ID NO: 1584013 - RNA, 21 nt, Pseudomonas putida KT2440
cggccacacgggcguucagcu

SEQ ID NO: 1584014 - RNA, 18 nt, Pseudomonas putida KT2440
cggccaccacacugguca

SEQ ID NO: 1584015 - RNA, 23 nt, Pseudomonas putida KT2440
cggcaugaacacauacccggcca

SEQ ID NO: 1584016 - RNA, 16 nt, Pseudomonas putida KT2440
cggcaucugccggguc

SEQ ID NO: 1584017 - RNA, 22 nt, Pseudomonas putida KT2440
cggcaugaucagcuugaucugg

SEQ ID NO: 1584018 - RNA, 21 nt, Pseudomonas putida KT2440
cggcauguagccacgcugcca

SEQ ID NO: 1584019 - RNA, 17 nt, Pseudomonas putida KT2440
cggccugcgcccgauca

SEQ ID NO: 1584020 - RNA, 20 nt, Pseudomonas putida KT2440
cggccugcgcuccagcagcu

SEQ ID NO: 1584021 - RNA, 12 nt, Pseudomonas putida KT2440
cggccgugcagg

SEQ ID NO: 1584022 - RNA, 14 nt, Pseudomonas putida KT2440
cggccgucgguaaa

SEQ ID NO: 1584023 - RNA, 16 nt, Pseudomonas putida KT2440
cggccuguuuggccgc

SEQ ID NO: 1584024 - RNA, 17 nt, Pseudomonas putida KT2440
cggccuguuuggccgca

SEQ ID NO: 1584025 - RNA, 15 nt, Pseudomonas putida KT2440
cggccuguugcgcac

SEQ ID NO: 1584026 - RNA, 15 nt, Pseudomonas putida KT2440
cggccuguggguaac

SEQ ID NO: 1584027 - RNA, 14 nt, Pseudomonas putida KT2440
cggccugggcaggu

SEQ ID NO: 1584028 - RNA, 21 nt, Pseudomonas putida KT2440
cggccuucguaguaauggccg

SEQ ID NO: 1584029 - RNA, 22 nt, Pseudomonas putida KT2440
cggccuucguaguaauggccga

SEQ ID NO: 1584030 - RNA, 17 nt, Pseudomonas putida KT2440
cggccuucagggccggu

SEQ ID NO: 1584031 - RNA, 12 nt, Pseudomonas putida KT2440
cggccuugcgcu

SEQ ID NO: 1584032 - RNA, 19 nt, Pseudomonas putida KT2440
cggccuugcgcugggcauc

SEQ ID NO: 1584033 - RNA, 24 nt, Pseudomonas putida KT2440
cggccuugccguuccucaagcggc

SEQ ID NO: 1584034 - RNA, 10 nt, Pseudomonas putida KT2440
cggccuugcg

SEQ ID NO: 1584035 - RNA, 20 nt, Pseudomonas putida KT2440
cggccuugccgcuggcgaug

SEQ ID NO: 1584036 - RNA, 17 nt, Pseudomonas putida KT2440
cggccuucuucgguggc

SEQ ID NO: 1584037 - RNA, 19 nt, Pseudomonas putida KT2440
cggcgaacacagcggccuu

SEQ ID NO: 1584038 - RNA, 20 nt, Pseudomonas putida KT2440
cggcgaacagcacugccagc

SEQ ID NO: 1584039 - RNA, 15 nt, Pseudomonas putida KT2440
cggcgacagggcgaa

SEQ ID NO: 1584040 - RNA, 14 nt, Pseudomonas putida KT2440
cggcgacaggugcc

SEQ ID NO: 1584041 - RNA, 23 nt, Pseudomonas putida KT2440
cggcgaagucacaccaucggccg

SEQ ID NO: 1584042 - RNA, 14 nt, Pseudomonas putida KT2440
cggcgacggcgagg

SEQ ID NO: 1584043 - RNA, 15 nt, Pseudomonas putida KT2440
cggcgacgcggugcu

SEQ ID NO: 1584044 - RNA, 17 nt, Pseudomonas putida KT2440
cggcgacgcggugcucg

SEQ ID NO: 1584045 - RNA, 18 nt, Pseudomonas putida KT2440
cggccgaugccagguaca

SEQ ID NO: 1584046 - RNA, 16 nt, Pseudomonas putida KT2440
cggccgggucgaaggc

SEQ ID NO: 1584047 - RNA, 21 nt, Pseudomonas putida KT2440
cggccggugguaauuggccgg

SEQ ID NO: 1584048 - RNA, 15 nt, Pseudomonas putida KT2440
cggccgucaacgagg

SEQ ID NO: 1584049 - RNA, 21 nt, Pseudomonas putida KT2440
cggccgucaacgaggccgcca

SEQ ID NO: 1584050 - RNA, 13 nt, Pseudomonas putida KT2440
cggccggggccug

SEQ ID NO: 1584051 - RNA, 15 nt, Pseudomonas putida KT2440
cggccggggccaggc

SEQ ID NO: 1584052 - RNA, 17 nt, Pseudomonas putida KT2440
cggccggggcaaccugg

SEQ ID NO: 1584053 - RNA, 18 nt, Pseudomonas putida KT2440
cggccggggcaaccuggg

SEQ ID NO: 1584054 - RNA, 16 nt, Pseudomonas putida KT2440
cggcgccgugcuacgg

SEQ ID NO: 1584055 - RNA, 14 nt, Pseudomonas putida KT2440
cggcgccuccagca

SEQ ID NO: 1584056 - RNA, 18 nt, Pseudomonas putida KT2440
cggcgccugugaucgagc

SEQ ID NO: 1584057 - RNA, 12 nt, Pseudomonas putida KT2440
cggcgcgcagcg

SEQ ID NO: 1584058 - RNA, 22 nt, Pseudomonas putida KT2440
cggcgcgcaacagcaaggcauc

SEQ ID NO: 1584059 - RNA, 19 nt, Pseudomonas putida KT2440
cggcgcgaaucagcgccuc

SEQ ID NO: 1584060 - RNA, 15 nt, Pseudomonas putida KT2440
cggcgcgaucaucga

SEQ ID NO: 1584061 - RNA, 20 nt, Pseudomonas putida KT2440
cggcgcgaucaucgaagcca

SEQ ID NO: 1584062 - RNA, 13 nt, Pseudomonas putida KT2440
cggcgccagcagu

SEQ ID NO: 1584063 - RNA, 23 nt, Pseudomonas putida KT2440
cggcgccgaacgaauagccgguc

SEQ ID NO: 1584064 - RNA, 19 nt, Pseudomonas putida KT2440
cggcgccgaccgaaccggc

SEQ ID NO: 1584065 - RNA, 20 nt, Pseudomonas putida KT2440
cggcgaucgacaccuaucag

SEQ ID NO: 1584066 - RNA, 12 nt, Pseudomonas putida KT2440
cggcgaucagcg

SEQ ID NO: 1584067 - RNA, 13 nt, Pseudomonas putida KT2440
cggcgacgucguu

SEQ ID NO: 1584068 - RNA, 15 nt, Pseudomonas putida KT2440
cggcgauggucaacc

SEQ ID NO: 1584069 - RNA, 22 nt, Pseudomonas putida KT2440
cggcgcagcauaugcuggucgc

SEQ ID NO: 1584070 - RNA, 21 nt, Pseudomonas putida KT2440
cggcgcaauccgugagccagg

SEQ ID NO: 1584071 - RNA, 14 nt, Pseudomonas putida KT2440
cgcugguaagccuc

SEQ ID NO: 1584072 - RNA, 18 nt, Pseudomonas putida KT2440
cgcugguaagccucgagc

SEQ ID NO: 1584073 - RNA, 22 nt, Pseudomonas putida KT2440
cgcuggucaaucugugaggcca

SEQ ID NO: 1584074 - RNA, 16 nt, Pseudomonas putida KT2440
cgcuggcuuguccuug

SEQ ID NO: 1584075 - RNA, 14 nt, Pseudomonas putida KT2440
cgcuggcugccgcg

SEQ ID NO: 1584076 - RNA, 22 nt, Pseudomonas putida KT2440
cgcuggcuggcagcugcagugc

SEQ ID NO: 1584077 - RNA, 19 nt, Pseudomonas putida KT2440
cgcuggcuuccucacggca

SEQ ID NO: 1584078 - RNA, 23 nt, Pseudomonas putida KT2440
cgcuggcuuccucacggcagugc

SEQ ID NO: 1584079 - RNA, 18 nt, Pseudomonas putida KT2440
cgcugucuuccagggcaa

SEQ ID NO: 1584080 - RNA, 18 nt, Pseudomonas putida KT2440
cgcugucuucugccagag

SEQ ID NO: 1584081 - RNA, 14 nt, Pseudomonas putida KT2440
cgcugucaccggua

SEQ ID NO: 1584082 - RNA, 23 nt, Pseudomonas putida KT2440
cgcugucaccgguaucgaugcac

SEQ ID NO: 1584083 - RNA, 19 nt, Pseudomonas putida KT2440
cgcuggcgccugcggcauc

SEQ ID NO: 1584084 - RNA, 21 nt, Pseudomonas putida KT2440
cgcugcgcaugaaacucgcgc

SEQ ID NO: 1584085 - RNA, 22 nt, Pseudomonas putida KT2440
cgcugcgcaugaaacucgcgcg

SEQ ID NO: 1584086 - RNA, 23 nt, Pseudomonas putida KT2440
cgcugcgaggccccagaccauca

SEQ ID NO: 1584087 - RNA, 22 nt, Pseudomonas putida KT2440
cgcuucccgggcaauggcgcga

SEQ ID NO: 1584088 - RNA, 15 nt, Pseudomonas putida KT2440
cgcuucauggcccca

SEQ ID NO: 1584089 - RNA, 17 nt, Pseudomonas putida KT2440
cgcuucauccagcggga

SEQ ID NO: 1584090 - RNA, 12 nt, Pseudomonas putida KT2440
cgcuuauggcgc

SEQ ID NO: 1584091 - RNA, 13 nt, Pseudomonas putida KT2440
cgcuucggcacgc

SEQ ID NO: 1584092 - RNA, 20 nt, Pseudomonas putida KT2440
cgcuucggcacgcguacccc

SEQ ID NO: 1584093 - RNA, 22 nt, Pseudomonas putida KT2440
cgcuucgaucagcgccugcuca

SEQ ID NO: 1584094 - RNA, 15 nt, Pseudomonas putida KT2440
cgcuuccuggccuuc

SEQ ID NO: 1584095 - RNA, 17 nt, Pseudomonas putida KT2440
cgcuucgaacacccgcu

SEQ ID NO: 1584096 - RNA, 12 nt, Pseudomonas putida KT2440
cgcuucgccagc

SEQ ID NO: 1584097 - RNA, 13 nt, Pseudomonas putida KT2440
cgcuucgccagcg

SEQ ID NO: 1584098 - RNA, 11 nt, Pseudomonas putida KT2440
cgcuucgccgc

SEQ ID NO: 1584099 - RNA, 20 nt, Pseudomonas putida KT2440
cgcuuagcagcuaaggcuga

SEQ ID NO: 1584100 - RNA, 15 nt, Pseudomonas putida KT2440
cgcugugcaacagcg

SEQ ID NO: 1584101 - RNA, 16 nt, Pseudomonas putida KT2440
cgcugugcaacagcgc

SEQ ID NO: 1584102 - RNA, 17 nt, Pseudomonas putida KT2440
cgcugugcaacagcgcc

SEQ ID NO: 1584103 - RNA, 22 nt, Pseudomonas putida KT2440
cgcugugcagcgcucgcugccg

SEQ ID NO: 1584104 - RNA, 14 nt, Pseudomonas putida KT2440
cgcugucguccagc

SEQ ID NO: 1584105 - RNA, 19 nt, Pseudomonas putida KT2440
cgcuguggcgcccggcgcu

SEQ ID NO: 1584106 - RNA, 22 nt, Pseudomonas putida KT2440
cgcuguggcgcccggcgcuggu

SEQ ID NO: 1584107 - RNA, 17 nt, Pseudomonas putida KT2440
cgcugugggaguaacgg

SEQ ID NO: 1584108 - RNA, 13 nt, Pseudomonas putida KT2440
cgcugugcgugau

SEQ ID NO: 1584109 - RNA, 21 nt, Pseudomonas putida KT2440
cgcuguucagcccuugcugca

SEQ ID NO: 1584110 - RNA, 23 nt, Pseudomonas putida KT2440
cggaacaggaucagcggcuuguu

SEQ ID NO: 1584111 - RNA, 22 nt, Pseudomonas putida KT2440
cggaacauacgcaucagcgcag

SEQ ID NO: 1584112 - RNA, 22 nt, Pseudomonas putida KT2440
cggaacaucgaggcgcgcgccu

SEQ ID NO: 1584113 - RNA, 15 nt, Pseudomonas putida KT2440
cggaagauacccgcc

SEQ ID NO: 1584114 - RNA, 21 nt, Pseudomonas putida KT2440
cggaacuaaaccggugaagcg

SEQ ID NO: 1584115 - RNA, 21 nt, Pseudomonas putida KT2440
cggaaggccucacgcaucugc

SEQ ID NO: 1584116 - RNA, 18 nt, Pseudomonas putida KT2440
cgcuuuccagcuguacgc

SEQ ID NO: 1584117 - RNA, 13 nt, Pseudomonas putida KT2440
cgcuuucagccga

SEQ ID NO: 1584118 - RNA, 18 nt, Pseudomonas putida KT2440
cgcuuguucggacccuac

SEQ ID NO: 1584119 - RNA, 18 nt, Pseudomonas putida KT2440
cgcuuuccaaaccugcga

SEQ ID NO: 1584120 - RNA, 22 nt, Pseudomonas putida KT2440
cgcuugcuguguuaccagucca

SEQ ID NO: 1584121 - RNA, 23 nt, Pseudomonas putida KT2440
cgcuuggccagacucagcugcug

SEQ ID NO: 1584122 - RNA, 23 nt, Pseudomonas putida KT2440
cgcuuggcguaauccagcugcug

SEQ ID NO: 1584123 - RNA, 20 nt, Pseudomonas putida KT2440
cgcuuggcucaucaccggcg

SEQ ID NO: 1584124 - RNA, 21 nt, Pseudomonas putida KT2440
cgcuuugugcacaagcugcug

SEQ ID NO: 1584125 - RNA, 22 nt, Pseudomonas putida KT2440
cgcuuugugcacaagcugcuga

SEQ ID NO: 1584126 - RNA, 19 nt, Pseudomonas putida KT2440
cgcuuugcacccgcgcgcu

SEQ ID NO: 1584127 - RNA, 16 nt, Pseudomonas putida KT2440
cgcuuuggcagcagcc

SEQ ID NO: 1584128 - RNA, 22 nt, Pseudomonas putida KT2440
cgcuuuggcagcagccucggcc

SEQ ID NO: 1584129 - RNA, 22 nt, Pseudomonas putida KT2440
cgcuugccuuccucggccaugc

SEQ ID NO: 1584130 - RNA, 17 nt, Pseudomonas putida KT2440
cgcuugagaccaggccu

SEQ ID NO: 1584131 - RNA, 18 nt, Pseudomonas putida KT2440
cgcuugcaguuguccagg

SEQ ID NO: 1584132 - RNA, 22 nt, Pseudomonas putida KT2440
cgcuuggaguugcucgagugcg

SEQ ID NO: 1584133 - RNA, 13 nt, Pseudomonas putida KT2440
cgcuucguccagg

SEQ ID NO: 1584134 - RNA, 13 nt, Pseudomonas putida KT2440
cgcuucgugcagg

SEQ ID NO: 1584135 - RNA, 14 nt, Pseudomonas putida KT2440
cgcuucuuugcgau

SEQ ID NO: 1584136 - RNA, 17 nt, Pseudomonas putida KT2440
cgcuugacccggugcac

SEQ ID NO: 1584137 - RNA, 17 nt, Pseudomonas putida KT2440
cgcuacgagagaucgca

SEQ ID NO: 1584138 - RNA, 18 nt, Pseudomonas putida KT2440
cgcuacgacccaccgacc

SEQ ID NO: 1584139 - RNA, 18 nt, Pseudomonas putida KT2440
cgcuacggcgucgacacc

SEQ ID NO: 1584140 - RNA, 17 nt, Pseudomonas putida KT2440
cgcuagucaagcugcgc

SEQ ID NO: 1584141 - RNA, 19 nt, Pseudomonas putida KT2440
cgcuagucaagcugcgccg

SEQ ID NO: 1584142 - RNA, 22 nt, Pseudomonas putida KT2440
cgcucaccguucuucuccaaca

SEQ ID NO: 1584143 - RNA, 12 nt, Pseudomonas putida KT2440
cgcucaggcggc

SEQ ID NO: 1584144 - RNA, 20 nt, Pseudomonas putida KT2440
cgcucagaaucagcuugcca

SEQ ID NO: 1584145 - RNA, 17 nt, Pseudomonas putida KT2440
cgcucagccgauacgcu

SEQ ID NO: 1584146 - RNA, 22 nt, Pseudomonas putida KT2440
cgcucacaaagcccuugucgaa

SEQ ID NO: 1584147 - RNA, 20 nt, Pseudomonas putida KT2440
cgcucaaauggguacgcacc

SEQ ID NO: 1584148 - RNA, 15 nt, Pseudomonas putida KT2440
cgcucaagcgugacg

SEQ ID NO: 1584149 - RNA, 20 nt, Pseudomonas putida KT2440
cgcucaagcgaggugacugc

SEQ ID NO: 1584150 - RNA, 20 nt, Pseudomonas putida KT2440
cgcucaacuccauggccagg

SEQ ID NO: 1584151 - RNA, 23 nt, Pseudomonas putida KT2440
cgcucaacuggcucaugcgccag

SEQ ID NO: 1584152 - RNA, 21 nt, Pseudomonas putida KT2440
cgcgugcggggcaucgccgag

SEQ ID NO: 1584153 - RNA, 16 nt, Pseudomonas putida KT2440
cgcgguucaccagcag

SEQ ID NO: 1584154 - RNA, 22 nt, Pseudomonas putida KT2440
cgcuacaagccggcgcucagcg

SEQ ID NO: 1584155 - RNA, 16 nt, Pseudomonas putida KT2440
cgcuaaguuugcccag

SEQ ID NO: 1584156 - RNA, 20 nt, Pseudomonas putida KT2440
cgcuaaguuugcccagcgcu

SEQ ID NO: 1584157 - RNA, 18 nt, Pseudomonas putida KT2440
cgcgugcuugugcuccca

SEQ ID NO: 1584158 - RNA, 13 nt, Pseudomonas putida KT2440
cgcugaacacgcc

SEQ ID NO: 1584159 - RNA, 22 nt, Pseudomonas putida KT2440
cgcucgugacagguaggcgcca

SEQ ID NO: 1584160 - RNA, 18 nt, Pseudomonas putida KT2440
cgcucgccggguuccacc

SEQ ID NO: 1584161 - RNA, 22 nt, Pseudomonas putida KT2440
cgcucaggccaugcugcgccag

SEQ ID NO: 1584162 - RNA, 23 nt, Pseudomonas putida KT2440
cgcucaggccaugcugcgccagg

SEQ ID NO: 1584163 - RNA, 16 nt, Pseudomonas putida KT2440
cgcucagguagcgcgc

SEQ ID NO: 1584164 - RNA, 16 nt, Pseudomonas putida KT2440
cgcucgcgcaggaacc

SEQ ID NO: 1584165 - RNA, 17 nt, Pseudomonas putida KT2440
cgcucgcgguucaucgg

SEQ ID NO: 1584166 - RNA, 23 nt, Pseudomonas putida KT2440
cgcugcaaucgagccgaacagca

SEQ ID NO: 1584167 - RNA, 23 nt, Pseudomonas putida KT2440
cgcugcacaggccagccccagcg

SEQ ID NO: 1584168 - RNA, 18 nt, Pseudomonas putida KT2440
cgcugcauggccuggcaa

SEQ ID NO: 1584169 - RNA, 16 nt, Pseudomonas putida KT2440
cgcugccagcagggca

SEQ ID NO: 1584170 - RNA, 14 nt, Pseudomonas putida KT2440
cgcugccaccuucc

SEQ ID NO: 1584171 - RNA, 21 nt, Pseudomonas putida KT2440
cgcugccaccuuccaggucga

SEQ ID NO: 1584172 - RNA, 17 nt, Pseudomonas putida KT2440
cgcugccacccacaggc

SEQ ID NO: 1584173 - RNA, 19 nt, Pseudomonas putida KT2440
cgcugccacccacaggcac

SEQ ID NO: 1584174 - RNA, 19 nt, Pseudomonas putida KT2440
cgcugccauagcgcugcac

SEQ ID NO: 1584175 - RNA, 16 nt, Pseudomonas putida KT2440
cgcugccaugcgcugc

SEQ ID NO: 1584176 - RNA, 17 nt, Pseudomonas putida KT2440
cgcugccaugcgcugca

SEQ ID NO: 1584177 - RNA, 23 nt, Pseudomonas putida KT2440
cgcugcccagcgaauagcaacac

SEQ ID NO: 1584178 - RNA, 19 nt, Pseudomonas putida KT2440
cgcugccggcguggcgagc

SEQ ID NO: 1584179 - RNA, 22 nt, Pseudomonas putida KT2440
cgcugaccgaugaucugccggg

SEQ ID NO: 1584180 - RNA, 15 nt, Pseudomonas putida KT2440
cgcugaugcgccgcu

SEQ ID NO: 1584181 - RNA, 23 nt, Pseudomonas putida KT2440
cgcugcaacacgucauacagccc

SEQ ID NO: 1584182 - RNA, 17 nt, Pseudomonas putida KT2440
cgcgggagacccguucc

SEQ ID NO: 1584183 - RNA, 20 nt, Pseudomonas putida KT2440
cgcgggcacgcccgcuccca

SEQ ID NO: 1584184 - RNA, 15 nt, Pseudomonas putida KT2440
cgcgggcaagcccgc

SEQ ID NO: 1584185 - RNA, 16 nt, Pseudomonas putida KT2440
cgcgggcaagcccgcg

SEQ ID NO: 1584186 - RNA, 19 nt, Pseudomonas putida KT2440
cgcgggcaagcccgcgaag

SEQ ID NO: 1584187 - RNA, 20 nt, Pseudomonas putida KT2440
cgcgggcaagcccgcuccga

SEQ ID NO: 1584188 - RNA, 20 nt, Pseudomonas putida KT2440
cgcgggcaagcccgcuccua

SEQ ID NO: 1584189 - RNA, 21 nt, Pseudomonas putida KT2440
cgcgggcaagcccgcuccuac

SEQ ID NO: 1584190 - RNA, 15 nt, Pseudomonas putida KT2440
cgcgggcaauggcca

SEQ ID NO: 1584191 - RNA, 17 nt, Pseudomonas putida KT2440
cgcgggaagcccguaca

SEQ ID NO: 1584192 - RNA, 21 nt, Pseudomonas putida KT2440
cgcggcuggugucggccaggg

SEQ ID NO: 1584193 - RNA, 13 nt, Pseudomonas putida KT2440
cgcgggcggcgcu

SEQ ID NO: 1584194 - RNA, 20 nt, Pseudomonas putida KT2440
cgcgggcgcgcccgcuccca

SEQ ID NO: 1584195 - RNA, 12 nt, Pseudomonas putida KT2440
cgcgggccuucu

SEQ ID NO: 1584196 - RNA, 14 nt, Pseudomonas putida KT2440
cgcgggcaugcccg

SEQ ID NO: 1584197 - RNA, 20 nt, Pseudomonas putida KT2440
cgcgggcaugcccgcuccca

SEQ ID NO: 1584198 - RNA, 13 nt, Pseudomonas putida KT2440
cgcgggccaaggu

SEQ ID NO: 1584199 - RNA, 18 nt, Pseudomonas putida KT2440
cgcgggccaaggucagca

SEQ ID NO: 1584200 - RNA, 21 nt, Pseudomonas putida KT2440
cgcggucgccgugcaacgccg

SEQ ID NO: 1584201 - RNA, 21 nt, Pseudomonas putida KT2440
cgcggugauggcgcauggccu

SEQ ID NO: 1584202 - RNA, 13 nt, Pseudomonas putida KT2440
cgcggugcucgau

SEQ ID NO: 1584203 - RNA, 20 nt, Pseudomonas putida KT2440
cgcggggugaucgccucgug

SEQ ID NO: 1584204 - RNA, 20 nt, Pseudomonas putida KT2440
cgcggguaaacccgccccua

SEQ ID NO: 1584205 - RNA, 20 nt, Pseudomonas putida KT2440
cgcggguaaacccgcgccua

SEQ ID NO: 1584206 - RNA, 23 nt, Pseudomonas putida KT2440
cgcggguaaacccgcgccuacaa

SEQ ID NO: 1584207 - RNA, 21 nt, Pseudomonas putida KT2440
cgcggguaaacccgcucccac

SEQ ID NO: 1584208 - RNA, 21 nt, Pseudomonas putida KT2440
cgcggguaaacccgcuccuac

SEQ ID NO: 1584209 - RNA, 13 nt, Pseudomonas putida KT2440
cgcgguaccugga

SEQ ID NO: 1584210 - RNA, 20 nt, Pseudomonas putida KT2440
cgcgguaccuguggggcaac

SEQ ID NO: 1584211 - RNA, 18 nt, Pseudomonas putida KT2440
cgcgguacaccgggaaca

SEQ ID NO: 1584212 - RNA, 15 nt, Pseudomonas putida KT2440
cgcggcgcaucgcga

SEQ ID NO: 1584213 - RNA, 22 nt, Pseudomonas putida KT2440
cgcggccgggcuucaaacccgg

SEQ ID NO: 1584214 - RNA, 16 nt, Pseudomonas putida KT2440
cgcggccgggucgaag

SEQ ID NO: 1584215 - RNA, 20 nt, Pseudomonas putida KT2440
cgcggccgccuccugcugcu

SEQ ID NO: 1584216 - RNA, 24 nt, Pseudomonas putida KT2440
cgcggccccagauucuggcaggca

SEQ ID NO: 1584217 - RNA, 15 nt, Pseudomonas putida KT2440
cgcggccccagggcu

SEQ ID NO: 1584218 - RNA, 18 nt, Pseudomonas putida KT2440
cgcggcaaagaucgccca

SEQ ID NO: 1584219 - RNA, 12 nt, Pseudomonas putida KT2440
cgcggcuacgcu

SEQ ID NO: 1584220 - RNA, 17 nt, Pseudomonas putida KT2440
cgcggcucgaugcugcg

SEQ ID NO: 1584221 - RNA, 19 nt, Pseudomonas putida KT2440
cgcggcguugucagccuuc

SEQ ID NO: 1584222 - RNA, 21 nt, Pseudomonas putida KT2440
cgcggcggcuaagcgccagca

SEQ ID NO: 1584223 - RNA, 22 nt, Pseudomonas putida KT2440
cgcggcggcuaagcgccagcaa

SEQ ID NO: 1584224 - RNA, 18 nt, Pseudomonas putida KT2440
cgcggcgcgcccugcuca

SEQ ID NO: 1584225 - RNA, 14 nt, Pseudomonas putida KT2440
cgcggcggcaacgg

SEQ ID NO: 1584226 - RNA, 12 nt, Pseudomonas putida KT2440
cgcgcuggccgc

SEQ ID NO: 1584227 - RNA, 17 nt, Pseudomonas putida KT2440
cgcggaagauacccgcc

SEQ ID NO: 1584228 - RNA, 22 nt, Pseudomonas putida KT2440
cgcggaaggccucacgcaucug

SEQ ID NO: 1584229 - RNA, 13 nt, Pseudomonas putida KT2440
cgcggaugcgccu

SEQ ID NO: 1584230 - RNA, 14 nt, Pseudomonas putida KT2440
cgcggaugcgccug

SEQ ID NO: 1584231 - RNA, 22 nt, Pseudomonas putida KT2440
cgcggaugcgccuggcccgcag

SEQ ID NO: 1584232 - RNA, 15 nt, Pseudomonas putida KT2440
cgcgcguugcagcca

SEQ ID NO: 1584233 - RNA, 14 nt, Pseudomonas putida KT2440
cgcgcuaaaggccg

SEQ ID NO: 1584234 - RNA, 22 nt, Pseudomonas putida KT2440
cgcgcuaaaggccgcuccugca

SEQ ID NO: 1584235 - RNA, 13 nt, Pseudomonas putida KT2440
cgcgcucugcgcc

SEQ ID NO: 1584236 - RNA, 12 nt, Pseudomonas putida KT2440
cgcgcgcgaugc

SEQ ID NO: 1584237 - RNA, 13 nt, Pseudomonas putida KT2440
cgcgcgcgaccgc

SEQ ID NO: 1584238 - RNA, 13 nt, Pseudomonas putida KT2440
cgcgcgggugcga

SEQ ID NO: 1584239 - RNA, 18 nt, Pseudomonas putida KT2440
cgcgccgacagccucaag

SEQ ID NO: 1584240 - RNA, 22 nt, Pseudomonas putida KT2440
cgcgcccgcgaagaggccggca

SEQ ID NO: 1584241 - RNA, 22 nt, Pseudomonas putida KT2440
cgcgcccgcggcccacagugcu

SEQ ID NO: 1584242 - RNA, 15 nt, Pseudomonas putida KT2440
cgcgcccgcagugca

SEQ ID NO: 1584243 - RNA, 18 nt, Pseudomonas putida KT2440
cgcgcccgcaaccucggc

SEQ ID NO: 1584244 - RNA, 16 nt, Pseudomonas putida KT2440
cgcgcccaucugcacg

SEQ ID NO: 1584245 - RNA, 22 nt, Pseudomonas putida KT2440
cgcgcccccgcucccacagggg

SEQ ID NO: 1584246 - RNA, 21 nt, Pseudomonas putida KT2440
cgcgccgccgcugcugcgccu

SEQ ID NO: 1584247 - RNA, 13 nt, Pseudomonas putida KT2440
cgcgccgcgccca

SEQ ID NO: 1584248 - RNA, 15 nt, Pseudomonas putida KT2440
cgcgccggcgucgau

SEQ ID NO: 1584249 - RNA, 19 nt, Pseudomonas putida KT2440
cgcgccggcgucgaucugc

SEQ ID NO: 1584250 - RNA, 14 nt, Pseudomonas putida KT2440
cgcgcgaugcgccg

SEQ ID NO: 1584251 - RNA, 23 nt, Pseudomonas putida KT2440
cgcgccucgaucccgccgccaga

SEQ ID NO: 1584252 - RNA, 22 nt, Pseudomonas putida KT2440
cgcgccuugauacgcccaucca

SEQ ID NO: 1584253 - RNA, 17 nt, Pseudomonas putida KT2440
cgcgccuugcgccaggu

SEQ ID NO: 1584254 - RNA, 14 nt, Pseudomonas putida KT2440
cgcgccuucgcugg

SEQ ID NO: 1584255 - RNA, 17 nt, Pseudomonas putida KT2440
cgcgccuucgcuggcga

SEQ ID NO: 1584256 - RNA, 20 nt, Pseudomonas putida KT2440
cgcgccuucauaggcggcca

SEQ ID NO: 1584257 - RNA, 15 nt, Pseudomonas putida KT2440
cgcgccuggcucgau

SEQ ID NO: 1584258 - RNA, 21 nt, Pseudomonas putida KT2440
cgccguccaccaucuccagcu

SEQ ID NO: 1584259 - RNA, 17 nt, Pseudomonas putida KT2440
cgccguccagcaggcug

SEQ ID NO: 1584260 - RNA, 16 nt, Pseudomonas putida KT2440
cgccgucaucaccacu

SEQ ID NO: 1584261 - RNA, 17 nt, Pseudomonas putida KT2440
cgccgucaccagcguca

SEQ ID NO: 1584262 - RNA, 16 nt, Pseudomonas putida KT2440
cgccguauucggcggu

SEQ ID NO: 1584263 - RNA, 17 nt, Pseudomonas putida KT2440
cgccgguuucucgcagc

SEQ ID NO: 1584264 - RNA, 20 nt, Pseudomonas putida KT2440
cgccgguuucucgcagcagc

SEQ ID NO: 1584265 - RNA, 20 nt, Pseudomonas putida KT2440
cgccgggcacaucaccagca

SEQ ID NO: 1584266 - RNA, 13 nt, Pseudomonas putida KT2440
cgccgggcccagg

SEQ ID NO: 1584267 - RNA, 15 nt, Pseudomonas putida KT2440
cgccggguuccacca

SEQ ID NO: 1584268 - RNA, 17 nt, Pseudomonas putida KT2440
cgccgugcucggccuug

SEQ ID NO: 1584269 - RNA, 15 nt, Pseudomonas putida KT2440
cgccguguucccagc

SEQ ID NO: 1584270 - RNA, 18 nt, Pseudomonas putida KT2440
cgccguucacuguugccg

SEQ ID NO: 1584271 - RNA, 21 nt, Pseudomonas putida KT2440
cgccguugaaagacugcuccg

SEQ ID NO: 1584272 - RNA, 15 nt, Pseudomonas putida KT2440
cgccgugccaggugu

SEQ ID NO: 1584273 - RNA, 19 nt, Pseudomonas putida KT2440
cgccgugccggucacuggc

SEQ ID NO: 1584274 - RNA, 14 nt, Pseudomonas putida KT2440
cgccgucgaccuug

SEQ ID NO: 1584275 - RNA, 13 nt, Pseudomonas putida KT2440
cgccucacagcgc

SEQ ID NO: 1584276 - RNA, 15 nt, Pseudomonas putida KT2440
cgccucacagcgccg

SEQ ID NO: 1584277 - RNA, 22 nt, Pseudomonas putida KT2440
cgccucagcgccaauaccgcgc

SEQ ID NO: 1584278 - RNA, 15 nt, Pseudomonas putida KT2440
cgccucauccucgcc

SEQ ID NO: 1584279 - RNA, 15 nt, Pseudomonas putida KT2440
cgccuccacggucag

SEQ ID NO: 1584280 - RNA, 22 nt, Pseudomonas putida KT2440
cgccucgaucgucgacaacgca

SEQ ID NO: 1584281 - RNA, 14 nt, Pseudomonas putida KT2440
cgccucgcagguaa

SEQ ID NO: 1584282 - RNA, 20 nt, Pseudomonas putida KT2440
cgccucgaucauuuccggca

SEQ ID NO: 1584283 - RNA, 12 nt, Pseudomonas putida KT2440
cgccugcgcacg

SEQ ID NO: 1584284 - RNA, 19 nt, Pseudomonas putida KT2440
cgccugcgcacggcgcugg

SEQ ID NO: 1584285 - RNA, 14 nt, Pseudomonas putida KT2440
cgccugccgccugu

SEQ ID NO: 1584286 - RNA, 24 nt, Pseudomonas putida KT2440
cgccugccgccuguguucgcugcg

SEQ ID NO: 1584287 - RNA, 17 nt, Pseudomonas putida KT2440
cgccugccgggccaggg

SEQ ID NO: 1584288 - RNA, 17 nt, Pseudomonas putida KT2440
cgccugccgaugggcac

SEQ ID NO: 1584289 - RNA, 21 nt, Pseudomonas putida KT2440
cgccucguuggcgaagucggc

SEQ ID NO: 1584290 - RNA, 16 nt, Pseudomonas putida KT2440
cgccugaacgcugcgc

SEQ ID NO: 1584291 - RNA, 21 nt, Pseudomonas putida KT2440
cgcgacgaagaugucgaugua

SEQ ID NO: 1584292 - RNA, 14 nt, Pseudomonas putida KT2440
cgcgacgaugauca

SEQ ID NO: 1584293 - RNA, 13 nt, Pseudomonas putida KT2440
cgcgacgcagcag

SEQ ID NO: 1584294 - RNA, 15 nt, Pseudomonas putida KT2440
cgcgacgcagcagcg

SEQ ID NO: 1584295 - RNA, 13 nt, Pseudomonas putida KT2440
cgcgacuccugug

SEQ ID NO: 1584296 - RNA, 18 nt, Pseudomonas putida KT2440
cgcgacuccugugggagc

SEQ ID NO: 1584297 - RNA, 21 nt, Pseudomonas putida KT2440
cgcgacagcguugcuccagcu

SEQ ID NO: 1584298 - RNA, 14 nt, Pseudomonas putida KT2440
cgcgaaugcuccgg

SEQ ID NO: 1584299 - RNA, 17 nt, Pseudomonas putida KT2440
cgcgaaucgccagggcu

SEQ ID NO: 1584300 - RNA, 18 nt, Pseudomonas putida KT2440
cgcgaaugggcugcaaag

SEQ ID NO: 1584301 - RNA, 18 nt, Pseudomonas putida KT2440
cgcgaauacgguagcggc

SEQ ID NO: 1584302 - RNA, 15 nt, Pseudomonas putida KT2440
cgccuuucaggucga

SEQ ID NO: 1584303 - RNA, 20 nt, Pseudomonas putida KT2440
cgccuugucggcacgcgcca

SEQ ID NO: 1584304 - RNA, 13 nt, Pseudomonas putida KT2440
cgccuuggcgcag

SEQ ID NO: 1584305 - RNA, 20 nt, Pseudomonas putida KT2440
cgccugcuuggccgacuggc

SEQ ID NO: 1584306 - RNA, 16 nt, Pseudomonas putida KT2440
cgccuugcuuggcagc

SEQ ID NO: 1584307 - RNA, 13 nt, Pseudomonas putida KT2440
cgccugcuggccg

SEQ ID NO: 1584308 - RNA, 14 nt, Pseudomonas putida KT2440
cgcgaaaagccugc

SEQ ID NO: 1584309 - RNA, 19 nt, Pseudomonas putida KT2440
cgcgaaaagccugcaccag

SEQ ID NO: 1584310 - RNA, 21 nt, Pseudomonas putida KT2440
cgccuuuuccaccagcccuuc

SEQ ID NO: 1584311 - RNA, 15 nt, Pseudomonas putida KT2440
cgcgaaagggccagu

SEQ ID NO: 1584312 - RNA, 19 nt, Pseudomonas putida KT2440
cgcgaaagggccgcaacgc

SEQ ID NO: 1584313 - RNA, 16 nt, Pseudomonas putida KT2440
cgcgaaaggggcgcaa

SEQ ID NO: 1584314 - RNA, 21 nt, Pseudomonas putida KT2440
cgcgaaacacagcaggccaag

SEQ ID NO: 1584315 - RNA, 22 nt, Pseudomonas putida KT2440
cgcgauagggcugcggggcagc

SEQ ID NO: 1584316 - RNA, 19 nt, Pseudomonas putida KT2440
cgcgauaucagcgccagca

SEQ ID NO: 1584317 - RNA, 20 nt, Pseudomonas putida KT2440
cgcgauaucagcgccagcac

SEQ ID NO: 1584318 - RNA, 20 nt, Pseudomonas putida KT2440
cgcgauauucagugcgcagg

SEQ ID NO: 1584319 - RNA, 21 nt, Pseudomonas putida KT2440
cgcgauauucagugcgcaggu

SEQ ID NO: 1584320 - RNA, 19 nt, Pseudomonas putida KT2440
cgcgaucacgcaggcccag

SEQ ID NO: 1584321 - RNA, 21 nt, Pseudomonas putida KT2440
cgcgaucacgcaggcccagca

SEQ ID NO: 1584322 - RNA, 18 nt, Pseudomonas putida KT2440
cgcgagugaugcgguaac

SEQ ID NO: 1584323 - RNA, 22 nt, Pseudomonas putida KT2440
cgcgaguccuccaacucgcgca

SEQ ID NO: 1584324 - RNA, 12 nt, Pseudomonas putida KT2440
cgcgaggcucuu

SEQ ID NO: 1584325 - RNA, 19 nt, Pseudomonas putida KT2440
cgcgagccagaucauggcg

SEQ ID NO: 1584326 - RNA, 20 nt, Pseudomonas putida KT2440
cgcgagccagaucauggcgg

SEQ ID NO: 1584327 - RNA, 20 nt, Pseudomonas putida KT2440
cgcgagcaagcucgcuccua

SEQ ID NO: 1584328 - RNA, 21 nt, Pseudomonas putida KT2440
cgcgagcguuaccaacaguug

SEQ ID NO: 1584329 - RNA, 15 nt, Pseudomonas putida KT2440
cgcgauggauggcac

SEQ ID NO: 1584330 - RNA, 19 nt, Pseudomonas putida KT2440
cgcgaugggcugcaaagca

SEQ ID NO: 1584331 - RNA, 16 nt, Pseudomonas putida KT2440
cgcgauugaucagcgc

SEQ ID NO: 1584332 - RNA, 19 nt, Pseudomonas putida KT2440
cgcgcaaaggcuagcagca

SEQ ID NO: 1584333 - RNA, 18 nt, Pseudomonas putida KT2440
cgcgcaacaccgccagcg

SEQ ID NO: 1584334 - RNA, 13 nt, Pseudomonas putida KT2440
cgcgcaacagcaa

SEQ ID NO: 1584335 - RNA, 20 nt, Pseudomonas putida KT2440
cgccgcagguccaccugguu

SEQ ID NO: 1584336 - RNA, 19 nt, Pseudomonas putida KT2440
cgccgaugaagcaggccga

SEQ ID NO: 1584337 - RNA, 15 nt, Pseudomonas putida KT2440
cgccgcauccucgug

SEQ ID NO: 1584338 - RNA, 18 nt, Pseudomonas putida KT2440
cgccgcaucgccacgggc

SEQ ID NO: 1584339 - RNA, 14 nt, Pseudomonas putida KT2440
cgccgcauccagca

SEQ ID NO: 1584340 - RNA, 18 nt, Pseudomonas putida KT2440
cgccgauagcagcaccga

SEQ ID NO: 1584341 - RNA, 14 nt, Pseudomonas putida KT2440
cgccgauacccgca

SEQ ID NO: 1584342 - RNA, 20 nt, Pseudomonas putida KT2440
cgccgauaccgaacaccagu

SEQ ID NO: 1584343 - RNA, 19 nt, Pseudomonas putida KT2440
cgccgaucgaagcagcagc

SEQ ID NO: 1584344 - RNA, 20 nt, Pseudomonas putida KT2440
cgccgaucgaagcagcagcu

SEQ ID NO: 1584345 - RNA, 21 nt, Pseudomonas putida KT2440
cgccgccacauccagcgccuc

SEQ ID NO: 1584346 - RNA, 14 nt, Pseudomonas putida KT2440
cgccgccaccugcg

SEQ ID NO: 1584347 - RNA, 14 nt, Pseudomonas putida KT2440
cgccgccaccaucg

SEQ ID NO: 1584348 - RNA, 14 nt, Pseudomonas putida KT2440
cgccgccaccagcg

SEQ ID NO: 1584349 - RNA, 16 nt, Pseudomonas putida KT2440
cgccgccaugcagccc

SEQ ID NO: 1584350 - RNA, 20 nt, Pseudomonas putida KT2440
cgccgccucgaacaccugcg

SEQ ID NO: 1584351 - RNA, 17 nt, Pseudomonas putida KT2440
cgccgccuccaccggga

SEQ ID NO: 1584352 - RNA, 16 nt, Pseudomonas putida KT2440
cgccgcucgcccagca

SEQ ID NO: 1584353 - RNA, 17 nt, Pseudomonas putida KT2440
cgccgcucgauaugccg

SEQ ID NO: 1584354 - RNA, 20 nt, Pseudomonas putida KT2440
cgccgcucgauaugccgccg

SEQ ID NO: 1584355 - RNA, 22 nt, Pseudomonas putida KT2440
cgccgcugguacagggucagga

SEQ ID NO: 1584356 - RNA, 18 nt, Pseudomonas putida KT2440
cgccggcaacuggcaucg

SEQ ID NO: 1584357 - RNA, 14 nt, Pseudomonas putida KT2440
cgccggcaagcugg

SEQ ID NO: 1584358 - RNA, 17 nt, Pseudomonas putida KT2440
cgccggcaagcugguca

SEQ ID NO: 1584359 - RNA, 19 nt, Pseudomonas putida KT2440
cgccggcaagcuggucagg

SEQ ID NO: 1584360 - RNA, 19 nt, Pseudomonas putida KT2440
cgccgcgcugauaucgaua

SEQ ID NO: 1584361 - RNA, 15 nt, Pseudomonas putida KT2440
cgccgcggguaccac

SEQ ID NO: 1584362 - RNA, 20 nt, Pseudomonas putida KT2440
cgcccggcaaacacauccac

SEQ ID NO: 1584363 - RNA, 18 nt, Pseudomonas putida KT2440
cgcccgggaucuggccga

SEQ ID NO: 1584364 - RNA, 19 nt, Pseudomonas putida KT2440
cgcccgggaagugguuggc

SEQ ID NO: 1584365 - RNA, 19 nt, Pseudomonas putida KT2440
cgcccgggccaggccccuu

SEQ ID NO: 1584366 - RNA, 13 nt, Pseudomonas putida KT2440
cgcccgggcauca

SEQ ID NO: 1584367 - RNA, 14 nt, Pseudomonas putida KT2440
cgcccguaacgguc

SEQ ID NO: 1584368 - RNA, 22 nt, Pseudomonas putida KT2440
cgcccggauggcggugaugcgc

SEQ ID NO: 1584369 - RNA, 21 nt, Pseudomonas putida KT2440
cgcccgcuuuuggcugugcac

SEQ ID NO: 1584370 - RNA, 15 nt, Pseudomonas putida KT2440
cgcccgcucacgcag

SEQ ID NO: 1584371 - RNA, 18 nt, Pseudomonas putida KT2440
cgcccuccagccgcgaac

SEQ ID NO: 1584372 - RNA, 19 nt, Pseudomonas putida KT2440
cgcccuagaacaggcggcu

SEQ ID NO: 1584373 - RNA, 18 nt, Pseudomonas putida KT2440
cgcccgugcucacgcacg

SEQ ID NO: 1584374 - RNA, 13 nt, Pseudomonas putida KT2440
cgcccgcacagca

SEQ ID NO: 1584375 - RNA, 20 nt, Pseudomonas putida KT2440
cgcccgccguguucccagca

SEQ ID NO: 1584376 - RNA, 13 nt, Pseudomonas putida KT2440
cgcccgccucgcc

SEQ ID NO: 1584377 - RNA, 20 nt, Pseudomonas putida KT2440
cgcccgccgucaucgaaccg

SEQ ID NO: 1584378 - RNA, 17 nt, Pseudomonas putida KT2440
cgcccgcaacaaccugg

SEQ ID NO: 1584379 - RNA, 21 nt, Pseudomonas putida KT2440
cgcccgcaacaaccuggccgg

SEQ ID NO: 1584380 - RNA, 20 nt, Pseudomonas putida KT2440
cgcccgcaacauaaggugca

SEQ ID NO: 1584381 - RNA, 17 nt, Pseudomonas putida KT2440
cgccccggcaauccugg

SEQ ID NO: 1584382 - RNA, 13 nt, Pseudomonas putida KT2440
cgccccggccagu

SEQ ID NO: 1584383 - RNA, 23 nt, Pseudomonas putida KT2440
cgcccgaccuuggcgacauaggc

SEQ ID NO: 1584384 - RNA, 18 nt, Pseudomonas putida KT2440
cgccaugccccccgccag

SEQ ID NO: 1584385 - RNA, 19 nt, Pseudomonas putida KT2440
cgccccgacugguucgggg

SEQ ID NO: 1584386 - RNA, 17 nt, Pseudomonas putida KT2440
cgccccgcaccagacca

SEQ ID NO: 1584387 - RNA, 15 nt, Pseudomonas putida KT2440
cgccgaccagguggu

SEQ ID NO: 1584388 - RNA, 14 nt, Pseudomonas putida KT2440
cgccgagaggcgcu

SEQ ID NO: 1584389 - RNA, 19 nt, Pseudomonas putida KT2440
cgccgaggcguuggccgaa

SEQ ID NO: 1584390 - RNA, 20 nt, Pseudomonas putida KT2440
cgccgaggcguuggccgaag

SEQ ID NO: 1584391 - RNA, 23 nt, Pseudomonas putida KT2440
cgccgaggcguuggccgaaggcc

SEQ ID NO: 1584392 - RNA, 16 nt, Pseudomonas putida KT2440
cgccgagcugaugccg

SEQ ID NO: 1584393 - RNA, 12 nt, Pseudomonas putida KT2440
cgcccuggcggc

SEQ ID NO: 1584394 - RNA, 22 nt, Pseudomonas putida KT2440
cgcccugcaaaggcaugggcca

SEQ ID NO: 1584395 - RNA, 17 nt, Pseudomonas putida KT2440
cgcccucuucgcgggca

SEQ ID NO: 1584396 - RNA, 18 nt, Pseudomonas putida KT2440
cgcccugugggagcggcc

SEQ ID NO: 1584397 - RNA, 11 nt, Pseudomonas putida KT2440
cgccgaacagg

SEQ ID NO: 1584398 - RNA, 18 nt, Pseudomonas putida KT2440
cgccgaccaagcgcccca

SEQ ID NO: 1584399 - RNA, 20 nt, Pseudomonas putida KT2440
cgccgaacuugccgaugaac

SEQ ID NO: 1584400 - RNA, 17 nt, Pseudomonas putida KT2440
cgccgaacgggccacca

SEQ ID NO: 1584401 - RNA, 22 nt, Pseudomonas putida KT2440
ccgucgccggccggcucgccau

SEQ ID NO: 1584402 - RNA, 16 nt, Pseudomonas putida KT2440
ccgucgccgcuucggc

SEQ ID NO: 1584403 - RNA, 16 nt, Pseudomonas putida KT2440
ccgucgaucacaugcg

SEQ ID NO: 1584404 - RNA, 17 nt, Pseudomonas putida KT2440
ccgucgaucacaugcgg

SEQ ID NO: 1584405 - RNA, 22 nt, Pseudomonas putida KT2440
ccgucgaucacaugcggcaccg

SEQ ID NO: 1584406 - RNA, 20 nt, Pseudomonas putida KT2440
ccgucgauuuccccgacuga

SEQ ID NO: 1584407 - RNA, 19 nt, Pseudomonas putida KT2440
ccgucgauuacccagcgcg

SEQ ID NO: 1584408 - RNA, 17 nt, Pseudomonas putida KT2440
ccgucgaugucggcgug

SEQ ID NO: 1584409 - RNA, 16 nt, Pseudomonas putida KT2440
ccgugcaggucagcgu

SEQ ID NO: 1584410 - RNA, 13 nt, Pseudomonas putida KT2440
ccgugcaggcggc

SEQ ID NO: 1584411 - RNA, 15 nt, Pseudomonas putida KT2440
ccgugccugccugca

SEQ ID NO: 1584412 - RNA, 11 nt, Pseudomonas putida KT2440
ccgugcgccua

SEQ ID NO: 1584413 - RNA, 16 nt, Pseudomonas putida KT2440
ccgugcgccugaccgu

SEQ ID NO: 1584414 - RNA, 18 nt, Pseudomonas putida KT2440
ccguggucuccaacguca

SEQ ID NO: 1584415 - RNA, 12 nt, Pseudomonas putida KT2440
ccgugguacacg

SEQ ID NO: 1584416 - RNA, 20 nt, Pseudomonas putida KT2440
ccgugguaggagcggguuca

SEQ ID NO: 1584417 - RNA, 14 nt, Pseudomonas putida KT2440
ccgugcaaccgcuc

SEQ ID NO: 1584418 - RNA, 21 nt, Pseudomonas putida KT2440
ccgugcaacgccgguagcugc

SEQ ID NO: 1584419 - RNA, 15 nt, Pseudomonas putida KT2440
ccgugcaccagcacc

SEQ ID NO: 1584420 - RNA, 17 nt, Pseudomonas putida KT2440
ccgugcaccagcaccac

SEQ ID NO: 1584421 - RNA, 20 nt, Pseudomonas putida KT2440
ccgugcacgucgaugaaggc

SEQ ID NO: 1584422 - RNA, 12 nt, Pseudomonas putida KT2440
ccgugcagcacc

SEQ ID NO: 1584423 - RNA, 19 nt, Pseudomonas putida KT2440
ccgucguaggagcggguuc

SEQ ID NO: 1584424 - RNA, 21 nt, Pseudomonas putida KT2440
ccgucguaggagcggguucac

SEQ ID NO: 1584425 - RNA, 20 nt, Pseudomonas putida KT2440
ccucgaacauggccacggug

SEQ ID NO: 1584426 - RNA, 15 nt, Pseudomonas putida KT2440
ccucgaacagcaguu

SEQ ID NO: 1584427 - RNA, 21 nt, Pseudomonas putida KT2440
ccucccgcuugcggcgacgca

SEQ ID NO: 1584428 - RNA, 16 nt, Pseudomonas putida KT2440
ccuccaguugccagug

SEQ ID NO: 1584429 - RNA, 14 nt, Pseudomonas putida KT2440
ccuccagcucgcgc

SEQ ID NO: 1584430 - RNA, 15 nt, Pseudomonas putida KT2440
ccuccagcacaccgc

SEQ ID NO: 1584431 - RNA, 16 nt, Pseudomonas putida KT2440
ccucacgcgccagguc

SEQ ID NO: 1584432 - RNA, 14 nt, Pseudomonas putida KT2440
ccucacucaccgca

SEQ ID NO: 1584433 - RNA, 21 nt, Pseudomonas putida KT2440
ccucaccgacccacaggcaca

SEQ ID NO: 1584434 - RNA, 13 nt, Pseudomonas putida KT2440
ccucacauucacc

SEQ ID NO: 1584435 - RNA, 13 nt, Pseudomonas putida KT2440
ccucacagcgccg

SEQ ID NO: 1584436 - RNA, 15 nt, Pseudomonas putida KT2440
ccucaaguucccgau

SEQ ID NO: 1584437 - RNA, 14 nt, Pseudomonas putida KT2440
ccucaaucacugcg

SEQ ID NO: 1584438 - RNA, 18 nt, Pseudomonas putida KT2440
ccuauucgcggguaaacc

SEQ ID NO: 1584439 - RNA, 15 nt, Pseudomonas putida KT2440
ccuauuggcuaugcc

SEQ ID NO: 1584440 - RNA, 16 nt, Pseudomonas putida KT2440
ccucaaaucgcugcgg

SEQ ID NO: 1584441 - RNA, 15 nt, Pseudomonas putida KT2440
ccucaagcugcaccg

SEQ ID NO: 1584442 - RNA, 23 nt, Pseudomonas putida KT2440
ccucaagggguacgaacgccagu

SEQ ID NO: 1584443 - RNA, 23 nt, Pseudomonas putida KT2440
ccucaagguaggggcagccaggu

SEQ ID NO: 1584444 - RNA, 16 nt, Pseudomonas putida KT2440
ccucaacccucgccca

SEQ ID NO: 1584445 - RNA, 22 nt, Pseudomonas putida KT2440
ccuacaaaacauacgcggcuuu

SEQ ID NO: 1584446 - RNA, 15 nt, Pseudomonas putida KT2440
ccuaucaguuucgcg

SEQ ID NO: 1584447 - RNA, 14 nt, Pseudomonas putida KT2440
ccuacaacggcugu

SEQ ID NO: 1584448 - RNA, 18 nt, Pseudomonas putida KT2440
ccuaagguugcuccugca

SEQ ID NO: 1584449 - RNA, 15 nt, Pseudomonas putida KT2440
ccguuggucagcgac

SEQ ID NO: 1584450 - RNA, 16 nt, Pseudomonas putida KT2440
ccguuggucagcgacu

SEQ ID NO: 1584451 - RNA, 19 nt, Pseudomonas putida KT2440
ccguuggucagcgacugcc

SEQ ID NO: 1584452 - RNA, 14 nt, Pseudomonas putida KT2440
ccguuggagcagcc

SEQ ID NO: 1584453 - RNA, 22 nt, Pseudomonas putida KT2440
ccguuggacgccgcaccgucga

SEQ ID NO: 1584454 - RNA, 14 nt, Pseudomonas putida KT2440
ccguugcgcagcag

SEQ ID NO: 1584455 - RNA, 15 nt, Pseudomonas putida KT2440
ccguugcgcagcagc

SEQ ID NO: 1584456 - RNA, 14 nt, Pseudomonas putida KT2440
ccguugucacgcgc

SEQ ID NO: 1584457 - RNA, 16 nt, Pseudomonas putida KT2440
ccguuuaccaaggcgg

SEQ ID NO: 1584458 - RNA, 15 nt, Pseudomonas putida KT2440
ccguugaaagacugc

SEQ ID NO: 1584459 - RNA, 19 nt, Pseudomonas putida KT2440
ccgugguucaucaccagcc

SEQ ID NO: 1584460 - RNA, 13 nt, Pseudomonas putida KT2440
ccgugucgaacug

SEQ ID NO: 1584461 - RNA, 18 nt, Pseudomonas putida KT2440
ccguugaucagcgacacc

SEQ ID NO: 1584462 - RNA, 16 nt, Pseudomonas putida KT2440
ccguugaccagguuua

SEQ ID NO: 1584463 - RNA, 21 nt, Pseudomonas putida KT2440
ccguugaccagguuuaccggc

SEQ ID NO: 1584464 - RNA, 20 nt, Pseudomonas putida KT2440
ccguugaggccgaacaccgc

SEQ ID NO: 1584465 - RNA, 18 nt, Pseudomonas putida KT2440
ccguugaggguggcaaug

SEQ ID NO: 1584466 - RNA, 17 nt, Pseudomonas putida KT2440
ccugcgcggccuugccg

SEQ ID NO: 1584467 - RNA, 17 nt, Pseudomonas putida KT2440
ccugcgcuugcaccagg

SEQ ID NO: 1584468 - RNA, 22 nt, Pseudomonas putida KT2440
ccugcggaaaagcgagguacgg

SEQ ID NO: 1584469 - RNA, 17 nt, Pseudomonas putida KT2440
ccugcgcuccagcagcu

SEQ ID NO: 1584470 - RNA, 20 nt, Pseudomonas putida KT2440
ccugcggcagauccugcagc

SEQ ID NO: 1584471 - RNA, 16 nt, Pseudomonas putida KT2440
ccugcgggagcgggcg

SEQ ID NO: 1584472 - RNA, 13 nt, Pseudomonas putida KT2440
ccugcgucuugcg

SEQ ID NO: 1584473 - RNA, 13 nt, Pseudomonas putida KT2440
ccugcgucaggac

SEQ ID NO: 1584474 - RNA, 14 nt, Pseudomonas putida KT2440
ccugcgucaggacc

SEQ ID NO: 1584475 - RNA, 15 nt, Pseudomonas putida KT2440
ccugcggucagccug

SEQ ID NO: 1584476 - RNA, 16 nt, Pseudomonas putida KT2440
ccugcggucagccugc

SEQ ID NO: 1584477 - RNA, 14 nt, Pseudomonas putida KT2440
ccugcaggcugccg

SEQ ID NO: 1584478 - RNA, 16 nt, Pseudomonas putida KT2440
ccugcagggcgagcac

SEQ ID NO: 1584479 - RNA, 17 nt, Pseudomonas putida KT2440
ccugcagggcgagcaca

SEQ ID NO: 1584480 - RNA, 22 nt, Pseudomonas putida KT2440
ccugcagguaucacgcgagcug

SEQ ID NO: 1584481 - RNA, 19 nt, Pseudomonas putida KT2440
ccugcagguacagcagcug

SEQ ID NO: 1584482 - RNA, 17 nt, Pseudomonas putida KT2440
ccugcgaauggccgcaa

SEQ ID NO: 1584483 - RNA, 18 nt, Pseudomonas putida KT2440
ccugcauaugcagggccu

SEQ ID NO: 1584484 - RNA, 17 nt, Pseudomonas putida KT2440
ccugcagucgaucccga

SEQ ID NO: 1584485 - RNA, 14 nt, Pseudomonas putida KT2440
ccugcgcaggcgcc

SEQ ID NO: 1584486 - RNA, 12 nt, Pseudomonas putida KT2440
ccugcgccagcg

SEQ ID NO: 1584487 - RNA, 23 nt, Pseudomonas putida KT2440
ccugcgccccgguacgacgcacc

SEQ ID NO: 1584488 - RNA, 22 nt, Pseudomonas putida KT2440
ccugcgccaaaaccuguuccag

SEQ ID NO: 1584489 - RNA, 21 nt, Pseudomonas putida KT2440
ccugcgccgggaaaucuuccg

SEQ ID NO: 1584490 - RNA, 21 nt, Pseudomonas putida KT2440
ccuggagaccuuucccaugac

SEQ ID NO: 1584491 - RNA, 15 nt, Pseudomonas putida KT2440
ccuggaucgcgccuu

SEQ ID NO: 1584492 - RNA, 20 nt, Pseudomonas putida KT2440
ccugcugguacagccggcug

SEQ ID NO: 1584493 - RNA, 18 nt, Pseudomonas putida KT2440
ccugcugggucagcgcug

SEQ ID NO: 1584494 - RNA, 13 nt, Pseudomonas putida KT2440
ccugcuuggccga

SEQ ID NO: 1584495 - RNA, 14 nt, Pseudomonas putida KT2440
ccugcuugccgcug

SEQ ID NO: 1584496 - RNA, 19 nt, Pseudomonas putida KT2440
ccugcuugccgggugcauc

SEQ ID NO: 1584497 - RNA, 13 nt, Pseudomonas putida KT2440
ccugcugacgcag

SEQ ID NO: 1584498 - RNA, 14 nt, Pseudomonas putida KT2440
ccugcugggcgaug

SEQ ID NO: 1584499 - RNA, 15 nt, Pseudomonas putida KT2440
ccugcuuaucggcug

SEQ ID NO: 1584500 - RNA, 15 nt, Pseudomonas putida KT2440
ccugcugcuggcacg

SEQ ID NO: 1584501 - RNA, 20 nt, Pseudomonas putida KT2440
ccugcuccaugggcaggccc

SEQ ID NO: 1584502 - RNA, 19 nt, Pseudomonas putida KT2440
ccugcuccugguccugcgc

SEQ ID NO: 1584503 - RNA, 20 nt, Pseudomonas putida KT2440
ccugcucgccaaauguagga

SEQ ID NO: 1584504 - RNA, 14 nt, Pseudomonas putida KT2440
ccugcuccagcacc

SEQ ID NO: 1584505 - RNA, 13 nt, Pseudomonas putida KT2440
ccugcucauccag

SEQ ID NO: 1584506 - RNA, 19 nt, Pseudomonas putida KT2440
ccugcagcuucccggccug

SEQ ID NO: 1584507 - RNA, 20 nt, Pseudomonas putida KT2440
ccugcacuaagggcaggccu

SEQ ID NO: 1584508 - RNA, 13 nt, Pseudomonas putida KT2440
ccugcaauaacgc

SEQ ID NO: 1584509 - RNA, 17 nt, Pseudomonas putida KT2440
ccugcacaucggccacc

SEQ ID NO: 1584510 - RNA, 22 nt, Pseudomonas putida KT2440
ccugcacaacccuaucagggcu

SEQ ID NO: 1584511 - RNA, 15 nt, Pseudomonas putida KT2440
ccugcaccgaagcac

SEQ ID NO: 1584512 - RNA, 18 nt, Pseudomonas putida KT2440
ccugcaccgaagcaccac

SEQ ID NO: 1584513 - RNA, 23 nt, Pseudomonas putida KT2440
ccugcaccaugauguucugcuug

SEQ ID NO: 1584514 - RNA, 21 nt, Pseudomonas putida KT2440
ccugcaccuggcugagguuca

SEQ ID NO: 1584515 - RNA, 15 nt, Pseudomonas putida KT2440
ccugcaccugguugc

SEQ ID NO: 1584516 - RNA, 16 nt, Pseudomonas putida KT2440
ccugcaacagggcgcu

SEQ ID NO: 1584517 - RNA, 23 nt, Pseudomonas putida KT2440
ccugcaacagggcgcuugcccgc

SEQ ID NO: 1584518 - RNA, 19 nt, Pseudomonas putida KT2440
ccugcaacgucgccacgcg

SEQ ID NO: 1584519 - RNA, 16 nt, Pseudomonas putida KT2440
ccugacgccgccagcg

SEQ ID NO: 1584520 - RNA, 15 nt, Pseudomonas putida KT2440
ccugaccuugcugcu

SEQ ID NO: 1584521 - RNA, 20 nt, Pseudomonas putida KT2440
ccugacgcuucaucgaggca

SEQ ID NO: 1584522 - RNA, 14 nt, Pseudomonas putida KT2440
ccugagccugcagg

SEQ ID NO: 1584523 - RNA, 19 nt, Pseudomonas putida KT2440
ccugacgggccucuucgcg

SEQ ID NO: 1584524 - RNA, 15 nt, Pseudomonas putida KT2440
ccugacucgaccgcc

SEQ ID NO: 1584525 - RNA, 23 nt, Pseudomonas putida KT2440
ccucgucggcgcgguucuucgcc

SEQ ID NO: 1584526 - RNA, 20 nt, Pseudomonas putida KT2440
ccucguuggcgaagucggcc

SEQ ID NO: 1584527 - RNA, 19 nt, Pseudomonas putida KT2440
ccucgugcagcugcaccga

SEQ ID NO: 1584528 - RNA, 17 nt, Pseudomonas putida KT2440
ccucguucagccaacgg

SEQ ID NO: 1584529 - RNA, 21 nt, Pseudomonas putida KT2440
ccucggcgaaaagccggguac

SEQ ID NO: 1584530 - RNA, 18 nt, Pseudomonas putida KT2440
ccucggccaggucgaucc

SEQ ID NO: 1584531 - RNA, 21 nt, Pseudomonas putida KT2440
ccucggcaucgaacagcuugc

SEQ ID NO: 1584532 - RNA, 18 nt, Pseudomonas putida KT2440
ccucgaccuggcccgcuu

SEQ ID NO: 1584533 - RNA, 17 nt, Pseudomonas putida KT2440
ccucgacccccuugcca

SEQ ID NO: 1584534 - RNA, 24 nt, Pseudomonas putida KT2440
ccucgacccccuugccagcauggu

SEQ ID NO: 1584535 - RNA, 19 nt, Pseudomonas putida KT2440
ccucgacaaucgccaggua

SEQ ID NO: 1584536 - RNA, 15 nt, Pseudomonas putida KT2440
ccucgaccaggcgcu

SEQ ID NO: 1584537 - RNA, 10 nt, Pseudomonas putida KT2440
ccucgaacuc

SEQ ID NO: 1584538 - RNA, 18 nt, Pseudomonas putida KT2440
ccucgacgccuuggcgca

SEQ ID NO: 1584539 - RNA, 13 nt, Pseudomonas putida KT2440
ccucgcugaccag

SEQ ID NO: 1584540 - RNA, 16 nt, Pseudomonas putida KT2440
ccucggcaaucugcag

SEQ ID NO: 1584541 - RNA, 18 nt, Pseudomonas putida KT2440
ccggcguacucucgucga

SEQ ID NO: 1584542 - RNA, 19 nt, Pseudomonas putida KT2440
ccggcgcuuugcgcaaccg

SEQ ID NO: 1584543 - RNA, 14 nt, Pseudomonas putida KT2440
ccggcgcugggcuu

SEQ ID NO: 1584544 - RNA, 11 nt, Pseudomonas putida KT2440
ccggcgcuggu

SEQ ID NO: 1584545 - RNA, 12 nt, Pseudomonas putida KT2440
ccggcgcuggac

SEQ ID NO: 1584546 - RNA, 20 nt, Pseudomonas putida KT2440
ccggcgcugcguuggccauc

SEQ ID NO: 1584547 - RNA, 19 nt, Pseudomonas putida KT2440
ccggcgcugagcgacagca

SEQ ID NO: 1584548 - RNA, 18 nt, Pseudomonas putida KT2440
ccggcgcugaucagcugg

SEQ ID NO: 1584549 - RNA, 16 nt, Pseudomonas putida KT2440
ccggccagcgccugca

SEQ ID NO: 1584550 - RNA, 17 nt, Pseudomonas putida KT2440
ccggccagcgccugcag

SEQ ID NO: 1584551 - RNA, 22 nt, Pseudomonas putida KT2440
ccggccagcgccugcaggccca

SEQ ID NO: 1584552 - RNA, 21 nt, Pseudomonas putida KT2440
ccggccagcgauaaaccagca

SEQ ID NO: 1584553 - RNA, 22 nt, Pseudomonas putida KT2440
ccggccagcgauaaaccagcag

SEQ ID NO: 1584554 - RNA, 14 nt, Pseudomonas putida KT2440
ccgggccaccaccg

SEQ ID NO: 1584555 - RNA, 14 nt, Pseudomonas putida KT2440
ccgggccaggcccc

SEQ ID NO: 1584556 - RNA, 17 nt, Pseudomonas putida KT2440
ccgggcaucgaucacua

SEQ ID NO: 1584557 - RNA, 15 nt, Pseudomonas putida KT2440
ccgggcaugcagguc

SEQ ID NO: 1584558 - RNA, 17 nt, Pseudomonas putida KT2440
ccgggcaugcaggucga

SEQ ID NO: 1584559 - RNA, 22 nt, Pseudomonas putida KT2440
ccgggcgcgguuuuuucaugcc

SEQ ID NO: 1584560 - RNA, 23 nt, Pseudomonas putida KT2440
ccgggccuucaaccucacuggca

SEQ ID NO: 1584561 - RNA, 17 nt, Pseudomonas putida KT2440
ccggcuaucggccagca

SEQ ID NO: 1584562 - RNA, 15 nt, Pseudomonas putida KT2440
ccggcuccagguacu

SEQ ID NO: 1584563 - RNA, 16 nt, Pseudomonas putida KT2440
ccggcuccagguacuc

SEQ ID NO: 1584564 - RNA, 19 nt, Pseudomonas putida KT2440
ccggcuccaccugcuccag

SEQ ID NO: 1584565 - RNA, 21 nt, Pseudomonas putida KT2440
ccggcuccaccugcuccagca

SEQ ID NO: 1584566 - RNA, 21 nt, Pseudomonas putida KT2440
ccggcucaccgcagcccagcg

SEQ ID NO: 1584567 - RNA, 18 nt, Pseudomonas putida KT2440
ccggcugaaauggcggcc

SEQ ID NO: 1584568 - RNA, 16 nt, Pseudomonas putida KT2440
ccgggaacagcagcac

SEQ ID NO: 1584569 - RNA, 13 nt, Pseudomonas putida KT2440
ccggcugguacuc

SEQ ID NO: 1584570 - RNA, 21 nt, Pseudomonas putida KT2440
ccggcucuaucuucaggcauc

SEQ ID NO: 1584571 - RNA, 21 nt, Pseudomonas putida KT2440
ccggcugaacuucaaccgcac

SEQ ID NO: 1584572 - RNA, 17 nt, Pseudomonas putida KT2440
ccgggaucaccgcaagc

SEQ ID NO: 1584573 - RNA, 20 nt, Pseudomonas putida KT2440
ccgggaucaccgcaagcugc

SEQ ID NO: 1584574 - RNA, 17 nt, Pseudomonas putida KT2440
ccgguagcugcgcaggu

SEQ ID NO: 1584575 - RNA, 19 nt, Pseudomonas putida KT2440
ccgguacagccuaccaacg

SEQ ID NO: 1584576 - RNA, 15 nt, Pseudomonas putida KT2440
ccgguaccagcaggc

SEQ ID NO: 1584577 - RNA, 18 nt, Pseudomonas putida KT2440
ccgguaauagcggcgguu

SEQ ID NO: 1584578 - RNA, 17 nt, Pseudomonas putida KT2440
ccgguaacgggccagcc

SEQ ID NO: 1584579 - RNA, 21 nt, Pseudomonas putida KT2440
ccgguaacgguaauggccggc

SEQ ID NO: 1584580 - RNA, 14 nt, Pseudomonas putida KT2440
ccgguaacuggccc

SEQ ID NO: 1584581 - RNA, 18 nt, Pseudomonas putida KT2440
ccggguuaccgcacagca

SEQ ID NO: 1584582 - RNA, 21 nt, Pseudomonas putida KT2440
ccggguugcucaggcgcucca

SEQ ID NO: 1584583 - RNA, 20 nt, Pseudomonas putida KT2440
ccggguguugaauguugacg

SEQ ID NO: 1584584 - RNA, 19 nt, Pseudomonas putida KT2440
ccgggucggcgccaggccu

SEQ ID NO: 1584585 - RNA, 22 nt, Pseudomonas putida KT2440
ccggucaccgaccaucggcagg

SEQ ID NO: 1584586 - RNA, 14 nt, Pseudomonas putida KT2440
ccggucacugcgcg

SEQ ID NO: 1584587 - RNA, 13 nt, Pseudomonas putida KT2440
ccggucagcagca

SEQ ID NO: 1584588 - RNA, 17 nt, Pseudomonas putida KT2440
ccgguaggucuaaccgc

SEQ ID NO: 1584589 - RNA, 23 nt, Pseudomonas putida KT2440
ccgguaggucuaaccgcgcuggu

SEQ ID NO: 1584590 - RNA, 18 nt, Pseudomonas putida KT2440
ccggucauccagcagcuc

SEQ ID NO: 1584591 - RNA, 20 nt, Pseudomonas putida KT2440
ccggucauggcgcgccaugc

SEQ ID NO: 1584592 - RNA, 12 nt, Pseudomonas putida KT2440
ccggucgcucaa

SEQ ID NO: 1584593 - RNA, 13 nt, Pseudomonas putida KT2440
ccggucgcucaac

SEQ ID NO: 1584594 - RNA, 15 nt, Pseudomonas putida KT2440
ccggucggccagcug

SEQ ID NO: 1584595 - RNA, 18 nt, Pseudomonas putida KT2440
ccgguggugaccucgaug

SEQ ID NO: 1584596 - RNA, 22 nt, Pseudomonas putida KT2440
ccgguggcuucguggugcuggc

SEQ ID NO: 1584597 - RNA, 18 nt, Pseudomonas putida KT2440
ccggugggcaacagcugc

SEQ ID NO: 1584598 - RNA, 18 nt, Pseudomonas putida KT2440
ccggugguaauuggccgg

SEQ ID NO: 1584599 - RNA, 20 nt, Pseudomonas putida KT2440
ccggugguaauuggccggca

SEQ ID NO: 1584600 - RNA, 21 nt, Pseudomonas putida KT2440
ccggugguaauuggccggcag

SEQ ID NO: 1584601 - RNA, 17 nt, Pseudomonas putida KT2440
ccgguggggugucuggu

SEQ ID NO: 1584602 - RNA, 17 nt, Pseudomonas putida KT2440
ccggucgggcaaggcca

SEQ ID NO: 1584603 - RNA, 18 nt, Pseudomonas putida KT2440
ccggucgggcaaggccag

SEQ ID NO: 1584604 - RNA, 21 nt, Pseudomonas putida KT2440
ccggucguacacucaccgcgc

SEQ ID NO: 1584605 - RNA, 17 nt, Pseudomonas putida KT2440
ccggucucccagcgcug

SEQ ID NO: 1584606 - RNA, 19 nt, Pseudomonas putida KT2440
ccggugccccgguccagca

SEQ ID NO: 1584607 - RNA, 20 nt, Pseudomonas putida KT2440
ccggucuugucugacagcag

SEQ ID NO: 1584608 - RNA, 19 nt, Pseudomonas putida KT2440
ccguaguagccuucuucgg

SEQ ID NO: 1584609 - RNA, 15 nt, Pseudomonas putida KT2440
ccguaggagcgggcu

SEQ ID NO: 1584610 - RNA, 22 nt, Pseudomonas putida KT2440
ccguaggagcgggcuugcccgc

SEQ ID NO: 1584611 - RNA, 16 nt, Pseudomonas putida KT2440
ccguagggggccgcuu

SEQ ID NO: 1584612 - RNA, 14 nt, Pseudomonas putida KT2440
ccguacuugcugca

SEQ ID NO: 1584613 - RNA, 16 nt, Pseudomonas putida KT2440
ccgguuccagcgcacc

SEQ ID NO: 1584614 - RNA, 17 nt, Pseudomonas putida KT2440
ccgucaccgcugccgau

SEQ ID NO: 1584615 - RNA, 19 nt, Pseudomonas putida KT2440
ccguccagguccaggccag

SEQ ID NO: 1584616 - RNA, 19 nt, Pseudomonas putida KT2440
ccguccagcugagcgccau

SEQ ID NO: 1584617 - RNA, 16 nt, Pseudomonas putida KT2440
ccguccaggaacgcug

SEQ ID NO: 1584618 - RNA, 22 nt, Pseudomonas putida KT2440
ccguccaguuccggcaggucga

SEQ ID NO: 1584619 - RNA, 21 nt, Pseudomonas putida KT2440
ccgccuucgccaagguccagc

SEQ ID NO: 1584620 - RNA, 23 nt, Pseudomonas putida KT2440
ccgccuuggcuuccugcuggcuc

SEQ ID NO: 1584621 - RNA, 12 nt, Pseudomonas putida KT2440
ccgcgagcagcg

SEQ ID NO: 1584622 - RNA, 19 nt, Pseudomonas putida KT2440
ccgcgcaauugccggucgg

SEQ ID NO: 1584623 - RNA, 22 nt, Pseudomonas putida KT2440
ccgcgcaccuccugcggcagau

SEQ ID NO: 1584624 - RNA, 12 nt, Pseudomonas putida KT2440
ccgcgccagcuc

SEQ ID NO: 1584625 - RNA, 14 nt, Pseudomonas putida KT2440
ccgcgccaucagcu

SEQ ID NO: 1584626 - RNA, 19 nt, Pseudomonas putida KT2440
ccgccguucaggcgccugc

SEQ ID NO: 1584627 - RNA, 15 nt, Pseudomonas putida KT2440
ccgccgugccgguca

SEQ ID NO: 1584628 - RNA, 16 nt, Pseudomonas putida KT2440
ccgccgucgggugcgc

SEQ ID NO: 1584629 - RNA, 19 nt, Pseudomonas putida KT2440
ccgccugucgcgacgggcu

SEQ ID NO: 1584630 - RNA, 17 nt, Pseudomonas putida KT2440
ccgccugggucaggcgu

SEQ ID NO: 1584631 - RNA, 16 nt, Pseudomonas putida KT2440
ccgccuggcgccugcg

SEQ ID NO: 1584632 - RNA, 13 nt, Pseudomonas putida KT2440
ccgccugcuggcc

SEQ ID NO: 1584633 - RNA, 14 nt, Pseudomonas putida KT2440
ccgccucgaccugg

SEQ ID NO: 1584634 - RNA, 15 nt, Pseudomonas putida KT2440
ccgccucgaccuggc

SEQ ID NO: 1584635 - RNA, 16 nt, Pseudomonas putida KT2440
ccgccucgaccuggcc

SEQ ID NO: 1584636 - RNA, 16 nt, Pseudomonas putida KT2440
ccgccuccugcugcug

SEQ ID NO: 1584637 - RNA, 14 nt, Pseudomonas putida KT2440
ccgccgcugcgagg

SEQ ID NO: 1584638 - RNA, 14 nt, Pseudomonas putida KT2440
ccgccgcugcugcg

SEQ ID NO: 1584639 - RNA, 15 nt, Pseudomonas putida KT2440
ccgccgccagggcaa

SEQ ID NO: 1584640 - RNA, 14 nt, Pseudomonas putida KT2440
ccgccccgcaccag

SEQ ID NO: 1584641 - RNA, 14 nt, Pseudomonas putida KT2440
ccgcccgcucacgc

SEQ ID NO: 1584642 - RNA, 23 nt, Pseudomonas putida KT2440
ccgcccgcuuuuggcugugcacc

SEQ ID NO: 1584643 - RNA, 18 nt, Pseudomonas putida KT2440
ccgccgaugaucgaaugg

SEQ ID NO: 1584644 - RNA, 15 nt, Pseudomonas putida KT2440
ccgccgaucgaagca

SEQ ID NO: 1584645 - RNA, 20 nt, Pseudomonas putida KT2440
ccgcccuuggugcaccagcu

SEQ ID NO: 1584646 - RNA, 13 nt, Pseudomonas putida KT2440
ccgcccgguaaua

SEQ ID NO: 1584647 - RNA, 14 nt, Pseudomonas putida KT2440
ccgcccgguaauag

SEQ ID NO: 1584648 - RNA, 18 nt, Pseudomonas putida KT2440
ccgcccuugagcuucagc

SEQ ID NO: 1584649 - RNA, 19 nt, Pseudomonas putida KT2440
ccgccccaaaccaggccgu

SEQ ID NO: 1584650 - RNA, 15 nt, Pseudomonas putida KT2440
ccgccccaagcgccu

SEQ ID NO: 1584651 - RNA, 14 nt, Pseudomonas putida KT2440
ccgccccagcgcgc

SEQ ID NO: 1584652 - RNA, 17 nt, Pseudomonas putida KT2440
ccgccccauagccugcu

SEQ ID NO: 1584653 - RNA, 14 nt, Pseudomonas putida KT2440
ccgcccaguucagc

SEQ ID NO: 1584654 - RNA, 21 nt, Pseudomonas putida KT2440
ccgcccacaugcgagccgcug

SEQ ID NO: 1584655 - RNA, 13 nt, Pseudomonas putida KT2440
ccgccauugaugc

SEQ ID NO: 1584656 - RNA, 18 nt, Pseudomonas putida KT2440
ccgccauugaugccgaag

SEQ ID NO: 1584657 - RNA, 20 nt, Pseudomonas putida KT2440
ccgccauugcaccacgccau

SEQ ID NO: 1584658 - RNA, 20 nt, Pseudomonas putida KT2440
ccgccagguccgguaacugg

SEQ ID NO: 1584659 - RNA, 16 nt, Pseudomonas putida KT2440
ccgccagugcggugac

SEQ ID NO: 1584660 - RNA, 14 nt, Pseudomonas putida KT2440
ccgccagugaccgc

SEQ ID NO: 1584661 - RNA, 21 nt, Pseudomonas putida KT2440
ccgccaguagcaaucagguca

SEQ ID NO: 1584662 - RNA, 21 nt, Pseudomonas putida KT2440
ccgccagguauucggcaaugc

SEQ ID NO: 1584663 - RNA, 12 nt, Pseudomonas putida KT2440
ccgccagcaggc

SEQ ID NO: 1584664 - RNA, 14 nt, Pseudomonas putida KT2440
ccgccagcaggcca

SEQ ID NO: 1584665 - RNA, 14 nt, Pseudomonas putida KT2440
ccgccagcauggcc

SEQ ID NO: 1584666 - RNA, 23 nt, Pseudomonas putida KT2440
ccgccauggucgcguuguucagc

SEQ ID NO: 1584667 - RNA, 22 nt, Pseudomonas putida KT2440
ccgccauucuucuccaggugcu

SEQ ID NO: 1584668 - RNA, 16 nt, Pseudomonas putida KT2440
ccgccauguugcgcag

SEQ ID NO: 1584669 - RNA, 19 nt, Pseudomonas putida KT2440
ccgccauguugcgcagcaa

SEQ ID NO: 1584670 - RNA, 16 nt, Pseudomonas putida KT2440
ccgccaccacgaugcc

SEQ ID NO: 1584671 - RNA, 17 nt, Pseudomonas putida KT2440
ccgccacauccagcgcc

SEQ ID NO: 1584672 - RNA, 17 nt, Pseudomonas putida KT2440
ccgccacaccugccagg

SEQ ID NO: 1584673 - RNA, 16 nt, Pseudomonas putida KT2440
ccgccaaccagcucac

SEQ ID NO: 1584674 - RNA, 14 nt, Pseudomonas putida KT2440
ccgccaagguaauc

SEQ ID NO: 1584675 - RNA, 18 nt, Pseudomonas putida KT2440
ccgccaagguaaucuggc

SEQ ID NO: 1584676 - RNA, 20 nt, Pseudomonas putida KT2440
ccgccaagguaaucuggcug

SEQ ID NO: 1584677 - RNA, 22 nt, Pseudomonas putida KT2440
ccgccaagguaaucuggcuguc

SEQ ID NO: 1584678 - RNA, 20 nt, Pseudomonas putida KT2440
ccgccacggccaccuugcca

SEQ ID NO: 1584679 - RNA, 17 nt, Pseudomonas putida KT2440
ccgccacgaucgacaac

SEQ ID NO: 1584680 - RNA, 16 nt, Pseudomonas putida KT2440
ccgccaccaucggcca

SEQ ID NO: 1584681 - RNA, 12 nt, Pseudomonas putida KT2440
ccgccaccaugc

SEQ ID NO: 1584682 - RNA, 17 nt, Pseudomonas putida KT2440
ccgccaccaucgacuca

SEQ ID NO: 1584683 - RNA, 18 nt, Pseudomonas putida KT2440
ccgccaaccccuccagca

SEQ ID NO: 1584684 - RNA, 17 nt, Pseudomonas putida KT2440
ccgccaacucgccauuc

SEQ ID NO: 1584685 - RNA, 17 nt, Pseudomonas putida KT2440
ccgcaugcuuggcgaag

SEQ ID NO: 1584686 - RNA, 15 nt, Pseudomonas putida KT2440
ccgccaacagcgcag

SEQ ID NO: 1584687 - RNA, 19 nt, Pseudomonas putida KT2440
ccgcaucguuauccagcac

SEQ ID NO: 1584688 - RNA, 22 nt, Pseudomonas putida KT2440
ccgcagcgcuucgaucagcgcc

SEQ ID NO: 1584689 - RNA, 13 nt, Pseudomonas putida KT2440
ccgcaaggcggcc

SEQ ID NO: 1584690 - RNA, 12 nt, Pseudomonas putida KT2440
ccgcaagcggcu

SEQ ID NO: 1584691 - RNA, 17 nt, Pseudomonas putida KT2440
ccgcaagcgggcagugc

SEQ ID NO: 1584692 - RNA, 18 nt, Pseudomonas putida KT2440
ccgcaagcagucccagca

SEQ ID NO: 1584693 - RNA, 12 nt, Pseudomonas putida KT2440
ccgcaagcgccg

SEQ ID NO: 1584694 - RNA, 20 nt, Pseudomonas putida KT2440
ccgcaacuggcccgcgccag

SEQ ID NO: 1584695 - RNA, 14 nt, Pseudomonas putida KT2440
ccgcacccggcgga

SEQ ID NO: 1584696 - RNA, 23 nt, Pseudomonas putida KT2440
ccgcacccggcuaccaaucugua

SEQ ID NO: 1584697 - RNA, 13 nt, Pseudomonas putida KT2440
ccgcacccgcgau

SEQ ID NO: 1584698 - RNA, 16 nt, Pseudomonas putida KT2440
ccgcacccgcaagcgc

SEQ ID NO: 1584699 - RNA, 17 nt, Pseudomonas putida KT2440
ccgcacccgcaagcgcc

SEQ ID NO: 1584700 - RNA, 11 nt, Pseudomonas putida KT2440
ccgcaccggcc

SEQ ID NO: 1584701 - RNA, 17 nt, Pseudomonas putida KT2440
ccgcaccuccuuggccg

SEQ ID NO: 1584702 - RNA, 18 nt, Pseudomonas putida KT2440
ccgcaccucacaacgcgc

SEQ ID NO: 1584703 - RNA, 15 nt, Pseudomonas putida KT2440
ccgcagacagcucga

SEQ ID NO: 1584704 - RNA, 22 nt, Pseudomonas putida KT2440
ccgcacuuguugcgcagguaca

SEQ ID NO: 1584705 - RNA, 21 nt, Pseudomonas putida KT2440
ccgcagccucuucggccagca

SEQ ID NO: 1584706 - RNA, 16 nt, Pseudomonas putida KT2440
ccgcagccccaccucg

SEQ ID NO: 1584707 - RNA, 18 nt, Pseudomonas putida KT2440
ccgaugcggugcagcacc

SEQ ID NO: 1584708 - RNA, 19 nt, Pseudomonas putida KT2440
ccgaugcggugcagcaccu

SEQ ID NO: 1584709 - RNA, 19 nt, Pseudomonas putida KT2440
ccgaugcucgucagccccu

SEQ ID NO: 1584710 - RNA, 14 nt, Pseudomonas putida KT2440
ccgaugccgucgau

SEQ ID NO: 1584711 - RNA, 20 nt, Pseudomonas putida KT2440
ccgaugccuuuuuuugccgc

SEQ ID NO: 1584712 - RNA, 22 nt, Pseudomonas putida KT2440
ccgaugccuuuuuuugccgcau

SEQ ID NO: 1584713 - RNA, 16 nt, Pseudomonas putida KT2440
ccgaugggcaggccau

SEQ ID NO: 1584714 - RNA, 15 nt, Pseudomonas putida KT2440
ccgauugcugccgac

SEQ ID NO: 1584715 - RNA, 13 nt, Pseudomonas putida KT2440
ccgauuuggcccg

SEQ ID NO: 1584716 - RNA, 13 nt, Pseudomonas putida KT2440
ccgcaaagcggcc

SEQ ID NO: 1584717 - RNA, 20 nt, Pseudomonas putida KT2440
ccgcaaagcggcccccagca

SEQ ID NO: 1584718 - RNA, 15 nt, Pseudomonas putida KT2440
ccgcaaagcccugcc

SEQ ID NO: 1584719 - RNA, 16 nt, Pseudomonas putida KT2440
ccgcaacaaccuggcc

SEQ ID NO: 1584720 - RNA, 13 nt, Pseudomonas putida KT2440
ccggacggguuuc

SEQ ID NO: 1584721 - RNA, 16 nt, Pseudomonas putida KT2440
ccggagcgacuucgac

SEQ ID NO: 1584722 - RNA, 19 nt, Pseudomonas putida KT2440
ccggagcgacuucgaccac

SEQ ID NO: 1584723 - RNA, 15 nt, Pseudomonas putida KT2440
ccggaccugccgcag

SEQ ID NO: 1584724 - RNA, 21 nt, Pseudomonas putida KT2440
ccggaacguuuccagcaaccg

SEQ ID NO: 1584725 - RNA, 16 nt, Pseudomonas putida KT2440
ccggaccagcgccgca

SEQ ID NO: 1584726 - RNA, 17 nt, Pseudomonas putida KT2440
ccggaucuggcagcuuc

SEQ ID NO: 1584727 - RNA, 17 nt, Pseudomonas putida KT2440
ccggaucguugcggguc

SEQ ID NO: 1584728 - RNA, 23 nt, Pseudomonas putida KT2440
ccggauucacggaucagccgcgg

SEQ ID NO: 1584729 - RNA, 18 nt, Pseudomonas putida KT2440
ccggaguccccaccggca

SEQ ID NO: 1584730 - RNA, 22 nt, Pseudomonas putida KT2440
ccggaguccccaccggcaccau

SEQ ID NO: 1584731 - RNA, 13 nt, Pseudomonas putida KT2440
ccggccagcagga

SEQ ID NO: 1584732 - RNA, 15 nt, Pseudomonas putida KT2440
ccggccagcagguca

SEQ ID NO: 1584733 - RNA, 17 nt, Pseudomonas putida KT2440
ccggccagcaggucagc

SEQ ID NO: 1584734 - RNA, 18 nt, Pseudomonas putida KT2440
ccggccagcaggucagca

SEQ ID NO: 1584735 - RNA, 17 nt, Pseudomonas putida KT2440
ccggcaucgccuccagc

SEQ ID NO: 1584736 - RNA, 15 nt, Pseudomonas putida KT2440
ccggcaucgccaaca

SEQ ID NO: 1584737 - RNA, 20 nt, Pseudomonas putida KT2440
ccggcaucgcucaacuggcu

SEQ ID NO: 1584738 - RNA, 13 nt, Pseudomonas putida KT2440
ccggcauggcgug

SEQ ID NO: 1584739 - RNA, 16 nt, Pseudomonas putida KT2440
ccggccaccaggcgcg

SEQ ID NO: 1584740 - RNA, 22 nt, Pseudomonas putida KT2440
ccggccaccaggcgcggcagca

SEQ ID NO: 1584741 - RNA, 18 nt, Pseudomonas putida KT2440
ccggcagcucaccggcaa

SEQ ID NO: 1584742 - RNA, 21 nt, Pseudomonas putida KT2440
ccggcagcucaccggcaaucg

SEQ ID NO: 1584743 - RNA, 18 nt, Pseudomonas putida KT2440
ccggcagguugcuggccu

SEQ ID NO: 1584744 - RNA, 12 nt, Pseudomonas putida KT2440
ccggcaggucgg

SEQ ID NO: 1584745 - RNA, 20 nt, Pseudomonas putida KT2440
ccggcagccaccgccggcca

SEQ ID NO: 1584746 - RNA, 21 nt, Pseudomonas putida KT2440
ccggauuucuuccauggccug

SEQ ID NO: 1584747 - RNA, 22 nt, Pseudomonas putida KT2440
ccggcaacccuucggccagcag

SEQ ID NO: 1584748 - RNA, 13 nt, Pseudomonas putida KT2440
ccggcaacggcca

SEQ ID NO: 1584749 - RNA, 18 nt, Pseudomonas putida KT2440
ccggcaacggccacgcug

SEQ ID NO: 1584750 - RNA, 15 nt, Pseudomonas putida KT2440
ccggcaagcccaugg

SEQ ID NO: 1584751 - RNA, 18 nt, Pseudomonas putida KT2440
ccggcaagcccauggcug

SEQ ID NO: 1584752 - RNA, 18 nt, Pseudomonas putida KT2440
ccggcaacuccuccagcc

SEQ ID NO: 1584753 - RNA, 24 nt, Pseudomonas putida KT2440
ccggcaacuggcaucggucaccgg

SEQ ID NO: 1584754 - RNA, 21 nt, Pseudomonas putida KT2440
ccggcaauaccggccacgcgc

SEQ ID NO: 1584755 - RNA, 23 nt, Pseudomonas putida KT2440
ccggcaauaccggccacgcgcgc

SEQ ID NO: 1584756 - RNA, 13 nt, Pseudomonas putida KT2440
ccggcacaaccga

SEQ ID NO: 1584757 - RNA, 13 nt, Pseudomonas putida KT2440
ccggcaccaucuu

SEQ ID NO: 1584758 - RNA, 23 nt, Pseudomonas putida KT2440
ccggcaccaucuucgacaguuca

SEQ ID NO: 1584759 - RNA, 21 nt, Pseudomonas putida KT2440
ccggcaccccuuucuccagca

SEQ ID NO: 1584760 - RNA, 22 nt, Pseudomonas putida KT2440
ccggcacagaauccucuaugcc

SEQ ID NO: 1584761 - RNA, 17 nt, Pseudomonas putida KT2440
ccggcacagaccgcaac

SEQ ID NO: 1584762 - RNA, 14 nt, Pseudomonas putida KT2440
ccggcacagcccag

SEQ ID NO: 1584763 - RNA, 12 nt, Pseudomonas putida KT2440
ccggcacaggaa

SEQ ID NO: 1584764 - RNA, 16 nt, Pseudomonas putida KT2440
ccggcacauagaccau

SEQ ID NO: 1584765 - RNA, 18 nt, Pseudomonas putida KT2440
ccggcagaaucagguuca

SEQ ID NO: 1584766 - RNA, 17 nt, Pseudomonas putida KT2440
ccggcacuccagcgagu

SEQ ID NO: 1584767 - RNA, 19 nt, Pseudomonas putida KT2440
ccggcacuccagcgagugg

SEQ ID NO: 1584768 - RNA, 15 nt, Pseudomonas putida KT2440
ccggcaccgacagca

SEQ ID NO: 1584769 - RNA, 16 nt, Pseudomonas putida KT2440
ccggcaccgacagcaa

SEQ ID NO: 1584770 - RNA, 21 nt, Pseudomonas putida KT2440
ccggcaccgccucuaccacgc

SEQ ID NO: 1584771 - RNA, 18 nt, Pseudomonas putida KT2440
ccggcaccugcuugccgc

SEQ ID NO: 1584772 - RNA, 21 nt, Pseudomonas putida KT2440
ccggcaccgggaugcucugca

SEQ ID NO: 1584773 - RNA, 12 nt, Pseudomonas putida KT2440
ccggcaccgcca

SEQ ID NO: 1584774 - RNA, 22 nt, Pseudomonas putida KT2440
ccgcgcugccucgucggacagc

SEQ ID NO: 1584775 - RNA, 13 nt, Pseudomonas putida KT2440
ccgcgcugacgca

SEQ ID NO: 1584776 - RNA, 18 nt, Pseudomonas putida KT2440
ccgcgcugaccaaggcaa

SEQ ID NO: 1584777 - RNA, 20 nt, Pseudomonas putida KT2440
ccgcgccgacagccucaagg

SEQ ID NO: 1584778 - RNA, 18 nt, Pseudomonas putida KT2440
ccgcggccaacauucacg

SEQ ID NO: 1584779 - RNA, 22 nt, Pseudomonas putida KT2440
ccgcguaccagcagggccauca

SEQ ID NO: 1584780 - RNA, 19 nt, Pseudomonas putida KT2440
ccgcgguuuggucgcggca

SEQ ID NO: 1584781 - RNA, 18 nt, Pseudomonas putida KT2440
ccgcguccuggacccgca

SEQ ID NO: 1584782 - RNA, 16 nt, Pseudomonas putida KT2440
ccgcgguagugcggcc

SEQ ID NO: 1584783 - RNA, 17 nt, Pseudomonas putida KT2440
ccgcggguaccaccugg

SEQ ID NO: 1584784 - RNA, 20 nt, Pseudomonas putida KT2440
ccgcgggcgucgcgaucacg

SEQ ID NO: 1584785 - RNA, 20 nt, Pseudomonas putida KT2440
ccgcggcgaacacagcggcc

SEQ ID NO: 1584786 - RNA, 17 nt, Pseudomonas putida KT2440
ccgcugcauaggugucg

SEQ ID NO: 1584787 - RNA, 23 nt, Pseudomonas putida KT2440
ccgcugccacagguacugcgcaa

SEQ ID NO: 1584788 - RNA, 22 nt, Pseudomonas putida KT2440
ccgcugccacccacaggcacga

SEQ ID NO: 1584789 - RNA, 16 nt, Pseudomonas putida KT2440
ccgcugccagcugcgc

SEQ ID NO: 1584790 - RNA, 15 nt, Pseudomonas putida KT2440
ccgcugcauggccug

SEQ ID NO: 1584791 - RNA, 13 nt, Pseudomonas putida KT2440
ccgcugcccagcg

SEQ ID NO: 1584792 - RNA, 21 nt, Pseudomonas putida KT2440
ccgcugccuuccaaccagcca

SEQ ID NO: 1584793 - RNA, 13 nt, Pseudomonas putida KT2440
ccgcugccuuccg

SEQ ID NO: 1584794 - RNA, 14 nt, Pseudomonas putida KT2440
ccgcugccuuccgc

SEQ ID NO: 1584795 - RNA, 21 nt, Pseudomonas putida KT2440
ccgcugcaaucgagccgaaca

SEQ ID NO: 1584796 - RNA, 13 nt, Pseudomonas putida KT2440
ccgcugcacaggc

SEQ ID NO: 1584797 - RNA, 14 nt, Pseudomonas putida KT2440
ccgcucgcugcgau

SEQ ID NO: 1584798 - RNA, 23 nt, Pseudomonas putida KT2440
ccgcucaaccuuugcggcacauc

SEQ ID NO: 1584799 - RNA, 22 nt, Pseudomonas putida KT2440
ccgcucaaacccggcagccacc

SEQ ID NO: 1584800 - RNA, 20 nt, Pseudomonas putida KT2440
ccgcuauccucgaucgccau

SEQ ID NO: 1584801 - RNA, 21 nt, Pseudomonas putida KT2440
ccgcucaugguucuggcgcac

SEQ ID NO: 1584802 - RNA, 12 nt, Pseudomonas putida KT2440
ccgcucccacag

SEQ ID NO: 1584803 - RNA, 22 nt, Pseudomonas putida KT2440
ccgcucccacagaaggcugcgu

SEQ ID NO: 1584804 - RNA, 17 nt, Pseudomonas putida KT2440
ccgcucccacagggacc

SEQ ID NO: 1584805 - RNA, 19 nt, Pseudomonas putida KT2440
ccgcucccacagggaccgc

SEQ ID NO: 1584806 - RNA, 20 nt, Pseudomonas putida KT2440
ccgcucccacagguacucgc

SEQ ID NO: 1584807 - RNA, 14 nt, Pseudomonas putida KT2440
ccgcuuguagcuca

SEQ ID NO: 1584808 - RNA, 16 nt, Pseudomonas putida KT2440
ccgcuuuggcagcagc

SEQ ID NO: 1584809 - RNA, 22 nt, Pseudomonas putida KT2440
ccgcuuuuugcgucuccacgac

SEQ ID NO: 1584810 - RNA, 18 nt, Pseudomonas putida KT2440
ccgcuuuuggcugugcac

SEQ ID NO: 1584811 - RNA, 20 nt, Pseudomonas putida KT2440
ccgcuuuuggcugugcaccc

SEQ ID NO: 1584812 - RNA, 20 nt, Pseudomonas putida KT2440
ccgcuugcaguuguccaggc

SEQ ID NO: 1584813 - RNA, 22 nt, Pseudomonas putida KT2440
ccgcuugccuuccucggccaug

SEQ ID NO: 1584814 - RNA, 17 nt, Pseudomonas putida KT2440
ccgcuuccaggaacggc

SEQ ID NO: 1584815 - RNA, 15 nt, Pseudomonas putida KT2440
ccgcuugaugggcca

SEQ ID NO: 1584816 - RNA, 21 nt, Pseudomonas putida KT2440
ccgcugguggcguggcugcgu

SEQ ID NO: 1584817 - RNA, 15 nt, Pseudomonas putida KT2440
ccgcuguacaccagg

SEQ ID NO: 1584818 - RNA, 15 nt, Pseudomonas putida KT2440
ccgcugcgccugccg

SEQ ID NO: 1584819 - RNA, 22 nt, Pseudomonas putida KT2440
ccgcugccgggcaaagcggguc

SEQ ID NO: 1584820 - RNA, 21 nt, Pseudomonas putida KT2440
ccgcugcgcaccaaggcggca

SEQ ID NO: 1584821 - RNA, 19 nt, Pseudomonas putida KT2440
ccgcugguacagggucagg

SEQ ID NO: 1584822 - RNA, 22 nt, Pseudomonas putida KT2440
ccgcuucacccucgcgcagcau

SEQ ID NO: 1584823 - RNA, 14 nt, Pseudomonas putida KT2440
ccgcuucaccgcgc

SEQ ID NO: 1584824 - RNA, 12 nt, Pseudomonas putida KT2440
ccgcuguucagc

SEQ ID NO: 1584825 - RNA, 13 nt, Pseudomonas putida KT2440
ccgcuguucugca

SEQ ID NO: 1584826 - RNA, 18 nt, Pseudomonas putida KT2440
ccgcuguugagcagcagc

SEQ ID NO: 1584827 - RNA, 15 nt, Pseudomonas putida KT2440
cgaugaugcuggucg

SEQ ID NO: 1584828 - RNA, 13 nt, Pseudomonas putida KT2440
cgaugaucugccg

SEQ ID NO: 1584829 - RNA, 24 nt, Pseudomonas putida KT2440
cgaugaugauaccgaacagcaccg

SEQ ID NO: 1584830 - RNA, 23 nt, Pseudomonas putida KT2440
cgaugagguagaucacaccggcc

SEQ ID NO: 1584831 - RNA, 23 nt, Pseudomonas putida KT2440
cgaugaaggcugcuucguucacg

SEQ ID NO: 1584832 - RNA, 23 nt, Pseudomonas putida KT2440
cgaucucugcuuccuugcgcacg

SEQ ID NO: 1584833 - RNA, 18 nt, Pseudomonas putida KT2440
cgaucuuggccagggccu

SEQ ID NO: 1584834 - RNA, 15 nt, Pseudomonas putida KT2440
cgaugaacccgcgau

SEQ ID NO: 1584835 - RNA, 22 nt, Pseudomonas putida KT2440
cgaucgaccggguaaucgccag

SEQ ID NO: 1584836 - RNA, 13 nt, Pseudomonas putida KT2440
cgaucgccaggug

SEQ ID NO: 1584837 - RNA, 16 nt, Pseudomonas putida KT2440
cgaucgccggcagcug

SEQ ID NO: 1584838 - RNA, 16 nt, Pseudomonas putida KT2440
cgaucgccagccccag

SEQ ID NO: 1584839 - RNA, 20 nt, Pseudomonas putida KT2440
cgaucggcgcgccuggcucg

SEQ ID NO: 1584840 - RNA, 15 nt, Pseudomonas putida KT2440
cgaucucggccagca

SEQ ID NO: 1584841 - RNA, 16 nt, Pseudomonas putida KT2440
cgaucucggccagcag

SEQ ID NO: 1584842 - RNA, 17 nt, Pseudomonas putida KT2440
cgaucacauaaggcagc

SEQ ID NO: 1584843 - RNA, 21 nt, Pseudomonas putida KT2440
cgaucacauaaggcagcagcu

SEQ ID NO: 1584844 - RNA, 22 nt, Pseudomonas putida KT2440
cgaucaccagcaccccgaacgc

SEQ ID NO: 1584845 - RNA, 23 nt, Pseudomonas putida KT2440
cgaucacgaacacaucaccugcu

SEQ ID NO: 1584846 - RNA, 18 nt, Pseudomonas putida KT2440
cgaucagguugagcaccg

SEQ ID NO: 1584847 - RNA, 18 nt, Pseudomonas putida KT2440
cgaucagguugcccagca

SEQ ID NO: 1584848 - RNA, 19 nt, Pseudomonas putida KT2440
cgaucagguugcccagcau

SEQ ID NO: 1584849 - RNA, 13 nt, Pseudomonas putida KT2440
cgaucagccguga

SEQ ID NO: 1584850 - RNA, 19 nt, Pseudomonas putida KT2440
cgaucaguaaucugccggc

SEQ ID NO: 1584851 - RNA, 13 nt, Pseudomonas putida KT2440
cgauccaggugcg

SEQ ID NO: 1584852 - RNA, 22 nt, Pseudomonas putida KT2440
cgauccaggugcgcaccuuggc

SEQ ID NO: 1584853 - RNA, 18 nt, Pseudomonas putida KT2440
cgauccaucuucaccuug

SEQ ID NO: 1584854 - RNA, 19 nt, Pseudomonas putida KT2440
cgauccgggugcuggcucg

SEQ ID NO: 1584855 - RNA, 16 nt, Pseudomonas putida KT2440
cgauccuguggaagcg

SEQ ID NO: 1584856 - RNA, 16 nt, Pseudomonas putida KT2440
cgaucgaagcagcagc

SEQ ID NO: 1584857 - RNA, 20 nt, Pseudomonas putida KT2440
cgaucgaaaaaccgcucccg

SEQ ID NO: 1584858 - RNA, 19 nt, Pseudomonas putida KT2440
cgaucgaaaucagccuuca

SEQ ID NO: 1584859 - RNA, 21 nt, Pseudomonas putida KT2440
cgauccucaucguccaccgcg

SEQ ID NO: 1584860 - RNA, 18 nt, Pseudomonas putida KT2440
cgauccucugugggagcg

SEQ ID NO: 1584861 - RNA, 15 nt, Pseudomonas putida KT2440
cgaggcgggccgcag

SEQ ID NO: 1584862 - RNA, 15 nt, Pseudomonas putida KT2440
cgaucaaugggccga

SEQ ID NO: 1584863 - RNA, 18 nt, Pseudomonas putida KT2440
cgaucaaugggccgauca

SEQ ID NO: 1584864 - RNA, 23 nt, Pseudomonas putida KT2440
cgauagcgugaagcggccaccug

SEQ ID NO: 1584865 - RNA, 17 nt, Pseudomonas putida KT2440
cgauagccagcuggcca

SEQ ID NO: 1584866 - RNA, 22 nt, Pseudomonas putida KT2440
cgauaaggaacuugucgacgau

SEQ ID NO: 1584867 - RNA, 17 nt, Pseudomonas putida KT2440
cgaugcccgggccuuca

SEQ ID NO: 1584868 - RNA, 20 nt, Pseudomonas putida KT2440
cgaugcccuccagcccuggc

SEQ ID NO: 1584869 - RNA, 12 nt, Pseudomonas putida KT2440
cgaugcugcuga

SEQ ID NO: 1584870 - RNA, 17 nt, Pseudomonas putida KT2440
cgauggccaccagcacc

SEQ ID NO: 1584871 - RNA, 19 nt, Pseudomonas putida KT2440
cgauguccuugcuggccac

SEQ ID NO: 1584872 - RNA, 23 nt, Pseudomonas putida KT2440
cgaugucgaauacaccgccgcau

SEQ ID NO: 1584873 - RNA, 17 nt, Pseudomonas putida KT2440
cgauggugccaggggcu

SEQ ID NO: 1584874 - RNA, 18 nt, Pseudomonas putida KT2440
cgauggugaaggccagga

SEQ ID NO: 1584875 - RNA, 18 nt, Pseudomonas putida KT2440
cgauggucacccgcgacc

SEQ ID NO: 1584876 - RNA, 20 nt, Pseudomonas putida KT2440
cgauugcugccgaccugcgc

SEQ ID NO: 1584877 - RNA, 23 nt, Pseudomonas putida KT2440
cgaugucugccgcuucguccagg

SEQ ID NO: 1584878 - RNA, 16 nt, Pseudomonas putida KT2440
cgaugucggcgugcac

SEQ ID NO: 1584879 - RNA, 16 nt, Pseudomonas putida KT2440
cgcaaaaguccccguu

SEQ ID NO: 1584880 - RNA, 17 nt, Pseudomonas putida KT2440
cgcaaaaaaugugcgca

SEQ ID NO: 1584881 - RNA, 17 nt, Pseudomonas putida KT2440
cgcaaagacugccaagu

SEQ ID NO: 1584882 - RNA, 12 nt, Pseudomonas putida KT2440
cgcaacuccacg

SEQ ID NO: 1584883 - RNA, 17 nt, Pseudomonas putida KT2440
cgcaaccgggucggcgc

SEQ ID NO: 1584884 - RNA, 17 nt, Pseudomonas putida KT2440
cgcaaggccgcggcuga

SEQ ID NO: 1584885 - RNA, 18 nt, Pseudomonas putida KT2440
cgcaaucgucguaggcgc

SEQ ID NO: 1584886 - RNA, 20 nt, Pseudomonas putida KT2440
cgcaauccgugagccaggag

SEQ ID NO: 1584887 - RNA, 15 nt, Pseudomonas putida KT2440
cgcaaucgucgacca

SEQ ID NO: 1584888 - RNA, 21 nt, Pseudomonas putida KT2440
cgcaauccccuccgccugcgg

SEQ ID NO: 1584889 - RNA, 18 nt, Pseudomonas putida KT2440
cgcaaucaaagcagacag

SEQ ID NO: 1584890 - RNA, 20 nt, Pseudomonas putida KT2440
cgcacaaggccgcucccaca

SEQ ID NO: 1584891 - RNA, 17 nt, Pseudomonas putida KT2440
cgcacaccgcugguggc

SEQ ID NO: 1584892 - RNA, 13 nt, Pseudomonas putida KT2440
cgcaauugccggu

SEQ ID NO: 1584893 - RNA, 18 nt, Pseudomonas putida KT2440
cgcaaugcgccccggcga

SEQ ID NO: 1584894 - RNA, 19 nt, Pseudomonas putida KT2440
cgcaaugaaaaagccccug

SEQ ID NO: 1584895 - RNA, 13 nt, Pseudomonas putida KT2440
cgcacagggcgau

SEQ ID NO: 1584896 - RNA, 16 nt, Pseudomonas putida KT2440
cgcacaggcuggccac

SEQ ID NO: 1584897 - RNA, 22 nt, Pseudomonas putida KT2440
cgcacaucacguuuggcagugc

SEQ ID NO: 1584898 - RNA, 23 nt, Pseudomonas putida KT2440
cgcacauagcccugcucguccau

SEQ ID NO: 1584899 - RNA, 17 nt, Pseudomonas putida KT2440
cgcacagcacguucagc

SEQ ID NO: 1584900 - RNA, 13 nt, Pseudomonas putida KT2440
cgcacagcugccg

SEQ ID NO: 1584901 - RNA, 16 nt, Pseudomonas putida KT2440
cgcacaugaagccgcg

SEQ ID NO: 1584902 - RNA, 14 nt, Pseudomonas putida KT2440
cgcaccaaggcggc

SEQ ID NO: 1584903 - RNA, 13 nt, Pseudomonas putida KT2440
cgcaccagcucca

SEQ ID NO: 1584904 - RNA, 23 nt, Pseudomonas putida KT2440
cgcaccagggcuggcagcgggua

SEQ ID NO: 1584905 - RNA, 15 nt, Pseudomonas putida KT2440
cgcacccgccuccgg

SEQ ID NO: 1584906 - RNA, 18 nt, Pseudomonas putida KT2440
cgcacccgccuccggcgc

SEQ ID NO: 1584907 - RNA, 15 nt, Pseudomonas putida KT2440
cgcacccgcaagcgc

SEQ ID NO: 1584908 - RNA, 16 nt, Pseudomonas putida KT2440
cgcaccaggucgcggu

SEQ ID NO: 1584909 - RNA, 20 nt, Pseudomonas putida KT2440
cgcaccaugucccaguucau

SEQ ID NO: 1584910 - RNA, 16 nt, Pseudomonas putida KT2440
cgcaccaucggcucca

SEQ ID NO: 1584911 - RNA, 19 nt, Pseudomonas putida KT2440
cgcaccaucggcuccagcg

SEQ ID NO: 1584912 - RNA, 18 nt, Pseudomonas putida KT2440
cgcacccaccgcagguca

SEQ ID NO: 1584913 - RNA, 16 nt, Pseudomonas putida KT2440
cgcacccagcaggccg

SEQ ID NO: 1584914 - RNA, 18 nt, Pseudomonas putida KT2440
cgcagcaucuuccugcca

SEQ ID NO: 1584915 - RNA, 17 nt, Pseudomonas putida KT2440
cgcagcccaaacagcau

SEQ ID NO: 1584916 - RNA, 13 nt, Pseudomonas putida KT2440
cgcagcccacggc

SEQ ID NO: 1584917 - RNA, 15 nt, Pseudomonas putida KT2440
cgcagccccaccucg

SEQ ID NO: 1584918 - RNA, 15 nt, Pseudomonas putida KT2440
cgcagauggcagaca

SEQ ID NO: 1584919 - RNA, 21 nt, Pseudomonas putida KT2440
cgcagaugguggcauagcgcg

SEQ ID NO: 1584920 - RNA, 21 nt, Pseudomonas putida KT2440
cgcagcaauacgcacaggcgc

SEQ ID NO: 1584921 - RNA, 13 nt, Pseudomonas putida KT2440
cgcagaucccgcu

SEQ ID NO: 1584922 - RNA, 14 nt, Pseudomonas putida KT2440
cgcagagcggcccu

SEQ ID NO: 1584923 - RNA, 22 nt, Pseudomonas putida KT2440
cgcagagcggcccugagccuug

SEQ ID NO: 1584924 - RNA, 14 nt, Pseudomonas putida KT2440
cgcagacuggguga

SEQ ID NO: 1584925 - RNA, 19 nt, Pseudomonas putida KT2440
cgcagacuucgaagugcca

SEQ ID NO: 1584926 - RNA, 12 nt, Pseudomonas putida KT2440
cgcaggcgcugc

SEQ ID NO: 1584927 - RNA, 14 nt, Pseudomonas putida KT2440
cgcaggcgcugcag

SEQ ID NO: 1584928 - RNA, 18 nt, Pseudomonas putida KT2440
cgcaggcgccgccagcug

SEQ ID NO: 1584929 - RNA, 19 nt, Pseudomonas putida KT2440
cgcaggaauaacuggcccg

SEQ ID NO: 1584930 - RNA, 15 nt, Pseudomonas putida KT2440
cgcaggaaggugcca

SEQ ID NO: 1584931 - RNA, 15 nt, Pseudomonas putida KT2440
cgcaggaagaaggca

SEQ ID NO: 1584932 - RNA, 21 nt, Pseudomonas putida KT2440
cgcaggaacaggcugaugcgc

SEQ ID NO: 1584933 - RNA, 19 nt, Pseudomonas putida KT2440
cgcagcggcgucaccuucc

SEQ ID NO: 1584934 - RNA, 14 nt, Pseudomonas putida KT2440
cgcagccggccuug

SEQ ID NO: 1584935 - RNA, 17 nt, Pseudomonas putida KT2440
cgcagcgcuucgaucag

SEQ ID NO: 1584936 - RNA, 20 nt, Pseudomonas putida KT2440
cgcaguggucauagucaccg

SEQ ID NO: 1584937 - RNA, 14 nt, Pseudomonas putida KT2440
cgcagugcagccgc

SEQ ID NO: 1584938 - RNA, 22 nt, Pseudomonas putida KT2440
cgcagugccgugaguggccucg

SEQ ID NO: 1584939 - RNA, 15 nt, Pseudomonas putida KT2440
cgcagggugugcugc

SEQ ID NO: 1584940 - RNA, 18 nt, Pseudomonas putida KT2440
cgcagggugugcugcugc

SEQ ID NO: 1584941 - RNA, 19 nt, Pseudomonas putida KT2440
cgcagggugugcugcugcc

SEQ ID NO: 1584942 - RNA, 18 nt, Pseudomonas putida KT2440
cgcagguaaucggccugu

SEQ ID NO: 1584943 - RNA, 16 nt, Pseudomonas putida KT2440
cgcagguacgccaugu

SEQ ID NO: 1584944 - RNA, 20 nt, Pseudomonas putida KT2440
cgcaggggcugcgcaaggcg

SEQ ID NO: 1584945 - RNA, 19 nt, Pseudomonas putida KT2440
cgcauaugccccaggcauu

SEQ ID NO: 1584946 - RNA, 15 nt, Pseudomonas putida KT2440
cgcauaggccaaggu

SEQ ID NO: 1584947 - RNA, 14 nt, Pseudomonas putida KT2440
cgcaguucguccag

SEQ ID NO: 1584948 - RNA, 19 nt, Pseudomonas putida KT2440
cgcauaaccaccaccgacc

SEQ ID NO: 1584949 - RNA, 15 nt, Pseudomonas putida KT2440
cgcaugcggccguga

SEQ ID NO: 1584950 - RNA, 18 nt, Pseudomonas putida KT2440
cgcaugcggccgugaaca

SEQ ID NO: 1584951 - RNA, 22 nt, Pseudomonas putida KT2440
cgcaugccgaugucggcgugca

SEQ ID NO: 1584952 - RNA, 15 nt, Pseudomonas putida KT2440
cgcaucagcgcagca

SEQ ID NO: 1584953 - RNA, 23 nt, Pseudomonas putida KT2440
cgcauccccggccuccucgcggg

SEQ ID NO: 1584954 - RNA, 17 nt, Pseudomonas putida KT2440
cgccaacgaaucagcca

SEQ ID NO: 1584955 - RNA, 15 nt, Pseudomonas putida KT2440
cgccaaccgccagca

SEQ ID NO: 1584956 - RNA, 20 nt, Pseudomonas putida KT2440
cgccaaagugauaacgcgcc

SEQ ID NO: 1584957 - RNA, 14 nt, Pseudomonas putida KT2440
cgccaacagcgcag

SEQ ID NO: 1584958 - RNA, 20 nt, Pseudomonas putida KT2440
cgccaacccgaucccgacaa

SEQ ID NO: 1584959 - RNA, 21 nt, Pseudomonas putida KT2440
cgccaaaaggcccgaaacugc

SEQ ID NO: 1584960 - RNA, 20 nt, Pseudomonas putida KT2440
cgcauucgcggguaaacccg

SEQ ID NO: 1584961 - RNA, 15 nt, Pseudomonas putida KT2440
cgccagcaucacccu

SEQ ID NO: 1584962 - RNA, 20 nt, Pseudomonas putida KT2440
cgccagcagugcaucgaagc

SEQ ID NO: 1584963 - RNA, 17 nt, Pseudomonas putida KT2440
cgccagcacgcaggcca

SEQ ID NO: 1584964 - RNA, 14 nt, Pseudomonas putida KT2440
cgccagcauggccg

SEQ ID NO: 1584965 - RNA, 22 nt, Pseudomonas putida KT2440
cgccagcuccacacucgacgcu

SEQ ID NO: 1584966 - RNA, 19 nt, Pseudomonas putida KT2440
cgccagcgcuccagcaacg

SEQ ID NO: 1584967 - RNA, 21 nt, Pseudomonas putida KT2440
cgccagcgcuccagcaacgga

SEQ ID NO: 1584968 - RNA, 15 nt, Pseudomonas putida KT2440
cgccagccugcagcg

SEQ ID NO: 1584969 - RNA, 18 nt, Pseudomonas putida KT2440
cgccagccugcagcgcgg

SEQ ID NO: 1584970 - RNA, 21 nt, Pseudomonas putida KT2440
cgccagacgcgcgcuggcucg

SEQ ID NO: 1584971 - RNA, 11 nt, Pseudomonas putida KT2440
cgccagcaauu

SEQ ID NO: 1584972 - RNA, 20 nt, Pseudomonas putida KT2440
cgccagaccaccucaucccc

SEQ ID NO: 1584973 - RNA, 13 nt, Pseudomonas putida KT2440
cgccacucccaug

SEQ ID NO: 1584974 - RNA, 23 nt, Pseudomonas putida KT2440
cgccacucccauguagaccacca

SEQ ID NO: 1584975 - RNA, 16 nt, Pseudomonas putida KT2440
cgccaaucaucgccag

SEQ ID NO: 1584976 - RNA, 17 nt, Pseudomonas putida KT2440
cgccaaucaucgccagc

SEQ ID NO: 1584977 - RNA, 16 nt, Pseudomonas putida KT2440
cgccaagguccagcca

SEQ ID NO: 1584978 - RNA, 17 nt, Pseudomonas putida KT2440
cgccaauaccgcgcauc

SEQ ID NO: 1584979 - RNA, 14 nt, Pseudomonas putida KT2440
cgccaauagcccgc

SEQ ID NO: 1584980 - RNA, 18 nt, Pseudomonas putida KT2440
cgccaaucaccugcacau

SEQ ID NO: 1584981 - RNA, 16 nt, Pseudomonas putida KT2440
cgccaaucaaccgcuu

SEQ ID NO: 1584982 - RNA, 22 nt, Pseudomonas putida KT2440
cgccaccuuguucgagcgccau

SEQ ID NO: 1584983 - RNA, 19 nt, Pseudomonas putida KT2440
cgccacgccugcagucgau

SEQ ID NO: 1584984 - RNA, 18 nt, Pseudomonas putida KT2440
cgccacgcgggcuaugcg

SEQ ID NO: 1584985 - RNA, 11 nt, Pseudomonas putida KT2440
cgccaggcgcg

SEQ ID NO: 1584986 - RNA, 22 nt, Pseudomonas putida KT2440
cgccaggcguugugggugaagu

SEQ ID NO: 1584987 - RNA, 18 nt, Pseudomonas putida KT2440
cgccaggcucuccagccg

SEQ ID NO: 1584988 - RNA, 22 nt, Pseudomonas putida KT2440
cgccaggcugauacgcgacagu

SEQ ID NO: 1584989 - RNA, 18 nt, Pseudomonas putida KT2440
cgccaggcggucgcccau

SEQ ID NO: 1584990 - RNA, 17 nt, Pseudomonas putida KT2440
cgccaggcccaccaccg

SEQ ID NO: 1584991 - RNA, 18 nt, Pseudomonas putida KT2440
cgccaggcccaccaccgg

SEQ ID NO: 1584992 - RNA, 18 nt, Pseudomonas putida KT2440
cgccagggcaucgaccag

SEQ ID NO: 1584993 - RNA, 21 nt, Pseudomonas putida KT2440
cgccagggcugauugagcagc

SEQ ID NO: 1584994 - RNA, 21 nt, Pseudomonas putida KT2440
cgccaggguugcaucgcgcac

SEQ ID NO: 1584995 - RNA, 19 nt, Pseudomonas putida KT2440
cgccagguauucggcaaug

SEQ ID NO: 1584996 - RNA, 23 nt, Pseudomonas putida KT2440
cgccagguccgguaacuggccca

SEQ ID NO: 1584997 - RNA, 22 nt, Pseudomonas putida KT2440
cgccaggucuuccuccgacagc

SEQ ID NO: 1584998 - RNA, 15 nt, Pseudomonas putida KT2440
cgccaguacgccagc

SEQ ID NO: 1584999 - RNA, 16 nt, Pseudomonas putida KT2440
cgccaggucggacagg

SEQ ID NO: 1585000 - RNA, 13 nt, Pseudomonas putida KT2440
cgccaggugcuca

SEQ ID NO: 1585001 - RNA, 15 nt, Pseudomonas putida KT2440
cgccaggugcucagc

SEQ ID NO: 1585002 - RNA, 18 nt, Pseudomonas putida KT2440
cgccagugcggugaccga

SEQ ID NO: 1585003 - RNA, 22 nt, Pseudomonas putida KT2440
cgccagugggugcuguggcgca

SEQ ID NO: 1585004 - RNA, 22 nt, Pseudomonas putida KT2440
cgccaguuacccuguacccgcu

SEQ ID NO: 1585005 - RNA, 17 nt, Pseudomonas putida KT2440
cgccaguucgcggcgca

SEQ ID NO: 1585006 - RNA, 22 nt, Pseudomonas putida KT2440
cgccaguucgcggcgcaccgcu

SEQ ID NO: 1585007 - RNA, 15 nt, Pseudomonas putida KT2440
cgccaguucgacgcu

SEQ ID NO: 1585008 - RNA, 22 nt, Pseudomonas putida KT2440
cgccaguucgacgcugcugucg

SEQ ID NO: 1585009 - RNA, 16 nt, Pseudomonas putida KT2440
cgccaguuccacgacc

SEQ ID NO: 1585010 - RNA, 12 nt, Pseudomonas putida KT2440
cgccaucgccca

SEQ ID NO: 1585011 - RNA, 14 nt, Pseudomonas putida KT2440
cgccaucucgcaaa

SEQ ID NO: 1585012 - RNA, 13 nt, Pseudomonas putida KT2440
cgccaucggccuc

SEQ ID NO: 1585013 - RNA, 15 nt, Pseudomonas putida KT2440
cgccaucggccucuc

SEQ ID NO: 1585014 - RNA, 21 nt, Pseudomonas putida KT2440
cgccaucggccucucucagca

SEQ ID NO: 1585015 - RNA, 22 nt, Pseudomonas putida KT2440
cgccaguuucaccugaccauca

SEQ ID NO: 1585016 - RNA, 23 nt, Pseudomonas putida KT2440
cgccaguuugucguucuccugcg

SEQ ID NO: 1585017 - RNA, 22 nt, Pseudomonas putida KT2440
cgccauagcucauggucagccg

SEQ ID NO: 1585018 - RNA, 22 nt, Pseudomonas putida KT2440
cgccauaucaggauugccgcag

SEQ ID NO: 1585019 - RNA, 17 nt, Pseudomonas putida KT2440
cgccauaggcuugcgcu

SEQ ID NO: 1585020 - RNA, 16 nt, Pseudomonas putida KT2440
cgccaguugucgcugg

SEQ ID NO: 1585021 - RNA, 22 nt, Pseudomonas putida KT2440
cgccaucagugcccccgccaca

SEQ ID NO: 1585022 - RNA, 14 nt, Pseudomonas putida KT2440
cgccaucagaggcg

SEQ ID NO: 1585023 - RNA, 19 nt, Pseudomonas putida KT2440
cgccaucagaggcgauggc

SEQ ID NO: 1585024 - RNA, 22 nt, Pseudomonas putida KT2440
cgccaucagaggcgauggcauc

SEQ ID NO: 1585025 - RNA, 19 nt, Pseudomonas putida KT2440
cgacccaaaaauggucggg

SEQ ID NO: 1585026 - RNA, 16 nt, Pseudomonas putida KT2440
cgacccauuugcagca

SEQ ID NO: 1585027 - RNA, 20 nt, Pseudomonas putida KT2440
cgaccucgauuuccaccggc

SEQ ID NO: 1585028 - RNA, 15 nt, Pseudomonas putida KT2440
cgaccucggccaggu

SEQ ID NO: 1585029 - RNA, 17 nt, Pseudomonas putida KT2440
cgaccucuuagcgggca

SEQ ID NO: 1585030 - RNA, 18 nt, Pseudomonas putida KT2440
cgaccucuuagcgggcaa

SEQ ID NO: 1585031 - RNA, 18 nt, Pseudomonas putida KT2440
cgaccugcguggugccuu

SEQ ID NO: 1585032 - RNA, 15 nt, Pseudomonas putida KT2440
cgaccugcaggcccu

SEQ ID NO: 1585033 - RNA, 18 nt, Pseudomonas putida KT2440
cgaccugccagccuucga

SEQ ID NO: 1585034 - RNA, 23 nt, Pseudomonas putida KT2440
cgacgcagacaaaacgcugcgac

SEQ ID NO: 1585035 - RNA, 18 nt, Pseudomonas putida KT2440
cgacgcaccagguuggcc

SEQ ID NO: 1585036 - RNA, 14 nt, Pseudomonas putida KT2440
cgacgcaucugcac

SEQ ID NO: 1585037 - RNA, 16 nt, Pseudomonas putida KT2440
cgacgcaucagggcau

SEQ ID NO: 1585038 - RNA, 18 nt, Pseudomonas putida KT2440
cgacgccggccugccgcu

SEQ ID NO: 1585039 - RNA, 14 nt, Pseudomonas putida KT2440
cgacgcuuggcgua

SEQ ID NO: 1585040 - RNA, 13 nt, Pseudomonas putida KT2440
cgacgcugccgca

SEQ ID NO: 1585041 - RNA, 13 nt, Pseudomonas putida KT2440
cgacgcgcgcagc

SEQ ID NO: 1585042 - RNA, 13 nt, Pseudomonas putida KT2440
cgacggccugugu

SEQ ID NO: 1585043 - RNA, 23 nt, Pseudomonas putida KT2440
cgacggccuguguucaaccaccg

SEQ ID NO: 1585044 - RNA, 21 nt, Pseudomonas putida KT2440
cgacuccggcaaggcauccag

SEQ ID NO: 1585045 - RNA, 14 nt, Pseudomonas putida KT2440
cgacucccgcugcc

SEQ ID NO: 1585046 - RNA, 17 nt, Pseudomonas putida KT2440
cgacgugguugagguuc

SEQ ID NO: 1585047 - RNA, 17 nt, Pseudomonas putida KT2440
cgacgugucaguggucg

SEQ ID NO: 1585048 - RNA, 17 nt, Pseudomonas putida KT2440
cgaggaucagcgcagac

SEQ ID NO: 1585049 - RNA, 19 nt, Pseudomonas putida KT2440
cgaggcccgaacuggccgg

SEQ ID NO: 1585050 - RNA, 20 nt, Pseudomonas putida KT2440
cgaggccccagaccaucagg

SEQ ID NO: 1585051 - RNA, 14 nt, Pseudomonas putida KT2440
cgaggccgucguag

SEQ ID NO: 1585052 - RNA, 15 nt, Pseudomonas putida KT2440
cgagcuacagccccu

SEQ ID NO: 1585053 - RNA, 14 nt, Pseudomonas putida KT2440
cgagcuugcucgcg

SEQ ID NO: 1585054 - RNA, 19 nt, Pseudomonas putida KT2440
cgagcuugcucgcgaugcg

SEQ ID NO: 1585055 - RNA, 19 nt, Pseudomonas putida KT2440
cgagcugaugcucaagcgc

SEQ ID NO: 1585056 - RNA, 17 nt, Pseudomonas putida KT2440
cgagcugcccaccaagg

SEQ ID NO: 1585057 - RNA, 13 nt, Pseudomonas putida KT2440
cgagccgaacagc

SEQ ID NO: 1585058 - RNA, 19 nt, Pseudomonas putida KT2440
cgagcccggguugaccuug

SEQ ID NO: 1585059 - RNA, 16 nt, Pseudomonas putida KT2440
cgagccgcauuggccg

SEQ ID NO: 1585060 - RNA, 16 nt, Pseudomonas putida KT2440
cgagccuuggccagcg

SEQ ID NO: 1585061 - RNA, 17 nt, Pseudomonas putida KT2440
cgagccuuccgggcacu

SEQ ID NO: 1585062 - RNA, 22 nt, Pseudomonas putida KT2440
cgagccuuccgggcacuggcug

SEQ ID NO: 1585063 - RNA, 15 nt, Pseudomonas putida KT2440
cgagcaugcggauau

SEQ ID NO: 1585064 - RNA, 20 nt, Pseudomonas putida KT2440
cgagcaucugcugcggcagg

SEQ ID NO: 1585065 - RNA, 14 nt, Pseudomonas putida KT2440
cgagcaugaggaua

SEQ ID NO: 1585066 - RNA, 19 nt, Pseudomonas putida KT2440
cgagcaugaucaccgccag

SEQ ID NO: 1585067 - RNA, 21 nt, Pseudomonas putida KT2440
cgagcaugaucaccgccagcg

SEQ ID NO: 1585068 - RNA, 19 nt, Pseudomonas putida KT2440
cgagcaucggcucgcagau

SEQ ID NO: 1585069 - RNA, 23 nt, Pseudomonas putida KT2440
cgagcagcuuauugcgcagggug

SEQ ID NO: 1585070 - RNA, 20 nt, Pseudomonas putida KT2440
cgagcaagcucgcuccuaca

SEQ ID NO: 1585071 - RNA, 20 nt, Pseudomonas putida KT2440
cgagcaagcucgcuccugca

SEQ ID NO: 1585072 - RNA, 18 nt, Pseudomonas putida KT2440
cgagcaacuugcgcagcu

SEQ ID NO: 1585073 - RNA, 11 nt, Pseudomonas putida KT2440
cgacugaccgc

SEQ ID NO: 1585074 - RNA, 17 nt, Pseudomonas putida KT2440
cgacucuacugcccgca

SEQ ID NO: 1585075 - RNA, 19 nt, Pseudomonas putida KT2440
cgacugccgcucaucgagg

SEQ ID NO: 1585076 - RNA, 18 nt, Pseudomonas putida KT2440
cgagaugaucgcggcaau

SEQ ID NO: 1585077 - RNA, 22 nt, Pseudomonas putida KT2440
cgagagccgggcaaugauccgg

SEQ ID NO: 1585078 - RNA, 14 nt, Pseudomonas putida KT2440
cgaacccuugaccu

SEQ ID NO: 1585079 - RNA, 14 nt, Pseudomonas putida KT2440
cgaacgcagcgccg

SEQ ID NO: 1585080 - RNA, 23 nt, Pseudomonas putida KT2440
cgaacgauucugccagcuccugg

SEQ ID NO: 1585081 - RNA, 18 nt, Pseudomonas putida KT2440
cgaagaucagcaccgagu

SEQ ID NO: 1585082 - RNA, 23 nt, Pseudomonas putida KT2440
cgaagaggccgguacagccagca

SEQ ID NO: 1585083 - RNA, 14 nt, Pseudomonas putida KT2440
cgaacuugccgaug

SEQ ID NO: 1585084 - RNA, 15 nt, Pseudomonas putida KT2440
cgaacuucuccagcg

SEQ ID NO: 1585085 - RNA, 21 nt, Pseudomonas putida KT2440
cgaacuuggguaacacgguga

SEQ ID NO: 1585086 - RNA, 17 nt, Pseudomonas putida KT2440
cgaacuuguuggccacc

SEQ ID NO: 1585087 - RNA, 15 nt, Pseudomonas putida KT2440
cgaacggcgccagca

SEQ ID NO: 1585088 - RNA, 13 nt, Pseudomonas putida KT2440
cgaacauggccac

SEQ ID NO: 1585089 - RNA, 18 nt, Pseudomonas putida KT2440
cgaacccgcugccaccca

SEQ ID NO: 1585090 - RNA, 19 nt, Pseudomonas putida KT2440
cgaaccaaggugcuaccgg

SEQ ID NO: 1585091 - RNA, 15 nt, Pseudomonas putida KT2440
cgaaccacagcacgc

SEQ ID NO: 1585092 - RNA, 14 nt, Pseudomonas putida KT2440
cgaacagcacugcc

SEQ ID NO: 1585093 - RNA, 22 nt, Pseudomonas putida KT2440
cgaacagcacgauggcggucga

SEQ ID NO: 1585094 - RNA, 16 nt, Pseudomonas putida KT2440
cgaacagcgccggcag

SEQ ID NO: 1585095 - RNA, 17 nt, Pseudomonas putida KT2440
cgaacagcgccggcagu

SEQ ID NO: 1585096 - RNA, 22 nt, Pseudomonas putida KT2440
cgaacagcugaucgccgucgac

SEQ ID NO: 1585097 - RNA, 14 nt, Pseudomonas putida KT2440
cgaacagcuugcca

SEQ ID NO: 1585098 - RNA, 16 nt, Pseudomonas putida KT2440
cgaacaggcugccgcg

SEQ ID NO: 1585099 - RNA, 22 nt, Pseudomonas putida KT2440
cgaaagccagcagugcggcaac

SEQ ID NO: 1585100 - RNA, 22 nt, Pseudomonas putida KT2440
ccuugugugggccuugcucaau

SEQ ID NO: 1585101 - RNA, 17 nt, Pseudomonas putida KT2440
ccuuuucgcggguaaac

SEQ ID NO: 1585102 - RNA, 18 nt, Pseudomonas putida KT2440
ccuuuucgcggguaaacc

SEQ ID NO: 1585103 - RNA, 18 nt, Pseudomonas putida KT2440
ccuugucgguauacggcc

SEQ ID NO: 1585104 - RNA, 23 nt, Pseudomonas putida KT2440
ccuugucgguauacggccaguug

SEQ ID NO: 1585105 - RNA, 22 nt, Pseudomonas putida KT2440
ccuugugggagcgggacugccc

SEQ ID NO: 1585106 - RNA, 16 nt, Pseudomonas putida KT2440
ccuuugagugcuucgc

SEQ ID NO: 1585107 - RNA, 21 nt, Pseudomonas putida KT2440
ccuuugcaaagcgcaccgcgc

SEQ ID NO: 1585108 - RNA, 14 nt, Pseudomonas putida KT2440
ccuugggguacacc

SEQ ID NO: 1585109 - RNA, 20 nt, Pseudomonas putida KT2440
ccuuggugcaauggucauug

SEQ ID NO: 1585110 - RNA, 21 nt, Pseudomonas putida KT2440
ccuuggugcaugcaagcagcc

SEQ ID NO: 1585111 - RNA, 13 nt, Pseudomonas putida KT2440
ccuuguaggagcu

SEQ ID NO: 1585112 - RNA, 16 nt, Pseudomonas putida KT2440
ccuugucagcaaccac

SEQ ID NO: 1585113 - RNA, 18 nt, Pseudomonas putida KT2440
ccuugucagccgccgcug

SEQ ID NO: 1585114 - RNA, 21 nt, Pseudomonas putida KT2440
ccuuggccagcucauccagcc

SEQ ID NO: 1585115 - RNA, 22 nt, Pseudomonas putida KT2440
ccuugcgcucgacgcgcgcagc

SEQ ID NO: 1585116 - RNA, 20 nt, Pseudomonas putida KT2440
ccuuggcgcacuuguuccag

SEQ ID NO: 1585117 - RNA, 12 nt, Pseudomonas putida KT2440
ccuucucuuccg

SEQ ID NO: 1585118 - RNA, 18 nt, Pseudomonas putida KT2440
ccuucugccguuugcugg

SEQ ID NO: 1585119 - RNA, 21 nt, Pseudomonas putida KT2440
ccuucugcgcgagugaugcgg

SEQ ID NO: 1585120 - RNA, 22 nt, Pseudomonas putida KT2440
ccuugaagaacaccugcagcgc

SEQ ID NO: 1585121 - RNA, 24 nt, Pseudomonas putida KT2440
ccuguucgauuucaccggcuucua

SEQ ID NO: 1585122 - RNA, 20 nt, Pseudomonas putida KT2440
ccuguuccggcccuuucgcg

SEQ ID NO: 1585123 - RNA, 20 nt, Pseudomonas putida KT2440
ccuguguaggagcggguuua

SEQ ID NO: 1585124 - RNA, 22 nt, Pseudomonas putida KT2440
ccuguggguaacccugcucgcc

SEQ ID NO: 1585125 - RNA, 19 nt, Pseudomonas putida KT2440
ccuguggggcaacugcgcg

SEQ ID NO: 1585126 - RNA, 21 nt, Pseudomonas putida KT2440
ccuguggggcaacugcgcgau

SEQ ID NO: 1585127 - RNA, 16 nt, Pseudomonas putida KT2440
ccugugggagcggccu

SEQ ID NO: 1585128 - RNA, 17 nt, Pseudomonas putida KT2440
ccugugggagcgggcau

SEQ ID NO: 1585129 - RNA, 18 nt, Pseudomonas putida KT2440
ccugugggagcgggcaug

SEQ ID NO: 1585130 - RNA, 23 nt, Pseudomonas putida KT2440
ccugugggagcgggcaugcccgc

SEQ ID NO: 1585131 - RNA, 18 nt, Pseudomonas putida KT2440
ccugugggagcgggcgug

SEQ ID NO: 1585132 - RNA, 19 nt, Pseudomonas putida KT2440
ccugugcuggccucuucgc

SEQ ID NO: 1585133 - RNA, 20 nt, Pseudomonas putida KT2440
ccugugcuggccucuucgcg

SEQ ID NO: 1585134 - RNA, 22 nt, Pseudomonas putida KT2440
ccugugcuuugagcaggcgcuc

SEQ ID NO: 1585135 - RNA, 20 nt, Pseudomonas putida KT2440
ccuguggaagcgggcgugcc

SEQ ID NO: 1585136 - RNA, 16 nt, Pseudomonas putida KT2440
ccugugaggccuucag

SEQ ID NO: 1585137 - RNA, 20 nt, Pseudomonas putida KT2440
ccugugaagccagggcaagc

SEQ ID NO: 1585138 - RNA, 16 nt, Pseudomonas putida KT2440
ccugugccgggccauc

SEQ ID NO: 1585139 - RNA, 22 nt, Pseudomonas putida KT2440
ccugugccgggccaucggugcc

SEQ ID NO: 1585140 - RNA, 20 nt, Pseudomonas putida KT2440
ccugugcccaaccaccgacc

SEQ ID NO: 1585141 - RNA, 22 nt, Pseudomonas putida KT2440
ccugugccgaaccaccgaugcc

SEQ ID NO: 1585142 - RNA, 16 nt, Pseudomonas putida KT2440
ccuggcacgcccggca

SEQ ID NO: 1585143 - RNA, 23 nt, Pseudomonas putida KT2440
ccuggcaugccccucgaacagcg

SEQ ID NO: 1585144 - RNA, 17 nt, Pseudomonas putida KT2440
ccuggccacuguugcag

SEQ ID NO: 1585145 - RNA, 18 nt, Pseudomonas putida KT2440
ccuuauccuucaggcgcu

SEQ ID NO: 1585146 - RNA, 16 nt, Pseudomonas putida KT2440
ccuguugccgcuucga

SEQ ID NO: 1585147 - RNA, 17 nt, Pseudomonas putida KT2440
ccuguugccgcuucgac

SEQ ID NO: 1585148 - RNA, 15 nt, Pseudomonas putida KT2440
ccuguuugccgaggu

SEQ ID NO: 1585149 - RNA, 21 nt, Pseudomonas putida KT2440
ccuucccgccauugcaccacg

SEQ ID NO: 1585150 - RNA, 18 nt, Pseudomonas putida KT2440
ccuuccagcccgccugcu

SEQ ID NO: 1585151 - RNA, 16 nt, Pseudomonas putida KT2440
ccuuccuuguaggcca

SEQ ID NO: 1585152 - RNA, 16 nt, Pseudomonas putida KT2440
ccuuccgaccggucau

SEQ ID NO: 1585153 - RNA, 21 nt, Pseudomonas putida KT2440
ccuuccguuaguucgugcacc

SEQ ID NO: 1585154 - RNA, 14 nt, Pseudomonas putida KT2440
ccuucgacuucccg

SEQ ID NO: 1585155 - RNA, 15 nt, Pseudomonas putida KT2440
cgacaccgccaacuc

SEQ ID NO: 1585156 - RNA, 23 nt, Pseudomonas putida KT2440
cgacaccuaucaguuucgcgacg

SEQ ID NO: 1585157 - RNA, 12 nt, Pseudomonas putida KT2440
cgacaccaggau

SEQ ID NO: 1585158 - RNA, 23 nt, Pseudomonas putida KT2440
cgaaugcuacagaagccucaccg

SEQ ID NO: 1585159 - RNA, 15 nt, Pseudomonas putida KT2440
cgacagcccgagcaa

SEQ ID NO: 1585160 - RNA, 22 nt, Pseudomonas putida KT2440
cgacagccucaaggccggcagc

SEQ ID NO: 1585161 - RNA, 16 nt, Pseudomonas putida KT2440
cgacagcguugcucca

SEQ ID NO: 1585162 - RNA, 15 nt, Pseudomonas putida KT2440
cgacagcggccagcu

SEQ ID NO: 1585163 - RNA, 20 nt, Pseudomonas putida KT2440
cgacagcggccagcucggcc

SEQ ID NO: 1585164 - RNA, 15 nt, Pseudomonas putida KT2440
cgaaguacggcuugc

SEQ ID NO: 1585165 - RNA, 22 nt, Pseudomonas putida KT2440
cgaagguguucaccacgcccug

SEQ ID NO: 1585166 - RNA, 14 nt, Pseudomonas putida KT2440
cgaaggggccggca

SEQ ID NO: 1585167 - RNA, 17 nt, Pseudomonas putida KT2440
cgaagucauccauggca

SEQ ID NO: 1585168 - RNA, 19 nt, Pseudomonas putida KT2440
cgaaguaggcaaacggcuc

SEQ ID NO: 1585169 - RNA, 12 nt, Pseudomonas putida KT2440
cgaagcaccacu

SEQ ID NO: 1585170 - RNA, 14 nt, Pseudomonas putida KT2440
cgaaguugcccgaa

SEQ ID NO: 1585171 - RNA, 15 nt, Pseudomonas putida KT2440
cgaaguugagcaccg

SEQ ID NO: 1585172 - RNA, 15 nt, Pseudomonas putida KT2440
cgaaguguugccggu

SEQ ID NO: 1585173 - RNA, 16 nt, Pseudomonas putida KT2440
cgaaucgacgcguacg

SEQ ID NO: 1585174 - RNA, 19 nt, Pseudomonas putida KT2440
cgaaucgccuucagcgccc

SEQ ID NO: 1585175 - RNA, 17 nt, Pseudomonas putida KT2440
cgaaucgcucugccgca

SEQ ID NO: 1585176 - RNA, 15 nt, Pseudomonas putida KT2440
cgaaucggguccacc

SEQ ID NO: 1585177 - RNA, 13 nt, Pseudomonas putida KT2440
cgaaugccgcugc

SEQ ID NO: 1585178 - RNA, 18 nt, Pseudomonas putida KT2440
cgaaugccgcugcuggcg

SEQ ID NO: 1585179 - RNA, 12 nt, Pseudomonas putida KT2440
cgaccagcgcca

SEQ ID NO: 1585180 - RNA, 13 nt, Pseudomonas putida KT2440
cgaccagcugcca

SEQ ID NO: 1585181 - RNA, 17 nt, Pseudomonas putida KT2440
cgaccagaagggcgcaa

SEQ ID NO: 1585182 - RNA, 16 nt, Pseudomonas putida KT2440
cgaccagaucagccgu

SEQ ID NO: 1585183 - RNA, 20 nt, Pseudomonas putida KT2440
cgaccagaucagccguuacc

SEQ ID NO: 1585184 - RNA, 18 nt, Pseudomonas putida KT2440
cgaccagaucaggccgcu

SEQ ID NO: 1585185 - RNA, 18 nt, Pseudomonas putida KT2440
cgaccauuugccauccgg

SEQ ID NO: 1585186 - RNA, 21 nt, Pseudomonas putida KT2440
cgacccacaggcacaggccca

SEQ ID NO: 1585187 - RNA, 18 nt, Pseudomonas putida KT2440
cgaccaucaccgccagca

SEQ ID NO: 1585188 - RNA, 13 nt, Pseudomonas putida KT2440
cgaccaggcgcuc

SEQ ID NO: 1585189 - RNA, 19 nt, Pseudomonas putida KT2440
cgaccagggccuuggccug

SEQ ID NO: 1585190 - RNA, 20 nt, Pseudomonas putida KT2440
cgaccagggccuuggccugg

SEQ ID NO: 1585191 - RNA, 18 nt, Pseudomonas putida KT2440
cgaccaguaccgcgccuc

SEQ ID NO: 1585192 - RNA, 23 nt, Pseudomonas putida KT2440
cgaccaguaccgcgccuccagcu

SEQ ID NO: 1585193 - RNA, 21 nt, Pseudomonas putida KT2440
cgaccaggugguaacuggcca

SEQ ID NO: 1585194 - RNA, 18 nt, Pseudomonas putida KT2440
cgaccaguacgaacuacg

SEQ ID NO: 1585195 - RNA, 14 nt, Pseudomonas putida KT2440
cgaccacccgguga

SEQ ID NO: 1585196 - RNA, 20 nt, Pseudomonas putida KT2440
cgaccacccggugacggcau

SEQ ID NO: 1585197 - RNA, 16 nt, Pseudomonas putida KT2440
cgaccaccaucgccag

SEQ ID NO: 1585198 - RNA, 14 nt, Pseudomonas putida KT2440
cgaccaauggcugc

SEQ ID NO: 1585199 - RNA, 17 nt, Pseudomonas putida KT2440
cgaccacgguaccggca

SEQ ID NO: 1585200 - RNA, 15 nt, Pseudomonas putida KT2440
cgaccacugcaggug

SEQ ID NO: 1585201 - RNA, 15 nt, Pseudomonas putida KT2440
cgaccaccugcucgg

SEQ ID NO: 1585202 - RNA, 15 nt, Pseudomonas putida KT2440
cgaccacgcacagcu

SEQ ID NO: 1585203 - RNA, 18 nt, Pseudomonas putida KT2440
cgaccaccgccucgaucg

SEQ ID NO: 1585204 - RNA, 15 nt, Pseudomonas putida KT2440
cgaccaccgcaggug

SEQ ID NO: 1585205 - RNA, 14 nt, Pseudomonas putida KT2440
cgacagugcccgcu

SEQ ID NO: 1585206 - RNA, 15 nt, Pseudomonas putida KT2440
cgacaguucaagcac

SEQ ID NO: 1585207 - RNA, 23 nt, Pseudomonas putida KT2440
cgacaguucgccacccgacgcca

SEQ ID NO: 1585208 - RNA, 20 nt, Pseudomonas putida KT2440
cgacagugaauuccuugcug

SEQ ID NO: 1585209 - RNA, 12 nt, Pseudomonas putida KT2440
cgacaugcaguu

SEQ ID NO: 1585210 - RNA, 17 nt, Pseudomonas putida KT2440
cgacaugccggccacca

SEQ ID NO: 1585211 - RNA, 22 nt, Pseudomonas putida KT2440
cuuuaucuccaagccgcuucac

SEQ ID NO: 1585212 - RNA, 19 nt, Pseudomonas putida KT2440
gaaaacugggcagcccuca

SEQ ID NO: 1585213 - RNA, 21 nt, Pseudomonas putida KT2440
gaaaagcgagguacggcaagg

SEQ ID NO: 1585214 - RNA, 23 nt, Pseudomonas putida KT2440
gaaaauuaguuugacagcccugc

SEQ ID NO: 1585215 - RNA, 15 nt, Pseudomonas putida KT2440
gaaacugcgcucaac

SEQ ID NO: 1585216 - RNA, 22 nt, Pseudomonas putida KT2440
gaaacugcgcucaaccagccgc

SEQ ID NO: 1585217 - RNA, 21 nt, Pseudomonas putida KT2440
gaaacacgaaguugagcaccg

SEQ ID NO: 1585218 - RNA, 21 nt, Pseudomonas putida KT2440
gaaagcccccgccugcuggcc

SEQ ID NO: 1585219 - RNA, 13 nt, Pseudomonas putida KT2440
gaaaggcgcucga

SEQ ID NO: 1585220 - RNA, 20 nt, Pseudomonas putida KT2440
gaaaggagacaaccaacagg

SEQ ID NO: 1585221 - RNA, 15 nt, Pseudomonas putida KT2440
gaaagucgaccagca

SEQ ID NO: 1585222 - RNA, 19 nt, Pseudomonas putida KT2440
gaaagggccaguacaggca

SEQ ID NO: 1585223 - RNA, 14 nt, Pseudomonas putida KT2440
gaaagggccgcaaa

SEQ ID NO: 1585224 - RNA, 16 nt, Pseudomonas putida KT2440
cuugcgcgccagcgca

SEQ ID NO: 1585225 - RNA, 19 nt, Pseudomonas putida KT2440
cuugcgcgccagcgcaugc

SEQ ID NO: 1585226 - RNA, 13 nt, Pseudomonas putida KT2440
cuugcgcacguag

SEQ ID NO: 1585227 - RNA, 20 nt, Pseudomonas putida KT2440
cuugcgcaguaacaggcgca

SEQ ID NO: 1585228 - RNA, 14 nt, Pseudomonas putida KT2440
cuugcgcauggccg

SEQ ID NO: 1585229 - RNA, 17 nt, Pseudomonas putida KT2440
cuugcggaccaccuggg

SEQ ID NO: 1585230 - RNA, 18 nt, Pseudomonas putida KT2440
cuugcggaccaccugggc

SEQ ID NO: 1585231 - RNA, 20 nt, Pseudomonas putida KT2440
cuugcggaacaggaucagcg

SEQ ID NO: 1585232 - RNA, 14 nt, Pseudomonas putida KT2440
cuugcucaggucgu

SEQ ID NO: 1585233 - RNA, 21 nt, Pseudomonas putida KT2440
cuugcuaugggaagucgccgc

SEQ ID NO: 1585234 - RNA, 16 nt, Pseudomonas putida KT2440
cuugcugaucaccagg

SEQ ID NO: 1585235 - RNA, 17 nt, Pseudomonas putida KT2440
cuugcucuguucgcugg

SEQ ID NO: 1585236 - RNA, 17 nt, Pseudomonas putida KT2440
cuugcucgaaugccgcu

SEQ ID NO: 1585237 - RNA, 14 nt, Pseudomonas putida KT2440
cuugcugcagggca

SEQ ID NO: 1585238 - RNA, 16 nt, Pseudomonas putida KT2440
cuuggccaccuucacc

SEQ ID NO: 1585239 - RNA, 17 nt, Pseudomonas putida KT2440
cuucgucggcgcggaau

SEQ ID NO: 1585240 - RNA, 19 nt, Pseudomonas putida KT2440
cuucggcucuucgccuucc

SEQ ID NO: 1585241 - RNA, 16 nt, Pseudomonas putida KT2440
cuugccccgcaggccg

SEQ ID NO: 1585242 - RNA, 14 nt, Pseudomonas putida KT2440
cuugcccaccagga

SEQ ID NO: 1585243 - RNA, 13 nt, Pseudomonas putida KT2440
cuugcccagcucc

SEQ ID NO: 1585244 - RNA, 14 nt, Pseudomonas putida KT2440
cuugccaucggcca

SEQ ID NO: 1585245 - RNA, 22 nt, Pseudomonas putida KT2440
cuugccuuccucggccaugcgc

SEQ ID NO: 1585246 - RNA, 15 nt, Pseudomonas putida KT2440
cuugccuucggcauu

SEQ ID NO: 1585247 - RNA, 11 nt, Pseudomonas putida KT2440
cuugccuaccu

SEQ ID NO: 1585248 - RNA, 20 nt, Pseudomonas putida KT2440
cuugcgacuugugcauccug

SEQ ID NO: 1585249 - RNA, 16 nt, Pseudomonas putida KT2440
cuugcccugcuugcgg

SEQ ID NO: 1585250 - RNA, 13 nt, Pseudomonas putida KT2440
cuugcccggcgca

SEQ ID NO: 1585251 - RNA, 14 nt, Pseudomonas putida KT2440
cuugcccgaggaac

SEQ ID NO: 1585252 - RNA, 14 nt, Pseudomonas putida KT2440
cuugcccucgccca

SEQ ID NO: 1585253 - RNA, 14 nt, Pseudomonas putida KT2440
cuuguucggguuca

SEQ ID NO: 1585254 - RNA, 17 nt, Pseudomonas putida KT2440
cuuuacgcauugccgac

SEQ ID NO: 1585255 - RNA, 18 nt, Pseudomonas putida KT2440
cuuuagcgcaucuuccgg

SEQ ID NO: 1585256 - RNA, 18 nt, Pseudomonas putida KT2440
cuugguggucagccaggc

SEQ ID NO: 1585257 - RNA, 13 nt, Pseudomonas putida KT2440
cuuguuacccgca

SEQ ID NO: 1585258 - RNA, 16 nt, Pseudomonas putida KT2440
cuugugugccugcucc

SEQ ID NO: 1585259 - RNA, 15 nt, Pseudomonas putida KT2440
cuuguggcggaucau

SEQ ID NO: 1585260 - RNA, 19 nt, Pseudomonas putida KT2440
cuugucuuccagcugcgcc

SEQ ID NO: 1585261 - RNA, 14 nt, Pseudomonas putida KT2440
cuugucggugguga

SEQ ID NO: 1585262 - RNA, 15 nt, Pseudomonas putida KT2440
cuugugaucccgcga

SEQ ID NO: 1585263 - RNA, 17 nt, Pseudomonas putida KT2440
cuuggccgacuggcgca

SEQ ID NO: 1585264 - RNA, 18 nt, Pseudomonas putida KT2440
cuuggccgacuggcgcac

SEQ ID NO: 1585265 - RNA, 16 nt, Pseudomonas putida KT2440
cuuggcccagccaucg

SEQ ID NO: 1585266 - RNA, 15 nt, Pseudomonas putida KT2440
cuuggccagggccuu

SEQ ID NO: 1585267 - RNA, 14 nt, Pseudomonas putida KT2440
cuuggccagggugc

SEQ ID NO: 1585268 - RNA, 15 nt, Pseudomonas putida KT2440
cuugguccagggcca

SEQ ID NO: 1585269 - RNA, 18 nt, Pseudomonas putida KT2440
cuuggucucgaucagcga

SEQ ID NO: 1585270 - RNA, 17 nt, Pseudomonas putida KT2440
gaacaacuguccugugc

SEQ ID NO: 1585271 - RNA, 21 nt, Pseudomonas putida KT2440
gaacaacggcagcgacagcug

SEQ ID NO: 1585272 - RNA, 23 nt, Pseudomonas putida KT2440
gaacacauccucaaaggcagccu

SEQ ID NO: 1585273 - RNA, 15 nt, Pseudomonas putida KT2440
gaacacauagaacag

SEQ ID NO: 1585274 - RNA, 14 nt, Pseudomonas putida KT2440
gaacacaucgguac

SEQ ID NO: 1585275 - RNA, 19 nt, Pseudomonas putida KT2440
gaacacaucgguacgccgc

SEQ ID NO: 1585276 - RNA, 19 nt, Pseudomonas putida KT2440
gaacaccacccggucggcc

SEQ ID NO: 1585277 - RNA, 17 nt, Pseudomonas putida KT2440
gaacaagucgcgcacca

SEQ ID NO: 1585278 - RNA, 16 nt, Pseudomonas putida KT2440
gaacaccugcagcgcg

SEQ ID NO: 1585279 - RNA, 21 nt, Pseudomonas putida KT2440
gaacacgaaaaagccagcgua

SEQ ID NO: 1585280 - RNA, 12 nt, Pseudomonas putida KT2440
gaacacgaacac

SEQ ID NO: 1585281 - RNA, 23 nt, Pseudomonas putida KT2440
gaacacggcuucgcagacgucuu

SEQ ID NO: 1585282 - RNA, 18 nt, Pseudomonas putida KT2440
gaacacgcucaugaacag

SEQ ID NO: 1585283 - RNA, 23 nt, Pseudomonas putida KT2440
gaacacgcaggucuugcccacuu

SEQ ID NO: 1585284 - RNA, 14 nt, Pseudomonas putida KT2440
gaacacgccgucga

SEQ ID NO: 1585285 - RNA, 14 nt, Pseudomonas putida KT2440
gaacacgcccgcgu

SEQ ID NO: 1585286 - RNA, 19 nt, Pseudomonas putida KT2440
gaacaggugcgcgcgcgac

SEQ ID NO: 1585287 - RNA, 20 nt, Pseudomonas putida KT2440
gaacaggugcgcgcgcgaca

SEQ ID NO: 1585288 - RNA, 21 nt, Pseudomonas putida KT2440
gaacaggugcgcgcgcgacag

SEQ ID NO: 1585289 - RNA, 14 nt, Pseudomonas putida KT2440
gaacagguugacca

SEQ ID NO: 1585290 - RNA, 14 nt, Pseudomonas putida KT2440
gaacagggccaggu

SEQ ID NO: 1585291 - RNA, 16 nt, Pseudomonas putida KT2440
gaacagggccagguag

SEQ ID NO: 1585292 - RNA, 18 nt, Pseudomonas putida KT2440
gaacauacgcaucagcgc

SEQ ID NO: 1585293 - RNA, 16 nt, Pseudomonas putida KT2440
gaacauggccgagcug

SEQ ID NO: 1585294 - RNA, 20 nt, Pseudomonas putida KT2440
gaaccaaggugcuaccggcg

SEQ ID NO: 1585295 - RNA, 20 nt, Pseudomonas putida KT2440
gaacagccggcuaucggcca

SEQ ID NO: 1585296 - RNA, 14 nt, Pseudomonas putida KT2440
gaacagccacagcu

SEQ ID NO: 1585297 - RNA, 16 nt, Pseudomonas putida KT2440
gaacagcacgauaccg

SEQ ID NO: 1585298 - RNA, 14 nt, Pseudomonas putida KT2440
gaacagcacugcca

SEQ ID NO: 1585299 - RNA, 17 nt, Pseudomonas putida KT2440
gaacacuuccgggcuga

SEQ ID NO: 1585300 - RNA, 14 nt, Pseudomonas putida KT2440
gaacagcgcagcca

SEQ ID NO: 1585301 - RNA, 16 nt, Pseudomonas putida KT2440
gaacagcgcagccacc

SEQ ID NO: 1585302 - RNA, 17 nt, Pseudomonas putida KT2440
gaacagcgcagccacca

SEQ ID NO: 1585303 - RNA, 15 nt, Pseudomonas putida KT2440
gaacagcgccggcag

SEQ ID NO: 1585304 - RNA, 20 nt, Pseudomonas putida KT2440
gaacagcgucuuguuguccg

SEQ ID NO: 1585305 - RNA, 20 nt, Pseudomonas putida KT2440
gaacagcuucaacaaggucu

SEQ ID NO: 1585306 - RNA, 16 nt, Pseudomonas putida KT2440
gaacagcucgaucagu

SEQ ID NO: 1585307 - RNA, 19 nt, Pseudomonas putida KT2440
gaacagcucgauggccagg

SEQ ID NO: 1585308 - RNA, 19 nt, Pseudomonas putida KT2440
gaacaggcggcuguccggc

SEQ ID NO: 1585309 - RNA, 14 nt, Pseudomonas putida KT2440
gaacaggcgcuugc

SEQ ID NO: 1585310 - RNA, 23 nt, Pseudomonas putida KT2440
gaacaggcgcuugcccgccgaau

SEQ ID NO: 1585311 - RNA, 22 nt, Pseudomonas putida KT2440
gaacaggccugcggccaggccg

SEQ ID NO: 1585312 - RNA, 17 nt, Pseudomonas putida KT2440
gaacaggccugucacgc

SEQ ID NO: 1585313 - RNA, 16 nt, Pseudomonas putida KT2440
gaacccagcuugaagc

SEQ ID NO: 1585314 - RNA, 22 nt, Pseudomonas putida KT2440
gaaccccccguaggagcgggcu

SEQ ID NO: 1585315 - RNA, 18 nt, Pseudomonas putida KT2440
gaaccagcagcaccugcc

SEQ ID NO: 1585316 - RNA, 12 nt, Pseudomonas putida KT2440
gaaccucaccgc

SEQ ID NO: 1585317 - RNA, 14 nt, Pseudomonas putida KT2440
gaaccggcgaucag

SEQ ID NO: 1585318 - RNA, 18 nt, Pseudomonas putida KT2440
gaaccgccagcaccaaug

SEQ ID NO: 1585319 - RNA, 16 nt, Pseudomonas putida KT2440
gaaccugggacugcgu

SEQ ID NO: 1585320 - RNA, 20 nt, Pseudomonas putida KT2440
gaacgacaacccccacaggg

SEQ ID NO: 1585321 - RNA, 17 nt, Pseudomonas putida KT2440
gaacuacgcgccagcau

SEQ ID NO: 1585322 - RNA, 23 nt, Pseudomonas putida KT2440
gaacucacccgccccacgcccga

SEQ ID NO: 1585323 - RNA, 22 nt, Pseudomonas putida KT2440
gaacucaugcuccugcgccacc

SEQ ID NO: 1585324 - RNA, 18 nt, Pseudomonas putida KT2440
gaacuccccaccaggcaa

SEQ ID NO: 1585325 - RNA, 15 nt, Pseudomonas putida KT2440
gaacucgaucacgaa

SEQ ID NO: 1585326 - RNA, 14 nt, Pseudomonas putida KT2440
gaacggcccgcgga

SEQ ID NO: 1585327 - RNA, 15 nt, Pseudomonas putida KT2440
gaacggcccgcggau

SEQ ID NO: 1585328 - RNA, 15 nt, Pseudomonas putida KT2440
gaacggccgucaccu

SEQ ID NO: 1585329 - RNA, 15 nt, Pseudomonas putida KT2440
cugguggcaaugcca

SEQ ID NO: 1585330 - RNA, 13 nt, Pseudomonas putida KT2440
cugguggcggcau

SEQ ID NO: 1585331 - RNA, 20 nt, Pseudomonas putida KT2440
cuggugguggcccugaccgc

SEQ ID NO: 1585332 - RNA, 20 nt, Pseudomonas putida KT2440
cuggugaaagucgaccagca

SEQ ID NO: 1585333 - RNA, 15 nt, Pseudomonas putida KT2440
cuggugaaucagccc

SEQ ID NO: 1585334 - RNA, 17 nt, Pseudomonas putida KT2440
cuggugaaggcagguca

SEQ ID NO: 1585335 - RNA, 20 nt, Pseudomonas putida KT2440
cuggugcaggcguucgucaa

SEQ ID NO: 1585336 - RNA, 23 nt, Pseudomonas putida KT2440
cuggugcaggcguucgucaagcu

SEQ ID NO: 1585337 - RNA, 19 nt, Pseudomonas putida KT2440
cugguaaugcucuccagcg

SEQ ID NO: 1585338 - RNA, 14 nt, Pseudomonas putida KT2440
cugguacagcagga

SEQ ID NO: 1585339 - RNA, 18 nt, Pseudomonas putida KT2440
cuggcuuagcgcgggccu

SEQ ID NO: 1585340 - RNA, 19 nt, Pseudomonas putida KT2440
cugggaagcugcagcagcu

SEQ ID NO: 1585341 - RNA, 17 nt, Pseudomonas putida KT2440
cuggcuuucccccagcc

SEQ ID NO: 1585342 - RNA, 18 nt, Pseudomonas putida KT2440
cuggcuuacaucaugccg

SEQ ID NO: 1585343 - RNA, 19 nt, Pseudomonas putida KT2440
cuggcuuacaucaugccgc

SEQ ID NO: 1585344 - RNA, 20 nt, Pseudomonas putida KT2440
cugggcacccugaucgauga

SEQ ID NO: 1585345 - RNA, 22 nt, Pseudomonas putida KT2440
cugggcaaaaucgaccagggcc

SEQ ID NO: 1585346 - RNA, 23 nt, Pseudomonas putida KT2440
cugggcaaaaucgaccagggccu

SEQ ID NO: 1585347 - RNA, 14 nt, Pseudomonas putida KT2440
cugggcauccagcu

SEQ ID NO: 1585348 - RNA, 20 nt, Pseudomonas putida KT2440
cugggcauccagcuugccac

SEQ ID NO: 1585349 - RNA, 20 nt, Pseudomonas putida KT2440
cugggcaugagccuggccgg

SEQ ID NO: 1585350 - RNA, 14 nt, Pseudomonas putida KT2440
cuggcggcugagcc

SEQ ID NO: 1585351 - RNA, 19 nt, Pseudomonas putida KT2440
cuggcggcugagccggcug

SEQ ID NO: 1585352 - RNA, 17 nt, Pseudomonas putida KT2440
cuggcgggguggccggc

SEQ ID NO: 1585353 - RNA, 18 nt, Pseudomonas putida KT2440
cuggcgggguggccggca

SEQ ID NO: 1585354 - RNA, 19 nt, Pseudomonas putida KT2440
cuggcgcgaccaucaccgc

SEQ ID NO: 1585355 - RNA, 20 nt, Pseudomonas putida KT2440
cugguaaaugaacggcuguu

SEQ ID NO: 1585356 - RNA, 23 nt, Pseudomonas putida KT2440
cuggggcaggcccggcagguuga

SEQ ID NO: 1585357 - RNA, 23 nt, Pseudomonas putida KT2440
cugggugaccaccagcaacaucg

SEQ ID NO: 1585358 - RNA, 20 nt, Pseudomonas putida KT2440
cuggggaucgggauguucag

SEQ ID NO: 1585359 - RNA, 16 nt, Pseudomonas putida KT2440
cugggcgugacggcga

SEQ ID NO: 1585360 - RNA, 15 nt, Pseudomonas putida KT2440
cugggcuucgacaac

SEQ ID NO: 1585361 - RNA, 23 nt, Pseudomonas putida KT2440
cugggcauuggagcguugcaggc

SEQ ID NO: 1585362 - RNA, 21 nt, Pseudomonas putida KT2440
cuggcccgucuugcgucagcu

SEQ ID NO: 1585363 - RNA, 16 nt, Pseudomonas putida KT2440
cuggcccgcgaugccg

SEQ ID NO: 1585364 - RNA, 19 nt, Pseudomonas putida KT2440
cuggcccgcgaugccgaca

SEQ ID NO: 1585365 - RNA, 19 nt, Pseudomonas putida KT2440
cuggcccucugcgugguau

SEQ ID NO: 1585366 - RNA, 13 nt, Pseudomonas putida KT2440
cuggcccugggag

SEQ ID NO: 1585367 - RNA, 18 nt, Pseudomonas putida KT2440
cuggcccuuacaggucgu

SEQ ID NO: 1585368 - RNA, 15 nt, Pseudomonas putida KT2440
cuggcccuugccauc

SEQ ID NO: 1585369 - RNA, 14 nt, Pseudomonas putida KT2440
cuggcccgaacagc

SEQ ID NO: 1585370 - RNA, 21 nt, Pseudomonas putida KT2440
cuggcccgaacgcagcgccgc

SEQ ID NO: 1585371 - RNA, 21 nt, Pseudomonas putida KT2440
cuggcccgcagcgcuucgauc

SEQ ID NO: 1585372 - RNA, 16 nt, Pseudomonas putida KT2440
cuggccagcagggccg

SEQ ID NO: 1585373 - RNA, 16 nt, Pseudomonas putida KT2440
cuggccugcagccguu

SEQ ID NO: 1585374 - RNA, 19 nt, Pseudomonas putida KT2440
cuggcccuuucgcggguaa

SEQ ID NO: 1585375 - RNA, 16 nt, Pseudomonas putida KT2440
cuggccuggccaagcg

SEQ ID NO: 1585376 - RNA, 20 nt, Pseudomonas putida KT2440
cuggccuuccuugcccagcc

SEQ ID NO: 1585377 - RNA, 12 nt, Pseudomonas putida KT2440
cuggccuugcgg

SEQ ID NO: 1585378 - RNA, 18 nt, Pseudomonas putida KT2440
cuggccuuggcgugcacg

SEQ ID NO: 1585379 - RNA, 17 nt, Pseudomonas putida KT2440
cuggccuuuucgcgggu

SEQ ID NO: 1585380 - RNA, 15 nt, Pseudomonas putida KT2440
cuggcgaauacgcuc

SEQ ID NO: 1585381 - RNA, 20 nt, Pseudomonas putida KT2440
cuggcgaauacgcucagccg

SEQ ID NO: 1585382 - RNA, 17 nt, Pseudomonas putida KT2440
cuggcgaagaguccagu

SEQ ID NO: 1585383 - RNA, 20 nt, Pseudomonas putida KT2440
cuggcgacacuugguccagg

SEQ ID NO: 1585384 - RNA, 14 nt, Pseudomonas putida KT2440
cuggcgcagagggu

SEQ ID NO: 1585385 - RNA, 11 nt, Pseudomonas putida KT2440
cuggcgcagca

SEQ ID NO: 1585386 - RNA, 17 nt, Pseudomonas putida KT2440
cuggcgcagcaggucca

SEQ ID NO: 1585387 - RNA, 20 nt, Pseudomonas putida KT2440
cuggcgcagcagguccagcu

SEQ ID NO: 1585388 - RNA, 21 nt, Pseudomonas putida KT2440
cuggcgcaccagcggcuuggc

SEQ ID NO: 1585389 - RNA, 20 nt, Pseudomonas putida KT2440
cuggcgcacguacuccacca

SEQ ID NO: 1585390 - RNA, 23 nt, Pseudomonas putida KT2440
cuggcgacgaguuuaccuccauc

SEQ ID NO: 1585391 - RNA, 14 nt, Pseudomonas putida KT2440
cuggcgaucaggca

SEQ ID NO: 1585392 - RNA, 20 nt, Pseudomonas putida KT2440
cuggcgcaucuuccagcaca

SEQ ID NO: 1585393 - RNA, 12 nt, Pseudomonas putida KT2440
cuggcgccugcg

SEQ ID NO: 1585394 - RNA, 14 nt, Pseudomonas putida KT2440
cuggcgccugcggc

SEQ ID NO: 1585395 - RNA, 20 nt, Pseudomonas putida KT2440
cuggcgcccggcaucgcuca

SEQ ID NO: 1585396 - RNA, 20 nt, Pseudomonas putida KT2440
cuggaucagugucugcgccu

SEQ ID NO: 1585397 - RNA, 16 nt, Pseudomonas putida KT2440
cuggagccggaucgac

SEQ ID NO: 1585398 - RNA, 15 nt, Pseudomonas putida KT2440
cuggagcaaggcguu

SEQ ID NO: 1585399 - RNA, 18 nt, Pseudomonas putida KT2440
cuggaggugauggucacc

SEQ ID NO: 1585400 - RNA, 19 nt, Pseudomonas putida KT2440
cuggagaacagcgucaugc

SEQ ID NO: 1585401 - RNA, 20 nt, Pseudomonas putida KT2440
cuggacgcugucagaccucc

SEQ ID NO: 1585402 - RNA, 15 nt, Pseudomonas putida KT2440
cugcgaggaucagcg

SEQ ID NO: 1585403 - RNA, 16 nt, Pseudomonas putida KT2440
cugcgaggaucagcgc

SEQ ID NO: 1585404 - RNA, 14 nt, Pseudomonas putida KT2440
cuggauggcgcggu

SEQ ID NO: 1585405 - RNA, 20 nt, Pseudomonas putida KT2440
cuggcacgcccggcaccugc

SEQ ID NO: 1585406 - RNA, 14 nt, Pseudomonas putida KT2440
cuggcacgccuuca

SEQ ID NO: 1585407 - RNA, 17 nt, Pseudomonas putida KT2440
cuggcacgccuucagca

SEQ ID NO: 1585408 - RNA, 24 nt, Pseudomonas putida KT2440
cuggcacuccacuugauugggcuu

SEQ ID NO: 1585409 - RNA, 21 nt, Pseudomonas putida KT2440
cuggcacucucgcggugccuu

SEQ ID NO: 1585410 - RNA, 17 nt, Pseudomonas putida KT2440
cuggcacugcggcucau

SEQ ID NO: 1585411 - RNA, 21 nt, Pseudomonas putida KT2440
cuggaugacacggauggcacc

SEQ ID NO: 1585412 - RNA, 12 nt, Pseudomonas putida KT2440
cuggaugacgcc

SEQ ID NO: 1585413 - RNA, 15 nt, Pseudomonas putida KT2440
cuggaugauccagcc

SEQ ID NO: 1585414 - RNA, 18 nt, Pseudomonas putida KT2440
cuggcagcugcagugcug

SEQ ID NO: 1585415 - RNA, 23 nt, Pseudomonas putida KT2440
cuggcagcugcagugcugggcau

SEQ ID NO: 1585416 - RNA, 19 nt, Pseudomonas putida KT2440
cuggcagcuucucgcggcg

SEQ ID NO: 1585417 - RNA, 19 nt, Pseudomonas putida KT2440
cuggcaggccuuguuccac

SEQ ID NO: 1585418 - RNA, 15 nt, Pseudomonas putida KT2440
cuggcagcuccagcc

SEQ ID NO: 1585419 - RNA, 18 nt, Pseudomonas putida KT2440
cuggcagcuccagccaga

SEQ ID NO: 1585420 - RNA, 15 nt, Pseudomonas putida KT2440
cuggcagcacgauca

SEQ ID NO: 1585421 - RNA, 18 nt, Pseudomonas putida KT2440
cuggcagcacgaucagcg

SEQ ID NO: 1585422 - RNA, 19 nt, Pseudomonas putida KT2440
cuggcagcacgaucagcgc

SEQ ID NO: 1585423 - RNA, 13 nt, Pseudomonas putida KT2440
cuggcagcagugc

SEQ ID NO: 1585424 - RNA, 20 nt, Pseudomonas putida KT2440
cuggccacuguugcagcgcc

SEQ ID NO: 1585425 - RNA, 21 nt, Pseudomonas putida KT2440
cuggccacuguugcagcgcca

SEQ ID NO: 1585426 - RNA, 20 nt, Pseudomonas putida KT2440
cuggccaccgaaguucagca

SEQ ID NO: 1585427 - RNA, 21 nt, Pseudomonas putida KT2440
cuggccaccgaaguucagcac

SEQ ID NO: 1585428 - RNA, 22 nt, Pseudomonas putida KT2440
cuggccaccgaaguucagcacg

SEQ ID NO: 1585429 - RNA, 14 nt, Pseudomonas putida KT2440
cuggccaccagcau

SEQ ID NO: 1585430 - RNA, 12 nt, Pseudomonas putida KT2440
cuggccacccgg

SEQ ID NO: 1585431 - RNA, 16 nt, Pseudomonas putida KT2440
cuuccagguggccgcc

SEQ ID NO: 1585432 - RNA, 15 nt, Pseudomonas putida KT2440
cuuccaguuucacca

SEQ ID NO: 1585433 - RNA, 18 nt, Pseudomonas putida KT2440
cuuccaguuggccggcau

SEQ ID NO: 1585434 - RNA, 19 nt, Pseudomonas putida KT2440
cuuccagcuucugcugguc

SEQ ID NO: 1585435 - RNA, 19 nt, Pseudomonas putida KT2440
cuucaucugcgccugugca

SEQ ID NO: 1585436 - RNA, 23 nt, Pseudomonas putida KT2440
cuucaugcacaacgcgcgggcaa

SEQ ID NO: 1585437 - RNA, 18 nt, Pseudomonas putida KT2440
cuucagcgggucgagcca

SEQ ID NO: 1585438 - RNA, 21 nt, Pseudomonas putida KT2440
cuucaucacgcaccaggucgc

SEQ ID NO: 1585439 - RNA, 15 nt, Pseudomonas putida KT2440
cuucauacagcgccu

SEQ ID NO: 1585440 - RNA, 13 nt, Pseudomonas putida KT2440
cuucagcgaccga

SEQ ID NO: 1585441 - RNA, 15 nt, Pseudomonas putida KT2440
cuucaccgucggcgc

SEQ ID NO: 1585442 - RNA, 14 nt, Pseudomonas putida KT2440
cuucaccuugccua

SEQ ID NO: 1585443 - RNA, 23 nt, Pseudomonas putida KT2440
cuucacggcuuuguuggauccgu

SEQ ID NO: 1585444 - RNA, 17 nt, Pseudomonas putida KT2440
cuucaccgcgcaccucc

SEQ ID NO: 1585445 - RNA, 21 nt, Pseudomonas putida KT2440
cuucagcgcggcaaccugcuc

SEQ ID NO: 1585446 - RNA, 14 nt, Pseudomonas putida KT2440
cuucagccagggcg

SEQ ID NO: 1585447 - RNA, 16 nt, Pseudomonas putida KT2440
cuucagccagggcgag

SEQ ID NO: 1585448 - RNA, 22 nt, Pseudomonas putida KT2440
cuucagcaggaagcuguacagc

SEQ ID NO: 1585449 - RNA, 23 nt, Pseudomonas putida KT2440
cuucagcaggaagcuguacagcg

SEQ ID NO: 1585450 - RNA, 15 nt, Pseudomonas putida KT2440
cuucagaucacccuu

SEQ ID NO: 1585451 - RNA, 22 nt, Pseudomonas putida KT2440
cuucagaucacccuuggccacc

SEQ ID NO: 1585452 - RNA, 16 nt, Pseudomonas putida KT2440
cuucacgucuggcacc

SEQ ID NO: 1585453 - RNA, 18 nt, Pseudomonas putida KT2440
cuucgcucacaaagcccu

SEQ ID NO: 1585454 - RNA, 20 nt, Pseudomonas putida KT2440
cuucgcucagaaucagcuug

SEQ ID NO: 1585455 - RNA, 15 nt, Pseudomonas putida KT2440
cuucgcucaggugca

SEQ ID NO: 1585456 - RNA, 20 nt, Pseudomonas putida KT2440
cuucgcgggcaugcccgcuc

SEQ ID NO: 1585457 - RNA, 19 nt, Pseudomonas putida KT2440
cuucgcggguaaacccgcg

SEQ ID NO: 1585458 - RNA, 20 nt, Pseudomonas putida KT2440
cuucgcggguaaacccgcgc

SEQ ID NO: 1585459 - RNA, 19 nt, Pseudomonas putida KT2440
cuucgcggguaaacccgcu

SEQ ID NO: 1585460 - RNA, 20 nt, Pseudomonas putida KT2440
cuucgcgggugaacccgcuc

SEQ ID NO: 1585461 - RNA, 20 nt, Pseudomonas putida KT2440
cuucgcggaagauacccgcc

SEQ ID NO: 1585462 - RNA, 16 nt, Pseudomonas putida KT2440
cuucgccuuccggggu

SEQ ID NO: 1585463 - RNA, 14 nt, Pseudomonas putida KT2440
cuucgccuuccucg

SEQ ID NO: 1585464 - RNA, 21 nt, Pseudomonas putida KT2440
cuucggccacgguguauccag

SEQ ID NO: 1585465 - RNA, 17 nt, Pseudomonas putida KT2440
cuucgcuuucaccuugc

SEQ ID NO: 1585466 - RNA, 14 nt, Pseudomonas putida KT2440
cuucggcggcuuuc

SEQ ID NO: 1585467 - RNA, 20 nt, Pseudomonas putida KT2440
cuuccuugaccauuuccggg

SEQ ID NO: 1585468 - RNA, 12 nt, Pseudomonas putida KT2440
cuucgaucagcg

SEQ ID NO: 1585469 - RNA, 21 nt, Pseudomonas putida KT2440
cuucgauccgcgccaucagcu

SEQ ID NO: 1585470 - RNA, 14 nt, Pseudomonas putida KT2440
cuucgauuagaccc

SEQ ID NO: 1585471 - RNA, 14 nt, Pseudomonas putida KT2440
cuucgccugcagca

SEQ ID NO: 1585472 - RNA, 20 nt, Pseudomonas putida KT2440
cuucgccgguguucgcgggu

SEQ ID NO: 1585473 - RNA, 15 nt, Pseudomonas putida KT2440
cuuccugaagacgcu

SEQ ID NO: 1585474 - RNA, 20 nt, Pseudomonas putida KT2440
cuuccucggccaugcgcggg

SEQ ID NO: 1585475 - RNA, 19 nt, Pseudomonas putida KT2440
cuuccuggccuuccuugcc

SEQ ID NO: 1585476 - RNA, 21 nt, Pseudomonas putida KT2440
cuuccguuaguucgugcaccc

SEQ ID NO: 1585477 - RNA, 21 nt, Pseudomonas putida KT2440
cuguacaguggcacuggcgcg

SEQ ID NO: 1585478 - RNA, 19 nt, Pseudomonas putida KT2440
cuguacaacgcagccggca

SEQ ID NO: 1585479 - RNA, 15 nt, Pseudomonas putida KT2440
cuguaagucguugaa

SEQ ID NO: 1585480 - RNA, 16 nt, Pseudomonas putida KT2440
cugguuagcgucgaug

SEQ ID NO: 1585481 - RNA, 14 nt, Pseudomonas putida KT2440
cuggugucggccag

SEQ ID NO: 1585482 - RNA, 18 nt, Pseudomonas putida KT2440
cuggugucggccagggcc

SEQ ID NO: 1585483 - RNA, 19 nt, Pseudomonas putida KT2440
cugguugcguucgucgaug

SEQ ID NO: 1585484 - RNA, 14 nt, Pseudomonas putida KT2440
cugguuuucgcggu

SEQ ID NO: 1585485 - RNA, 15 nt, Pseudomonas putida KT2440
cuguaggagcgggcu

SEQ ID NO: 1585486 - RNA, 24 nt, Pseudomonas putida KT2440
cuguaggagcggguucacccgcga

SEQ ID NO: 1585487 - RNA, 23 nt, Pseudomonas putida KT2440
cuguaggagcggguuuacccgcg

SEQ ID NO: 1585488 - RNA, 23 nt, Pseudomonas putida KT2440
cuguaggaucggguuuacccgcg

SEQ ID NO: 1585489 - RNA, 20 nt, Pseudomonas putida KT2440
cuguaggugcggcuuuagcc

SEQ ID NO: 1585490 - RNA, 15 nt, Pseudomonas putida KT2440
cuguaggcgcggguu

SEQ ID NO: 1585491 - RNA, 19 nt, Pseudomonas putida KT2440
cuguagagcgccuugucgg

SEQ ID NO: 1585492 - RNA, 15 nt, Pseudomonas putida KT2440
cuguacgcuggccaa

SEQ ID NO: 1585493 - RNA, 16 nt, Pseudomonas putida KT2440
cuguacugacugacgu

SEQ ID NO: 1585494 - RNA, 16 nt, Pseudomonas putida KT2440
cuguacuugucugcca

SEQ ID NO: 1585495 - RNA, 12 nt, Pseudomonas putida KT2440
cuguccagcgca

SEQ ID NO: 1585496 - RNA, 13 nt, Pseudomonas putida KT2440
cuguccagcgcau

SEQ ID NO: 1585497 - RNA, 14 nt, Pseudomonas putida KT2440
cuguccagacgccg

SEQ ID NO: 1585498 - RNA, 17 nt, Pseudomonas putida KT2440
cugucgaucacgggcaa

SEQ ID NO: 1585499 - RNA, 18 nt, Pseudomonas putida KT2440
cugucgaugucuuucgcg

SEQ ID NO: 1585500 - RNA, 20 nt, Pseudomonas putida KT2440
cuguugcgcaccuugugcac

SEQ ID NO: 1585501 - RNA, 15 nt, Pseudomonas putida KT2440
cuguugcagcgccag

SEQ ID NO: 1585502 - RNA, 12 nt, Pseudomonas putida KT2440
cuguugcugcag

SEQ ID NO: 1585503 - RNA, 17 nt, Pseudomonas putida KT2440
cuguugcugcaguucag

SEQ ID NO: 1585504 - RNA, 15 nt, Pseudomonas putida KT2440
cuguucgucggccuu

SEQ ID NO: 1585505 - RNA, 23 nt, Pseudomonas putida KT2440
cuguugaucagguuacuggccaa

SEQ ID NO: 1585506 - RNA, 18 nt, Pseudomonas putida KT2440
cuuagcgggcaaauccgc

SEQ ID NO: 1585507 - RNA, 18 nt, Pseudomonas putida KT2440
cugugccgcuuuggcagc

SEQ ID NO: 1585508 - RNA, 16 nt, Pseudomonas putida KT2440
cugugccggcagcgag

SEQ ID NO: 1585509 - RNA, 14 nt, Pseudomonas putida KT2440
cugugccagcgagg

SEQ ID NO: 1585510 - RNA, 18 nt, Pseudomonas putida KT2440
cugugcccgccaggcgca

SEQ ID NO: 1585511 - RNA, 17 nt, Pseudomonas putida KT2440
cugugccgaaccaccga

SEQ ID NO: 1585512 - RNA, 13 nt, Pseudomonas putida KT2440
cugucggucagca

SEQ ID NO: 1585513 - RNA, 22 nt, Pseudomonas putida KT2440
cuguuccggccgcuucgcggau

SEQ ID NO: 1585514 - RNA, 16 nt, Pseudomonas putida KT2440
cuguuccacgaccgca

SEQ ID NO: 1585515 - RNA, 18 nt, Pseudomonas putida KT2440
cuguuccagcguagccgu

SEQ ID NO: 1585516 - RNA, 13 nt, Pseudomonas putida KT2440
cugugcggcguau

SEQ ID NO: 1585517 - RNA, 19 nt, Pseudomonas putida KT2440
cugugcggcuccggcgugu

SEQ ID NO: 1585518 - RNA, 23 nt, Pseudomonas putida KT2440
cugugcggccaaugcacgccugu

SEQ ID NO: 1585519 - RNA, 19 nt, Pseudomonas putida KT2440
cuguucagguguuccagca

SEQ ID NO: 1585520 - RNA, 22 nt, Pseudomonas putida KT2440
gacuucagcuucauggcgccga

SEQ ID NO: 1585521 - RNA, 14 nt, Pseudomonas putida KT2440
gacuuccagguagc

SEQ ID NO: 1585522 - RNA, 20 nt, Pseudomonas putida KT2440
gacuucaucaccuccagugc

SEQ ID NO: 1585523 - RNA, 14 nt, Pseudomonas putida KT2440
gacuucugcgugcg

SEQ ID NO: 1585524 - RNA, 13 nt, Pseudomonas putida KT2440
gacuuucccacau

SEQ ID NO: 1585525 - RNA, 18 nt, Pseudomonas putida KT2440
gagaaacucacgcauggc

SEQ ID NO: 1585526 - RNA, 22 nt, Pseudomonas putida KT2440
gagaaacugucguuuggcgcga

SEQ ID NO: 1585527 - RNA, 19 nt, Pseudomonas putida KT2440
gacugcuucaggccuucga

SEQ ID NO: 1585528 - RNA, 21 nt, Pseudomonas putida KT2440
gacuggcgcaccagcggcuug

SEQ ID NO: 1585529 - RNA, 20 nt, Pseudomonas putida KT2440
gacuccugugggagcgggcg

SEQ ID NO: 1585530 - RNA, 15 nt, Pseudomonas putida KT2440
gacucaugccuucgg

SEQ ID NO: 1585531 - RNA, 14 nt, Pseudomonas putida KT2440
gacuaguggccacu

SEQ ID NO: 1585532 - RNA, 15 nt, Pseudomonas putida KT2440
gacuacaucuucgcg

SEQ ID NO: 1585533 - RNA, 22 nt, Pseudomonas putida KT2440
gacucguccgacaaugccagca

SEQ ID NO: 1585534 - RNA, 15 nt, Pseudomonas putida KT2440
gacugaacaccugcc

SEQ ID NO: 1585535 - RNA, 20 nt, Pseudomonas putida KT2440
gacugaacaccugccagccc

SEQ ID NO: 1585536 - RNA, 17 nt, Pseudomonas putida KT2440
gacugaagcgcgggucu

SEQ ID NO: 1585537 - RNA, 23 nt, Pseudomonas putida KT2440
gagacaucuccauagguuaucca

SEQ ID NO: 1585538 - RNA, 15 nt, Pseudomonas putida KT2440
gagacgccaccaagc

SEQ ID NO: 1585539 - RNA, 21 nt, Pseudomonas putida KT2440
gagacgccaccaagcccuucu

SEQ ID NO: 1585540 - RNA, 16 nt, Pseudomonas putida KT2440
gagacgaacagcgccg

SEQ ID NO: 1585541 - RNA, 19 nt, Pseudomonas putida KT2440
gagaccguagggggccgcu

SEQ ID NO: 1585542 - RNA, 16 nt, Pseudomonas putida KT2440
gagaacgggcugucga

SEQ ID NO: 1585543 - RNA, 22 nt, Pseudomonas putida KT2440
gagacuuuagcuuauucgaugc

SEQ ID NO: 1585544 - RNA, 21 nt, Pseudomonas putida KT2440
gagauauguccauccaugcaa

SEQ ID NO: 1585545 - RNA, 18 nt, Pseudomonas putida KT2440
gagcacucggcggcgaag

SEQ ID NO: 1585546 - RNA, 13 nt, Pseudomonas putida KT2440
gagcaccacggcg

SEQ ID NO: 1585547 - RNA, 21 nt, Pseudomonas putida KT2440
gagaucgucguaggagcgggu

SEQ ID NO: 1585548 - RNA, 21 nt, Pseudomonas putida KT2440
gagaugaugguugacagcgcu

SEQ ID NO: 1585549 - RNA, 17 nt, Pseudomonas putida KT2440
gagaucgagugcucgaa

SEQ ID NO: 1585550 - RNA, 20 nt, Pseudomonas putida KT2440
gagcaagacacgagcggccu

SEQ ID NO: 1585551 - RNA, 23 nt, Pseudomonas putida KT2440
gagcaagggccguuacucccaca

SEQ ID NO: 1585552 - RNA, 20 nt, Pseudomonas putida KT2440
gagcaaaaccguacaaggca

SEQ ID NO: 1585553 - RNA, 13 nt, Pseudomonas putida KT2440
gacguuggccgcc

SEQ ID NO: 1585554 - RNA, 20 nt, Pseudomonas putida KT2440
gacguuggccgccagcggca

SEQ ID NO: 1585555 - RNA, 16 nt, Pseudomonas putida KT2440
gacguugguagcggug

SEQ ID NO: 1585556 - RNA, 22 nt, Pseudomonas putida KT2440
gacguuguucuuguagcugacc

SEQ ID NO: 1585557 - RNA, 19 nt, Pseudomonas putida KT2440
gacgugcaaggaucaccaa

SEQ ID NO: 1585558 - RNA, 16 nt, Pseudomonas putida KT2440
gacgguuacgugcagg

SEQ ID NO: 1585559 - RNA, 21 nt, Pseudomonas putida KT2440
gacgguuacgugcaggcgcac

SEQ ID NO: 1585560 - RNA, 15 nt, Pseudomonas putida KT2440
gacgcagggccucga

SEQ ID NO: 1585561 - RNA, 18 nt, Pseudomonas putida KT2440
gacgcagggccucgaugc

SEQ ID NO: 1585562 - RNA, 14 nt, Pseudomonas putida KT2440
gacgcaucagggca

SEQ ID NO: 1585563 - RNA, 19 nt, Pseudomonas putida KT2440
gacgcugcccagcaacggu

SEQ ID NO: 1585564 - RNA, 23 nt, Pseudomonas putida KT2440
gacgcuuccuuguccgccaagau

SEQ ID NO: 1585565 - RNA, 15 nt, Pseudomonas putida KT2440
gacgcuugccaccca

SEQ ID NO: 1585566 - RNA, 22 nt, Pseudomonas putida KT2440
gaccaucaccgccagcauggcc

SEQ ID NO: 1585567 - RNA, 12 nt, Pseudomonas putida KT2440
gaccaucagccu

SEQ ID NO: 1585568 - RNA, 15 nt, Pseudomonas putida KT2440
gaccaguugcucgca

SEQ ID NO: 1585569 - RNA, 20 nt, Pseudomonas putida KT2440
gaccagugcaacguucaccg

SEQ ID NO: 1585570 - RNA, 23 nt, Pseudomonas putida KT2440
gaccagugcaacguucaccgucg

SEQ ID NO: 1585571 - RNA, 15 nt, Pseudomonas putida KT2440
gaccaguaccgcgcc

SEQ ID NO: 1585572 - RNA, 14 nt, Pseudomonas putida KT2440
gaccaggcccagca

SEQ ID NO: 1585573 - RNA, 16 nt, Pseudomonas putida KT2440
gaccaggcccagcagg

SEQ ID NO: 1585574 - RNA, 22 nt, Pseudomonas putida KT2440
gaccaggccgauguuguggcug

SEQ ID NO: 1585575 - RNA, 14 nt, Pseudomonas putida KT2440
gaccagccgggcug

SEQ ID NO: 1585576 - RNA, 15 nt, Pseudomonas putida KT2440
gaccgcacccgcgau

SEQ ID NO: 1585577 - RNA, 13 nt, Pseudomonas putida KT2440
gaccggcucaaca

SEQ ID NO: 1585578 - RNA, 20 nt, Pseudomonas putida KT2440
gaccggucggccaucgacgu

SEQ ID NO: 1585579 - RNA, 18 nt, Pseudomonas putida KT2440
gaccgugaucaucagcgc

SEQ ID NO: 1585580 - RNA, 22 nt, Pseudomonas putida KT2440
gaccugcuggcacugcggcuca

SEQ ID NO: 1585581 - RNA, 22 nt, Pseudomonas putida KT2440
gaccugcugggucagcgcugac

SEQ ID NO: 1585582 - RNA, 15 nt, Pseudomonas putida KT2440
gaccucuggcgugca

SEQ ID NO: 1585583 - RNA, 15 nt, Pseudomonas putida KT2440
gaccuggaucgcgcc

SEQ ID NO: 1585584 - RNA, 18 nt, Pseudomonas putida KT2440
gaccuugauuucgucgcu

SEQ ID NO: 1585585 - RNA, 10 nt, Pseudomonas putida KT2440
gacgaacagg

SEQ ID NO: 1585586 - RNA, 23 nt, Pseudomonas putida KT2440
gacgaacaacgccaccgaaggcg

SEQ ID NO: 1585587 - RNA, 19 nt, Pseudomonas putida KT2440
gacaagguacucagcggcu

SEQ ID NO: 1585588 - RNA, 13 nt, Pseudomonas putida KT2440
gacaagguagcgg

SEQ ID NO: 1585589 - RNA, 20 nt, Pseudomonas putida KT2440
gacaagguagcggccagccc

SEQ ID NO: 1585590 - RNA, 21 nt, Pseudomonas putida KT2440
gacaagcgagguaggccguca

SEQ ID NO: 1585591 - RNA, 12 nt, Pseudomonas putida KT2440
gacaagccgcug

SEQ ID NO: 1585592 - RNA, 15 nt, Pseudomonas putida KT2440
gacaagcugcgcccu

SEQ ID NO: 1585593 - RNA, 18 nt, Pseudomonas putida KT2440
gacaacgguguggccagu

SEQ ID NO: 1585594 - RNA, 15 nt, Pseudomonas putida KT2440
gacaacgaugugcga

SEQ ID NO: 1585595 - RNA, 21 nt, Pseudomonas putida KT2440
gacaaucaggcgucaggcuug

SEQ ID NO: 1585596 - RNA, 15 nt, Pseudomonas putida KT2440
gacaauacgguaagc

SEQ ID NO: 1585597 - RNA, 16 nt, Pseudomonas putida KT2440
gacacaucacgcacau

SEQ ID NO: 1585598 - RNA, 19 nt, Pseudomonas putida KT2440
gaauuugguggaaguugcc

SEQ ID NO: 1585599 - RNA, 19 nt, Pseudomonas putida KT2440
gacaaaccagcggucugcu

SEQ ID NO: 1585600 - RNA, 21 nt, Pseudomonas putida KT2440
gaauggccuuuacaccgaugc

SEQ ID NO: 1585601 - RNA, 16 nt, Pseudomonas putida KT2440
gaauggcgucuucgcc

SEQ ID NO: 1585602 - RNA, 17 nt, Pseudomonas putida KT2440
gaaugcucgucaccauc

SEQ ID NO: 1585603 - RNA, 15 nt, Pseudomonas putida KT2440
gaaugacuucgcugc

SEQ ID NO: 1585604 - RNA, 17 nt, Pseudomonas putida KT2440
gaacugcagagccugca

SEQ ID NO: 1585605 - RNA, 14 nt, Pseudomonas putida KT2440
gaacucgccgcgca

SEQ ID NO: 1585606 - RNA, 20 nt, Pseudomonas putida KT2440
gaauacgauagcggcggcag

SEQ ID NO: 1585607 - RNA, 23 nt, Pseudomonas putida KT2440
gaaucagcaaaccgaccaggcag

SEQ ID NO: 1585608 - RNA, 18 nt, Pseudomonas putida KT2440
gaaucagccccagccggu

SEQ ID NO: 1585609 - RNA, 15 nt, Pseudomonas putida KT2440
gaaucagcuugccau

SEQ ID NO: 1585610 - RNA, 21 nt, Pseudomonas putida KT2440
gaauccccuuauaaugcgccc

SEQ ID NO: 1585611 - RNA, 19 nt, Pseudomonas putida KT2440
gaauccugcugaguccgcc

SEQ ID NO: 1585612 - RNA, 17 nt, Pseudomonas putida KT2440
gaaucucccgggccaug

SEQ ID NO: 1585613 - RNA, 14 nt, Pseudomonas putida KT2440
gacagguuguggua

SEQ ID NO: 1585614 - RNA, 22 nt, Pseudomonas putida KT2440
gacauccagcgccgccaugcag

SEQ ID NO: 1585615 - RNA, 17 nt, Pseudomonas putida KT2440
gaccaccagacgggcau

SEQ ID NO: 1585616 - RNA, 11 nt, Pseudomonas putida KT2440
gaccaccagca

SEQ ID NO: 1585617 - RNA, 12 nt, Pseudomonas putida KT2440
gaccacacugcu

SEQ ID NO: 1585618 - RNA, 21 nt, Pseudomonas putida KT2440
gaccacgcgcucguugcgagc

SEQ ID NO: 1585619 - RNA, 13 nt, Pseudomonas putida KT2440
gaccacgacguga

SEQ ID NO: 1585620 - RNA, 14 nt, Pseudomonas putida KT2440
gaccacgcacagcu

SEQ ID NO: 1585621 - RNA, 16 nt, Pseudomonas putida KT2440
gaccagcaccaccugu

SEQ ID NO: 1585622 - RNA, 18 nt, Pseudomonas putida KT2440
gaccagaucaggccgcug

SEQ ID NO: 1585623 - RNA, 20 nt, Pseudomonas putida KT2440
gaccagaucaggccgcugaa

SEQ ID NO: 1585624 - RNA, 16 nt, Pseudomonas putida KT2440
gaccacugcaggugca

SEQ ID NO: 1585625 - RNA, 19 nt, Pseudomonas putida KT2440
gaccacugcaggugcaggu

SEQ ID NO: 1585626 - RNA, 17 nt, Pseudomonas putida KT2440
gaccacuaucgccagaa

SEQ ID NO: 1585627 - RNA, 18 nt, Pseudomonas putida KT2440
gacagggugcggauaccg

SEQ ID NO: 1585628 - RNA, 17 nt, Pseudomonas putida KT2440
gacagcagguccggccu

SEQ ID NO: 1585629 - RNA, 16 nt, Pseudomonas putida KT2440
gacagccucaaggccg

SEQ ID NO: 1585630 - RNA, 17 nt, Pseudomonas putida KT2440
gacagccucaaggccgg

SEQ ID NO: 1585631 - RNA, 20 nt, Pseudomonas putida KT2440
gacagcgcguuaggcgagau

SEQ ID NO: 1585632 - RNA, 23 nt, Pseudomonas putida KT2440
gacagcggcagcaucgaccugcc

SEQ ID NO: 1585633 - RNA, 15 nt, Pseudomonas putida KT2440
gacaccagcgcacca

SEQ ID NO: 1585634 - RNA, 19 nt, Pseudomonas putida KT2440
gacaccagcgcaccacugu

SEQ ID NO: 1585635 - RNA, 21 nt, Pseudomonas putida KT2440
gacagcaucugcaccaggaag

SEQ ID NO: 1585636 - RNA, 20 nt, Pseudomonas putida KT2440
gacagcaggaacagcggcag

SEQ ID NO: 1585637 - RNA, 17 nt, Pseudomonas putida KT2440
cucauccucgcccacca

SEQ ID NO: 1585638 - RNA, 16 nt, Pseudomonas putida KT2440
cucauccacaccuucg

SEQ ID NO: 1585639 - RNA, 19 nt, Pseudomonas putida KT2440
cucauccacaccuucggca

SEQ ID NO: 1585640 - RNA, 11 nt, Pseudomonas putida KT2440
cucaucgaugc

SEQ ID NO: 1585641 - RNA, 15 nt, Pseudomonas putida KT2440
cucaucggcggcuuc

SEQ ID NO: 1585642 - RNA, 14 nt, Pseudomonas putida KT2440
cucaucguccaccg

SEQ ID NO: 1585643 - RNA, 23 nt, Pseudomonas putida KT2440
cucaucguccaccgcgccaucaa

SEQ ID NO: 1585644 - RNA, 18 nt, Pseudomonas putida KT2440
cucaugcgccagggcuga

SEQ ID NO: 1585645 - RNA, 14 nt, Pseudomonas putida KT2440
cucaugccuucggu

SEQ ID NO: 1585646 - RNA, 19 nt, Pseudomonas putida KT2440
cucaggcgcuggcgccagc

SEQ ID NO: 1585647 - RNA, 14 nt, Pseudomonas putida KT2440
cucagggcagcaac

SEQ ID NO: 1585648 - RNA, 19 nt, Pseudomonas putida KT2440
cucaggcucagcuccaugc

SEQ ID NO: 1585649 - RNA, 22 nt, Pseudomonas putida KT2440
cucagucgcaucgacaggucca

SEQ ID NO: 1585650 - RNA, 16 nt, Pseudomonas putida KT2440
cucaggugcacagggc

SEQ ID NO: 1585651 - RNA, 18 nt, Pseudomonas putida KT2440
cucaguggcugcacuucg

SEQ ID NO: 1585652 - RNA, 19 nt, Pseudomonas putida KT2440
cucacuggcauccagcgcc

SEQ ID NO: 1585653 - RNA, 14 nt, Pseudomonas putida KT2440
cucacguucgccau

SEQ ID NO: 1585654 - RNA, 20 nt, Pseudomonas putida KT2440
cucacguuugggcggcguga

SEQ ID NO: 1585655 - RNA, 14 nt, Pseudomonas putida KT2440
cucacucaccgcac

SEQ ID NO: 1585656 - RNA, 14 nt, Pseudomonas putida KT2440
cucacucgucgauc

SEQ ID NO: 1585657 - RNA, 18 nt, Pseudomonas putida KT2440
cucacaggcgaugaaagc

SEQ ID NO: 1585658 - RNA, 21 nt, Pseudomonas putida KT2440
cucacaggcucagucgcaucg

SEQ ID NO: 1585659 - RNA, 14 nt, Pseudomonas putida KT2440
cucacaucaucgcc

SEQ ID NO: 1585660 - RNA, 21 nt, Pseudomonas putida KT2440
cucacaucgcgcagggcgcga

SEQ ID NO: 1585661 - RNA, 20 nt, Pseudomonas putida KT2440
cucaauuucuuucagcucgg

SEQ ID NO: 1585662 - RNA, 22 nt, Pseudomonas putida KT2440
cucacgccccuuggcacggcca

SEQ ID NO: 1585663 - RNA, 24 nt, Pseudomonas putida KT2440
cucacgcucguuguccagcagcag

SEQ ID NO: 1585664 - RNA, 12 nt, Pseudomonas putida KT2440
cucacgcgccag

SEQ ID NO: 1585665 - RNA, 17 nt, Pseudomonas putida KT2440
cucacggcagugcaccc

SEQ ID NO: 1585666 - RNA, 23 nt, Pseudomonas putida KT2440
cucauucaaagccugcuccagca

SEQ ID NO: 1585667 - RNA, 17 nt, Pseudomonas putida KT2440
cuccagcaccucgcuca

SEQ ID NO: 1585668 - RNA, 19 nt, Pseudomonas putida KT2440
cucaugcuccugcgccacc

SEQ ID NO: 1585669 - RNA, 22 nt, Pseudomonas putida KT2440
cuccagcagcgcauccaccucg

SEQ ID NO: 1585670 - RNA, 19 nt, Pseudomonas putida KT2440
cuccagcacuuuugccacc

SEQ ID NO: 1585671 - RNA, 11 nt, Pseudomonas putida KT2440
cuccagcagcg

SEQ ID NO: 1585672 - RNA, 23 nt, Pseudomonas putida KT2440
cuccagcagcgacaccagcgcac

SEQ ID NO: 1585673 - RNA, 16 nt, Pseudomonas putida KT2440
cuccagcgaugacccg

SEQ ID NO: 1585674 - RNA, 22 nt, Pseudomonas putida KT2440
cuccagcgcacgcaacaggucg

SEQ ID NO: 1585675 - RNA, 17 nt, Pseudomonas putida KT2440
cuccagcccggcuucac

SEQ ID NO: 1585676 - RNA, 14 nt, Pseudomonas putida KT2440
cuccagcgccagca

SEQ ID NO: 1585677 - RNA, 23 nt, Pseudomonas putida KT2440
cuccagcucacagcacucguuga

SEQ ID NO: 1585678 - RNA, 13 nt, Pseudomonas putida KT2440
cuccagcuggcca

SEQ ID NO: 1585679 - RNA, 22 nt, Pseudomonas putida KT2440
cuccauugcgccugucacguug

SEQ ID NO: 1585680 - RNA, 20 nt, Pseudomonas putida KT2440
cucccacagauauugcaccg

SEQ ID NO: 1585681 - RNA, 14 nt, Pseudomonas putida KT2440
cuccauggccaggg

SEQ ID NO: 1585682 - RNA, 20 nt, Pseudomonas putida KT2440
cuccaugggcaggcccaggu

SEQ ID NO: 1585683 - RNA, 20 nt, Pseudomonas putida KT2440
cuccaugguaaagcccgaag

SEQ ID NO: 1585684 - RNA, 19 nt, Pseudomonas putida KT2440
cuccauguaacgcuccaca

SEQ ID NO: 1585685 - RNA, 18 nt, Pseudomonas putida KT2440
cucccguuugacagcgag

SEQ ID NO: 1585686 - RNA, 18 nt, Pseudomonas putida KT2440
cucccgggaucaccgcaa

SEQ ID NO: 1585687 - RNA, 14 nt, Pseudomonas putida KT2440
cucccggcucauca

SEQ ID NO: 1585688 - RNA, 20 nt, Pseudomonas putida KT2440
cucccggcucaucaggcgau

SEQ ID NO: 1585689 - RNA, 12 nt, Pseudomonas putida KT2440
cucccaccagca

SEQ ID NO: 1585690 - RNA, 17 nt, Pseudomonas putida KT2440
cucccacagguccagcg

SEQ ID NO: 1585691 - RNA, 19 nt, Pseudomonas putida KT2440
cucccacagguccagcgca

SEQ ID NO: 1585692 - RNA, 20 nt, Pseudomonas putida KT2440
cucccacagguccagcgcag

SEQ ID NO: 1585693 - RNA, 20 nt, Pseudomonas putida KT2440
cucccacaggugcagcacag

SEQ ID NO: 1585694 - RNA, 20 nt, Pseudomonas putida KT2440
cucccacaggaauggcacca

SEQ ID NO: 1585695 - RNA, 21 nt, Pseudomonas putida KT2440
cucccacaggggaucgcgcaa

SEQ ID NO: 1585696 - RNA, 14 nt, Pseudomonas putida KT2440
cuacugcuggcgcg

SEQ ID NO: 1585697 - RNA, 13 nt, Pseudomonas putida KT2440
cuacugcgaaugg

SEQ ID NO: 1585698 - RNA, 13 nt, Pseudomonas putida KT2440
cuagaugcugguu

SEQ ID NO: 1585699 - RNA, 17 nt, Pseudomonas putida KT2440
cuaccggcgccacuucg

SEQ ID NO: 1585700 - RNA, 18 nt, Pseudomonas putida KT2440
cguucuugaagaugaccu

SEQ ID NO: 1585701 - RNA, 21 nt, Pseudomonas putida KT2440
cguucuggccuuggcgugcac

SEQ ID NO: 1585702 - RNA, 19 nt, Pseudomonas putida KT2440
cuacccgguaaaaccgcuc

SEQ ID NO: 1585703 - RNA, 18 nt, Pseudomonas putida KT2440
cuaccaaccugccaugca

SEQ ID NO: 1585704 - RNA, 21 nt, Pseudomonas putida KT2440
cuaccaaccugccaugcaggu

SEQ ID NO: 1585705 - RNA, 22 nt, Pseudomonas putida KT2440
cuaccaaccugccaugcagguc

SEQ ID NO: 1585706 - RNA, 13 nt, Pseudomonas putida KT2440
cuacaucuucgcg

SEQ ID NO: 1585707 - RNA, 22 nt, Pseudomonas putida KT2440
cucaagaaaucgggucaucccc

SEQ ID NO: 1585708 - RNA, 13 nt, Pseudomonas putida KT2440
cucaagcgcagcc

SEQ ID NO: 1585709 - RNA, 12 nt, Pseudomonas putida KT2440
cucaagcgccag

SEQ ID NO: 1585710 - RNA, 20 nt, Pseudomonas putida KT2440
cucaagcgccagggcaucga

SEQ ID NO: 1585711 - RNA, 19 nt, Pseudomonas putida KT2440
cucaacggguuugccguga

SEQ ID NO: 1585712 - RNA, 16 nt, Pseudomonas putida KT2440
cucaacgccagggcaa

SEQ ID NO: 1585713 - RNA, 15 nt, Pseudomonas putida KT2440
cucaagggauuggca

SEQ ID NO: 1585714 - RNA, 21 nt, Pseudomonas putida KT2440
cucaagggcgcugaucaagcc

SEQ ID NO: 1585715 - RNA, 19 nt, Pseudomonas putida KT2440
cucaaggucacggcuguca

SEQ ID NO: 1585716 - RNA, 12 nt, Pseudomonas putida KT2440
cucaauggcacc

SEQ ID NO: 1585717 - RNA, 15 nt, Pseudomonas putida KT2440
cuauggaugccagcg

SEQ ID NO: 1585718 - RNA, 11 nt, Pseudomonas putida KT2440
cuauggccgga

SEQ ID NO: 1585719 - RNA, 22 nt, Pseudomonas putida KT2440
cuaugcggugguugucgcaccc

SEQ ID NO: 1585720 - RNA, 23 nt, Pseudomonas putida KT2440
cucaacagccacgcccgucaccu

SEQ ID NO: 1585721 - RNA, 17 nt, Pseudomonas putida KT2440
cuauauagaagcgggga

SEQ ID NO: 1585722 - RNA, 20 nt, Pseudomonas putida KT2440
cuagccucaucagagcguga

SEQ ID NO: 1585723 - RNA, 15 nt, Pseudomonas putida KT2440
cuagccggucaccga

SEQ ID NO: 1585724 - RNA, 17 nt, Pseudomonas putida KT2440
cuagccggucaccgacc

SEQ ID NO: 1585725 - RNA, 16 nt, Pseudomonas putida KT2440
cuagccaucgcaccac

SEQ ID NO: 1585726 - RNA, 20 nt, Pseudomonas putida KT2440
cucgacgccuuggcgcagca

SEQ ID NO: 1585727 - RNA, 16 nt, Pseudomonas putida KT2440
cucgacgcgcgcagcc

SEQ ID NO: 1585728 - RNA, 17 nt, Pseudomonas putida KT2440
cucgacgcgcgcagccu

SEQ ID NO: 1585729 - RNA, 20 nt, Pseudomonas putida KT2440
cucgacgcgcgcagccuggc

SEQ ID NO: 1585730 - RNA, 12 nt, Pseudomonas putida KT2440
cucgacggcgca

SEQ ID NO: 1585731 - RNA, 16 nt, Pseudomonas putida KT2440
cucgagcccgccagca

SEQ ID NO: 1585732 - RNA, 17 nt, Pseudomonas putida KT2440
cucgaacucaugcuccu

SEQ ID NO: 1585733 - RNA, 21 nt, Pseudomonas putida KT2440
cucgaagauauccgccugaau

SEQ ID NO: 1585734 - RNA, 14 nt, Pseudomonas putida KT2440
cucgacgaaggucu

SEQ ID NO: 1585735 - RNA, 15 nt, Pseudomonas putida KT2440
cuccucaucgaugcc

SEQ ID NO: 1585736 - RNA, 20 nt, Pseudomonas putida KT2440
cuccuccagcucgcgcgggu

SEQ ID NO: 1585737 - RNA, 12 nt, Pseudomonas putida KT2440
cuccucgcgggc

SEQ ID NO: 1585738 - RNA, 13 nt, Pseudomonas putida KT2440
cuccucgcgggca

SEQ ID NO: 1585739 - RNA, 14 nt, Pseudomonas putida KT2440
cuccucgcgggcaa

SEQ ID NO: 1585740 - RNA, 20 nt, Pseudomonas putida KT2440
cucgaacagcaguucgcggu

SEQ ID NO: 1585741 - RNA, 13 nt, Pseudomonas putida KT2440
cucgaacagcgcc

SEQ ID NO: 1585742 - RNA, 17 nt, Pseudomonas putida KT2440
cucgaacagcgccggca

SEQ ID NO: 1585743 - RNA, 15 nt, Pseudomonas putida KT2440
cucgaacaccugcgc

SEQ ID NO: 1585744 - RNA, 19 nt, Pseudomonas putida KT2440
cucgaaccaaggugcuacc

SEQ ID NO: 1585745 - RNA, 20 nt, Pseudomonas putida KT2440
cucgaacacuucacgcacau

SEQ ID NO: 1585746 - RNA, 15 nt, Pseudomonas putida KT2440
cucgaacaacgccuc

SEQ ID NO: 1585747 - RNA, 23 nt, Pseudomonas putida KT2440
cuccuuguagauauugaccagcg

SEQ ID NO: 1585748 - RNA, 23 nt, Pseudomonas putida KT2440
cuccuggucaucgaagccaagcg

SEQ ID NO: 1585749 - RNA, 18 nt, Pseudomonas putida KT2440
cuccugugggagcgggcg

SEQ ID NO: 1585750 - RNA, 18 nt, Pseudomonas putida KT2440
cuccggcaucauccugcu

SEQ ID NO: 1585751 - RNA, 15 nt, Pseudomonas putida KT2440
cuccgcgcaagcggu

SEQ ID NO: 1585752 - RNA, 22 nt, Pseudomonas putida KT2440
cuccgcgagggcaucagcgcac

SEQ ID NO: 1585753 - RNA, 13 nt, Pseudomonas putida KT2440
cuccgcuucauca

SEQ ID NO: 1585754 - RNA, 17 nt, Pseudomonas putida KT2440
cuccgccccaaaccagg

SEQ ID NO: 1585755 - RNA, 22 nt, Pseudomonas putida KT2440
cuccgcccgcucacgcagcccu

SEQ ID NO: 1585756 - RNA, 19 nt, Pseudomonas putida KT2440
cucccucguaggagcgggu

SEQ ID NO: 1585757 - RNA, 13 nt, Pseudomonas putida KT2440
cuccgacagcgca

SEQ ID NO: 1585758 - RNA, 20 nt, Pseudomonas putida KT2440
cuccgacagcgcagucacca

SEQ ID NO: 1585759 - RNA, 24 nt, Pseudomonas putida KT2440
cuccgacaaaugcaccacgcgcaa

SEQ ID NO: 1585760 - RNA, 21 nt, Pseudomonas putida KT2440
cucgcagguaaucggccugug

SEQ ID NO: 1585761 - RNA, 15 nt, Pseudomonas putida KT2440
cucgccaaacugcug

SEQ ID NO: 1585762 - RNA, 17 nt, Pseudomonas putida KT2440
cucgccauucaccagcu

SEQ ID NO: 1585763 - RNA, 17 nt, Pseudomonas putida KT2440
cucgccauucucgauca

SEQ ID NO: 1585764 - RNA, 15 nt, Pseudomonas putida KT2440
cucgccaucgccccg

SEQ ID NO: 1585765 - RNA, 14 nt, Pseudomonas putida KT2440
cucgcccaccagcu

SEQ ID NO: 1585766 - RNA, 20 nt, Pseudomonas putida KT2440
cucgcccaccagcugcacca

SEQ ID NO: 1585767 - RNA, 14 nt, Pseudomonas putida KT2440
cucgcagcagcacc

SEQ ID NO: 1585768 - RNA, 14 nt, Pseudomonas putida KT2440
cucgaggaagcggc

SEQ ID NO: 1585769 - RNA, 13 nt, Pseudomonas putida KT2440
cucgccgccgcga

SEQ ID NO: 1585770 - RNA, 15 nt, Pseudomonas putida KT2440
cucgcccggcacggc

SEQ ID NO: 1585771 - RNA, 14 nt, Pseudomonas putida KT2440
cucgcccgggucag

SEQ ID NO: 1585772 - RNA, 14 nt, Pseudomonas putida KT2440
cucgcccaugggcu

SEQ ID NO: 1585773 - RNA, 15 nt, Pseudomonas putida KT2440
cucgcccaugggcuu

SEQ ID NO: 1585774 - RNA, 19 nt, Pseudomonas putida KT2440
cucgcccacucacgcaacu

SEQ ID NO: 1585775 - RNA, 19 nt, Pseudomonas putida KT2440
cucgcgggcaaacccgcgc

SEQ ID NO: 1585776 - RNA, 21 nt, Pseudomonas putida KT2440
cucgcggcggcuaagcgccag

SEQ ID NO: 1585777 - RNA, 16 nt, Pseudomonas putida KT2440
cucgccucacagcgcc

SEQ ID NO: 1585778 - RNA, 14 nt, Pseudomonas putida KT2440
cucgccucagcgcc

SEQ ID NO: 1585779 - RNA, 15 nt, Pseudomonas putida KT2440
cucgccucagcgcca

SEQ ID NO: 1585780 - RNA, 14 nt, Pseudomonas putida KT2440
cucgccuggccaua

SEQ ID NO: 1585781 - RNA, 22 nt, Pseudomonas putida KT2440
cucgcgauccaucuucaccuug

SEQ ID NO: 1585782 - RNA, 20 nt, Pseudomonas putida KT2440
cucggccagguacucgcgcu

SEQ ID NO: 1585783 - RNA, 14 nt, Pseudomonas putida KT2440
cucggccaggucga

SEQ ID NO: 1585784 - RNA, 16 nt, Pseudomonas putida KT2440
cucggccaggucgauc

SEQ ID NO: 1585785 - RNA, 23 nt, Pseudomonas putida KT2440
cucggcccauuccgggucgccag

SEQ ID NO: 1585786 - RNA, 16 nt, Pseudomonas putida KT2440
cucggccgaugccagg

SEQ ID NO: 1585787 - RNA, 18 nt, Pseudomonas putida KT2440
cucgcuggcuuguucggc

SEQ ID NO: 1585788 - RNA, 21 nt, Pseudomonas putida KT2440
cucgcugccuuuggccgccag

SEQ ID NO: 1585789 - RNA, 16 nt, Pseudomonas putida KT2440
cucgcugccggcgugg

SEQ ID NO: 1585790 - RNA, 23 nt, Pseudomonas putida KT2440
cucggcaaucacccgcagggucg

SEQ ID NO: 1585791 - RNA, 17 nt, Pseudomonas putida KT2440
cucggcaaagcggcuga

SEQ ID NO: 1585792 - RNA, 13 nt, Pseudomonas putida KT2440
cucggcacgcgcc

SEQ ID NO: 1585793 - RNA, 20 nt, Pseudomonas putida KT2440
cucggcaaucugcagcagca

SEQ ID NO: 1585794 - RNA, 14 nt, Pseudomonas putida KT2440
cucggcaccaccga

SEQ ID NO: 1585795 - RNA, 18 nt, Pseudomonas putida KT2440
cugccaggcuggcgcuac

SEQ ID NO: 1585796 - RNA, 21 nt, Pseudomonas putida KT2440
cugccagcccggcggccagca

SEQ ID NO: 1585797 - RNA, 15 nt, Pseudomonas putida KT2440
cugccagcaccagcg

SEQ ID NO: 1585798 - RNA, 21 nt, Pseudomonas putida KT2440
cugccagcaccagcgcgauca

SEQ ID NO: 1585799 - RNA, 22 nt, Pseudomonas putida KT2440
cugccagcaccagcgcgaucac

SEQ ID NO: 1585800 - RNA, 18 nt, Pseudomonas putida KT2440
cugccagcaccuggcggc

SEQ ID NO: 1585801 - RNA, 12 nt, Pseudomonas putida KT2440
cugccagcacga

SEQ ID NO: 1585802 - RNA, 15 nt, Pseudomonas putida KT2440
cugccaggucaccgc

SEQ ID NO: 1585803 - RNA, 18 nt, Pseudomonas putida KT2440
cugccaggucaccgccca

SEQ ID NO: 1585804 - RNA, 15 nt, Pseudomonas putida KT2440
cugccagucgcacag

SEQ ID NO: 1585805 - RNA, 15 nt, Pseudomonas putida KT2440
cugccaugcaggucg

SEQ ID NO: 1585806 - RNA, 13 nt, Pseudomonas putida KT2440
cugccaugcgcug

SEQ ID NO: 1585807 - RNA, 21 nt, Pseudomonas putida KT2440
cugcccaggaucacuggccug

SEQ ID NO: 1585808 - RNA, 20 nt, Pseudomonas putida KT2440
cugcccaaguacaccggcag

SEQ ID NO: 1585809 - RNA, 19 nt, Pseudomonas putida KT2440
cugcccaagccauccacca

SEQ ID NO: 1585810 - RNA, 14 nt, Pseudomonas putida KT2440
cugcccggccagca

SEQ ID NO: 1585811 - RNA, 13 nt, Pseudomonas putida KT2440
cugcccgguacgc

SEQ ID NO: 1585812 - RNA, 18 nt, Pseudomonas putida KT2440
cugcccgcgccuugcgca

SEQ ID NO: 1585813 - RNA, 19 nt, Pseudomonas putida KT2440
cugcccgcgccuugcgcac

SEQ ID NO: 1585814 - RNA, 20 nt, Pseudomonas putida KT2440
cugcccgaucgccucgcugg

SEQ ID NO: 1585815 - RNA, 13 nt, Pseudomonas putida KT2440
cugccccucgauc

SEQ ID NO: 1585816 - RNA, 14 nt, Pseudomonas putida KT2440
cugccccucgauca

SEQ ID NO: 1585817 - RNA, 23 nt, Pseudomonas putida KT2440
cugcccccccauacggucgauga

SEQ ID NO: 1585818 - RNA, 15 nt, Pseudomonas putida KT2440
cugcccaggugccag

SEQ ID NO: 1585819 - RNA, 18 nt, Pseudomonas putida KT2440
cugcccauaaaagccuca

SEQ ID NO: 1585820 - RNA, 21 nt, Pseudomonas putida KT2440
cugcccauaaaagccucagcg

SEQ ID NO: 1585821 - RNA, 23 nt, Pseudomonas putida KT2440
cugcccauaaaagccucagcgcc

SEQ ID NO: 1585822 - RNA, 15 nt, Pseudomonas putida KT2440
cugcauggcauucgc

SEQ ID NO: 1585823 - RNA, 15 nt, Pseudomonas putida KT2440
cugcaugucggcagu

SEQ ID NO: 1585824 - RNA, 13 nt, Pseudomonas putida KT2440
cugcauugcgcgu

SEQ ID NO: 1585825 - RNA, 14 nt, Pseudomonas putida KT2440
cugcauuggccacg

SEQ ID NO: 1585826 - RNA, 20 nt, Pseudomonas putida KT2440
cugcauuggcggcaggcgca

SEQ ID NO: 1585827 - RNA, 14 nt, Pseudomonas putida KT2440
cugccaacgcaccg

SEQ ID NO: 1585828 - RNA, 21 nt, Pseudomonas putida KT2440
cugccaaaguccggcgaagca

SEQ ID NO: 1585829 - RNA, 22 nt, Pseudomonas putida KT2440
cugccaaaucccuuugcccgcc

SEQ ID NO: 1585830 - RNA, 17 nt, Pseudomonas putida KT2440
cugccacgauggucacc

SEQ ID NO: 1585831 - RNA, 23 nt, Pseudomonas putida KT2440
cugccaccuuccaggucgaucgc

SEQ ID NO: 1585832 - RNA, 22 nt, Pseudomonas putida KT2440
cugcaugccuuccugcaccuug

SEQ ID NO: 1585833 - RNA, 13 nt, Pseudomonas putida KT2440
cugcagugcuggg

SEQ ID NO: 1585834 - RNA, 18 nt, Pseudomonas putida KT2440
cugcaguucgcugcgcaa

SEQ ID NO: 1585835 - RNA, 14 nt, Pseudomonas putida KT2440
cugcauauaccgcg

SEQ ID NO: 1585836 - RNA, 13 nt, Pseudomonas putida KT2440
cugcauaugggcg

SEQ ID NO: 1585837 - RNA, 18 nt, Pseudomonas putida KT2440
cugcauacgcaucggugg

SEQ ID NO: 1585838 - RNA, 19 nt, Pseudomonas putida KT2440
cugcauacgcaucgguggu

SEQ ID NO: 1585839 - RNA, 16 nt, Pseudomonas putida KT2440
cugcagggcacgccaa

SEQ ID NO: 1585840 - RNA, 18 nt, Pseudomonas putida KT2440
cugcagguaaugcgccgc

SEQ ID NO: 1585841 - RNA, 17 nt, Pseudomonas putida KT2440
cugcagguacagcagcu

SEQ ID NO: 1585842 - RNA, 17 nt, Pseudomonas putida KT2440
cugcagggucaggcgga

SEQ ID NO: 1585843 - RNA, 12 nt, Pseudomonas putida KT2440
cugcaggguucg

SEQ ID NO: 1585844 - RNA, 17 nt, Pseudomonas putida KT2440
cugcagcuuuugcgcag

SEQ ID NO: 1585845 - RNA, 18 nt, Pseudomonas putida KT2440
cugcaggaaccuccguug

SEQ ID NO: 1585846 - RNA, 21 nt, Pseudomonas putida KT2440
cugcagcuucagguucugccg

SEQ ID NO: 1585847 - RNA, 15 nt, Pseudomonas putida KT2440
cugcagcuucccggc

SEQ ID NO: 1585848 - RNA, 16 nt, Pseudomonas putida KT2440
cugcaggagcgggcac

SEQ ID NO: 1585849 - RNA, 17 nt, Pseudomonas putida KT2440
cugcaggagcgggcacg

SEQ ID NO: 1585850 - RNA, 14 nt, Pseudomonas putida KT2440
cugcagccgcaccu

SEQ ID NO: 1585851 - RNA, 18 nt, Pseudomonas putida KT2440
cugcagccgcaccugccc

SEQ ID NO: 1585852 - RNA, 18 nt, Pseudomonas putida KT2440
cugcagcgcgucauccgc

SEQ ID NO: 1585853 - RNA, 20 nt, Pseudomonas putida KT2440
cugcagcgcgucauccgcca

SEQ ID NO: 1585854 - RNA, 20 nt, Pseudomonas putida KT2440
cugcagcgcguuggcgaucg

SEQ ID NO: 1585855 - RNA, 19 nt, Pseudomonas putida KT2440
cugcagcggcaagguagcc

SEQ ID NO: 1585856 - RNA, 23 nt, Pseudomonas putida KT2440
cugcagcguauucagauuacgcg

SEQ ID NO: 1585857 - RNA, 14 nt, Pseudomonas putida KT2440
cugcagcccggcaa

SEQ ID NO: 1585858 - RNA, 23 nt, Pseudomonas putida KT2440
cugcagcgaacacgaaaaagcca

SEQ ID NO: 1585859 - RNA, 18 nt, Pseudomonas putida KT2440
cugccggcgaauccagcc

SEQ ID NO: 1585860 - RNA, 16 nt, Pseudomonas putida KT2440
cugccggcaccguggc

SEQ ID NO: 1585861 - RNA, 17 nt, Pseudomonas putida KT2440
cugccggccagcgccug

SEQ ID NO: 1585862 - RNA, 14 nt, Pseudomonas putida KT2440
cugccgcucaucga

SEQ ID NO: 1585863 - RNA, 16 nt, Pseudomonas putida KT2440
cugccgcugaccuggg

SEQ ID NO: 1585864 - RNA, 19 nt, Pseudomonas putida KT2440
cugccggaccugccgcagc

SEQ ID NO: 1585865 - RNA, 12 nt, Pseudomonas putida KT2440
cugccgccugug

SEQ ID NO: 1585866 - RNA, 18 nt, Pseudomonas putida KT2440
cugccgccuucuccagcu

SEQ ID NO: 1585867 - RNA, 16 nt, Pseudomonas putida KT2440
cugccgcgcagcccaa

SEQ ID NO: 1585868 - RNA, 24 nt, Pseudomonas putida KT2440
cugccgcggaaauaccagacgcag

SEQ ID NO: 1585869 - RNA, 21 nt, Pseudomonas putida KT2440
cugccgccgaacauggugcuu

SEQ ID NO: 1585870 - RNA, 18 nt, Pseudomonas putida KT2440
cugcccgugccucgcgca

SEQ ID NO: 1585871 - RNA, 18 nt, Pseudomonas putida KT2440
cugccgaagaacgcgagc

SEQ ID NO: 1585872 - RNA, 20 nt, Pseudomonas putida KT2440
cugccgaagaacgcgagcgu

SEQ ID NO: 1585873 - RNA, 19 nt, Pseudomonas putida KT2440
cugccgacaaacguaccag

SEQ ID NO: 1585874 - RNA, 16 nt, Pseudomonas putida KT2440
cugccgaccugcgccg

SEQ ID NO: 1585875 - RNA, 17 nt, Pseudomonas putida KT2440
cugccgaccugcgccgg

SEQ ID NO: 1585876 - RNA, 16 nt, Pseudomonas putida KT2440
cugccgaccuugggcc

SEQ ID NO: 1585877 - RNA, 17 nt, Pseudomonas putida KT2440
cugccgacaggccguga

SEQ ID NO: 1585878 - RNA, 18 nt, Pseudomonas putida KT2440
cugccgagaggaucaccg

SEQ ID NO: 1585879 - RNA, 21 nt, Pseudomonas putida KT2440
cugccgaggcgccgacgauac

SEQ ID NO: 1585880 - RNA, 13 nt, Pseudomonas putida KT2440
cugccgcaccugc

SEQ ID NO: 1585881 - RNA, 17 nt, Pseudomonas putida KT2440
cugccgcauucgcgggu

SEQ ID NO: 1585882 - RNA, 20 nt, Pseudomonas putida KT2440
cugccgcaccagguccacca

SEQ ID NO: 1585883 - RNA, 16 nt, Pseudomonas putida KT2440
cugccgggcaucgauc

SEQ ID NO: 1585884 - RNA, 17 nt, Pseudomonas putida KT2440
cugccgggcaucgauca

SEQ ID NO: 1585885 - RNA, 17 nt, Pseudomonas putida KT2440
cugccggcgccuccagc

SEQ ID NO: 1585886 - RNA, 16 nt, Pseudomonas putida KT2440
cugccgggccagggua

SEQ ID NO: 1585887 - RNA, 15 nt, Pseudomonas putida KT2440
cugccgggucggccu

SEQ ID NO: 1585888 - RNA, 18 nt, Pseudomonas putida KT2440
cugccgggucggccugcu

SEQ ID NO: 1585889 - RNA, 13 nt, Pseudomonas putida KT2440
cugccgucagccg

SEQ ID NO: 1585890 - RNA, 20 nt, Pseudomonas putida KT2440
cugccgucauugcucaccgu

SEQ ID NO: 1585891 - RNA, 18 nt, Pseudomonas putida KT2440
cugccgucucgucacugg

SEQ ID NO: 1585892 - RNA, 22 nt, Pseudomonas putida KT2440
cugccguuuauugguuugacgc

SEQ ID NO: 1585893 - RNA, 20 nt, Pseudomonas putida KT2440
cugccguuugcuggccugca

SEQ ID NO: 1585894 - RNA, 12 nt, Pseudomonas putida KT2440
cugcgaaccugu

SEQ ID NO: 1585895 - RNA, 16 nt, Pseudomonas putida KT2440
cugcgacacgcgaauc

SEQ ID NO: 1585896 - RNA, 21 nt, Pseudomonas putida KT2440
cugcgaauggguggcggcaau

SEQ ID NO: 1585897 - RNA, 11 nt, Pseudomonas putida KT2440
cugcgacgaac

SEQ ID NO: 1585898 - RNA, 17 nt, Pseudomonas putida KT2440
cugcgacgaacucaacg

SEQ ID NO: 1585899 - RNA, 12 nt, Pseudomonas putida KT2440
cugccugcgcuu

SEQ ID NO: 1585900 - RNA, 17 nt, Pseudomonas putida KT2440
cugccuggccacuguug

SEQ ID NO: 1585901 - RNA, 19 nt, Pseudomonas putida KT2440
cugccuuccaaccagccag

SEQ ID NO: 1585902 - RNA, 13 nt, Pseudomonas putida KT2440
cugccuuccgcca

SEQ ID NO: 1585903 - RNA, 14 nt, Pseudomonas putida KT2440
cugccuugcccagc

SEQ ID NO: 1585904 - RNA, 16 nt, Pseudomonas putida KT2440
cugccuugcccugcag

SEQ ID NO: 1585905 - RNA, 19 nt, Pseudomonas putida KT2440
cugccuuuggccgccagcg

SEQ ID NO: 1585906 - RNA, 22 nt, Pseudomonas putida KT2440
cugccuuagaacagauccaucg

SEQ ID NO: 1585907 - RNA, 18 nt, Pseudomonas putida KT2440
cugaccacgccgaagcgc

SEQ ID NO: 1585908 - RNA, 23 nt, Pseudomonas putida KT2440
cugaccacgccgaagcgcgccug

SEQ ID NO: 1585909 - RNA, 18 nt, Pseudomonas putida KT2440
cugaccauaccucccgca

SEQ ID NO: 1585910 - RNA, 14 nt, Pseudomonas putida KT2440
cugaccagcccggc

SEQ ID NO: 1585911 - RNA, 11 nt, Pseudomonas putida KT2440
cugacccgcuu

SEQ ID NO: 1585912 - RNA, 14 nt, Pseudomonas putida KT2440
cugacccgcuucgc

SEQ ID NO: 1585913 - RNA, 14 nt, Pseudomonas putida KT2440
cugaccgcggugcu

SEQ ID NO: 1585914 - RNA, 15 nt, Pseudomonas putida KT2440
cugaccgccugcgca

SEQ ID NO: 1585915 - RNA, 18 nt, Pseudomonas putida KT2440
cugaccggucagcccggc

SEQ ID NO: 1585916 - RNA, 14 nt, Pseudomonas putida KT2440
cugagccggcuggc

SEQ ID NO: 1585917 - RNA, 14 nt, Pseudomonas putida KT2440
cugagcccggcacg

SEQ ID NO: 1585918 - RNA, 14 nt, Pseudomonas putida KT2440
cugagccaguucac

SEQ ID NO: 1585919 - RNA, 18 nt, Pseudomonas putida KT2440
cugagccaggccgacaac

SEQ ID NO: 1585920 - RNA, 17 nt, Pseudomonas putida KT2440
cugaucaccgccgccac

SEQ ID NO: 1585921 - RNA, 21 nt, Pseudomonas putida KT2440
cugaucgauacaccacuggug

SEQ ID NO: 1585922 - RNA, 22 nt, Pseudomonas putida KT2440
cugcacccagcguauagccacc

SEQ ID NO: 1585923 - RNA, 18 nt, Pseudomonas putida KT2440
cugcaccacaugcacggc

SEQ ID NO: 1585924 - RNA, 15 nt, Pseudomonas putida KT2440
cugcacccgccagcc

SEQ ID NO: 1585925 - RNA, 15 nt, Pseudomonas putida KT2440
cugcacgucgcgcag

SEQ ID NO: 1585926 - RNA, 23 nt, Pseudomonas putida KT2440
cugcacgucgcugucuucugcca

SEQ ID NO: 1585927 - RNA, 14 nt, Pseudomonas putida KT2440
cugcacgcgugccu

SEQ ID NO: 1585928 - RNA, 21 nt, Pseudomonas putida KT2440
cugcaccgaaggccgccggca

SEQ ID NO: 1585929 - RNA, 16 nt, Pseudomonas putida KT2440
cugcaccgaccgugca

SEQ ID NO: 1585930 - RNA, 17 nt, Pseudomonas putida KT2440
cugcagcacugccugca

SEQ ID NO: 1585931 - RNA, 14 nt, Pseudomonas putida KT2440
cugcagcaccagcu

SEQ ID NO: 1585932 - RNA, 17 nt, Pseudomonas putida KT2440
cugcacucccgcugcug

SEQ ID NO: 1585933 - RNA, 16 nt, Pseudomonas putida KT2440
cugcagacagugguca

SEQ ID NO: 1585934 - RNA, 16 nt, Pseudomonas putida KT2440
cugcagacgccgucaa

SEQ ID NO: 1585935 - RNA, 16 nt, Pseudomonas putida KT2440
cugcagaacauggccg

SEQ ID NO: 1585936 - RNA, 17 nt, Pseudomonas putida KT2440
cugcagaaccgccagca

SEQ ID NO: 1585937 - RNA, 13 nt, Pseudomonas putida KT2440
cugcaacagggcg

SEQ ID NO: 1585938 - RNA, 21 nt, Pseudomonas putida KT2440
cugcaacagcucauccaggcu

SEQ ID NO: 1585939 - RNA, 22 nt, Pseudomonas putida KT2440
cugcaacagcuccagcagugcc

SEQ ID NO: 1585940 - RNA, 22 nt, Pseudomonas putida KT2440
cugcaaacgccgcucgauaugc

SEQ ID NO: 1585941 - RNA, 15 nt, Pseudomonas putida KT2440
cugcaaagcgggcaa

SEQ ID NO: 1585942 - RNA, 22 nt, Pseudomonas putida KT2440
cugcaaaggcaugggccagggu

SEQ ID NO: 1585943 - RNA, 16 nt, Pseudomonas putida KT2440
cugcaaaggcuuguca

SEQ ID NO: 1585944 - RNA, 21 nt, Pseudomonas putida KT2440
cugcaaaggcuugucaugccu

SEQ ID NO: 1585945 - RNA, 17 nt, Pseudomonas putida KT2440
cugaucucuucagccac

SEQ ID NO: 1585946 - RNA, 13 nt, Pseudomonas putida KT2440
cugaucgugcacc

SEQ ID NO: 1585947 - RNA, 15 nt, Pseudomonas putida KT2440
cugaucgccuccagg

SEQ ID NO: 1585948 - RNA, 12 nt, Pseudomonas putida KT2440
cugaugcaccag

SEQ ID NO: 1585949 - RNA, 17 nt, Pseudomonas putida KT2440
cugaugcaccaggccca

SEQ ID NO: 1585950 - RNA, 20 nt, Pseudomonas putida KT2440
cugaugaacuuccaguccgc

SEQ ID NO: 1585951 - RNA, 17 nt, Pseudomonas putida KT2440
cugaugaaagcgcaugu

SEQ ID NO: 1585952 - RNA, 14 nt, Pseudomonas putida KT2440
cucguacgucgccu

SEQ ID NO: 1585953 - RNA, 17 nt, Pseudomonas putida KT2440
cucguccccgcgcuuug

SEQ ID NO: 1585954 - RNA, 14 nt, Pseudomonas putida KT2440
cucgucgaacagca

SEQ ID NO: 1585955 - RNA, 15 nt, Pseudomonas putida KT2440
cucgucgaacagcau

SEQ ID NO: 1585956 - RNA, 16 nt, Pseudomonas putida KT2440
cucguccgggcgccag

SEQ ID NO: 1585957 - RNA, 16 nt, Pseudomonas putida KT2440
cucggcgaaaagccgg

SEQ ID NO: 1585958 - RNA, 16 nt, Pseudomonas putida KT2440
cucggccugggcaggu

SEQ ID NO: 1585959 - RNA, 19 nt, Pseudomonas putida KT2440
cucggccucccgcuugcgg

SEQ ID NO: 1585960 - RNA, 13 nt, Pseudomonas putida KT2440
cucguugaccgac

SEQ ID NO: 1585961 - RNA, 15 nt, Pseudomonas putida KT2440
cucguugaccgucca

SEQ ID NO: 1585962 - RNA, 13 nt, Pseudomonas putida KT2440
cucguucaugccc

SEQ ID NO: 1585963 - RNA, 20 nt, Pseudomonas putida KT2440
cucguuggcgaagucggccu

SEQ ID NO: 1585964 - RNA, 16 nt, Pseudomonas putida KT2440
cucguuguccagcagc

SEQ ID NO: 1585965 - RNA, 24 nt, Pseudomonas putida KT2440
cucguuguccagcagcagcgcacc

SEQ ID NO: 1585966 - RNA, 22 nt, Pseudomonas putida KT2440
cucuaugccaccuguugccgcu

SEQ ID NO: 1585967 - RNA, 23 nt, Pseudomonas putida KT2440
cucucaaguucuuuguccugcga

SEQ ID NO: 1585968 - RNA, 16 nt, Pseudomonas putida KT2440
cucugccggaucuggc

SEQ ID NO: 1585969 - RNA, 12 nt, Pseudomonas putida KT2440
cucugcgccugc

SEQ ID NO: 1585970 - RNA, 17 nt, Pseudomonas putida KT2440
cucugcccgcaaggcaa

SEQ ID NO: 1585971 - RNA, 12 nt, Pseudomonas putida KT2440
cucugccgacaa

SEQ ID NO: 1585972 - RNA, 18 nt, Pseudomonas putida KT2440
cucugccgacaaacguac

SEQ ID NO: 1585973 - RNA, 17 nt, Pseudomonas putida KT2440
cucuugcagcgagugcg

SEQ ID NO: 1585974 - RNA, 20 nt, Pseudomonas putida KT2440
cucuuguguugccacccggc

SEQ ID NO: 1585975 - RNA, 18 nt, Pseudomonas putida KT2440
cucuuucaggcacagcac

SEQ ID NO: 1585976 - RNA, 14 nt, Pseudomonas putida KT2440
cugaaccucaccgc

SEQ ID NO: 1585977 - RNA, 23 nt, Pseudomonas putida KT2440
cugaacgaugcccgggccuucaa

SEQ ID NO: 1585978 - RNA, 19 nt, Pseudomonas putida KT2440
cugaagugaauagccggca

SEQ ID NO: 1585979 - RNA, 20 nt, Pseudomonas putida KT2440
cugaagugaauagccggcac

SEQ ID NO: 1585980 - RNA, 16 nt, Pseudomonas putida KT2440
cugaagugccaaggcu

SEQ ID NO: 1585981 - RNA, 17 nt, Pseudomonas putida KT2440
cugacagcaggaacagc

SEQ ID NO: 1585982 - RNA, 13 nt, Pseudomonas putida KT2440
cugacagcaugcc

SEQ ID NO: 1585983 - RNA, 20 nt, Pseudomonas putida KT2440
cugacacauaggcagccacc

SEQ ID NO: 1585984 - RNA, 15 nt, Pseudomonas putida KT2440
cugacaaugcgacug

SEQ ID NO: 1585985 - RNA, 21 nt, Pseudomonas putida KT2440
cugaaugucaucugaggcccg

SEQ ID NO: 1585986 - RNA, 20 nt, Pseudomonas putida KT2440
cguggcaaacccggccagca

SEQ ID NO: 1585987 - RNA, 15 nt, Pseudomonas putida KT2440
cguggcaacgccaca

SEQ ID NO: 1585988 - RNA, 19 nt, Pseudomonas putida KT2440
cgugcggccaaagcuguug

SEQ ID NO: 1585989 - RNA, 14 nt, Pseudomonas putida KT2440
cgugcugcaggcug

SEQ ID NO: 1585990 - RNA, 19 nt, Pseudomonas putida KT2440
cgugcugccggucggccug

SEQ ID NO: 1585991 - RNA, 18 nt, Pseudomonas putida KT2440
cgugccgcaucagccggc

SEQ ID NO: 1585992 - RNA, 13 nt, Pseudomonas putida KT2440
cgugccgcaugug

SEQ ID NO: 1585993 - RNA, 15 nt, Pseudomonas putida KT2440
cgugccgaggacaac

SEQ ID NO: 1585994 - RNA, 16 nt, Pseudomonas putida KT2440
cgugcccggcaaucgc

SEQ ID NO: 1585995 - RNA, 21 nt, Pseudomonas putida KT2440
cgugcccggcaaucgccaggc

SEQ ID NO: 1585996 - RNA, 22 nt, Pseudomonas putida KT2440
cgugcccgcgaagggcugccgc

SEQ ID NO: 1585997 - RNA, 14 nt, Pseudomonas putida KT2440
cgugccauucaucg

SEQ ID NO: 1585998 - RNA, 23 nt, Pseudomonas putida KT2440
cgugcaccacggucggccugcgc

SEQ ID NO: 1585999 - RNA, 14 nt, Pseudomonas putida KT2440
cgugcaccagcacc

SEQ ID NO: 1586000 - RNA, 18 nt, Pseudomonas putida KT2440
cgugcaccggccuugccg

SEQ ID NO: 1586001 - RNA, 14 nt, Pseudomonas putida KT2440
cgugcaccugucgc

SEQ ID NO: 1586002 - RNA, 14 nt, Pseudomonas putida KT2440
cgugacgauggcca

SEQ ID NO: 1586003 - RNA, 17 nt, Pseudomonas putida KT2440
cgugagauguucaccag

SEQ ID NO: 1586004 - RNA, 18 nt, Pseudomonas putida KT2440
cgugagcaucggcguugc

SEQ ID NO: 1586005 - RNA, 18 nt, Pseudomonas putida KT2440
cgugcaaggaucaccaag

SEQ ID NO: 1586006 - RNA, 21 nt, Pseudomonas putida KT2440
cgucgucgaagaucaucgagg

SEQ ID NO: 1586007 - RNA, 11 nt, Pseudomonas putida KT2440
cgucggucagc

SEQ ID NO: 1586008 - RNA, 15 nt, Pseudomonas putida KT2440
cgucgucaaggaagc

SEQ ID NO: 1586009 - RNA, 13 nt, Pseudomonas putida KT2440
cgucguaggcgcg

SEQ ID NO: 1586010 - RNA, 18 nt, Pseudomonas putida KT2440
cgucguaggcgcggguuu

SEQ ID NO: 1586011 - RNA, 22 nt, Pseudomonas putida KT2440
cgucguaggagcggguuuaccc

SEQ ID NO: 1586012 - RNA, 17 nt, Pseudomonas putida KT2440
cgucgcgugaggcaugg

SEQ ID NO: 1586013 - RNA, 22 nt, Pseudomonas putida KT2440
cgucggcguauggcuucacggc

SEQ ID NO: 1586014 - RNA, 20 nt, Pseudomonas putida KT2440
cgucggggaauggcccagcc

SEQ ID NO: 1586015 - RNA, 16 nt, Pseudomonas putida KT2440
cgucucgccgcuguac

SEQ ID NO: 1586016 - RNA, 17 nt, Pseudomonas putida KT2440
cgugaaucgcgcuugcg

SEQ ID NO: 1586017 - RNA, 23 nt, Pseudomonas putida KT2440
cgugacagguaggcgccacgccg

SEQ ID NO: 1586018 - RNA, 11 nt, Pseudomonas putida KT2440
cgugaccagcc

SEQ ID NO: 1586019 - RNA, 13 nt, Pseudomonas putida KT2440
cgucucuggccgc

SEQ ID NO: 1586020 - RNA, 20 nt, Pseudomonas putida KT2440
cguucaacuucgguggcuca

SEQ ID NO: 1586021 - RNA, 14 nt, Pseudomonas putida KT2440
cguuaccaccgggu

SEQ ID NO: 1586022 - RNA, 13 nt, Pseudomonas putida KT2440
cguguucgccugu

SEQ ID NO: 1586023 - RNA, 18 nt, Pseudomonas putida KT2440
cguguucgcgaggaaacc

SEQ ID NO: 1586024 - RNA, 17 nt, Pseudomonas putida KT2440
cguguuccccgaccaaa

SEQ ID NO: 1586025 - RNA, 16 nt, Pseudomonas putida KT2440
cguguugcagcggguu

SEQ ID NO: 1586026 - RNA, 14 nt, Pseudomonas putida KT2440
cgugugcaggugga

SEQ ID NO: 1586027 - RNA, 20 nt, Pseudomonas putida KT2440
cgugugacccaguucgcgga

SEQ ID NO: 1586028 - RNA, 21 nt, Pseudomonas putida KT2440
cgugugacccaguucgcggau

SEQ ID NO: 1586029 - RNA, 17 nt, Pseudomonas putida KT2440
cguucgccauaggccgc

SEQ ID NO: 1586030 - RNA, 20 nt, Pseudomonas putida KT2440
cguucgaugcgcagagccac

SEQ ID NO: 1586031 - RNA, 16 nt, Pseudomonas putida KT2440
cguucgagcaucggcu

SEQ ID NO: 1586032 - RNA, 13 nt, Pseudomonas putida KT2440
cguucugccgguu

SEQ ID NO: 1586033 - RNA, 16 nt, Pseudomonas putida KT2440
cguucggcccgcugcc

SEQ ID NO: 1586034 - RNA, 15 nt, Pseudomonas putida KT2440
cguucaucgaaggcc

SEQ ID NO: 1586035 - RNA, 14 nt, Pseudomonas putida KT2440
cguuccagccaggc

SEQ ID NO: 1586036 - RNA, 18 nt, Pseudomonas putida KT2440
cguucaggucauugucau

SEQ ID NO: 1586037 - RNA, 16 nt, Pseudomonas putida KT2440
cguucaggcgccugcc

SEQ ID NO: 1586038 - RNA, 16 nt, Pseudomonas putida KT2440
cguguaggagcggguu

SEQ ID NO: 1586039 - RNA, 23 nt, Pseudomonas putida KT2440
cgugucaguggucgugccauuca

SEQ ID NO: 1586040 - RNA, 18 nt, Pseudomonas putida KT2440
cgugguugaugcgcucgu

SEQ ID NO: 1586041 - RNA, 14 nt, Pseudomonas putida KT2440
cgugguucuugccg

SEQ ID NO: 1586042 - RNA, 23 nt, Pseudomonas putida KT2440
cgugguugcugauguuggccauc

SEQ ID NO: 1586043 - RNA, 22 nt, Pseudomonas putida KT2440
cguggugcgggccaccaggccu

SEQ ID NO: 1586044 - RNA, 20 nt, Pseudomonas putida KT2440
cgugggucgggaacagcucu

SEQ ID NO: 1586045 - RNA, 15 nt, Pseudomonas putida KT2440
cguggucgccuucac

SEQ ID NO: 1586046 - RNA, 19 nt, Pseudomonas putida KT2440
cguggugcgauucgcgcau

SEQ ID NO: 1586047 - RNA, 13 nt, Pseudomonas putida KT2440
cguggcaccggcg

SEQ ID NO: 1586048 - RNA, 15 nt, Pseudomonas putida KT2440
cguggccgccaacag

SEQ ID NO: 1586049 - RNA, 19 nt, Pseudomonas putida KT2440
cguggccgccaacagcgca

SEQ ID NO: 1586050 - RNA, 13 nt, Pseudomonas putida KT2440
cguggccgccaug

SEQ ID NO: 1586051 - RNA, 19 nt, Pseudomonas putida KT2440
cguggcgaacacuuggcag

SEQ ID NO: 1586052 - RNA, 18 nt, Pseudomonas putida KT2440
cguggcgcuggcgggcaa

SEQ ID NO: 1586053 - RNA, 16 nt, Pseudomonas putida KT2440
cguggcugaugccauc

SEQ ID NO: 1586054 - RNA, 17 nt, Pseudomonas putida KT2440
cguggcugaugccaucg

SEQ ID NO: 1586055 - RNA, 18 nt, Pseudomonas putida KT2440
cgugggcgcaacaucgau

SEQ ID NO: 1586056 - RNA, 20 nt, Pseudomonas putida KT2440
cggugucggccagcugcgca

SEQ ID NO: 1586057 - RNA, 14 nt, Pseudomonas putida KT2440
cggugaagcgacca

SEQ ID NO: 1586058 - RNA, 16 nt, Pseudomonas putida KT2440
cgguguagaacggcag

SEQ ID NO: 1586059 - RNA, 17 nt, Pseudomonas putida KT2440
cgguugcuccagcgugu

SEQ ID NO: 1586060 - RNA, 15 nt, Pseudomonas putida KT2440
cgguugccuugucgg

SEQ ID NO: 1586061 - RNA, 16 nt, Pseudomonas putida KT2440
cgguugaugcagcgcc

SEQ ID NO: 1586062 - RNA, 17 nt, Pseudomonas putida KT2440
cgguugaugcagcgccc

SEQ ID NO: 1586063 - RNA, 23 nt, Pseudomonas putida KT2440
cgguuccaauacauacaccaacg

SEQ ID NO: 1586064 - RNA, 16 nt, Pseudomonas putida KT2440
cgguugggcaagugcg

SEQ ID NO: 1586065 - RNA, 17 nt, Pseudomonas putida KT2440
cgguuggugcgccucca

SEQ ID NO: 1586066 - RNA, 14 nt, Pseudomonas putida KT2440
cgguuguacggcga

SEQ ID NO: 1586067 - RNA, 21 nt, Pseudomonas putida KT2440
cgguuggcgcuuccuggccuu

SEQ ID NO: 1586068 - RNA, 16 nt, Pseudomonas putida KT2440
cgguugucgaccuggc

SEQ ID NO: 1586069 - RNA, 20 nt, Pseudomonas putida KT2440
cguaacgagccuuggccagc

SEQ ID NO: 1586070 - RNA, 22 nt, Pseudomonas putida KT2440
cguagccuucagcggccgcgca

SEQ ID NO: 1586071 - RNA, 15 nt, Pseudomonas putida KT2440
cguacggcgucaguu

SEQ ID NO: 1586072 - RNA, 17 nt, Pseudomonas putida KT2440
cguacuggccgcugaac

SEQ ID NO: 1586073 - RNA, 12 nt, Pseudomonas putida KT2440
cguacuggacgu

SEQ ID NO: 1586074 - RNA, 16 nt, Pseudomonas putida KT2440
cguaccuuucaugccu

SEQ ID NO: 1586075 - RNA, 20 nt, Pseudomonas putida KT2440
cguaccugugggagcgggcg

SEQ ID NO: 1586076 - RNA, 14 nt, Pseudomonas putida KT2440
cguaagcgcugcgc

SEQ ID NO: 1586077 - RNA, 23 nt, Pseudomonas putida KT2440
cgucaccgccgccugggucaacc

SEQ ID NO: 1586078 - RNA, 22 nt, Pseudomonas putida KT2440
cgucagcauccaacccugcgcc

SEQ ID NO: 1586079 - RNA, 17 nt, Pseudomonas putida KT2440
cguauucgcggguaaac

SEQ ID NO: 1586080 - RNA, 18 nt, Pseudomonas putida KT2440
cgucaaaaaucucgacga

SEQ ID NO: 1586081 - RNA, 22 nt, Pseudomonas putida KT2440
cgucaaaguuuugcaucaagag

SEQ ID NO: 1586082 - RNA, 15 nt, Pseudomonas putida KT2440
cguaguaacggcgga

SEQ ID NO: 1586083 - RNA, 19 nt, Pseudomonas putida KT2440
cguaguaauggccgaugaa

SEQ ID NO: 1586084 - RNA, 19 nt, Pseudomonas putida KT2440
cgucgaacucgcgcccacg

SEQ ID NO: 1586085 - RNA, 12 nt, Pseudomonas putida KT2440
cgucgaccaccg

SEQ ID NO: 1586086 - RNA, 22 nt, Pseudomonas putida KT2440
cgucgagcaccacggcggcgau

SEQ ID NO: 1586087 - RNA, 19 nt, Pseudomonas putida KT2440
cgucgagcucgaucggcaa

SEQ ID NO: 1586088 - RNA, 12 nt, Pseudomonas putida KT2440
cgucgcccgcga

SEQ ID NO: 1586089 - RNA, 21 nt, Pseudomonas putida KT2440
cgucgccgcuucggcaugcac

SEQ ID NO: 1586090 - RNA, 20 nt, Pseudomonas putida KT2440
cgucgcgauugaucagcgcc

SEQ ID NO: 1586091 - RNA, 17 nt, Pseudomonas putida KT2440
cgucgaucauuuccggg

SEQ ID NO: 1586092 - RNA, 19 nt, Pseudomonas putida KT2440
cgucaucaucagcaggcag

SEQ ID NO: 1586093 - RNA, 19 nt, Pseudomonas putida KT2440
cgucaucgaaccguucacg

SEQ ID NO: 1586094 - RNA, 14 nt, Pseudomonas putida KT2440
cgucauccugcgcg

SEQ ID NO: 1586095 - RNA, 15 nt, Pseudomonas putida KT2440
cgucaggcucagcag

SEQ ID NO: 1586096 - RNA, 18 nt, Pseudomonas putida KT2440
cgucagccguugaccagg

SEQ ID NO: 1586097 - RNA, 21 nt, Pseudomonas putida KT2440
cgucaggccaugcccuugccu

SEQ ID NO: 1586098 - RNA, 15 nt, Pseudomonas putida KT2440
cguccacaaaccccg

SEQ ID NO: 1586099 - RNA, 16 nt, Pseudomonas putida KT2440
cgucaugcagcgccaa

SEQ ID NO: 1586100 - RNA, 16 nt, Pseudomonas putida KT2440
cgucaugguggugccg

SEQ ID NO: 1586101 - RNA, 16 nt, Pseudomonas putida KT2440
cgucauuagccuucau

SEQ ID NO: 1586102 - RNA, 19 nt, Pseudomonas putida KT2440
cguccagcaggcuggcggc

SEQ ID NO: 1586103 - RNA, 15 nt, Pseudomonas putida KT2440
cguccagcagugcca

SEQ ID NO: 1586104 - RNA, 15 nt, Pseudomonas putida KT2440
cguccagcaacagcu

SEQ ID NO: 1586105 - RNA, 19 nt, Pseudomonas putida KT2440
cguccagcaacagcugccg

SEQ ID NO: 1586106 - RNA, 16 nt, Pseudomonas putida KT2440
cguccagcccggucca

SEQ ID NO: 1586107 - RNA, 13 nt, Pseudomonas putida KT2440
cguccagguagcg

SEQ ID NO: 1586108 - RNA, 20 nt, Pseudomonas putida KT2440
cguccagguagcgcucgaca

SEQ ID NO: 1586109 - RNA, 17 nt, Pseudomonas putida KT2440
cgucccgaaagggccgc

SEQ ID NO: 1586110 - RNA, 18 nt, Pseudomonas putida KT2440
cgucccccgguaccagca

SEQ ID NO: 1586111 - RNA, 23 nt, Pseudomonas putida KT2440
gcccgcgguaaugcgcacggcuu

SEQ ID NO: 1586112 - RNA, 16 nt, Pseudomonas putida KT2440
gcccgcggcucaccca

SEQ ID NO: 1586113 - RNA, 16 nt, Pseudomonas putida KT2440
gcccgcgccuugcgca

SEQ ID NO: 1586114 - RNA, 18 nt, Pseudomonas putida KT2440
gcccgcgccuugcgcacg

SEQ ID NO: 1586115 - RNA, 24 nt, Pseudomonas putida KT2440
gcccgcgcggcgcaucgcgagcaa

SEQ ID NO: 1586116 - RNA, 15 nt, Pseudomonas putida KT2440
gcccgcgcuucacgu

SEQ ID NO: 1586117 - RNA, 16 nt, Pseudomonas putida KT2440
gcccgcgcuucccggg

SEQ ID NO: 1586118 - RNA, 15 nt, Pseudomonas putida KT2440
gcccgcgcaggauca

SEQ ID NO: 1586119 - RNA, 11 nt, Pseudomonas putida KT2440
gcccgcgcaaa

SEQ ID NO: 1586120 - RNA, 23 nt, Pseudomonas putida KT2440
gcccgcgaaucgccuucagcgcc

SEQ ID NO: 1586121 - RNA, 17 nt, Pseudomonas putida KT2440
gcccgcgaaugggcugc

SEQ ID NO: 1586122 - RNA, 17 nt, Pseudomonas putida KT2440
gcccgcgaaggcuccag

SEQ ID NO: 1586123 - RNA, 20 nt, Pseudomonas putida KT2440
gcccgcgaaggcuccagcac

SEQ ID NO: 1586124 - RNA, 14 nt, Pseudomonas putida KT2440
gcccgcgaagggcc

SEQ ID NO: 1586125 - RNA, 21 nt, Pseudomonas putida KT2440
gcccgcgaagggcucaacacc

SEQ ID NO: 1586126 - RNA, 23 nt, Pseudomonas putida KT2440
gcccgcgaagggcugccgcgcag

SEQ ID NO: 1586127 - RNA, 15 nt, Pseudomonas putida KT2440
gcccgcccgccugcg

SEQ ID NO: 1586128 - RNA, 20 nt, Pseudomonas putida KT2440
gcccgccccugccagcacca

SEQ ID NO: 1586129 - RNA, 20 nt, Pseudomonas putida KT2440
gcccgccccucgucacugac

SEQ ID NO: 1586130 - RNA, 13 nt, Pseudomonas putida KT2440
gcccgcgaaaugc

SEQ ID NO: 1586131 - RNA, 16 nt, Pseudomonas putida KT2440
gcccgcgaacaaggcu

SEQ ID NO: 1586132 - RNA, 18 nt, Pseudomonas putida KT2440
gcccgcgaacaaggcuca

SEQ ID NO: 1586133 - RNA, 14 nt, Pseudomonas putida KT2440
gcccgcgaagaagc

SEQ ID NO: 1586134 - RNA, 20 nt, Pseudomonas putida KT2440
gcccgcgaagaauucaacgc

SEQ ID NO: 1586135 - RNA, 20 nt, Pseudomonas putida KT2440
gcccgcgaagaggccagcac

SEQ ID NO: 1586136 - RNA, 22 nt, Pseudomonas putida KT2440
gcccgcgaagaggccagcacag

SEQ ID NO: 1586137 - RNA, 21 nt, Pseudomonas putida KT2440
gcccgcgaagaggccgguaca

SEQ ID NO: 1586138 - RNA, 21 nt, Pseudomonas putida KT2440
gcccgcgaagaggccgguacu

SEQ ID NO: 1586139 - RNA, 18 nt, Pseudomonas putida KT2440
gcccgcgaagagguccug

SEQ ID NO: 1586140 - RNA, 16 nt, Pseudomonas putida KT2440
gcccgccugcgccagc

SEQ ID NO: 1586141 - RNA, 18 nt, Pseudomonas putida KT2440
gcccgcuggccgcaccca

SEQ ID NO: 1586142 - RNA, 23 nt, Pseudomonas putida KT2440
gcccgcuggccgcacccagcagg

SEQ ID NO: 1586143 - RNA, 20 nt, Pseudomonas putida KT2440
gcccgcuguugagcagcagc

SEQ ID NO: 1586144 - RNA, 21 nt, Pseudomonas putida KT2440
gcccgcuguugagcagcagcc

SEQ ID NO: 1586145 - RNA, 18 nt, Pseudomonas putida KT2440
gcccgcuucaacagcuuc

SEQ ID NO: 1586146 - RNA, 14 nt, Pseudomonas putida KT2440
gcccgcuugcgcgg

SEQ ID NO: 1586147 - RNA, 19 nt, Pseudomonas putida KT2440
gcccgcgugcuucaagcca

SEQ ID NO: 1586148 - RNA, 22 nt, Pseudomonas putida KT2440
gcccgcgugagauguucaccag

SEQ ID NO: 1586149 - RNA, 16 nt, Pseudomonas putida KT2440
gcccgcucauguccag

SEQ ID NO: 1586150 - RNA, 20 nt, Pseudomonas putida KT2440
gcccgcuauccucgaucgcc

SEQ ID NO: 1586151 - RNA, 15 nt, Pseudomonas putida KT2440
gcccgcgucugccgc

SEQ ID NO: 1586152 - RNA, 19 nt, Pseudomonas putida KT2440
gcccgcucccacagguaau

SEQ ID NO: 1586153 - RNA, 20 nt, Pseudomonas putida KT2440
gcccgcucccacagguaaug

SEQ ID NO: 1586154 - RNA, 20 nt, Pseudomonas putida KT2440
gcccgcucccacagguacug

SEQ ID NO: 1586155 - RNA, 19 nt, Pseudomonas putida KT2440
gcccgcucccacagguaug

SEQ ID NO: 1586156 - RNA, 19 nt, Pseudomonas putida KT2440
gcccgcucccacaggucca

SEQ ID NO: 1586157 - RNA, 20 nt, Pseudomonas putida KT2440
gcccgcucccacagguuugc

SEQ ID NO: 1586158 - RNA, 21 nt, Pseudomonas putida KT2440
gcccgcuccuacaggggaugc

SEQ ID NO: 1586159 - RNA, 20 nt, Pseudomonas putida KT2440
gcccgcuccuacagguucug

SEQ ID NO: 1586160 - RNA, 19 nt, Pseudomonas putida KT2440
gcccgcucucacagggacc

SEQ ID NO: 1586161 - RNA, 19 nt, Pseudomonas putida KT2440
gcccgcucggucagggcgg

SEQ ID NO: 1586162 - RNA, 21 nt, Pseudomonas putida KT2440
gcccggacaggggaugcgcga

SEQ ID NO: 1586163 - RNA, 16 nt, Pseudomonas putida KT2440
gcccggcagaucgagc

SEQ ID NO: 1586164 - RNA, 14 nt, Pseudomonas putida KT2440
gcccggcagguugc

SEQ ID NO: 1586165 - RNA, 17 nt, Pseudomonas putida KT2440
gcccggcagguugcugg

SEQ ID NO: 1586166 - RNA, 15 nt, Pseudomonas putida KT2440
gcccggcaaucgcca

SEQ ID NO: 1586167 - RNA, 12 nt, Pseudomonas putida KT2440
gcccgggcgcag

SEQ ID NO: 1586168 - RNA, 18 nt, Pseudomonas putida KT2440
gcccggcuugcaccaacg

SEQ ID NO: 1586169 - RNA, 19 nt, Pseudomonas putida KT2440
gcccgggcaaagcaccaug

SEQ ID NO: 1586170 - RNA, 21 nt, Pseudomonas putida KT2440
gcccgggcacgggccagcgcg

SEQ ID NO: 1586171 - RNA, 13 nt, Pseudomonas putida KT2440
gcccgggcagccg

SEQ ID NO: 1586172 - RNA, 20 nt, Pseudomonas putida KT2440
gcccgucaccuugccaucga

SEQ ID NO: 1586173 - RNA, 12 nt, Pseudomonas putida KT2440
gcccggcgcaau

SEQ ID NO: 1586174 - RNA, 23 nt, Pseudomonas putida KT2440
gcccggccacgaauuucaaggcg

SEQ ID NO: 1586175 - RNA, 14 nt, Pseudomonas putida KT2440
gcccggccagcagg

SEQ ID NO: 1586176 - RNA, 16 nt, Pseudomonas putida KT2440
gcccggcccauaccgu

SEQ ID NO: 1586177 - RNA, 19 nt, Pseudomonas putida KT2440
gcccggcuccagguacucg

SEQ ID NO: 1586178 - RNA, 17 nt, Pseudomonas putida KT2440
gcccggcuccgcgcaag

SEQ ID NO: 1586179 - RNA, 19 nt, Pseudomonas putida KT2440
gcccggcugaaaccgcgaa

SEQ ID NO: 1586180 - RNA, 16 nt, Pseudomonas putida KT2440
gcccggcucaccgcag

SEQ ID NO: 1586181 - RNA, 21 nt, Pseudomonas putida KT2440
gcccggcgucgaacaacggca

SEQ ID NO: 1586182 - RNA, 13 nt, Pseudomonas putida KT2440
gcccggcgcagca

SEQ ID NO: 1586183 - RNA, 16 nt, Pseudomonas putida KT2440
gcccaccagcugcacc

SEQ ID NO: 1586184 - RNA, 13 nt, Pseudomonas putida KT2440
gcccaccagguca

SEQ ID NO: 1586185 - RNA, 12 nt, Pseudomonas putida KT2440
gcccaccagcgc

SEQ ID NO: 1586186 - RNA, 21 nt, Pseudomonas putida KT2440
gcccacccaaccgcgccagcu

SEQ ID NO: 1586187 - RNA, 23 nt, Pseudomonas putida KT2440
gcccacccaccacaaaccacagc

SEQ ID NO: 1586188 - RNA, 16 nt, Pseudomonas putida KT2440
gcccaaggcuggccag

SEQ ID NO: 1586189 - RNA, 17 nt, Pseudomonas putida KT2440
gcccaaggcuggccaga

SEQ ID NO: 1586190 - RNA, 19 nt, Pseudomonas putida KT2440
gcccaaguacaccggcagc

SEQ ID NO: 1586191 - RNA, 17 nt, Pseudomonas putida KT2440
gcccaagcgcuccgcca

SEQ ID NO: 1586192 - RNA, 13 nt, Pseudomonas putida KT2440
gcccaagcggcag

SEQ ID NO: 1586193 - RNA, 16 nt, Pseudomonas putida KT2440
gcccaauggacgcgca

SEQ ID NO: 1586194 - RNA, 16 nt, Pseudomonas putida KT2440
gcccaauuuggccagc

SEQ ID NO: 1586195 - RNA, 18 nt, Pseudomonas putida KT2440
gcccagcgccgccggcug

SEQ ID NO: 1586196 - RNA, 15 nt, Pseudomonas putida KT2440
gcccagcuucuccag

SEQ ID NO: 1586197 - RNA, 18 nt, Pseudomonas putida KT2440
gcccagcuucuccagcaa

SEQ ID NO: 1586198 - RNA, 13 nt, Pseudomonas putida KT2440
gcccagggcugcu

SEQ ID NO: 1586199 - RNA, 12 nt, Pseudomonas putida KT2440
gccccagccggu

SEQ ID NO: 1586200 - RNA, 12 nt, Pseudomonas putida KT2440
gccccagccuca

SEQ ID NO: 1586201 - RNA, 14 nt, Pseudomonas putida KT2440
gccccaccaggaag

SEQ ID NO: 1586202 - RNA, 16 nt, Pseudomonas putida KT2440
gccccaccaggcaccg

SEQ ID NO: 1586203 - RNA, 21 nt, Pseudomonas putida KT2440
gccccacccaguccguuacca

SEQ ID NO: 1586204 - RNA, 19 nt, Pseudomonas putida KT2440
gccccaggcauugcaaggu

SEQ ID NO: 1586205 - RNA, 21 nt, Pseudomonas putida KT2440
gccccagcgucacccguggca

SEQ ID NO: 1586206 - RNA, 12 nt, Pseudomonas putida KT2440
gccccagcgccu

SEQ ID NO: 1586207 - RNA, 17 nt, Pseudomonas putida KT2440
gccccagcgcgccagca

SEQ ID NO: 1586208 - RNA, 16 nt, Pseudomonas putida KT2440
gccccaugcgaccagu

SEQ ID NO: 1586209 - RNA, 16 nt, Pseudomonas putida KT2440
gccccauucgcugcgu

SEQ ID NO: 1586210 - RNA, 16 nt, Pseudomonas putida KT2440
gcccccacgccgaccg

SEQ ID NO: 1586211 - RNA, 20 nt, Pseudomonas putida KT2440
gcccccacgccgaccgcgcg

SEQ ID NO: 1586212 - RNA, 14 nt, Pseudomonas putida KT2440
gcccccagccuuga

SEQ ID NO: 1586213 - RNA, 13 nt, Pseudomonas putida KT2440
gcccccagcacag

SEQ ID NO: 1586214 - RNA, 16 nt, Pseudomonas putida KT2440
gccccccagccagcag

SEQ ID NO: 1586215 - RNA, 14 nt, Pseudomonas putida KT2440
gcccccccagcaac

SEQ ID NO: 1586216 - RNA, 13 nt, Pseudomonas putida KT2440
gcccccggcuguc

SEQ ID NO: 1586217 - RNA, 16 nt, Pseudomonas putida KT2440
gcccagugcgcgcaac

SEQ ID NO: 1586218 - RNA, 19 nt, Pseudomonas putida KT2440
gcccagugcgcgcaacagu

SEQ ID NO: 1586219 - RNA, 16 nt, Pseudomonas putida KT2440
gcccaguggcacacca

SEQ ID NO: 1586220 - RNA, 22 nt, Pseudomonas putida KT2440
gcccaguacuucgcgugaacug

SEQ ID NO: 1586221 - RNA, 16 nt, Pseudomonas putida KT2440
gcccauggccaggcug

SEQ ID NO: 1586222 - RNA, 15 nt, Pseudomonas putida KT2440
gcccauguggcgcag

SEQ ID NO: 1586223 - RNA, 15 nt, Pseudomonas putida KT2440
gcccauggcuggcag

SEQ ID NO: 1586224 - RNA, 22 nt, Pseudomonas putida KT2440
gcccauggcgcagcuccacugg

SEQ ID NO: 1586225 - RNA, 17 nt, Pseudomonas putida KT2440
gcccaguucagcucgcu

SEQ ID NO: 1586226 - RNA, 13 nt, Pseudomonas putida KT2440
gcccauucgcggg

SEQ ID NO: 1586227 - RNA, 14 nt, Pseudomonas putida KT2440
gcccauucgcgggc

SEQ ID NO: 1586228 - RNA, 17 nt, Pseudomonas putida KT2440
gcccauucgcgggcaag

SEQ ID NO: 1586229 - RNA, 18 nt, Pseudomonas putida KT2440
gcccauucgcgggcaagc

SEQ ID NO: 1586230 - RNA, 19 nt, Pseudomonas putida KT2440
gcccauucgcgggcaagcc

SEQ ID NO: 1586231 - RNA, 15 nt, Pseudomonas putida KT2440
gcccauuucgugggu

SEQ ID NO: 1586232 - RNA, 23 nt, Pseudomonas putida KT2440
gcccauuucugcauguccagccc

SEQ ID NO: 1586233 - RNA, 13 nt, Pseudomonas putida KT2440
gccccaagcgccu

SEQ ID NO: 1586234 - RNA, 18 nt, Pseudomonas putida KT2440
gccccaagcgggccaagg

SEQ ID NO: 1586235 - RNA, 19 nt, Pseudomonas putida KT2440
gccccuuccuuguaggcca

SEQ ID NO: 1586236 - RNA, 14 nt, Pseudomonas putida KT2440
gccccuucgauuca

SEQ ID NO: 1586237 - RNA, 18 nt, Pseudomonas putida KT2440
gcccgaaaccgccagcca

SEQ ID NO: 1586238 - RNA, 16 nt, Pseudomonas putida KT2440
gcccgaacgacacggc

SEQ ID NO: 1586239 - RNA, 21 nt, Pseudomonas putida KT2440
gcccgaacaacaggucggcgc

SEQ ID NO: 1586240 - RNA, 15 nt, Pseudomonas putida KT2440
gcccgaacagacaac

SEQ ID NO: 1586241 - RNA, 16 nt, Pseudomonas putida KT2440
gcccgaacagcacgau

SEQ ID NO: 1586242 - RNA, 18 nt, Pseudomonas putida KT2440
gccccuacgucagcuugc

SEQ ID NO: 1586243 - RNA, 18 nt, Pseudomonas putida KT2440
gccccuccacccaccuug

SEQ ID NO: 1586244 - RNA, 18 nt, Pseudomonas putida KT2440
gccccucgaacagcgccg

SEQ ID NO: 1586245 - RNA, 21 nt, Pseudomonas putida KT2440
gccccucgaccacgcacagcu

SEQ ID NO: 1586246 - RNA, 15 nt, Pseudomonas putida KT2440
gccccggcggcgcga

SEQ ID NO: 1586247 - RNA, 22 nt, Pseudomonas putida KT2440
gccccggcggcgcgaaucagcg

SEQ ID NO: 1586248 - RNA, 22 nt, Pseudomonas putida KT2440
gccccggcgccgccaggcagca

SEQ ID NO: 1586249 - RNA, 23 nt, Pseudomonas putida KT2440
gccccggcgccgccaggcagcag

SEQ ID NO: 1586250 - RNA, 20 nt, Pseudomonas putida KT2440
gccccggcuaucucaggcca

SEQ ID NO: 1586251 - RNA, 22 nt, Pseudomonas putida KT2440
gccccggcuaucucaggccagu

SEQ ID NO: 1586252 - RNA, 16 nt, Pseudomonas putida KT2440
gccccggccugcacaa

SEQ ID NO: 1586253 - RNA, 15 nt, Pseudomonas putida KT2440
gccccgggcaggcca

SEQ ID NO: 1586254 - RNA, 22 nt, Pseudomonas putida KT2440
gccccggccagugaagcucgau

SEQ ID NO: 1586255 - RNA, 13 nt, Pseudomonas putida KT2440
gccccggccaggc

SEQ ID NO: 1586256 - RNA, 13 nt, Pseudomonas putida KT2440
gccccggcaauac

SEQ ID NO: 1586257 - RNA, 15 nt, Pseudomonas putida KT2440
gccccggcaauaccg

SEQ ID NO: 1586258 - RNA, 19 nt, Pseudomonas putida KT2440
gcccccuguaggagcgggu

SEQ ID NO: 1586259 - RNA, 20 nt, Pseudomonas putida KT2440
gcccccuguaggagcggguu

SEQ ID NO: 1586260 - RNA, 16 nt, Pseudomonas putida KT2440
gcccccgucagcggca

SEQ ID NO: 1586261 - RNA, 17 nt, Pseudomonas putida KT2440
gcccccgucagcggcaa

SEQ ID NO: 1586262 - RNA, 21 nt, Pseudomonas putida KT2440
gcccccgucagcggcaacacc

SEQ ID NO: 1586263 - RNA, 19 nt, Pseudomonas putida KT2440
gccccgaccaccgccucga

SEQ ID NO: 1586264 - RNA, 16 nt, Pseudomonas putida KT2440
gcccgcacugcaaugc

SEQ ID NO: 1586265 - RNA, 17 nt, Pseudomonas putida KT2440
gcccgccagcaggccac

SEQ ID NO: 1586266 - RNA, 14 nt, Pseudomonas putida KT2440
gcccgccacaccga

SEQ ID NO: 1586267 - RNA, 15 nt, Pseudomonas putida KT2440
gcccgccaaaaggcc

SEQ ID NO: 1586268 - RNA, 17 nt, Pseudomonas putida KT2440
gcccgccaaaaggcccg

SEQ ID NO: 1586269 - RNA, 18 nt, Pseudomonas putida KT2440
gcccgccaaaaggcccga

SEQ ID NO: 1586270 - RNA, 18 nt, Pseudomonas putida KT2440
gcccgaucggguacucca

SEQ ID NO: 1586271 - RNA, 21 nt, Pseudomonas putida KT2440
gcccgaucggguacuccacca

SEQ ID NO: 1586272 - RNA, 23 nt, Pseudomonas putida KT2440
gcccgaggaacggcuggcugccg

SEQ ID NO: 1586273 - RNA, 17 nt, Pseudomonas putida KT2440
gcccgaacgcagcgccg

SEQ ID NO: 1586274 - RNA, 13 nt, Pseudomonas putida KT2440
gcccgaagcgcag

SEQ ID NO: 1586275 - RNA, 18 nt, Pseudomonas putida KT2440
gcccgaagcgcaggucca

SEQ ID NO: 1586276 - RNA, 18 nt, Pseudomonas putida KT2440
gccaacgcugcucggccu

SEQ ID NO: 1586277 - RNA, 20 nt, Pseudomonas putida KT2440
gccaacggucagacgcggaa

SEQ ID NO: 1586278 - RNA, 15 nt, Pseudomonas putida KT2440
gccaacggucgauca

SEQ ID NO: 1586279 - RNA, 24 nt, Pseudomonas putida KT2440
gccacgauagcgucagcagggcca

SEQ ID NO: 1586280 - RNA, 15 nt, Pseudomonas putida KT2440
gccacgauggucacc

SEQ ID NO: 1586281 - RNA, 17 nt, Pseudomonas putida KT2440
gccacgcaccagggcug

SEQ ID NO: 1586282 - RNA, 14 nt, Pseudomonas putida KT2440
gccacggcgcugac

SEQ ID NO: 1586283 - RNA, 14 nt, Pseudomonas putida KT2440
gccacgucgccagc

SEQ ID NO: 1586284 - RNA, 17 nt, Pseudomonas putida KT2440
gccacgucgccagcggc

SEQ ID NO: 1586285 - RNA, 17 nt, Pseudomonas putida KT2440
gccacguucugcagccu

SEQ ID NO: 1586286 - RNA, 19 nt, Pseudomonas putida KT2440
gccacguucugcagccuga

SEQ ID NO: 1586287 - RNA, 15 nt, Pseudomonas putida KT2440
gccacucagcggguc

SEQ ID NO: 1586288 - RNA, 13 nt, Pseudomonas putida KT2440
gccacguuuucgc

SEQ ID NO: 1586289 - RNA, 23 nt, Pseudomonas putida KT2440
gccacuccgccucguuggcgaag

SEQ ID NO: 1586290 - RNA, 19 nt, Pseudomonas putida KT2440
gccagaagcguaccgccag

SEQ ID NO: 1586291 - RNA, 17 nt, Pseudomonas putida KT2440
gccagacgcgcgcuggc

SEQ ID NO: 1586292 - RNA, 15 nt, Pseudomonas putida KT2440
gccagacgaccagca

SEQ ID NO: 1586293 - RNA, 17 nt, Pseudomonas putida KT2440
gccagacgaccagcaug

SEQ ID NO: 1586294 - RNA, 15 nt, Pseudomonas putida KT2440
gccagaccuugcgca

SEQ ID NO: 1586295 - RNA, 17 nt, Pseudomonas putida KT2440
gccagaccuugcgcacg

SEQ ID NO: 1586296 - RNA, 21 nt, Pseudomonas putida KT2440
gccagaccacggugucgucgc

SEQ ID NO: 1586297 - RNA, 13 nt, Pseudomonas putida KT2440
gccagaugcgccg

SEQ ID NO: 1586298 - RNA, 16 nt, Pseudomonas putida KT2440
gccagaucauggcggu

SEQ ID NO: 1586299 - RNA, 23 nt, Pseudomonas putida KT2440
gccagcaacuggugaaucagccc

SEQ ID NO: 1586300 - RNA, 17 nt, Pseudomonas putida KT2440
gccagcaaugcgucggc

SEQ ID NO: 1586301 - RNA, 20 nt, Pseudomonas putida KT2440
gccagcaauugcgagguacc

SEQ ID NO: 1586302 - RNA, 14 nt, Pseudomonas putida KT2440
gccagcagggccgg

SEQ ID NO: 1586303 - RNA, 23 nt, Pseudomonas putida KT2440
gccagcagggccggcccuuucgc

SEQ ID NO: 1586304 - RNA, 22 nt, Pseudomonas putida KT2440
gccagcaucgaggaaggcaucg

SEQ ID NO: 1586305 - RNA, 20 nt, Pseudomonas putida KT2440
gccagcaguuucagcggccg

SEQ ID NO: 1586306 - RNA, 14 nt, Pseudomonas putida KT2440
gccagcaucacgcc

SEQ ID NO: 1586307 - RNA, 16 nt, Pseudomonas putida KT2440
gccagcaucacgccgc

SEQ ID NO: 1586308 - RNA, 21 nt, Pseudomonas putida KT2440
gccagcaggucagcacgcgcu

SEQ ID NO: 1586309 - RNA, 15 nt, Pseudomonas putida KT2440
gccagcagugcaucg

SEQ ID NO: 1586310 - RNA, 19 nt, Pseudomonas putida KT2440
gccagcagugcaucgaagc

SEQ ID NO: 1586311 - RNA, 20 nt, Pseudomonas putida KT2440
gccagcagugcaucgaagca

SEQ ID NO: 1586312 - RNA, 16 nt, Pseudomonas putida KT2440
gccagcagugcggcaa

SEQ ID NO: 1586313 - RNA, 17 nt, Pseudomonas putida KT2440
gccagcagugcggcaac

SEQ ID NO: 1586314 - RNA, 19 nt, Pseudomonas putida KT2440
gccagccacagacgggucg

SEQ ID NO: 1586315 - RNA, 18 nt, Pseudomonas putida KT2440
gccagccaccaccaugcg

SEQ ID NO: 1586316 - RNA, 14 nt, Pseudomonas putida KT2440
gccagccaacggca

SEQ ID NO: 1586317 - RNA, 14 nt, Pseudomonas putida KT2440
gccagcaugcuggu

SEQ ID NO: 1586318 - RNA, 15 nt, Pseudomonas putida KT2440
gccagcauggugcag

SEQ ID NO: 1586319 - RNA, 14 nt, Pseudomonas putida KT2440
gccagccagguugu

SEQ ID NO: 1586320 - RNA, 23 nt, Pseudomonas putida KT2440
gccagccacuccgccucguuggc

SEQ ID NO: 1586321 - RNA, 15 nt, Pseudomonas putida KT2440
gccagccgcggcagc

SEQ ID NO: 1586322 - RNA, 17 nt, Pseudomonas putida KT2440
gccagccccagcggcag

SEQ ID NO: 1586323 - RNA, 20 nt, Pseudomonas putida KT2440
gccagccccagcggcagcag

SEQ ID NO: 1586324 - RNA, 22 nt, Pseudomonas putida KT2440
gccagccccagcggcagcagca

SEQ ID NO: 1586325 - RNA, 23 nt, Pseudomonas putida KT2440
gccagccccagcggcagcagcag

SEQ ID NO: 1586326 - RNA, 23 nt, Pseudomonas putida KT2440
gccagccuuaccccccugcacca

SEQ ID NO: 1586327 - RNA, 20 nt, Pseudomonas putida KT2440
gccagccugcagcgcggcga

SEQ ID NO: 1586328 - RNA, 21 nt, Pseudomonas putida KT2440
gccagccugcagcgcggcgau

SEQ ID NO: 1586329 - RNA, 12 nt, Pseudomonas putida KT2440
gccagccuucga

SEQ ID NO: 1586330 - RNA, 20 nt, Pseudomonas putida KT2440
gccagccuucgccaacugca

SEQ ID NO: 1586331 - RNA, 21 nt, Pseudomonas putida KT2440
gccagcgaggcaaucagggca

SEQ ID NO: 1586332 - RNA, 24 nt, Pseudomonas putida KT2440
gccagcgauaaaccagcagcgccu

SEQ ID NO: 1586333 - RNA, 17 nt, Pseudomonas putida KT2440
gccagcgcgguagcugc

SEQ ID NO: 1586334 - RNA, 19 nt, Pseudomonas putida KT2440
gccagcgcgguagcugccg

SEQ ID NO: 1586335 - RNA, 19 nt, Pseudomonas putida KT2440
gccagcgccugcaggccca

SEQ ID NO: 1586336 - RNA, 23 nt, Pseudomonas putida KT2440
gccagcgccugcaggcccaggug

SEQ ID NO: 1586337 - RNA, 15 nt, Pseudomonas putida KT2440
gccagcgccucaccg

SEQ ID NO: 1586338 - RNA, 16 nt, Pseudomonas putida KT2440
gccagcggcgaugcuc

SEQ ID NO: 1586339 - RNA, 14 nt, Pseudomonas putida KT2440
gccagcggccagcg

SEQ ID NO: 1586340 - RNA, 15 nt, Pseudomonas putida KT2440
gccaggcgcaccgcc

SEQ ID NO: 1586341 - RNA, 12 nt, Pseudomonas putida KT2440
gccaggccgaca

SEQ ID NO: 1586342 - RNA, 17 nt, Pseudomonas putida KT2440
gccaggccggcgcagau

SEQ ID NO: 1586343 - RNA, 14 nt, Pseudomonas putida KT2440
gccaggcauugccc

SEQ ID NO: 1586344 - RNA, 17 nt, Pseudomonas putida KT2440
gccaggcauugcucgau

SEQ ID NO: 1586345 - RNA, 21 nt, Pseudomonas putida KT2440
gccaggcacuggccagcggcg

SEQ ID NO: 1586346 - RNA, 20 nt, Pseudomonas putida KT2440
gccaggcacagaucaacgcc

SEQ ID NO: 1586347 - RNA, 23 nt, Pseudomonas putida KT2440
gccaggcaccacaagaacugcga

SEQ ID NO: 1586348 - RNA, 16 nt, Pseudomonas putida KT2440
gccaggauggcaccga

SEQ ID NO: 1586349 - RNA, 23 nt, Pseudomonas putida KT2440
gccaggccccuuggccaacggca

SEQ ID NO: 1586350 - RNA, 18 nt, Pseudomonas putida KT2440
gccaggaguucugcacag

SEQ ID NO: 1586351 - RNA, 14 nt, Pseudomonas putida KT2440
gccaggaucggcac

SEQ ID NO: 1586352 - RNA, 14 nt, Pseudomonas putida KT2440
gccaggaucgagac

SEQ ID NO: 1586353 - RNA, 13 nt, Pseudomonas putida KT2440
gccagcguggccg

SEQ ID NO: 1586354 - RNA, 19 nt, Pseudomonas putida KT2440
gccagcguggccgccaaca

SEQ ID NO: 1586355 - RNA, 21 nt, Pseudomonas putida KT2440
gccagcucggccgaugccagg

SEQ ID NO: 1586356 - RNA, 12 nt, Pseudomonas putida KT2440
gccagggcaucg

SEQ ID NO: 1586357 - RNA, 18 nt, Pseudomonas putida KT2440
gccagggcgcugucggcg

SEQ ID NO: 1586358 - RNA, 14 nt, Pseudomonas putida KT2440
gccagggccugacc

SEQ ID NO: 1586359 - RNA, 20 nt, Pseudomonas putida KT2440
gccagggcaaaaugcagcaa

SEQ ID NO: 1586360 - RNA, 21 nt, Pseudomonas putida KT2440
gccaggcugauacgcgacagu

SEQ ID NO: 1586361 - RNA, 21 nt, Pseudomonas putida KT2440
gccaggcguauucggccacca

SEQ ID NO: 1586362 - RNA, 15 nt, Pseudomonas putida KT2440
gccaggcucaggccu

SEQ ID NO: 1586363 - RNA, 19 nt, Pseudomonas putida KT2440
gccaggcucgacggcgcaa

SEQ ID NO: 1586364 - RNA, 15 nt, Pseudomonas putida KT2440
gccagguacaggcaa

SEQ ID NO: 1586365 - RNA, 17 nt, Pseudomonas putida KT2440
gccagguacaggcaaag

SEQ ID NO: 1586366 - RNA, 12 nt, Pseudomonas putida KT2440
gccagggugcca

SEQ ID NO: 1586367 - RNA, 14 nt, Pseudomonas putida KT2440
gccaggucaccgcc

SEQ ID NO: 1586368 - RNA, 19 nt, Pseudomonas putida KT2440
gccaggugcucagccacgc

SEQ ID NO: 1586369 - RNA, 18 nt, Pseudomonas putida KT2440
gccaggugccgucgggca

SEQ ID NO: 1586370 - RNA, 20 nt, Pseudomonas putida KT2440
gccaggugccgucgggcacg

SEQ ID NO: 1586371 - RNA, 20 nt, Pseudomonas putida KT2440
gccaggucggacagggucag

SEQ ID NO: 1586372 - RNA, 18 nt, Pseudomonas putida KT2440
gccaggucgccggugugc

SEQ ID NO: 1586373 - RNA, 19 nt, Pseudomonas putida KT2440
gcccaacgaaaaaggcccu

SEQ ID NO: 1586374 - RNA, 16 nt, Pseudomonas putida KT2440
gcccaacccagccagc

SEQ ID NO: 1586375 - RNA, 20 nt, Pseudomonas putida KT2440
gcccaacccagccagcgaca

SEQ ID NO: 1586376 - RNA, 15 nt, Pseudomonas putida KT2440
gcccaaccccagcgc

SEQ ID NO: 1586377 - RNA, 17 nt, Pseudomonas putida KT2440
gcccaaccccagcgcgu

SEQ ID NO: 1586378 - RNA, 23 nt, Pseudomonas putida KT2440
gcccaaccccagcgcguacagcg

SEQ ID NO: 1586379 - RNA, 17 nt, Pseudomonas putida KT2440
gcccaaccccaggcgca

SEQ ID NO: 1586380 - RNA, 19 nt, Pseudomonas putida KT2440
gcccaaccccaggcgcaca

SEQ ID NO: 1586381 - RNA, 20 nt, Pseudomonas putida KT2440
gcccaaagcccgugccgcau

SEQ ID NO: 1586382 - RNA, 14 nt, Pseudomonas putida KT2440
gccauuugcucgac

SEQ ID NO: 1586383 - RNA, 17 nt, Pseudomonas putida KT2440
gccauugacccgcuugc

SEQ ID NO: 1586384 - RNA, 14 nt, Pseudomonas putida KT2440
gccauuccuugcgc

SEQ ID NO: 1586385 - RNA, 21 nt, Pseudomonas putida KT2440
gccauucguccgaccaacggu

SEQ ID NO: 1586386 - RNA, 17 nt, Pseudomonas putida KT2440
gccauggcgggcgacga

SEQ ID NO: 1586387 - RNA, 18 nt, Pseudomonas putida KT2440
gccaugggccugcacgau

SEQ ID NO: 1586388 - RNA, 21 nt, Pseudomonas putida KT2440
gccaugaacaccaccgcgaaa

SEQ ID NO: 1586389 - RNA, 15 nt, Pseudomonas putida KT2440
gccauguugcgcagc

SEQ ID NO: 1586390 - RNA, 17 nt, Pseudomonas putida KT2440
gccauguugcgcagcaa

SEQ ID NO: 1586391 - RNA, 16 nt, Pseudomonas putida KT2440
gccauucgcgggcaug

SEQ ID NO: 1586392 - RNA, 18 nt, Pseudomonas putida KT2440
gccauguacguugccaga

SEQ ID NO: 1586393 - RNA, 22 nt, Pseudomonas putida KT2440
gccauaucaggauugccgcagc

SEQ ID NO: 1586394 - RNA, 15 nt, Pseudomonas putida KT2440
gccauaguugaccag

SEQ ID NO: 1586395 - RNA, 18 nt, Pseudomonas putida KT2440
gccauaguugaccagcac

SEQ ID NO: 1586396 - RNA, 19 nt, Pseudomonas putida KT2440
gccauauugcugagccagu

SEQ ID NO: 1586397 - RNA, 19 nt, Pseudomonas putida KT2440
gccaucagaggcgauggca

SEQ ID NO: 1586398 - RNA, 15 nt, Pseudomonas putida KT2440
gccaucaaggccgac

SEQ ID NO: 1586399 - RNA, 13 nt, Pseudomonas putida KT2440
gccauagcaccag

SEQ ID NO: 1586400 - RNA, 15 nt, Pseudomonas putida KT2440
gccauagccaguagc

SEQ ID NO: 1586401 - RNA, 17 nt, Pseudomonas putida KT2440
gccauagcccucggcaa

SEQ ID NO: 1586402 - RNA, 14 nt, Pseudomonas putida KT2440
gccauagcguuguc

SEQ ID NO: 1586403 - RNA, 20 nt, Pseudomonas putida KT2440
gccagucccuccugugcccg

SEQ ID NO: 1586404 - RNA, 14 nt, Pseudomonas putida KT2440
gccaucggcacgcc

SEQ ID NO: 1586405 - RNA, 22 nt, Pseudomonas putida KT2440
gccaucuggcguugcgaaggcg

SEQ ID NO: 1586406 - RNA, 20 nt, Pseudomonas putida KT2440
gccaucugguugcuggcgcc

SEQ ID NO: 1586407 - RNA, 20 nt, Pseudomonas putida KT2440
gccaucuucacggcaagccu

SEQ ID NO: 1586408 - RNA, 21 nt, Pseudomonas putida KT2440
gccaucgccucggcacugcac

SEQ ID NO: 1586409 - RNA, 19 nt, Pseudomonas putida KT2440
gccaucgcgcaggucgaca

SEQ ID NO: 1586410 - RNA, 23 nt, Pseudomonas putida KT2440
gccauccaccugugaggccuuca

SEQ ID NO: 1586411 - RNA, 16 nt, Pseudomonas putida KT2440
gccgacaaacguacca

SEQ ID NO: 1586412 - RNA, 21 nt, Pseudomonas putida KT2440
gccgacaaacguaccagccgc

SEQ ID NO: 1586413 - RNA, 19 nt, Pseudomonas putida KT2440
gccgacaacagcaugcuca

SEQ ID NO: 1586414 - RNA, 18 nt, Pseudomonas putida KT2440
gccgacaaaaacaacaau

SEQ ID NO: 1586415 - RNA, 12 nt, Pseudomonas putida KT2440
gccgacagcggc

SEQ ID NO: 1586416 - RNA, 13 nt, Pseudomonas putida KT2440
gccgacagccuca

SEQ ID NO: 1586417 - RNA, 19 nt, Pseudomonas putida KT2440
gcccuagaacaggcggcug

SEQ ID NO: 1586418 - RNA, 19 nt, Pseudomonas putida KT2440
gcccucaagggauuggcaa

SEQ ID NO: 1586419 - RNA, 12 nt, Pseudomonas putida KT2440
gcccucaagggc

SEQ ID NO: 1586420 - RNA, 19 nt, Pseudomonas putida KT2440
gcccucaagggcgcugauc

SEQ ID NO: 1586421 - RNA, 20 nt, Pseudomonas putida KT2440
gcccuauggggugagcggcu

SEQ ID NO: 1586422 - RNA, 21 nt, Pseudomonas putida KT2440
gcccuauggggugagcggcuu

SEQ ID NO: 1586423 - RNA, 20 nt, Pseudomonas putida KT2440
gcccuaucgcgacgcaaggc

SEQ ID NO: 1586424 - RNA, 18 nt, Pseudomonas putida KT2440
gcccucacucaccgcaca

SEQ ID NO: 1586425 - RNA, 14 nt, Pseudomonas putida KT2440
gccgaccgcgcgca

SEQ ID NO: 1586426 - RNA, 16 nt, Pseudomonas putida KT2440
gccgaccgcgcgcacg

SEQ ID NO: 1586427 - RNA, 13 nt, Pseudomonas putida KT2440
gccgagccaaccg

SEQ ID NO: 1586428 - RNA, 19 nt, Pseudomonas putida KT2440
gccgagccaagcgacgugc

SEQ ID NO: 1586429 - RNA, 18 nt, Pseudomonas putida KT2440
gccgagcauuacaggcag

SEQ ID NO: 1586430 - RNA, 19 nt, Pseudomonas putida KT2440
gccgagcauccgcgccacu

SEQ ID NO: 1586431 - RNA, 21 nt, Pseudomonas putida KT2440
gccgagcaucuuccagccugc

SEQ ID NO: 1586432 - RNA, 23 nt, Pseudomonas putida KT2440
gccgagcgcggcgcccagcaaca

SEQ ID NO: 1586433 - RNA, 20 nt, Pseudomonas putida KT2440
gccgagggcaugggccacuu

SEQ ID NO: 1586434 - RNA, 15 nt, Pseudomonas putida KT2440
gccgaggaauugcgc

SEQ ID NO: 1586435 - RNA, 19 nt, Pseudomonas putida KT2440
gccgaggaauugcgccagg

SEQ ID NO: 1586436 - RNA, 15 nt, Pseudomonas putida KT2440
gccgagugcgcggaa

SEQ ID NO: 1586437 - RNA, 14 nt, Pseudomonas putida KT2440
gccgagugccaaca

SEQ ID NO: 1586438 - RNA, 20 nt, Pseudomonas putida KT2440
gccgauaccgcccacuucug

SEQ ID NO: 1586439 - RNA, 12 nt, Pseudomonas putida KT2440
gccgaucagcga

SEQ ID NO: 1586440 - RNA, 14 nt, Pseudomonas putida KT2440
gccgaucagcgagu

SEQ ID NO: 1586441 - RNA, 15 nt, Pseudomonas putida KT2440
gccgcacccaggcca

SEQ ID NO: 1586442 - RNA, 16 nt, Pseudomonas putida KT2440
gccgcacccaggccac

SEQ ID NO: 1586443 - RNA, 22 nt, Pseudomonas putida KT2440
gccgcacguuauccacagcguu

SEQ ID NO: 1586444 - RNA, 17 nt, Pseudomonas putida KT2440
gccgauguuggucacca

SEQ ID NO: 1586445 - RNA, 13 nt, Pseudomonas putida KT2440
gccgaugccaagc

SEQ ID NO: 1586446 - RNA, 14 nt, Pseudomonas putida KT2440
gccgaugccaagca

SEQ ID NO: 1586447 - RNA, 16 nt, Pseudomonas putida KT2440
gccgaugccagguaca

SEQ ID NO: 1586448 - RNA, 14 nt, Pseudomonas putida KT2440
gccgaugcccaccu

SEQ ID NO: 1586449 - RNA, 19 nt, Pseudomonas putida KT2440
gccgcaaagcggccccagu

SEQ ID NO: 1586450 - RNA, 22 nt, Pseudomonas putida KT2440
gccgcaaccugggcaaccacau

SEQ ID NO: 1586451 - RNA, 16 nt, Pseudomonas putida KT2440
gccgcaaccgggucgg

SEQ ID NO: 1586452 - RNA, 20 nt, Pseudomonas putida KT2440
gccgcaaccgggucggcgcc

SEQ ID NO: 1586453 - RNA, 22 nt, Pseudomonas putida KT2440
gccgauuuggcccgcugcgccg

SEQ ID NO: 1586454 - RNA, 21 nt, Pseudomonas putida KT2440
gccgccgucagguucaagccu

SEQ ID NO: 1586455 - RNA, 20 nt, Pseudomonas putida KT2440
gccgccgguuucucgcagca

SEQ ID NO: 1586456 - RNA, 18 nt, Pseudomonas putida KT2440
gccgccguggugccgguu

SEQ ID NO: 1586457 - RNA, 20 nt, Pseudomonas putida KT2440
gccgcgacuggaacgauacc

SEQ ID NO: 1586458 - RNA, 19 nt, Pseudomonas putida KT2440
gccgccuccaccgggaugg

SEQ ID NO: 1586459 - RNA, 20 nt, Pseudomonas putida KT2440
gccgccuccaccgggauggc

SEQ ID NO: 1586460 - RNA, 18 nt, Pseudomonas putida KT2440
gccgccggcaacuggcau

SEQ ID NO: 1586461 - RNA, 14 nt, Pseudomonas putida KT2440
gccgcccuuucgcg

SEQ ID NO: 1586462 - RNA, 18 nt, Pseudomonas putida KT2440
gccgcccuuucgcgggug

SEQ ID NO: 1586463 - RNA, 19 nt, Pseudomonas putida KT2440
gccgcccuuucgcggguga

SEQ ID NO: 1586464 - RNA, 13 nt, Pseudomonas putida KT2440
gccgccgcagcaa

SEQ ID NO: 1586465 - RNA, 15 nt, Pseudomonas putida KT2440
gccgccgaugcgcuu

SEQ ID NO: 1586466 - RNA, 13 nt, Pseudomonas putida KT2440
gccgccgccucga

SEQ ID NO: 1586467 - RNA, 13 nt, Pseudomonas putida KT2440
gccgccgccagaa

SEQ ID NO: 1586468 - RNA, 23 nt, Pseudomonas putida KT2440
gccgcccuuggugcaccagcuug

SEQ ID NO: 1586469 - RNA, 22 nt, Pseudomonas putida KT2440
gccgcccuugagcuucagcgcg

SEQ ID NO: 1586470 - RNA, 15 nt, Pseudomonas putida KT2440
gccgcccugcggcug

SEQ ID NO: 1586471 - RNA, 23 nt, Pseudomonas putida KT2440
gccgcccucuugcugcaacagcu

SEQ ID NO: 1586472 - RNA, 15 nt, Pseudomonas putida KT2440
gccgcccgcggcgaa

SEQ ID NO: 1586473 - RNA, 17 nt, Pseudomonas putida KT2440
gccgcccgcggcgaaca

SEQ ID NO: 1586474 - RNA, 21 nt, Pseudomonas putida KT2440
gccgccaggcccaccaccggu

SEQ ID NO: 1586475 - RNA, 14 nt, Pseudomonas putida KT2440
gccgccaggcagca

SEQ ID NO: 1586476 - RNA, 15 nt, Pseudomonas putida KT2440
gccgccaggcagcag

SEQ ID NO: 1586477 - RNA, 13 nt, Pseudomonas putida KT2440
gccgccaggcggu

SEQ ID NO: 1586478 - RNA, 13 nt, Pseudomonas putida KT2440
gccgccagggcaa

SEQ ID NO: 1586479 - RNA, 16 nt, Pseudomonas putida KT2440
gccgccaguucgcccu

SEQ ID NO: 1586480 - RNA, 19 nt, Pseudomonas putida KT2440
gccgccaguucgcccuuca

SEQ ID NO: 1586481 - RNA, 15 nt, Pseudomonas putida KT2440
gccgccagaccaccu

SEQ ID NO: 1586482 - RNA, 13 nt, Pseudomonas putida KT2440
gccgccagcagcg

SEQ ID NO: 1586483 - RNA, 23 nt, Pseudomonas putida KT2440
gccgccacuaccguauucgcggg

SEQ ID NO: 1586484 - RNA, 12 nt, Pseudomonas putida KT2440
gccgccaccucg

SEQ ID NO: 1586485 - RNA, 15 nt, Pseudomonas putida KT2440
gccgccaccucgcua

SEQ ID NO: 1586486 - RNA, 20 nt, Pseudomonas putida KT2440
gccgccaccugcggcaggug

SEQ ID NO: 1586487 - RNA, 14 nt, Pseudomonas putida KT2440
gccgcccaucaccg

SEQ ID NO: 1586488 - RNA, 12 nt, Pseudomonas putida KT2440
gccgcccaauac

SEQ ID NO: 1586489 - RNA, 15 nt, Pseudomonas putida KT2440
gccgccauugaugcc

SEQ ID NO: 1586490 - RNA, 18 nt, Pseudomonas putida KT2440
gccgccccacucgcgcag

SEQ ID NO: 1586491 - RNA, 20 nt, Pseudomonas putida KT2440
gccgccccacucgcgcagca

SEQ ID NO: 1586492 - RNA, 14 nt, Pseudomonas putida KT2440
gccgcccgccucga

SEQ ID NO: 1586493 - RNA, 17 nt, Pseudomonas putida KT2440
gccgccaacucgccauu

SEQ ID NO: 1586494 - RNA, 20 nt, Pseudomonas putida KT2440
gccgccacauccagcgccuc

SEQ ID NO: 1586495 - RNA, 13 nt, Pseudomonas putida KT2440
gccgccaacagcg

SEQ ID NO: 1586496 - RNA, 16 nt, Pseudomonas putida KT2440
gccgccaacagcgcag

SEQ ID NO: 1586497 - RNA, 21 nt, Pseudomonas putida KT2440
gccgcauuggccgggucgacc

SEQ ID NO: 1586498 - RNA, 19 nt, Pseudomonas putida KT2440
gccgcaucguuauccagca

SEQ ID NO: 1586499 - RNA, 20 nt, Pseudomonas putida KT2440
gccgcaucguuauccagcac

SEQ ID NO: 1586500 - RNA, 12 nt, Pseudomonas putida KT2440
gccgcagcugcg

SEQ ID NO: 1586501 - RNA, 18 nt, Pseudomonas putida KT2440
gccgcagcuggcgcaaau

SEQ ID NO: 1586502 - RNA, 14 nt, Pseudomonas putida KT2440
gccgcauccagcac

SEQ ID NO: 1586503 - RNA, 22 nt, Pseudomonas putida KT2440
gccggcgcugggcuuacggucu

SEQ ID NO: 1586504 - RNA, 20 nt, Pseudomonas putida KT2440
gccggcgcugagcgacagca

SEQ ID NO: 1586505 - RNA, 19 nt, Pseudomonas putida KT2440
gccggcgcucagcgggcgu

SEQ ID NO: 1586506 - RNA, 23 nt, Pseudomonas putida KT2440
gccggcgucgaucugcagguggu

SEQ ID NO: 1586507 - RNA, 21 nt, Pseudomonas putida KT2440
gccggcguuggcuuccacggc

SEQ ID NO: 1586508 - RNA, 12 nt, Pseudomonas putida KT2440
gccggcguuggc

SEQ ID NO: 1586509 - RNA, 17 nt, Pseudomonas putida KT2440
gccggcgucggcgcgca

SEQ ID NO: 1586510 - RNA, 18 nt, Pseudomonas putida KT2440
gccggcgucggcgcgcaa

SEQ ID NO: 1586511 - RNA, 23 nt, Pseudomonas putida KT2440
gccggcgucggcgcgcaacagca

SEQ ID NO: 1586512 - RNA, 20 nt, Pseudomonas putida KT2440
gccggcuuccagcgauggcg

SEQ ID NO: 1586513 - RNA, 13 nt, Pseudomonas putida KT2440
gccggcugugcag

SEQ ID NO: 1586514 - RNA, 14 nt, Pseudomonas putida KT2440
gccggcuucacuag

SEQ ID NO: 1586515 - RNA, 15 nt, Pseudomonas putida KT2440
gccggcuggacaccu

SEQ ID NO: 1586516 - RNA, 18 nt, Pseudomonas putida KT2440
gccggcugaugaacuucc

SEQ ID NO: 1586517 - RNA, 12 nt, Pseudomonas putida KT2440
gccggcucgaac

SEQ ID NO: 1586518 - RNA, 14 nt, Pseudomonas putida KT2440
gccggcuaucggcc

SEQ ID NO: 1586519 - RNA, 18 nt, Pseudomonas putida KT2440
gccggccucuucgcgggu

SEQ ID NO: 1586520 - RNA, 15 nt, Pseudomonas putida KT2440
gccggccuguugcgc

SEQ ID NO: 1586521 - RNA, 16 nt, Pseudomonas putida KT2440
gccggccuguugcgca

SEQ ID NO: 1586522 - RNA, 22 nt, Pseudomonas putida KT2440
gccggcccugccuaccaccgca

SEQ ID NO: 1586523 - RNA, 14 nt, Pseudomonas putida KT2440
gccggccccggcaa

SEQ ID NO: 1586524 - RNA, 23 nt, Pseudomonas putida KT2440
gccggccuuggcgcggcggauaa

SEQ ID NO: 1586525 - RNA, 21 nt, Pseudomonas putida KT2440
gccggcgaacagcacugccag

SEQ ID NO: 1586526 - RNA, 22 nt, Pseudomonas putida KT2440
gccggcgcacgcaugcgcgaca

SEQ ID NO: 1586527 - RNA, 15 nt, Pseudomonas putida KT2440
gccggcgcaggucga

SEQ ID NO: 1586528 - RNA, 16 nt, Pseudomonas putida KT2440
gccgcguugucaggca

SEQ ID NO: 1586529 - RNA, 17 nt, Pseudomonas putida KT2440
gccgcggcuccagguga

SEQ ID NO: 1586530 - RNA, 15 nt, Pseudomonas putida KT2440
gccgcucccacaggu

SEQ ID NO: 1586531 - RNA, 16 nt, Pseudomonas putida KT2440
gccgcucccacaggua

SEQ ID NO: 1586532 - RNA, 17 nt, Pseudomonas putida KT2440
gccgcuccuucaccagg

SEQ ID NO: 1586533 - RNA, 19 nt, Pseudomonas putida KT2440
gccgcucgauaugccgccg

SEQ ID NO: 1586534 - RNA, 17 nt, Pseudomonas putida KT2440
gccgcucgcccagcagc

SEQ ID NO: 1586535 - RNA, 17 nt, Pseudomonas putida KT2440
gccggccaaggucagca

SEQ ID NO: 1586536 - RNA, 22 nt, Pseudomonas putida KT2440
gccggccaaggucagcaagccg

SEQ ID NO: 1586537 - RNA, 23 nt, Pseudomonas putida KT2440
gccggcaggcccggcccuuucgc

SEQ ID NO: 1586538 - RNA, 16 nt, Pseudomonas putida KT2440
gccggcagucacccac

SEQ ID NO: 1586539 - RNA, 20 nt, Pseudomonas putida KT2440
gccggcagucacccaccggc

SEQ ID NO: 1586540 - RNA, 21 nt, Pseudomonas putida KT2440
gccggauagagcccggcgcag

SEQ ID NO: 1586541 - RNA, 22 nt, Pseudomonas putida KT2440
gccggauuucuuccauggccug

SEQ ID NO: 1586542 - RNA, 14 nt, Pseudomonas putida KT2440
gccggcagcucgcg

SEQ ID NO: 1586543 - RNA, 22 nt, Pseudomonas putida KT2440
gccggcagcucgcgcugcgcag

SEQ ID NO: 1586544 - RNA, 15 nt, Pseudomonas putida KT2440
gccgcuucggcaugc

SEQ ID NO: 1586545 - RNA, 20 nt, Pseudomonas putida KT2440
gccgcuucggcaugcacggc

SEQ ID NO: 1586546 - RNA, 23 nt, Pseudomonas putida KT2440
gccgcuuucggucagggcgauga

SEQ ID NO: 1586547 - RNA, 18 nt, Pseudomonas putida KT2440
gccgcuuuggcagcagcc

SEQ ID NO: 1586548 - RNA, 19 nt, Pseudomonas putida KT2440
gccgcuuuguuugcuggca

SEQ ID NO: 1586549 - RNA, 15 nt, Pseudomonas putida KT2440
gccgcuucguccagg

SEQ ID NO: 1586550 - RNA, 19 nt, Pseudomonas putida KT2440
gccgcuucguccagguagu

SEQ ID NO: 1586551 - RNA, 13 nt, Pseudomonas putida KT2440
gccgcuucgcgga

SEQ ID NO: 1586552 - RNA, 15 nt, Pseudomonas putida KT2440
gccgcuucgcggcca

SEQ ID NO: 1586553 - RNA, 15 nt, Pseudomonas putida KT2440
gccgcugcgccugcc

SEQ ID NO: 1586554 - RNA, 21 nt, Pseudomonas putida KT2440
gccgcuguugaucagguuacu

SEQ ID NO: 1586555 - RNA, 12 nt, Pseudomonas putida KT2440
gccgcugcggcu

SEQ ID NO: 1586556 - RNA, 13 nt, Pseudomonas putida KT2440
gccgcugcgcggu

SEQ ID NO: 1586557 - RNA, 17 nt, Pseudomonas putida KT2440
gccgcugcgcgguaaac

SEQ ID NO: 1586558 - RNA, 18 nt, Pseudomonas putida KT2440
gccggaacguuuccagca

SEQ ID NO: 1586559 - RNA, 22 nt, Pseudomonas putida KT2440
gcaugaacgcagcuuccgccac

SEQ ID NO: 1586560 - RNA, 14 nt, Pseudomonas putida KT2440
gcaugaacagcgcu

SEQ ID NO: 1586561 - RNA, 16 nt, Pseudomonas putida KT2440
gcaucugccgggucgg

SEQ ID NO: 1586562 - RNA, 22 nt, Pseudomonas putida KT2440
gcaucucgcacuugaucuugcg

SEQ ID NO: 1586563 - RNA, 15 nt, Pseudomonas putida KT2440
gcaucugcaccagga

SEQ ID NO: 1586564 - RNA, 16 nt, Pseudomonas putida KT2440
gcaucugcaccggcag

SEQ ID NO: 1586565 - RNA, 21 nt, Pseudomonas putida KT2440
gcaucgcuguccuuggccaac

SEQ ID NO: 1586566 - RNA, 20 nt, Pseudomonas putida KT2440
gcaucggccacuucgcggaa

SEQ ID NO: 1586567 - RNA, 15 nt, Pseudomonas putida KT2440
gcaucggcgugcugc

SEQ ID NO: 1586568 - RNA, 17 nt, Pseudomonas putida KT2440
gcaucggcucgcagaua

SEQ ID NO: 1586569 - RNA, 12 nt, Pseudomonas putida KT2440
gcaugcggccgu

SEQ ID NO: 1586570 - RNA, 19 nt, Pseudomonas putida KT2440
gcaugcggcauagcgugcu

SEQ ID NO: 1586571 - RNA, 13 nt, Pseudomonas putida KT2440
gcaugcgcgccau

SEQ ID NO: 1586572 - RNA, 20 nt, Pseudomonas putida KT2440
gcaugcgcgccauggccucg

SEQ ID NO: 1586573 - RNA, 17 nt, Pseudomonas putida KT2440
gcaugcucgcgggccug

SEQ ID NO: 1586574 - RNA, 22 nt, Pseudomonas putida KT2440
gcaugcucgcgggccuggagca

SEQ ID NO: 1586575 - RNA, 21 nt, Pseudomonas putida KT2440
gcaugcucaucgcggccgaag

SEQ ID NO: 1586576 - RNA, 14 nt, Pseudomonas putida KT2440
gcaugcgcgacagc

SEQ ID NO: 1586577 - RNA, 23 nt, Pseudomonas putida KT2440
gcaugcgcacggucuccggcgaa

SEQ ID NO: 1586578 - RNA, 18 nt, Pseudomonas putida KT2440
gcaugccuuccugcaccu

SEQ ID NO: 1586579 - RNA, 15 nt, Pseudomonas putida KT2440
gcauggccuggucga

SEQ ID NO: 1586580 - RNA, 17 nt, Pseudomonas putida KT2440
gcauggccaguuccugg

SEQ ID NO: 1586581 - RNA, 18 nt, Pseudomonas putida KT2440
gcauggcccaugaucgcg

SEQ ID NO: 1586582 - RNA, 13 nt, Pseudomonas putida KT2440
gcauggccgaggu

SEQ ID NO: 1586583 - RNA, 12 nt, Pseudomonas putida KT2440
gcauggcaaaca

SEQ ID NO: 1586584 - RNA, 19 nt, Pseudomonas putida KT2440
gcauggcaaacagcaccag

SEQ ID NO: 1586585 - RNA, 20 nt, Pseudomonas putida KT2440
gcauggcaaacagcaccagc

SEQ ID NO: 1586586 - RNA, 18 nt, Pseudomonas putida KT2440
gcauggcaaccaugucga

SEQ ID NO: 1586587 - RNA, 15 nt, Pseudomonas putida KT2440
gcaugcccagcgcca

SEQ ID NO: 1586588 - RNA, 19 nt, Pseudomonas putida KT2440
gcaugcaggucgaccugcc

SEQ ID NO: 1586589 - RNA, 22 nt, Pseudomonas putida KT2440
gcaugccaguagaagcccagau

SEQ ID NO: 1586590 - RNA, 14 nt, Pseudomonas putida KT2440
gcaugccagcagcu

SEQ ID NO: 1586591 - RNA, 15 nt, Pseudomonas putida KT2440
gcaugcccgcuccca

SEQ ID NO: 1586592 - RNA, 20 nt, Pseudomonas putida KT2440
gcaugcccgcucccacaggg

SEQ ID NO: 1586593 - RNA, 17 nt, Pseudomonas putida KT2440
gcaugcccgccccugcc

SEQ ID NO: 1586594 - RNA, 20 nt, Pseudomonas putida KT2440
gcaugcccgccccugccagc

SEQ ID NO: 1586595 - RNA, 21 nt, Pseudomonas putida KT2440
gcaugcccgcgcaaaucgccg

SEQ ID NO: 1586596 - RNA, 22 nt, Pseudomonas putida KT2440
gcaugcccgcgcaaaucgccgc

SEQ ID NO: 1586597 - RNA, 21 nt, Pseudomonas putida KT2440
gcaugaucaccgccagcggca

SEQ ID NO: 1586598 - RNA, 23 nt, Pseudomonas putida KT2440
gcaugcacggcagcaaucgccgc

SEQ ID NO: 1586599 - RNA, 13 nt, Pseudomonas putida KT2440
gcaugcaacggca

SEQ ID NO: 1586600 - RNA, 15 nt, Pseudomonas putida KT2440
gcaugaucgcgcuug

SEQ ID NO: 1586601 - RNA, 19 nt, Pseudomonas putida KT2440
gcaugaucuugggcuucau

SEQ ID NO: 1586602 - RNA, 18 nt, Pseudomonas putida KT2440
gcauggcucaacuggcag

SEQ ID NO: 1586603 - RNA, 19 nt, Pseudomonas putida KT2440
gcaugugcacuggcaggcc

SEQ ID NO: 1586604 - RNA, 20 nt, Pseudomonas putida KT2440
gcaugugcacuggcaggccu

SEQ ID NO: 1586605 - RNA, 18 nt, Pseudomonas putida KT2440
gcauguucaucaccggcc

SEQ ID NO: 1586606 - RNA, 17 nt, Pseudomonas putida KT2440
gcauguagccacgcugc

SEQ ID NO: 1586607 - RNA, 18 nt, Pseudomonas putida KT2440
gcauguacucuucgacgg

SEQ ID NO: 1586608 - RNA, 16 nt, Pseudomonas putida KT2440
gcauugcucacugacc

SEQ ID NO: 1586609 - RNA, 19 nt, Pseudomonas putida KT2440
gcauugcucacugaccacc

SEQ ID NO: 1586610 - RNA, 13 nt, Pseudomonas putida KT2440
gcauugcggccgu

SEQ ID NO: 1586611 - RNA, 18 nt, Pseudomonas putida KT2440
gcauugcccgcgauagca

SEQ ID NO: 1586612 - RNA, 21 nt, Pseudomonas putida KT2440
gcauucgcauuaccagcacca

SEQ ID NO: 1586613 - RNA, 22 nt, Pseudomonas putida KT2440
gcauucggugugcucggcgaug

SEQ ID NO: 1586614 - RNA, 18 nt, Pseudomonas putida KT2440
gcauucccggcgccaugc

SEQ ID NO: 1586615 - RNA, 12 nt, Pseudomonas putida KT2440
gcauuacaggca

SEQ ID NO: 1586616 - RNA, 22 nt, Pseudomonas putida KT2440
gcauuacuucuuggagcggccu

SEQ ID NO: 1586617 - RNA, 17 nt, Pseudomonas putida KT2440
gcauuacgcggcagcag

SEQ ID NO: 1586618 - RNA, 18 nt, Pseudomonas putida KT2440
gccaacgccccaggccgc

SEQ ID NO: 1586619 - RNA, 22 nt, Pseudomonas putida KT2440
gccaacgcaccgaccacgguac

SEQ ID NO: 1586620 - RNA, 19 nt, Pseudomonas putida KT2440
gccaacgauuggcaguccu

SEQ ID NO: 1586621 - RNA, 21 nt, Pseudomonas putida KT2440
gccaaccgcuucaccgcgcac

SEQ ID NO: 1586622 - RNA, 16 nt, Pseudomonas putida KT2440
gccaaccgagucaaca

SEQ ID NO: 1586623 - RNA, 18 nt, Pseudomonas putida KT2440
gccaaccccuccagcaca

SEQ ID NO: 1586624 - RNA, 19 nt, Pseudomonas putida KT2440
gccaaccacgccugcgccg

SEQ ID NO: 1586625 - RNA, 22 nt, Pseudomonas putida KT2440
gccaaccccgcagacagcucga

SEQ ID NO: 1586626 - RNA, 18 nt, Pseudomonas putida KT2440
gccaacagcaguugcugc

SEQ ID NO: 1586627 - RNA, 12 nt, Pseudomonas putida KT2440
gccaacagcgca

SEQ ID NO: 1586628 - RNA, 14 nt, Pseudomonas putida KT2440
gccaacaggcagca

SEQ ID NO: 1586629 - RNA, 15 nt, Pseudomonas putida KT2440
gccaaaguccggcga

SEQ ID NO: 1586630 - RNA, 13 nt, Pseudomonas putida KT2440
gccaaacugcugg

SEQ ID NO: 1586631 - RNA, 13 nt, Pseudomonas putida KT2440
gccaaagcgagca

SEQ ID NO: 1586632 - RNA, 20 nt, Pseudomonas putida KT2440
gccaaaccauggcgucaggc

SEQ ID NO: 1586633 - RNA, 19 nt, Pseudomonas putida KT2440
gccaaacaaaaaagccgcu

SEQ ID NO: 1586634 - RNA, 20 nt, Pseudomonas putida KT2440
gccaaacaaaaaagccgcuc

SEQ ID NO: 1586635 - RNA, 17 nt, Pseudomonas putida KT2440
gccaaacaggccgaucu

SEQ ID NO: 1586636 - RNA, 18 nt, Pseudomonas putida KT2440
gcauuggcguugagccgc

SEQ ID NO: 1586637 - RNA, 16 nt, Pseudomonas putida KT2440
gcauuggagcguugca

SEQ ID NO: 1586638 - RNA, 13 nt, Pseudomonas putida KT2440
gcauuggcgcgcu

SEQ ID NO: 1586639 - RNA, 21 nt, Pseudomonas putida KT2440
gcauuggcggcaggcgcagcu

SEQ ID NO: 1586640 - RNA, 14 nt, Pseudomonas putida KT2440
gcaguucgucgacc

SEQ ID NO: 1586641 - RNA, 15 nt, Pseudomonas putida KT2440
gcaguucgucgaccg

SEQ ID NO: 1586642 - RNA, 20 nt, Pseudomonas putida KT2440
gcagugccugugagaucgag

SEQ ID NO: 1586643 - RNA, 22 nt, Pseudomonas putida KT2440
gcagguucgaccaccgcaggug

SEQ ID NO: 1586644 - RNA, 18 nt, Pseudomonas putida KT2440
gcagguucgaccacugca

SEQ ID NO: 1586645 - RNA, 14 nt, Pseudomonas putida KT2440
gcagguugaacagc

SEQ ID NO: 1586646 - RNA, 15 nt, Pseudomonas putida KT2440
gcagguugaacagca

SEQ ID NO: 1586647 - RNA, 21 nt, Pseudomonas putida KT2440
gcagugcacccaucggcgcga

SEQ ID NO: 1586648 - RNA, 22 nt, Pseudomonas putida KT2440
gcagugcacccaucggcgcgaa

SEQ ID NO: 1586649 - RNA, 23 nt, Pseudomonas putida KT2440
gcagugcacccaucggcgcgaag

SEQ ID NO: 1586650 - RNA, 13 nt, Pseudomonas putida KT2440
gcagugcacccgc

SEQ ID NO: 1586651 - RNA, 16 nt, Pseudomonas putida KT2440
gcagguucugaaucug

SEQ ID NO: 1586652 - RNA, 21 nt, Pseudomonas putida KT2440
gcagguucugaaucuggcucu

SEQ ID NO: 1586653 - RNA, 18 nt, Pseudomonas putida KT2440
gcagugccagcaacaagc

SEQ ID NO: 1586654 - RNA, 15 nt, Pseudomonas putida KT2440
gcagugccaucgccu

SEQ ID NO: 1586655 - RNA, 21 nt, Pseudomonas putida KT2440
gcagugcccccgucagcggca

SEQ ID NO: 1586656 - RNA, 23 nt, Pseudomonas putida KT2440
gcaggugaaaaugcuggucgaac

SEQ ID NO: 1586657 - RNA, 15 nt, Pseudomonas putida KT2440
gcagguucaacggcg

SEQ ID NO: 1586658 - RNA, 21 nt, Pseudomonas putida KT2440
gcaggugcgcacgcugcccag

SEQ ID NO: 1586659 - RNA, 20 nt, Pseudomonas putida KT2440
gcauagcccguauucgcggg

SEQ ID NO: 1586660 - RNA, 20 nt, Pseudomonas putida KT2440
gcauagauggcugucugcag

SEQ ID NO: 1586661 - RNA, 16 nt, Pseudomonas putida KT2440
gcauacuugggcgcag

SEQ ID NO: 1586662 - RNA, 20 nt, Pseudomonas putida KT2440
gcauaaaaaaaccggccacg

SEQ ID NO: 1586663 - RNA, 21 nt, Pseudomonas putida KT2440
gcaguucuuccagcggcaagg

SEQ ID NO: 1586664 - RNA, 17 nt, Pseudomonas putida KT2440
gcagugcuuguggccau

SEQ ID NO: 1586665 - RNA, 18 nt, Pseudomonas putida KT2440
gcaguucgcggucgccgu

SEQ ID NO: 1586666 - RNA, 14 nt, Pseudomonas putida KT2440
gcaguucgcugcgc

SEQ ID NO: 1586667 - RNA, 13 nt, Pseudomonas putida KT2440
gcaguggccgagu

SEQ ID NO: 1586668 - RNA, 14 nt, Pseudomonas putida KT2440
gcagugcggcaacc

SEQ ID NO: 1586669 - RNA, 18 nt, Pseudomonas putida KT2440
gcaucgcgcacuugccag

SEQ ID NO: 1586670 - RNA, 21 nt, Pseudomonas putida KT2440
gcaucgaucccuggggccaag

SEQ ID NO: 1586671 - RNA, 19 nt, Pseudomonas putida KT2440
gcaucgccaacagaggccu

SEQ ID NO: 1586672 - RNA, 20 nt, Pseudomonas putida KT2440
gcaucgccacgggcgugacc

SEQ ID NO: 1586673 - RNA, 17 nt, Pseudomonas putida KT2440
gcaucaccggcagguga

SEQ ID NO: 1586674 - RNA, 16 nt, Pseudomonas putida KT2440
gcauccgccccaggug

SEQ ID NO: 1586675 - RNA, 15 nt, Pseudomonas putida KT2440
gcaucgacgaugccg

SEQ ID NO: 1586676 - RNA, 15 nt, Pseudomonas putida KT2440
gcaucgacaggucca

SEQ ID NO: 1586677 - RNA, 13 nt, Pseudomonas putida KT2440
gcaucaaucgcuc

SEQ ID NO: 1586678 - RNA, 15 nt, Pseudomonas putida KT2440
gcaucacgccgcgcu

SEQ ID NO: 1586679 - RNA, 12 nt, Pseudomonas putida KT2440
gcaucacgcugg

SEQ ID NO: 1586680 - RNA, 13 nt, Pseudomonas putida KT2440
gcaucacgcuggc

SEQ ID NO: 1586681 - RNA, 17 nt, Pseudomonas putida KT2440
gcaucacgucacagcca

SEQ ID NO: 1586682 - RNA, 14 nt, Pseudomonas putida KT2440
gcaggcgguuggcc

SEQ ID NO: 1586683 - RNA, 19 nt, Pseudomonas putida KT2440
gcaggcuaauggcgcgccu

SEQ ID NO: 1586684 - RNA, 22 nt, Pseudomonas putida KT2440
gcaggcucagggccgcagagcg

SEQ ID NO: 1586685 - RNA, 23 nt, Pseudomonas putida KT2440
gcaggcucaucuaccagcuugcc

SEQ ID NO: 1586686 - RNA, 22 nt, Pseudomonas putida KT2440
gcaggcucugaaugucagcgcu

SEQ ID NO: 1586687 - RNA, 20 nt, Pseudomonas putida KT2440
gcaggguucgccgucagccu

SEQ ID NO: 1586688 - RNA, 20 nt, Pseudomonas putida KT2440
gcagguaaacccgcgccugc

SEQ ID NO: 1586689 - RNA, 21 nt, Pseudomonas putida KT2440
gcagguaaacccgcgccugca

SEQ ID NO: 1586690 - RNA, 13 nt, Pseudomonas putida KT2440
gcagggcugcgcg

SEQ ID NO: 1586691 - RNA, 13 nt, Pseudomonas putida KT2440
gcagggcgccgau

SEQ ID NO: 1586692 - RNA, 20 nt, Pseudomonas putida KT2440
gcagguacucugucacccgc

SEQ ID NO: 1586693 - RNA, 16 nt, Pseudomonas putida KT2440
gcagguacugcaugug

SEQ ID NO: 1586694 - RNA, 18 nt, Pseudomonas putida KT2440
gcagguacagcagcugca

SEQ ID NO: 1586695 - RNA, 22 nt, Pseudomonas putida KT2440
gcagguacagcagcugcauugg

SEQ ID NO: 1586696 - RNA, 21 nt, Pseudomonas putida KT2440
gcagguaaugcgccgcaccaa

SEQ ID NO: 1586697 - RNA, 13 nt, Pseudomonas putida KT2440
gcagguacagcag

SEQ ID NO: 1586698 - RNA, 15 nt, Pseudomonas putida KT2440
gcagguaggcccagc

SEQ ID NO: 1586699 - RNA, 12 nt, Pseudomonas putida KT2440
gcaggucagcgu

SEQ ID NO: 1586700 - RNA, 19 nt, Pseudomonas putida KT2440
gcagguccaguucgcgcaa

SEQ ID NO: 1586701 - RNA, 12 nt, Pseudomonas putida KT2440
gcaggucgaccu

SEQ ID NO: 1586702 - RNA, 15 nt, Pseudomonas putida KT2440
gcaggucgaccugcc

SEQ ID NO: 1586703 - RNA, 17 nt, Pseudomonas putida KT2440
gcaggucgaccugccag

SEQ ID NO: 1586704 - RNA, 16 nt, Pseudomonas putida KT2440
gcaggccgccggggua

SEQ ID NO: 1586705 - RNA, 14 nt, Pseudomonas putida KT2440
gcaggccgcagccu

SEQ ID NO: 1586706 - RNA, 20 nt, Pseudomonas putida KT2440
gcaggcgcgacaugaucagc

SEQ ID NO: 1586707 - RNA, 18 nt, Pseudomonas putida KT2440
gcaggcgcgagccuugcc

SEQ ID NO: 1586708 - RNA, 13 nt, Pseudomonas putida KT2440
gcaggcgcaggug

SEQ ID NO: 1586709 - RNA, 15 nt, Pseudomonas putida KT2440
gcaggcgcaggugca

SEQ ID NO: 1586710 - RNA, 17 nt, Pseudomonas putida KT2440
gcaggcgcagggugugc

SEQ ID NO: 1586711 - RNA, 16 nt, Pseudomonas putida KT2440
gcaggcagcucgaugu

SEQ ID NO: 1586712 - RNA, 23 nt, Pseudomonas putida KT2440
gcaggcauacaggaccaggccga

SEQ ID NO: 1586713 - RNA, 13 nt, Pseudomonas putida KT2440
gcaggccaccggc

SEQ ID NO: 1586714 - RNA, 14 nt, Pseudomonas putida KT2440
gcaggccaccggca

SEQ ID NO: 1586715 - RNA, 20 nt, Pseudomonas putida KT2440
gcaggccaccggcagcaccu

SEQ ID NO: 1586716 - RNA, 12 nt, Pseudomonas putida KT2440
gcaggccaagga

SEQ ID NO: 1586717 - RNA, 16 nt, Pseudomonas putida KT2440
gcaggccaaggaacgu

SEQ ID NO: 1586718 - RNA, 14 nt, Pseudomonas putida KT2440
gcaggcaguaggcc

SEQ ID NO: 1586719 - RNA, 14 nt, Pseudomonas putida KT2440
gcaggccagcgcac

SEQ ID NO: 1586720 - RNA, 24 nt, Pseudomonas putida KT2440
gcagcgggcucgcccacacggcaa

SEQ ID NO: 1586721 - RNA, 11 nt, Pseudomonas putida KT2440
gcagcgggcac

SEQ ID NO: 1586722 - RNA, 15 nt, Pseudomonas putida KT2440
gcagcgggcacaggc

SEQ ID NO: 1586723 - RNA, 17 nt, Pseudomonas putida KT2440
gcagcgggcacaggccg

SEQ ID NO: 1586724 - RNA, 18 nt, Pseudomonas putida KT2440
gcagcgggcacaggccgc

SEQ ID NO: 1586725 - RNA, 20 nt, Pseudomonas putida KT2440
gcaggcagcacaugccacgc

SEQ ID NO: 1586726 - RNA, 19 nt, Pseudomonas putida KT2440
gcagcggcuuggccgcgaa

SEQ ID NO: 1586727 - RNA, 20 nt, Pseudomonas putida KT2440
gcagcgggauguuggucuug

SEQ ID NO: 1586728 - RNA, 21 nt, Pseudomonas putida KT2440
gcagcgggagucgaaccugcc

SEQ ID NO: 1586729 - RNA, 12 nt, Pseudomonas putida KT2440
gcagcgggucgc

SEQ ID NO: 1586730 - RNA, 21 nt, Pseudomonas putida KT2440
gcagcgggucgcacucggcaa

SEQ ID NO: 1586731 - RNA, 18 nt, Pseudomonas putida KT2440
gcagcgcgggcagaugag

SEQ ID NO: 1586732 - RNA, 18 nt, Pseudomonas putida KT2440
gcagcgcggcgaucaacg

SEQ ID NO: 1586733 - RNA, 11 nt, Pseudomonas putida KT2440
gcagcgcguca

SEQ ID NO: 1586734 - RNA, 20 nt, Pseudomonas putida KT2440
gcagcgccugugagaucgag

SEQ ID NO: 1586735 - RNA, 17 nt, Pseudomonas putida KT2440
gcagcgccugcagcgcg

SEQ ID NO: 1586736 - RNA, 21 nt, Pseudomonas putida KT2440
gcagcgccugcagcgcgucau

SEQ ID NO: 1586737 - RNA, 13 nt, Pseudomonas putida KT2440
gcagcgcaugguc

SEQ ID NO: 1586738 - RNA, 17 nt, Pseudomonas putida KT2440
gcagcgcauccaccucg

SEQ ID NO: 1586739 - RNA, 13 nt, Pseudomonas putida KT2440
gcagcgcacggcu

SEQ ID NO: 1586740 - RNA, 17 nt, Pseudomonas putida KT2440
gcagcgcaaucaccgcc

SEQ ID NO: 1586741 - RNA, 12 nt, Pseudomonas putida KT2440
gcagcgaccauc

SEQ ID NO: 1586742 - RNA, 15 nt, Pseudomonas putida KT2440
gcagcgaaugcagcu

SEQ ID NO: 1586743 - RNA, 12 nt, Pseudomonas putida KT2440
gcagccgauacg

SEQ ID NO: 1586744 - RNA, 15 nt, Pseudomonas putida KT2440
gcagcccuucgcagg

SEQ ID NO: 1586745 - RNA, 17 nt, Pseudomonas putida KT2440
gcagcccuucgccggca

SEQ ID NO: 1586746 - RNA, 13 nt, Pseudomonas putida KT2440
gcagcccggcaaa

SEQ ID NO: 1586747 - RNA, 13 nt, Pseudomonas putida KT2440
gcagcccauucgc

SEQ ID NO: 1586748 - RNA, 19 nt, Pseudomonas putida KT2440
gcagcccauucgcgggcaa

SEQ ID NO: 1586749 - RNA, 21 nt, Pseudomonas putida KT2440
gcagcccauucgcggguaaac

SEQ ID NO: 1586750 - RNA, 15 nt, Pseudomonas putida KT2440
gcagcccgcaggcua

SEQ ID NO: 1586751 - RNA, 13 nt, Pseudomonas putida KT2440
gcagccccgccaa

SEQ ID NO: 1586752 - RNA, 13 nt, Pseudomonas putida KT2440
gcagccccggcaa

SEQ ID NO: 1586753 - RNA, 18 nt, Pseudomonas putida KT2440
gcagccccagggcccuca

SEQ ID NO: 1586754 - RNA, 15 nt, Pseudomonas putida KT2440
gcagcccccccagca

SEQ ID NO: 1586755 - RNA, 21 nt, Pseudomonas putida KT2440
gcagccauucauccucggccu

SEQ ID NO: 1586756 - RNA, 17 nt, Pseudomonas putida KT2440
gcagcccaaacagcauc

SEQ ID NO: 1586757 - RNA, 18 nt, Pseudomonas putida KT2440
gcagcccaaacagcauca

SEQ ID NO: 1586758 - RNA, 18 nt, Pseudomonas putida KT2440
gcagcagcuugcagcgcc

SEQ ID NO: 1586759 - RNA, 22 nt, Pseudomonas putida KT2440
gcagcagcuugcagcgccgagc

SEQ ID NO: 1586760 - RNA, 21 nt, Pseudomonas putida KT2440
gcagcagcucccgagccagga

SEQ ID NO: 1586761 - RNA, 12 nt, Pseudomonas putida KT2440
gcagccggcacc

SEQ ID NO: 1586762 - RNA, 21 nt, Pseudomonas putida KT2440
gcagccgggccugauuggcau

SEQ ID NO: 1586763 - RNA, 22 nt, Pseudomonas putida KT2440
gcagccgggcgguugucgaccu

SEQ ID NO: 1586764 - RNA, 23 nt, Pseudomonas putida KT2440
gcagccgggcgguugucgaccug

SEQ ID NO: 1586765 - RNA, 15 nt, Pseudomonas putida KT2440
gcagccgcguccuug

SEQ ID NO: 1586766 - RNA, 18 nt, Pseudomonas putida KT2440
gcagccgcaccugcccgc

SEQ ID NO: 1586767 - RNA, 18 nt, Pseudomonas putida KT2440
gcagccgcacccaggcca

SEQ ID NO: 1586768 - RNA, 22 nt, Pseudomonas putida KT2440
gcagaccugugggagcgggcau

SEQ ID NO: 1586769 - RNA, 15 nt, Pseudomonas putida KT2440
gcagacgucgcaauu

SEQ ID NO: 1586770 - RNA, 21 nt, Pseudomonas putida KT2440
gcagacgucgcaauugaugca

SEQ ID NO: 1586771 - RNA, 19 nt, Pseudomonas putida KT2440
gcagacgucuuccaugccu

SEQ ID NO: 1586772 - RNA, 14 nt, Pseudomonas putida KT2440
gcagaacguacugg

SEQ ID NO: 1586773 - RNA, 19 nt, Pseudomonas putida KT2440
gcagaagcgcugacugcca

SEQ ID NO: 1586774 - RNA, 15 nt, Pseudomonas putida KT2440
gcagacacaggcgcu

SEQ ID NO: 1586775 - RNA, 16 nt, Pseudomonas putida KT2440
gcacuugcuugacagc

SEQ ID NO: 1586776 - RNA, 20 nt, Pseudomonas putida KT2440
gcagcagccccagcggcaac

SEQ ID NO: 1586777 - RNA, 13 nt, Pseudomonas putida KT2440
gcagcagcgcgau

SEQ ID NO: 1586778 - RNA, 14 nt, Pseudomonas putida KT2440
gcagcaagcuggca

SEQ ID NO: 1586779 - RNA, 14 nt, Pseudomonas putida KT2440
gcagcaaggucgcc

SEQ ID NO: 1586780 - RNA, 12 nt, Pseudomonas putida KT2440
gcagcaccugcc

SEQ ID NO: 1586781 - RNA, 14 nt, Pseudomonas putida KT2440
gcagcaccugccag

SEQ ID NO: 1586782 - RNA, 14 nt, Pseudomonas putida KT2440
gcagcacgaucagc

SEQ ID NO: 1586783 - RNA, 17 nt, Pseudomonas putida KT2440
gcagcacgaucagcgcg

SEQ ID NO: 1586784 - RNA, 21 nt, Pseudomonas putida KT2440
gcagcacgaucagcgcggcaa

SEQ ID NO: 1586785 - RNA, 18 nt, Pseudomonas putida KT2440
gcagauggcucaucgccg

SEQ ID NO: 1586786 - RNA, 15 nt, Pseudomonas putida KT2440
gcagcaacagguaca

SEQ ID NO: 1586787 - RNA, 14 nt, Pseudomonas putida KT2440
gcagauugcaucac

SEQ ID NO: 1586788 - RNA, 15 nt, Pseudomonas putida KT2440
gcagcaacgccuuca

SEQ ID NO: 1586789 - RNA, 22 nt, Pseudomonas putida KT2440
gcagcaacgccuucaggcgaag

SEQ ID NO: 1586790 - RNA, 16 nt, Pseudomonas putida KT2440
gcagcaacgccuuggc

SEQ ID NO: 1586791 - RNA, 19 nt, Pseudomonas putida KT2440
gcagcaaagguuugucgcc

SEQ ID NO: 1586792 - RNA, 12 nt, Pseudomonas putida KT2440
gcacuccagcga

SEQ ID NO: 1586793 - RNA, 21 nt, Pseudomonas putida KT2440
gcacuccagcgaguggccacg

SEQ ID NO: 1586794 - RNA, 17 nt, Pseudomonas putida KT2440
gcacuccccaucagcag

SEQ ID NO: 1586795 - RNA, 19 nt, Pseudomonas putida KT2440
gcacuacgccggccaaggu

SEQ ID NO: 1586796 - RNA, 16 nt, Pseudomonas putida KT2440
gcacggucuccggcga

SEQ ID NO: 1586797 - RNA, 20 nt, Pseudomonas putida KT2440
gcacgugggucgggaacagc

SEQ ID NO: 1586798 - RNA, 23 nt, Pseudomonas putida KT2440
gcacgugggucgggaacagcucu

SEQ ID NO: 1586799 - RNA, 16 nt, Pseudomonas putida KT2440
gcacugcacgcuucga

SEQ ID NO: 1586800 - RNA, 20 nt, Pseudomonas putida KT2440
gcacucugcugcucugccgc

SEQ ID NO: 1586801 - RNA, 20 nt, Pseudomonas putida KT2440
gcacuaccaggcccaacagc

SEQ ID NO: 1586802 - RNA, 17 nt, Pseudomonas putida KT2440
gcacugcccaagccauc

SEQ ID NO: 1586803 - RNA, 13 nt, Pseudomonas putida KT2440
gcacugccagcgc

SEQ ID NO: 1586804 - RNA, 19 nt, Pseudomonas putida KT2440
gcacugccgcauucgcggg

SEQ ID NO: 1586805 - RNA, 16 nt, Pseudomonas putida KT2440
gcacugcggcucaucg

SEQ ID NO: 1586806 - RNA, 19 nt, Pseudomonas putida KT2440
gcacugccugcacggcaaa

SEQ ID NO: 1586807 - RNA, 15 nt, Pseudomonas putida KT2440
gcacugcugccgccc

SEQ ID NO: 1586808 - RNA, 20 nt, Pseudomonas putida KT2440
gcacuggccucuucgcgggu

SEQ ID NO: 1586809 - RNA, 16 nt, Pseudomonas putida KT2440
gcacuggcaggccuug

SEQ ID NO: 1586810 - RNA, 13 nt, Pseudomonas putida KT2440
gcacuggccagcg

SEQ ID NO: 1586811 - RNA, 15 nt, Pseudomonas putida KT2440
gcacuucgauaccca

SEQ ID NO: 1586812 - RNA, 22 nt, Pseudomonas putida KT2440
gcacuucgauacccagccagcc

SEQ ID NO: 1586813 - RNA, 20 nt, Pseudomonas putida KT2440
gcacuuccaggaaggccucg

SEQ ID NO: 1586814 - RNA, 15 nt, Pseudomonas putida KT2440
gcacuguugcuggcg

SEQ ID NO: 1586815 - RNA, 22 nt, Pseudomonas putida KT2440
gcacuggcgcgaugcgguugca

SEQ ID NO: 1586816 - RNA, 20 nt, Pseudomonas putida KT2440
gcacuggcuacagaucagcc

SEQ ID NO: 1586817 - RNA, 15 nt, Pseudomonas putida KT2440
gcacgcccagcaacu

SEQ ID NO: 1586818 - RNA, 15 nt, Pseudomonas putida KT2440
gcacgcccgcuccca

SEQ ID NO: 1586819 - RNA, 20 nt, Pseudomonas putida KT2440
gcacgcccgcucccacagga

SEQ ID NO: 1586820 - RNA, 20 nt, Pseudomonas putida KT2440
gcacgcccgcucccacaggg

SEQ ID NO: 1586821 - RNA, 14 nt, Pseudomonas putida KT2440
gcacgcccggcacc

SEQ ID NO: 1586822 - RNA, 13 nt, Pseudomonas putida KT2440
gcacgcgccagca

SEQ ID NO: 1586823 - RNA, 23 nt, Pseudomonas putida KT2440
gcacgccugucuagccgccugcc

SEQ ID NO: 1586824 - RNA, 14 nt, Pseudomonas putida KT2440
gcacgcugcccagg

SEQ ID NO: 1586825 - RNA, 18 nt, Pseudomonas putida KT2440
gcacggcaaucaggcuga

SEQ ID NO: 1586826 - RNA, 20 nt, Pseudomonas putida KT2440
gcacggcaccagcaccagcu

SEQ ID NO: 1586827 - RNA, 18 nt, Pseudomonas putida KT2440
gcacggccaccauguacu

SEQ ID NO: 1586828 - RNA, 16 nt, Pseudomonas putida KT2440
gcacggccugcaucca

SEQ ID NO: 1586829 - RNA, 14 nt, Pseudomonas putida KT2440
gcaccgccaccaug

SEQ ID NO: 1586830 - RNA, 18 nt, Pseudomonas putida KT2440
gcaccgcggaugcgccug

SEQ ID NO: 1586831 - RNA, 24 nt, Pseudomonas putida KT2440
gcacccugaucgaugagcgagccc

SEQ ID NO: 1586832 - RNA, 15 nt, Pseudomonas putida KT2440
gcacccgugccugcc

SEQ ID NO: 1586833 - RNA, 15 nt, Pseudomonas putida KT2440
gcacccgugcagggc

SEQ ID NO: 1586834 - RNA, 17 nt, Pseudomonas putida KT2440
gcacccgugcagggcug

SEQ ID NO: 1586835 - RNA, 21 nt, Pseudomonas putida KT2440
gcacaccgcugguggcguggc

SEQ ID NO: 1586836 - RNA, 13 nt, Pseudomonas putida KT2440
gcacaccaugggc

SEQ ID NO: 1586837 - RNA, 21 nt, Pseudomonas putida KT2440
gcacgaagaucaccgacaaga

SEQ ID NO: 1586838 - RNA, 14 nt, Pseudomonas putida KT2440
gcacgaaggccagc

SEQ ID NO: 1586839 - RNA, 15 nt, Pseudomonas putida KT2440
gcaccuuguauucga

SEQ ID NO: 1586840 - RNA, 20 nt, Pseudomonas putida KT2440
gcaccuugugcacgaacaga

SEQ ID NO: 1586841 - RNA, 17 nt, Pseudomonas putida KT2440
gcaccuuguuacccgca

SEQ ID NO: 1586842 - RNA, 13 nt, Pseudomonas putida KT2440
gcaccuuggcguc

SEQ ID NO: 1586843 - RNA, 15 nt, Pseudomonas putida KT2440
gcaccugccagccgc

SEQ ID NO: 1586844 - RNA, 24 nt, Pseudomonas putida KT2440
gcaccugcccgcccucacucaccg

SEQ ID NO: 1586845 - RNA, 17 nt, Pseudomonas putida KT2440
gcaccugccgggcaucg

SEQ ID NO: 1586846 - RNA, 21 nt, Pseudomonas putida KT2440
gcaccugcagguacagcagcu

SEQ ID NO: 1586847 - RNA, 22 nt, Pseudomonas putida KT2440
gcaccugcagguacagcagcug

SEQ ID NO: 1586848 - RNA, 16 nt, Pseudomonas putida KT2440
gcaccgugcaccagca

SEQ ID NO: 1586849 - RNA, 19 nt, Pseudomonas putida KT2440
gcaccgugcaccagcacca

SEQ ID NO: 1586850 - RNA, 16 nt, Pseudomonas putida KT2440
gcaccggcgaacagca

SEQ ID NO: 1586851 - RNA, 13 nt, Pseudomonas putida KT2440
gcaccggccaggc

SEQ ID NO: 1586852 - RNA, 15 nt, Pseudomonas putida KT2440
gcaccggcagcagca

SEQ ID NO: 1586853 - RNA, 18 nt, Pseudomonas putida KT2440
gcaccggcagcagcaaug

SEQ ID NO: 1586854 - RNA, 22 nt, Pseudomonas putida KT2440
gcaccgcuucacccucgcgcag

SEQ ID NO: 1586855 - RNA, 18 nt, Pseudomonas putida KT2440
gcaccuccugcggcagau

SEQ ID NO: 1586856 - RNA, 17 nt, Pseudomonas putida KT2440
gcaccuaucgcugccgc

SEQ ID NO: 1586857 - RNA, 21 nt, Pseudomonas putida KT2440
gcaccucauagaucagcaucg

SEQ ID NO: 1586858 - RNA, 17 nt, Pseudomonas putida KT2440
gcaacggugaacggcgg

SEQ ID NO: 1586859 - RNA, 12 nt, Pseudomonas putida KT2440
gcaacgcgccau

SEQ ID NO: 1586860 - RNA, 20 nt, Pseudomonas putida KT2440
gcaacggacgucccagcagg

SEQ ID NO: 1586861 - RNA, 17 nt, Pseudomonas putida KT2440
gcaacggccacgcugcg

SEQ ID NO: 1586862 - RNA, 18 nt, Pseudomonas putida KT2440
gcaacggcacacgcacca

SEQ ID NO: 1586863 - RNA, 23 nt, Pseudomonas putida KT2440
gcaacgccgagcauuacaggcag

SEQ ID NO: 1586864 - RNA, 16 nt, Pseudomonas putida KT2440
gcaacgauaauuaccg

SEQ ID NO: 1586865 - RNA, 18 nt, Pseudomonas putida KT2440
gcaacgauugggcggcag

SEQ ID NO: 1586866 - RNA, 21 nt, Pseudomonas putida KT2440
gcaacgccaccaguuccaccg

SEQ ID NO: 1586867 - RNA, 16 nt, Pseudomonas putida KT2440
gcaaccgcauccccug

SEQ ID NO: 1586868 - RNA, 18 nt, Pseudomonas putida KT2440
gcaacgaaaaaaagggca

SEQ ID NO: 1586869 - RNA, 15 nt, Pseudomonas putida KT2440
gcaacaccggucagg

SEQ ID NO: 1586870 - RNA, 16 nt, Pseudomonas putida KT2440
gcaacaccugccgcag

SEQ ID NO: 1586871 - RNA, 16 nt, Pseudomonas putida KT2440
gcaacaccuccacgcc

SEQ ID NO: 1586872 - RNA, 15 nt, Pseudomonas putida KT2440
gcaacaccgccagaa

SEQ ID NO: 1586873 - RNA, 14 nt, Pseudomonas putida KT2440
gcaacaccagcagc

SEQ ID NO: 1586874 - RNA, 16 nt, Pseudomonas putida KT2440
gcaacaccagcagcca

SEQ ID NO: 1586875 - RNA, 18 nt, Pseudomonas putida KT2440
gcaacaagcuggacaugc

SEQ ID NO: 1586876 - RNA, 18 nt, Pseudomonas putida KT2440
gcaacacgcagucgaacu

SEQ ID NO: 1586877 - RNA, 20 nt, Pseudomonas putida KT2440
gcaacacgcagucgaacuug

SEQ ID NO: 1586878 - RNA, 16 nt, Pseudomonas putida KT2440
gcaacacgacgauggc

SEQ ID NO: 1586879 - RNA, 21 nt, Pseudomonas putida KT2440
gcaacacgacgauggccacca

SEQ ID NO: 1586880 - RNA, 20 nt, Pseudomonas putida KT2440
gcaacagcaaggcaucggcg

SEQ ID NO: 1586881 - RNA, 18 nt, Pseudomonas putida KT2440
gcaacagaaaaugcccgc

SEQ ID NO: 1586882 - RNA, 15 nt, Pseudomonas putida KT2440
gcaacagcggcgagu

SEQ ID NO: 1586883 - RNA, 22 nt, Pseudomonas putida KT2440
gcaacagcggcgagucgaucgg

SEQ ID NO: 1586884 - RNA, 22 nt, Pseudomonas putida KT2440
gcaacagcuccagcagugccgu

SEQ ID NO: 1586885 - RNA, 21 nt, Pseudomonas putida KT2440
gcaacaguuucuugccuucca

SEQ ID NO: 1586886 - RNA, 12 nt, Pseudomonas putida KT2440
gcaaccacgcuu

SEQ ID NO: 1586887 - RNA, 16 nt, Pseudomonas putida KT2440
gcaaccaccaacagca

SEQ ID NO: 1586888 - RNA, 21 nt, Pseudomonas putida KT2440
gcaaccauuuggcccgacaaa

SEQ ID NO: 1586889 - RNA, 16 nt, Pseudomonas putida KT2440
gcaaccaggcgccgag

SEQ ID NO: 1586890 - RNA, 14 nt, Pseudomonas putida KT2440
gcaaccauggcuuc

SEQ ID NO: 1586891 - RNA, 20 nt, Pseudomonas putida KT2440
gcaacccggccuuggccgcu

SEQ ID NO: 1586892 - RNA, 16 nt, Pseudomonas putida KT2440
gcaaccgaugcccagg

SEQ ID NO: 1586893 - RNA, 17 nt, Pseudomonas putida KT2440
gcaaccgaugcccaggc

SEQ ID NO: 1586894 - RNA, 20 nt, Pseudomonas putida KT2440
gcaaccgauagcgugaagcg

SEQ ID NO: 1586895 - RNA, 22 nt, Pseudomonas putida KT2440
gcaaccgccgcgccucgcggug

SEQ ID NO: 1586896 - RNA, 15 nt, Pseudomonas putida KT2440
gcaaccgggucggcg

SEQ ID NO: 1586897 - RNA, 16 nt, Pseudomonas putida KT2440
gcaaccgcgugacgcg

SEQ ID NO: 1586898 - RNA, 16 nt, Pseudomonas putida KT2440
gcaaucuucuugccgg

SEQ ID NO: 1586899 - RNA, 23 nt, Pseudomonas putida KT2440
gcaaucuucuugccgguaccgcc

SEQ ID NO: 1586900 - RNA, 22 nt, Pseudomonas putida KT2440
gcaauccgcuugacgaucgcca

SEQ ID NO: 1586901 - RNA, 18 nt, Pseudomonas putida KT2440
gcaaucagcgacaacggc

SEQ ID NO: 1586902 - RNA, 15 nt, Pseudomonas putida KT2440
gcaaucaggucaucg

SEQ ID NO: 1586903 - RNA, 23 nt, Pseudomonas putida KT2440
gcaaucaguaagauacgcgcaga

SEQ ID NO: 1586904 - RNA, 17 nt, Pseudomonas putida KT2440
gcaauaaccaaucaacg

SEQ ID NO: 1586905 - RNA, 17 nt, Pseudomonas putida KT2440
gcaaggugccaacaggc

SEQ ID NO: 1586906 - RNA, 21 nt, Pseudomonas putida KT2440
gcaauaaaaaaccccggcaca

SEQ ID NO: 1586907 - RNA, 20 nt, Pseudomonas putida KT2440
gcaaguucccgugcgccuau

SEQ ID NO: 1586908 - RNA, 20 nt, Pseudomonas putida KT2440
gcaaucagcucacaggcuca

SEQ ID NO: 1586909 - RNA, 14 nt, Pseudomonas putida KT2440
gcaauguucgcugc

SEQ ID NO: 1586910 - RNA, 17 nt, Pseudomonas putida KT2440
gcaauguuuucauaccg

SEQ ID NO: 1586911 - RNA, 15 nt, Pseudomonas putida KT2440
gcaaucugcagcagc

SEQ ID NO: 1586912 - RNA, 19 nt, Pseudomonas putida KT2440
gcaaugaccaagcaacgca

SEQ ID NO: 1586913 - RNA, 15 nt, Pseudomonas putida KT2440
gcaaugcaggcagua

SEQ ID NO: 1586914 - RNA, 18 nt, Pseudomonas putida KT2440
gcaaugauggcaaucacg

SEQ ID NO: 1586915 - RNA, 14 nt, Pseudomonas putida KT2440
gcaaugaucagccc

SEQ ID NO: 1586916 - RNA, 15 nt, Pseudomonas putida KT2440
gcaauugccaccggc

SEQ ID NO: 1586917 - RNA, 16 nt, Pseudomonas putida KT2440
gcacaaggcuguucca

SEQ ID NO: 1586918 - RNA, 18 nt, Pseudomonas putida KT2440
gcacaaggcuguuccaca

SEQ ID NO: 1586919 - RNA, 21 nt, Pseudomonas putida KT2440
gcacaagcgucccugcccgau

SEQ ID NO: 1586920 - RNA, 15 nt, Pseudomonas putida KT2440
gcacaaggccacugg

SEQ ID NO: 1586921 - RNA, 17 nt, Pseudomonas putida KT2440
gcacaaggccgcuccca

SEQ ID NO: 1586922 - RNA, 19 nt, Pseudomonas putida KT2440
gcacaaggccgcucccaca

SEQ ID NO: 1586923 - RNA, 21 nt, Pseudomonas putida KT2440
gcacaaggccgcucccacagg

SEQ ID NO: 1586924 - RNA, 23 nt, Pseudomonas putida KT2440
gcacaaggcggcucuugcagcga

SEQ ID NO: 1586925 - RNA, 15 nt, Pseudomonas putida KT2440
gcacaccacgccaac

SEQ ID NO: 1586926 - RNA, 15 nt, Pseudomonas putida KT2440
gcaaggcuggcaacc

SEQ ID NO: 1586927 - RNA, 15 nt, Pseudomonas putida KT2440
gcaagcuugccagcg

SEQ ID NO: 1586928 - RNA, 15 nt, Pseudomonas putida KT2440
gcaaggaucaccaag

SEQ ID NO: 1586929 - RNA, 21 nt, Pseudomonas putida KT2440
gcaaggcaaugcccauggcca

SEQ ID NO: 1586930 - RNA, 20 nt, Pseudomonas putida KT2440
gcaaggccguucccacaaag

SEQ ID NO: 1586931 - RNA, 18 nt, Pseudomonas putida KT2440
gcaagccgccgaccaggu

SEQ ID NO: 1586932 - RNA, 21 nt, Pseudomonas putida KT2440
gcaagcccaauggacgcgcaa

SEQ ID NO: 1586933 - RNA, 18 nt, Pseudomonas putida KT2440
gcaagcccgcuccuacag

SEQ ID NO: 1586934 - RNA, 18 nt, Pseudomonas putida KT2440
gcaagccuugugggagcg

SEQ ID NO: 1586935 - RNA, 23 nt, Pseudomonas putida KT2440
gcaagccuucgucgcuggccagc

SEQ ID NO: 1586936 - RNA, 17 nt, Pseudomonas putida KT2440
gcaagccgucucugacc

SEQ ID NO: 1586937 - RNA, 18 nt, Pseudomonas putida KT2440
gcaagcggcucucgaagu

SEQ ID NO: 1586938 - RNA, 15 nt, Pseudomonas putida KT2440
gcaagcugagaaugc

SEQ ID NO: 1586939 - RNA, 13 nt, Pseudomonas putida KT2440
gcaacugcgcgau

SEQ ID NO: 1586940 - RNA, 18 nt, Pseudomonas putida KT2440
gcaacugcggccccugga

SEQ ID NO: 1586941 - RNA, 19 nt, Pseudomonas putida KT2440
gcaacuggcgcaggccgcu

SEQ ID NO: 1586942 - RNA, 23 nt, Pseudomonas putida KT2440
gcaacuguuggaauggcgcaccg

SEQ ID NO: 1586943 - RNA, 20 nt, Pseudomonas putida KT2440
gcaacuucucggucgccaac

SEQ ID NO: 1586944 - RNA, 20 nt, Pseudomonas putida KT2440
gcaacuugcgggucagcagc

SEQ ID NO: 1586945 - RNA, 19 nt, Pseudomonas putida KT2440
gcaagcaggugcgcaggcu

SEQ ID NO: 1586946 - RNA, 14 nt, Pseudomonas putida KT2440
gcaagccagccucc

SEQ ID NO: 1586947 - RNA, 21 nt, Pseudomonas putida KT2440
gcaagccaaugguauugcccg

SEQ ID NO: 1586948 - RNA, 15 nt, Pseudomonas putida KT2440
gcaagcaaacgccag

SEQ ID NO: 1586949 - RNA, 16 nt, Pseudomonas putida KT2440
gcaagcaaacgccaga

SEQ ID NO: 1586950 - RNA, 18 nt, Pseudomonas putida KT2440
gcaagaccggguccagca

SEQ ID NO: 1586951 - RNA, 23 nt, Pseudomonas putida KT2440
gcaaaggcuagcagcaucaccgc

SEQ ID NO: 1586952 - RNA, 14 nt, Pseudomonas putida KT2440
gcaaagcgggucgc

SEQ ID NO: 1586953 - RNA, 13 nt, Pseudomonas putida KT2440
gcaaagcgcaccg

SEQ ID NO: 1586954 - RNA, 15 nt, Pseudomonas putida KT2440
gcaaagcgcagcaau

SEQ ID NO: 1586955 - RNA, 23 nt, Pseudomonas putida KT2440
gcaaagcggcccccacgccgacc

SEQ ID NO: 1586956 - RNA, 15 nt, Pseudomonas putida KT2440
gcaaagagugcccca

SEQ ID NO: 1586957 - RNA, 14 nt, Pseudomonas putida KT2440
gcaaagaucgccca

SEQ ID NO: 1586958 - RNA, 15 nt, Pseudomonas putida KT2440
gcaaagaucgcccag

SEQ ID NO: 1586959 - RNA, 17 nt, Pseudomonas putida KT2440
gcaaagaucgcccagcu

SEQ ID NO: 1586960 - RNA, 23 nt, Pseudomonas putida KT2440
gcaaacuucucgccucagcgcca

SEQ ID NO: 1586961 - RNA, 23 nt, Pseudomonas putida KT2440
gcaaagaaugccgcccaucaccg

SEQ ID NO: 1586962 - RNA, 17 nt, Pseudomonas putida KT2440
gcaaaguugagcgccgc

SEQ ID NO: 1586963 - RNA, 12 nt, Pseudomonas putida KT2440
gcaaaucgccaa

SEQ ID NO: 1586964 - RNA, 24 nt, Pseudomonas putida KT2440
gcaaaugcggcgcgggcgcaggca

SEQ ID NO: 1586965 - RNA, 19 nt, Pseudomonas putida KT2440
gcaaauucucgagcugaug

SEQ ID NO: 1586966 - RNA, 16 nt, Pseudomonas putida KT2440
gcaaacccggccagca

SEQ ID NO: 1586967 - RNA, 19 nt, Pseudomonas putida KT2440
gcaaacccggccagcaggu

SEQ ID NO: 1586968 - RNA, 21 nt, Pseudomonas putida KT2440
gcaaacccggccagcagguca

SEQ ID NO: 1586969 - RNA, 21 nt, Pseudomonas putida KT2440
gcaaacccgacaacagcugca

SEQ ID NO: 1586970 - RNA, 22 nt, Pseudomonas putida KT2440
gcaaacuccacugugcccgcca

SEQ ID NO: 1586971 - RNA, 19 nt, Pseudomonas putida KT2440
gcaaacuggcgcccggcau

SEQ ID NO: 1586972 - RNA, 14 nt, Pseudomonas putida KT2440
gauuucggcggcga

SEQ ID NO: 1586973 - RNA, 19 nt, Pseudomonas putida KT2440
gauuugcgcuacagcuuug

SEQ ID NO: 1586974 - RNA, 17 nt, Pseudomonas putida KT2440
gaugugcggcgccaucg

SEQ ID NO: 1586975 - RNA, 14 nt, Pseudomonas putida KT2440
gauguucaggucgc

SEQ ID NO: 1586976 - RNA, 20 nt, Pseudomonas putida KT2440
gauguucaggucgcgcugca

SEQ ID NO: 1586977 - RNA, 14 nt, Pseudomonas putida KT2440
gaugguggucggca

SEQ ID NO: 1586978 - RNA, 17 nt, Pseudomonas putida KT2440
gauugggcggcaguuca

SEQ ID NO: 1586979 - RNA, 16 nt, Pseudomonas putida KT2440
gauugggcuuggcagc

SEQ ID NO: 1586980 - RNA, 15 nt, Pseudomonas putida KT2440
gauuccuugcagcgc

SEQ ID NO: 1586981 - RNA, 18 nt, Pseudomonas putida KT2440
gauggcaaucacgaacag

SEQ ID NO: 1586982 - RNA, 20 nt, Pseudomonas putida KT2440
gauggcaccggcuucgccgg

SEQ ID NO: 1586983 - RNA, 16 nt, Pseudomonas putida KT2440
gauggcauccacacgc

SEQ ID NO: 1586984 - RNA, 23 nt, Pseudomonas putida KT2440
gauggcauccacacgcugcugcg

SEQ ID NO: 1586985 - RNA, 18 nt, Pseudomonas putida KT2440
gauggccaauaccgcugc

SEQ ID NO: 1586986 - RNA, 15 nt, Pseudomonas putida KT2440
gauggugacugccag

SEQ ID NO: 1586987 - RNA, 17 nt, Pseudomonas putida KT2440
gauggucagcgcuucgc

SEQ ID NO: 1586988 - RNA, 16 nt, Pseudomonas putida KT2440
gauggucuccgugcuc

SEQ ID NO: 1586989 - RNA, 13 nt, Pseudomonas putida KT2440
gaugggcaggcca

SEQ ID NO: 1586990 - RNA, 16 nt, Pseudomonas putida KT2440
gauggcucaucgccgu

SEQ ID NO: 1586991 - RNA, 22 nt, Pseudomonas putida KT2440
gaugcgccuggcccgcagcgcu

SEQ ID NO: 1586992 - RNA, 17 nt, Pseudomonas putida KT2440
gaugcgcccuucgcgga

SEQ ID NO: 1586993 - RNA, 20 nt, Pseudomonas putida KT2440
gaugcgccaguacgccagca

SEQ ID NO: 1586994 - RNA, 23 nt, Pseudomonas putida KT2440
gaugcggccacagccgagggcau

SEQ ID NO: 1586995 - RNA, 16 nt, Pseudomonas putida KT2440
gaugaccaccaggaac

SEQ ID NO: 1586996 - RNA, 19 nt, Pseudomonas putida KT2440
gaugccgugcgcggcauca

SEQ ID NO: 1586997 - RNA, 23 nt, Pseudomonas putida KT2440
gaugccgugcgcggcaucagcuc

SEQ ID NO: 1586998 - RNA, 22 nt, Pseudomonas putida KT2440
gaugccguucggcccgcugcca

SEQ ID NO: 1586999 - RNA, 14 nt, Pseudomonas putida KT2440
gaucaucagcgccg

SEQ ID NO: 1587000 - RNA, 23 nt, Pseudomonas putida KT2440
gaucaguuccgcguccuugacgg

SEQ ID NO: 1587001 - RNA, 14 nt, Pseudomonas putida KT2440
gauccacagcgggu

SEQ ID NO: 1587002 - RNA, 12 nt, Pseudomonas putida KT2440
gaucaugucgcc

SEQ ID NO: 1587003 - RNA, 20 nt, Pseudomonas putida KT2440
gaucaugaacgaggacugca

SEQ ID NO: 1587004 - RNA, 15 nt, Pseudomonas putida KT2440
gaucaugcuggccag

SEQ ID NO: 1587005 - RNA, 18 nt, Pseudomonas putida KT2440
gaucaugcggcaagccaa

SEQ ID NO: 1587006 - RNA, 14 nt, Pseudomonas putida KT2440
gaucagguugccca

SEQ ID NO: 1587007 - RNA, 14 nt, Pseudomonas putida KT2440
gaucagguugcccg

SEQ ID NO: 1587008 - RNA, 15 nt, Pseudomonas putida KT2440
gaucaggccgcucac

SEQ ID NO: 1587009 - RNA, 17 nt, Pseudomonas putida KT2440
gaucagcugccacucuu

SEQ ID NO: 1587010 - RNA, 17 nt, Pseudomonas putida KT2440
gaucagcuuaacgcuug

SEQ ID NO: 1587011 - RNA, 19 nt, Pseudomonas putida KT2440
gaucagcgcggugaccagc

SEQ ID NO: 1587012 - RNA, 12 nt, Pseudomonas putida KT2440
gaucagcgccuc

SEQ ID NO: 1587013 - RNA, 19 nt, Pseudomonas putida KT2440
gauccggcacuccagcgag

SEQ ID NO: 1587014 - RNA, 19 nt, Pseudomonas putida KT2440
gaucccuguaggagcgggu

SEQ ID NO: 1587015 - RNA, 14 nt, Pseudomonas putida KT2440
gauccuuggcgaag

SEQ ID NO: 1587016 - RNA, 21 nt, Pseudomonas putida KT2440
gauccugggggcguaaagcgc

SEQ ID NO: 1587017 - RNA, 13 nt, Pseudomonas putida KT2440
gauccggccgugu

SEQ ID NO: 1587018 - RNA, 17 nt, Pseudomonas putida KT2440
gaucgaagcagcagcuu

SEQ ID NO: 1587019 - RNA, 20 nt, Pseudomonas putida KT2440
gaucgaugaacucacccgcc

SEQ ID NO: 1587020 - RNA, 14 nt, Pseudomonas putida KT2440
gaucggguuuaccc

SEQ ID NO: 1587021 - RNA, 16 nt, Pseudomonas putida KT2440
gaucggguuuacccgc

SEQ ID NO: 1587022 - RNA, 13 nt, Pseudomonas putida KT2440
gaucggcuggcca

SEQ ID NO: 1587023 - RNA, 21 nt, Pseudomonas putida KT2440
gaucgucggccccggccccag

SEQ ID NO: 1587024 - RNA, 12 nt, Pseudomonas putida KT2440
gaucucuucgcc

SEQ ID NO: 1587025 - RNA, 20 nt, Pseudomonas putida KT2440
gaucucugugggagcgggcg

SEQ ID NO: 1587026 - RNA, 13 nt, Pseudomonas putida KT2440
gaucugccaggca

SEQ ID NO: 1587027 - RNA, 23 nt, Pseudomonas putida KT2440
gaucugucagguguggcucagcu

SEQ ID NO: 1587028 - RNA, 17 nt, Pseudomonas putida KT2440
gaugaaauucaccugcc

SEQ ID NO: 1587029 - RNA, 14 nt, Pseudomonas putida KT2440
gaugaaauccacca

SEQ ID NO: 1587030 - RNA, 15 nt, Pseudomonas putida KT2440
gaugaacucacccgc

SEQ ID NO: 1587031 - RNA, 19 nt, Pseudomonas putida KT2440
gaugaagacgcucgacagc

SEQ ID NO: 1587032 - RNA, 16 nt, Pseudomonas putida KT2440
gaugaagucggcaacc

SEQ ID NO: 1587033 - RNA, 16 nt, Pseudomonas putida KT2440
gaggcgggccgcaggc

SEQ ID NO: 1587034 - RNA, 16 nt, Pseudomonas putida KT2440
gaggcgcgcgccuggg

SEQ ID NO: 1587035 - RNA, 17 nt, Pseudomonas putida KT2440
gaggccgccauugaugc

SEQ ID NO: 1587036 - RNA, 22 nt, Pseudomonas putida KT2440
gaggccggcacaggaaggcaua

SEQ ID NO: 1587037 - RNA, 23 nt, Pseudomonas putida KT2440
gaggccgguaggccuccccgcuu

SEQ ID NO: 1587038 - RNA, 19 nt, Pseudomonas putida KT2440
gaggcauggaagggcgggu

SEQ ID NO: 1587039 - RNA, 15 nt, Pseudomonas putida KT2440
gagucgguggcgaag

SEQ ID NO: 1587040 - RNA, 21 nt, Pseudomonas putida KT2440
gaguggaucaaccgaccagcg

SEQ ID NO: 1587041 - RNA, 23 nt, Pseudomonas putida KT2440
gaguggaucaaccgaccagcgga

SEQ ID NO: 1587042 - RNA, 22 nt, Pseudomonas putida KT2440
gagugcucgccucacagcgccg

SEQ ID NO: 1587043 - RNA, 14 nt, Pseudomonas putida KT2440
gagugcuucgccca

SEQ ID NO: 1587044 - RNA, 20 nt, Pseudomonas putida KT2440
gagugcuucgcccagugccu

SEQ ID NO: 1587045 - RNA, 22 nt, Pseudomonas putida KT2440
gaguucccaggcagccuccagg

SEQ ID NO: 1587046 - RNA, 21 nt, Pseudomonas putida KT2440
gaguucagggccuugcucgug

SEQ ID NO: 1587047 - RNA, 14 nt, Pseudomonas putida KT2440
gauacccgccacca

SEQ ID NO: 1587048 - RNA, 16 nt, Pseudomonas putida KT2440
gauacccacgccaugu

SEQ ID NO: 1587049 - RNA, 15 nt, Pseudomonas putida KT2440
gauacccagcgccga

SEQ ID NO: 1587050 - RNA, 16 nt, Pseudomonas putida KT2440
gauacccagcgccgaa

SEQ ID NO: 1587051 - RNA, 17 nt, Pseudomonas putida KT2440
gauaccugcuugcugac

SEQ ID NO: 1587052 - RNA, 20 nt, Pseudomonas putida KT2440
gauaccugugggagcgggcg

SEQ ID NO: 1587053 - RNA, 20 nt, Pseudomonas putida KT2440
gauaaaccagcagcgccugc

SEQ ID NO: 1587054 - RNA, 15 nt, Pseudomonas putida KT2440
gauagcacgggcuuc

SEQ ID NO: 1587055 - RNA, 19 nt, Pseudomonas putida KT2440
gauacgacgcaucagggca

SEQ ID NO: 1587056 - RNA, 17 nt, Pseudomonas putida KT2440
gauagcggcagcgacga

SEQ ID NO: 1587057 - RNA, 21 nt, Pseudomonas putida KT2440
gauagccuguggggcaacugc

SEQ ID NO: 1587058 - RNA, 15 nt, Pseudomonas putida KT2440
gaucagccgcgccau

SEQ ID NO: 1587059 - RNA, 16 nt, Pseudomonas putida KT2440
gaucagccgcgcugac

SEQ ID NO: 1587060 - RNA, 19 nt, Pseudomonas putida KT2440
gaucagcccuugccaguga

SEQ ID NO: 1587061 - RNA, 15 nt, Pseudomonas putida KT2440
gaucagccacgggcu

SEQ ID NO: 1587062 - RNA, 14 nt, Pseudomonas putida KT2440
gaucagcauguccc

SEQ ID NO: 1587063 - RNA, 15 nt, Pseudomonas putida KT2440
gaucagcaugucccg

SEQ ID NO: 1587064 - RNA, 13 nt, Pseudomonas putida KT2440
gaucacugcgcag

SEQ ID NO: 1587065 - RNA, 19 nt, Pseudomonas putida KT2440
gaucacguggcugaugcca

SEQ ID NO: 1587066 - RNA, 18 nt, Pseudomonas putida KT2440
gaucagcagcaccgaggc

SEQ ID NO: 1587067 - RNA, 11 nt, Pseudomonas putida KT2440
gaucaccugcg

SEQ ID NO: 1587068 - RNA, 22 nt, Pseudomonas putida KT2440
gauauggaagcuguggggcuga

SEQ ID NO: 1587069 - RNA, 16 nt, Pseudomonas putida KT2440
cagaaacggcggcaga

SEQ ID NO: 1587070 - RNA, 21 nt, Pseudomonas putida KT2440
cagaaaauucucccgggccac

SEQ ID NO: 1587071 - RNA, 14 nt, Pseudomonas putida KT2440
cagaagccgucgac

SEQ ID NO: 1587072 - RNA, 22 nt, Pseudomonas putida KT2440
cagaagccuuggccuuggcagc

SEQ ID NO: 1587073 - RNA, 19 nt, Pseudomonas putida KT2440
cagaacggcuucgaugucc

SEQ ID NO: 1587074 - RNA, 13 nt, Pseudomonas putida KT2440
cagaagcagcuga

SEQ ID NO: 1587075 - RNA, 14 nt, Pseudomonas putida KT2440
cagacaaaacgcug

SEQ ID NO: 1587076 - RNA, 22 nt, Pseudomonas putida KT2440
cacuucgaucaggcagucuuca

SEQ ID NO: 1587077 - RNA, 16 nt, Pseudomonas putida KT2440
cacucguuucacagca

SEQ ID NO: 1587078 - RNA, 22 nt, Pseudomonas putida KT2440
cacucaguuaaucagcaacgcc

SEQ ID NO: 1587079 - RNA, 12 nt, Pseudomonas putida KT2440
cacucgcggcca

SEQ ID NO: 1587080 - RNA, 23 nt, Pseudomonas putida KT2440
cacuccgcccguaugcauccgcc

SEQ ID NO: 1587081 - RNA, 12 nt, Pseudomonas putida KT2440
cacucgucgauc

SEQ ID NO: 1587082 - RNA, 18 nt, Pseudomonas putida KT2440
cagaccagcagcaguggc

SEQ ID NO: 1587083 - RNA, 15 nt, Pseudomonas putida KT2440
cagaccaccugccaa

SEQ ID NO: 1587084 - RNA, 13 nt, Pseudomonas putida KT2440
cagaccuugcgca

SEQ ID NO: 1587085 - RNA, 19 nt, Pseudomonas putida KT2440
cagaccgccgggcccaggc

SEQ ID NO: 1587086 - RNA, 19 nt, Pseudomonas putida KT2440
cagaccuccgucugcucug

SEQ ID NO: 1587087 - RNA, 15 nt, Pseudomonas putida KT2440
cagaucccgcuccuc

SEQ ID NO: 1587088 - RNA, 22 nt, Pseudomonas putida KT2440
cagauaaccuggcucggcuggg

SEQ ID NO: 1587089 - RNA, 15 nt, Pseudomonas putida KT2440
cagauaaaccugcca

SEQ ID NO: 1587090 - RNA, 14 nt, Pseudomonas putida KT2440
cagaucgagcgccc

SEQ ID NO: 1587091 - RNA, 15 nt, Pseudomonas putida KT2440
cagaucgagcgccgc

SEQ ID NO: 1587092 - RNA, 15 nt, Pseudomonas putida KT2440
cagauccaucggcgu

SEQ ID NO: 1587093 - RNA, 14 nt, Pseudomonas putida KT2440
cagauccugcagcc

SEQ ID NO: 1587094 - RNA, 24 nt, Pseudomonas putida KT2440
cagauccuugaucaacugacgcag

SEQ ID NO: 1587095 - RNA, 22 nt, Pseudomonas putida KT2440
cagaucguuguaggagcgggcu

SEQ ID NO: 1587096 - RNA, 22 nt, Pseudomonas putida KT2440
cagcaaagaauguucgacgaac

SEQ ID NO: 1587097 - RNA, 23 nt, Pseudomonas putida KT2440
cagcaacagguacauguugguca

SEQ ID NO: 1587098 - RNA, 14 nt, Pseudomonas putida KT2440
cagcaacagcugcc

SEQ ID NO: 1587099 - RNA, 13 nt, Pseudomonas putida KT2440
cagcaacacgacg

SEQ ID NO: 1587100 - RNA, 20 nt, Pseudomonas putida KT2440
cagcaacacgacgauggcca

SEQ ID NO: 1587101 - RNA, 21 nt, Pseudomonas putida KT2440
cagcaacacgacgauggccac

SEQ ID NO: 1587102 - RNA, 12 nt, Pseudomonas putida KT2440
cagcaacagccc

SEQ ID NO: 1587103 - RNA, 19 nt, Pseudomonas putida KT2440
cagagcgccagcaagcgca

SEQ ID NO: 1587104 - RNA, 20 nt, Pseudomonas putida KT2440
cagagcgucaaccaggcgca

SEQ ID NO: 1587105 - RNA, 14 nt, Pseudomonas putida KT2440
cagagcucagcgug

SEQ ID NO: 1587106 - RNA, 12 nt, Pseudomonas putida KT2440
cagagcaaccag

SEQ ID NO: 1587107 - RNA, 18 nt, Pseudomonas putida KT2440
cagagcauggccagccgg

SEQ ID NO: 1587108 - RNA, 21 nt, Pseudomonas putida KT2440
cagagaauuucuccccagcau

SEQ ID NO: 1587109 - RNA, 14 nt, Pseudomonas putida KT2440
cagagaagccgcac

SEQ ID NO: 1587110 - RNA, 16 nt, Pseudomonas putida KT2440
cagacuucgaagugcc

SEQ ID NO: 1587111 - RNA, 14 nt, Pseudomonas putida KT2440
cagacgucuuccau

SEQ ID NO: 1587112 - RNA, 17 nt, Pseudomonas putida KT2440
cagacucagcugcugcu

SEQ ID NO: 1587113 - RNA, 22 nt, Pseudomonas putida KT2440
cagacgggcgacggaucggcac

SEQ ID NO: 1587114 - RNA, 16 nt, Pseudomonas putida KT2440
cagacgcggaacuggc

SEQ ID NO: 1587115 - RNA, 19 nt, Pseudomonas putida KT2440
cacguccaaugccgccuug

SEQ ID NO: 1587116 - RNA, 13 nt, Pseudomonas putida KT2440
cacguucaacgcc

SEQ ID NO: 1587117 - RNA, 15 nt, Pseudomonas putida KT2440
cacguucaacgccgu

SEQ ID NO: 1587118 - RNA, 21 nt, Pseudomonas putida KT2440
cacgugggucgggaacagcuc

SEQ ID NO: 1587119 - RNA, 22 nt, Pseudomonas putida KT2440
cacguuugcucaggcgggcagc

SEQ ID NO: 1587120 - RNA, 24 nt, Pseudomonas putida KT2440
cacucaccgcacaggcauaccgca

SEQ ID NO: 1587121 - RNA, 18 nt, Pseudomonas putida KT2440
cacuaccguauucgcggg

SEQ ID NO: 1587122 - RNA, 14 nt, Pseudomonas putida KT2440
cacuaccuccagcc

SEQ ID NO: 1587123 - RNA, 14 nt, Pseudomonas putida KT2440
cacuacgccggcca

SEQ ID NO: 1587124 - RNA, 18 nt, Pseudomonas putida KT2440
cacggucagcauccagcc

SEQ ID NO: 1587125 - RNA, 20 nt, Pseudomonas putida KT2440
cacggucggccugcgcucca

SEQ ID NO: 1587126 - RNA, 15 nt, Pseudomonas putida KT2440
cacguagaacaggcc

SEQ ID NO: 1587127 - RNA, 16 nt, Pseudomonas putida KT2440
cacguaccuggcugca

SEQ ID NO: 1587128 - RNA, 12 nt, Pseudomonas putida KT2440
cacgucacgcac

SEQ ID NO: 1587129 - RNA, 19 nt, Pseudomonas putida KT2440
cacggccuucccgccuggc

SEQ ID NO: 1587130 - RNA, 14 nt, Pseudomonas putida KT2440
cacggccuggccug

SEQ ID NO: 1587131 - RNA, 16 nt, Pseudomonas putida KT2440
cacggccuggccugca

SEQ ID NO: 1587132 - RNA, 17 nt, Pseudomonas putida KT2440
cacggccuugucagcag

SEQ ID NO: 1587133 - RNA, 13 nt, Pseudomonas putida KT2440
cacgggcaggccc

SEQ ID NO: 1587134 - RNA, 17 nt, Pseudomonas putida KT2440
cacgggcaaacaggcug

SEQ ID NO: 1587135 - RNA, 13 nt, Pseudomonas putida KT2440
cacgcuggccauu

SEQ ID NO: 1587136 - RNA, 14 nt, Pseudomonas putida KT2440
cacgcuggcaccca

SEQ ID NO: 1587137 - RNA, 20 nt, Pseudomonas putida KT2440
cacggccaauaucuggugca

SEQ ID NO: 1587138 - RNA, 19 nt, Pseudomonas putida KT2440
cacggcauccccgccagug

SEQ ID NO: 1587139 - RNA, 15 nt, Pseudomonas putida KT2440
cacgcuuacagguag

SEQ ID NO: 1587140 - RNA, 15 nt, Pseudomonas putida KT2440
cacgcugcugcguac

SEQ ID NO: 1587141 - RNA, 21 nt, Pseudomonas putida KT2440
cacgcugcccaggugccaggc

SEQ ID NO: 1587142 - RNA, 20 nt, Pseudomonas putida KT2440
cacgcucguuguccagcagc

SEQ ID NO: 1587143 - RNA, 15 nt, Pseudomonas putida KT2440
cacgcucggccagua

SEQ ID NO: 1587144 - RNA, 20 nt, Pseudomonas putida KT2440
cacgcggugggucgacgaac

SEQ ID NO: 1587145 - RNA, 23 nt, Pseudomonas putida KT2440
cacgcggugggucgacgaacacg

SEQ ID NO: 1587146 - RNA, 15 nt, Pseudomonas putida KT2440
cacgcguaccccugg

SEQ ID NO: 1587147 - RNA, 19 nt, Pseudomonas putida KT2440
cacgcguaccccuggcgcu

SEQ ID NO: 1587148 - RNA, 13 nt, Pseudomonas putida KT2440
cacgcucagugug

SEQ ID NO: 1587149 - RNA, 14 nt, Pseudomonas putida KT2440
cacgcucgcgcagg

SEQ ID NO: 1587150 - RNA, 13 nt, Pseudomonas putida KT2440
cacgccgucgacc

SEQ ID NO: 1587151 - RNA, 14 nt, Pseudomonas putida KT2440
cacgccgucgaccu

SEQ ID NO: 1587152 - RNA, 16 nt, Pseudomonas putida KT2440
cacgccgucgaccuug

SEQ ID NO: 1587153 - RNA, 16 nt, Pseudomonas putida KT2440
cacgcggguccagcgc

SEQ ID NO: 1587154 - RNA, 16 nt, Pseudomonas putida KT2440
cacgcgguauucgaga

SEQ ID NO: 1587155 - RNA, 14 nt, Pseudomonas putida KT2440
cacgcggcgucacc

SEQ ID NO: 1587156 - RNA, 16 nt, Pseudomonas putida KT2440
cacgcccaucagcgcc

SEQ ID NO: 1587157 - RNA, 19 nt, Pseudomonas putida KT2440
cacgcccauuuccgggcaa

SEQ ID NO: 1587158 - RNA, 14 nt, Pseudomonas putida KT2440
cacgcccaacccag

SEQ ID NO: 1587159 - RNA, 19 nt, Pseudomonas putida KT2440
cacgcccaacccagccagc

SEQ ID NO: 1587160 - RNA, 17 nt, Pseudomonas putida KT2440
cacgccggcaaccccug

SEQ ID NO: 1587161 - RNA, 22 nt, Pseudomonas putida KT2440
cacgccgaagcgcgccuggucg

SEQ ID NO: 1587162 - RNA, 18 nt, Pseudomonas putida KT2440
cacgccgaccgcgcgcac

SEQ ID NO: 1587163 - RNA, 14 nt, Pseudomonas putida KT2440
cagcgccaccgcgc

SEQ ID NO: 1587164 - RNA, 14 nt, Pseudomonas putida KT2440
cagcgccaccggca

SEQ ID NO: 1587165 - RNA, 15 nt, Pseudomonas putida KT2440
cagcgccaccggcag

SEQ ID NO: 1587166 - RNA, 17 nt, Pseudomonas putida KT2440
cagcgccaccggcagca

SEQ ID NO: 1587167 - RNA, 16 nt, Pseudomonas putida KT2440
cagcgccacgccugca

SEQ ID NO: 1587168 - RNA, 19 nt, Pseudomonas putida KT2440
cagcgccacgccugcaguc

SEQ ID NO: 1587169 - RNA, 13 nt, Pseudomonas putida KT2440
cagcgccagcagc

SEQ ID NO: 1587170 - RNA, 14 nt, Pseudomonas putida KT2440
cagcgccagcagcc

SEQ ID NO: 1587171 - RNA, 22 nt, Pseudomonas putida KT2440
cagcgcagggaagguggccggc

SEQ ID NO: 1587172 - RNA, 19 nt, Pseudomonas putida KT2440
cagcgcauacagcuugccc

SEQ ID NO: 1587173 - RNA, 19 nt, Pseudomonas putida KT2440
cagcgcaucgaccggcagg

SEQ ID NO: 1587174 - RNA, 15 nt, Pseudomonas putida KT2440
cagcgcauaggccaa

SEQ ID NO: 1587175 - RNA, 16 nt, Pseudomonas putida KT2440
cagcgcauggcucaac

SEQ ID NO: 1587176 - RNA, 21 nt, Pseudomonas putida KT2440
cagcgcccagaucagcagcac

SEQ ID NO: 1587177 - RNA, 16 nt, Pseudomonas putida KT2440
cagcgccgcauccagc

SEQ ID NO: 1587178 - RNA, 19 nt, Pseudomonas putida KT2440
cagcgccgcauccagcacu

SEQ ID NO: 1587179 - RNA, 12 nt, Pseudomonas putida KT2440
cagcgcccgcaa

SEQ ID NO: 1587180 - RNA, 14 nt, Pseudomonas putida KT2440
cagcgcccggcgca

SEQ ID NO: 1587181 - RNA, 15 nt, Pseudomonas putida KT2440
cagcgccucaccgac

SEQ ID NO: 1587182 - RNA, 14 nt, Pseudomonas putida KT2440
cagcgccgcgccac

SEQ ID NO: 1587183 - RNA, 16 nt, Pseudomonas putida KT2440
cagcgccgcggccaac

SEQ ID NO: 1587184 - RNA, 15 nt, Pseudomonas putida KT2440
cagcgccgccaugca

SEQ ID NO: 1587185 - RNA, 15 nt, Pseudomonas putida KT2440
cagcgccugccuggc

SEQ ID NO: 1587186 - RNA, 22 nt, Pseudomonas putida KT2440
cagcgccugcugcuggaucagu

SEQ ID NO: 1587187 - RNA, 15 nt, Pseudomonas putida KT2440
cagcgccugcuggug

SEQ ID NO: 1587188 - RNA, 14 nt, Pseudomonas putida KT2440
cagcgccuccagca

SEQ ID NO: 1587189 - RNA, 17 nt, Pseudomonas putida KT2440
cagcgccuccagcaggg

SEQ ID NO: 1587190 - RNA, 14 nt, Pseudomonas putida KT2440
cagcgccuggcgca

SEQ ID NO: 1587191 - RNA, 20 nt, Pseudomonas putida KT2440
cagcgccuugaagcuggccg

SEQ ID NO: 1587192 - RNA, 21 nt, Pseudomonas putida KT2440
cagcgccuuggccugcucacc

SEQ ID NO: 1587193 - RNA, 22 nt, Pseudomonas putida KT2440
cagccuucgaaauuacccugcg

SEQ ID NO: 1587194 - RNA, 13 nt, Pseudomonas putida KT2440
cagccucaaggcc

SEQ ID NO: 1587195 - RNA, 14 nt, Pseudomonas putida KT2440
cagccuucagugcu

SEQ ID NO: 1587196 - RNA, 19 nt, Pseudomonas putida KT2440
cagccuucagugcuucaca

SEQ ID NO: 1587197 - RNA, 20 nt, Pseudomonas putida KT2440
cagccuuucuuggcaugcga

SEQ ID NO: 1587198 - RNA, 14 nt, Pseudomonas putida KT2440
cagccguuggagca

SEQ ID NO: 1587199 - RNA, 19 nt, Pseudomonas putida KT2440
cagccguuguacaagcugg

SEQ ID NO: 1587200 - RNA, 21 nt, Pseudomonas putida KT2440
cagccguuguacaagcuggca

SEQ ID NO: 1587201 - RNA, 19 nt, Pseudomonas putida KT2440
cagccuaagguugcuccug

SEQ ID NO: 1587202 - RNA, 18 nt, Pseudomonas putida KT2440
cagccggucucccagcgc

SEQ ID NO: 1587203 - RNA, 21 nt, Pseudomonas putida KT2440
cagccgugguuucgaagucga

SEQ ID NO: 1587204 - RNA, 22 nt, Pseudomonas putida KT2440
cagccgugguuucgaagucgaa

SEQ ID NO: 1587205 - RNA, 22 nt, Pseudomonas putida KT2440
cagccgaucacuuccuggccgc

SEQ ID NO: 1587206 - RNA, 13 nt, Pseudomonas putida KT2440
cagccggcuaucg

SEQ ID NO: 1587207 - RNA, 20 nt, Pseudomonas putida KT2440
cagccgauacgcuguacuug

SEQ ID NO: 1587208 - RNA, 19 nt, Pseudomonas putida KT2440
cagccgcaaccgggucggc

SEQ ID NO: 1587209 - RNA, 22 nt, Pseudomonas putida KT2440
cagccgggccaacuugcgcagu

SEQ ID NO: 1587210 - RNA, 17 nt, Pseudomonas putida KT2440
cagccggucauccagca

SEQ ID NO: 1587211 - RNA, 19 nt, Pseudomonas putida KT2440
cagccggucauccagcagc

SEQ ID NO: 1587212 - RNA, 21 nt, Pseudomonas putida KT2440
cagccgggcaugcaggucgac

SEQ ID NO: 1587213 - RNA, 22 nt, Pseudomonas putida KT2440
cagcgagucguaguucggcgga

SEQ ID NO: 1587214 - RNA, 18 nt, Pseudomonas putida KT2440
cagcgauaaaccagcagc

SEQ ID NO: 1587215 - RNA, 21 nt, Pseudomonas putida KT2440
cagcgauaaaccagcagcgcc

SEQ ID NO: 1587216 - RNA, 16 nt, Pseudomonas putida KT2440
cagcgaggggacgauc

SEQ ID NO: 1587217 - RNA, 20 nt, Pseudomonas putida KT2440
cagcgaggguuccaggccac

SEQ ID NO: 1587218 - RNA, 20 nt, Pseudomonas putida KT2440
cagcgagcgguucagcgcac

SEQ ID NO: 1587219 - RNA, 20 nt, Pseudomonas putida KT2440
cagcgacaugccggccacca

SEQ ID NO: 1587220 - RNA, 20 nt, Pseudomonas putida KT2440
cagcgacagcaucggcaggu

SEQ ID NO: 1587221 - RNA, 17 nt, Pseudomonas putida KT2440
cagcgacagcugcggca

SEQ ID NO: 1587222 - RNA, 15 nt, Pseudomonas putida KT2440
cagcgaccgacacgc

SEQ ID NO: 1587223 - RNA, 13 nt, Pseudomonas putida KT2440
cagcgaucagcgc

SEQ ID NO: 1587224 - RNA, 15 nt, Pseudomonas putida KT2440
cagcgcaccgugcac

SEQ ID NO: 1587225 - RNA, 23 nt, Pseudomonas putida KT2440
cagcgcaccgugcaccagcacca

SEQ ID NO: 1587226 - RNA, 22 nt, Pseudomonas putida KT2440
cagcgcaccacuguucaggugu

SEQ ID NO: 1587227 - RNA, 17 nt, Pseudomonas putida KT2440
cagcgcacucucccgca

SEQ ID NO: 1587228 - RNA, 20 nt, Pseudomonas putida KT2440
cagcgcacucucccgcagcc

SEQ ID NO: 1587229 - RNA, 18 nt, Pseudomonas putida KT2440
cagcgcacugaacagcgc

SEQ ID NO: 1587230 - RNA, 13 nt, Pseudomonas putida KT2440
cagcgcagccacc

SEQ ID NO: 1587231 - RNA, 23 nt, Pseudomonas putida KT2440
cagcaguucgcggucgccgugca

SEQ ID NO: 1587232 - RNA, 17 nt, Pseudomonas putida KT2440
cagcaguuggcugccgg

SEQ ID NO: 1587233 - RNA, 17 nt, Pseudomonas putida KT2440
cagcaguuugcugcgcu

SEQ ID NO: 1587234 - RNA, 12 nt, Pseudomonas putida KT2440
cagcaucggcac

SEQ ID NO: 1587235 - RNA, 16 nt, Pseudomonas putida KT2440
cagcaucgggucacgc

SEQ ID NO: 1587236 - RNA, 16 nt, Pseudomonas putida KT2440
cagcaucugcaccagg

SEQ ID NO: 1587237 - RNA, 14 nt, Pseudomonas putida KT2440
cagcaucugcacgu

SEQ ID NO: 1587238 - RNA, 16 nt, Pseudomonas putida KT2440
cagcauuacgcggcag

SEQ ID NO: 1587239 - RNA, 18 nt, Pseudomonas putida KT2440
cagcauuacgcggcagca

SEQ ID NO: 1587240 - RNA, 19 nt, Pseudomonas putida KT2440
cagccaaucggcgccagga

SEQ ID NO: 1587241 - RNA, 13 nt, Pseudomonas putida KT2440
cagccaauggcaa

SEQ ID NO: 1587242 - RNA, 17 nt, Pseudomonas putida KT2440
cagcauggcgucggcga

SEQ ID NO: 1587243 - RNA, 18 nt, Pseudomonas putida KT2440
cagcauggcgucggcgau

SEQ ID NO: 1587244 - RNA, 19 nt, Pseudomonas putida KT2440
cagcauggcgucggcgaug

SEQ ID NO: 1587245 - RNA, 20 nt, Pseudomonas putida KT2440
cagcauguccugcugcaggc

SEQ ID NO: 1587246 - RNA, 22 nt, Pseudomonas putida KT2440
cagccacagcugcugcagggcc

SEQ ID NO: 1587247 - RNA, 21 nt, Pseudomonas putida KT2440
cagccacauccucugcccgca

SEQ ID NO: 1587248 - RNA, 12 nt, Pseudomonas putida KT2440
cagccacaugcc

SEQ ID NO: 1587249 - RNA, 16 nt, Pseudomonas putida KT2440
cagccacaugccagcu

SEQ ID NO: 1587250 - RNA, 19 nt, Pseudomonas putida KT2440
cagccacggaucaccuggc

SEQ ID NO: 1587251 - RNA, 14 nt, Pseudomonas putida KT2440
cagccacgcuggca

SEQ ID NO: 1587252 - RNA, 20 nt, Pseudomonas putida KT2440
cagccacgauagcgucagca

SEQ ID NO: 1587253 - RNA, 15 nt, Pseudomonas putida KT2440
cagccacccuccgca

SEQ ID NO: 1587254 - RNA, 22 nt, Pseudomonas putida KT2440
cagccaccgacgaacagggccg

SEQ ID NO: 1587255 - RNA, 14 nt, Pseudomonas putida KT2440
cagccaccgcgagc

SEQ ID NO: 1587256 - RNA, 15 nt, Pseudomonas putida KT2440
cagccaccugcccgg

SEQ ID NO: 1587257 - RNA, 13 nt, Pseudomonas putida KT2440
cagccagggccug

SEQ ID NO: 1587258 - RNA, 15 nt, Pseudomonas putida KT2440
cagccagggccugac

SEQ ID NO: 1587259 - RNA, 21 nt, Pseudomonas putida KT2440
cagccagguucggaucagcaa

SEQ ID NO: 1587260 - RNA, 16 nt, Pseudomonas putida KT2440
cagccagguauggcca

SEQ ID NO: 1587261 - RNA, 14 nt, Pseudomonas putida KT2440
cagccaguucgaca

SEQ ID NO: 1587262 - RNA, 15 nt, Pseudomonas putida KT2440
cagccagugcugccu

SEQ ID NO: 1587263 - RNA, 21 nt, Pseudomonas putida KT2440
cagccauaguuuugugccacc

SEQ ID NO: 1587264 - RNA, 19 nt, Pseudomonas putida KT2440
cagccaucgagcaccggcu

SEQ ID NO: 1587265 - RNA, 15 nt, Pseudomonas putida KT2440
cagccccagcgccuu

SEQ ID NO: 1587266 - RNA, 13 nt, Pseudomonas putida KT2440
cagccccagcggc

SEQ ID NO: 1587267 - RNA, 14 nt, Pseudomonas putida KT2440
cagccccagugugc

SEQ ID NO: 1587268 - RNA, 20 nt, Pseudomonas putida KT2440
cagccccaucaccagcccga

SEQ ID NO: 1587269 - RNA, 14 nt, Pseudomonas putida KT2440
cagccccgcaugcu

SEQ ID NO: 1587270 - RNA, 16 nt, Pseudomonas putida KT2440
cagccccuagcgcauc

SEQ ID NO: 1587271 - RNA, 12 nt, Pseudomonas putida KT2440
cagcccgaagcc

SEQ ID NO: 1587272 - RNA, 14 nt, Pseudomonas putida KT2440
cagcccgaagccgg

SEQ ID NO: 1587273 - RNA, 20 nt, Pseudomonas putida KT2440
cagcccgaagcgcaggucca

SEQ ID NO: 1587274 - RNA, 17 nt, Pseudomonas putida KT2440
cagccgacugacaggug

SEQ ID NO: 1587275 - RNA, 14 nt, Pseudomonas putida KT2440
cagccgaacuuguc

SEQ ID NO: 1587276 - RNA, 16 nt, Pseudomonas putida KT2440
cagccgaacuugucug

SEQ ID NO: 1587277 - RNA, 14 nt, Pseudomonas putida KT2440
cagcccuucgcagg

SEQ ID NO: 1587278 - RNA, 22 nt, Pseudomonas putida KT2440
cagcccuucgccggcacgcccg

SEQ ID NO: 1587279 - RNA, 16 nt, Pseudomonas putida KT2440
cagcccuuucagggua

SEQ ID NO: 1587280 - RNA, 16 nt, Pseudomonas putida KT2440
cagcccuucgcgggca

SEQ ID NO: 1587281 - RNA, 18 nt, Pseudomonas putida KT2440
cagcccuucgcucaaccg

SEQ ID NO: 1587282 - RNA, 15 nt, Pseudomonas putida KT2440
cagcccuugcucggc

SEQ ID NO: 1587283 - RNA, 20 nt, Pseudomonas putida KT2440
cagcccuugcucggccagcc

SEQ ID NO: 1587284 - RNA, 17 nt, Pseudomonas putida KT2440
cagcccuugcugcagca

SEQ ID NO: 1587285 - RNA, 18 nt, Pseudomonas putida KT2440
cagcccuugcugcagcag

SEQ ID NO: 1587286 - RNA, 19 nt, Pseudomonas putida KT2440
cagcccuugcugcagcagg

SEQ ID NO: 1587287 - RNA, 17 nt, Pseudomonas putida KT2440
cagcccgauaaacacga

SEQ ID NO: 1587288 - RNA, 22 nt, Pseudomonas putida KT2440
cagcaggcgcggcguggccuca

SEQ ID NO: 1587289 - RNA, 20 nt, Pseudomonas putida KT2440
cagcaggcugcgugccugcu

SEQ ID NO: 1587290 - RNA, 22 nt, Pseudomonas putida KT2440
cagcaggcuggcgggguggccg

SEQ ID NO: 1587291 - RNA, 16 nt, Pseudomonas putida KT2440
cagcaggcccggccca

SEQ ID NO: 1587292 - RNA, 14 nt, Pseudomonas putida KT2440
cagcagcgaagggc

SEQ ID NO: 1587293 - RNA, 21 nt, Pseudomonas putida KT2440
cagcagccccccuuccgcgug

SEQ ID NO: 1587294 - RNA, 19 nt, Pseudomonas putida KT2440
cagcagcgcgauaccgacg

SEQ ID NO: 1587295 - RNA, 20 nt, Pseudomonas putida KT2440
cagcaggucggcacgcaccu

SEQ ID NO: 1587296 - RNA, 18 nt, Pseudomonas putida KT2440
cagcaggugcccaagcgg

SEQ ID NO: 1587297 - RNA, 19 nt, Pseudomonas putida KT2440
cagcagguugaacagcagc

SEQ ID NO: 1587298 - RNA, 20 nt, Pseudomonas putida KT2440
cagcagguuggacagcgccc

SEQ ID NO: 1587299 - RNA, 21 nt, Pseudomonas putida KT2440
cagcagguuggacagcgcccg

SEQ ID NO: 1587300 - RNA, 20 nt, Pseudomonas putida KT2440
cagcaguggcaagccgagca

SEQ ID NO: 1587301 - RNA, 18 nt, Pseudomonas putida KT2440
cagcagugccguggcagg

SEQ ID NO: 1587302 - RNA, 16 nt, Pseudomonas putida KT2440
cagcaguucgcagcca

SEQ ID NO: 1587303 - RNA, 14 nt, Pseudomonas putida KT2440
cagcacucguugaa

SEQ ID NO: 1587304 - RNA, 16 nt, Pseudomonas putida KT2440
cagcacuucguccagg

SEQ ID NO: 1587305 - RNA, 13 nt, Pseudomonas putida KT2440
cagcacugccagc

SEQ ID NO: 1587306 - RNA, 14 nt, Pseudomonas putida KT2440
cagcagcaccgggu

SEQ ID NO: 1587307 - RNA, 20 nt, Pseudomonas putida KT2440
cagcaaguugaagaacagug

SEQ ID NO: 1587308 - RNA, 17 nt, Pseudomonas putida KT2440
cagcaagcucaucacca

SEQ ID NO: 1587309 - RNA, 18 nt, Pseudomonas putida KT2440
cagcaagcgcucauaccc

SEQ ID NO: 1587310 - RNA, 12 nt, Pseudomonas putida KT2440
cagcaagccugc

SEQ ID NO: 1587311 - RNA, 21 nt, Pseudomonas putida KT2440
cagcaaggcaauaccgauggc

SEQ ID NO: 1587312 - RNA, 15 nt, Pseudomonas putida KT2440
cagcaaggcauccag

SEQ ID NO: 1587313 - RNA, 17 nt, Pseudomonas putida KT2440
cagcaaggcauccagcg

SEQ ID NO: 1587314 - RNA, 14 nt, Pseudomonas putida KT2440
cagcaacuucucgg

SEQ ID NO: 1587315 - RNA, 18 nt, Pseudomonas putida KT2440
cagcaacaugccggccca

SEQ ID NO: 1587316 - RNA, 22 nt, Pseudomonas putida KT2440
cagcaacaucgcccccgcugca

SEQ ID NO: 1587317 - RNA, 21 nt, Pseudomonas putida KT2440
cagcaacuggugaaucagccc

SEQ ID NO: 1587318 - RNA, 15 nt, Pseudomonas putida KT2440
cagcaauacgcacag

SEQ ID NO: 1587319 - RNA, 21 nt, Pseudomonas putida KT2440
cagcaagucccccaucggcac

SEQ ID NO: 1587320 - RNA, 16 nt, Pseudomonas putida KT2440
cagcacguucagcggg

SEQ ID NO: 1587321 - RNA, 15 nt, Pseudomonas putida KT2440
caucgaucaggucga

SEQ ID NO: 1587322 - RNA, 16 nt, Pseudomonas putida KT2440
caucgaggcguuguac

SEQ ID NO: 1587323 - RNA, 16 nt, Pseudomonas putida KT2440
caucgcauacagcgca

SEQ ID NO: 1587324 - RNA, 17 nt, Pseudomonas putida KT2440
caucgcauacagcgcac

SEQ ID NO: 1587325 - RNA, 15 nt, Pseudomonas putida KT2440
caucgacccgcugcc

SEQ ID NO: 1587326 - RNA, 20 nt, Pseudomonas putida KT2440
caucgacucacgcucguugu

SEQ ID NO: 1587327 - RNA, 22 nt, Pseudomonas putida KT2440
caucgacucacgcucguugucc

SEQ ID NO: 1587328 - RNA, 19 nt, Pseudomonas putida KT2440
caucgccaggccuucaucg

SEQ ID NO: 1587329 - RNA, 16 nt, Pseudomonas putida KT2440
caucgccagcagcgcu

SEQ ID NO: 1587330 - RNA, 17 nt, Pseudomonas putida KT2440
caucgcccccgcugcac

SEQ ID NO: 1587331 - RNA, 23 nt, Pseudomonas putida KT2440
caucgcccucgagugcgcugauc

SEQ ID NO: 1587332 - RNA, 21 nt, Pseudomonas putida KT2440
caucgccgucuugaguuucau

SEQ ID NO: 1587333 - RNA, 14 nt, Pseudomonas putida KT2440
caucgccgggucca

SEQ ID NO: 1587334 - RNA, 17 nt, Pseudomonas putida KT2440
caucgccggguccacca

SEQ ID NO: 1587335 - RNA, 14 nt, Pseudomonas putida KT2440
caucgcggccgaag

SEQ ID NO: 1587336 - RNA, 23 nt, Pseudomonas putida KT2440
caucgcgguauccaucaccauca

SEQ ID NO: 1587337 - RNA, 13 nt, Pseudomonas putida KT2440
caucgcgggccag

SEQ ID NO: 1587338 - RNA, 17 nt, Pseudomonas putida KT2440
caucgcgggccaggugg

SEQ ID NO: 1587339 - RNA, 17 nt, Pseudomonas putida KT2440
caucgcgcacuugccag

SEQ ID NO: 1587340 - RNA, 16 nt, Pseudomonas putida KT2440
caucgccuccagcgca

SEQ ID NO: 1587341 - RNA, 16 nt, Pseudomonas putida KT2440
caucgccgucaucacc

SEQ ID NO: 1587342 - RNA, 21 nt, Pseudomonas putida KT2440
caucggcaaucgccgggcgca

SEQ ID NO: 1587343 - RNA, 22 nt, Pseudomonas putida KT2440
caucgcuguccuuggccaacug

SEQ ID NO: 1587344 - RNA, 12 nt, Pseudomonas putida KT2440
caucgcugacuu

SEQ ID NO: 1587345 - RNA, 19 nt, Pseudomonas putida KT2440
caucgcugcggucaucacc

SEQ ID NO: 1587346 - RNA, 17 nt, Pseudomonas putida KT2440
caucggcaugcagcggc

SEQ ID NO: 1587347 - RNA, 17 nt, Pseudomonas putida KT2440
caucggcaccgacggcg

SEQ ID NO: 1587348 - RNA, 12 nt, Pseudomonas putida KT2440
caucggccucuc

SEQ ID NO: 1587349 - RNA, 21 nt, Pseudomonas putida KT2440
cauagcgccaucgcucaccgu

SEQ ID NO: 1587350 - RNA, 19 nt, Pseudomonas putida KT2440
cauagcgguacagcaccca

SEQ ID NO: 1587351 - RNA, 16 nt, Pseudomonas putida KT2440
cauagaucagcaucgg

SEQ ID NO: 1587352 - RNA, 15 nt, Pseudomonas putida KT2440
cauagaucucgacaa

SEQ ID NO: 1587353 - RNA, 18 nt, Pseudomonas putida KT2440
cauagcguugucgacugc

SEQ ID NO: 1587354 - RNA, 20 nt, Pseudomonas putida KT2440
caucaauacgcuggaucacc

SEQ ID NO: 1587355 - RNA, 14 nt, Pseudomonas putida KT2440
caucacgcuggcca

SEQ ID NO: 1587356 - RNA, 16 nt, Pseudomonas putida KT2440
caucacgaucaugcug

SEQ ID NO: 1587357 - RNA, 21 nt, Pseudomonas putida KT2440
caucacgcgacgggaagugca

SEQ ID NO: 1587358 - RNA, 21 nt, Pseudomonas putida KT2440
caucaccugcuuucaggugcu

SEQ ID NO: 1587359 - RNA, 13 nt, Pseudomonas putida KT2440
caucacgaaaucc

SEQ ID NO: 1587360 - RNA, 22 nt, Pseudomonas putida KT2440
caucagcgggcgauugccaggg

SEQ ID NO: 1587361 - RNA, 23 nt, Pseudomonas putida KT2440
caucagcgggcgauugccagggu

SEQ ID NO: 1587362 - RNA, 17 nt, Pseudomonas putida KT2440
caucagccgcgggcucg

SEQ ID NO: 1587363 - RNA, 22 nt, Pseudomonas putida KT2440
caucagccggucucccagcgcu

SEQ ID NO: 1587364 - RNA, 11 nt, Pseudomonas putida KT2440
caucagccucg

SEQ ID NO: 1587365 - RNA, 13 nt, Pseudomonas putida KT2440
caucagcagcugu

SEQ ID NO: 1587366 - RNA, 15 nt, Pseudomonas putida KT2440
caucagcaagccgcc

SEQ ID NO: 1587367 - RNA, 13 nt, Pseudomonas putida KT2440
caucagcacacgc

SEQ ID NO: 1587368 - RNA, 15 nt, Pseudomonas putida KT2440
caucagcacacgccc

SEQ ID NO: 1587369 - RNA, 15 nt, Pseudomonas putida KT2440
cauccaucaccugcc

SEQ ID NO: 1587370 - RNA, 20 nt, Pseudomonas putida KT2440
cauccagucggcgcuggaca

SEQ ID NO: 1587371 - RNA, 23 nt, Pseudomonas putida KT2440
cauccauccaagugcuaaugcuc

SEQ ID NO: 1587372 - RNA, 15 nt, Pseudomonas putida KT2440
cauccaucgcaaucc

SEQ ID NO: 1587373 - RNA, 17 nt, Pseudomonas putida KT2440
cauccaugcaaucacca

SEQ ID NO: 1587374 - RNA, 17 nt, Pseudomonas putida KT2440
cauccccgccgccagca

SEQ ID NO: 1587375 - RNA, 17 nt, Pseudomonas putida KT2440
cauccagucgaucagcg

SEQ ID NO: 1587376 - RNA, 15 nt, Pseudomonas putida KT2440
cauccaggcuggcca

SEQ ID NO: 1587377 - RNA, 17 nt, Pseudomonas putida KT2440
cauccaggcuggccagc

SEQ ID NO: 1587378 - RNA, 15 nt, Pseudomonas putida KT2440
cauccagcuccagca

SEQ ID NO: 1587379 - RNA, 12 nt, Pseudomonas putida KT2440
cauccagcgccg

SEQ ID NO: 1587380 - RNA, 15 nt, Pseudomonas putida KT2440
cauccagcacugccu

SEQ ID NO: 1587381 - RNA, 12 nt, Pseudomonas putida KT2440
caucaggccgau

SEQ ID NO: 1587382 - RNA, 17 nt, Pseudomonas putida KT2440
caucaggaacagcucga

SEQ ID NO: 1587383 - RNA, 15 nt, Pseudomonas putida KT2440
caucgaagcaggccg

SEQ ID NO: 1587384 - RNA, 15 nt, Pseudomonas putida KT2440
caucgaagcagugcu

SEQ ID NO: 1587385 - RNA, 17 nt, Pseudomonas putida KT2440
caucgaacagcuugcca

SEQ ID NO: 1587386 - RNA, 16 nt, Pseudomonas putida KT2440
cauccuuggugcaugc

SEQ ID NO: 1587387 - RNA, 21 nt, Pseudomonas putida KT2440
cauccggccgacucuucacca

SEQ ID NO: 1587388 - RNA, 19 nt, Pseudomonas putida KT2440
cauccggcgcaucgacggg

SEQ ID NO: 1587389 - RNA, 12 nt, Pseudomonas putida KT2440
cauccgcggcau

SEQ ID NO: 1587390 - RNA, 22 nt, Pseudomonas putida KT2440
caggucgccgcuguucagcccu

SEQ ID NO: 1587391 - RNA, 15 nt, Pseudomonas putida KT2440
caggucgccaggcuu

SEQ ID NO: 1587392 - RNA, 13 nt, Pseudomonas putida KT2440
caggucgccagca

SEQ ID NO: 1587393 - RNA, 14 nt, Pseudomonas putida KT2440
caggucgccagcac

SEQ ID NO: 1587394 - RNA, 15 nt, Pseudomonas putida KT2440
caggucgccagcacc

SEQ ID NO: 1587395 - RNA, 16 nt, Pseudomonas putida KT2440
caggucgccagcacca

SEQ ID NO: 1587396 - RNA, 16 nt, Pseudomonas putida KT2440
cagggcugcaaggugu

SEQ ID NO: 1587397 - RNA, 12 nt, Pseudomonas putida KT2440
caggucgaugcc

SEQ ID NO: 1587398 - RNA, 20 nt, Pseudomonas putida KT2440
caggucgaugauggcugcca

SEQ ID NO: 1587399 - RNA, 20 nt, Pseudomonas putida KT2440
caggucgcgguucgacugcc

SEQ ID NO: 1587400 - RNA, 17 nt, Pseudomonas putida KT2440
caggucggcacgcaccu

SEQ ID NO: 1587401 - RNA, 15 nt, Pseudomonas putida KT2440
caggucggccagcuc

SEQ ID NO: 1587402 - RNA, 12 nt, Pseudomonas putida KT2440
caggucggccag

SEQ ID NO: 1587403 - RNA, 22 nt, Pseudomonas putida KT2440
caggucuucaaaucgcugcgca

SEQ ID NO: 1587404 - RNA, 21 nt, Pseudomonas putida KT2440
caggugaaucagcggcaggcu

SEQ ID NO: 1587405 - RNA, 21 nt, Pseudomonas putida KT2440
caggucggcggggcccggaca

SEQ ID NO: 1587406 - RNA, 23 nt, Pseudomonas putida KT2440
caggucggcggggcccggacagg

SEQ ID NO: 1587407 - RNA, 18 nt, Pseudomonas putida KT2440
cagguguggaaacccgca

SEQ ID NO: 1587408 - RNA, 22 nt, Pseudomonas putida KT2440
cagguguggcucagcucggcau

SEQ ID NO: 1587409 - RNA, 13 nt, Pseudomonas putida KT2440
cagguggaucagc

SEQ ID NO: 1587410 - RNA, 19 nt, Pseudomonas putida KT2440
cagguggaucagccgcgcu

SEQ ID NO: 1587411 - RNA, 17 nt, Pseudomonas putida KT2440
cagguguuccagcacgu

SEQ ID NO: 1587412 - RNA, 18 nt, Pseudomonas putida KT2440
cagguuccccccacgcac

SEQ ID NO: 1587413 - RNA, 13 nt, Pseudomonas putida KT2440
cagguucgaccac

SEQ ID NO: 1587414 - RNA, 18 nt, Pseudomonas putida KT2440
cagguucgaccacugcag

SEQ ID NO: 1587415 - RNA, 22 nt, Pseudomonas putida KT2440
cagguucgaccacugcaggugc

SEQ ID NO: 1587416 - RNA, 23 nt, Pseudomonas putida KT2440
cagguucgaccacugcaggugca

SEQ ID NO: 1587417 - RNA, 21 nt, Pseudomonas putida KT2440
cagguucucgcuccaguggug

SEQ ID NO: 1587418 - RNA, 18 nt, Pseudomonas putida KT2440
cagguucggcucacugac

SEQ ID NO: 1587419 - RNA, 18 nt, Pseudomonas putida KT2440
cagguucgguaaugcccg

SEQ ID NO: 1587420 - RNA, 20 nt, Pseudomonas putida KT2440
caggugaucgccacaacggc

SEQ ID NO: 1587421 - RNA, 19 nt, Pseudomonas putida KT2440
caggugcgcgcgcgacagc

SEQ ID NO: 1587422 - RNA, 20 nt, Pseudomonas putida KT2440
caggugcgcgcgcgacagca

SEQ ID NO: 1587423 - RNA, 17 nt, Pseudomonas putida KT2440
cagguggaagcgcgcau

SEQ ID NO: 1587424 - RNA, 13 nt, Pseudomonas putida KT2440
cagguugcaccuc

SEQ ID NO: 1587425 - RNA, 15 nt, Pseudomonas putida KT2440
cagguugauccagcc

SEQ ID NO: 1587426 - RNA, 14 nt, Pseudomonas putida KT2440
cagguugaacagca

SEQ ID NO: 1587427 - RNA, 20 nt, Pseudomonas putida KT2440
cagguugaacagcagcgccg

SEQ ID NO: 1587428 - RNA, 12 nt, Pseudomonas putida KT2440
caguaucgcccc

SEQ ID NO: 1587429 - RNA, 17 nt, Pseudomonas putida KT2440
caguaguucucgacagc

SEQ ID NO: 1587430 - RNA, 18 nt, Pseudomonas putida KT2440
caguaguucucgacagcc

SEQ ID NO: 1587431 - RNA, 19 nt, Pseudomonas putida KT2440
cagucacccaccggcucca

SEQ ID NO: 1587432 - RNA, 15 nt, Pseudomonas putida KT2440
cagucaccuggccca

SEQ ID NO: 1587433 - RNA, 12 nt, Pseudomonas putida KT2440
cagucagcgccg

SEQ ID NO: 1587434 - RNA, 14 nt, Pseudomonas putida KT2440
cagucagcgccgau

SEQ ID NO: 1587435 - RNA, 15 nt, Pseudomonas putida KT2440
cagucgagucgacag

SEQ ID NO: 1587436 - RNA, 12 nt, Pseudomonas putida KT2440
cagucgaagucu

SEQ ID NO: 1587437 - RNA, 19 nt, Pseudomonas putida KT2440
cagucgaaggggaucagca

SEQ ID NO: 1587438 - RNA, 20 nt, Pseudomonas putida KT2440
caguccugcaacucggccuu

SEQ ID NO: 1587439 - RNA, 19 nt, Pseudomonas putida KT2440
caguccgucucuucagccg

SEQ ID NO: 1587440 - RNA, 16 nt, Pseudomonas putida KT2440
cagucgcacaggucca

SEQ ID NO: 1587441 - RNA, 13 nt, Pseudomonas putida KT2440
cagucucuuucaa

SEQ ID NO: 1587442 - RNA, 18 nt, Pseudomonas putida KT2440
cagugaacuccaacgccg

SEQ ID NO: 1587443 - RNA, 21 nt, Pseudomonas putida KT2440
cagugaacuccaacgccggca

SEQ ID NO: 1587444 - RNA, 23 nt, Pseudomonas putida KT2440
cagucuucaagcucgaagcgcuc

SEQ ID NO: 1587445 - RNA, 20 nt, Pseudomonas putida KT2440
caguucguccaccgacggcg

SEQ ID NO: 1587446 - RNA, 17 nt, Pseudomonas putida KT2440
caguucguccucgaccc

SEQ ID NO: 1587447 - RNA, 16 nt, Pseudomonas putida KT2440
caguucgucgagcauc

SEQ ID NO: 1587448 - RNA, 21 nt, Pseudomonas putida KT2440
caguucgguaaucugcuugcc

SEQ ID NO: 1587449 - RNA, 19 nt, Pseudomonas putida KT2440
cauaaaccccagccuucag

SEQ ID NO: 1587450 - RNA, 16 nt, Pseudomonas putida KT2440
cauacgcaucagcgca

SEQ ID NO: 1587451 - RNA, 21 nt, Pseudomonas putida KT2440
cauacagccagaaagccacug

SEQ ID NO: 1587452 - RNA, 13 nt, Pseudomonas putida KT2440
cauacaccccgcg

SEQ ID NO: 1587453 - RNA, 16 nt, Pseudomonas putida KT2440
cagugcaucgaagcag

SEQ ID NO: 1587454 - RNA, 20 nt, Pseudomonas putida KT2440
cagugccaugaacaccaccg

SEQ ID NO: 1587455 - RNA, 23 nt, Pseudomonas putida KT2440
cagugccaugaacaccaccgcga

SEQ ID NO: 1587456 - RNA, 15 nt, Pseudomonas putida KT2440
cagugccauguaguu

SEQ ID NO: 1587457 - RNA, 16 nt, Pseudomonas putida KT2440
cagugcggucaggcca

SEQ ID NO: 1587458 - RNA, 17 nt, Pseudomonas putida KT2440
cagugccgccaccuggc

SEQ ID NO: 1587459 - RNA, 22 nt, Pseudomonas putida KT2440
cagugaagcuuccaguuggccg

SEQ ID NO: 1587460 - RNA, 16 nt, Pseudomonas putida KT2440
cagugaugcuugcgcg

SEQ ID NO: 1587461 - RNA, 15 nt, Pseudomonas putida KT2440
cagugaucuggcgca

SEQ ID NO: 1587462 - RNA, 21 nt, Pseudomonas putida KT2440
cagugaggucgggaauugcag

SEQ ID NO: 1587463 - RNA, 23 nt, Pseudomonas putida KT2440
cagugaccgguuuuggcaggccg

SEQ ID NO: 1587464 - RNA, 13 nt, Pseudomonas putida KT2440
cagugcaggucua

SEQ ID NO: 1587465 - RNA, 12 nt, Pseudomonas putida KT2440
cagugaugccgu

SEQ ID NO: 1587466 - RNA, 16 nt, Pseudomonas putida KT2440
cagugucagcggcgca

SEQ ID NO: 1587467 - RNA, 16 nt, Pseudomonas putida KT2440
cagugucugcgccugc

SEQ ID NO: 1587468 - RNA, 17 nt, Pseudomonas putida KT2440
cagugucugcgccugcu

SEQ ID NO: 1587469 - RNA, 18 nt, Pseudomonas putida KT2440
caguguggugcggcuggg

SEQ ID NO: 1587470 - RNA, 13 nt, Pseudomonas putida KT2440
cagugcgugcagu

SEQ ID NO: 1587471 - RNA, 23 nt, Pseudomonas putida KT2440
cagugcugccugcugcagcucga

SEQ ID NO: 1587472 - RNA, 22 nt, Pseudomonas putida KT2440
caguggcacccacagcgccugc

SEQ ID NO: 1587473 - RNA, 20 nt, Pseudomonas putida KT2440
caguggcacuggcgcgaugc

SEQ ID NO: 1587474 - RNA, 17 nt, Pseudomonas putida KT2440
caguggcagguucgacc

SEQ ID NO: 1587475 - RNA, 23 nt, Pseudomonas putida KT2440
cagugcgucggccaccaccgggu

SEQ ID NO: 1587476 - RNA, 20 nt, Pseudomonas putida KT2440
cagugcuucacugccggcaa

SEQ ID NO: 1587477 - RNA, 22 nt, Pseudomonas putida KT2440
caguggaaacgacaagguagcg

SEQ ID NO: 1587478 - RNA, 20 nt, Pseudomonas putida KT2440
caguggaccucuggcgugca

SEQ ID NO: 1587479 - RNA, 17 nt, Pseudomonas putida KT2440
caguucgcccuucagca

SEQ ID NO: 1587480 - RNA, 21 nt, Pseudomonas putida KT2440
caguucgccacccgacgccac

SEQ ID NO: 1587481 - RNA, 14 nt, Pseudomonas putida KT2440
caguucgcgcacca

SEQ ID NO: 1587482 - RNA, 17 nt, Pseudomonas putida KT2440
caguucgcggcgcaccg

SEQ ID NO: 1587483 - RNA, 19 nt, Pseudomonas putida KT2440
caguucgcgggcaaaugcg

SEQ ID NO: 1587484 - RNA, 23 nt, Pseudomonas putida KT2440
caguucgcugcgcaaggcauuca

SEQ ID NO: 1587485 - RNA, 17 nt, Pseudomonas putida KT2440
caguucggacaggcgcu

SEQ ID NO: 1587486 - RNA, 17 nt, Pseudomonas putida KT2440
caguucgcgugccaccu

SEQ ID NO: 1587487 - RNA, 23 nt, Pseudomonas putida KT2440
caguucgauguaggcagcugccu

SEQ ID NO: 1587488 - RNA, 17 nt, Pseudomonas putida KT2440
caguucgcacagcucga

SEQ ID NO: 1587489 - RNA, 14 nt, Pseudomonas putida KT2440
caguucgcagccau

SEQ ID NO: 1587490 - RNA, 14 nt, Pseudomonas putida KT2440
caguucgagcgccu

SEQ ID NO: 1587491 - RNA, 20 nt, Pseudomonas putida KT2440
caguucgacgccuucgaaca

SEQ ID NO: 1587492 - RNA, 17 nt, Pseudomonas putida KT2440
caguucgacgcugcugu

SEQ ID NO: 1587493 - RNA, 22 nt, Pseudomonas putida KT2440
caguuccuugagcacccccggu

SEQ ID NO: 1587494 - RNA, 19 nt, Pseudomonas putida KT2440
caguuacccuguacccgcu

SEQ ID NO: 1587495 - RNA, 17 nt, Pseudomonas putida KT2440
cagcucgaucucccgcg

SEQ ID NO: 1587496 - RNA, 20 nt, Pseudomonas putida KT2440
cagcucgaucucccgcgaac

SEQ ID NO: 1587497 - RNA, 13 nt, Pseudomonas putida KT2440
cagcucgaucagg

SEQ ID NO: 1587498 - RNA, 15 nt, Pseudomonas putida KT2440
cagcucgaucagugc

SEQ ID NO: 1587499 - RNA, 20 nt, Pseudomonas putida KT2440
cagcucgaaguaggcauucg

SEQ ID NO: 1587500 - RNA, 17 nt, Pseudomonas putida KT2440
cagcucgccaacaccgc

SEQ ID NO: 1587501 - RNA, 14 nt, Pseudomonas putida KT2440
cagcucggcacugu

SEQ ID NO: 1587502 - RNA, 18 nt, Pseudomonas putida KT2440
cagcucgcgcugccaggc

SEQ ID NO: 1587503 - RNA, 18 nt, Pseudomonas putida KT2440
cagcucgcgcggguaaau

SEQ ID NO: 1587504 - RNA, 18 nt, Pseudomonas putida KT2440
cagcucggccgaugccag

SEQ ID NO: 1587505 - RNA, 17 nt, Pseudomonas putida KT2440
cagcucggccacccgcg

SEQ ID NO: 1587506 - RNA, 22 nt, Pseudomonas putida KT2440
cagcuccaccaguugguaaaac

SEQ ID NO: 1587507 - RNA, 18 nt, Pseudomonas putida KT2440
cagcuccacacucgacgc

SEQ ID NO: 1587508 - RNA, 20 nt, Pseudomonas putida KT2440
cagcuccacacucgacgcug

SEQ ID NO: 1587509 - RNA, 20 nt, Pseudomonas putida KT2440
cagcuacgcgagucaacaau

SEQ ID NO: 1587510 - RNA, 14 nt, Pseudomonas putida KT2440
cagcucccgagcca

SEQ ID NO: 1587511 - RNA, 20 nt, Pseudomonas putida KT2440
cagcucccgagccaggaaga

SEQ ID NO: 1587512 - RNA, 13 nt, Pseudomonas putida KT2440
cagcguuccuggg

SEQ ID NO: 1587513 - RNA, 17 nt, Pseudomonas putida KT2440
cagcguugccgaugacc

SEQ ID NO: 1587514 - RNA, 15 nt, Pseudomonas putida KT2440
cagcguugcuggcga

SEQ ID NO: 1587515 - RNA, 17 nt, Pseudomonas putida KT2440
cagcgggcccagcaggu

SEQ ID NO: 1587516 - RNA, 17 nt, Pseudomonas putida KT2440
cagcgggcguaccuggc

SEQ ID NO: 1587517 - RNA, 17 nt, Pseudomonas putida KT2440
cagcgggcucgcccaca

SEQ ID NO: 1587518 - RNA, 13 nt, Pseudomonas putida KT2440
cagcgcgccagca

SEQ ID NO: 1587519 - RNA, 18 nt, Pseudomonas putida KT2440
cagcgcgccagcaggucc

SEQ ID NO: 1587520 - RNA, 19 nt, Pseudomonas putida KT2440
cagcgcgccagcaggucca

SEQ ID NO: 1587521 - RNA, 20 nt, Pseudomonas putida KT2440
cagcgggagucgaaccugcc

SEQ ID NO: 1587522 - RNA, 13 nt, Pseudomonas putida KT2440
cagcgcgccgaac

SEQ ID NO: 1587523 - RNA, 19 nt, Pseudomonas putida KT2440
cagcguauagccaccgggc

SEQ ID NO: 1587524 - RNA, 18 nt, Pseudomonas putida KT2440
cagcgucuuguuguccgg

SEQ ID NO: 1587525 - RNA, 14 nt, Pseudomonas putida KT2440
cagcgguucgacca

SEQ ID NO: 1587526 - RNA, 16 nt, Pseudomonas putida KT2440
cagcgguucgaccgac

SEQ ID NO: 1587527 - RNA, 15 nt, Pseudomonas putida KT2440
cagcguaagcuggcu

SEQ ID NO: 1587528 - RNA, 16 nt, Pseudomonas putida KT2440
cagcguacgcaugguc

SEQ ID NO: 1587529 - RNA, 14 nt, Pseudomonas putida KT2440
caggaccaggccga

SEQ ID NO: 1587530 - RNA, 18 nt, Pseudomonas putida KT2440
cagcuuggcaggcuucau

SEQ ID NO: 1587531 - RNA, 21 nt, Pseudomonas putida KT2440
caggaaggcgucguacaggcc

SEQ ID NO: 1587532 - RNA, 17 nt, Pseudomonas putida KT2440
caggaagucgauguuca

SEQ ID NO: 1587533 - RNA, 21 nt, Pseudomonas putida KT2440
caggaagucgauguucagcac

SEQ ID NO: 1587534 - RNA, 23 nt, Pseudomonas putida KT2440
caggaaggcaccacggaaggcca

SEQ ID NO: 1587535 - RNA, 18 nt, Pseudomonas putida KT2440
caggaagcuguacagcgc

SEQ ID NO: 1587536 - RNA, 20 nt, Pseudomonas putida KT2440
caggaagcuguacagcgcau

SEQ ID NO: 1587537 - RNA, 14 nt, Pseudomonas putida KT2440
caggauuggccgca

SEQ ID NO: 1587538 - RNA, 18 nt, Pseudomonas putida KT2440
caggauugccgcagcugc

SEQ ID NO: 1587539 - RNA, 21 nt, Pseudomonas putida KT2440
caggauugccgcagcugcggu

SEQ ID NO: 1587540 - RNA, 20 nt, Pseudomonas putida KT2440
caggcaauaaaaaaccggcg

SEQ ID NO: 1587541 - RNA, 14 nt, Pseudomonas putida KT2440
caggcacagcacgg

SEQ ID NO: 1587542 - RNA, 14 nt, Pseudomonas putida KT2440
caggagggcuggug

SEQ ID NO: 1587543 - RNA, 13 nt, Pseudomonas putida KT2440
caggagggccgua

SEQ ID NO: 1587544 - RNA, 20 nt, Pseudomonas putida KT2440
caggagcggguucacccgcg

SEQ ID NO: 1587545 - RNA, 15 nt, Pseudomonas putida KT2440
caggauauugccgac

SEQ ID NO: 1587546 - RNA, 16 nt, Pseudomonas putida KT2440
caggauauugccgacu

SEQ ID NO: 1587547 - RNA, 22 nt, Pseudomonas putida KT2440
caggauauugccgacuccaacg

SEQ ID NO: 1587548 - RNA, 17 nt, Pseudomonas putida KT2440
caggauggugacugcca

SEQ ID NO: 1587549 - RNA, 16 nt, Pseudomonas putida KT2440
cagcucgucgagcaac

SEQ ID NO: 1587550 - RNA, 15 nt, Pseudomonas putida KT2440
cagcucuggucaccu

SEQ ID NO: 1587551 - RNA, 17 nt, Pseudomonas putida KT2440
cagcucuugucgacagu

SEQ ID NO: 1587552 - RNA, 12 nt, Pseudomonas putida KT2440
cagcugaucgcc

SEQ ID NO: 1587553 - RNA, 17 nt, Pseudomonas putida KT2440
cagcugagcgccaucca

SEQ ID NO: 1587554 - RNA, 22 nt, Pseudomonas putida KT2440
cagcugccauuucuucagcagg

SEQ ID NO: 1587555 - RNA, 16 nt, Pseudomonas putida KT2440
cagcugcauuggcggc

SEQ ID NO: 1587556 - RNA, 21 nt, Pseudomonas putida KT2440
cagcugcucguacgaguugcc

SEQ ID NO: 1587557 - RNA, 20 nt, Pseudomonas putida KT2440
cagcugcugucgagcaucca

SEQ ID NO: 1587558 - RNA, 22 nt, Pseudomonas putida KT2440
cagcuggccaucgacccgcugc

SEQ ID NO: 1587559 - RNA, 12 nt, Pseudomonas putida KT2440
cagcuggccuuc

SEQ ID NO: 1587560 - RNA, 18 nt, Pseudomonas putida KT2440
cagcuggccuugcggcaa

SEQ ID NO: 1587561 - RNA, 20 nt, Pseudomonas putida KT2440
cagcuugccgaucagcgagu

SEQ ID NO: 1587562 - RNA, 23 nt, Pseudomonas putida KT2440
cagcuugccaccaucgaccuggc

SEQ ID NO: 1587563 - RNA, 21 nt, Pseudomonas putida KT2440
cagcuugaggucgccaggggu

SEQ ID NO: 1587564 - RNA, 13 nt, Pseudomonas putida KT2440
caggcugagcaga

SEQ ID NO: 1587565 - RNA, 22 nt, Pseudomonas putida KT2440
caggcuggcgggguggccggca

SEQ ID NO: 1587566 - RNA, 14 nt, Pseudomonas putida KT2440
caggcuggccagca

SEQ ID NO: 1587567 - RNA, 15 nt, Pseudomonas putida KT2440
caggcuggccagcaa

SEQ ID NO: 1587568 - RNA, 13 nt, Pseudomonas putida KT2440
caggcucagggca

SEQ ID NO: 1587569 - RNA, 18 nt, Pseudomonas putida KT2440
caggcucagcuccaugcg

SEQ ID NO: 1587570 - RNA, 16 nt, Pseudomonas putida KT2440
caggcuaucggcuccc

SEQ ID NO: 1587571 - RNA, 18 nt, Pseudomonas putida KT2440
caggcuaugccggucagc

SEQ ID NO: 1587572 - RNA, 20 nt, Pseudomonas putida KT2440
caggcuagccggucaccgac

SEQ ID NO: 1587573 - RNA, 18 nt, Pseudomonas putida KT2440
caggcucaucuaccagcu

SEQ ID NO: 1587574 - RNA, 16 nt, Pseudomonas putida KT2440
caggcucgacggcgca

SEQ ID NO: 1587575 - RNA, 13 nt, Pseudomonas putida KT2440
caggcucggccac

SEQ ID NO: 1587576 - RNA, 21 nt, Pseudomonas putida KT2440
caggcucugaaugucagcgcu

SEQ ID NO: 1587577 - RNA, 20 nt, Pseudomonas putida KT2440
caggcucugcuccagcugcu

SEQ ID NO: 1587578 - RNA, 20 nt, Pseudomonas putida KT2440
caggcucuccucaucgaugc

SEQ ID NO: 1587579 - RNA, 15 nt, Pseudomonas putida KT2440
caggcucuugaacug

SEQ ID NO: 1587580 - RNA, 21 nt, Pseudomonas putida KT2440
caggcucuugaacugggcauc

SEQ ID NO: 1587581 - RNA, 16 nt, Pseudomonas putida KT2440
caggcguucgucaagc

SEQ ID NO: 1587582 - RNA, 18 nt, Pseudomonas putida KT2440
caggcuaauggcgcgccu

SEQ ID NO: 1587583 - RNA, 21 nt, Pseudomonas putida KT2440
caggcguuuuuccaugcguuc

SEQ ID NO: 1587584 - RNA, 22 nt, Pseudomonas putida KT2440
caggcguuuuuccaugcguucg

SEQ ID NO: 1587585 - RNA, 21 nt, Pseudomonas putida KT2440
caggcuaaagugccuugauca

SEQ ID NO: 1587586 - RNA, 17 nt, Pseudomonas putida KT2440
caggcggugcacggccu

SEQ ID NO: 1587587 - RNA, 20 nt, Pseudomonas putida KT2440
caggcggugcacggccugca

SEQ ID NO: 1587588 - RNA, 14 nt, Pseudomonas putida KT2440
caggcggucgccca

SEQ ID NO: 1587589 - RNA, 23 nt, Pseudomonas putida KT2440
caggcgguuguagaucgccggca

SEQ ID NO: 1587590 - RNA, 21 nt, Pseudomonas putida KT2440
caggcguaacucagcaacgcu

SEQ ID NO: 1587591 - RNA, 15 nt, Pseudomonas putida KT2440
cagggcacgccaauc

SEQ ID NO: 1587592 - RNA, 15 nt, Pseudomonas putida KT2440
cagggcaaucgccaa

SEQ ID NO: 1587593 - RNA, 19 nt, Pseudomonas putida KT2440
cagggcacacuucgccgug

SEQ ID NO: 1587594 - RNA, 22 nt, Pseudomonas putida KT2440
cagggcaccaguugcaggucgg

SEQ ID NO: 1587595 - RNA, 12 nt, Pseudomonas putida KT2440
cagggcagguca

SEQ ID NO: 1587596 - RNA, 17 nt, Pseudomonas putida KT2440
cagggcguugggcacga

SEQ ID NO: 1587597 - RNA, 22 nt, Pseudomonas putida KT2440
cagggccuuuucauauggcucg

SEQ ID NO: 1587598 - RNA, 13 nt, Pseudomonas putida KT2440
cagggaucgaugc

SEQ ID NO: 1587599 - RNA, 23 nt, Pseudomonas putida KT2440
cagggauuccuuggucaggucga

SEQ ID NO: 1587600 - RNA, 23 nt, Pseudomonas putida KT2440
cagggcaaacaccuugccccgca

SEQ ID NO: 1587601 - RNA, 15 nt, Pseudomonas putida KT2440
caggcuuugcugcag

SEQ ID NO: 1587602 - RNA, 18 nt, Pseudomonas putida KT2440
cagggaagguggccggca

SEQ ID NO: 1587603 - RNA, 15 nt, Pseudomonas putida KT2440
cagggaacugcgcga

SEQ ID NO: 1587604 - RNA, 20 nt, Pseudomonas putida KT2440
caggcuuuccagguccugcu

SEQ ID NO: 1587605 - RNA, 23 nt, Pseudomonas putida KT2440
caggcuuucggccacccggacca

SEQ ID NO: 1587606 - RNA, 19 nt, Pseudomonas putida KT2440
caggcuugaagcugcgcuc

SEQ ID NO: 1587607 - RNA, 15 nt, Pseudomonas putida KT2440
caggcuugccagcuu

SEQ ID NO: 1587608 - RNA, 19 nt, Pseudomonas putida KT2440
caggcuuggcgugcggcgu

SEQ ID NO: 1587609 - RNA, 22 nt, Pseudomonas putida KT2440
caggcuuguccuugagcgccgc

SEQ ID NO: 1587610 - RNA, 15 nt, Pseudomonas putida KT2440
caggcuucaaggcca

SEQ ID NO: 1587611 - RNA, 22 nt, Pseudomonas putida KT2440
caggcaccgaguaccgucggca

SEQ ID NO: 1587612 - RNA, 13 nt, Pseudomonas putida KT2440
caggcacaggcca

SEQ ID NO: 1587613 - RNA, 16 nt, Pseudomonas putida KT2440
caggcacaggccagcc

SEQ ID NO: 1587614 - RNA, 14 nt, Pseudomonas putida KT2440
caggcacaggcgca

SEQ ID NO: 1587615 - RNA, 14 nt, Pseudomonas putida KT2440
caggcccagcaggu

SEQ ID NO: 1587616 - RNA, 21 nt, Pseudomonas putida KT2440
caggcccagcagguacagcac

SEQ ID NO: 1587617 - RNA, 14 nt, Pseudomonas putida KT2440
caggcccagcauga

SEQ ID NO: 1587618 - RNA, 20 nt, Pseudomonas putida KT2440
caggccccgauacagcgcgc

SEQ ID NO: 1587619 - RNA, 23 nt, Pseudomonas putida KT2440
caggcccauuucgcgggucaggg

SEQ ID NO: 1587620 - RNA, 18 nt, Pseudomonas putida KT2440
caggcccugacgccagcg

SEQ ID NO: 1587621 - RNA, 16 nt, Pseudomonas putida KT2440
caggcccgccagagca

SEQ ID NO: 1587622 - RNA, 13 nt, Pseudomonas putida KT2440
caggcccggccca

SEQ ID NO: 1587623 - RNA, 21 nt, Pseudomonas putida KT2440
caggcccggcccuuucgcggg

SEQ ID NO: 1587624 - RNA, 15 nt, Pseudomonas putida KT2440
caggcgccgccagcu

SEQ ID NO: 1587625 - RNA, 14 nt, Pseudomonas putida KT2440
caggcgcccugcgc

SEQ ID NO: 1587626 - RNA, 19 nt, Pseudomonas putida KT2440
caggcgaucguugguccgc

SEQ ID NO: 1587627 - RNA, 21 nt, Pseudomonas putida KT2440
caggcgacggaacggccgcac

SEQ ID NO: 1587628 - RNA, 20 nt, Pseudomonas putida KT2440
caggcgaccgguggcgccuu

SEQ ID NO: 1587629 - RNA, 20 nt, Pseudomonas putida KT2440
caggcgacgagccaguucga

SEQ ID NO: 1587630 - RNA, 21 nt, Pseudomonas putida KT2440
caggccguuguaggagcgggu

SEQ ID NO: 1587631 - RNA, 17 nt, Pseudomonas putida KT2440
caggccguugaucagcg

SEQ ID NO: 1587632 - RNA, 18 nt, Pseudomonas putida KT2440
caggccguugaucagcga

SEQ ID NO: 1587633 - RNA, 19 nt, Pseudomonas putida KT2440
caggccguugaucagcgac

SEQ ID NO: 1587634 - RNA, 19 nt, Pseudomonas putida KT2440
caggccgguugcuccagcg

SEQ ID NO: 1587635 - RNA, 22 nt, Pseudomonas putida KT2440
caggccguaguaggagcggguu

SEQ ID NO: 1587636 - RNA, 14 nt, Pseudomonas putida KT2440
caggcgcucacccc

SEQ ID NO: 1587637 - RNA, 23 nt, Pseudomonas putida KT2440
caggcgcuugacccggugcaccc

SEQ ID NO: 1587638 - RNA, 13 nt, Pseudomonas putida KT2440
caggcgcuugccc

SEQ ID NO: 1587639 - RNA, 16 nt, Pseudomonas putida KT2440
caggcgcuugcccgcc

SEQ ID NO: 1587640 - RNA, 18 nt, Pseudomonas putida KT2440
caggcgcuccagcagggu

SEQ ID NO: 1587641 - RNA, 18 nt, Pseudomonas putida KT2440
caggcgcuccaucaugcg

SEQ ID NO: 1587642 - RNA, 22 nt, Pseudomonas putida KT2440
caggcggauguucuugaccuug

SEQ ID NO: 1587643 - RNA, 13 nt, Pseudomonas putida KT2440
caggcggccagcc

SEQ ID NO: 1587644 - RNA, 12 nt, Pseudomonas putida KT2440
caggcggccagc

SEQ ID NO: 1587645 - RNA, 14 nt, Pseudomonas putida KT2440
caggcggcgacaac

SEQ ID NO: 1587646 - RNA, 19 nt, Pseudomonas putida KT2440
ccaccgaccgcaccggcca

SEQ ID NO: 1587647 - RNA, 23 nt, Pseudomonas putida KT2440
ccaccgacauuguaggcggcaag

SEQ ID NO: 1587648 - RNA, 12 nt, Pseudomonas putida KT2440
ccaccgaaggcg

SEQ ID NO: 1587649 - RNA, 15 nt, Pseudomonas putida KT2440
ccacccuggcaugcc

SEQ ID NO: 1587650 - RNA, 22 nt, Pseudomonas putida KT2440
ccacccugucguuauccugcag

SEQ ID NO: 1587651 - RNA, 17 nt, Pseudomonas putida KT2440
ccaccgaucucgccagc

SEQ ID NO: 1587652 - RNA, 17 nt, Pseudomonas putida KT2440
ccacccugaugcagcag

SEQ ID NO: 1587653 - RNA, 22 nt, Pseudomonas putida KT2440
ccacccugaugcagcagugcca

SEQ ID NO: 1587654 - RNA, 15 nt, Pseudomonas putida KT2440
ccacccggaccagcg

SEQ ID NO: 1587655 - RNA, 16 nt, Pseudomonas putida KT2440
ccacccggaccagcgc

SEQ ID NO: 1587656 - RNA, 17 nt, Pseudomonas putida KT2440
ccacccggaccagcgcc

SEQ ID NO: 1587657 - RNA, 19 nt, Pseudomonas putida KT2440
ccaccaggaacaucgccgu

SEQ ID NO: 1587658 - RNA, 21 nt, Pseudomonas putida KT2440
ccaccagcugcaccaccugcu

SEQ ID NO: 1587659 - RNA, 14 nt, Pseudomonas putida KT2440
ccaccccaggccac

SEQ ID NO: 1587660 - RNA, 14 nt, Pseudomonas putida KT2440
ccacccaggcccug

SEQ ID NO: 1587661 - RNA, 14 nt, Pseudomonas putida KT2440
ccacccccagcgac

SEQ ID NO: 1587662 - RNA, 15 nt, Pseudomonas putida KT2440
ccacccccagcgacc

SEQ ID NO: 1587663 - RNA, 18 nt, Pseudomonas putida KT2440
ccacccccagcgccucca

SEQ ID NO: 1587664 - RNA, 19 nt, Pseudomonas putida KT2440
ccaccgcguuggccagguc

SEQ ID NO: 1587665 - RNA, 20 nt, Pseudomonas putida KT2440
ccaccgcguacagcugcuca

SEQ ID NO: 1587666 - RNA, 23 nt, Pseudomonas putida KT2440
ccaccgggauggcggcgccugcc

SEQ ID NO: 1587667 - RNA, 13 nt, Pseudomonas putida KT2440
ccaccgcgcaacg

SEQ ID NO: 1587668 - RNA, 16 nt, Pseudomonas putida KT2440
ccaccgcgccagccug

SEQ ID NO: 1587669 - RNA, 15 nt, Pseudomonas putida KT2440
ccaccgcgcgccagu

SEQ ID NO: 1587670 - RNA, 12 nt, Pseudomonas putida KT2440
ccaccgcagguc

SEQ ID NO: 1587671 - RNA, 14 nt, Pseudomonas putida KT2440
ccaccgcaggugca

SEQ ID NO: 1587672 - RNA, 23 nt, Pseudomonas putida KT2440
ccaccgcauacacaucggucggc

SEQ ID NO: 1587673 - RNA, 13 nt, Pseudomonas putida KT2440
ccaccgccgggug

SEQ ID NO: 1587674 - RNA, 15 nt, Pseudomonas putida KT2440
ccacacggcaagcca

SEQ ID NO: 1587675 - RNA, 21 nt, Pseudomonas putida KT2440
ccacagcagucuugugcugcg

SEQ ID NO: 1587676 - RNA, 19 nt, Pseudomonas putida KT2440
ccacagccaugccggcaac

SEQ ID NO: 1587677 - RNA, 15 nt, Pseudomonas putida KT2440
ccacacgcugcugcg

SEQ ID NO: 1587678 - RNA, 14 nt, Pseudomonas putida KT2440
ccacacgggcguuc

SEQ ID NO: 1587679 - RNA, 14 nt, Pseudomonas putida KT2440
ccacagcgggucga

SEQ ID NO: 1587680 - RNA, 18 nt, Pseudomonas putida KT2440
ccacagcggccacagcgc

SEQ ID NO: 1587681 - RNA, 20 nt, Pseudomonas putida KT2440
ccacagcggccacagcgcca

SEQ ID NO: 1587682 - RNA, 21 nt, Pseudomonas putida KT2440
ccacagcggccacagcgccaa

SEQ ID NO: 1587683 - RNA, 14 nt, Pseudomonas putida KT2440
ccacagcgccugcu

SEQ ID NO: 1587684 - RNA, 14 nt, Pseudomonas putida KT2440
ccacaggcacaggc

SEQ ID NO: 1587685 - RNA, 18 nt, Pseudomonas putida KT2440
ccacagcugcgccagccg

SEQ ID NO: 1587686 - RNA, 18 nt, Pseudomonas putida KT2440
ccacagguuuagcgcugg

SEQ ID NO: 1587687 - RNA, 15 nt, Pseudomonas putida KT2440
ccacagguccagcgc

SEQ ID NO: 1587688 - RNA, 15 nt, Pseudomonas putida KT2440
ccacaggugcagcac

SEQ ID NO: 1587689 - RNA, 18 nt, Pseudomonas putida KT2440
ccacagguaaugcacaag

SEQ ID NO: 1587690 - RNA, 14 nt, Pseudomonas putida KT2440
ccacagguaccagg

SEQ ID NO: 1587691 - RNA, 16 nt, Pseudomonas putida KT2440
ccacagguaccaggcu

SEQ ID NO: 1587692 - RNA, 20 nt, Pseudomonas putida KT2440
ccacagguacugagucggcc

SEQ ID NO: 1587693 - RNA, 16 nt, Pseudomonas putida KT2440
ccacagguacugcgca

SEQ ID NO: 1587694 - RNA, 21 nt, Pseudomonas putida KT2440
ccaccaccagcgcccuucacg

SEQ ID NO: 1587695 - RNA, 21 nt, Pseudomonas putida KT2440
ccacagugcuuccagcaggac

SEQ ID NO: 1587696 - RNA, 20 nt, Pseudomonas putida KT2440
ccaccacgguacuuggcgcu

SEQ ID NO: 1587697 - RNA, 14 nt, Pseudomonas putida KT2440
ccacaguugcggga

SEQ ID NO: 1587698 - RNA, 11 nt, Pseudomonas putida KT2440
ccaaucgccgc

SEQ ID NO: 1587699 - RNA, 16 nt, Pseudomonas putida KT2440
ccaaucuccacccgcc

SEQ ID NO: 1587700 - RNA, 22 nt, Pseudomonas putida KT2440
ccaaucucgggguguagcgcag

SEQ ID NO: 1587701 - RNA, 14 nt, Pseudomonas putida KT2440
ccaauuacuuggcc

SEQ ID NO: 1587702 - RNA, 12 nt, Pseudomonas putida KT2440
ccaauugcgcca

SEQ ID NO: 1587703 - RNA, 20 nt, Pseudomonas putida KT2440
ccacaacccuugcagcgccu

SEQ ID NO: 1587704 - RNA, 19 nt, Pseudomonas putida KT2440
ccacaauggcgcacagggc

SEQ ID NO: 1587705 - RNA, 20 nt, Pseudomonas putida KT2440
ccacaauguagucgucggcc

SEQ ID NO: 1587706 - RNA, 21 nt, Pseudomonas putida KT2440
ccacaagcgcaggcgguuggc

SEQ ID NO: 1587707 - RNA, 17 nt, Pseudomonas putida KT2440
ccaaucaacccguucag

SEQ ID NO: 1587708 - RNA, 23 nt, Pseudomonas putida KT2440
ccaaucaacccguucaggucauu

SEQ ID NO: 1587709 - RNA, 14 nt, Pseudomonas putida KT2440
ccaaucaucgccag

SEQ ID NO: 1587710 - RNA, 21 nt, Pseudomonas putida KT2440
ccaaucaucgccagcagcgcu

SEQ ID NO: 1587711 - RNA, 18 nt, Pseudomonas putida KT2440
ccaagggucgacaccagg

SEQ ID NO: 1587712 - RNA, 17 nt, Pseudomonas putida KT2440
ccaagguccagccacga

SEQ ID NO: 1587713 - RNA, 15 nt, Pseudomonas putida KT2440
ccaaccccagcgcau

SEQ ID NO: 1587714 - RNA, 16 nt, Pseudomonas putida KT2440
ccaaccccaggcgcac

SEQ ID NO: 1587715 - RNA, 18 nt, Pseudomonas putida KT2440
ccaaggaucagcucggca

SEQ ID NO: 1587716 - RNA, 22 nt, Pseudomonas putida KT2440
caugccggcaacgauacccacg

SEQ ID NO: 1587717 - RNA, 18 nt, Pseudomonas putida KT2440
caugcgcugcagcgucgc

SEQ ID NO: 1587718 - RNA, 13 nt, Pseudomonas putida KT2440
caugcgcuggcca

SEQ ID NO: 1587719 - RNA, 14 nt, Pseudomonas putida KT2440
caugcucagcuggg

SEQ ID NO: 1587720 - RNA, 14 nt, Pseudomonas putida KT2440
caugcucaggaaca

SEQ ID NO: 1587721 - RNA, 14 nt, Pseudomonas putida KT2440
caugcucaccagcu

SEQ ID NO: 1587722 - RNA, 15 nt, Pseudomonas putida KT2440
caugcguucgcuacg

SEQ ID NO: 1587723 - RNA, 23 nt, Pseudomonas putida KT2440
caugcccgccccugccagcacca

SEQ ID NO: 1587724 - RNA, 22 nt, Pseudomonas putida KT2440
caugcccgcucccacaggucca

SEQ ID NO: 1587725 - RNA, 21 nt, Pseudomonas putida KT2440
caugccccgggugcagccgca

SEQ ID NO: 1587726 - RNA, 16 nt, Pseudomonas putida KT2440
caugcccauggccagc

SEQ ID NO: 1587727 - RNA, 23 nt, Pseudomonas putida KT2440
caugcccagcgccaccggcagca

SEQ ID NO: 1587728 - RNA, 16 nt, Pseudomonas putida KT2440
caugcccacaggggcu

SEQ ID NO: 1587729 - RNA, 18 nt, Pseudomonas putida KT2440
caugccauuggugccacc

SEQ ID NO: 1587730 - RNA, 14 nt, Pseudomonas putida KT2440
caugcccaccgcau

SEQ ID NO: 1587731 - RNA, 17 nt, Pseudomonas putida KT2440
caugcccaccgcugcaa

SEQ ID NO: 1587732 - RNA, 17 nt, Pseudomonas putida KT2440
caugcaccacgccacca

SEQ ID NO: 1587733 - RNA, 14 nt, Pseudomonas putida KT2440
caugcacagcgagc

SEQ ID NO: 1587734 - RNA, 22 nt, Pseudomonas putida KT2440
caugcacagcgagcagccuggc

SEQ ID NO: 1587735 - RNA, 13 nt, Pseudomonas putida KT2440
caugcaacccgca

SEQ ID NO: 1587736 - RNA, 16 nt, Pseudomonas putida KT2440
caucggcuccagcgca

SEQ ID NO: 1587737 - RNA, 17 nt, Pseudomonas putida KT2440
caucggcuccagcgcac

SEQ ID NO: 1587738 - RNA, 17 nt, Pseudomonas putida KT2440
caugaugucgcugccgc

SEQ ID NO: 1587739 - RNA, 15 nt, Pseudomonas putida KT2440
caucggcgcgacagc

SEQ ID NO: 1587740 - RNA, 16 nt, Pseudomonas putida KT2440
caucggcgcgacagcg

SEQ ID NO: 1587741 - RNA, 14 nt, Pseudomonas putida KT2440
cauguucagcuugu

SEQ ID NO: 1587742 - RNA, 14 nt, Pseudomonas putida KT2440
cauguucaggucgu

SEQ ID NO: 1587743 - RNA, 22 nt, Pseudomonas putida KT2440
cauguucaucaccggccagcac

SEQ ID NO: 1587744 - RNA, 20 nt, Pseudomonas putida KT2440
cauguuacggcccaggggca

SEQ ID NO: 1587745 - RNA, 22 nt, Pseudomonas putida KT2440
caugugccgcucguacuggucg

SEQ ID NO: 1587746 - RNA, 16 nt, Pseudomonas putida KT2440
caugguguucaugccc

SEQ ID NO: 1587747 - RNA, 14 nt, Pseudomonas putida KT2440
caugguguccggca

SEQ ID NO: 1587748 - RNA, 14 nt, Pseudomonas putida KT2440
caugggcaggccca

SEQ ID NO: 1587749 - RNA, 19 nt, Pseudomonas putida KT2440
caugggcaggcccagguaa

SEQ ID NO: 1587750 - RNA, 15 nt, Pseudomonas putida KT2440
caugggccugcacga

SEQ ID NO: 1587751 - RNA, 19 nt, Pseudomonas putida KT2440
caugcucggccagcucgcc

SEQ ID NO: 1587752 - RNA, 16 nt, Pseudomonas putida KT2440
caugcucgcgggccug

SEQ ID NO: 1587753 - RNA, 18 nt, Pseudomonas putida KT2440
caugcucggcggugccug

SEQ ID NO: 1587754 - RNA, 12 nt, Pseudomonas putida KT2440
caugcucaccgc

SEQ ID NO: 1587755 - RNA, 15 nt, Pseudomonas putida KT2440
caugcugcgacacgc

SEQ ID NO: 1587756 - RNA, 14 nt, Pseudomonas putida KT2440
caugcuggccagga

SEQ ID NO: 1587757 - RNA, 16 nt, Pseudomonas putida KT2440
caugcuggccaggaug

SEQ ID NO: 1587758 - RNA, 19 nt, Pseudomonas putida KT2440
caugcuggccaggaugcca

SEQ ID NO: 1587759 - RNA, 15 nt, Pseudomonas putida KT2440
cauggcgacaauggc

SEQ ID NO: 1587760 - RNA, 17 nt, Pseudomonas putida KT2440
cauugaggaugcugaag

SEQ ID NO: 1587761 - RNA, 12 nt, Pseudomonas putida KT2440
cauugcaggcca

SEQ ID NO: 1587762 - RNA, 15 nt, Pseudomonas putida KT2440
cauugcaggccagcg

SEQ ID NO: 1587763 - RNA, 22 nt, Pseudomonas putida KT2440
cauugcaccacccccagcgccu

SEQ ID NO: 1587764 - RNA, 15 nt, Pseudomonas putida KT2440
cauugauaacugcgg

SEQ ID NO: 1587765 - RNA, 16 nt, Pseudomonas putida KT2440
cauugaugaacgacag

SEQ ID NO: 1587766 - RNA, 16 nt, Pseudomonas putida KT2440
cauugauagcggcagc

SEQ ID NO: 1587767 - RNA, 21 nt, Pseudomonas putida KT2440
cauuuccgggcaaugcaggca

SEQ ID NO: 1587768 - RNA, 23 nt, Pseudomonas putida KT2440
cauuuccggguuaccgcacagca

SEQ ID NO: 1587769 - RNA, 14 nt, Pseudomonas putida KT2440
cauuucgcggcgca

SEQ ID NO: 1587770 - RNA, 17 nt, Pseudomonas putida KT2440
cauuucguccaggcuca

SEQ ID NO: 1587771 - RNA, 20 nt, Pseudomonas putida KT2440
ccaacacggugaugcgcccu

SEQ ID NO: 1587772 - RNA, 20 nt, Pseudomonas putida KT2440
ccaacaccggcgaugccgag

SEQ ID NO: 1587773 - RNA, 19 nt, Pseudomonas putida KT2440
ccaacaaucgcgucagcac

SEQ ID NO: 1587774 - RNA, 22 nt, Pseudomonas putida KT2440
ccaacacccggugugugcccac

SEQ ID NO: 1587775 - RNA, 17 nt, Pseudomonas putida KT2440
cauuaccugcaggcgcg

SEQ ID NO: 1587776 - RNA, 18 nt, Pseudomonas putida KT2440
cauuaccauccaucacca

SEQ ID NO: 1587777 - RNA, 20 nt, Pseudomonas putida KT2440
cauuagcagguaaacccgcg

SEQ ID NO: 1587778 - RNA, 14 nt, Pseudomonas putida KT2440
cauguugcgcucgu

SEQ ID NO: 1587779 - RNA, 20 nt, Pseudomonas putida KT2440
cauguugucacccagcacuu

SEQ ID NO: 1587780 - RNA, 21 nt, Pseudomonas putida KT2440
cauuauccaccaggccgauca

SEQ ID NO: 1587781 - RNA, 17 nt, Pseudomonas putida KT2440
cauucagcagcgccugg

SEQ ID NO: 1587782 - RNA, 21 nt, Pseudomonas putida KT2440
cauucgcggguaaacccgcuc

SEQ ID NO: 1587783 - RNA, 19 nt, Pseudomonas putida KT2440
cauucgcggguaaacccgg

SEQ ID NO: 1587784 - RNA, 20 nt, Pseudomonas putida KT2440
cauucgcgggugaacccgcu

SEQ ID NO: 1587785 - RNA, 19 nt, Pseudomonas putida KT2440
cauucgcugcgucaggcca

SEQ ID NO: 1587786 - RNA, 23 nt, Pseudomonas putida KT2440
cauucgcauuaccagcaccauca

SEQ ID NO: 1587787 - RNA, 23 nt, Pseudomonas putida KT2440
cauucgcgccauggcuugcguuu

SEQ ID NO: 1587788 - RNA, 12 nt, Pseudomonas putida KT2440
cauucagcucgg

SEQ ID NO: 1587789 - RNA, 16 nt, Pseudomonas putida KT2440
cauucaggaugcuucg

SEQ ID NO: 1587790 - RNA, 12 nt, Pseudomonas putida KT2440
cauucaggccau

SEQ ID NO: 1587791 - RNA, 13 nt, Pseudomonas putida KT2440
cauucaggccauc

SEQ ID NO: 1587792 - RNA, 15 nt, Pseudomonas putida KT2440
ccagcgaguggccac

SEQ ID NO: 1587793 - RNA, 20 nt, Pseudomonas putida KT2440
ccagcgauaaaccagcagcg

SEQ ID NO: 1587794 - RNA, 17 nt, Pseudomonas putida KT2440
ccagcgaugacccggcc

SEQ ID NO: 1587795 - RNA, 13 nt, Pseudomonas putida KT2440
ccagcgaccagcu

SEQ ID NO: 1587796 - RNA, 13 nt, Pseudomonas putida KT2440
ccagccguggcaa

SEQ ID NO: 1587797 - RNA, 16 nt, Pseudomonas putida KT2440
ccagccguggcaacgc

SEQ ID NO: 1587798 - RNA, 12 nt, Pseudomonas putida KT2440
ccagccugcagc

SEQ ID NO: 1587799 - RNA, 15 nt, Pseudomonas putida KT2440
ccagccugcagcacc

SEQ ID NO: 1587800 - RNA, 15 nt, Pseudomonas putida KT2440
ccagccuugaggcug

SEQ ID NO: 1587801 - RNA, 15 nt, Pseudomonas putida KT2440
ccagccgcugcugca

SEQ ID NO: 1587802 - RNA, 20 nt, Pseudomonas putida KT2440
ccagcaugcgaagccgccag

SEQ ID NO: 1587803 - RNA, 23 nt, Pseudomonas putida KT2440
ccagcaugcgaagccgccagcgu

SEQ ID NO: 1587804 - RNA, 16 nt, Pseudomonas putida KT2440
ccagcaugaacgcagc

SEQ ID NO: 1587805 - RNA, 18 nt, Pseudomonas putida KT2440
ccagcaucucggccagug

SEQ ID NO: 1587806 - RNA, 20 nt, Pseudomonas putida KT2440
ccagccggcccggcuggcca

SEQ ID NO: 1587807 - RNA, 14 nt, Pseudomonas putida KT2440
ccagccgggcugca

SEQ ID NO: 1587808 - RNA, 12 nt, Pseudomonas putida KT2440
ccagccggcuga

SEQ ID NO: 1587809 - RNA, 13 nt, Pseudomonas putida KT2440
ccagccggcagca

SEQ ID NO: 1587810 - RNA, 22 nt, Pseudomonas putida KT2440
ccagccgucgauuacccagcgc

SEQ ID NO: 1587811 - RNA, 21 nt, Pseudomonas putida KT2440
ccagccggucauccagcagcu

SEQ ID NO: 1587812 - RNA, 22 nt, Pseudomonas putida KT2440
ccagcgcugucccccagcccug

SEQ ID NO: 1587813 - RNA, 18 nt, Pseudomonas putida KT2440
ccagcgcuccagcaacgg

SEQ ID NO: 1587814 - RNA, 21 nt, Pseudomonas putida KT2440
ccagcggaucaccgacgugca

SEQ ID NO: 1587815 - RNA, 19 nt, Pseudomonas putida KT2440
ccagcgcugauaccgaacu

SEQ ID NO: 1587816 - RNA, 20 nt, Pseudomonas putida KT2440
ccagcgcuugagaccaggcc

SEQ ID NO: 1587817 - RNA, 15 nt, Pseudomonas putida KT2440
ccagcgcggccacgc

SEQ ID NO: 1587818 - RNA, 19 nt, Pseudomonas putida KT2440
ccagcgcgguagcugccgc

SEQ ID NO: 1587819 - RNA, 12 nt, Pseudomonas putida KT2440
ccagcgccugca

SEQ ID NO: 1587820 - RNA, 17 nt, Pseudomonas putida KT2440
ccagcgccugcaggccc

SEQ ID NO: 1587821 - RNA, 16 nt, Pseudomonas putida KT2440
ccagcgccccgccgca

SEQ ID NO: 1587822 - RNA, 14 nt, Pseudomonas putida KT2440
ccagcgcgccagca

SEQ ID NO: 1587823 - RNA, 17 nt, Pseudomonas putida KT2440
ccagcgccaguacggcc

SEQ ID NO: 1587824 - RNA, 12 nt, Pseudomonas putida KT2440
ccagcgccagca

SEQ ID NO: 1587825 - RNA, 15 nt, Pseudomonas putida KT2440
ccagcgccaccgcgc

SEQ ID NO: 1587826 - RNA, 19 nt, Pseudomonas putida KT2440
ccagcgccaccgcgcgguu

SEQ ID NO: 1587827 - RNA, 16 nt, Pseudomonas putida KT2440
ccagcgauucaguuca

SEQ ID NO: 1587828 - RNA, 14 nt, Pseudomonas putida KT2440
ccagcgauggcgga

SEQ ID NO: 1587829 - RNA, 20 nt, Pseudomonas putida KT2440
ccagcucuggucaccuucgu

SEQ ID NO: 1587830 - RNA, 17 nt, Pseudomonas putida KT2440
ccagcucguucaacacc

SEQ ID NO: 1587831 - RNA, 16 nt, Pseudomonas putida KT2440
ccagcugagcgccauc

SEQ ID NO: 1587832 - RNA, 20 nt, Pseudomonas putida KT2440
ccagcugagcgccauccacc

SEQ ID NO: 1587833 - RNA, 15 nt, Pseudomonas putida KT2440
ccagcugcgccugca

SEQ ID NO: 1587834 - RNA, 12 nt, Pseudomonas putida KT2440
ccagcugcugcg

SEQ ID NO: 1587835 - RNA, 13 nt, Pseudomonas putida KT2440
ccagcugcguggc

SEQ ID NO: 1587836 - RNA, 13 nt, Pseudomonas putida KT2440
ccagcuggccauc

SEQ ID NO: 1587837 - RNA, 15 nt, Pseudomonas putida KT2440
ccagcuggccaucga

SEQ ID NO: 1587838 - RNA, 16 nt, Pseudomonas putida KT2440
ccagcuggccaucgac

SEQ ID NO: 1587839 - RNA, 17 nt, Pseudomonas putida KT2440
ccagcuggccaucgacc

SEQ ID NO: 1587840 - RNA, 22 nt, Pseudomonas putida KT2440
ccagcucuuugggggugcugag

SEQ ID NO: 1587841 - RNA, 18 nt, Pseudomonas putida KT2440
ccagcugcaacagcggcg

SEQ ID NO: 1587842 - RNA, 14 nt, Pseudomonas putida KT2440
ccagcugcgccugc

SEQ ID NO: 1587843 - RNA, 20 nt, Pseudomonas putida KT2440
ccagcuucuccagcaagcgc

SEQ ID NO: 1587844 - RNA, 20 nt, Pseudomonas putida KT2440
ccagcuucugcugguccuug

SEQ ID NO: 1587845 - RNA, 16 nt, Pseudomonas putida KT2440
ccagcuugaagcggcc

SEQ ID NO: 1587846 - RNA, 19 nt, Pseudomonas putida KT2440
ccagcuugccgucgcugga

SEQ ID NO: 1587847 - RNA, 13 nt, Pseudomonas putida KT2440
ccagcuugcccag

SEQ ID NO: 1587848 - RNA, 22 nt, Pseudomonas putida KT2440
ccagcuugcccagcagguacac

SEQ ID NO: 1587849 - RNA, 14 nt, Pseudomonas putida KT2440
ccagcuggcucauc

SEQ ID NO: 1587850 - RNA, 21 nt, Pseudomonas putida KT2440
ccagcuggcucaucugccggc

SEQ ID NO: 1587851 - RNA, 20 nt, Pseudomonas putida KT2440
ccaggaagaucacgucggcc

SEQ ID NO: 1587852 - RNA, 22 nt, Pseudomonas putida KT2440
ccaggaagaucacgucggccug

SEQ ID NO: 1587853 - RNA, 20 nt, Pseudomonas putida KT2440
ccaggaacaucgccgucauc

SEQ ID NO: 1587854 - RNA, 21 nt, Pseudomonas putida KT2440
ccagcuuggaagugucgaacu

SEQ ID NO: 1587855 - RNA, 14 nt, Pseudomonas putida KT2440
ccagcuuguugccg

SEQ ID NO: 1587856 - RNA, 13 nt, Pseudomonas putida KT2440
ccaggaacagcgc

SEQ ID NO: 1587857 - RNA, 16 nt, Pseudomonas putida KT2440
ccaggaacagcgccac

SEQ ID NO: 1587858 - RNA, 20 nt, Pseudomonas putida KT2440
ccaggacaaaccagcggucu

SEQ ID NO: 1587859 - RNA, 21 nt, Pseudomonas putida KT2440
ccaggagaacacccagcgcau

SEQ ID NO: 1587860 - RNA, 17 nt, Pseudomonas putida KT2440
ccagcguucgggucaac

SEQ ID NO: 1587861 - RNA, 17 nt, Pseudomonas putida KT2440
ccagcguucggccagca

SEQ ID NO: 1587862 - RNA, 12 nt, Pseudomonas putida KT2440
ccagcucaacgc

SEQ ID NO: 1587863 - RNA, 13 nt, Pseudomonas putida KT2440
ccagcucaacgcg

SEQ ID NO: 1587864 - RNA, 21 nt, Pseudomonas putida KT2440
ccagcuacgcgagccaccguc

SEQ ID NO: 1587865 - RNA, 23 nt, Pseudomonas putida KT2440
ccagcguuuguaaguaggcgcug

SEQ ID NO: 1587866 - RNA, 14 nt, Pseudomonas putida KT2440
ccagcgugggccgu

SEQ ID NO: 1587867 - RNA, 17 nt, Pseudomonas putida KT2440
ccagcgugggccgugca

SEQ ID NO: 1587868 - RNA, 15 nt, Pseudomonas putida KT2440
ccagcuccagcaccu

SEQ ID NO: 1587869 - RNA, 14 nt, Pseudomonas putida KT2440
ccagcuccagcacc

SEQ ID NO: 1587870 - RNA, 14 nt, Pseudomonas putida KT2440
ccagcuccuucgcu

SEQ ID NO: 1587871 - RNA, 15 nt, Pseudomonas putida KT2440
ccagcucgcgcgggu

SEQ ID NO: 1587872 - RNA, 12 nt, Pseudomonas putida KT2440
ccagcucggccu

SEQ ID NO: 1587873 - RNA, 14 nt, Pseudomonas putida KT2440
ccagcucggcaagg

SEQ ID NO: 1587874 - RNA, 12 nt, Pseudomonas putida KT2440
ccagcucggcag

SEQ ID NO: 1587875 - RNA, 18 nt, Pseudomonas putida KT2440
ccagcucgcgcagggcau

SEQ ID NO: 1587876 - RNA, 13 nt, Pseudomonas putida KT2440
ccagacucagcgc

SEQ ID NO: 1587877 - RNA, 14 nt, Pseudomonas putida KT2440
ccagacucagcgcu

SEQ ID NO: 1587878 - RNA, 22 nt, Pseudomonas putida KT2440
ccagacucagcgcuugccgcug

SEQ ID NO: 1587879 - RNA, 14 nt, Pseudomonas putida KT2440
ccagacgggcaugg

SEQ ID NO: 1587880 - RNA, 19 nt, Pseudomonas putida KT2440
ccagaauagcaagcgccaa

SEQ ID NO: 1587881 - RNA, 16 nt, Pseudomonas putida KT2440
ccagaaaaguuggcca

SEQ ID NO: 1587882 - RNA, 16 nt, Pseudomonas putida KT2440
ccagaaacccagggca

SEQ ID NO: 1587883 - RNA, 20 nt, Pseudomonas putida KT2440
ccagaaaauaugcuguuggc

SEQ ID NO: 1587884 - RNA, 18 nt, Pseudomonas putida KT2440
ccacuugcguucgccgcu

SEQ ID NO: 1587885 - RNA, 22 nt, Pseudomonas putida KT2440
ccacuugucccggcccagccgc

SEQ ID NO: 1587886 - RNA, 20 nt, Pseudomonas putida KT2440
ccacuugcagguagcgcccg

SEQ ID NO: 1587887 - RNA, 15 nt, Pseudomonas putida KT2440
ccacuucgacauggc

SEQ ID NO: 1587888 - RNA, 20 nt, Pseudomonas putida KT2440
ccacuucgugcaaggcgaug

SEQ ID NO: 1587889 - RNA, 23 nt, Pseudomonas putida KT2440
ccacuucaaguucguuggcgaac

SEQ ID NO: 1587890 - RNA, 17 nt, Pseudomonas putida KT2440
ccacuguugcagcgcca

SEQ ID NO: 1587891 - RNA, 18 nt, Pseudomonas putida KT2440
ccacuguugcagcgccag

SEQ ID NO: 1587892 - RNA, 11 nt, Pseudomonas putida KT2440
ccacgggcaaa

SEQ ID NO: 1587893 - RNA, 18 nt, Pseudomonas putida KT2440
ccacggccgaguccuugc

SEQ ID NO: 1587894 - RNA, 15 nt, Pseudomonas putida KT2440
ccacgguauaguggu

SEQ ID NO: 1587895 - RNA, 15 nt, Pseudomonas putida KT2440
ccacgguaccggcaa

SEQ ID NO: 1587896 - RNA, 14 nt, Pseudomonas putida KT2440
ccacgcugccagga

SEQ ID NO: 1587897 - RNA, 21 nt, Pseudomonas putida KT2440
ccacggcaaucggcaggccgg

SEQ ID NO: 1587898 - RNA, 23 nt, Pseudomonas putida KT2440
ccacgcugcggcgaaagccagca

SEQ ID NO: 1587899 - RNA, 20 nt, Pseudomonas putida KT2440
ccacgcuggcacccacgcgc

SEQ ID NO: 1587900 - RNA, 15 nt, Pseudomonas putida KT2440
ccacgcugaacacgc

SEQ ID NO: 1587901 - RNA, 20 nt, Pseudomonas putida KT2440
ccacgcucuguaucgaacag

SEQ ID NO: 1587902 - RNA, 23 nt, Pseudomonas putida KT2440
ccagcaggacgauaccguuguag

SEQ ID NO: 1587903 - RNA, 23 nt, Pseudomonas putida KT2440
ccagcagcuucuucacaccggcc

SEQ ID NO: 1587904 - RNA, 14 nt, Pseudomonas putida KT2440
ccagcagguacacc

SEQ ID NO: 1587905 - RNA, 17 nt, Pseudomonas putida KT2440
ccagcagguacagcacc

SEQ ID NO: 1587906 - RNA, 14 nt, Pseudomonas putida KT2440
ccagcagcgggcac

SEQ ID NO: 1587907 - RNA, 19 nt, Pseudomonas putida KT2440
ccagcagcgggcacaggcc

SEQ ID NO: 1587908 - RNA, 18 nt, Pseudomonas putida KT2440
ccagcagcguacccagcu

SEQ ID NO: 1587909 - RNA, 12 nt, Pseudomonas putida KT2440
ccagcagcgaca

SEQ ID NO: 1587910 - RNA, 19 nt, Pseudomonas putida KT2440
ccagcagcgacaccagcgc

SEQ ID NO: 1587911 - RNA, 14 nt, Pseudomonas putida KT2440
ccagcagcgacacu

SEQ ID NO: 1587912 - RNA, 23 nt, Pseudomonas putida KT2440
ccagcagcgacagguaguuggcc

SEQ ID NO: 1587913 - RNA, 17 nt, Pseudomonas putida KT2440
ccagcagguucaacggc

SEQ ID NO: 1587914 - RNA, 22 nt, Pseudomonas putida KT2440
ccagcagugcaucgaagcaggc

SEQ ID NO: 1587915 - RNA, 17 nt, Pseudomonas putida KT2440
ccagcaucgaggaaggc

SEQ ID NO: 1587916 - RNA, 16 nt, Pseudomonas putida KT2440
ccagcaggucggcacg

SEQ ID NO: 1587917 - RNA, 21 nt, Pseudomonas putida KT2440
ccagcaggucggcacgcaccu

SEQ ID NO: 1587918 - RNA, 13 nt, Pseudomonas putida KT2440
ccagcaggucagg

SEQ ID NO: 1587919 - RNA, 17 nt, Pseudomonas putida KT2440
ccagcaggggcagaugc

SEQ ID NO: 1587920 - RNA, 13 nt, Pseudomonas putida KT2440
ccagcaggccaua

SEQ ID NO: 1587921 - RNA, 17 nt, Pseudomonas putida KT2440
ccagcagguugaacagg

SEQ ID NO: 1587922 - RNA, 19 nt, Pseudomonas putida KT2440
ccagcagguuggacagcgc

SEQ ID NO: 1587923 - RNA, 20 nt, Pseudomonas putida KT2440
ccagcagguuggacagcgcc

SEQ ID NO: 1587924 - RNA, 22 nt, Pseudomonas putida KT2440
ccagcagguuggacagcgcccg

SEQ ID NO: 1587925 - RNA, 18 nt, Pseudomonas putida KT2440
ccagcagcaguggcaagc

SEQ ID NO: 1587926 - RNA, 12 nt, Pseudomonas putida KT2440
ccagcaccggcg

SEQ ID NO: 1587927 - RNA, 20 nt, Pseudomonas putida KT2440
ccagcaauugcgagguaccg

SEQ ID NO: 1587928 - RNA, 19 nt, Pseudomonas putida KT2440
ccagcaagucccccaucgg

SEQ ID NO: 1587929 - RNA, 14 nt, Pseudomonas putida KT2440
ccagcacaagccga

SEQ ID NO: 1587930 - RNA, 16 nt, Pseudomonas putida KT2440
ccagcacaccgcgcac

SEQ ID NO: 1587931 - RNA, 15 nt, Pseudomonas putida KT2440
ccagcacacgguagg

SEQ ID NO: 1587932 - RNA, 18 nt, Pseudomonas putida KT2440
ccagcacacugagcacca

SEQ ID NO: 1587933 - RNA, 20 nt, Pseudomonas putida KT2440
ccagcacacugagcaccaca

SEQ ID NO: 1587934 - RNA, 20 nt, Pseudomonas putida KT2440
ccagcacagauaaaccugcc

SEQ ID NO: 1587935 - RNA, 23 nt, Pseudomonas putida KT2440
ccagcaccaucagagcgccagca

SEQ ID NO: 1587936 - RNA, 18 nt, Pseudomonas putida KT2440
ccagcaccaucaggcaca

SEQ ID NO: 1587937 - RNA, 15 nt, Pseudomonas putida KT2440
ccagcaccccagcac

SEQ ID NO: 1587938 - RNA, 21 nt, Pseudomonas putida KT2440
ccagcaccccgaacgcgguaa

SEQ ID NO: 1587939 - RNA, 17 nt, Pseudomonas putida KT2440
ccagcacccgcaggcga

SEQ ID NO: 1587940 - RNA, 23 nt, Pseudomonas putida KT2440
ccagcaccgaaccggcgaucagg

SEQ ID NO: 1587941 - RNA, 20 nt, Pseudomonas putida KT2440
ccagcaagcgcauaggcaau

SEQ ID NO: 1587942 - RNA, 20 nt, Pseudomonas putida KT2440
ccagcaagcucaucaccagg

SEQ ID NO: 1587943 - RNA, 21 nt, Pseudomonas putida KT2440
ccagcaacggugaaaaacgcg

SEQ ID NO: 1587944 - RNA, 16 nt, Pseudomonas putida KT2440
ccagcaacaugccggc

SEQ ID NO: 1587945 - RNA, 21 nt, Pseudomonas putida KT2440
ccagagcguccucggcagaaa

SEQ ID NO: 1587946 - RNA, 15 nt, Pseudomonas putida KT2440
ccagagcgcgccacg

SEQ ID NO: 1587947 - RNA, 23 nt, Pseudomonas putida KT2440
ccagagcauggccagccggcagc

SEQ ID NO: 1587948 - RNA, 13 nt, Pseudomonas putida KT2440
ccagauucaagcc

SEQ ID NO: 1587949 - RNA, 14 nt, Pseudomonas putida KT2440
ccagauucaagccc

SEQ ID NO: 1587950 - RNA, 18 nt, Pseudomonas putida KT2440
ccagggcgcgcuggcgca

SEQ ID NO: 1587951 - RNA, 14 nt, Pseudomonas putida KT2440
ccagggcgucggca

SEQ ID NO: 1587952 - RNA, 14 nt, Pseudomonas putida KT2440
ccagggcgucgaac

SEQ ID NO: 1587953 - RNA, 12 nt, Pseudomonas putida KT2440
ccagggcgcugu

SEQ ID NO: 1587954 - RNA, 14 nt, Pseudomonas putida KT2440
ccagggcccucaac

SEQ ID NO: 1587955 - RNA, 20 nt, Pseudomonas putida KT2440
ccagggcccgccgcgcggcu

SEQ ID NO: 1587956 - RNA, 21 nt, Pseudomonas putida KT2440
ccagggcccgccgcgcggcuu

SEQ ID NO: 1587957 - RNA, 22 nt, Pseudomonas putida KT2440
ccaggaucuucucggcgcggaa

SEQ ID NO: 1587958 - RNA, 14 nt, Pseudomonas putida KT2440
ccagggcaucgacc

SEQ ID NO: 1587959 - RNA, 14 nt, Pseudomonas putida KT2440
ccagggcaucgauc

SEQ ID NO: 1587960 - RNA, 21 nt, Pseudomonas putida KT2440
ccagggcaucggcgccccgca

SEQ ID NO: 1587961 - RNA, 16 nt, Pseudomonas putida KT2440
ccaggauauugccgac

SEQ ID NO: 1587962 - RNA, 13 nt, Pseudomonas putida KT2440
ccagguccaccag

SEQ ID NO: 1587963 - RNA, 15 nt, Pseudomonas putida KT2440
ccagguaguacggca

SEQ ID NO: 1587964 - RNA, 13 nt, Pseudomonas putida KT2440
ccagguauggcca

SEQ ID NO: 1587965 - RNA, 17 nt, Pseudomonas putida KT2440
ccaggucacgguccauc

SEQ ID NO: 1587966 - RNA, 14 nt, Pseudomonas putida KT2440
ccagguccaggcca

SEQ ID NO: 1587967 - RNA, 22 nt, Pseudomonas putida KT2440
ccaggucgggcuggcugcccga

SEQ ID NO: 1587968 - RNA, 14 nt, Pseudomonas putida KT2440
ccaggguggcguug

SEQ ID NO: 1587969 - RNA, 18 nt, Pseudomonas putida KT2440
ccagggggcagcugcuga

SEQ ID NO: 1587970 - RNA, 22 nt, Pseudomonas putida KT2440
ccaggguacuugugugccugcu

SEQ ID NO: 1587971 - RNA, 14 nt, Pseudomonas putida KT2440
ccagggcugcuuca

SEQ ID NO: 1587972 - RNA, 20 nt, Pseudomonas putida KT2440
ccagugggugcuguggcgca

SEQ ID NO: 1587973 - RNA, 19 nt, Pseudomonas putida KT2440
ccagugucaguugcucgcc

SEQ ID NO: 1587974 - RNA, 15 nt, Pseudomonas putida KT2440
ccaguggugcaaggu

SEQ ID NO: 1587975 - RNA, 16 nt, Pseudomonas putida KT2440
ccagugcaacguucac

SEQ ID NO: 1587976 - RNA, 16 nt, Pseudomonas putida KT2440
ccaguugaucaacccg

SEQ ID NO: 1587977 - RNA, 18 nt, Pseudomonas putida KT2440
ccaguugcuggcuggucu

SEQ ID NO: 1587978 - RNA, 12 nt, Pseudomonas putida KT2440
ccaguuggcagg

SEQ ID NO: 1587979 - RNA, 13 nt, Pseudomonas putida KT2440
ccaguuggcggcg

SEQ ID NO: 1587980 - RNA, 19 nt, Pseudomonas putida KT2440
ccaguuggcggcgcagcgc

SEQ ID NO: 1587981 - RNA, 23 nt, Pseudomonas putida KT2440
ccaguucaaugccagcaguucgc

SEQ ID NO: 1587982 - RNA, 19 nt, Pseudomonas putida KT2440
ccaguccgccucgucgaug

SEQ ID NO: 1587983 - RNA, 19 nt, Pseudomonas putida KT2440
ccagucgaucagcgacacc

SEQ ID NO: 1587984 - RNA, 17 nt, Pseudomonas putida KT2440
ccaguccuuggccaaug

SEQ ID NO: 1587985 - RNA, 20 nt, Pseudomonas putida KT2440
ccagucgccccgccagcgcc

SEQ ID NO: 1587986 - RNA, 14 nt, Pseudomonas putida KT2440
ccagucgccuucgu

SEQ ID NO: 1587987 - RNA, 12 nt, Pseudomonas putida KT2440
ccagucgcgcaa

SEQ ID NO: 1587988 - RNA, 16 nt, Pseudomonas putida KT2440
ccagguuguggcccau

SEQ ID NO: 1587989 - RNA, 14 nt, Pseudomonas putida KT2440
ccagguuggcccug

SEQ ID NO: 1587990 - RNA, 20 nt, Pseudomonas putida KT2440
ccaggugaaucagcggcagg

SEQ ID NO: 1587991 - RNA, 16 nt, Pseudomonas putida KT2440
ccagguucucgcucca

SEQ ID NO: 1587992 - RNA, 19 nt, Pseudomonas putida KT2440
ccagguucuguaugacgau

SEQ ID NO: 1587993 - RNA, 20 nt, Pseudomonas putida KT2440
ccaggugcaacccggccuug

SEQ ID NO: 1587994 - RNA, 23 nt, Pseudomonas putida KT2440
ccaugcugcagaaccgccagcac

SEQ ID NO: 1587995 - RNA, 13 nt, Pseudomonas putida KT2440
ccaugcugucgau

SEQ ID NO: 1587996 - RNA, 13 nt, Pseudomonas putida KT2440
ccaugcugcugcc

SEQ ID NO: 1587997 - RNA, 16 nt, Pseudomonas putida KT2440
ccaugcuggccaaggu

SEQ ID NO: 1587998 - RNA, 23 nt, Pseudomonas putida KT2440
ccaugcaggucgacgauacccag

SEQ ID NO: 1587999 - RNA, 14 nt, Pseudomonas putida KT2440
ccaugcagcccgca

SEQ ID NO: 1588000 - RNA, 19 nt, Pseudomonas putida KT2440
ccaugccacccccggccga

SEQ ID NO: 1588001 - RNA, 16 nt, Pseudomonas putida KT2440
ccaugccccuaccgcc

SEQ ID NO: 1588002 - RNA, 20 nt, Pseudomonas putida KT2440
ccaugccccucaaugcugcc

SEQ ID NO: 1588003 - RNA, 21 nt, Pseudomonas putida KT2440
ccaugccccucaaugcugccu

SEQ ID NO: 1588004 - RNA, 18 nt, Pseudomonas putida KT2440
ccaugcccuugccuucgg

SEQ ID NO: 1588005 - RNA, 20 nt, Pseudomonas putida KT2440
ccauggcaaucagcgacaac

SEQ ID NO: 1588006 - RNA, 11 nt, Pseudomonas putida KT2440
ccauggccagc

SEQ ID NO: 1588007 - RNA, 18 nt, Pseudomonas putida KT2440
ccauggccagcguggccg

SEQ ID NO: 1588008 - RNA, 22 nt, Pseudomonas putida KT2440
ccauucaucgauggucuucgcc

SEQ ID NO: 1588009 - RNA, 13 nt, Pseudomonas putida KT2440
ccaugaucagcgc

SEQ ID NO: 1588010 - RNA, 15 nt, Pseudomonas putida KT2440
ccaugaucagcgccu

SEQ ID NO: 1588011 - RNA, 16 nt, Pseudomonas putida KT2440
ccaugaucagcgccug

SEQ ID NO: 1588012 - RNA, 21 nt, Pseudomonas putida KT2440
ccaucuucucgcgcaggcggu

SEQ ID NO: 1588013 - RNA, 18 nt, Pseudomonas putida KT2440
ccaucuugcccagggcug

SEQ ID NO: 1588014 - RNA, 20 nt, Pseudomonas putida KT2440
ccaucuugcccagggcugcu

SEQ ID NO: 1588015 - RNA, 23 nt, Pseudomonas putida KT2440
ccaucuugcugcucugcaaugcc

SEQ ID NO: 1588016 - RNA, 22 nt, Pseudomonas putida KT2440
ccaucuugguuggcggagccag

SEQ ID NO: 1588017 - RNA, 23 nt, Pseudomonas putida KT2440
ccaucuugguuggcggagccagc

SEQ ID NO: 1588018 - RNA, 21 nt, Pseudomonas putida KT2440
ccaugaaguucauccagaucg

SEQ ID NO: 1588019 - RNA, 16 nt, Pseudomonas putida KT2440
ccauccaccgcgccag

SEQ ID NO: 1588020 - RNA, 18 nt, Pseudomonas putida KT2440
ccauccaguucauugcga

SEQ ID NO: 1588021 - RNA, 20 nt, Pseudomonas putida KT2440
ccauccagcggcgacaggug

SEQ ID NO: 1588022 - RNA, 16 nt, Pseudomonas putida KT2440
ccauccagggcuuccu

SEQ ID NO: 1588023 - RNA, 15 nt, Pseudomonas putida KT2440
ccauccagucggcgc

SEQ ID NO: 1588024 - RNA, 18 nt, Pseudomonas putida KT2440
ccaucaguugcagcaacg

SEQ ID NO: 1588025 - RNA, 20 nt, Pseudomonas putida KT2440
ccaucagugcccccgccaca

SEQ ID NO: 1588026 - RNA, 22 nt, Pseudomonas putida KT2440
ccaucaucagacagaagccugu

SEQ ID NO: 1588027 - RNA, 21 nt, Pseudomonas putida KT2440
ccaucauucgauagccugcaa

SEQ ID NO: 1588028 - RNA, 14 nt, Pseudomonas putida KT2440
ccauccaacgcauc

SEQ ID NO: 1588029 - RNA, 19 nt, Pseudomonas putida KT2440
ccauccacaucgccaggug

SEQ ID NO: 1588030 - RNA, 17 nt, Pseudomonas putida KT2440
ccauccaccagccccag

SEQ ID NO: 1588031 - RNA, 22 nt, Pseudomonas putida KT2440
ccaucagguauugcgcaaggcc

SEQ ID NO: 1588032 - RNA, 14 nt, Pseudomonas putida KT2440
ccauagcaccagcg

SEQ ID NO: 1588033 - RNA, 22 nt, Pseudomonas putida KT2440
ccauacuuggccgacauggcgc

SEQ ID NO: 1588034 - RNA, 13 nt, Pseudomonas putida KT2440
ccaucagggcgau

SEQ ID NO: 1588035 - RNA, 20 nt, Pseudomonas putida KT2440
ccaucagggcgaugcgcaca

SEQ ID NO: 1588036 - RNA, 21 nt, Pseudomonas putida KT2440
ccaguuguugggcagccacgc

SEQ ID NO: 1588037 - RNA, 22 nt, Pseudomonas putida KT2440
ccauaccucccgcacugcugcc

SEQ ID NO: 1588038 - RNA, 17 nt, Pseudomonas putida KT2440
ccauaccaauggcaauc

SEQ ID NO: 1588039 - RNA, 22 nt, Pseudomonas putida KT2440
ccaucgcauaugccccaggcau

SEQ ID NO: 1588040 - RNA, 15 nt, Pseudomonas putida KT2440
ccaucccgcuucgcc

SEQ ID NO: 1588041 - RNA, 19 nt, Pseudomonas putida KT2440
ccaucccgcuucgccagcg

SEQ ID NO: 1588042 - RNA, 23 nt, Pseudomonas putida KT2440
ccaucccgcuucgccagcgccac

SEQ ID NO: 1588043 - RNA, 16 nt, Pseudomonas putida KT2440
ccccgaguaacccugg

SEQ ID NO: 1588044 - RNA, 14 nt, Pseudomonas putida KT2440
ccccgcacaucacg

SEQ ID NO: 1588045 - RNA, 21 nt, Pseudomonas putida KT2440
ccccgcaggccgccgggguaa

SEQ ID NO: 1588046 - RNA, 17 nt, Pseudomonas putida KT2440
cccccguaggagcgggu

SEQ ID NO: 1588047 - RNA, 12 nt, Pseudomonas putida KT2440
cccccgguacca

SEQ ID NO: 1588048 - RNA, 12 nt, Pseudomonas putida KT2440
cccccgccagca

SEQ ID NO: 1588049 - RNA, 12 nt, Pseudomonas putida KT2440
cccccgccgaag

SEQ ID NO: 1588050 - RNA, 20 nt, Pseudomonas putida KT2440
cccccuggccuggccaagcg

SEQ ID NO: 1588051 - RNA, 13 nt, Pseudomonas putida KT2440
ccccgaagcagcc

SEQ ID NO: 1588052 - RNA, 14 nt, Pseudomonas putida KT2440
cccccuugccagca

SEQ ID NO: 1588053 - RNA, 22 nt, Pseudomonas putida KT2440
cccccuugccagcauggugcag

SEQ ID NO: 1588054 - RNA, 21 nt, Pseudomonas putida KT2440
ccccgaccaaggccaacugcg

SEQ ID NO: 1588055 - RNA, 20 nt, Pseudomonas putida KT2440
ccccggcaauaccgauuauc

SEQ ID NO: 1588056 - RNA, 16 nt, Pseudomonas putida KT2440
ccccggcaucgcugcc

SEQ ID NO: 1588057 - RNA, 16 nt, Pseudomonas putida KT2440
ccccggcagcgaugcc

SEQ ID NO: 1588058 - RNA, 14 nt, Pseudomonas putida KT2440
ccccgccagugcaa

SEQ ID NO: 1588059 - RNA, 23 nt, Pseudomonas putida KT2440
ccccauaaaaaaacccgcugauc

SEQ ID NO: 1588060 - RNA, 20 nt, Pseudomonas putida KT2440
ccccaguucacgcaggcgca

SEQ ID NO: 1588061 - RNA, 18 nt, Pseudomonas putida KT2440
ccccaguugaucaacccg

SEQ ID NO: 1588062 - RNA, 21 nt, Pseudomonas putida KT2440
ccccaguugaucaacccgugc

SEQ ID NO: 1588063 - RNA, 19 nt, Pseudomonas putida KT2440
ccccaugaugaccaccagg

SEQ ID NO: 1588064 - RNA, 14 nt, Pseudomonas putida KT2440
ccccaucugcucgg

SEQ ID NO: 1588065 - RNA, 17 nt, Pseudomonas putida KT2440
ccccaucacgcagcgcg

SEQ ID NO: 1588066 - RNA, 21 nt, Pseudomonas putida KT2440
ccccaucaguugcagcaacgc

SEQ ID NO: 1588067 - RNA, 12 nt, Pseudomonas putida KT2440
cccccaccuggc

SEQ ID NO: 1588068 - RNA, 21 nt, Pseudomonas putida KT2440
cccccagccggucauccagca

SEQ ID NO: 1588069 - RNA, 16 nt, Pseudomonas putida KT2440
cccccagccuugaggc

SEQ ID NO: 1588070 - RNA, 11 nt, Pseudomonas putida KT2440
cccccaaucag

SEQ ID NO: 1588071 - RNA, 15 nt, Pseudomonas putida KT2440
cccccagguuaucca

SEQ ID NO: 1588072 - RNA, 18 nt, Pseudomonas putida KT2440
cccccaugcucaccagcu

SEQ ID NO: 1588073 - RNA, 12 nt, Pseudomonas putida KT2440
ccccccagcagc

SEQ ID NO: 1588074 - RNA, 18 nt, Pseudomonas putida KT2440
ccccagccggucaucacg

SEQ ID NO: 1588075 - RNA, 12 nt, Pseudomonas putida KT2440
ccccagccuuca

SEQ ID NO: 1588076 - RNA, 23 nt, Pseudomonas putida KT2440
ccccagcgccuuggccugcucac

SEQ ID NO: 1588077 - RNA, 19 nt, Pseudomonas putida KT2440
ccccagcgccuccaccugg

SEQ ID NO: 1588078 - RNA, 17 nt, Pseudomonas putida KT2440
ccccaggguuaccuuga

SEQ ID NO: 1588079 - RNA, 17 nt, Pseudomonas putida KT2440
ccccagggaucgaugcc

SEQ ID NO: 1588080 - RNA, 13 nt, Pseudomonas putida KT2440
ccccaagcgccug

SEQ ID NO: 1588081 - RNA, 13 nt, Pseudomonas putida KT2440
ccccaaagccgcc

SEQ ID NO: 1588082 - RNA, 16 nt, Pseudomonas putida KT2440
ccccaaaugcccgcca

SEQ ID NO: 1588083 - RNA, 22 nt, Pseudomonas putida KT2440
ccccaaaccgcugcccagcgaa

SEQ ID NO: 1588084 - RNA, 21 nt, Pseudomonas putida KT2440
ccccacaaccccugcaaggcc

SEQ ID NO: 1588085 - RNA, 15 nt, Pseudomonas putida KT2440
ccccaagcuucaccu

SEQ ID NO: 1588086 - RNA, 20 nt, Pseudomonas putida KT2440
ccccaauaaaaaaccggcca

SEQ ID NO: 1588087 - RNA, 19 nt, Pseudomonas putida KT2440
ccccaaucuccagcccgaa

SEQ ID NO: 1588088 - RNA, 19 nt, Pseudomonas putida KT2440
cccaucccgcuucgccagc

SEQ ID NO: 1588089 - RNA, 13 nt, Pseudomonas putida KT2440
cccauccaacgca

SEQ ID NO: 1588090 - RNA, 14 nt, Pseudomonas putida KT2440
cccauccacaucgc

SEQ ID NO: 1588091 - RNA, 23 nt, Pseudomonas putida KT2440
ccccaccuggcccugcucacgca

SEQ ID NO: 1588092 - RNA, 13 nt, Pseudomonas putida KT2440
ccccacagggcaa

SEQ ID NO: 1588093 - RNA, 13 nt, Pseudomonas putida KT2440
ccccaccaggcaa

SEQ ID NO: 1588094 - RNA, 12 nt, Pseudomonas putida KT2440
ccccagcaacgg

SEQ ID NO: 1588095 - RNA, 23 nt, Pseudomonas putida KT2440
ccccagcaacggguucagguaca

SEQ ID NO: 1588096 - RNA, 22 nt, Pseudomonas putida KT2440
ccccagcaaggcaaucgugauc

SEQ ID NO: 1588097 - RNA, 14 nt, Pseudomonas putida KT2440
ccccacucgcgcag

SEQ ID NO: 1588098 - RNA, 19 nt, Pseudomonas putida KT2440
ccccacucgcgcagcacau

SEQ ID NO: 1588099 - RNA, 15 nt, Pseudomonas putida KT2440
ccccagcauggccga

SEQ ID NO: 1588100 - RNA, 12 nt, Pseudomonas putida KT2440
ccccagcccgaa

SEQ ID NO: 1588101 - RNA, 18 nt, Pseudomonas putida KT2440
ccccagcaguucgcgcac

SEQ ID NO: 1588102 - RNA, 15 nt, Pseudomonas putida KT2440
cccacgccggcaacc

SEQ ID NO: 1588103 - RNA, 11 nt, Pseudomonas putida KT2440
cccacgccgac

SEQ ID NO: 1588104 - RNA, 14 nt, Pseudomonas putida KT2440
cccacgcacaucgu

SEQ ID NO: 1588105 - RNA, 17 nt, Pseudomonas putida KT2440
cccagauucuggcaggc

SEQ ID NO: 1588106 - RNA, 14 nt, Pseudomonas putida KT2440
cccagcaacggauu

SEQ ID NO: 1588107 - RNA, 14 nt, Pseudomonas putida KT2440
cccagcaacagccc

SEQ ID NO: 1588108 - RNA, 20 nt, Pseudomonas putida KT2440
cccagaugcgggcccugguc

SEQ ID NO: 1588109 - RNA, 20 nt, Pseudomonas putida KT2440
cccacccuugaagacaucga

SEQ ID NO: 1588110 - RNA, 22 nt, Pseudomonas putida KT2440
cccacccauuccgccgucaccg

SEQ ID NO: 1588111 - RNA, 18 nt, Pseudomonas putida KT2440
cccaccaggauuggccgc

SEQ ID NO: 1588112 - RNA, 19 nt, Pseudomonas putida KT2440
cccaccgcauugcaggcca

SEQ ID NO: 1588113 - RNA, 22 nt, Pseudomonas putida KT2440
ccauugcaccacccccagcgcc

SEQ ID NO: 1588114 - RNA, 15 nt, Pseudomonas putida KT2440
ccauucgcgggcaag

SEQ ID NO: 1588115 - RNA, 19 nt, Pseudomonas putida KT2440
ccauucgcggguaaacccg

SEQ ID NO: 1588116 - RNA, 18 nt, Pseudomonas putida KT2440
ccauucccugcacaucgc

SEQ ID NO: 1588117 - RNA, 14 nt, Pseudomonas putida KT2440
cccagcagcgggca

SEQ ID NO: 1588118 - RNA, 18 nt, Pseudomonas putida KT2440
cccagcgcgccagcaggu

SEQ ID NO: 1588119 - RNA, 14 nt, Pseudomonas putida KT2440
cccagcgcggcaaa

SEQ ID NO: 1588120 - RNA, 12 nt, Pseudomonas putida KT2440
cccagcacuucg

SEQ ID NO: 1588121 - RNA, 23 nt, Pseudomonas putida KT2440
cccagcuacgcgagccaccgucg

SEQ ID NO: 1588122 - RNA, 15 nt, Pseudomonas putida KT2440
cccagcucgaucagc

SEQ ID NO: 1588123 - RNA, 15 nt, Pseudomonas putida KT2440
cccagcucgccaaca

SEQ ID NO: 1588124 - RNA, 16 nt, Pseudomonas putida KT2440
cccagcucgcuggcca

SEQ ID NO: 1588125 - RNA, 13 nt, Pseudomonas putida KT2440
cccagcuccagca

SEQ ID NO: 1588126 - RNA, 21 nt, Pseudomonas putida KT2440
cccagcguauagccaccgggc

SEQ ID NO: 1588127 - RNA, 22 nt, Pseudomonas putida KT2440
cccagguugcaccucggaugcc

SEQ ID NO: 1588128 - RNA, 15 nt, Pseudomonas putida KT2440
cccaggccgacacgg

SEQ ID NO: 1588129 - RNA, 13 nt, Pseudomonas putida KT2440
cccaggauuaccg

SEQ ID NO: 1588130 - RNA, 17 nt, Pseudomonas putida KT2440
cccaggauuaccggucu

SEQ ID NO: 1588131 - RNA, 20 nt, Pseudomonas putida KT2440
cccaggccaucagcagcugu

SEQ ID NO: 1588132 - RNA, 16 nt, Pseudomonas putida KT2440
cccaggccauccagcg

SEQ ID NO: 1588133 - RNA, 17 nt, Pseudomonas putida KT2440
cccaggcauugcaaggu

SEQ ID NO: 1588134 - RNA, 15 nt, Pseudomonas putida KT2440
cccagucuuggcucg

SEQ ID NO: 1588135 - RNA, 19 nt, Pseudomonas putida KT2440
cccaguagaucgcgccagu

SEQ ID NO: 1588136 - RNA, 13 nt, Pseudomonas putida KT2440
cccaucagcagcu

SEQ ID NO: 1588137 - RNA, 15 nt, Pseudomonas putida KT2440
cccaucaccggcacc

SEQ ID NO: 1588138 - RNA, 14 nt, Pseudomonas putida KT2440
cccaucacgcggua

SEQ ID NO: 1588139 - RNA, 19 nt, Pseudomonas putida KT2440
cccaucacgcgguauucga

SEQ ID NO: 1588140 - RNA, 16 nt, Pseudomonas putida KT2440
cccaguggcacaccau

SEQ ID NO: 1588141 - RNA, 21 nt, Pseudomonas putida KT2440
cccggccgacacaccaauggc

SEQ ID NO: 1588142 - RNA, 21 nt, Pseudomonas putida KT2440
cccggccuccucgcgggcaaa

SEQ ID NO: 1588143 - RNA, 18 nt, Pseudomonas putida KT2440
cccggccgcuugcaaccg

SEQ ID NO: 1588144 - RNA, 14 nt, Pseudomonas putida KT2440
cccggccagcaggu

SEQ ID NO: 1588145 - RNA, 16 nt, Pseudomonas putida KT2440
cccggccagcagguca

SEQ ID NO: 1588146 - RNA, 13 nt, Pseudomonas putida KT2440
cccggccagcgac

SEQ ID NO: 1588147 - RNA, 14 nt, Pseudomonas putida KT2440
cccggccaggucac

SEQ ID NO: 1588148 - RNA, 14 nt, Pseudomonas putida KT2440
cccggaccagcgcc

SEQ ID NO: 1588149 - RNA, 13 nt, Pseudomonas putida KT2440
cccggaaucggcu

SEQ ID NO: 1588150 - RNA, 18 nt, Pseudomonas putida KT2440
cccggacaacuuggcacc

SEQ ID NO: 1588151 - RNA, 20 nt, Pseudomonas putida KT2440
cccggacaacuuggcaccga

SEQ ID NO: 1588152 - RNA, 23 nt, Pseudomonas putida KT2440
cccggaagcuucucgagcggccu

SEQ ID NO: 1588153 - RNA, 20 nt, Pseudomonas putida KT2440
cccggcaaacuccacugugc

SEQ ID NO: 1588154 - RNA, 18 nt, Pseudomonas putida KT2440
cccggcaaucgggauggc

SEQ ID NO: 1588155 - RNA, 13 nt, Pseudomonas putida KT2440
cccggcauccgcc

SEQ ID NO: 1588156 - RNA, 20 nt, Pseudomonas putida KT2440
cccggcaucgcucaacuggc

SEQ ID NO: 1588157 - RNA, 16 nt, Pseudomonas putida KT2440
cccggcaucgcugccg

SEQ ID NO: 1588158 - RNA, 17 nt, Pseudomonas putida KT2440
cccggcucaccgcagcc

SEQ ID NO: 1588159 - RNA, 19 nt, Pseudomonas putida KT2440
cccggcucaccgcagccca

SEQ ID NO: 1588160 - RNA, 17 nt, Pseudomonas putida KT2440
cccgguagaagcggucg

SEQ ID NO: 1588161 - RNA, 18 nt, Pseudomonas putida KT2440
cccgguacgacgcaccag

SEQ ID NO: 1588162 - RNA, 15 nt, Pseudomonas putida KT2440
cccgguaccagcagg

SEQ ID NO: 1588163 - RNA, 16 nt, Pseudomonas putida KT2440
cccgguaccagcaggc

SEQ ID NO: 1588164 - RNA, 20 nt, Pseudomonas putida KT2440
cccggucaccucgcaaccau

SEQ ID NO: 1588165 - RNA, 22 nt, Pseudomonas putida KT2440
cccgggccuucaaccucacugg

SEQ ID NO: 1588166 - RNA, 20 nt, Pseudomonas putida KT2440
cccgggcgcaggggucuuug

SEQ ID NO: 1588167 - RNA, 16 nt, Pseudomonas putida KT2440
cccggcugaaaccgcg

SEQ ID NO: 1588168 - RNA, 15 nt, Pseudomonas putida KT2440
cccgggccgcuugcu

SEQ ID NO: 1588169 - RNA, 19 nt, Pseudomonas putida KT2440
cccgcacagcacguucagc

SEQ ID NO: 1588170 - RNA, 18 nt, Pseudomonas putida KT2440
cccgcaccucacaacgcg

SEQ ID NO: 1588171 - RNA, 22 nt, Pseudomonas putida KT2440
cccgcaccucacaacgcgcauc

SEQ ID NO: 1588172 - RNA, 19 nt, Pseudomonas putida KT2440
ccccggcuaucucaggcca

SEQ ID NO: 1588173 - RNA, 15 nt, Pseudomonas putida KT2440
ccccggcgacggcga

SEQ ID NO: 1588174 - RNA, 12 nt, Pseudomonas putida KT2440
cccgcagcaggu

SEQ ID NO: 1588175 - RNA, 22 nt, Pseudomonas putida KT2440
cccgcaggaauaacuggcccga

SEQ ID NO: 1588176 - RNA, 16 nt, Pseudomonas putida KT2440
cccgcaggccgcagcc

SEQ ID NO: 1588177 - RNA, 18 nt, Pseudomonas putida KT2440
cccgcaggcuaugccggu

SEQ ID NO: 1588178 - RNA, 14 nt, Pseudomonas putida KT2440
cccgccgccaccag

SEQ ID NO: 1588179 - RNA, 18 nt, Pseudomonas putida KT2440
cccgccgccaccagcgcc

SEQ ID NO: 1588180 - RNA, 20 nt, Pseudomonas putida KT2440
cccgcccugagccaaggccg

SEQ ID NO: 1588181 - RNA, 23 nt, Pseudomonas putida KT2440
cccgccgaagccaugagcgagcu

SEQ ID NO: 1588182 - RNA, 17 nt, Pseudomonas putida KT2440
cccgcccuccagccgcg

SEQ ID NO: 1588183 - RNA, 18 nt, Pseudomonas putida KT2440
cccgcuggccgcacccag

SEQ ID NO: 1588184 - RNA, 23 nt, Pseudomonas putida KT2440
cccgcuggccgcacccagcaggc

SEQ ID NO: 1588185 - RNA, 20 nt, Pseudomonas putida KT2440
cccgcuggaccuggcuggcg

SEQ ID NO: 1588186 - RNA, 19 nt, Pseudomonas putida KT2440
cccgcugcugcggcaacga

SEQ ID NO: 1588187 - RNA, 16 nt, Pseudomonas putida KT2440
cccgcugcacaggcca

SEQ ID NO: 1588188 - RNA, 21 nt, Pseudomonas putida KT2440
cccgcugaaacaucagccggu

SEQ ID NO: 1588189 - RNA, 20 nt, Pseudomonas putida KT2440
cccgcucggucagggcggca

SEQ ID NO: 1588190 - RNA, 17 nt, Pseudomonas putida KT2440
cccgcucccacagguaa

SEQ ID NO: 1588191 - RNA, 20 nt, Pseudomonas putida KT2440
cccgcucccacagguaaugc

SEQ ID NO: 1588192 - RNA, 20 nt, Pseudomonas putida KT2440
cccgcucccacagguacuga

SEQ ID NO: 1588193 - RNA, 19 nt, Pseudomonas putida KT2440
cccgcucccacagguaugu

SEQ ID NO: 1588194 - RNA, 20 nt, Pseudomonas putida KT2440
cccgcucccacagguccagc

SEQ ID NO: 1588195 - RNA, 20 nt, Pseudomonas putida KT2440
cccgcucccacaggugcagc

SEQ ID NO: 1588196 - RNA, 20 nt, Pseudomonas putida KT2440
cccgcucccacagguuuagc

SEQ ID NO: 1588197 - RNA, 14 nt, Pseudomonas putida KT2440
cccgcguucaugcc

SEQ ID NO: 1588198 - RNA, 18 nt, Pseudomonas putida KT2440
cccgcuauccucgaucgc

SEQ ID NO: 1588199 - RNA, 15 nt, Pseudomonas putida KT2440
cccgcguuugcaacu

SEQ ID NO: 1588200 - RNA, 22 nt, Pseudomonas putida KT2440
cccgcuacaccggccuggauaa

SEQ ID NO: 1588201 - RNA, 20 nt, Pseudomonas putida KT2440
cccgcgaaagggccaguaca

SEQ ID NO: 1588202 - RNA, 20 nt, Pseudomonas putida KT2440
cccgcgaaagggccagucca

SEQ ID NO: 1588203 - RNA, 21 nt, Pseudomonas putida KT2440
cccgcgaaagggccgcaacgc

SEQ ID NO: 1588204 - RNA, 22 nt, Pseudomonas putida KT2440
cccgcgaaagggccgcaacgcg

SEQ ID NO: 1588205 - RNA, 16 nt, Pseudomonas putida KT2440
cccgccuggcgccugc

SEQ ID NO: 1588206 - RNA, 22 nt, Pseudomonas putida KT2440
cccgccuggcgccugcgccagu

SEQ ID NO: 1588207 - RNA, 16 nt, Pseudomonas putida KT2440
cccgccugcuggccgc

SEQ ID NO: 1588208 - RNA, 19 nt, Pseudomonas putida KT2440
cccgccugacgccgccagc

SEQ ID NO: 1588209 - RNA, 18 nt, Pseudomonas putida KT2440
cccgccuccugaagggcc

SEQ ID NO: 1588210 - RNA, 18 nt, Pseudomonas putida KT2440
cccgcgccuacaggcaac

SEQ ID NO: 1588211 - RNA, 20 nt, Pseudomonas putida KT2440
cccgcgccuacaggcaaccg

SEQ ID NO: 1588212 - RNA, 12 nt, Pseudomonas putida KT2440
cccgcgccugca

SEQ ID NO: 1588213 - RNA, 14 nt, Pseudomonas putida KT2440
cccgcgcugccucg

SEQ ID NO: 1588214 - RNA, 17 nt, Pseudomonas putida KT2440
cccgcgccgacagccuc

SEQ ID NO: 1588215 - RNA, 15 nt, Pseudomonas putida KT2440
cccgcgaacaggccc

SEQ ID NO: 1588216 - RNA, 14 nt, Pseudomonas putida KT2440
ccgaagggcagggc

SEQ ID NO: 1588217 - RNA, 16 nt, Pseudomonas putida KT2440
ccgaagggcagggcga

SEQ ID NO: 1588218 - RNA, 16 nt, Pseudomonas putida KT2440
ccgaagcuaucgccag

SEQ ID NO: 1588219 - RNA, 18 nt, Pseudomonas putida KT2440
ccgaagcuaucgccagca

SEQ ID NO: 1588220 - RNA, 23 nt, Pseudomonas putida KT2440
ccgaagcuaucgccagcaggccg

SEQ ID NO: 1588221 - RNA, 16 nt, Pseudomonas putida KT2440
ccgaagucauccaugg

SEQ ID NO: 1588222 - RNA, 16 nt, Pseudomonas putida KT2440
ccgaccacgguaccgg

SEQ ID NO: 1588223 - RNA, 23 nt, Pseudomonas putida KT2440
ccgacaggcuguguggccggcca

SEQ ID NO: 1588224 - RNA, 17 nt, Pseudomonas putida KT2440
ccgacaguguugccggc

SEQ ID NO: 1588225 - RNA, 22 nt, Pseudomonas putida KT2440
ccgacagcuugcccagcugcgg

SEQ ID NO: 1588226 - RNA, 22 nt, Pseudomonas putida KT2440
ccgacagcggcgaaggauggac

SEQ ID NO: 1588227 - RNA, 12 nt, Pseudomonas putida KT2440
ccgacagcgcag

SEQ ID NO: 1588228 - RNA, 15 nt, Pseudomonas putida KT2440
ccgaccgaaccggcg

SEQ ID NO: 1588229 - RNA, 16 nt, Pseudomonas putida KT2440
ccgaccggucggccau

SEQ ID NO: 1588230 - RNA, 21 nt, Pseudomonas putida KT2440
ccgaccucacgcagguacucg

SEQ ID NO: 1588231 - RNA, 13 nt, Pseudomonas putida KT2440
ccgaccaucggca

SEQ ID NO: 1588232 - RNA, 14 nt, Pseudomonas putida KT2440
ccgaccgcgcgcac

SEQ ID NO: 1588233 - RNA, 16 nt, Pseudomonas putida KT2440
cccucggcaaucugca

SEQ ID NO: 1588234 - RNA, 21 nt, Pseudomonas putida KT2440
cccucggcaaucugcagcagc

SEQ ID NO: 1588235 - RNA, 23 nt, Pseudomonas putida KT2440
cccucggcaaucugcagcagcau

SEQ ID NO: 1588236 - RNA, 19 nt, Pseudomonas putida KT2440
cccucgcgcguugcagcca

SEQ ID NO: 1588237 - RNA, 14 nt, Pseudomonas putida KT2440
cccucggcgccaua

SEQ ID NO: 1588238 - RNA, 16 nt, Pseudomonas putida KT2440
cccucaagggauuggc

SEQ ID NO: 1588239 - RNA, 17 nt, Pseudomonas putida KT2440
cccucaagggcgcugau

SEQ ID NO: 1588240 - RNA, 16 nt, Pseudomonas putida KT2440
cccucacgcgccaggu

SEQ ID NO: 1588241 - RNA, 13 nt, Pseudomonas putida KT2440
cccugccagcacc

SEQ ID NO: 1588242 - RNA, 20 nt, Pseudomonas putida KT2440
cccugcagcuucccggccug

SEQ ID NO: 1588243 - RNA, 18 nt, Pseudomonas putida KT2440
cccugcucguccaucacc

SEQ ID NO: 1588244 - RNA, 19 nt, Pseudomonas putida KT2440
cccugcucguccaucaccg

SEQ ID NO: 1588245 - RNA, 20 nt, Pseudomonas putida KT2440
cccugcucguccaucaccgc

SEQ ID NO: 1588246 - RNA, 20 nt, Pseudomonas putida KT2440
cccugcaacagggcgcuugc

SEQ ID NO: 1588247 - RNA, 20 nt, Pseudomonas putida KT2440
cccugaucugccccucgauc

SEQ ID NO: 1588248 - RNA, 14 nt, Pseudomonas putida KT2440
cccugaucgaugag

SEQ ID NO: 1588249 - RNA, 20 nt, Pseudomonas putida KT2440
cccugaucgaugagcgagcc

SEQ ID NO: 1588250 - RNA, 16 nt, Pseudomonas putida KT2440
cccguucgcccugcgc

SEQ ID NO: 1588251 - RNA, 20 nt, Pseudomonas putida KT2440
cccguugaggguggcaaugc

SEQ ID NO: 1588252 - RNA, 16 nt, Pseudomonas putida KT2440
cccguugcgcagcagc

SEQ ID NO: 1588253 - RNA, 19 nt, Pseudomonas putida KT2440
cccuaucagggcugcgaca

SEQ ID NO: 1588254 - RNA, 21 nt, Pseudomonas putida KT2440
cccuauacacaugcacaggcc

SEQ ID NO: 1588255 - RNA, 22 nt, Pseudomonas putida KT2440
ccgaacagucauccagaaagcg

SEQ ID NO: 1588256 - RNA, 20 nt, Pseudomonas putida KT2440
ccgaacaggccggcugcagu

SEQ ID NO: 1588257 - RNA, 20 nt, Pseudomonas putida KT2440
cccuuucgcgggagacccgu

SEQ ID NO: 1588258 - RNA, 14 nt, Pseudomonas putida KT2440
cccuuugguacugc

SEQ ID NO: 1588259 - RNA, 19 nt, Pseudomonas putida KT2440
ccgaacuggccggucuguu

SEQ ID NO: 1588260 - RNA, 17 nt, Pseudomonas putida KT2440
cccuggacaaucucggc

SEQ ID NO: 1588261 - RNA, 16 nt, Pseudomonas putida KT2440
cccugcugcuggcacg

SEQ ID NO: 1588262 - RNA, 20 nt, Pseudomonas putida KT2440
cccugcucuucgauccgcgc

SEQ ID NO: 1588263 - RNA, 23 nt, Pseudomonas putida KT2440
cccugcucuucgauccgcgccau

SEQ ID NO: 1588264 - RNA, 15 nt, Pseudomonas putida KT2440
cccuuccccccuggc

SEQ ID NO: 1588265 - RNA, 18 nt, Pseudomonas putida KT2440
cccuucaucgccgggucc

SEQ ID NO: 1588266 - RNA, 12 nt, Pseudomonas putida KT2440
cccuucaggccc

SEQ ID NO: 1588267 - RNA, 14 nt, Pseudomonas putida KT2440
cccuucgcaggcac

SEQ ID NO: 1588268 - RNA, 14 nt, Pseudomonas putida KT2440
cccuuccgcgugcc

SEQ ID NO: 1588269 - RNA, 16 nt, Pseudomonas putida KT2440
cccuucggccagcagu

SEQ ID NO: 1588270 - RNA, 23 nt, Pseudomonas putida KT2440
cccuugaugaucaggucggcggc

SEQ ID NO: 1588271 - RNA, 16 nt, Pseudomonas putida KT2440
cccuugccaccagugc

SEQ ID NO: 1588272 - RNA, 13 nt, Pseudomonas putida KT2440
cccuuggcgacgu

SEQ ID NO: 1588273 - RNA, 19 nt, Pseudomonas putida KT2440
cccuugguccgggucugau

SEQ ID NO: 1588274 - RNA, 15 nt, Pseudomonas putida KT2440
cccuugucagccgcc

SEQ ID NO: 1588275 - RNA, 22 nt, Pseudomonas putida KT2440
aucacaugcggcaccgccagcu

SEQ ID NO: 1588276 - RNA, 13 nt, Pseudomonas putida KT2440
aucacaccggccg

SEQ ID NO: 1588277 - RNA, 23 nt, Pseudomonas putida KT2440
aucaccgcaagcugcaccgccac

SEQ ID NO: 1588278 - RNA, 15 nt, Pseudomonas putida KT2440
aucacccuuggccac

SEQ ID NO: 1588279 - RNA, 21 nt, Pseudomonas putida KT2440
aucacccgggaacagcagcac

SEQ ID NO: 1588280 - RNA, 17 nt, Pseudomonas putida KT2440
aucaccgccgccaccga

SEQ ID NO: 1588281 - RNA, 13 nt, Pseudomonas putida KT2440
aucaccgguaccg

SEQ ID NO: 1588282 - RNA, 14 nt, Pseudomonas putida KT2440
aucaccugcggccu

SEQ ID NO: 1588283 - RNA, 21 nt, Pseudomonas putida KT2440
aucacgucacagccaagccuu

SEQ ID NO: 1588284 - RNA, 17 nt, Pseudomonas putida KT2440
aucacgcgaccucagcc

SEQ ID NO: 1588285 - RNA, 19 nt, Pseudomonas putida KT2440
aucagcaacccggccaggc

SEQ ID NO: 1588286 - RNA, 18 nt, Pseudomonas putida KT2440
aucagcaaaccgaccagg

SEQ ID NO: 1588287 - RNA, 20 nt, Pseudomonas putida KT2440
aucagcaaaccgaccaggca

SEQ ID NO: 1588288 - RNA, 22 nt, Pseudomonas putida KT2440
aucagagcgccagcaagcgcau

SEQ ID NO: 1588289 - RNA, 20 nt, Pseudomonas putida KT2440
aucagagcgugaagcggaca

SEQ ID NO: 1588290 - RNA, 14 nt, Pseudomonas putida KT2440
aucacuuccauggc

SEQ ID NO: 1588291 - RNA, 22 nt, Pseudomonas putida KT2440
aucagccagccuucgccaacug

SEQ ID NO: 1588292 - RNA, 21 nt, Pseudomonas putida KT2440
aucagccgcgccauuggccgc

SEQ ID NO: 1588293 - RNA, 13 nt, Pseudomonas putida KT2440
aucagcgacacca

SEQ ID NO: 1588294 - RNA, 22 nt, Pseudomonas putida KT2440
aucagcaccgagucgccuucac

SEQ ID NO: 1588295 - RNA, 18 nt, Pseudomonas putida KT2440
aucagcacgcgaucggca

SEQ ID NO: 1588296 - RNA, 18 nt, Pseudomonas putida KT2440
aucagcagcugccggaac

SEQ ID NO: 1588297 - RNA, 16 nt, Pseudomonas putida KT2440
aucagcaggucggcgu

SEQ ID NO: 1588298 - RNA, 22 nt, Pseudomonas putida KT2440
aucagcaugcccagcgccaccg

SEQ ID NO: 1588299 - RNA, 16 nt, Pseudomonas putida KT2440
aucagccaacacccuc

SEQ ID NO: 1588300 - RNA, 14 nt, Pseudomonas putida KT2440
auaugccgccguuc

SEQ ID NO: 1588301 - RNA, 21 nt, Pseudomonas putida KT2440
auaugccgccguucaggcgcc

SEQ ID NO: 1588302 - RNA, 13 nt, Pseudomonas putida KT2440
auaugguggguau

SEQ ID NO: 1588303 - RNA, 14 nt, Pseudomonas putida KT2440
auagccggugccga

SEQ ID NO: 1588304 - RNA, 16 nt, Pseudomonas putida KT2440
auagccagcuggccac

SEQ ID NO: 1588305 - RNA, 20 nt, Pseudomonas putida KT2440
auagccgccagcaucacgcc

SEQ ID NO: 1588306 - RNA, 20 nt, Pseudomonas putida KT2440
auagcccaccuucacgccau

SEQ ID NO: 1588307 - RNA, 16 nt, Pseudomonas putida KT2440
auagccagggccugua

SEQ ID NO: 1588308 - RNA, 22 nt, Pseudomonas putida KT2440
auagccccgcaaucgucgacca

SEQ ID NO: 1588309 - RNA, 21 nt, Pseudomonas putida KT2440
auauccgccugaaucuugcgc

SEQ ID NO: 1588310 - RNA, 20 nt, Pseudomonas putida KT2440
aucaacgugguaaugcgcug

SEQ ID NO: 1588311 - RNA, 18 nt, Pseudomonas putida KT2440
aucaagcccgcucgccac

SEQ ID NO: 1588312 - RNA, 20 nt, Pseudomonas putida KT2440
aucaagcccgcucgccacac

SEQ ID NO: 1588313 - RNA, 14 nt, Pseudomonas putida KT2440
aucaauaccggcau

SEQ ID NO: 1588314 - RNA, 12 nt, Pseudomonas putida KT2440
aucaacccguuc

SEQ ID NO: 1588315 - RNA, 20 nt, Pseudomonas putida KT2440
aucaacccgcgaagcggcca

SEQ ID NO: 1588316 - RNA, 17 nt, Pseudomonas putida KT2440
auacucuucgcgggcuc

SEQ ID NO: 1588317 - RNA, 17 nt, Pseudomonas putida KT2440
auacuggcgcugaucau

SEQ ID NO: 1588318 - RNA, 22 nt, Pseudomonas putida KT2440
auacuggcgcugaucaucgaca

SEQ ID NO: 1588319 - RNA, 18 nt, Pseudomonas putida KT2440
auagcagcgcuaugccuu

SEQ ID NO: 1588320 - RNA, 16 nt, Pseudomonas putida KT2440
auagcagcaccgauca

SEQ ID NO: 1588321 - RNA, 15 nt, Pseudomonas putida KT2440
auagaguacucggcu

SEQ ID NO: 1588322 - RNA, 21 nt, Pseudomonas putida KT2440
auaccgauuaucgagcuacag

SEQ ID NO: 1588323 - RNA, 21 nt, Pseudomonas putida KT2440
auaccgccuauguacucggcg

SEQ ID NO: 1588324 - RNA, 18 nt, Pseudomonas putida KT2440
auacguuugcucuugacc

SEQ ID NO: 1588325 - RNA, 14 nt, Pseudomonas putida KT2440
auacucacccgcuu

SEQ ID NO: 1588326 - RNA, 23 nt, Pseudomonas putida KT2440
auacucacccgcuugccacggcg

SEQ ID NO: 1588327 - RNA, 19 nt, Pseudomonas putida KT2440
auacuccagcgucaccacc

SEQ ID NO: 1588328 - RNA, 23 nt, Pseudomonas putida KT2440
auaccgaacaccagugucaccga

SEQ ID NO: 1588329 - RNA, 16 nt, Pseudomonas putida KT2440
auacauagcgaucgau

SEQ ID NO: 1588330 - RNA, 19 nt, Pseudomonas putida KT2440
auacagcuugcccaucacc

SEQ ID NO: 1588331 - RNA, 23 nt, Pseudomonas putida KT2440
auacagcccuacgcagucagcca

SEQ ID NO: 1588332 - RNA, 21 nt, Pseudomonas putida KT2440
auacagcgcacucucccgcag

SEQ ID NO: 1588333 - RNA, 12 nt, Pseudomonas putida KT2440
auacagcgccuc

SEQ ID NO: 1588334 - RNA, 19 nt, Pseudomonas putida KT2440
auaacaccccccagcagcg

SEQ ID NO: 1588335 - RNA, 12 nt, Pseudomonas putida KT2440
aguuguccaggc

SEQ ID NO: 1588336 - RNA, 17 nt, Pseudomonas putida KT2440
aguuuaccuccaucacc

SEQ ID NO: 1588337 - RNA, 18 nt, Pseudomonas putida KT2440
auaaaaaaccccggcaca

SEQ ID NO: 1588338 - RNA, 19 nt, Pseudomonas putida KT2440
auaaaaaaccggcgcuugg

SEQ ID NO: 1588339 - RNA, 23 nt, Pseudomonas putida KT2440
auaaaccagcagcgccugcagcg

SEQ ID NO: 1588340 - RNA, 19 nt, Pseudomonas putida KT2440
aguucuugauccaguagcc

SEQ ID NO: 1588341 - RNA, 14 nt, Pseudomonas putida KT2440
aguucuuggcggcu

SEQ ID NO: 1588342 - RNA, 22 nt, Pseudomonas putida KT2440
aguucguccucgacccacggcu

SEQ ID NO: 1588343 - RNA, 19 nt, Pseudomonas putida KT2440
aguugcaggcgcagggugu

SEQ ID NO: 1588344 - RNA, 15 nt, Pseudomonas putida KT2440
aguugagcaccggca

SEQ ID NO: 1588345 - RNA, 13 nt, Pseudomonas putida KT2440
aguugagcgccgc

SEQ ID NO: 1588346 - RNA, 20 nt, Pseudomonas putida KT2440
aguugaccgugaucaucagc

SEQ ID NO: 1588347 - RNA, 14 nt, Pseudomonas putida KT2440
aguucguccaggcu

SEQ ID NO: 1588348 - RNA, 19 nt, Pseudomonas putida KT2440
agucgcacaugaagccgcg

SEQ ID NO: 1588349 - RNA, 17 nt, Pseudomonas putida KT2440
agucgauaaaccgugca

SEQ ID NO: 1588350 - RNA, 22 nt, Pseudomonas putida KT2440
agucgaucccgaggucagcagu

SEQ ID NO: 1588351 - RNA, 14 nt, Pseudomonas putida KT2440
agucgaaugccucg

SEQ ID NO: 1588352 - RNA, 23 nt, Pseudomonas putida KT2440
agucgaacaccaguucgccaucg

SEQ ID NO: 1588353 - RNA, 22 nt, Pseudomonas putida KT2440
aguggugguagaaggucggugc

SEQ ID NO: 1588354 - RNA, 16 nt, Pseudomonas putida KT2440
aguggugcucagcggc

SEQ ID NO: 1588355 - RNA, 20 nt, Pseudomonas putida KT2440
agugucagcguacacugcag

SEQ ID NO: 1588356 - RNA, 23 nt, Pseudomonas putida KT2440
aguuccaccggcaagcccauggc

SEQ ID NO: 1588357 - RNA, 20 nt, Pseudomonas putida KT2440
agguuuggggugagcgaauc

SEQ ID NO: 1588358 - RNA, 15 nt, Pseudomonas putida KT2440
aguaaagccagcagc

SEQ ID NO: 1588359 - RNA, 16 nt, Pseudomonas putida KT2440
agguuggacagcgccc

SEQ ID NO: 1588360 - RNA, 17 nt, Pseudomonas putida KT2440
agguugcgcaagccuca

SEQ ID NO: 1588361 - RNA, 12 nt, Pseudomonas putida KT2440
agguugcccggc

SEQ ID NO: 1588362 - RNA, 22 nt, Pseudomonas putida KT2440
agguugcccucggccaccuggc

SEQ ID NO: 1588363 - RNA, 14 nt, Pseudomonas putida KT2440
agguugacggugug

SEQ ID NO: 1588364 - RNA, 17 nt, Pseudomonas putida KT2440
agguugagcaccgggca

SEQ ID NO: 1588365 - RNA, 23 nt, Pseudomonas putida KT2440
agguucgaccagaacaugccacg

SEQ ID NO: 1588366 - RNA, 16 nt, Pseudomonas putida KT2440
agguucgaauccugcu

SEQ ID NO: 1588367 - RNA, 13 nt, Pseudomonas putida KT2440
agguucucggcac

SEQ ID NO: 1588368 - RNA, 15 nt, Pseudomonas putida KT2440
aggugcuugcggaac

SEQ ID NO: 1588369 - RNA, 15 nt, Pseudomonas putida KT2440
agguggaucagccgc

SEQ ID NO: 1588370 - RNA, 15 nt, Pseudomonas putida KT2440
agguguucaccacgc

SEQ ID NO: 1588371 - RNA, 14 nt, Pseudomonas putida KT2440
agguguuccagcac

SEQ ID NO: 1588372 - RNA, 17 nt, Pseudomonas putida KT2440
aggugucaccgcgagca

SEQ ID NO: 1588373 - RNA, 15 nt, Pseudomonas putida KT2440
agguggucgaggcaa

SEQ ID NO: 1588374 - RNA, 13 nt, Pseudomonas putida KT2440
agguucaggcgca

SEQ ID NO: 1588375 - RNA, 16 nt, Pseudomonas putida KT2440
agguucacuuccacac

SEQ ID NO: 1588376 - RNA, 15 nt, Pseudomonas putida KT2440
aguacaugaucgggu

SEQ ID NO: 1588377 - RNA, 15 nt, Pseudomonas putida KT2440
aguacaaacgccaga

SEQ ID NO: 1588378 - RNA, 15 nt, Pseudomonas putida KT2440
aguaaugcagccggc

SEQ ID NO: 1588379 - RNA, 15 nt, Pseudomonas putida KT2440
aguccgaagcgaaca

SEQ ID NO: 1588380 - RNA, 21 nt, Pseudomonas putida KT2440
agucccgccauauucgcggcg

SEQ ID NO: 1588381 - RNA, 18 nt, Pseudomonas putida KT2440
aguccgacucauguaucg

SEQ ID NO: 1588382 - RNA, 14 nt, Pseudomonas putida KT2440
aggucacggcuguc

SEQ ID NO: 1588383 - RNA, 13 nt, Pseudomonas putida KT2440
aggucaacggcaa

SEQ ID NO: 1588384 - RNA, 21 nt, Pseudomonas putida KT2440
agguaggcaccccggccgcuu

SEQ ID NO: 1588385 - RNA, 20 nt, Pseudomonas putida KT2440
agguacucugucacccgcug

SEQ ID NO: 1588386 - RNA, 20 nt, Pseudomonas putida KT2440
agguaccccaccggccugga

SEQ ID NO: 1588387 - RNA, 22 nt, Pseudomonas putida KT2440
agggugcggauaccgcuggccg

SEQ ID NO: 1588388 - RNA, 21 nt, Pseudomonas putida KT2440
agggccaggccgauggcgaug

SEQ ID NO: 1588389 - RNA, 18 nt, Pseudomonas putida KT2440
aggggcugccuugcagcc

SEQ ID NO: 1588390 - RNA, 21 nt, Pseudomonas putida KT2440
agggguagcgucaacugccag

SEQ ID NO: 1588391 - RNA, 16 nt, Pseudomonas putida KT2440
agggggguaaggcugg

SEQ ID NO: 1588392 - RNA, 17 nt, Pseudomonas putida KT2440
agggggguaaggcuggc

SEQ ID NO: 1588393 - RNA, 18 nt, Pseudomonas putida KT2440
aggguauugaacggcgca

SEQ ID NO: 1588394 - RNA, 17 nt, Pseudomonas putida KT2440
agggguguucagugauu

SEQ ID NO: 1588395 - RNA, 12 nt, Pseudomonas putida KT2440
agggcaggcuga

SEQ ID NO: 1588396 - RNA, 14 nt, Pseudomonas putida KT2440
agggcaaugaucag

SEQ ID NO: 1588397 - RNA, 13 nt, Pseudomonas putida KT2440
agggcaugggcca

SEQ ID NO: 1588398 - RNA, 14 nt, Pseudomonas putida KT2440
agggaugcuggaca

SEQ ID NO: 1588399 - RNA, 11 nt, Pseudomonas putida KT2440
aggucggcgcg

SEQ ID NO: 1588400 - RNA, 15 nt, Pseudomonas putida KT2440
aggucgccaggcgcg

SEQ ID NO: 1588401 - RNA, 21 nt, Pseudomonas putida KT2440
aggucggcgauggucaaccgg

SEQ ID NO: 1588402 - RNA, 20 nt, Pseudomonas putida KT2440
aggucggggcgguagccgaa

SEQ ID NO: 1588403 - RNA, 14 nt, Pseudomonas putida KT2440
aggucaugaugccc

SEQ ID NO: 1588404 - RNA, 16 nt, Pseudomonas putida KT2440
aggucaucgcugcggu

SEQ ID NO: 1588405 - RNA, 16 nt, Pseudomonas putida KT2440
aggucaggacaucgcg

SEQ ID NO: 1588406 - RNA, 13 nt, Pseudomonas putida KT2440
aggucgaccugcc

SEQ ID NO: 1588407 - RNA, 15 nt, Pseudomonas putida KT2440
aggucgaccugccag

SEQ ID NO: 1588408 - RNA, 17 nt, Pseudomonas putida KT2440
aggucgacgaucgccgc

SEQ ID NO: 1588409 - RNA, 17 nt, Pseudomonas putida KT2440
aggucgaugcugcugag

SEQ ID NO: 1588410 - RNA, 20 nt, Pseudomonas putida KT2440
aggucgaugccuuccaggcg

SEQ ID NO: 1588411 - RNA, 19 nt, Pseudomonas putida KT2440
aggugcagcaacagguaca

SEQ ID NO: 1588412 - RNA, 17 nt, Pseudomonas putida KT2440
aggugcaacccggccuu

SEQ ID NO: 1588413 - RNA, 21 nt, Pseudomonas putida KT2440
aggugccgucgggcacgauca

SEQ ID NO: 1588414 - RNA, 20 nt, Pseudomonas putida KT2440
aggugcgcaggcuuucggcc

SEQ ID NO: 1588415 - RNA, 16 nt, Pseudomonas putida KT2440
aggugcgcgcgcgaca

SEQ ID NO: 1588416 - RNA, 18 nt, Pseudomonas putida KT2440
aggugcgcggcaggucga

SEQ ID NO: 1588417 - RNA, 23 nt, Pseudomonas putida KT2440
aggugcccaagcggcacuaccag

SEQ ID NO: 1588418 - RNA, 18 nt, Pseudomonas putida KT2440
aggugccaacaggcagca

SEQ ID NO: 1588419 - RNA, 15 nt, Pseudomonas putida KT2440
aggugccaggcucag

SEQ ID NO: 1588420 - RNA, 16 nt, Pseudomonas putida KT2440
aggugacaagcugcgc

SEQ ID NO: 1588421 - RNA, 15 nt, Pseudomonas putida KT2440
aggucuucucggcag

SEQ ID NO: 1588422 - RNA, 13 nt, Pseudomonas putida KT2440
aggucuaaccgcg

SEQ ID NO: 1588423 - RNA, 17 nt, Pseudomonas putida KT2440
aggucggucagcaccgu

SEQ ID NO: 1588424 - RNA, 22 nt, Pseudomonas putida KT2440
aggccggaacaggcuaaagugc

SEQ ID NO: 1588425 - RNA, 18 nt, Pseudomonas putida KT2440
aggccgcucccacaggua

SEQ ID NO: 1588426 - RNA, 13 nt, Pseudomonas putida KT2440
aggccgcugagga

SEQ ID NO: 1588427 - RNA, 16 nt, Pseudomonas putida KT2440
aggccgccugcccgcc

SEQ ID NO: 1588428 - RNA, 13 nt, Pseudomonas putida KT2440
aggccggccacca

SEQ ID NO: 1588429 - RNA, 13 nt, Pseudomonas putida KT2440
aggccggccauac

SEQ ID NO: 1588430 - RNA, 13 nt, Pseudomonas putida KT2440
aggccggcaccga

SEQ ID NO: 1588431 - RNA, 22 nt, Pseudomonas putida KT2440
aggccggcacuggcuacagauc

SEQ ID NO: 1588432 - RNA, 19 nt, Pseudomonas putida KT2440
aggccggcacagaccgcaa

SEQ ID NO: 1588433 - RNA, 21 nt, Pseudomonas putida KT2440
aggccgguaggucuaaccgcg

SEQ ID NO: 1588434 - RNA, 18 nt, Pseudomonas putida KT2440
aggccgacaguguugccg

SEQ ID NO: 1588435 - RNA, 22 nt, Pseudomonas putida KT2440
aggcccaguucggacaggcgcu

SEQ ID NO: 1588436 - RNA, 22 nt, Pseudomonas putida KT2440
aggcccauguggcgcagcaccg

SEQ ID NO: 1588437 - RNA, 20 nt, Pseudomonas putida KT2440
aggccccagggggcagcugc

SEQ ID NO: 1588438 - RNA, 21 nt, Pseudomonas putida KT2440
aggccccagggggcagcugcu

SEQ ID NO: 1588439 - RNA, 23 nt, Pseudomonas putida KT2440
aggcccagcaugaacgcagcuuc

SEQ ID NO: 1588440 - RNA, 18 nt, Pseudomonas putida KT2440
aggccgccauugaugccg

SEQ ID NO: 1588441 - RNA, 19 nt, Pseudomonas putida KT2440
aggccaacgauuggcaguc

SEQ ID NO: 1588442 - RNA, 21 nt, Pseudomonas putida KT2440
aggccaaccacgccugcgccg

SEQ ID NO: 1588443 - RNA, 20 nt, Pseudomonas putida KT2440
aggcauuuucgaucaucgcc

SEQ ID NO: 1588444 - RNA, 17 nt, Pseudomonas putida KT2440
aggcauugcggccguca

SEQ ID NO: 1588445 - RNA, 23 nt, Pseudomonas putida KT2440
aggcauucggugugcucggcgau

SEQ ID NO: 1588446 - RNA, 20 nt, Pseudomonas putida KT2440
aggcaugaauaaccugguua

SEQ ID NO: 1588447 - RNA, 18 nt, Pseudomonas putida KT2440
aggcaugccagcagcugg

SEQ ID NO: 1588448 - RNA, 22 nt, Pseudomonas putida KT2440
aggcccagcaacagccccauca

SEQ ID NO: 1588449 - RNA, 13 nt, Pseudomonas putida KT2440
aggccauccagcg

SEQ ID NO: 1588450 - RNA, 23 nt, Pseudomonas putida KT2440
aggcccaacagcgcggagaggug

SEQ ID NO: 1588451 - RNA, 17 nt, Pseudomonas putida KT2440
aggccaucagcagcugu

SEQ ID NO: 1588452 - RNA, 18 nt, Pseudomonas putida KT2440
agcugccggccagcgccu

SEQ ID NO: 1588453 - RNA, 20 nt, Pseudomonas putida KT2440
agcugccacugcgcgcaaag

SEQ ID NO: 1588454 - RNA, 22 nt, Pseudomonas putida KT2440
agcugcaucagguagcugggcc

SEQ ID NO: 1588455 - RNA, 16 nt, Pseudomonas putida KT2440
agcugccauccagguu

SEQ ID NO: 1588456 - RNA, 21 nt, Pseudomonas putida KT2440
agcugccauuucuucagcagg

SEQ ID NO: 1588457 - RNA, 23 nt, Pseudomonas putida KT2440
agcugccauuucuucagcaggaa

SEQ ID NO: 1588458 - RNA, 23 nt, Pseudomonas putida KT2440
agcugcauuggcggcaggcgcag

SEQ ID NO: 1588459 - RNA, 11 nt, Pseudomonas putida KT2440
agcugcagcuu

SEQ ID NO: 1588460 - RNA, 15 nt, Pseudomonas putida KT2440
agcugcagcagcuuc

SEQ ID NO: 1588461 - RNA, 15 nt, Pseudomonas putida KT2440
agcugcgcgcgagag

SEQ ID NO: 1588462 - RNA, 19 nt, Pseudomonas putida KT2440
aggcggucggccagcggca

SEQ ID NO: 1588463 - RNA, 21 nt, Pseudomonas putida KT2440
aggcggucguagcccucgaug

SEQ ID NO: 1588464 - RNA, 17 nt, Pseudomonas putida KT2440
aggcgucguuguugcgc

SEQ ID NO: 1588465 - RNA, 14 nt, Pseudomonas putida KT2440
aggcgguccagcaa

SEQ ID NO: 1588466 - RNA, 18 nt, Pseudomonas putida KT2440
aggcgggagagcagggcu

SEQ ID NO: 1588467 - RNA, 13 nt, Pseudomonas putida KT2440
aggcgggucaggu

SEQ ID NO: 1588468 - RNA, 14 nt, Pseudomonas putida KT2440
aggcguuggccgaa

SEQ ID NO: 1588469 - RNA, 12 nt, Pseudomonas putida KT2440
aggcguggugca

SEQ ID NO: 1588470 - RNA, 14 nt, Pseudomonas putida KT2440
aggcuagccgguca

SEQ ID NO: 1588471 - RNA, 16 nt, Pseudomonas putida KT2440
aggcuacgcagcaccc

SEQ ID NO: 1588472 - RNA, 20 nt, Pseudomonas putida KT2440
aggcuacgcagcacccgguc

SEQ ID NO: 1588473 - RNA, 21 nt, Pseudomonas putida KT2440
aggcucaggccuucgccacug

SEQ ID NO: 1588474 - RNA, 20 nt, Pseudomonas putida KT2440
aggcucagcagguugaacag

SEQ ID NO: 1588475 - RNA, 12 nt, Pseudomonas putida KT2440
aggcugccgcgc

SEQ ID NO: 1588476 - RNA, 17 nt, Pseudomonas putida KT2440
aggcugcacaaggugcu

SEQ ID NO: 1588477 - RNA, 11 nt, Pseudomonas putida KT2440
aggcugcgcau

SEQ ID NO: 1588478 - RNA, 12 nt, Pseudomonas putida KT2440
agggagcgggcu

SEQ ID NO: 1588479 - RNA, 15 nt, Pseudomonas putida KT2440
aggcuuggcgaacag

SEQ ID NO: 1588480 - RNA, 20 nt, Pseudomonas putida KT2440
aggcgcggcagcaugaacag

SEQ ID NO: 1588481 - RNA, 21 nt, Pseudomonas putida KT2440
aggcgcggcagcaugaacagc

SEQ ID NO: 1588482 - RNA, 20 nt, Pseudomonas putida KT2440
aggcgcggguuuacccgcga

SEQ ID NO: 1588483 - RNA, 19 nt, Pseudomonas putida KT2440
aggcgcggguuugcccgcg

SEQ ID NO: 1588484 - RNA, 19 nt, Pseudomonas putida KT2440
aggcgcucgggggugcaca

SEQ ID NO: 1588485 - RNA, 23 nt, Pseudomonas putida KT2440
aggcgcucgggggugcacagcgu

SEQ ID NO: 1588486 - RNA, 21 nt, Pseudomonas putida KT2440
aggcgcguaguacuccagcag

SEQ ID NO: 1588487 - RNA, 22 nt, Pseudomonas putida KT2440
aggcgcguaguacuccagcagc

SEQ ID NO: 1588488 - RNA, 15 nt, Pseudomonas putida KT2440
aggcgcuucagguaa

SEQ ID NO: 1588489 - RNA, 19 nt, Pseudomonas putida KT2440
aggcgcuugagcucggcaa

SEQ ID NO: 1588490 - RNA, 13 nt, Pseudomonas putida KT2440
aggcgcuggcgcc

SEQ ID NO: 1588491 - RNA, 11 nt, Pseudomonas putida KT2440
aggcgcuggcg

SEQ ID NO: 1588492 - RNA, 21 nt, Pseudomonas putida KT2440
aggccucaagccucgcgcaac

SEQ ID NO: 1588493 - RNA, 17 nt, Pseudomonas putida KT2440
aggccucacgcaucugc

SEQ ID NO: 1588494 - RNA, 15 nt, Pseudomonas putida KT2440
aggcgaugcagggcu

SEQ ID NO: 1588495 - RNA, 22 nt, Pseudomonas putida KT2440
aggccggucuugucugacagca

SEQ ID NO: 1588496 - RNA, 16 nt, Pseudomonas putida KT2440
aggccguaggccaggu

SEQ ID NO: 1588497 - RNA, 19 nt, Pseudomonas putida KT2440
aggccguaggccagguaca

SEQ ID NO: 1588498 - RNA, 15 nt, Pseudomonas putida KT2440
agcagcagcgcaccg

SEQ ID NO: 1588499 - RNA, 13 nt, Pseudomonas putida KT2440
agcagcaggcccg

SEQ ID NO: 1588500 - RNA, 17 nt, Pseudomonas putida KT2440
agcagcagcuugcagcg

SEQ ID NO: 1588501 - RNA, 14 nt, Pseudomonas putida KT2440
agcagcaccgauca

SEQ ID NO: 1588502 - RNA, 13 nt, Pseudomonas putida KT2440
agcacucggcggc

SEQ ID NO: 1588503 - RNA, 23 nt, Pseudomonas putida KT2440
agcaccgccauggccaggucggu

SEQ ID NO: 1588504 - RNA, 16 nt, Pseudomonas putida KT2440
agcaccgccacaaucc

SEQ ID NO: 1588505 - RNA, 21 nt, Pseudomonas putida KT2440
agcaccgaaccggcgaucagg

SEQ ID NO: 1588506 - RNA, 15 nt, Pseudomonas putida KT2440
agcaccaucagagcg

SEQ ID NO: 1588507 - RNA, 14 nt, Pseudomonas putida KT2440
agcacccgcaggcg

SEQ ID NO: 1588508 - RNA, 21 nt, Pseudomonas putida KT2440
agcacccgcaggcgacgagcc

SEQ ID NO: 1588509 - RNA, 16 nt, Pseudomonas putida KT2440
agcacccgcccaucgc

SEQ ID NO: 1588510 - RNA, 16 nt, Pseudomonas putida KT2440
agcaccaucaggcaca

SEQ ID NO: 1588511 - RNA, 12 nt, Pseudomonas putida KT2440
agcaaucugcug

SEQ ID NO: 1588512 - RNA, 17 nt, Pseudomonas putida KT2440
agcaacugcgcccaaug

SEQ ID NO: 1588513 - RNA, 21 nt, Pseudomonas putida KT2440
agcaacuguuggaauggcgca

SEQ ID NO: 1588514 - RNA, 15 nt, Pseudomonas putida KT2440
agcaacuaccaugaa

SEQ ID NO: 1588515 - RNA, 17 nt, Pseudomonas putida KT2440
agcaacacgacgauggc

SEQ ID NO: 1588516 - RNA, 12 nt, Pseudomonas putida KT2440
agcaacaucgcc

SEQ ID NO: 1588517 - RNA, 16 nt, Pseudomonas putida KT2440
agcaacaucugccgaa

SEQ ID NO: 1588518 - RNA, 23 nt, Pseudomonas putida KT2440
agcaacaucugccgaaacuccgg

SEQ ID NO: 1588519 - RNA, 17 nt, Pseudomonas putida KT2440
agcaacagaacgccuug

SEQ ID NO: 1588520 - RNA, 17 nt, Pseudomonas putida KT2440
agcaacacauguaggcg

SEQ ID NO: 1588521 - RNA, 16 nt, Pseudomonas putida KT2440
agaucgcccagcugga

SEQ ID NO: 1588522 - RNA, 19 nt, Pseudomonas putida KT2440
agaguccagugcgguggau

SEQ ID NO: 1588523 - RNA, 21 nt, Pseudomonas putida KT2440
agaucaacgccgccagcggcu

SEQ ID NO: 1588524 - RNA, 12 nt, Pseudomonas putida KT2440
agaucagcagca

SEQ ID NO: 1588525 - RNA, 20 nt, Pseudomonas putida KT2440
agauggcuacgugauugacc

SEQ ID NO: 1588526 - RNA, 20 nt, Pseudomonas putida KT2440
agaugccgccgcugccagca

SEQ ID NO: 1588527 - RNA, 21 nt, Pseudomonas putida KT2440
agaggccggcacagacaccac

SEQ ID NO: 1588528 - RNA, 18 nt, Pseudomonas putida KT2440
agaggccgguacaggcuu

SEQ ID NO: 1588529 - RNA, 19 nt, Pseudomonas putida KT2440
agaggcgggucagguggcu

SEQ ID NO: 1588530 - RNA, 20 nt, Pseudomonas putida KT2440
agaggccaguaccagcagca

SEQ ID NO: 1588531 - RNA, 16 nt, Pseudomonas putida KT2440
agaggccagugagccu

SEQ ID NO: 1588532 - RNA, 23 nt, Pseudomonas putida KT2440
agagauuugccuuggaaugcaca

SEQ ID NO: 1588533 - RNA, 15 nt, Pseudomonas putida KT2440
agaggacucgcggug

SEQ ID NO: 1588534 - RNA, 13 nt, Pseudomonas putida KT2440
agcagugcaucga

SEQ ID NO: 1588535 - RNA, 17 nt, Pseudomonas putida KT2440
agcaugaucaccgccag

SEQ ID NO: 1588536 - RNA, 16 nt, Pseudomonas putida KT2440
agcaugaacagcgcug

SEQ ID NO: 1588537 - RNA, 14 nt, Pseudomonas putida KT2440
agcaugcccagcgc

SEQ ID NO: 1588538 - RNA, 16 nt, Pseudomonas putida KT2440
agcaugccccgggugc

SEQ ID NO: 1588539 - RNA, 22 nt, Pseudomonas putida KT2440
agcauggcaaacagcaccagcc

SEQ ID NO: 1588540 - RNA, 12 nt, Pseudomonas putida KT2440
agcauggccgaa

SEQ ID NO: 1588541 - RNA, 19 nt, Pseudomonas putida KT2440
agcauggccgaaaccagcc

SEQ ID NO: 1588542 - RNA, 11 nt, Pseudomonas putida KT2440
agcauggcgau

SEQ ID NO: 1588543 - RNA, 22 nt, Pseudomonas putida KT2440
agccaaacaaaaaagccgcuca

SEQ ID NO: 1588544 - RNA, 23 nt, Pseudomonas putida KT2440
agcagcccccaacccucacucgc

SEQ ID NO: 1588545 - RNA, 11 nt, Pseudomonas putida KT2440
agcagccacca

SEQ ID NO: 1588546 - RNA, 17 nt, Pseudomonas putida KT2440
agcagguucaggcgcag

SEQ ID NO: 1588547 - RNA, 19 nt, Pseudomonas putida KT2440
agcagguugaacagcagcg

SEQ ID NO: 1588548 - RNA, 17 nt, Pseudomonas putida KT2440
agcagguuguccaccgc

SEQ ID NO: 1588549 - RNA, 19 nt, Pseudomonas putida KT2440
agcagguuguccaccgcgc

SEQ ID NO: 1588550 - RNA, 19 nt, Pseudomonas putida KT2440
agcaggugcccaagcggca

SEQ ID NO: 1588551 - RNA, 17 nt, Pseudomonas putida KT2440
agcaggucucgacacgc

SEQ ID NO: 1588552 - RNA, 14 nt, Pseudomonas putida KT2440
agccagcgacagca

SEQ ID NO: 1588553 - RNA, 15 nt, Pseudomonas putida KT2440
agccauaccgcaucc

SEQ ID NO: 1588554 - RNA, 11 nt, Pseudomonas putida KT2440
agccaguucac

SEQ ID NO: 1588555 - RNA, 23 nt, Pseudomonas putida KT2440
agccaggguuucggugacgaccu

SEQ ID NO: 1588556 - RNA, 16 nt, Pseudomonas putida KT2440
agccagucgcgcaacu

SEQ ID NO: 1588557 - RNA, 18 nt, Pseudomonas putida KT2440
agccaugaaaaagcccgg

SEQ ID NO: 1588558 - RNA, 14 nt, Pseudomonas putida KT2440
agccaugaucagcg

SEQ ID NO: 1588559 - RNA, 13 nt, Pseudomonas putida KT2440
agccaucgagcac

SEQ ID NO: 1588560 - RNA, 17 nt, Pseudomonas putida KT2440
agccaucaucagguacg

SEQ ID NO: 1588561 - RNA, 16 nt, Pseudomonas putida KT2440
agccauccaccagccc

SEQ ID NO: 1588562 - RNA, 19 nt, Pseudomonas putida KT2440
agccagacauugaagaagc

SEQ ID NO: 1588563 - RNA, 14 nt, Pseudomonas putida KT2440
agccacucggcaau

SEQ ID NO: 1588564 - RNA, 19 nt, Pseudomonas putida KT2440
agccagcaucucggccagu

SEQ ID NO: 1588565 - RNA, 14 nt, Pseudomonas putida KT2440
agccacggaucacc

SEQ ID NO: 1588566 - RNA, 20 nt, Pseudomonas putida KT2440
agccacggaucaccuggccg

SEQ ID NO: 1588567 - RNA, 14 nt, Pseudomonas putida KT2440
agccacgcuccagu

SEQ ID NO: 1588568 - RNA, 19 nt, Pseudomonas putida KT2440
agccacgcucgugcaggcu

SEQ ID NO: 1588569 - RNA, 19 nt, Pseudomonas putida KT2440
agccacgcugccaggaccg

SEQ ID NO: 1588570 - RNA, 12 nt, Pseudomonas putida KT2440
agccacgcuggc

SEQ ID NO: 1588571 - RNA, 14 nt, Pseudomonas putida KT2440
agccacgcaucugc

SEQ ID NO: 1588572 - RNA, 19 nt, Pseudomonas putida KT2440
agccacgauagcgucagca

SEQ ID NO: 1588573 - RNA, 17 nt, Pseudomonas putida KT2440
agccaaggccgcccagu

SEQ ID NO: 1588574 - RNA, 23 nt, Pseudomonas putida KT2440
agccaaugcagaugguccggcau

SEQ ID NO: 1588575 - RNA, 14 nt, Pseudomonas putida KT2440
agccaaccgcuuca

SEQ ID NO: 1588576 - RNA, 17 nt, Pseudomonas putida KT2440
agccaaccgcuucaccg

SEQ ID NO: 1588577 - RNA, 20 nt, Pseudomonas putida KT2440
agcccccccagcaacggguu

SEQ ID NO: 1588578 - RNA, 21 nt, Pseudomonas putida KT2440
agccccaucaccagcccgaag

SEQ ID NO: 1588579 - RNA, 17 nt, Pseudomonas putida KT2440
agccccaugcgaccagu

SEQ ID NO: 1588580 - RNA, 21 nt, Pseudomonas putida KT2440
agcccgaagcuaucgccagca

SEQ ID NO: 1588581 - RNA, 19 nt, Pseudomonas putida KT2440
agccccugcggcugcccca

SEQ ID NO: 1588582 - RNA, 17 nt, Pseudomonas putida KT2440
agccccucgcaucgagg

SEQ ID NO: 1588583 - RNA, 12 nt, Pseudomonas putida KT2440
agcccgccagca

SEQ ID NO: 1588584 - RNA, 16 nt, Pseudomonas putida KT2440
agcccgcaccggccga

SEQ ID NO: 1588585 - RNA, 23 nt, Pseudomonas putida KT2440
agcccgcacccacagagacaccg

SEQ ID NO: 1588586 - RNA, 22 nt, Pseudomonas putida KT2440
agcccaguaccacuuccaacac

SEQ ID NO: 1588587 - RNA, 22 nt, Pseudomonas putida KT2440
agcccaguugcuggcuggucuc

SEQ ID NO: 1588588 - RNA, 15 nt, Pseudomonas putida KT2440
agcccauagcgccau

SEQ ID NO: 1588589 - RNA, 16 nt, Pseudomonas putida KT2440
agcccauggcgcugac

SEQ ID NO: 1588590 - RNA, 18 nt, Pseudomonas putida KT2440
agcccauggcuggcagca

SEQ ID NO: 1588591 - RNA, 15 nt, Pseudomonas putida KT2440
agcccauccagggcu

SEQ ID NO: 1588592 - RNA, 14 nt, Pseudomonas putida KT2440
agcccauuucaccu

SEQ ID NO: 1588593 - RNA, 23 nt, Pseudomonas putida KT2440
agccccaaugguuuaguccugca

SEQ ID NO: 1588594 - RNA, 17 nt, Pseudomonas putida KT2440
agcccaaggcuggccag

SEQ ID NO: 1588595 - RNA, 14 nt, Pseudomonas putida KT2440
agcccaccagguca

SEQ ID NO: 1588596 - RNA, 15 nt, Pseudomonas putida KT2440
agcccacacaccgca

SEQ ID NO: 1588597 - RNA, 22 nt, Pseudomonas putida KT2440
agcccaccgucaggcucagcag

SEQ ID NO: 1588598 - RNA, 13 nt, Pseudomonas putida KT2440
agcccagcgccgc

SEQ ID NO: 1588599 - RNA, 19 nt, Pseudomonas putida KT2440
agcccgcgaagaggccagg

SEQ ID NO: 1588600 - RNA, 22 nt, Pseudomonas putida KT2440
agcccgcgaagaggccaggaca

SEQ ID NO: 1588601 - RNA, 15 nt, Pseudomonas putida KT2440
agcccgcucggucag

SEQ ID NO: 1588602 - RNA, 17 nt, Pseudomonas putida KT2440
agcccgcucauguccag

SEQ ID NO: 1588603 - RNA, 22 nt, Pseudomonas putida KT2440
agcccggccaggugccgggcuu

SEQ ID NO: 1588604 - RNA, 13 nt, Pseudomonas putida KT2440
agcccugcugcug

SEQ ID NO: 1588605 - RNA, 19 nt, Pseudomonas putida KT2440
agcccugugggagcgggca

SEQ ID NO: 1588606 - RNA, 15 nt, Pseudomonas putida KT2440
agcccuucgcgggca

SEQ ID NO: 1588607 - RNA, 19 nt, Pseudomonas putida KT2440
agccgacccgggccagcca

SEQ ID NO: 1588608 - RNA, 20 nt, Pseudomonas putida KT2440
agccgcccgcccgccugcgc

SEQ ID NO: 1588609 - RNA, 20 nt, Pseudomonas putida KT2440
agccgaucacuuccuggccg

SEQ ID NO: 1588610 - RNA, 15 nt, Pseudomonas putida KT2440
agccgccagcaucac

SEQ ID NO: 1588611 - RNA, 21 nt, Pseudomonas putida KT2440
agccgccagcaucacgccgcg

SEQ ID NO: 1588612 - RNA, 22 nt, Pseudomonas putida KT2440
agcgacaggcuugaagcugcgc

SEQ ID NO: 1588613 - RNA, 18 nt, Pseudomonas putida KT2440
agcgacacccuggucaug

SEQ ID NO: 1588614 - RNA, 13 nt, Pseudomonas putida KT2440
agcgacagcaucg

SEQ ID NO: 1588615 - RNA, 16 nt, Pseudomonas putida KT2440
agcgacagcaucggca

SEQ ID NO: 1588616 - RNA, 15 nt, Pseudomonas putida KT2440
agcgacagcaucugc

SEQ ID NO: 1588617 - RNA, 19 nt, Pseudomonas putida KT2440
agcgagcaccggcaguaca

SEQ ID NO: 1588618 - RNA, 11 nt, Pseudomonas putida KT2440
agcgagguacg

SEQ ID NO: 1588619 - RNA, 19 nt, Pseudomonas putida KT2440
agcgaguugaacuuggcga

SEQ ID NO: 1588620 - RNA, 19 nt, Pseudomonas putida KT2440
agcgcaccgugcaccagca

SEQ ID NO: 1588621 - RNA, 21 nt, Pseudomonas putida KT2440
agcgcaccgaugcggugcagc

SEQ ID NO: 1588622 - RNA, 13 nt, Pseudomonas putida KT2440
agcgcagacuggg

SEQ ID NO: 1588623 - RNA, 21 nt, Pseudomonas putida KT2440
agcgcacuuccacacccagcg

SEQ ID NO: 1588624 - RNA, 16 nt, Pseudomonas putida KT2440
agcgcagcaauacgca

SEQ ID NO: 1588625 - RNA, 17 nt, Pseudomonas putida KT2440
agcgcauaggccaaggu

SEQ ID NO: 1588626 - RNA, 23 nt, Pseudomonas putida KT2440
agcgcagcuucucaagcaucugg

SEQ ID NO: 1588627 - RNA, 16 nt, Pseudomonas putida KT2440
agccguugaccagguu

SEQ ID NO: 1588628 - RNA, 21 nt, Pseudomonas putida KT2440
agccguucccgggcagguucg

SEQ ID NO: 1588629 - RNA, 15 nt, Pseudomonas putida KT2440
agccuuccgggcacu

SEQ ID NO: 1588630 - RNA, 16 nt, Pseudomonas putida KT2440
agccuuccgggcacug

SEQ ID NO: 1588631 - RNA, 21 nt, Pseudomonas putida KT2440
agccuucagcggccgcgcaau

SEQ ID NO: 1588632 - RNA, 22 nt, Pseudomonas putida KT2440
agcgacaacgcgaaagcgaaga

SEQ ID NO: 1588633 - RNA, 17 nt, Pseudomonas putida KT2440
agccuuuuuucgggcug

SEQ ID NO: 1588634 - RNA, 14 nt, Pseudomonas putida KT2440
agccuuuuccagcu

SEQ ID NO: 1588635 - RNA, 20 nt, Pseudomonas putida KT2440
agccuuucgagagccgggca

SEQ ID NO: 1588636 - RNA, 17 nt, Pseudomonas putida KT2440
agccuuguucgcgcagg

SEQ ID NO: 1588637 - RNA, 16 nt, Pseudomonas putida KT2440
agccuuggccagcguc

SEQ ID NO: 1588638 - RNA, 14 nt, Pseudomonas putida KT2440
agccuuggguaacc

SEQ ID NO: 1588639 - RNA, 22 nt, Pseudomonas putida KT2440
agccgucgauuacccagcgcga

SEQ ID NO: 1588640 - RNA, 13 nt, Pseudomonas putida KT2440
agccgcgccaggu

SEQ ID NO: 1588641 - RNA, 14 nt, Pseudomonas putida KT2440
agccgcgccagguc

SEQ ID NO: 1588642 - RNA, 15 nt, Pseudomonas putida KT2440
agccgcgccacuccc

SEQ ID NO: 1588643 - RNA, 23 nt, Pseudomonas putida KT2440
agccgccgccgagugcgcggaac

SEQ ID NO: 1588644 - RNA, 22 nt, Pseudomonas putida KT2440
agcgccugcugccaggccgcac

SEQ ID NO: 1588645 - RNA, 14 nt, Pseudomonas putida KT2440
agcgccuggcgcag

SEQ ID NO: 1588646 - RNA, 20 nt, Pseudomonas putida KT2440
agcgccuggcgagaaggcgu

SEQ ID NO: 1588647 - RNA, 15 nt, Pseudomonas putida KT2440
agcgccuggccugca

SEQ ID NO: 1588648 - RNA, 15 nt, Pseudomonas putida KT2440
agcgcgacuggugcu

SEQ ID NO: 1588649 - RNA, 16 nt, Pseudomonas putida KT2440
agcgcgacgcagcagc

SEQ ID NO: 1588650 - RNA, 14 nt, Pseudomonas putida KT2440
agcgccagcaacgc

SEQ ID NO: 1588651 - RNA, 18 nt, Pseudomonas putida KT2440
agcgccagcaagcgcaua

SEQ ID NO: 1588652 - RNA, 16 nt, Pseudomonas putida KT2440
agcgccagcaucgagg

SEQ ID NO: 1588653 - RNA, 17 nt, Pseudomonas putida KT2440
agcgccagcaucgagga

SEQ ID NO: 1588654 - RNA, 16 nt, Pseudomonas putida KT2440
agcgcgagcguuacca

SEQ ID NO: 1588655 - RNA, 21 nt, Pseudomonas putida KT2440
agcgcguccagcaacagcugc

SEQ ID NO: 1588656 - RNA, 18 nt, Pseudomonas putida KT2440
agcgcucgacauccagcg

SEQ ID NO: 1588657 - RNA, 13 nt, Pseudomonas putida KT2440
agcgcucgaugcg

SEQ ID NO: 1588658 - RNA, 20 nt, Pseudomonas putida KT2440
agcgcugacucagcggccuu

SEQ ID NO: 1588659 - RNA, 15 nt, Pseudomonas putida KT2440
agcggguuuacccgc

SEQ ID NO: 1588660 - RNA, 20 nt, Pseudomonas putida KT2440
agcggguuuacccgcgaaca

SEQ ID NO: 1588661 - RNA, 19 nt, Pseudomonas putida KT2440
agcggguuuacccgcgaag

SEQ ID NO: 1588662 - RNA, 20 nt, Pseudomonas putida KT2440
agcggguuuacccgcgaaga

SEQ ID NO: 1588663 - RNA, 20 nt, Pseudomonas putida KT2440
agcggguuuacccgcgaagc

SEQ ID NO: 1588664 - RNA, 13 nt, Pseudomonas putida KT2440
agcggguucaccc

SEQ ID NO: 1588665 - RNA, 15 nt, Pseudomonas putida KT2440
agcggguucacccgc

SEQ ID NO: 1588666 - RNA, 19 nt, Pseudomonas putida KT2440
agcggguucacccgcgaag

SEQ ID NO: 1588667 - RNA, 20 nt, Pseudomonas putida KT2440
agcggguucacccgcgaagc

SEQ ID NO: 1588668 - RNA, 22 nt, Pseudomonas putida KT2440
agcgucggcagagcgccagcau

SEQ ID NO: 1588669 - RNA, 14 nt, Pseudomonas putida KT2440
agcgucggccaccu

SEQ ID NO: 1588670 - RNA, 21 nt, Pseudomonas putida KT2440
agcgucgcgcgcccaggccca

SEQ ID NO: 1588671 - RNA, 16 nt, Pseudomonas putida KT2440
agcgucgcccgcgaaa

SEQ ID NO: 1588672 - RNA, 14 nt, Pseudomonas putida KT2440
agcguucgaugcgc

SEQ ID NO: 1588673 - RNA, 14 nt, Pseudomonas putida KT2440
agcgugcgaaguug

SEQ ID NO: 1588674 - RNA, 17 nt, Pseudomonas putida KT2440
agcgggcaacugcgccu

SEQ ID NO: 1588675 - RNA, 22 nt, Pseudomonas putida KT2440
agcgggucacugcgcgccguug

SEQ ID NO: 1588676 - RNA, 16 nt, Pseudomonas putida KT2440
agcgggcccagcaggu

SEQ ID NO: 1588677 - RNA, 15 nt, Pseudomonas putida KT2440
agcggguccucgaaa

SEQ ID NO: 1588678 - RNA, 14 nt, Pseudomonas putida KT2440
agcggcuuggccgc

SEQ ID NO: 1588679 - RNA, 18 nt, Pseudomonas putida KT2440
agcggcuuggccgcgaag

SEQ ID NO: 1588680 - RNA, 17 nt, Pseudomonas putida KT2440
agcggcuucuaccgcac

SEQ ID NO: 1588681 - RNA, 20 nt, Pseudomonas putida KT2440
agcggcuaccgcugcgcacc

SEQ ID NO: 1588682 - RNA, 15 nt, Pseudomonas putida KT2440
agcggcucucgaagu

SEQ ID NO: 1588683 - RNA, 20 nt, Pseudomonas putida KT2440
agcggcaaggucaacggcaa

SEQ ID NO: 1588684 - RNA, 17 nt, Pseudomonas putida KT2440
agcucuugcggaucacu

SEQ ID NO: 1588685 - RNA, 17 nt, Pseudomonas putida KT2440
agcugauccgccuggcc

SEQ ID NO: 1588686 - RNA, 21 nt, Pseudomonas putida KT2440
agcugaugcucaagcgccagg

SEQ ID NO: 1588687 - RNA, 15 nt, Pseudomonas putida KT2440
agcucuggcagcagu

SEQ ID NO: 1588688 - RNA, 22 nt, Pseudomonas putida KT2440
agcucuggucgaucuucagcgc

SEQ ID NO: 1588689 - RNA, 17 nt, Pseudomonas putida KT2440
agcucguccugcagggc

SEQ ID NO: 1588690 - RNA, 17 nt, Pseudomonas putida KT2440
agcucguacauggugua

SEQ ID NO: 1588691 - RNA, 15 nt, Pseudomonas putida KT2440
agcucgguauccccg

SEQ ID NO: 1588692 - RNA, 12 nt, Pseudomonas putida KT2440
agcucgcuggcc

SEQ ID NO: 1588693 - RNA, 15 nt, Pseudomonas putida KT2440
agcucgcgcugccag

SEQ ID NO: 1588694 - RNA, 12 nt, Pseudomonas putida KT2440
agcucgcgcugc

SEQ ID NO: 1588695 - RNA, 21 nt, Pseudomonas putida KT2440
agcucgccaaacaggaucucc

SEQ ID NO: 1588696 - RNA, 17 nt, Pseudomonas putida KT2440
agcucgccaacaccgcc

SEQ ID NO: 1588697 - RNA, 18 nt, Pseudomonas putida KT2440
agcucgacccgcgucagc

SEQ ID NO: 1588698 - RNA, 19 nt, Pseudomonas putida KT2440
agcucgaagcgcucaugca

SEQ ID NO: 1588699 - RNA, 17 nt, Pseudomonas putida KT2440
agcucgacaacccgcgc

SEQ ID NO: 1588700 - RNA, 17 nt, Pseudomonas putida KT2440
agcuccccagcaacgga

SEQ ID NO: 1588701 - RNA, 13 nt, Pseudomonas putida KT2440
agcuccgacaggc

SEQ ID NO: 1588702 - RNA, 22 nt, Pseudomonas putida KT2440
agcucacguuugggcggcguga

SEQ ID NO: 1588703 - RNA, 14 nt, Pseudomonas putida KT2440
agcucacuggccaa

SEQ ID NO: 1588704 - RNA, 17 nt, Pseudomonas putida KT2440
agcucacuggccaacuc

SEQ ID NO: 1588705 - RNA, 14 nt, Pseudomonas putida KT2440
agcucauacgggug

SEQ ID NO: 1588706 - RNA, 13 nt, Pseudomonas putida KT2440
agcucauccagcc

SEQ ID NO: 1588707 - RNA, 14 nt, Pseudomonas putida KT2440
agcucauccaucac

SEQ ID NO: 1588708 - RNA, 12 nt, Pseudomonas putida KT2440
agcucagguagc

SEQ ID NO: 1588709 - RNA, 16 nt, Pseudomonas putida KT2440
agcucaugggcuucga

SEQ ID NO: 1588710 - RNA, 19 nt, Pseudomonas putida KT2440
agcucaugggcuucgagca

SEQ ID NO: 1588711 - RNA, 14 nt, Pseudomonas putida KT2440
agcuccagcagugc

SEQ ID NO: 1588712 - RNA, 18 nt, Pseudomonas putida KT2440
agcuccagcccagcgcca

SEQ ID NO: 1588713 - RNA, 13 nt, Pseudomonas putida KT2440
agcuccaccagcg

SEQ ID NO: 1588714 - RNA, 22 nt, Pseudomonas putida KT2440
agcucaauuggauagagcaucc

SEQ ID NO: 1588715 - RNA, 21 nt, Pseudomonas putida KT2440
agcucaauuucuuucagcucg

SEQ ID NO: 1588716 - RNA, 15 nt, Pseudomonas putida KT2440
agcguugcuggcgau

SEQ ID NO: 1588717 - RNA, 13 nt, Pseudomonas putida KT2440
agcguugcaggcg

SEQ ID NO: 1588718 - RNA, 19 nt, Pseudomonas putida KT2440
agcguucucgcucagguag

SEQ ID NO: 1588719 - RNA, 13 nt, Pseudomonas putida KT2440
agcguucucggug

SEQ ID NO: 1588720 - RNA, 23 nt, Pseudomonas putida KT2440
agcguuuuucucgaugaugcugg

SEQ ID NO: 1588721 - RNA, 14 nt, Pseudomonas putida KT2440
aucgccgccgagcu

SEQ ID NO: 1588722 - RNA, 21 nt, Pseudomonas putida KT2440
aucgccgcaucguuauccagc

SEQ ID NO: 1588723 - RNA, 14 nt, Pseudomonas putida KT2440
aucgccgcaaccgc

SEQ ID NO: 1588724 - RNA, 17 nt, Pseudomonas putida KT2440
aucgccgucgaccaggc

SEQ ID NO: 1588725 - RNA, 19 nt, Pseudomonas putida KT2440
aucgacuggaugcucgaua

SEQ ID NO: 1588726 - RNA, 13 nt, Pseudomonas putida KT2440
aucgagccacuga

SEQ ID NO: 1588727 - RNA, 12 nt, Pseudomonas putida KT2440
aucgagcgccgc

SEQ ID NO: 1588728 - RNA, 14 nt, Pseudomonas putida KT2440
aucgcccgcugcuu

SEQ ID NO: 1588729 - RNA, 15 nt, Pseudomonas putida KT2440
aucgaggaaagggca

SEQ ID NO: 1588730 - RNA, 13 nt, Pseudomonas putida KT2440
aucggccuggggc

SEQ ID NO: 1588731 - RNA, 15 nt, Pseudomonas putida KT2440
aucggcgcgacagcg

SEQ ID NO: 1588732 - RNA, 16 nt, Pseudomonas putida KT2440
aucggccuguggguaa

SEQ ID NO: 1588733 - RNA, 21 nt, Pseudomonas putida KT2440
aucggcacacgguuuccaggc

SEQ ID NO: 1588734 - RNA, 20 nt, Pseudomonas putida KT2440
aucggccaggaaaagguugc

SEQ ID NO: 1588735 - RNA, 16 nt, Pseudomonas putida KT2440
aucggcacgcccagca

SEQ ID NO: 1588736 - RNA, 14 nt, Pseudomonas putida KT2440
aucgcucaccguuc

SEQ ID NO: 1588737 - RNA, 19 nt, Pseudomonas putida KT2440
aucgcugcggccgucggua

SEQ ID NO: 1588738 - RNA, 21 nt, Pseudomonas putida KT2440
aucgcuguccuuggccaacug

SEQ ID NO: 1588739 - RNA, 23 nt, Pseudomonas putida KT2440
aucgcugugcaacagcgccuggc

SEQ ID NO: 1588740 - RNA, 17 nt, Pseudomonas putida KT2440
aucgcggccgaaggcgc

SEQ ID NO: 1588741 - RNA, 13 nt, Pseudomonas putida KT2440
aucgaccugcagg

SEQ ID NO: 1588742 - RNA, 12 nt, Pseudomonas putida KT2440
aucgacgcaaug

SEQ ID NO: 1588743 - RNA, 13 nt, Pseudomonas putida KT2440
aucgacgcaauga

SEQ ID NO: 1588744 - RNA, 12 nt, Pseudomonas putida KT2440
aucgaagcgcac

SEQ ID NO: 1588745 - RNA, 13 nt, Pseudomonas putida KT2440
aucgaagcagcag

SEQ ID NO: 1588746 - RNA, 15 nt, Pseudomonas putida KT2440
aucgaagcagcagcu

SEQ ID NO: 1588747 - RNA, 22 nt, Pseudomonas putida KT2440
aucgaagcagcagcuugcagcg

SEQ ID NO: 1588748 - RNA, 17 nt, Pseudomonas putida KT2440
aucgaagcaggccgguu

SEQ ID NO: 1588749 - RNA, 20 nt, Pseudomonas putida KT2440
aucgacaacauggucacaug

SEQ ID NO: 1588750 - RNA, 17 nt, Pseudomonas putida KT2440
aucgaaggugguagccg

SEQ ID NO: 1588751 - RNA, 15 nt, Pseudomonas putida KT2440
auccugcgcggccac

SEQ ID NO: 1588752 - RNA, 21 nt, Pseudomonas putida KT2440
auccugcucgacaagccgcug

SEQ ID NO: 1588753 - RNA, 15 nt, Pseudomonas putida KT2440
auccugcuggcccgc

SEQ ID NO: 1588754 - RNA, 14 nt, Pseudomonas putida KT2440
auccucgacgacca

SEQ ID NO: 1588755 - RNA, 22 nt, Pseudomonas putida KT2440
auccucggugcgcgguaccugg

SEQ ID NO: 1588756 - RNA, 20 nt, Pseudomonas putida KT2440
auccucugugggagcggccu

SEQ ID NO: 1588757 - RNA, 20 nt, Pseudomonas putida KT2440
auccuuuguaggagcgggcu

SEQ ID NO: 1588758 - RNA, 18 nt, Pseudomonas putida KT2440
auccuguggaagcgggcg

SEQ ID NO: 1588759 - RNA, 18 nt, Pseudomonas putida KT2440
auccugugggagcgggcu

SEQ ID NO: 1588760 - RNA, 19 nt, Pseudomonas putida KT2440
aucagcgcggugaccagcg

SEQ ID NO: 1588761 - RNA, 13 nt, Pseudomonas putida KT2440
aucagcggcucca

SEQ ID NO: 1588762 - RNA, 19 nt, Pseudomonas putida KT2440
aucccuguacagaucgauc

SEQ ID NO: 1588763 - RNA, 17 nt, Pseudomonas putida KT2440
aucccuguaggugcggc

SEQ ID NO: 1588764 - RNA, 18 nt, Pseudomonas putida KT2440
aucccugugggagcgggc

SEQ ID NO: 1588765 - RNA, 22 nt, Pseudomonas putida KT2440
auccgaucuugaaccguugcga

SEQ ID NO: 1588766 - RNA, 20 nt, Pseudomonas putida KT2440
auccgcauaucauagaucuc

SEQ ID NO: 1588767 - RNA, 17 nt, Pseudomonas putida KT2440
auccggcaacuggcaca

SEQ ID NO: 1588768 - RNA, 15 nt, Pseudomonas putida KT2440
aucugcguggcaguu

SEQ ID NO: 1588769 - RNA, 17 nt, Pseudomonas putida KT2440
aucugcugcagcauggc

SEQ ID NO: 1588770 - RNA, 19 nt, Pseudomonas putida KT2440
aucugcuggauacccagcg

SEQ ID NO: 1588771 - RNA, 20 nt, Pseudomonas putida KT2440
aucugcuggauacccagcgc

SEQ ID NO: 1588772 - RNA, 19 nt, Pseudomonas putida KT2440
aucugcugcggcaggcugg

SEQ ID NO: 1588773 - RNA, 15 nt, Pseudomonas putida KT2440
aucugcgccugugca

SEQ ID NO: 1588774 - RNA, 20 nt, Pseudomonas putida KT2440
aucuggcggaaugucggcgu

SEQ ID NO: 1588775 - RNA, 17 nt, Pseudomonas putida KT2440
aucuggcucugcagcgu

SEQ ID NO: 1588776 - RNA, 19 nt, Pseudomonas putida KT2440
aucugugaggccagcggga

SEQ ID NO: 1588777 - RNA, 13 nt, Pseudomonas putida KT2440
aucuuccgcaugc

SEQ ID NO: 1588778 - RNA, 20 nt, Pseudomonas putida KT2440
aucuucgccggcaucgccuc

SEQ ID NO: 1588779 - RNA, 19 nt, Pseudomonas putida KT2440
aucuugcgcgccagcgcau

SEQ ID NO: 1588780 - RNA, 18 nt, Pseudomonas putida KT2440
aucuucucuuccaccgua

SEQ ID NO: 1588781 - RNA, 20 nt, Pseudomonas putida KT2440
aucuucggguuguaguucuu

SEQ ID NO: 1588782 - RNA, 19 nt, Pseudomonas putida KT2440
aucggcguugcggugcaga

SEQ ID NO: 1588783 - RNA, 20 nt, Pseudomonas putida KT2440
aucguugcgggucagcucga

SEQ ID NO: 1588784 - RNA, 15 nt, Pseudomonas putida KT2440
aucguuucgaugaua

SEQ ID NO: 1588785 - RNA, 17 nt, Pseudomonas putida KT2440
aucguuugaugcgggcu

SEQ ID NO: 1588786 - RNA, 18 nt, Pseudomonas putida KT2440
aucucccgcgaacgcccg

SEQ ID NO: 1588787 - RNA, 21 nt, Pseudomonas putida KT2440
aucucgauguacucaggggca

SEQ ID NO: 1588788 - RNA, 16 nt, Pseudomonas putida KT2440
aucuagcaggugcuca

SEQ ID NO: 1588789 - RNA, 15 nt, Pseudomonas putida KT2440
aucuccaugcugcug

SEQ ID NO: 1588790 - RNA, 16 nt, Pseudomonas putida KT2440
aucuaugcccggcuca

SEQ ID NO: 1588791 - RNA, 15 nt, Pseudomonas putida KT2440
augcagugcccgcga

SEQ ID NO: 1588792 - RNA, 22 nt, Pseudomonas putida KT2440
augcaguagcuuaaucccgcaa

SEQ ID NO: 1588793 - RNA, 15 nt, Pseudomonas putida KT2440
augcagcggccagua

SEQ ID NO: 1588794 - RNA, 23 nt, Pseudomonas putida KT2440
augcagcgggucgcacucggcaa

SEQ ID NO: 1588795 - RNA, 19 nt, Pseudomonas putida KT2440
augcaggucgaccugccag

SEQ ID NO: 1588796 - RNA, 19 nt, Pseudomonas putida KT2440
augcagcgucggcagagcg

SEQ ID NO: 1588797 - RNA, 18 nt, Pseudomonas putida KT2440
augaugguugacagcgcu

SEQ ID NO: 1588798 - RNA, 18 nt, Pseudomonas putida KT2440
augaugcuggucggcuau

SEQ ID NO: 1588799 - RNA, 14 nt, Pseudomonas putida KT2440
augcacugccugca

SEQ ID NO: 1588800 - RNA, 17 nt, Pseudomonas putida KT2440
augcagcaagcuggcac

SEQ ID NO: 1588801 - RNA, 20 nt, Pseudomonas putida KT2440
augcagaugguccggcauca

SEQ ID NO: 1588802 - RNA, 14 nt, Pseudomonas putida KT2440
augaucgccuggcc

SEQ ID NO: 1588803 - RNA, 12 nt, Pseudomonas putida KT2440
augaucgcgcuu

SEQ ID NO: 1588804 - RNA, 16 nt, Pseudomonas putida KT2440
augaucgcuucggcgc

SEQ ID NO: 1588805 - RNA, 20 nt, Pseudomonas putida KT2440
augauggccguugcugcgcg

SEQ ID NO: 1588806 - RNA, 15 nt, Pseudomonas putida KT2440
augauccuguugcga

SEQ ID NO: 1588807 - RNA, 19 nt, Pseudomonas putida KT2440
augaucgagcgcaccugga

SEQ ID NO: 1588808 - RNA, 23 nt, Pseudomonas putida KT2440
augaucaauaucaucacugccac

SEQ ID NO: 1588809 - RNA, 20 nt, Pseudomonas putida KT2440
augaaggcggggagcgaacu

SEQ ID NO: 1588810 - RNA, 13 nt, Pseudomonas putida KT2440
augaagucagcca

SEQ ID NO: 1588811 - RNA, 12 nt, Pseudomonas putida KT2440
augaacccgcga

SEQ ID NO: 1588812 - RNA, 16 nt, Pseudomonas putida KT2440
augaacaccaccgcga

SEQ ID NO: 1588813 - RNA, 22 nt, Pseudomonas putida KT2440
augaacggcuguuccucgccau

SEQ ID NO: 1588814 - RNA, 12 nt, Pseudomonas putida KT2440
augaacagcacg

SEQ ID NO: 1588815 - RNA, 13 nt, Pseudomonas putida KT2440
augaacagcgcug

SEQ ID NO: 1588816 - RNA, 21 nt, Pseudomonas putida KT2440
auugcaccacccccagcgccu

SEQ ID NO: 1588817 - RNA, 12 nt, Pseudomonas putida KT2440
auugaucgccgc

SEQ ID NO: 1588818 - RNA, 14 nt, Pseudomonas putida KT2440
auugccgcagcugc

SEQ ID NO: 1588819 - RNA, 16 nt, Pseudomonas putida KT2440
auucuuauuaccagaa

SEQ ID NO: 1588820 - RNA, 21 nt, Pseudomonas putida KT2440
auugacuaccagguagccguc

SEQ ID NO: 1588821 - RNA, 12 nt, Pseudomonas putida KT2440
auugacccgcuu

SEQ ID NO: 1588822 - RNA, 14 nt, Pseudomonas putida KT2440
auugcguucuugcc

SEQ ID NO: 1588823 - RNA, 22 nt, Pseudomonas putida KT2440
auugcgccaucagaggcgaugg

SEQ ID NO: 1588824 - RNA, 16 nt, Pseudomonas putida KT2440
auuggugccagcgcca

SEQ ID NO: 1588825 - RNA, 16 nt, Pseudomonas putida KT2440
auugucauccacauca

SEQ ID NO: 1588826 - RNA, 16 nt, Pseudomonas putida KT2440
auugucgguaaagcgc

SEQ ID NO: 1588827 - RNA, 17 nt, Pseudomonas putida KT2440
auuggcgccaucgccca

SEQ ID NO: 1588828 - RNA, 20 nt, Pseudomonas putida KT2440
auuggccaaccagccggcaa

SEQ ID NO: 1588829 - RNA, 16 nt, Pseudomonas putida KT2440
auuggccagcaggccc

SEQ ID NO: 1588830 - RNA, 17 nt, Pseudomonas putida KT2440
auuggccggcgcugagc

SEQ ID NO: 1588831 - RNA, 15 nt, Pseudomonas putida KT2440
auuggaguacgggca

SEQ ID NO: 1588832 - RNA, 14 nt, Pseudomonas putida KT2440
auuggcaucgcugc

SEQ ID NO: 1588833 - RNA, 13 nt, Pseudomonas putida KT2440
auuccguaccagu

SEQ ID NO: 1588834 - RNA, 17 nt, Pseudomonas putida KT2440
auucagaaguccacgcu

SEQ ID NO: 1588835 - RNA, 15 nt, Pseudomonas putida KT2440
auucagcucggccac

SEQ ID NO: 1588836 - RNA, 21 nt, Pseudomonas putida KT2440
auucagcucggccacccgcgu

SEQ ID NO: 1588837 - RNA, 20 nt, Pseudomonas putida KT2440
auucgcggguaaacccauuc

SEQ ID NO: 1588838 - RNA, 20 nt, Pseudomonas putida KT2440
auucgcggguaaacccgcgc

SEQ ID NO: 1588839 - RNA, 18 nt, Pseudomonas putida KT2440
auucgcccgcaccgccgc

SEQ ID NO: 1588840 - RNA, 19 nt, Pseudomonas putida KT2440
auucgcgggugaacccgcu

SEQ ID NO: 1588841 - RNA, 20 nt, Pseudomonas putida KT2440
auucgcgggugaacccgcuc

SEQ ID NO: 1588842 - RNA, 15 nt, Pseudomonas putida KT2440
auucgaggaucagcg

SEQ ID NO: 1588843 - RNA, 12 nt, Pseudomonas putida KT2440
auucgaccagca

SEQ ID NO: 1588844 - RNA, 16 nt, Pseudomonas putida KT2440
augcggucuuccagcg

SEQ ID NO: 1588845 - RNA, 20 nt, Pseudomonas putida KT2440
augcgggggccccaccaggc

SEQ ID NO: 1588846 - RNA, 18 nt, Pseudomonas putida KT2440
augcggugguugucgcac

SEQ ID NO: 1588847 - RNA, 21 nt, Pseudomonas putida KT2440
augcggcuacccagccgggca

SEQ ID NO: 1588848 - RNA, 22 nt, Pseudomonas putida KT2440
augcugccuuuuccugcugcaa

SEQ ID NO: 1588849 - RNA, 14 nt, Pseudomonas putida KT2440
augcugcgccagga

SEQ ID NO: 1588850 - RNA, 15 nt, Pseudomonas putida KT2440
augcugccaggcaaa

SEQ ID NO: 1588851 - RNA, 23 nt, Pseudomonas putida KT2440
augcugcagaaccgccagcacca

SEQ ID NO: 1588852 - RNA, 14 nt, Pseudomonas putida KT2440
augcgcaggcagcg

SEQ ID NO: 1588853 - RNA, 15 nt, Pseudomonas putida KT2440
augcgcaggcagcga

SEQ ID NO: 1588854 - RNA, 17 nt, Pseudomonas putida KT2440
augcgccacacccgcua

SEQ ID NO: 1588855 - RNA, 17 nt, Pseudomonas putida KT2440
augcgauugaucugcug

SEQ ID NO: 1588856 - RNA, 16 nt, Pseudomonas putida KT2440
augcgcacaccgcugg

SEQ ID NO: 1588857 - RNA, 16 nt, Pseudomonas putida KT2440
augcgccccggcgauc

SEQ ID NO: 1588858 - RNA, 23 nt, Pseudomonas putida KT2440
augcgccaguacgccagcagcgc

SEQ ID NO: 1588859 - RNA, 19 nt, Pseudomonas putida KT2440
augcgccccacuuccagcg

SEQ ID NO: 1588860 - RNA, 18 nt, Pseudomonas putida KT2440
augcgcccugcugccgca

SEQ ID NO: 1588861 - RNA, 22 nt, Pseudomonas putida KT2440
augcgcccuggcggccacggca

SEQ ID NO: 1588862 - RNA, 18 nt, Pseudomonas putida KT2440
augcuggugguggcccug

SEQ ID NO: 1588863 - RNA, 16 nt, Pseudomonas putida KT2440
augcugguguguugaa

SEQ ID NO: 1588864 - RNA, 23 nt, Pseudomonas putida KT2440
augcuggucgccgugcagcaccg

SEQ ID NO: 1588865 - RNA, 23 nt, Pseudomonas putida KT2440
auggccacggugucggacagguu

SEQ ID NO: 1588866 - RNA, 14 nt, Pseudomonas putida KT2440
auggcauucgccac

SEQ ID NO: 1588867 - RNA, 15 nt, Pseudomonas putida KT2440
auggcccagccagcg

SEQ ID NO: 1588868 - RNA, 16 nt, Pseudomonas putida KT2440
auggccccgcccaggu

SEQ ID NO: 1588869 - RNA, 19 nt, Pseudomonas putida KT2440
auggcaggugaucguugcg

SEQ ID NO: 1588870 - RNA, 16 nt, Pseudomonas putida KT2440
auggcaguguggcaag

SEQ ID NO: 1588871 - RNA, 17 nt, Pseudomonas putida KT2440
auggcaccgaucaccug

SEQ ID NO: 1588872 - RNA, 13 nt, Pseudomonas putida KT2440
auggcaccggcag

SEQ ID NO: 1588873 - RNA, 22 nt, Pseudomonas putida KT2440
auggcaaucagcgacaacggcu

SEQ ID NO: 1588874 - RNA, 16 nt, Pseudomonas putida KT2440
auggcaaucgccuggc

SEQ ID NO: 1588875 - RNA, 14 nt, Pseudomonas putida KT2440
auggcaaacagcac

SEQ ID NO: 1588876 - RNA, 14 nt, Pseudomonas putida KT2440
auggauuccucgcg

SEQ ID NO: 1588877 - RNA, 17 nt, Pseudomonas putida KT2440
auggauggcaccggcuu

SEQ ID NO: 1588878 - RNA, 19 nt, Pseudomonas putida KT2440
augguuuaaaccgcgaagc

SEQ ID NO: 1588879 - RNA, 14 nt, Pseudomonas putida KT2440
augggcuucgagca

SEQ ID NO: 1588880 - RNA, 22 nt, Pseudomonas putida KT2440
augggcgaaguugaagcgccgg

SEQ ID NO: 1588881 - RNA, 11 nt, Pseudomonas putida KT2440
augggccaggg

SEQ ID NO: 1588882 - RNA, 15 nt, Pseudomonas putida KT2440
augggcacuggccac

SEQ ID NO: 1588883 - RNA, 19 nt, Pseudomonas putida KT2440
auggcgaugaacacgccgu

SEQ ID NO: 1588884 - RNA, 19 nt, Pseudomonas putida KT2440
auggccugcaugucggcag

SEQ ID NO: 1588885 - RNA, 22 nt, Pseudomonas putida KT2440
auggccuuucugcuuccacucg

SEQ ID NO: 1588886 - RNA, 17 nt, Pseudomonas putida KT2440
auguccagcgaggguuc

SEQ ID NO: 1588887 - RNA, 20 nt, Pseudomonas putida KT2440
augucguccaguuggcggcg

SEQ ID NO: 1588888 - RNA, 22 nt, Pseudomonas putida KT2440
augucgugcugccggucggccu

SEQ ID NO: 1588889 - RNA, 21 nt, Pseudomonas putida KT2440
auguucggugcucaggcucag

SEQ ID NO: 1588890 - RNA, 22 nt, Pseudomonas putida KT2440
auguugaagaagaucaggucgc

SEQ ID NO: 1588891 - RNA, 18 nt, Pseudomonas putida KT2440
auguugaugccacgggca

SEQ ID NO: 1588892 - RNA, 16 nt, Pseudomonas putida KT2440
augugcucggccuggg

SEQ ID NO: 1588893 - RNA, 19 nt, Pseudomonas putida KT2440
auguggcgcagcaccgugg

SEQ ID NO: 1588894 - RNA, 17 nt, Pseudomonas putida KT2440
caaagcgcaccgcgcac

SEQ ID NO: 1588895 - RNA, 21 nt, Pseudomonas putida KT2440
caaagaacacuuccgggcuga

SEQ ID NO: 1588896 - RNA, 19 nt, Pseudomonas putida KT2440
caaagcgggcaacugcgcc

SEQ ID NO: 1588897 - RNA, 22 nt, Pseudomonas putida KT2440
caaagcuguugaaggcguuuuc

SEQ ID NO: 1588898 - RNA, 16 nt, Pseudomonas putida KT2440
caaaggcaugggccag

SEQ ID NO: 1588899 - RNA, 18 nt, Pseudomonas putida KT2440
caaaggccggcaccgaca

SEQ ID NO: 1588900 - RNA, 15 nt, Pseudomonas putida KT2440
caaaccgaccaggca

SEQ ID NO: 1588901 - RNA, 19 nt, Pseudomonas putida KT2440
caaaccgacccugcugcug

SEQ ID NO: 1588902 - RNA, 14 nt, Pseudomonas putida KT2440
caaaccgcugccca

SEQ ID NO: 1588903 - RNA, 14 nt, Pseudomonas putida KT2440
caaaccggaucggg

SEQ ID NO: 1588904 - RNA, 15 nt, Pseudomonas putida KT2440
caaaccggcaccggc

SEQ ID NO: 1588905 - RNA, 22 nt, Pseudomonas putida KT2440
caaaccggcaccggcgaacagc

SEQ ID NO: 1588906 - RNA, 20 nt, Pseudomonas putida KT2440
caaacuccacugugcccgcc

SEQ ID NO: 1588907 - RNA, 21 nt, Pseudomonas putida KT2440
caaacucuugagcuggccguc

SEQ ID NO: 1588908 - RNA, 12 nt, Pseudomonas putida KT2440
caaacuggcgcc

SEQ ID NO: 1588909 - RNA, 17 nt, Pseudomonas putida KT2440
caaacugauucacgccc

SEQ ID NO: 1588910 - RNA, 18 nt, Pseudomonas putida KT2440
caaaccauggcgucaggc

SEQ ID NO: 1588911 - RNA, 15 nt, Pseudomonas putida KT2440
caaacacauccagcg

SEQ ID NO: 1588912 - RNA, 17 nt, Pseudomonas putida KT2440
caaacaaugcacagcgc

SEQ ID NO: 1588913 - RNA, 20 nt, Pseudomonas putida KT2440
caaaucgaaaaugcagaugc

SEQ ID NO: 1588914 - RNA, 20 nt, Pseudomonas putida KT2440
caaaugccccgggcaggcca

SEQ ID NO: 1588915 - RNA, 18 nt, Pseudomonas putida KT2440
caaaugcccacugcguuc

SEQ ID NO: 1588916 - RNA, 21 nt, Pseudomonas putida KT2440
caaaugcgcccugcugccgca

SEQ ID NO: 1588917 - RNA, 16 nt, Pseudomonas putida KT2440
caaaugcuugcccgcc

SEQ ID NO: 1588918 - RNA, 13 nt, Pseudomonas putida KT2440
caaaucggcagaa

SEQ ID NO: 1588919 - RNA, 16 nt, Pseudomonas putida KT2440
caaauccuccugcgca

SEQ ID NO: 1588920 - RNA, 23 nt, Pseudomonas putida KT2440
caacaacgacuggucauacucca

SEQ ID NO: 1588921 - RNA, 13 nt, Pseudomonas putida KT2440
caacaaucgcguc

SEQ ID NO: 1588922 - RNA, 18 nt, Pseudomonas putida KT2440
caacaccagacucagcgc

SEQ ID NO: 1588923 - RNA, 19 nt, Pseudomonas putida KT2440
caacaccagacucagcgcu

SEQ ID NO: 1588924 - RNA, 14 nt, Pseudomonas putida KT2440
caacaccaucuuca

SEQ ID NO: 1588925 - RNA, 21 nt, Pseudomonas putida KT2440
caacccagccagcgacagcau

SEQ ID NO: 1588926 - RNA, 18 nt, Pseudomonas putida KT2440
caacccaccagcacugcu

SEQ ID NO: 1588927 - RNA, 18 nt, Pseudomonas putida KT2440
caaccccaaaccgcucga

SEQ ID NO: 1588928 - RNA, 15 nt, Pseudomonas putida KT2440
caaccccaggcgcac

SEQ ID NO: 1588929 - RNA, 15 nt, Pseudomonas putida KT2440
caaccccaggugcug

SEQ ID NO: 1588930 - RNA, 20 nt, Pseudomonas putida KT2440
caaccccugcaaggccagcg

SEQ ID NO: 1588931 - RNA, 22 nt, Pseudomonas putida KT2440
caacccgauuccuugcagcgcc

SEQ ID NO: 1588932 - RNA, 22 nt, Pseudomonas putida KT2440
caaccaccucuaucaccuguuc

SEQ ID NO: 1588933 - RNA, 15 nt, Pseudomonas putida KT2440
caaccaugcuggcca

SEQ ID NO: 1588934 - RNA, 17 nt, Pseudomonas putida KT2440
caaccaccgaccugugu

SEQ ID NO: 1588935 - RNA, 20 nt, Pseudomonas putida KT2440
caacauggucacaugucgag

SEQ ID NO: 1588936 - RNA, 20 nt, Pseudomonas putida KT2440
caaccuccaggucauccgca

SEQ ID NO: 1588937 - RNA, 20 nt, Pseudomonas putida KT2440
caaccguacccuuccuggag

SEQ ID NO: 1588938 - RNA, 22 nt, Pseudomonas putida KT2440
caaccggcuuguagccggcagu

SEQ ID NO: 1588939 - RNA, 21 nt, Pseudomonas putida KT2440
caaccgccuccacggucagca

SEQ ID NO: 1588940 - RNA, 19 nt, Pseudomonas putida KT2440
caaccgcgugacgcggagc

SEQ ID NO: 1588941 - RNA, 15 nt, Pseudomonas putida KT2440
caaccgcgccagcuc

SEQ ID NO: 1588942 - RNA, 16 nt, Pseudomonas putida KT2440
caaccgcucucgauca

SEQ ID NO: 1588943 - RNA, 17 nt, Pseudomonas putida KT2440
caacccgccuccugaag

SEQ ID NO: 1588944 - RNA, 14 nt, Pseudomonas putida KT2440
caacccggccaggc

SEQ ID NO: 1588945 - RNA, 15 nt, Pseudomonas putida KT2440
caacgcaaauccucc

SEQ ID NO: 1588946 - RNA, 22 nt, Pseudomonas putida KT2440
caacgcaaauccuccugcgcau

SEQ ID NO: 1588947 - RNA, 12 nt, Pseudomonas putida KT2440
caacgucucgaa

SEQ ID NO: 1588948 - RNA, 16 nt, Pseudomonas putida KT2440
caacgucaucggccca

SEQ ID NO: 1588949 - RNA, 23 nt, Pseudomonas putida KT2440
caacuccacuguggucgaauagc

SEQ ID NO: 1588950 - RNA, 22 nt, Pseudomonas putida KT2440
caagccggguuuuuugugccug

SEQ ID NO: 1588951 - RNA, 18 nt, Pseudomonas putida KT2440
caacucggccuuguccgu

SEQ ID NO: 1588952 - RNA, 19 nt, Pseudomonas putida KT2440
caagcgagguaggccguca

SEQ ID NO: 1588953 - RNA, 16 nt, Pseudomonas putida KT2440
caagcgaacuauccua

SEQ ID NO: 1588954 - RNA, 19 nt, Pseudomonas putida KT2440
caagccugacucagcccug

SEQ ID NO: 1588955 - RNA, 22 nt, Pseudomonas putida KT2440
caagccuacgcccccagccuug

SEQ ID NO: 1588956 - RNA, 16 nt, Pseudomonas putida KT2440
caacucgcgcauccag

SEQ ID NO: 1588957 - RNA, 16 nt, Pseudomonas putida KT2440
caacuccugcguaccc

SEQ ID NO: 1588958 - RNA, 16 nt, Pseudomonas putida KT2440
caagcgccgaugcucg

SEQ ID NO: 1588959 - RNA, 15 nt, Pseudomonas putida KT2440
caagcgccugacgca

SEQ ID NO: 1588960 - RNA, 23 nt, Pseudomonas putida KT2440
caaggcgccgaugaagcaggccg

SEQ ID NO: 1588961 - RNA, 19 nt, Pseudomonas putida KT2440
caaggcgagguucagcgca

SEQ ID NO: 1588962 - RNA, 17 nt, Pseudomonas putida KT2440
caaggcgaccugccagc

SEQ ID NO: 1588963 - RNA, 14 nt, Pseudomonas putida KT2440
caaggccgcccagu

SEQ ID NO: 1588964 - RNA, 22 nt, Pseudomonas putida KT2440
caagcucaucaccaggcccgca

SEQ ID NO: 1588965 - RNA, 14 nt, Pseudomonas putida KT2440
caaggccgcuccca

SEQ ID NO: 1588966 - RNA, 19 nt, Pseudomonas putida KT2440
caaggccgcucccacaggu

SEQ ID NO: 1588967 - RNA, 17 nt, Pseudomonas putida KT2440
caagguugccaccagca

SEQ ID NO: 1588968 - RNA, 22 nt, Pseudomonas putida KT2440
caaggcugcgcuugagccuugu

SEQ ID NO: 1588969 - RNA, 22 nt, Pseudomonas putida KT2440
caaggcuuuccaccuggccacc

SEQ ID NO: 1588970 - RNA, 17 nt, Pseudomonas putida KT2440
caaggcuggccagacga

SEQ ID NO: 1588971 - RNA, 15 nt, Pseudomonas putida KT2440
caaggcucaagcgca

SEQ ID NO: 1588972 - RNA, 19 nt, Pseudomonas putida KT2440
caagugccuuggcggcgga

SEQ ID NO: 1588973 - RNA, 13 nt, Pseudomonas putida KT2440
caaguacggccag

SEQ ID NO: 1588974 - RNA, 18 nt, Pseudomonas putida KT2440
caaguacuugcaggugca

SEQ ID NO: 1588975 - RNA, 20 nt, Pseudomonas putida KT2440
caaguaggcacgaugaccgu

SEQ ID NO: 1588976 - RNA, 16 nt, Pseudomonas putida KT2440
caauacccaacagcau

SEQ ID NO: 1588977 - RNA, 19 nt, Pseudomonas putida KT2440
caauacccaacagcaucca

SEQ ID NO: 1588978 - RNA, 24 nt, Pseudomonas putida KT2440
caauagccccgcaaucgucgacca

SEQ ID NO: 1588979 - RNA, 19 nt, Pseudomonas putida KT2440
caauaacucgcagcgcaaa

SEQ ID NO: 1588980 - RNA, 13 nt, Pseudomonas putida KT2440
caaguucguuggc

SEQ ID NO: 1588981 - RNA, 22 nt, Pseudomonas putida KT2440
caaguggccuuguugccaccca

SEQ ID NO: 1588982 - RNA, 20 nt, Pseudomonas putida KT2440
caaucgggauggcaccggca

SEQ ID NO: 1588983 - RNA, 15 nt, Pseudomonas putida KT2440
caaucggcagcgcgc

SEQ ID NO: 1588984 - RNA, 15 nt, Pseudomonas putida KT2440
caaucuccagcccga

SEQ ID NO: 1588985 - RNA, 15 nt, Pseudomonas putida KT2440
caaucgucggugaug

SEQ ID NO: 1588986 - RNA, 17 nt, Pseudomonas putida KT2440
caaucgucguaggcgcg

SEQ ID NO: 1588987 - RNA, 20 nt, Pseudomonas putida KT2440
caaugccccgaccaccgccu

SEQ ID NO: 1588988 - RNA, 16 nt, Pseudomonas putida KT2440
caaucuuguggcggau

SEQ ID NO: 1588989 - RNA, 18 nt, Pseudomonas putida KT2440
caaugcaggcaguaggcc

SEQ ID NO: 1588990 - RNA, 20 nt, Pseudomonas putida KT2440
caaugcaggcaguaggccac

SEQ ID NO: 1588991 - RNA, 14 nt, Pseudomonas putida KT2440
caaucugcagcagc

SEQ ID NO: 1588992 - RNA, 13 nt, Pseudomonas putida KT2440
caaucugguuacc

SEQ ID NO: 1588993 - RNA, 21 nt, Pseudomonas putida KT2440
caaucugugaggccagcggga

SEQ ID NO: 1588994 - RNA, 18 nt, Pseudomonas putida KT2440
caaucaggucucccgccc

SEQ ID NO: 1588995 - RNA, 21 nt, Pseudomonas putida KT2440
caaucagcucgucagccacca

SEQ ID NO: 1588996 - RNA, 15 nt, Pseudomonas putida KT2440
caaucaggcagcgau

SEQ ID NO: 1588997 - RNA, 16 nt, Pseudomonas putida KT2440
caaucaccgccagguc

SEQ ID NO: 1588998 - RNA, 16 nt, Pseudomonas putida KT2440
caauccucugcccgca

SEQ ID NO: 1588999 - RNA, 18 nt, Pseudomonas putida KT2440
caauccgugagccaggag

SEQ ID NO: 1589000 - RNA, 19 nt, Pseudomonas putida KT2440
caaucgccgggcgcaccac

SEQ ID NO: 1589001 - RNA, 14 nt, Pseudomonas putida KT2440
cacaccggcaaucg

SEQ ID NO: 1589002 - RNA, 13 nt, Pseudomonas putida KT2440
cacaccgaucacu

SEQ ID NO: 1589003 - RNA, 15 nt, Pseudomonas putida KT2440
cacacaaacaccggc

SEQ ID NO: 1589004 - RNA, 16 nt, Pseudomonas putida KT2440
cacacaaacaccggcc

SEQ ID NO: 1589005 - RNA, 19 nt, Pseudomonas putida KT2440
cacacaacuguuuucaguu

SEQ ID NO: 1589006 - RNA, 14 nt, Pseudomonas putida KT2440
cacaaucagcucgu

SEQ ID NO: 1589007 - RNA, 19 nt, Pseudomonas putida KT2440
cacaaggccgcucccacag

SEQ ID NO: 1589008 - RNA, 21 nt, Pseudomonas putida KT2440
cacaacggcgcgcccggcgca

SEQ ID NO: 1589009 - RNA, 15 nt, Pseudomonas putida KT2440
caauugccaccggcg

SEQ ID NO: 1589010 - RNA, 16 nt, Pseudomonas putida KT2440
caauugccggucgggc

SEQ ID NO: 1589011 - RNA, 15 nt, Pseudomonas putida KT2440
caauugcgccagccg

SEQ ID NO: 1589012 - RNA, 18 nt, Pseudomonas putida KT2440
cacaacccuugcagcgcc

SEQ ID NO: 1589013 - RNA, 20 nt, Pseudomonas putida KT2440
caauuucccccaaaugcccg

SEQ ID NO: 1589014 - RNA, 21 nt, Pseudomonas putida KT2440
caauuucuaaaagcuggcgcg

SEQ ID NO: 1589015 - RNA, 15 nt, Pseudomonas putida KT2440
caaugggccgaucac

SEQ ID NO: 1589016 - RNA, 19 nt, Pseudomonas putida KT2440
caauggucauugaaggcca

SEQ ID NO: 1589017 - RNA, 22 nt, Pseudomonas putida KT2440
caauggucauugaaggccagug

SEQ ID NO: 1589018 - RNA, 19 nt, Pseudomonas putida KT2440
caauggcgaaccgcuguuc

SEQ ID NO: 1589019 - RNA, 19 nt, Pseudomonas putida KT2440
caccggcuucgccgguguu

SEQ ID NO: 1589020 - RNA, 21 nt, Pseudomonas putida KT2440
caccggcuucgucggcgcgga

SEQ ID NO: 1589021 - RNA, 19 nt, Pseudomonas putida KT2440
caccggcuugcccggcgca

SEQ ID NO: 1589022 - RNA, 20 nt, Pseudomonas putida KT2440
caccggcucugccgguguuc

SEQ ID NO: 1589023 - RNA, 22 nt, Pseudomonas putida KT2440
caccgggcacuuggcauuggcc

SEQ ID NO: 1589024 - RNA, 17 nt, Pseudomonas putida KT2440
caccgggcgcgauugcc

SEQ ID NO: 1589025 - RNA, 21 nt, Pseudomonas putida KT2440
caccgggaugcucugcagcag

SEQ ID NO: 1589026 - RNA, 22 nt, Pseudomonas putida KT2440
caccgggauggcggcgccugcc

SEQ ID NO: 1589027 - RNA, 18 nt, Pseudomonas putida KT2440
caccgggauacugcgcac

SEQ ID NO: 1589028 - RNA, 22 nt, Pseudomonas putida KT2440
caccguagcgagcaccggcagu

SEQ ID NO: 1589029 - RNA, 23 nt, Pseudomonas putida KT2440
caccgguucgcccccacgggcau

SEQ ID NO: 1589030 - RNA, 12 nt, Pseudomonas putida KT2440
caccgguaggac

SEQ ID NO: 1589031 - RNA, 21 nt, Pseudomonas putida KT2440
caccgguaccgcucugcgcca

SEQ ID NO: 1589032 - RNA, 20 nt, Pseudomonas putida KT2440
caccggucgccuguaggagc

SEQ ID NO: 1589033 - RNA, 18 nt, Pseudomonas putida KT2440
caccgguacauugcgcac

SEQ ID NO: 1589034 - RNA, 18 nt, Pseudomonas putida KT2440
caccgucgaugucggcgu

SEQ ID NO: 1589035 - RNA, 23 nt, Pseudomonas putida KT2440
caccgucgaugucggcguggaug

SEQ ID NO: 1589036 - RNA, 17 nt, Pseudomonas putida KT2440
caccgucaggcucagca

SEQ ID NO: 1589037 - RNA, 12 nt, Pseudomonas putida KT2440
caccgucggcgc

SEQ ID NO: 1589038 - RNA, 15 nt, Pseudomonas putida KT2440
caccgugcaccagca

SEQ ID NO: 1589039 - RNA, 13 nt, Pseudomonas putida KT2440
caccguggcagca

SEQ ID NO: 1589040 - RNA, 23 nt, Pseudomonas putida KT2440
caccguggcguauugcugguaga

SEQ ID NO: 1589041 - RNA, 19 nt, Pseudomonas putida KT2440
caccguugcgcucgagccc

SEQ ID NO: 1589042 - RNA, 15 nt, Pseudomonas putida KT2440
caccuaucgcugccg

SEQ ID NO: 1589043 - RNA, 15 nt, Pseudomonas putida KT2440
caccgccucgaccug

SEQ ID NO: 1589044 - RNA, 17 nt, Pseudomonas putida KT2440
caccgccucgaccuggc

SEQ ID NO: 1589045 - RNA, 16 nt, Pseudomonas putida KT2440
caccgcgccagccugg

SEQ ID NO: 1589046 - RNA, 17 nt, Pseudomonas putida KT2440
caccgagacgaucacca

SEQ ID NO: 1589047 - RNA, 20 nt, Pseudomonas putida KT2440
caccgagacgaucaccaggu

SEQ ID NO: 1589048 - RNA, 18 nt, Pseudomonas putida KT2440
caccgaguaccgucggca

SEQ ID NO: 1589049 - RNA, 20 nt, Pseudomonas putida KT2440
caccgaguaccgucggcacg

SEQ ID NO: 1589050 - RNA, 20 nt, Pseudomonas putida KT2440
caccgauccgguguaggagc

SEQ ID NO: 1589051 - RNA, 14 nt, Pseudomonas putida KT2440
caccgaucaccugg

SEQ ID NO: 1589052 - RNA, 23 nt, Pseudomonas putida KT2440
caccgaucaccugggcgaucaca

SEQ ID NO: 1589053 - RNA, 14 nt, Pseudomonas putida KT2440
caccgaucagcggc

SEQ ID NO: 1589054 - RNA, 15 nt, Pseudomonas putida KT2440
caccgaugccugugu

SEQ ID NO: 1589055 - RNA, 20 nt, Pseudomonas putida KT2440
caccgaucucgccagccugc

SEQ ID NO: 1589056 - RNA, 23 nt, Pseudomonas putida KT2440
caccgcggugucuucuucgcggg

SEQ ID NO: 1589057 - RNA, 14 nt, Pseudomonas putida KT2440
caccggccaccagg

SEQ ID NO: 1589058 - RNA, 20 nt, Pseudomonas putida KT2440
caccggccccccagccagca

SEQ ID NO: 1589059 - RNA, 15 nt, Pseudomonas putida KT2440
caccggccuugcgca

SEQ ID NO: 1589060 - RNA, 21 nt, Pseudomonas putida KT2440
caccggccuugcgcaaggcaa

SEQ ID NO: 1589061 - RNA, 18 nt, Pseudomonas putida KT2440
caccggcgaagacggcag

SEQ ID NO: 1589062 - RNA, 13 nt, Pseudomonas putida KT2440
caccggcgaugcc

SEQ ID NO: 1589063 - RNA, 21 nt, Pseudomonas putida KT2440
caccggcgccaaucaucgcca

SEQ ID NO: 1589064 - RNA, 20 nt, Pseudomonas putida KT2440
caccggcauucccggcgcca

SEQ ID NO: 1589065 - RNA, 13 nt, Pseudomonas putida KT2440
caccggcagcagc

SEQ ID NO: 1589066 - RNA, 15 nt, Pseudomonas putida KT2440
caccggcagcagcaa

SEQ ID NO: 1589067 - RNA, 19 nt, Pseudomonas putida KT2440
caccggcagagccggugcc

SEQ ID NO: 1589068 - RNA, 13 nt, Pseudomonas putida KT2440
caccggcagcacc

SEQ ID NO: 1589069 - RNA, 10 nt, Pseudomonas putida KT2440
caccggcacc

SEQ ID NO: 1589070 - RNA, 17 nt, Pseudomonas putida KT2440
caccgcucaaacccggc

SEQ ID NO: 1589071 - RNA, 22 nt, Pseudomonas putida KT2440
caccgcucaaacccggcagcca

SEQ ID NO: 1589072 - RNA, 16 nt, Pseudomonas putida KT2440
caccgcugccgaucag

SEQ ID NO: 1589073 - RNA, 21 nt, Pseudomonas putida KT2440
caccgcugauggccaauaccg

SEQ ID NO: 1589074 - RNA, 22 nt, Pseudomonas putida KT2440
caccgcugcaaucgagccgaac

SEQ ID NO: 1589075 - RNA, 13 nt, Pseudomonas putida KT2440
caccgcuugcaca

SEQ ID NO: 1589076 - RNA, 22 nt, Pseudomonas putida KT2440
caccgcuucacccucgcgcagc

SEQ ID NO: 1589077 - RNA, 18 nt, Pseudomonas putida KT2440
caccggaguccccaccgg

SEQ ID NO: 1589078 - RNA, 20 nt, Pseudomonas putida KT2440
caccggacgcuugccaccca

SEQ ID NO: 1589079 - RNA, 13 nt, Pseudomonas putida KT2440
caccagcgacugc

SEQ ID NO: 1589080 - RNA, 18 nt, Pseudomonas putida KT2440
caccagcgcaccacuguu

SEQ ID NO: 1589081 - RNA, 19 nt, Pseudomonas putida KT2440
caccagcccgaagcgcagg

SEQ ID NO: 1589082 - RNA, 21 nt, Pseudomonas putida KT2440
caccagcauguccugcugcag

SEQ ID NO: 1589083 - RNA, 16 nt, Pseudomonas putida KT2440
caccagcacgucaccc

SEQ ID NO: 1589084 - RNA, 18 nt, Pseudomonas putida KT2440
caccagcacugccuugcc

SEQ ID NO: 1589085 - RNA, 14 nt, Pseudomonas putida KT2440
caccagcgcugccg

SEQ ID NO: 1589086 - RNA, 16 nt, Pseudomonas putida KT2440
caccagcuccaccuuc

SEQ ID NO: 1589087 - RNA, 17 nt, Pseudomonas putida KT2440
caccagcuccaccuucc

SEQ ID NO: 1589088 - RNA, 19 nt, Pseudomonas putida KT2440
caccagcugcaccaccugc

SEQ ID NO: 1589089 - RNA, 17 nt, Pseudomonas putida KT2440
caccagcuucugggcaa

SEQ ID NO: 1589090 - RNA, 16 nt, Pseudomonas putida KT2440
caccagcuugaugcug

SEQ ID NO: 1589091 - RNA, 16 nt, Pseudomonas putida KT2440
caccaggaacaucgcc

SEQ ID NO: 1589092 - RNA, 14 nt, Pseudomonas putida KT2440
caccagacgggcau

SEQ ID NO: 1589093 - RNA, 22 nt, Pseudomonas putida KT2440
caccagaccagcagcaguggca

SEQ ID NO: 1589094 - RNA, 14 nt, Pseudomonas putida KT2440
caccacggaaggcc

SEQ ID NO: 1589095 - RNA, 15 nt, Pseudomonas putida KT2440
caccacggaaggcca

SEQ ID NO: 1589096 - RNA, 15 nt, Pseudomonas putida KT2440
caccacuugcucggu

SEQ ID NO: 1589097 - RNA, 15 nt, Pseudomonas putida KT2440
caccacggucggccu

SEQ ID NO: 1589098 - RNA, 17 nt, Pseudomonas putida KT2440
cacacgucgccugggca

SEQ ID NO: 1589099 - RNA, 17 nt, Pseudomonas putida KT2440
cacacuacacgaucacu

SEQ ID NO: 1589100 - RNA, 14 nt, Pseudomonas putida KT2440
cacacucgccccca

SEQ ID NO: 1589101 - RNA, 14 nt, Pseudomonas putida KT2440
cacacggcaagcca

SEQ ID NO: 1589102 - RNA, 21 nt, Pseudomonas putida KT2440
cacacugcucagugcuggcgu

SEQ ID NO: 1589103 - RNA, 14 nt, Pseudomonas putida KT2440
caccacagcugcac

SEQ ID NO: 1589104 - RNA, 14 nt, Pseudomonas putida KT2440
caccacacggcagc

SEQ ID NO: 1589105 - RNA, 15 nt, Pseudomonas putida KT2440
caccacaugcacggc

SEQ ID NO: 1589106 - RNA, 19 nt, Pseudomonas putida KT2440
caccacccggucggccagc

SEQ ID NO: 1589107 - RNA, 20 nt, Pseudomonas putida KT2440
caccacccggucggccagcu

SEQ ID NO: 1589108 - RNA, 15 nt, Pseudomonas putida KT2440
caccacccaccagca

SEQ ID NO: 1589109 - RNA, 14 nt, Pseudomonas putida KT2440
caccacccccagcg

SEQ ID NO: 1589110 - RNA, 16 nt, Pseudomonas putida KT2440
caccacccccagcgcc

SEQ ID NO: 1589111 - RNA, 21 nt, Pseudomonas putida KT2440
cacccagcguauagccaccgg

SEQ ID NO: 1589112 - RNA, 17 nt, Pseudomonas putida KT2440
cacccaggugaucgcca

SEQ ID NO: 1589113 - RNA, 19 nt, Pseudomonas putida KT2440
cacccaggugcaacccggc

SEQ ID NO: 1589114 - RNA, 22 nt, Pseudomonas putida KT2440
cacccaggcccugacgccagcg

SEQ ID NO: 1589115 - RNA, 16 nt, Pseudomonas putida KT2440
cacccagucaccuugc

SEQ ID NO: 1589116 - RNA, 22 nt, Pseudomonas putida KT2440
cacccccagguuauccacaggg

SEQ ID NO: 1589117 - RNA, 13 nt, Pseudomonas putida KT2440
cacccccagcgac

SEQ ID NO: 1589118 - RNA, 15 nt, Pseudomonas putida KT2440
cacccccagcgccuc

SEQ ID NO: 1589119 - RNA, 18 nt, Pseudomonas putida KT2440
cacccccaucagcgggcg

SEQ ID NO: 1589120 - RNA, 20 nt, Pseudomonas putida KT2440
cacccgcgcguugcggaaca

SEQ ID NO: 1589121 - RNA, 17 nt, Pseudomonas putida KT2440
cacccgcgccaccagcc

SEQ ID NO: 1589122 - RNA, 20 nt, Pseudomonas putida KT2440
cacccgcgccaccagcccca

SEQ ID NO: 1589123 - RNA, 16 nt, Pseudomonas putida KT2440
caccaggacaagccga

SEQ ID NO: 1589124 - RNA, 18 nt, Pseudomonas putida KT2440
caccaggcaccgaguacc

SEQ ID NO: 1589125 - RNA, 12 nt, Pseudomonas putida KT2440
cacccaccagcc

SEQ ID NO: 1589126 - RNA, 14 nt, Pseudomonas putida KT2440
cacccaccagccaa

SEQ ID NO: 1589127 - RNA, 16 nt, Pseudomonas putida KT2440
cacccaccgcagguca

SEQ ID NO: 1589128 - RNA, 20 nt, Pseudomonas putida KT2440
cacccaccgcaggucacugc

SEQ ID NO: 1589129 - RNA, 22 nt, Pseudomonas putida KT2440
cacccacuuggaaaacagcgcg

SEQ ID NO: 1589130 - RNA, 13 nt, Pseudomonas putida KT2440
cacccacuggccg

SEQ ID NO: 1589131 - RNA, 15 nt, Pseudomonas putida KT2440
cacccgugcagggcu

SEQ ID NO: 1589132 - RNA, 18 nt, Pseudomonas putida KT2440
caccgaaaucagcaacgc

SEQ ID NO: 1589133 - RNA, 18 nt, Pseudomonas putida KT2440
cacccgguccugguccga

SEQ ID NO: 1589134 - RNA, 17 nt, Pseudomonas putida KT2440
cacccgcugggcuucuu

SEQ ID NO: 1589135 - RNA, 15 nt, Pseudomonas putida KT2440
caccgaacucguuga

SEQ ID NO: 1589136 - RNA, 16 nt, Pseudomonas putida KT2440
caccgaacucguugac

SEQ ID NO: 1589137 - RNA, 17 nt, Pseudomonas putida KT2440
caccgaagcaccacugg

SEQ ID NO: 1589138 - RNA, 15 nt, Pseudomonas putida KT2440
caccgacauccacgu

SEQ ID NO: 1589139 - RNA, 16 nt, Pseudomonas putida KT2440
caccgacagcaacgcg

SEQ ID NO: 1589140 - RNA, 17 nt, Pseudomonas putida KT2440
caccgacgaacagggcc

SEQ ID NO: 1589141 - RNA, 14 nt, Pseudomonas putida KT2440
caccgacgccgauc

SEQ ID NO: 1589142 - RNA, 17 nt, Pseudomonas putida KT2440
caccgaccgcaccggcc

SEQ ID NO: 1589143 - RNA, 14 nt, Pseudomonas putida KT2440
caccgaccaucggc

SEQ ID NO: 1589144 - RNA, 18 nt, Pseudomonas putida KT2440
accagccccucaggcaca

SEQ ID NO: 1589145 - RNA, 21 nt, Pseudomonas putida KT2440
accagcauguccugcugcagg

SEQ ID NO: 1589146 - RNA, 14 nt, Pseudomonas putida KT2440
accagccaggcaca

SEQ ID NO: 1589147 - RNA, 14 nt, Pseudomonas putida KT2440
accagcaccugcag

SEQ ID NO: 1589148 - RNA, 13 nt, Pseudomonas putida KT2440
accagcgccgcau

SEQ ID NO: 1589149 - RNA, 14 nt, Pseudomonas putida KT2440
accagcaccagcuc

SEQ ID NO: 1589150 - RNA, 23 nt, Pseudomonas putida KT2440
accagcaccaucagagcgccagc

SEQ ID NO: 1589151 - RNA, 13 nt, Pseudomonas putida KT2440
accagcaccccga

SEQ ID NO: 1589152 - RNA, 16 nt, Pseudomonas putida KT2440
accagcaacaucggug

SEQ ID NO: 1589153 - RNA, 22 nt, Pseudomonas putida KT2440
accagacccgcuucgccgcgcu

SEQ ID NO: 1589154 - RNA, 14 nt, Pseudomonas putida KT2440
accagacgggcaug

SEQ ID NO: 1589155 - RNA, 16 nt, Pseudomonas putida KT2440
accagaccagcagcag

SEQ ID NO: 1589156 - RNA, 17 nt, Pseudomonas putida KT2440
accacguccggccagca

SEQ ID NO: 1589157 - RNA, 19 nt, Pseudomonas putida KT2440
accacggucgaaccggucu

SEQ ID NO: 1589158 - RNA, 21 nt, Pseudomonas putida KT2440
accacggucgaaccggucugc

SEQ ID NO: 1589159 - RNA, 20 nt, Pseudomonas putida KT2440
accacgcgcaaaugcuugcc

SEQ ID NO: 1589160 - RNA, 14 nt, Pseudomonas putida KT2440
accacgaucacgcc

SEQ ID NO: 1589161 - RNA, 12 nt, Pseudomonas putida KT2440
accaccgcaucc

SEQ ID NO: 1589162 - RNA, 14 nt, Pseudomonas putida KT2440
accaccgcaggugc

SEQ ID NO: 1589163 - RNA, 13 nt, Pseudomonas putida KT2440
accaccgcgaaac

SEQ ID NO: 1589164 - RNA, 17 nt, Pseudomonas putida KT2440
accacaagaacugcgac

SEQ ID NO: 1589165 - RNA, 21 nt, Pseudomonas putida KT2440
accacaagaacugcgacgaac

SEQ ID NO: 1589166 - RNA, 12 nt, Pseudomonas putida KT2440
acauucaccgcc

SEQ ID NO: 1589167 - RNA, 21 nt, Pseudomonas putida KT2440
acauucaggaugcuucggcug

SEQ ID NO: 1589168 - RNA, 19 nt, Pseudomonas putida KT2440
accaucagagcgccagcaa

SEQ ID NO: 1589169 - RNA, 20 nt, Pseudomonas putida KT2440
accaucaccgccagcauggc

SEQ ID NO: 1589170 - RNA, 15 nt, Pseudomonas putida KT2440
accauccgccaggua

SEQ ID NO: 1589171 - RNA, 14 nt, Pseudomonas putida KT2440
accagucugcucag

SEQ ID NO: 1589172 - RNA, 16 nt, Pseudomonas putida KT2440
accaguucgccaucgc

SEQ ID NO: 1589173 - RNA, 23 nt, Pseudomonas putida KT2440
accagugucaccgagacgaucac

SEQ ID NO: 1589174 - RNA, 15 nt, Pseudomonas putida KT2440
accaugcucaggaac

SEQ ID NO: 1589175 - RNA, 15 nt, Pseudomonas putida KT2440
accaugcucggccag

SEQ ID NO: 1589176 - RNA, 20 nt, Pseudomonas putida KT2440
accauucccugcacaucgcu

SEQ ID NO: 1589177 - RNA, 14 nt, Pseudomonas putida KT2440
accaucggccggcu

SEQ ID NO: 1589178 - RNA, 17 nt, Pseudomonas putida KT2440
accaucuccagcucgcc

SEQ ID NO: 1589179 - RNA, 14 nt, Pseudomonas putida KT2440
accaugaacagcac

SEQ ID NO: 1589180 - RNA, 17 nt, Pseudomonas putida KT2440
accaguaguucucgaca

SEQ ID NO: 1589181 - RNA, 21 nt, Pseudomonas putida KT2440
accagugcaacguucaccguc

SEQ ID NO: 1589182 - RNA, 14 nt, Pseudomonas putida KT2440
accagguuggccgc

SEQ ID NO: 1589183 - RNA, 16 nt, Pseudomonas putida KT2440
accaggugcagguacu

SEQ ID NO: 1589184 - RNA, 19 nt, Pseudomonas putida KT2440
accaggugguaacuggcca

SEQ ID NO: 1589185 - RNA, 21 nt, Pseudomonas putida KT2440
accaggugguaacuggccagu

SEQ ID NO: 1589186 - RNA, 13 nt, Pseudomonas putida KT2440
accaggucuucaa

SEQ ID NO: 1589187 - RNA, 18 nt, Pseudomonas putida KT2440
accaggguggcgauccac

SEQ ID NO: 1589188 - RNA, 20 nt, Pseudomonas putida KT2440
accagggcuggcagcgggua

SEQ ID NO: 1589189 - RNA, 19 nt, Pseudomonas putida KT2440
accaggucauaguucuggc

SEQ ID NO: 1589190 - RNA, 16 nt, Pseudomonas putida KT2440
accagggcgcgcuggc

SEQ ID NO: 1589191 - RNA, 18 nt, Pseudomonas putida KT2440
accagcgcugccgccuug

SEQ ID NO: 1589192 - RNA, 13 nt, Pseudomonas putida KT2440
accagcggaucac

SEQ ID NO: 1589193 - RNA, 14 nt, Pseudomonas putida KT2440
accagcggaucacc

SEQ ID NO: 1589194 - RNA, 14 nt, Pseudomonas putida KT2440
accagcggcagcaa

SEQ ID NO: 1589195 - RNA, 16 nt, Pseudomonas putida KT2440
accaggcccagcaggu

SEQ ID NO: 1589196 - RNA, 19 nt, Pseudomonas putida KT2440
accaggccguugaucagcg

SEQ ID NO: 1589197 - RNA, 15 nt, Pseudomonas putida KT2440
accaggccuggaugc

SEQ ID NO: 1589198 - RNA, 16 nt, Pseudomonas putida KT2440
accaggcgcagcagcu

SEQ ID NO: 1589199 - RNA, 15 nt, Pseudomonas putida KT2440
accaggcgcggcagc

SEQ ID NO: 1589200 - RNA, 17 nt, Pseudomonas putida KT2440
acaccagcgcaccacug

SEQ ID NO: 1589201 - RNA, 15 nt, Pseudomonas putida KT2440
acaccagacggccuu

SEQ ID NO: 1589202 - RNA, 17 nt, Pseudomonas putida KT2440
acaccaucggccggcuc

SEQ ID NO: 1589203 - RNA, 13 nt, Pseudomonas putida KT2440
acacccagcaccc

SEQ ID NO: 1589204 - RNA, 20 nt, Pseudomonas putida KT2440
acaccggccuuggccagcuc

SEQ ID NO: 1589205 - RNA, 16 nt, Pseudomonas putida KT2440
acaccggcagagccgg

SEQ ID NO: 1589206 - RNA, 14 nt, Pseudomonas putida KT2440
acaccucccgcgca

SEQ ID NO: 1589207 - RNA, 15 nt, Pseudomonas putida KT2440
acaccucccgcgcau

SEQ ID NO: 1589208 - RNA, 13 nt, Pseudomonas putida KT2440
acaccaccuccac

SEQ ID NO: 1589209 - RNA, 15 nt, Pseudomonas putida KT2440
acacaucgaucaggu

SEQ ID NO: 1589210 - RNA, 19 nt, Pseudomonas putida KT2440
acacauagucgauacccag

SEQ ID NO: 1589211 - RNA, 21 nt, Pseudomonas putida KT2440
acacagguaguucacuggcca

SEQ ID NO: 1589212 - RNA, 21 nt, Pseudomonas putida KT2440
acacggcugccgacaggccgu

SEQ ID NO: 1589213 - RNA, 18 nt, Pseudomonas putida KT2440
acacgguaguccugccau

SEQ ID NO: 1589214 - RNA, 18 nt, Pseudomonas putida KT2440
acacgguaugcagguacc

SEQ ID NO: 1589215 - RNA, 12 nt, Pseudomonas putida KT2440
acaccugcagcg

SEQ ID NO: 1589216 - RNA, 13 nt, Pseudomonas putida KT2440
acaccugccgcga

SEQ ID NO: 1589217 - RNA, 13 nt, Pseudomonas putida KT2440
acacgaacaccgg

SEQ ID NO: 1589218 - RNA, 19 nt, Pseudomonas putida KT2440
acacgaacaucagcaggaa

SEQ ID NO: 1589219 - RNA, 17 nt, Pseudomonas putida KT2440
acacgucggcuggcagc

SEQ ID NO: 1589220 - RNA, 15 nt, Pseudomonas putida KT2440
acagacagggccuug

SEQ ID NO: 1589221 - RNA, 18 nt, Pseudomonas putida KT2440
acagacaaucaucggcag

SEQ ID NO: 1589222 - RNA, 15 nt, Pseudomonas putida KT2440
acagcaggccaagga

SEQ ID NO: 1589223 - RNA, 12 nt, Pseudomonas putida KT2440
acagcagcugca

SEQ ID NO: 1589224 - RNA, 22 nt, Pseudomonas putida KT2440
acagcaggaacagcggcagcaa

SEQ ID NO: 1589225 - RNA, 13 nt, Pseudomonas putida KT2440
acagaugcugcug

SEQ ID NO: 1589226 - RNA, 21 nt, Pseudomonas putida KT2440
acagcccuacgcagucagcca

SEQ ID NO: 1589227 - RNA, 19 nt, Pseudomonas putida KT2440
acagcauuacgcggcagca

SEQ ID NO: 1589228 - RNA, 14 nt, Pseudomonas putida KT2440
acagcaucugcacc

SEQ ID NO: 1589229 - RNA, 13 nt, Pseudomonas putida KT2440
acagcccgggcau

SEQ ID NO: 1589230 - RNA, 16 nt, Pseudomonas putida KT2440
acagauggcaccccag

SEQ ID NO: 1589231 - RNA, 22 nt, Pseudomonas putida KT2440
acagcacaaggcucaagcgcag

SEQ ID NO: 1589232 - RNA, 19 nt, Pseudomonas putida KT2440
acagcuggauggucacgcc

SEQ ID NO: 1589233 - RNA, 19 nt, Pseudomonas putida KT2440
acaggaucuccucggccag

SEQ ID NO: 1589234 - RNA, 21 nt, Pseudomonas putida KT2440
acagcucaacccgccugacgc

SEQ ID NO: 1589235 - RNA, 19 nt, Pseudomonas putida KT2440
acagcucgacaacccgcgc

SEQ ID NO: 1589236 - RNA, 23 nt, Pseudomonas putida KT2440
acagcucccgcgcaugcugccag

SEQ ID NO: 1589237 - RNA, 16 nt, Pseudomonas putida KT2440
acagcucacuggccaa

SEQ ID NO: 1589238 - RNA, 13 nt, Pseudomonas putida KT2440
acagcucauccag

SEQ ID NO: 1589239 - RNA, 20 nt, Pseudomonas putida KT2440
acagcucauccaggcugcac

SEQ ID NO: 1589240 - RNA, 22 nt, Pseudomonas putida KT2440
acagcucauccaggcugcacug

SEQ ID NO: 1589241 - RNA, 17 nt, Pseudomonas putida KT2440
acagcucgauggccagg

SEQ ID NO: 1589242 - RNA, 18 nt, Pseudomonas putida KT2440
acagcucgauggccagga

SEQ ID NO: 1589243 - RNA, 18 nt, Pseudomonas putida KT2440
acagcgugcgcucaggcg

SEQ ID NO: 1589244 - RNA, 16 nt, Pseudomonas putida KT2440
acagccgcggcaccca

SEQ ID NO: 1589245 - RNA, 15 nt, Pseudomonas putida KT2440
acaggcccagcauga

SEQ ID NO: 1589246 - RNA, 18 nt, Pseudomonas putida KT2440
acaggcacaggcccagca

SEQ ID NO: 1589247 - RNA, 18 nt, Pseudomonas putida KT2440
acaggcaauacaaggcuc

SEQ ID NO: 1589248 - RNA, 15 nt, Pseudomonas putida KT2440
acaggcagcaugacc

SEQ ID NO: 1589249 - RNA, 20 nt, Pseudomonas putida KT2440
acaggcauaccgcaacaccu

SEQ ID NO: 1589250 - RNA, 13 nt, Pseudomonas putida KT2440
acaggccggcugc

SEQ ID NO: 1589251 - RNA, 12 nt, Pseudomonas putida KT2440
acaggcgcagca

SEQ ID NO: 1589252 - RNA, 22 nt, Pseudomonas putida KT2440
acaggcgcgugugcagguggau

SEQ ID NO: 1589253 - RNA, 18 nt, Pseudomonas putida KT2440
acaggcucuccucaucga

SEQ ID NO: 1589254 - RNA, 18 nt, Pseudomonas putida KT2440
acaggcuggccaccauga

SEQ ID NO: 1589255 - RNA, 12 nt, Pseudomonas putida KT2440
acagggaccgca

SEQ ID NO: 1589256 - RNA, 14 nt, Pseudomonas putida KT2440
acauggaucagcuc

SEQ ID NO: 1589257 - RNA, 15 nt, Pseudomonas putida KT2440
acaugccugcacugg

SEQ ID NO: 1589258 - RNA, 17 nt, Pseudomonas putida KT2440
acaugcggcaccgccag

SEQ ID NO: 1589259 - RNA, 23 nt, Pseudomonas putida KT2440
acaugcgccacacccgcuacacc

SEQ ID NO: 1589260 - RNA, 13 nt, Pseudomonas putida KT2440
acauccagcgccu

SEQ ID NO: 1589261 - RNA, 22 nt, Pseudomonas putida KT2440
acagguacauguuggucagcgc

SEQ ID NO: 1589262 - RNA, 19 nt, Pseudomonas putida KT2440
acagguaucgccgcccuug

SEQ ID NO: 1589263 - RNA, 18 nt, Pseudomonas putida KT2440
acagguuuagcgcuggcu

SEQ ID NO: 1589264 - RNA, 23 nt, Pseudomonas putida KT2440
acagguucuugcggugcaugcgc

SEQ ID NO: 1589265 - RNA, 21 nt, Pseudomonas putida KT2440
acaggugcgcgcgcgacagca

SEQ ID NO: 1589266 - RNA, 22 nt, Pseudomonas putida KT2440
acaggugcggcagcucgccgug

SEQ ID NO: 1589267 - RNA, 21 nt, Pseudomonas putida KT2440
acaucacugcuguaaucggcg

SEQ ID NO: 1589268 - RNA, 12 nt, Pseudomonas putida KT2440
acccggcuggac

SEQ ID NO: 1589269 - RNA, 23 nt, Pseudomonas putida KT2440
acccgcucggccuugucuggcac

SEQ ID NO: 1589270 - RNA, 19 nt, Pseudomonas putida KT2440
acccgcuggccggacgacg

SEQ ID NO: 1589271 - RNA, 17 nt, Pseudomonas putida KT2440
acccgcuggcgaucagg

SEQ ID NO: 1589272 - RNA, 19 nt, Pseudomonas putida KT2440
acccgcuggcgaucaggca

SEQ ID NO: 1589273 - RNA, 17 nt, Pseudomonas putida KT2440
acccgggcagcgggcuc

SEQ ID NO: 1589274 - RNA, 20 nt, Pseudomonas putida KT2440
acccggucgccgacggcaug

SEQ ID NO: 1589275 - RNA, 15 nt, Pseudomonas putida KT2440
acccgggucaggcgc

SEQ ID NO: 1589276 - RNA, 19 nt, Pseudomonas putida KT2440
acccgguaaaaccgcucga

SEQ ID NO: 1589277 - RNA, 21 nt, Pseudomonas putida KT2440
acccuggcgguugaccagggc

SEQ ID NO: 1589278 - RNA, 14 nt, Pseudomonas putida KT2440
acccucgaccucga

SEQ ID NO: 1589279 - RNA, 14 nt, Pseudomonas putida KT2440
acccuguacccgcu

SEQ ID NO: 1589280 - RNA, 20 nt, Pseudomonas putida KT2440
acccuguacccgcuggcuga

SEQ ID NO: 1589281 - RNA, 19 nt, Pseudomonas putida KT2440
acccuuccccccuggccug

SEQ ID NO: 1589282 - RNA, 13 nt, Pseudomonas putida KT2440
acccuucaucgcc

SEQ ID NO: 1589283 - RNA, 16 nt, Pseudomonas putida KT2440
acccuucggccagcag

SEQ ID NO: 1589284 - RNA, 13 nt, Pseudomonas putida KT2440
accgaacccgcug

SEQ ID NO: 1589285 - RNA, 12 nt, Pseudomonas putida KT2440
accgaaccggcg

SEQ ID NO: 1589286 - RNA, 21 nt, Pseudomonas putida KT2440
acccgcaggcgacgagccagu

SEQ ID NO: 1589287 - RNA, 15 nt, Pseudomonas putida KT2440
acccgcaagcgccga

SEQ ID NO: 1589288 - RNA, 20 nt, Pseudomonas putida KT2440
acccgcuccuacgggcaacc

SEQ ID NO: 1589289 - RNA, 12 nt, Pseudomonas putida KT2440
acccgcuccugc

SEQ ID NO: 1589290 - RNA, 13 nt, Pseudomonas putida KT2440
acccgcgcugccu

SEQ ID NO: 1589291 - RNA, 20 nt, Pseudomonas putida KT2440
acccgcgccuacagcggccu

SEQ ID NO: 1589292 - RNA, 18 nt, Pseudomonas putida KT2440
acccgcgccuacaggcaa

SEQ ID NO: 1589293 - RNA, 20 nt, Pseudomonas putida KT2440
acccgcgccuacaggcaacc

SEQ ID NO: 1589294 - RNA, 14 nt, Pseudomonas putida KT2440
acccgcgccuacga

SEQ ID NO: 1589295 - RNA, 22 nt, Pseudomonas putida KT2440
acccgcgccuacgacgauugcg

SEQ ID NO: 1589296 - RNA, 12 nt, Pseudomonas putida KT2440
acccgcgccagg

SEQ ID NO: 1589297 - RNA, 14 nt, Pseudomonas putida KT2440
acccgcgccagggu

SEQ ID NO: 1589298 - RNA, 20 nt, Pseudomonas putida KT2440
acccgcgaccacaggcgcuu

SEQ ID NO: 1589299 - RNA, 22 nt, Pseudomonas putida KT2440
acccacaggcacaggcccagca

SEQ ID NO: 1589300 - RNA, 14 nt, Pseudomonas putida KT2440
acccacacccgcgc

SEQ ID NO: 1589301 - RNA, 20 nt, Pseudomonas putida KT2440
acccaauagcccaccgucag

SEQ ID NO: 1589302 - RNA, 15 nt, Pseudomonas putida KT2440
acccaacuccagcgc

SEQ ID NO: 1589303 - RNA, 15 nt, Pseudomonas putida KT2440
acccaccgcagguca

SEQ ID NO: 1589304 - RNA, 15 nt, Pseudomonas putida KT2440
acccaccacggccug

SEQ ID NO: 1589305 - RNA, 15 nt, Pseudomonas putida KT2440
acccaccagcacugc

SEQ ID NO: 1589306 - RNA, 15 nt, Pseudomonas putida KT2440
acccaccagcagugc

SEQ ID NO: 1589307 - RNA, 17 nt, Pseudomonas putida KT2440
acccaccagcagugccc

SEQ ID NO: 1589308 - RNA, 16 nt, Pseudomonas putida KT2440
acccgauuacaagggc

SEQ ID NO: 1589309 - RNA, 16 nt, Pseudomonas putida KT2440
accgaugccgccguug

SEQ ID NO: 1589310 - RNA, 18 nt, Pseudomonas putida KT2440
accgauagcgugaagcgg

SEQ ID NO: 1589311 - RNA, 21 nt, Pseudomonas putida KT2440
accgaggcgaauggcagguga

SEQ ID NO: 1589312 - RNA, 16 nt, Pseudomonas putida KT2440
accgagguaccaccgg

SEQ ID NO: 1589313 - RNA, 19 nt, Pseudomonas putida KT2440
accgaacuuguaaggcucg

SEQ ID NO: 1589314 - RNA, 16 nt, Pseudomonas putida KT2440
acccuugcagcgccug

SEQ ID NO: 1589315 - RNA, 20 nt, Pseudomonas putida KT2440
accgaaggccgccggcaacu

SEQ ID NO: 1589316 - RNA, 16 nt, Pseudomonas putida KT2440
accgagacgaucacca

SEQ ID NO: 1589317 - RNA, 22 nt, Pseudomonas putida KT2440
accgagacgaucaccagguugc

SEQ ID NO: 1589318 - RNA, 18 nt, Pseudomonas putida KT2440
accgagccuuccgggcac

SEQ ID NO: 1589319 - RNA, 20 nt, Pseudomonas putida KT2440
accgccaccaugcucaccgc

SEQ ID NO: 1589320 - RNA, 14 nt, Pseudomonas putida KT2440
accgccaaggcacg

SEQ ID NO: 1589321 - RNA, 16 nt, Pseudomonas putida KT2440
accgcaccggccaccg

SEQ ID NO: 1589322 - RNA, 22 nt, Pseudomonas putida KT2440
accgcaacuggcccgcgccagg

SEQ ID NO: 1589323 - RNA, 20 nt, Pseudomonas putida KT2440
accgcaagcggcucucgaag

SEQ ID NO: 1589324 - RNA, 15 nt, Pseudomonas putida KT2440
accgcaagcugcacc

SEQ ID NO: 1589325 - RNA, 16 nt, Pseudomonas putida KT2440
accgcaagcugcaccg

SEQ ID NO: 1589326 - RNA, 23 nt, Pseudomonas putida KT2440
accgcaacaccugccgcagcugg

SEQ ID NO: 1589327 - RNA, 23 nt, Pseudomonas putida KT2440
accgcaacaguuuucaaugcugc

SEQ ID NO: 1589328 - RNA, 21 nt, Pseudomonas putida KT2440
accgcccagguuauacgccgc

SEQ ID NO: 1589329 - RNA, 19 nt, Pseudomonas putida KT2440
accgccccagcgcgccagc

SEQ ID NO: 1589330 - RNA, 20 nt, Pseudomonas putida KT2440
accgccccagcgcgccagca

SEQ ID NO: 1589331 - RNA, 21 nt, Pseudomonas putida KT2440
accgcccagcgucgucugcgu

SEQ ID NO: 1589332 - RNA, 17 nt, Pseudomonas putida KT2440
accgccauggccagguc

SEQ ID NO: 1589333 - RNA, 14 nt, Pseudomonas putida KT2440
accgccgccuggcu

SEQ ID NO: 1589334 - RNA, 13 nt, Pseudomonas putida KT2440
accgccgcccacg

SEQ ID NO: 1589335 - RNA, 19 nt, Pseudomonas putida KT2440
accgccgcccacgccggca

SEQ ID NO: 1589336 - RNA, 21 nt, Pseudomonas putida KT2440
accgccgcccaggucaugauc

SEQ ID NO: 1589337 - RNA, 19 nt, Pseudomonas putida KT2440
accgccggcucgucacugc

SEQ ID NO: 1589338 - RNA, 15 nt, Pseudomonas putida KT2440
accgccgcgaugaug

SEQ ID NO: 1589339 - RNA, 19 nt, Pseudomonas putida KT2440
accgcggaaugaaccgcga

SEQ ID NO: 1589340 - RNA, 17 nt, Pseudomonas putida KT2440
accgcggcugacgaagc

SEQ ID NO: 1589341 - RNA, 17 nt, Pseudomonas putida KT2440
accgcguaaccagucga

SEQ ID NO: 1589342 - RNA, 20 nt, Pseudomonas putida KT2440
accgcguacagcugcucacc

SEQ ID NO: 1589343 - RNA, 22 nt, Pseudomonas putida KT2440
accgcguccuggacccgcagca

SEQ ID NO: 1589344 - RNA, 19 nt, Pseudomonas putida KT2440
accgcgucgauacgcugcu

SEQ ID NO: 1589345 - RNA, 21 nt, Pseudomonas putida KT2440
accgcugggcacccugaucga

SEQ ID NO: 1589346 - RNA, 20 nt, Pseudomonas putida KT2440
accgcugguggcguggcugc

SEQ ID NO: 1589347 - RNA, 16 nt, Pseudomonas putida KT2440
accgcuguacaggugc

SEQ ID NO: 1589348 - RNA, 14 nt, Pseudomonas putida KT2440
accggccaccaggc

SEQ ID NO: 1589349 - RNA, 22 nt, Pseudomonas putida KT2440
accggcaugcccaguucgcgug

SEQ ID NO: 1589350 - RNA, 22 nt, Pseudomonas putida KT2440
accggcauagcgcaagggggca

SEQ ID NO: 1589351 - RNA, 22 nt, Pseudomonas putida KT2440
accggcaguacauagaacagca

SEQ ID NO: 1589352 - RNA, 14 nt, Pseudomonas putida KT2440
accggcagcaccgg

SEQ ID NO: 1589353 - RNA, 22 nt, Pseudomonas putida KT2440
accggcguguugccgcugugcu

SEQ ID NO: 1589354 - RNA, 23 nt, Pseudomonas putida KT2440
accggcguguugccgcugugcuu

SEQ ID NO: 1589355 - RNA, 23 nt, Pseudomonas putida KT2440
accggcuucuaccacuggggcuu

SEQ ID NO: 1589356 - RNA, 16 nt, Pseudomonas putida KT2440
accggcuugcgcccgu

SEQ ID NO: 1589357 - RNA, 19 nt, Pseudomonas putida KT2440
accggcuuguagccggcag

SEQ ID NO: 1589358 - RNA, 14 nt, Pseudomonas putida KT2440
accggccgcucacc

SEQ ID NO: 1589359 - RNA, 23 nt, Pseudomonas putida KT2440
accggccgccaggauggcaccga

SEQ ID NO: 1589360 - RNA, 15 nt, Pseudomonas putida KT2440
accgucggcacgagc

SEQ ID NO: 1589361 - RNA, 13 nt, Pseudomonas putida KT2440
accgucgcuggac

SEQ ID NO: 1589362 - RNA, 20 nt, Pseudomonas putida KT2440
accgucuggacugggaaacc

SEQ ID NO: 1589363 - RNA, 14 nt, Pseudomonas putida KT2440
accgucguaggagc

SEQ ID NO: 1589364 - RNA, 22 nt, Pseudomonas putida KT2440
accgugaucacgggcaggcccc

SEQ ID NO: 1589365 - RNA, 23 nt, Pseudomonas putida KT2440
accgugagcauggcaaacagcac

SEQ ID NO: 1589366 - RNA, 17 nt, Pseudomonas putida KT2440
accgugcacgucgauga

SEQ ID NO: 1589367 - RNA, 23 nt, Pseudomonas putida KT2440
accguguauccauacuuggccga

SEQ ID NO: 1589368 - RNA, 17 nt, Pseudomonas putida KT2440
accguguaccccaucug

SEQ ID NO: 1589369 - RNA, 18 nt, Pseudomonas putida KT2440
accguucuugauccagcu

SEQ ID NO: 1589370 - RNA, 21 nt, Pseudomonas putida KT2440
accgguucgcccccacgggca

SEQ ID NO: 1589371 - RNA, 18 nt, Pseudomonas putida KT2440
accguaaggaaaaucagc

SEQ ID NO: 1589372 - RNA, 14 nt, Pseudomonas putida KT2440
accguacaaggcac

SEQ ID NO: 1589373 - RNA, 18 nt, Pseudomonas putida KT2440
accgguuuucuguugccu

SEQ ID NO: 1589374 - RNA, 18 nt, Pseudomonas putida KT2440
accgucaggcucagcagg

SEQ ID NO: 1589375 - RNA, 14 nt, Pseudomonas putida KT2440
accguccagguagc

SEQ ID NO: 1589376 - RNA, 15 nt, Pseudomonas putida KT2440
accguagcggucaug

SEQ ID NO: 1589377 - RNA, 21 nt, Pseudomonas putida KT2440
accgggcagaccugcuggcac

SEQ ID NO: 1589378 - RNA, 15 nt, Pseudomonas putida KT2440
accgggaacaggugc

SEQ ID NO: 1589379 - RNA, 23 nt, Pseudomonas putida KT2440
acuuuagcuuauucgaugcaggc

SEQ ID NO: 1589380 - RNA, 16 nt, Pseudomonas putida KT2440
agaaaagcaucaacuc

SEQ ID NO: 1589381 - RNA, 21 nt, Pseudomonas putida KT2440
acuugacguccagcucaacgc

SEQ ID NO: 1589382 - RNA, 20 nt, Pseudomonas putida KT2440
acuugccugucauggcaguc

SEQ ID NO: 1589383 - RNA, 13 nt, Pseudomonas putida KT2440
acuugcuggguac

SEQ ID NO: 1589384 - RNA, 21 nt, Pseudomonas putida KT2440
acuuggcgccgcccuggaugc

SEQ ID NO: 1589385 - RNA, 18 nt, Pseudomonas putida KT2440
acuugugugaacggcgcc

SEQ ID NO: 1589386 - RNA, 16 nt, Pseudomonas putida KT2440
acuuccggcugcagca

SEQ ID NO: 1589387 - RNA, 16 nt, Pseudomonas putida KT2440
acuucgaagugccacg

SEQ ID NO: 1589388 - RNA, 13 nt, Pseudomonas putida KT2440
acuuccuggccgc

SEQ ID NO: 1589389 - RNA, 15 nt, Pseudomonas putida KT2440
acuuccagcuugccg

SEQ ID NO: 1589390 - RNA, 17 nt, Pseudomonas putida KT2440
acuuccagcaucgcccc

SEQ ID NO: 1589391 - RNA, 22 nt, Pseudomonas putida KT2440
acuuccagcgacaacggaacga

SEQ ID NO: 1589392 - RNA, 23 nt, Pseudomonas putida KT2440
acuguggucauccaggcuggcca

SEQ ID NO: 1589393 - RNA, 14 nt, Pseudomonas putida KT2440
acugugccuggggc

SEQ ID NO: 1589394 - RNA, 17 nt, Pseudomonas putida KT2440
acugugcuggggccagc

SEQ ID NO: 1589395 - RNA, 13 nt, Pseudomonas putida KT2440
acuucaauggcac

SEQ ID NO: 1589396 - RNA, 14 nt, Pseudomonas putida KT2440
acuuauccgcuggc

SEQ ID NO: 1589397 - RNA, 21 nt, Pseudomonas putida KT2440
acuguuugagccggcgcuggg

SEQ ID NO: 1589398 - RNA, 15 nt, Pseudomonas putida KT2440
acucacuuucagcgc

SEQ ID NO: 1589399 - RNA, 13 nt, Pseudomonas putida KT2440
acucacgcauggc

SEQ ID NO: 1589400 - RNA, 15 nt, Pseudomonas putida KT2440
acucaguuaaucagc

SEQ ID NO: 1589401 - RNA, 19 nt, Pseudomonas putida KT2440
acucaggcugagcagacca

SEQ ID NO: 1589402 - RNA, 16 nt, Pseudomonas putida KT2440
acucaggggcauugcg

SEQ ID NO: 1589403 - RNA, 14 nt, Pseudomonas putida KT2440
acucaccacaucgg

SEQ ID NO: 1589404 - RNA, 18 nt, Pseudomonas putida KT2440
acucggcgcgugccgcau

SEQ ID NO: 1589405 - RNA, 16 nt, Pseudomonas putida KT2440
acucggcguagcaggu

SEQ ID NO: 1589406 - RNA, 19 nt, Pseudomonas putida KT2440
acucggcguagcagguacg

SEQ ID NO: 1589407 - RNA, 20 nt, Pseudomonas putida KT2440
acucugucacccgcugcacg

SEQ ID NO: 1589408 - RNA, 21 nt, Pseudomonas putida KT2440
acucugucacccgcugcacgu

SEQ ID NO: 1589409 - RNA, 15 nt, Pseudomonas putida KT2440
acugaauuggccggc

SEQ ID NO: 1589410 - RNA, 12 nt, Pseudomonas putida KT2440
acugaggcaccg

SEQ ID NO: 1589411 - RNA, 13 nt, Pseudomonas putida KT2440
acucguucagugc

SEQ ID NO: 1589412 - RNA, 16 nt, Pseudomonas putida KT2440
acucuccuugcguugc

SEQ ID NO: 1589413 - RNA, 16 nt, Pseudomonas putida KT2440
acuggcccgcgccagg

SEQ ID NO: 1589414 - RNA, 13 nt, Pseudomonas putida KT2440
acuggcgacagcc

SEQ ID NO: 1589415 - RNA, 18 nt, Pseudomonas putida KT2440
acuggcuacagaucagcc

SEQ ID NO: 1589416 - RNA, 18 nt, Pseudomonas putida KT2440
acuggcgcugaucaucga

SEQ ID NO: 1589417 - RNA, 17 nt, Pseudomonas putida KT2440
acuggcucaugcgccag

SEQ ID NO: 1589418 - RNA, 17 nt, Pseudomonas putida KT2440
acuggcugaccaguguc

SEQ ID NO: 1589419 - RNA, 17 nt, Pseudomonas putida KT2440
acugggcgauggcgucg

SEQ ID NO: 1589420 - RNA, 11 nt, Pseudomonas putida KT2440
acuggcugccg

SEQ ID NO: 1589421 - RNA, 14 nt, Pseudomonas putida KT2440
acuggcugcugcgg

SEQ ID NO: 1589422 - RNA, 21 nt, Pseudomonas putida KT2440
acuggcugauagccgccagca

SEQ ID NO: 1589423 - RNA, 15 nt, Pseudomonas putida KT2440
acuggucgccucgac

SEQ ID NO: 1589424 - RNA, 22 nt, Pseudomonas putida KT2440
acugguaacucaccacaucggc

SEQ ID NO: 1589425 - RNA, 20 nt, Pseudomonas putida KT2440
acugcacgcuucgauccgcg

SEQ ID NO: 1589426 - RNA, 15 nt, Pseudomonas putida KT2440
acugcaagcgaugca

SEQ ID NO: 1589427 - RNA, 17 nt, Pseudomonas putida KT2440
acugcacccgugcaggg

SEQ ID NO: 1589428 - RNA, 15 nt, Pseudomonas putida KT2440
acugcaggagcgggc

SEQ ID NO: 1589429 - RNA, 15 nt, Pseudomonas putida KT2440
acugcagagccugca

SEQ ID NO: 1589430 - RNA, 14 nt, Pseudomonas putida KT2440
acugcagaucacca

SEQ ID NO: 1589431 - RNA, 22 nt, Pseudomonas putida KT2440
acugcagggacugucggcucaa

SEQ ID NO: 1589432 - RNA, 14 nt, Pseudomonas putida KT2440
acugcaggugcagg

SEQ ID NO: 1589433 - RNA, 13 nt, Pseudomonas putida KT2440
acugcgccggcca

SEQ ID NO: 1589434 - RNA, 14 nt, Pseudomonas putida KT2440
acugcauuggccac

SEQ ID NO: 1589435 - RNA, 15 nt, Pseudomonas putida KT2440
acuggcacaacccga

SEQ ID NO: 1589436 - RNA, 22 nt, Pseudomonas putida KT2440
acuggcaggcucagggcagcaa

SEQ ID NO: 1589437 - RNA, 15 nt, Pseudomonas putida KT2440
acuggcaucggucac

SEQ ID NO: 1589438 - RNA, 16 nt, Pseudomonas putida KT2440
acgucgcgcagggccu

SEQ ID NO: 1589439 - RNA, 14 nt, Pseudomonas putida KT2440
acgucgcgcuggcc

SEQ ID NO: 1589440 - RNA, 13 nt, Pseudomonas putida KT2440
acgucgcgauuga

SEQ ID NO: 1589441 - RNA, 17 nt, Pseudomonas putida KT2440
acgucgcgauugaucag

SEQ ID NO: 1589442 - RNA, 19 nt, Pseudomonas putida KT2440
acgucgcgauugaucagcg

SEQ ID NO: 1589443 - RNA, 20 nt, Pseudomonas putida KT2440
acgucgcgauugaucagcgc

SEQ ID NO: 1589444 - RNA, 19 nt, Pseudomonas putida KT2440
acgucucgaacggcgccag

SEQ ID NO: 1589445 - RNA, 14 nt, Pseudomonas putida KT2440
acguacagcagcuc

SEQ ID NO: 1589446 - RNA, 15 nt, Pseudomonas putida KT2440
acguacagcagcuca

SEQ ID NO: 1589447 - RNA, 18 nt, Pseudomonas putida KT2440
acguagaacaggccugcg

SEQ ID NO: 1589448 - RNA, 16 nt, Pseudomonas putida KT2440
acgucacaugcgccac

SEQ ID NO: 1589449 - RNA, 19 nt, Pseudomonas putida KT2440
acguugcgcuugagcaggu

SEQ ID NO: 1589450 - RNA, 17 nt, Pseudomonas putida KT2440
acuaccgcaaaugcugc

SEQ ID NO: 1589451 - RNA, 16 nt, Pseudomonas putida KT2440
acuaccaacaccggcg

SEQ ID NO: 1589452 - RNA, 17 nt, Pseudomonas putida KT2440
acuaccaacaccggcga

SEQ ID NO: 1589453 - RNA, 21 nt, Pseudomonas putida KT2440
acgugcaaggaucaccaaggc

SEQ ID NO: 1589454 - RNA, 14 nt, Pseudomonas putida KT2440
acgugcaccggccu

SEQ ID NO: 1589455 - RNA, 22 nt, Pseudomonas putida KT2440
acgugcagcuugaggucgccag

SEQ ID NO: 1589456 - RNA, 13 nt, Pseudomonas putida KT2440
acguuauccagcu

SEQ ID NO: 1589457 - RNA, 16 nt, Pseudomonas putida KT2440
acgugguacgcguggu

SEQ ID NO: 1589458 - RNA, 16 nt, Pseudomonas putida KT2440
acggcgguucugcgca

SEQ ID NO: 1589459 - RNA, 17 nt, Pseudomonas putida KT2440
acggcgguucugcgcac

SEQ ID NO: 1589460 - RNA, 21 nt, Pseudomonas putida KT2440
acggcaauucgccggcagcaa

SEQ ID NO: 1589461 - RNA, 15 nt, Pseudomonas putida KT2440
acggcaacgccagca

SEQ ID NO: 1589462 - RNA, 12 nt, Pseudomonas putida KT2440
acggcuaccccg

SEQ ID NO: 1589463 - RNA, 18 nt, Pseudomonas putida KT2440
acggcuaccccgaugcgc

SEQ ID NO: 1589464 - RNA, 22 nt, Pseudomonas putida KT2440
acggcuaaagccgcaccuacag

SEQ ID NO: 1589465 - RNA, 16 nt, Pseudomonas putida KT2440
acggcugaacuuccag

SEQ ID NO: 1589466 - RNA, 20 nt, Pseudomonas putida KT2440
acggcugccgacaggccgug

SEQ ID NO: 1589467 - RNA, 16 nt, Pseudomonas putida KT2440
acggcuguuccucgcc

SEQ ID NO: 1589468 - RNA, 13 nt, Pseudomonas putida KT2440
acggcuggcgcau

SEQ ID NO: 1589469 - RNA, 17 nt, Pseudomonas putida KT2440
acgggcacaccuggugc

SEQ ID NO: 1589470 - RNA, 17 nt, Pseudomonas putida KT2440
acgggcaaacaggcuga

SEQ ID NO: 1589471 - RNA, 16 nt, Pseudomonas putida KT2440
acgggcaaccgcaucc

SEQ ID NO: 1589472 - RNA, 14 nt, Pseudomonas putida KT2440
acgggcaaggcugg

SEQ ID NO: 1589473 - RNA, 17 nt, Pseudomonas putida KT2440
acgggcaaggcuggcaa

SEQ ID NO: 1589474 - RNA, 20 nt, Pseudomonas putida KT2440
acggugccaauaaccggcac

SEQ ID NO: 1589475 - RNA, 15 nt, Pseudomonas putida KT2440
acggugcgcgccagc

SEQ ID NO: 1589476 - RNA, 16 nt, Pseudomonas putida KT2440
acggugcgcgccagcg

SEQ ID NO: 1589477 - RNA, 16 nt, Pseudomonas putida KT2440
acggugcgccugaaca

SEQ ID NO: 1589478 - RNA, 11 nt, Pseudomonas putida KT2440
acggucgauga

SEQ ID NO: 1589479 - RNA, 13 nt, Pseudomonas putida KT2440
acggggcgacgca

SEQ ID NO: 1589480 - RNA, 17 nt, Pseudomonas putida KT2440
acggucaguaccuggcc

SEQ ID NO: 1589481 - RNA, 11 nt, Pseudomonas putida KT2440
acggucagcgg

SEQ ID NO: 1589482 - RNA, 16 nt, Pseudomonas putida KT2440
acggucagcggcaguu

SEQ ID NO: 1589483 - RNA, 13 nt, Pseudomonas putida KT2440
acgguucgggaag

SEQ ID NO: 1589484 - RNA, 13 nt, Pseudomonas putida KT2440
acgguguggccag

SEQ ID NO: 1589485 - RNA, 14 nt, Pseudomonas putida KT2440
acgguguggccagu

SEQ ID NO: 1589486 - RNA, 21 nt, Pseudomonas putida KT2440
acgguggcugccacgggcaua

SEQ ID NO: 1589487 - RNA, 15 nt, Pseudomonas putida KT2440
acgguggcggcagca

SEQ ID NO: 1589488 - RNA, 20 nt, Pseudomonas putida KT2440
acggugcugccgaggcgccg

SEQ ID NO: 1589489 - RNA, 14 nt, Pseudomonas putida KT2440
acgacggaagccga

SEQ ID NO: 1589490 - RNA, 22 nt, Pseudomonas putida KT2440
acgacgggcugagcccaaccuc

SEQ ID NO: 1589491 - RNA, 19 nt, Pseudomonas putida KT2440
acgaaggucuugccgugcu

SEQ ID NO: 1589492 - RNA, 16 nt, Pseudomonas putida KT2440
acgaguuuaccuccau

SEQ ID NO: 1589493 - RNA, 15 nt, Pseudomonas putida KT2440
acgagagaucgcagc

SEQ ID NO: 1589494 - RNA, 15 nt, Pseudomonas putida KT2440
accguuggucagcga

SEQ ID NO: 1589495 - RNA, 19 nt, Pseudomonas putida KT2440
accguuggucgcgccgaca

SEQ ID NO: 1589496 - RNA, 12 nt, Pseudomonas putida KT2440
accuucggcaug

SEQ ID NO: 1589497 - RNA, 13 nt, Pseudomonas putida KT2440
accuucggggaug

SEQ ID NO: 1589498 - RNA, 21 nt, Pseudomonas putida KT2440
accugugaagccagggcaagc

SEQ ID NO: 1589499 - RNA, 13 nt, Pseudomonas putida KT2440
accuuccaugcgc

SEQ ID NO: 1589500 - RNA, 17 nt, Pseudomonas putida KT2440
accugucccagcuggca

SEQ ID NO: 1589501 - RNA, 19 nt, Pseudomonas putida KT2440
acgaacucaacgcaacugc

SEQ ID NO: 1589502 - RNA, 16 nt, Pseudomonas putida KT2440
acgaacuacgcgccag

SEQ ID NO: 1589503 - RNA, 14 nt, Pseudomonas putida KT2440
acgaacacguccag

SEQ ID NO: 1589504 - RNA, 13 nt, Pseudomonas putida KT2440
acgaacagcaaca

SEQ ID NO: 1589505 - RNA, 21 nt, Pseudomonas putida KT2440
accuugaugcgcgagcugggc

SEQ ID NO: 1589506 - RNA, 23 nt, Pseudomonas putida KT2440
accuuugagugcuucgcccagug

SEQ ID NO: 1589507 - RNA, 20 nt, Pseudomonas putida KT2440
acgaaacccaguacggcgcc

SEQ ID NO: 1589508 - RNA, 20 nt, Pseudomonas putida KT2440
acgcauggcguuguccagca

SEQ ID NO: 1589509 - RNA, 15 nt, Pseudomonas putida KT2440
acgcauuuucaucaa

SEQ ID NO: 1589510 - RNA, 15 nt, Pseudomonas putida KT2440
acgcagguacucgcc

SEQ ID NO: 1589511 - RNA, 19 nt, Pseudomonas putida KT2440
acgcagggccucgaugcgg

SEQ ID NO: 1589512 - RNA, 14 nt, Pseudomonas putida KT2440
acgcaucugcaccg

SEQ ID NO: 1589513 - RNA, 21 nt, Pseudomonas putida KT2440
acgcaucugcacuuucacccc

SEQ ID NO: 1589514 - RNA, 17 nt, Pseudomonas putida KT2440
acgcaugcgcgacagca

SEQ ID NO: 1589515 - RNA, 22 nt, Pseudomonas putida KT2440
acgcaggcgcgacaugaucagc

SEQ ID NO: 1589516 - RNA, 12 nt, Pseudomonas putida KT2440
acgcaggcgcag

SEQ ID NO: 1589517 - RNA, 16 nt, Pseudomonas putida KT2440
acgcaggcgcaggugc

SEQ ID NO: 1589518 - RNA, 14 nt, Pseudomonas putida KT2440
acgcaggcccagca

SEQ ID NO: 1589519 - RNA, 13 nt, Pseudomonas putida KT2440
acgcaggcaccgc

SEQ ID NO: 1589520 - RNA, 17 nt, Pseudomonas putida KT2440
acgccaucaggcagcuc

SEQ ID NO: 1589521 - RNA, 23 nt, Pseudomonas putida KT2440
acgcccgucaccuugccaucgac

SEQ ID NO: 1589522 - RNA, 14 nt, Pseudomonas putida KT2440
acgcccauccaacg

SEQ ID NO: 1589523 - RNA, 15 nt, Pseudomonas putida KT2440
acgccccaggccgcg

SEQ ID NO: 1589524 - RNA, 15 nt, Pseudomonas putida KT2440
acgauagcgucagca

SEQ ID NO: 1589525 - RNA, 19 nt, Pseudomonas putida KT2440
acgcaagcgcgccgccaca

SEQ ID NO: 1589526 - RNA, 15 nt, Pseudomonas putida KT2440
acgcaagaaggcugc

SEQ ID NO: 1589527 - RNA, 15 nt, Pseudomonas putida KT2440
acgcugccuugccca

SEQ ID NO: 1589528 - RNA, 19 nt, Pseudomonas putida KT2440
acgcugccuugcccagcuc

SEQ ID NO: 1589529 - RNA, 23 nt, Pseudomonas putida KT2440
acgcugcgacucgcggccgguca

SEQ ID NO: 1589530 - RNA, 22 nt, Pseudomonas putida KT2440
acgcugcgcggguucugguugc

SEQ ID NO: 1589531 - RNA, 19 nt, Pseudomonas putida KT2440
acgcucuguaucgaacagg

SEQ ID NO: 1589532 - RNA, 23 nt, Pseudomonas putida KT2440
acgcucguccaggcccugcagcg

SEQ ID NO: 1589533 - RNA, 23 nt, Pseudomonas putida KT2440
acgcucguuguccagcagcagcg

SEQ ID NO: 1589534 - RNA, 20 nt, Pseudomonas putida KT2440
acgcugagcgaugcgcuggc

SEQ ID NO: 1589535 - RNA, 22 nt, Pseudomonas putida KT2440
acgcugagcgaugcgcuggcac

SEQ ID NO: 1589536 - RNA, 23 nt, Pseudomonas putida KT2440
acgcugagcgaugcgcuggcaca

SEQ ID NO: 1589537 - RNA, 19 nt, Pseudomonas putida KT2440
acggaaucugcaccgccuu

SEQ ID NO: 1589538 - RNA, 15 nt, Pseudomonas putida KT2440
acggacgucccagca

SEQ ID NO: 1589539 - RNA, 15 nt, Pseudomonas putida KT2440
acggacgucgcgcug

SEQ ID NO: 1589540 - RNA, 22 nt, Pseudomonas putida KT2440
acgcucaugcugguuuggcagc

SEQ ID NO: 1589541 - RNA, 16 nt, Pseudomonas putida KT2440
acgcucggccaguacc

SEQ ID NO: 1589542 - RNA, 23 nt, Pseudomonas putida KT2440
acgcucgcgcaggaaccgcguca

SEQ ID NO: 1589543 - RNA, 15 nt, Pseudomonas putida KT2440
acgcucgacagcaac

SEQ ID NO: 1589544 - RNA, 14 nt, Pseudomonas putida KT2440
acgcucaugaacag

SEQ ID NO: 1589545 - RNA, 20 nt, Pseudomonas putida KT2440
acgcgugcaagggauaucag

SEQ ID NO: 1589546 - RNA, 21 nt, Pseudomonas putida KT2440
acgcguugauuuagcaggcac

SEQ ID NO: 1589547 - RNA, 23 nt, Pseudomonas putida KT2440
acgcguugauuuagcaggcaccc

SEQ ID NO: 1589548 - RNA, 19 nt, Pseudomonas putida KT2440
acgcgguggagggcaccgg

SEQ ID NO: 1589549 - RNA, 15 nt, Pseudomonas putida KT2440
acgccggcgccgugc

SEQ ID NO: 1589550 - RNA, 16 nt, Pseudomonas putida KT2440
acgccggucgggcacu

SEQ ID NO: 1589551 - RNA, 19 nt, Pseudomonas putida KT2440
acgcccuucauacagcgcc

SEQ ID NO: 1589552 - RNA, 23 nt, Pseudomonas putida KT2440
acgcccuucauacagcgccucca

SEQ ID NO: 1589553 - RNA, 22 nt, Pseudomonas putida KT2440
acgccugaagcacgucgcgauu

SEQ ID NO: 1589554 - RNA, 16 nt, Pseudomonas putida KT2440
acgccugcagggccug

SEQ ID NO: 1589555 - RNA, 15 nt, Pseudomonas putida KT2440
acgcgaaagcgaaga

SEQ ID NO: 1589556 - RNA, 17 nt, Pseudomonas putida KT2440
acgccguacggcccaug

SEQ ID NO: 1589557 - RNA, 21 nt, Pseudomonas putida KT2440
acgcgaaugaugaauaaugcu

SEQ ID NO: 1589558 - RNA, 14 nt, Pseudomonas putida KT2440
acgcgaaucgccag

SEQ ID NO: 1589559 - RNA, 14 nt, Pseudomonas putida KT2440
acgcggggcagcgc

SEQ ID NO: 1589560 - RNA, 21 nt, Pseudomonas putida KT2440
acgcgggcgcgacaaucaggc

SEQ ID NO: 1589561 - RNA, 22 nt, Pseudomonas putida KT2440
acgcgcuuggagaagcgaucga

SEQ ID NO: 1589562 - RNA, 16 nt, Pseudomonas putida KT2440
acgcgcuuuuccagca

SEQ ID NO: 1589563 - RNA, 22 nt, Pseudomonas putida KT2440
uguuugaccaccagacgggcau

SEQ ID NO: 1589564 - RNA, 12 nt, Pseudomonas putida KT2440
uguuugggcuug

SEQ ID NO: 1589565 - RNA, 15 nt, Pseudomonas putida KT2440
uuaaaacccaggcaa

SEQ ID NO: 1589566 - RNA, 21 nt, Pseudomonas putida KT2440
uguugggcagggugucgacga

SEQ ID NO: 1589567 - RNA, 19 nt, Pseudomonas putida KT2440
uguucccucaacaagcuga

SEQ ID NO: 1589568 - RNA, 22 nt, Pseudomonas putida KT2440
uguuccacgcgcaggcgcugca

SEQ ID NO: 1589569 - RNA, 19 nt, Pseudomonas putida KT2440
uguuggaugcuucgcgggu

SEQ ID NO: 1589570 - RNA, 22 nt, Pseudomonas putida KT2440
uguugcgguggaagcuggcuac

SEQ ID NO: 1589571 - RNA, 21 nt, Pseudomonas putida KT2440
uguugcgcagguacacgggca

SEQ ID NO: 1589572 - RNA, 13 nt, Pseudomonas putida KT2440
ugucggccagauc

SEQ ID NO: 1589573 - RNA, 23 nt, Pseudomonas putida KT2440
ugucggccagaucggccagcuug

SEQ ID NO: 1589574 - RNA, 21 nt, Pseudomonas putida KT2440
uguggugagcccugugggagc

SEQ ID NO: 1589575 - RNA, 21 nt, Pseudomonas putida KT2440
ugucgcugccgccaaccagcu

SEQ ID NO: 1589576 - RNA, 22 nt, Pseudomonas putida KT2440
ugucgcugccgccaaccagcuc

SEQ ID NO: 1589577 - RNA, 17 nt, Pseudomonas putida KT2440
ugucggcagccagggug

SEQ ID NO: 1589578 - RNA, 17 nt, Pseudomonas putida KT2440
ugucggaagccugcauc

SEQ ID NO: 1589579 - RNA, 14 nt, Pseudomonas putida KT2440
ugucgcuguugcgc

SEQ ID NO: 1589580 - RNA, 19 nt, Pseudomonas putida KT2440
uguucacggucaggccuga

SEQ ID NO: 1589581 - RNA, 16 nt, Pseudomonas putida KT2440
uguucagauacgccug

SEQ ID NO: 1589582 - RNA, 15 nt, Pseudomonas putida KT2440
uguucaccuugggcg

SEQ ID NO: 1589583 - RNA, 16 nt, Pseudomonas putida KT2440
uuauucgaugcaggca

SEQ ID NO: 1589584 - RNA, 17 nt, Pseudomonas putida KT2440
uucagcgcggcaaccug

SEQ ID NO: 1589585 - RNA, 19 nt, Pseudomonas putida KT2440
uucagcccuugcugcagca

SEQ ID NO: 1589586 - RNA, 16 nt, Pseudomonas putida KT2440
uucaccguugccgcca

SEQ ID NO: 1589587 - RNA, 21 nt, Pseudomonas putida KT2440
uucagccaggguuucggugac

SEQ ID NO: 1589588 - RNA, 11 nt, Pseudomonas putida KT2440
uucacccgcga

SEQ ID NO: 1589589 - RNA, 17 nt, Pseudomonas putida KT2440
uucacccucgcgcagca

SEQ ID NO: 1589590 - RNA, 19 nt, Pseudomonas putida KT2440
uucaccacgcccugcacca

SEQ ID NO: 1589591 - RNA, 16 nt, Pseudomonas putida KT2440
uucaaccuguuccggc

SEQ ID NO: 1589592 - RNA, 16 nt, Pseudomonas putida KT2440
uugaacgagccagcca

SEQ ID NO: 1589593 - RNA, 13 nt, Pseudomonas putida KT2440
uugaacagcagcg

SEQ ID NO: 1589594 - RNA, 23 nt, Pseudomonas putida KT2440
uugaagguauggccuuucugcuu

SEQ ID NO: 1589595 - RNA, 11 nt, Pseudomonas putida KT2440
uugaagcgccg

SEQ ID NO: 1589596 - RNA, 22 nt, Pseudomonas putida KT2440
uugaccgugaucaucagcgccg

SEQ ID NO: 1589597 - RNA, 22 nt, Pseudomonas putida KT2440
uugacgaucuucugcacgcccg

SEQ ID NO: 1589598 - RNA, 19 nt, Pseudomonas putida KT2440
uugaccggggcugcuuugc

SEQ ID NO: 1589599 - RNA, 17 nt, Pseudomonas putida KT2440
uugacggugaauuccuu

SEQ ID NO: 1589600 - RNA, 21 nt, Pseudomonas putida KT2440
uugagcaccgggcacuuggca

SEQ ID NO: 1589601 - RNA, 15 nt, Pseudomonas putida KT2440
aaucagcggcaggcu

SEQ ID NO: 1589602 - RNA, 17 nt, Pseudomonas putida KT2440
aaucagcggcaggcugg

SEQ ID NO: 1589603 - RNA, 19 nt, Pseudomonas putida KT2440
aaucagcucacaggcucag

SEQ ID NO: 1589604 - RNA, 24 nt, Pseudomonas putida KT2440
aaucagccuuugcccuugguccgg

SEQ ID NO: 1589605 - RNA, 22 nt, Pseudomonas putida KT2440
uucuucgguggcguugucagca

SEQ ID NO: 1589606 - RNA, 15 nt, Pseudomonas putida KT2440
uucuucgugcgccuc

SEQ ID NO: 1589607 - RNA, 16 nt, Pseudomonas putida KT2440
uucugcauguccagcc

SEQ ID NO: 1589608 - RNA, 20 nt, Pseudomonas putida KT2440
uucugcaacagcuccagcag

SEQ ID NO: 1589609 - RNA, 15 nt, Pseudomonas putida KT2440
uucuugucuccgaac

SEQ ID NO: 1589610 - RNA, 14 nt, Pseudomonas putida KT2440
uucuuugcaagccu

SEQ ID NO: 1589611 - RNA, 23 nt, Pseudomonas putida KT2440
uuccuacagaaacgagcaagccu

SEQ ID NO: 1589612 - RNA, 14 nt, Pseudomonas putida KT2440
uuccggcugcagca

SEQ ID NO: 1589613 - RNA, 20 nt, Pseudomonas putida KT2440
uuccgggcugcugcgcagcc

SEQ ID NO: 1589614 - RNA, 22 nt, Pseudomonas putida KT2440
uuccugaguuagacauuagaaa

SEQ ID NO: 1589615 - RNA, 19 nt, Pseudomonas putida KT2440
uuccugggcuucaugcugc

SEQ ID NO: 1589616 - RNA, 19 nt, Pseudomonas putida KT2440
uuccugggaagcugcagca

SEQ ID NO: 1589617 - RNA, 22 nt, Pseudomonas putida KT2440
uuccugggaagcugcagcagcu

SEQ ID NO: 1589618 - RNA, 20 nt, Pseudomonas putida KT2440
uuccuggccuuccuugccca

SEQ ID NO: 1589619 - RNA, 14 nt, Pseudomonas putida KT2440
uuccccggucagca

SEQ ID NO: 1589620 - RNA, 18 nt, Pseudomonas putida KT2440
uucaggugccguuccggc

SEQ ID NO: 1589621 - RNA, 19 nt, Pseudomonas putida KT2440
uucaguuggcguccagcag

SEQ ID NO: 1589622 - RNA, 20 nt, Pseudomonas putida KT2440
uucccagcaccccagcacca

SEQ ID NO: 1589623 - RNA, 18 nt, Pseudomonas putida KT2440
uucgcgaggaaacccgcg

SEQ ID NO: 1589624 - RNA, 22 nt, Pseudomonas putida KT2440
uucggccacgguguauccagcc

SEQ ID NO: 1589625 - RNA, 17 nt, Pseudomonas putida KT2440
uucgcuggccugcccca

SEQ ID NO: 1589626 - RNA, 13 nt, Pseudomonas putida KT2440
uucgcugcgugac

SEQ ID NO: 1589627 - RNA, 19 nt, Pseudomonas putida KT2440
uucgccggcacgcccgcuc

SEQ ID NO: 1589628 - RNA, 19 nt, Pseudomonas putida KT2440
uucgcaggcacgcccgcuc

SEQ ID NO: 1589629 - RNA, 17 nt, Pseudomonas putida KT2440
uucgaucucuucgguag

SEQ ID NO: 1589630 - RNA, 15 nt, Pseudomonas putida KT2440
uucgaugcccggcag

SEQ ID NO: 1589631 - RNA, 20 nt, Pseudomonas putida KT2440
uucgauccacuugucccggc

SEQ ID NO: 1589632 - RNA, 15 nt, Pseudomonas putida KT2440
uucgaucgccggcag

SEQ ID NO: 1589633 - RNA, 17 nt, Pseudomonas putida KT2440
uucgacucccgcugccu

SEQ ID NO: 1589634 - RNA, 23 nt, Pseudomonas putida KT2440
uucgacggucggcaguuugccga

SEQ ID NO: 1589635 - RNA, 19 nt, Pseudomonas putida KT2440
uucgacgcugcuguccaga

SEQ ID NO: 1589636 - RNA, 20 nt, Pseudomonas putida KT2440
uucgacgcugcugucgguca

SEQ ID NO: 1589637 - RNA, 19 nt, Pseudomonas putida KT2440
uuucagggucugucggugg

SEQ ID NO: 1589638 - RNA, 14 nt, Pseudomonas putida KT2440
uuucgaucucgcca

SEQ ID NO: 1589639 - RNA, 17 nt, Pseudomonas putida KT2440
uuucgaucaucgccacc

SEQ ID NO: 1589640 - RNA, 15 nt, Pseudomonas putida KT2440
uuuccaaaccugcga

SEQ ID NO: 1589641 - RNA, 12 nt, Pseudomonas putida KT2440
uuuccaccggca

SEQ ID NO: 1589642 - RNA, 13 nt, Pseudomonas putida KT2440
uuguugcaaccag

SEQ ID NO: 1589643 - RNA, 16 nt, Pseudomonas putida KT2440
uuguuuggcuuugccg

SEQ ID NO: 1589644 - RNA, 18 nt, Pseudomonas putida KT2440
uuguucggcaucggugcu

SEQ ID NO: 1589645 - RNA, 20 nt, Pseudomonas putida KT2440
uuguaccugugguggcugcu

SEQ ID NO: 1589646 - RNA, 18 nt, Pseudomonas putida KT2440
uugggcaagugcgugcaa

SEQ ID NO: 1589647 - RNA, 24 nt, Pseudomonas putida KT2440
uuggcguugagccgccaacccgug

SEQ ID NO: 1589648 - RNA, 23 nt, Pseudomonas putida KT2440
uuggcgugcggcgucgucaagga

SEQ ID NO: 1589649 - RNA, 18 nt, Pseudomonas putida KT2440
uuggcguccagcagugcc

SEQ ID NO: 1589650 - RNA, 18 nt, Pseudomonas putida KT2440
uuggcuucuucgcgggca

SEQ ID NO: 1589651 - RNA, 19 nt, Pseudomonas putida KT2440
uuggcuucuucgcgggcau

SEQ ID NO: 1589652 - RNA, 16 nt, Pseudomonas putida KT2440
uuggcuaucagccgug

SEQ ID NO: 1589653 - RNA, 13 nt, Pseudomonas putida KT2440
uuggcuuugccgg

SEQ ID NO: 1589654 - RNA, 12 nt, Pseudomonas putida KT2440
uugcuuggcagc

SEQ ID NO: 1589655 - RNA, 22 nt, Pseudomonas putida KT2440
uuggaggggcugcuuugcagcc

SEQ ID NO: 1589656 - RNA, 19 nt, Pseudomonas putida KT2440
uuggccaucaauaccggca

SEQ ID NO: 1589657 - RNA, 21 nt, Pseudomonas putida KT2440
uuggccggguuuacaccaccg

SEQ ID NO: 1589658 - RNA, 22 nt, Pseudomonas putida KT2440
uugauccagcugcugucgagca

SEQ ID NO: 1589659 - RNA, 16 nt, Pseudomonas putida KT2440
uugcgagcgcgggcag

SEQ ID NO: 1589660 - RNA, 20 nt, Pseudomonas putida KT2440
uugccugggccggugggcaa

SEQ ID NO: 1589661 - RNA, 16 nt, Pseudomonas putida KT2440
uugccugggcgagcca

SEQ ID NO: 1589662 - RNA, 17 nt, Pseudomonas putida KT2440
uugccuuccuugaacuc

SEQ ID NO: 1589663 - RNA, 21 nt, Pseudomonas putida KT2440
uugccuuccucggccaugcgc

SEQ ID NO: 1589664 - RNA, 16 nt, Pseudomonas putida KT2440
uugcggaucacuucca

SEQ ID NO: 1589665 - RNA, 15 nt, Pseudomonas putida KT2440
uugcgcgccagggca

SEQ ID NO: 1589666 - RNA, 13 nt, Pseudomonas putida KT2440
uugcgcggcaccg

SEQ ID NO: 1589667 - RNA, 14 nt, Pseudomonas putida KT2440
uugcgcacgcgcuc

SEQ ID NO: 1589668 - RNA, 17 nt, Pseudomonas putida KT2440
uugcgcagcaauccgcu

SEQ ID NO: 1589669 - RNA, 16 nt, Pseudomonas putida KT2440
uugcggguuucgucga

SEQ ID NO: 1589670 - RNA, 16 nt, Pseudomonas putida KT2440
uugcgggucagcucga

SEQ ID NO: 1589671 - RNA, 20 nt, Pseudomonas putida KT2440
uugcgugccucagccaggcu

SEQ ID NO: 1589672 - RNA, 12 nt, Pseudomonas putida KT2440
uugcugagccag

SEQ ID NO: 1589673 - RNA, 13 nt, Pseudomonas putida KT2440
uugcugcugccag

SEQ ID NO: 1589674 - RNA, 17 nt, Pseudomonas putida KT2440
uugcugguguggcgcca

SEQ ID NO: 1589675 - RNA, 22 nt, Pseudomonas putida KT2440
uugcuggcgacgcugcccagca

SEQ ID NO: 1589676 - RNA, 15 nt, Pseudomonas putida KT2440
uugcucuuguuccgc

SEQ ID NO: 1589677 - RNA, 24 nt, Pseudomonas putida KT2440
uugcugaaauccagccgcccgaac

SEQ ID NO: 1589678 - RNA, 18 nt, Pseudomonas putida KT2440
uugcucgcagacuucgaa

SEQ ID NO: 1589679 - RNA, 16 nt, Pseudomonas putida KT2440
uugcucggugcugcug

SEQ ID NO: 1589680 - RNA, 22 nt, Pseudomonas putida KT2440
uugcuccagcucacagcacucg

SEQ ID NO: 1589681 - RNA, 12 nt, Pseudomonas putida KT2440
uugcuaugggaa

SEQ ID NO: 1589682 - RNA, 14 nt, Pseudomonas putida KT2440
aauuggagcggccu

SEQ ID NO: 1589683 - RNA, 22 nt, Pseudomonas putida KT2440
aauucuggcuuagcgcgggccu

SEQ ID NO: 1589684 - RNA, 14 nt, Pseudomonas putida KT2440
aauuguucguaggu

SEQ ID NO: 1589685 - RNA, 18 nt, Pseudomonas putida KT2440
aauucauaaggaucauga

SEQ ID NO: 1589686 - RNA, 18 nt, Pseudomonas putida KT2440
aaugcugccaugcaaggc

SEQ ID NO: 1589687 - RNA, 21 nt, Pseudomonas putida KT2440
aaugcuccggcgacagcucaa

SEQ ID NO: 1589688 - RNA, 16 nt, Pseudomonas putida KT2440
aaucucccgggccaug

SEQ ID NO: 1589689 - RNA, 14 nt, Pseudomonas putida KT2440
aaucugcaccgccu

SEQ ID NO: 1589690 - RNA, 15 nt, Pseudomonas putida KT2440
aaucgccaggcccag

SEQ ID NO: 1589691 - RNA, 14 nt, Pseudomonas putida KT2440
aaucgccagggcuc

SEQ ID NO: 1589692 - RNA, 23 nt, Pseudomonas putida KT2440
aaucuucggcuuugaacagcucg

SEQ ID NO: 1589693 - RNA, 23 nt, Pseudomonas putida KT2440
aaucuucggugcccacugcagcc

SEQ ID NO: 1589694 - RNA, 20 nt, Pseudomonas putida KT2440
uuuucuuuacaacccagacu

SEQ ID NO: 1589695 - RNA, 14 nt, Pseudomonas putida KT2440
uuucguuugcgcua

SEQ ID NO: 1589696 - RNA, 17 nt, Pseudomonas putida KT2440
ugcuggcgacgcugccc

SEQ ID NO: 1589697 - RNA, 17 nt, Pseudomonas putida KT2440
ugcugguccucgacggg

SEQ ID NO: 1589698 - RNA, 16 nt, Pseudomonas putida KT2440
ugcuggucagugcacu

SEQ ID NO: 1589699 - RNA, 15 nt, Pseudomonas putida KT2440
ugcugggucagcacu

SEQ ID NO: 1589700 - RNA, 17 nt, Pseudomonas putida KT2440
ugcugggucagcgcuga

SEQ ID NO: 1589701 - RNA, 19 nt, Pseudomonas putida KT2440
ugcuggggccgcaaagcgg

SEQ ID NO: 1589702 - RNA, 13 nt, Pseudomonas putida KT2440
ugcugacgacgcg

SEQ ID NO: 1589703 - RNA, 14 nt, Pseudomonas putida KT2440
ugcugcaguucagg

SEQ ID NO: 1589704 - RNA, 17 nt, Pseudomonas putida KT2440
ugcugcauaugggcgaa

SEQ ID NO: 1589705 - RNA, 13 nt, Pseudomonas putida KT2440
ugcugcccgcgug

SEQ ID NO: 1589706 - RNA, 14 nt, Pseudomonas putida KT2440
ugcugccccaugcg

SEQ ID NO: 1589707 - RNA, 13 nt, Pseudomonas putida KT2440
ugcugcgaagagg

SEQ ID NO: 1589708 - RNA, 14 nt, Pseudomonas putida KT2440
ugcugccugugccg

SEQ ID NO: 1589709 - RNA, 20 nt, Pseudomonas putida KT2440
ugcuggcccuuucgcgggua

SEQ ID NO: 1589710 - RNA, 12 nt, Pseudomonas putida KT2440
ugcuggccaauc

SEQ ID NO: 1589711 - RNA, 18 nt, Pseudomonas putida KT2440
ugcucgggguuggugcca

SEQ ID NO: 1589712 - RNA, 17 nt, Pseudomonas putida KT2440
ugcucggcgaugccgcg

SEQ ID NO: 1589713 - RNA, 17 nt, Pseudomonas putida KT2440
ugcucacugaccaccug

SEQ ID NO: 1589714 - RNA, 17 nt, Pseudomonas putida KT2440
ugcucaccauguuccag

SEQ ID NO: 1589715 - RNA, 20 nt, Pseudomonas putida KT2440
ugcucuucgaguuuggccag

SEQ ID NO: 1589716 - RNA, 13 nt, Pseudomonas putida KT2440
ugcucuucaccug

SEQ ID NO: 1589717 - RNA, 21 nt, Pseudomonas putida KT2440
ugcugaaccugaccuugcugc

SEQ ID NO: 1589718 - RNA, 17 nt, Pseudomonas putida KT2440
ugcucguugcugagcaa

SEQ ID NO: 1589719 - RNA, 17 nt, Pseudomonas putida KT2440
ugcucgucucuggccgc

SEQ ID NO: 1589720 - RNA, 22 nt, Pseudomonas putida KT2440
ugcucgucguccucgaacucau

SEQ ID NO: 1589721 - RNA, 16 nt, Pseudomonas putida KT2440
ugcucguccaucaccg

SEQ ID NO: 1589722 - RNA, 18 nt, Pseudomonas putida KT2440
ugcucguccaucaccgcc

SEQ ID NO: 1589723 - RNA, 19 nt, Pseudomonas putida KT2440
ugcguggccuguaccgacc

SEQ ID NO: 1589724 - RNA, 15 nt, Pseudomonas putida KT2440
ugcguggcaccggcg

SEQ ID NO: 1589725 - RNA, 13 nt, Pseudomonas putida KT2440
ugcguggcauccu

SEQ ID NO: 1589726 - RNA, 19 nt, Pseudomonas putida KT2440
ugcguucuagaacucggcg

SEQ ID NO: 1589727 - RNA, 14 nt, Pseudomonas putida KT2440
ugcuaccggcgcca

SEQ ID NO: 1589728 - RNA, 20 nt, Pseudomonas putida KT2440
ugcuaccaaccuccagguca

SEQ ID NO: 1589729 - RNA, 13 nt, Pseudomonas putida KT2440
ugcgucagcaucc

SEQ ID NO: 1589730 - RNA, 22 nt, Pseudomonas putida KT2440
ugcgugccucagccaggcugag

SEQ ID NO: 1589731 - RNA, 19 nt, Pseudomonas putida KT2440
ugcgugccucgcccagguc

SEQ ID NO: 1589732 - RNA, 14 nt, Pseudomonas putida KT2440
ugcgugccugcugc

SEQ ID NO: 1589733 - RNA, 23 nt, Pseudomonas putida KT2440
ugcgugauuugaacuugcgcauc

SEQ ID NO: 1589734 - RNA, 16 nt, Pseudomonas putida KT2440
ugcgugcaacgccuug

SEQ ID NO: 1589735 - RNA, 14 nt, Pseudomonas putida KT2440
ugcgugauggcagc

SEQ ID NO: 1589736 - RNA, 18 nt, Pseudomonas putida KT2440
ugcggcgaaagccagcag

SEQ ID NO: 1589737 - RNA, 20 nt, Pseudomonas putida KT2440
ugcggcgaaagccagcagug

SEQ ID NO: 1589738 - RNA, 19 nt, Pseudomonas putida KT2440
ugcguaggagcgggucuac

SEQ ID NO: 1589739 - RNA, 20 nt, Pseudomonas putida KT2440
ugcggcgcgggcgcaggcaa

SEQ ID NO: 1589740 - RNA, 21 nt, Pseudomonas putida KT2440
ugcggcgccaucggcacgcca

SEQ ID NO: 1589741 - RNA, 13 nt, Pseudomonas putida KT2440
uggaauaccaccu

SEQ ID NO: 1589742 - RNA, 23 nt, Pseudomonas putida KT2440
uggacgccgcaccgucgaugucg

SEQ ID NO: 1589743 - RNA, 20 nt, Pseudomonas putida KT2440
ugcuguagcccaccagguca

SEQ ID NO: 1589744 - RNA, 17 nt, Pseudomonas putida KT2440
ugcugguucgauuccag

SEQ ID NO: 1589745 - RNA, 17 nt, Pseudomonas putida KT2440
uggaacgcuuggccaga

SEQ ID NO: 1589746 - RNA, 19 nt, Pseudomonas putida KT2440
uggaagucgcgagucaggc

SEQ ID NO: 1589747 - RNA, 22 nt, Pseudomonas putida KT2440
uggagagguacacccccagguu

SEQ ID NO: 1589748 - RNA, 23 nt, Pseudomonas putida KT2440
uggagcguuauaccggcccugau

SEQ ID NO: 1589749 - RNA, 22 nt, Pseudomonas putida KT2440
uggaggagggcugcaucacuug

SEQ ID NO: 1589750 - RNA, 20 nt, Pseudomonas putida KT2440
uggaggucaugugauaccug

SEQ ID NO: 1589751 - RNA, 21 nt, Pseudomonas putida KT2440
uggagauaccguagcggucau

SEQ ID NO: 1589752 - RNA, 20 nt, Pseudomonas putida KT2440
uggagaucgucguaggagcg

SEQ ID NO: 1589753 - RNA, 23 nt, Pseudomonas putida KT2440
uggacuucaucgcgggccaggug

SEQ ID NO: 1589754 - RNA, 23 nt, Pseudomonas putida KT2440
uggacugggaaaccuccggcauc

SEQ ID NO: 1589755 - RNA, 13 nt, Pseudomonas putida KT2440
uggacuaacaggu

SEQ ID NO: 1589756 - RNA, 17 nt, Pseudomonas putida KT2440
uggaugaucggcuggcc

SEQ ID NO: 1589757 - RNA, 20 nt, Pseudomonas putida KT2440
uggaugaucggcuggccauu

SEQ ID NO: 1589758 - RNA, 12 nt, Pseudomonas putida KT2440
uggaucggcgug

SEQ ID NO: 1589759 - RNA, 19 nt, Pseudomonas putida KT2440
uggaucccacgcccggcca

SEQ ID NO: 1589760 - RNA, 18 nt, Pseudomonas putida KT2440
uggauagaguacucggcu

SEQ ID NO: 1589761 - RNA, 22 nt, Pseudomonas putida KT2440
uggcaaagcugaauucgaagug

SEQ ID NO: 1589762 - RNA, 16 nt, Pseudomonas putida KT2440
uggcaccggcagcagc

SEQ ID NO: 1589763 - RNA, 15 nt, Pseudomonas putida KT2440
uggcacccacagcgc

SEQ ID NO: 1589764 - RNA, 19 nt, Pseudomonas putida KT2440
uggcacccacgcgcuugga

SEQ ID NO: 1589765 - RNA, 20 nt, Pseudomonas putida KT2440
uggcacccucaccaacugcc

SEQ ID NO: 1589766 - RNA, 22 nt, Pseudomonas putida KT2440
uggcacccucaccaacugccug

SEQ ID NO: 1589767 - RNA, 17 nt, Pseudomonas putida KT2440
uggcacccaucacgacg

SEQ ID NO: 1589768 - RNA, 17 nt, Pseudomonas putida KT2440
uggcaccccagccgcuc

SEQ ID NO: 1589769 - RNA, 21 nt, Pseudomonas putida KT2440
uggcaccagauucaagcccgg

SEQ ID NO: 1589770 - RNA, 17 nt, Pseudomonas putida KT2440
uggcaaucgccuggcgc

SEQ ID NO: 1589771 - RNA, 13 nt, Pseudomonas putida KT2440
uggcaacgccaca

SEQ ID NO: 1589772 - RNA, 17 nt, Pseudomonas putida KT2440
uggcaauuggcuuccag

SEQ ID NO: 1589773 - RNA, 20 nt, Pseudomonas putida KT2440
uggcaauuggcuuccaggug

SEQ ID NO: 1589774 - RNA, 15 nt, Pseudomonas putida KT2440
uggcacggccagcca

SEQ ID NO: 1589775 - RNA, 16 nt, Pseudomonas putida KT2440
uggcagcacgaucagc

SEQ ID NO: 1589776 - RNA, 17 nt, Pseudomonas putida KT2440
uggcagcacgaucagcg

SEQ ID NO: 1589777 - RNA, 22 nt, Pseudomonas putida KT2440
uggcagccacgauagcgucagc

SEQ ID NO: 1589778 - RNA, 20 nt, Pseudomonas putida KT2440
uggcagcuucucgcggcgaa

SEQ ID NO: 1589779 - RNA, 15 nt, Pseudomonas putida KT2440
uggcagcuccagcca

SEQ ID NO: 1589780 - RNA, 13 nt, Pseudomonas putida KT2440
uggcagcugcagu

SEQ ID NO: 1589781 - RNA, 18 nt, Pseudomonas putida KT2440
uggcagcugcagugcugg

SEQ ID NO: 1589782 - RNA, 22 nt, Pseudomonas putida KT2440
uggcagcugcagugcugggcau

SEQ ID NO: 1589783 - RNA, 18 nt, Pseudomonas putida KT2440
ugcgauagauguccagcg

SEQ ID NO: 1589784 - RNA, 13 nt, Pseudomonas putida KT2440
ugcgaccgaugcc

SEQ ID NO: 1589785 - RNA, 24 nt, Pseudomonas putida KT2440
ugcgaccgaugcccaacauaucgc

SEQ ID NO: 1589786 - RNA, 16 nt, Pseudomonas putida KT2440
ugcgaccaguaccgcg

SEQ ID NO: 1589787 - RNA, 16 nt, Pseudomonas putida KT2440
ugccuggcgcuugauc

SEQ ID NO: 1589788 - RNA, 14 nt, Pseudomonas putida KT2440
ugccuggcgugcug

SEQ ID NO: 1589789 - RNA, 14 nt, Pseudomonas putida KT2440
ugccuggcucaggc

SEQ ID NO: 1589790 - RNA, 20 nt, Pseudomonas putida KT2440
ugccugcgcuucaccuucgu

SEQ ID NO: 1589791 - RNA, 17 nt, Pseudomonas putida KT2440
ugccugcacugggcgaa

SEQ ID NO: 1589792 - RNA, 20 nt, Pseudomonas putida KT2440
ugccugcgauuuaugcuugc

SEQ ID NO: 1589793 - RNA, 14 nt, Pseudomonas putida KT2440
ugccugccagaauc

SEQ ID NO: 1589794 - RNA, 16 nt, Pseudomonas putida KT2440
ugccugauugccuggc

SEQ ID NO: 1589795 - RNA, 17 nt, Pseudomonas putida KT2440
ugccugggauuugugca

SEQ ID NO: 1589796 - RNA, 19 nt, Pseudomonas putida KT2440
ugccuggggguggguugac

SEQ ID NO: 1589797 - RNA, 19 nt, Pseudomonas putida KT2440
ugcgcaaaucuuguaggcg

SEQ ID NO: 1589798 - RNA, 17 nt, Pseudomonas putida KT2440
aauagugcuucuggaua

SEQ ID NO: 1589799 - RNA, 14 nt, Pseudomonas putida KT2440
ugcgauccaggauc

SEQ ID NO: 1589800 - RNA, 20 nt, Pseudomonas putida KT2440
ugcgauccgccccauagccu

SEQ ID NO: 1589801 - RNA, 20 nt, Pseudomonas putida KT2440
ugcgcaggcgccgccagcug

SEQ ID NO: 1589802 - RNA, 23 nt, Pseudomonas putida KT2440
ugcgcaggcgccgccagcugcug

SEQ ID NO: 1589803 - RNA, 19 nt, Pseudomonas putida KT2440
ugcgcaggcagcgauggcc

SEQ ID NO: 1589804 - RNA, 18 nt, Pseudomonas putida KT2440
ugcgcagguacacgggca

SEQ ID NO: 1589805 - RNA, 13 nt, Pseudomonas putida KT2440
ugcgcaguaccug

SEQ ID NO: 1589806 - RNA, 15 nt, Pseudomonas putida KT2440
ugcgcagcagcaggc

SEQ ID NO: 1589807 - RNA, 14 nt, Pseudomonas putida KT2440
ugcgcagccggccu

SEQ ID NO: 1589808 - RNA, 23 nt, Pseudomonas putida KT2440
ugccugcacggcaaaguccagca

SEQ ID NO: 1589809 - RNA, 14 nt, Pseudomonas putida KT2440
ugccugaccgguca

SEQ ID NO: 1589810 - RNA, 13 nt, Pseudomonas putida KT2440
ugccucgggcuug

SEQ ID NO: 1589811 - RNA, 16 nt, Pseudomonas putida KT2440
ugccucgcgcauggcc

SEQ ID NO: 1589812 - RNA, 14 nt, Pseudomonas putida KT2440
ugccucgcccaggu

SEQ ID NO: 1589813 - RNA, 16 nt, Pseudomonas putida KT2440
ugccucgcccagguca

SEQ ID NO: 1589814 - RNA, 17 nt, Pseudomonas putida KT2440
ugccuacccaggcaacg

SEQ ID NO: 1589815 - RNA, 23 nt, Pseudomonas putida KT2440
ugccguuguucggcaaaggccuc

SEQ ID NO: 1589816 - RNA, 21 nt, Pseudomonas putida KT2440
ugccguuuucgguaaucaccu

SEQ ID NO: 1589817 - RNA, 22 nt, Pseudomonas putida KT2440
ugccguuuucgguaaucaccuu

SEQ ID NO: 1589818 - RNA, 23 nt, Pseudomonas putida KT2440
ugccguuuauugguuugacgcug

SEQ ID NO: 1589819 - RNA, 15 nt, Pseudomonas putida KT2440
ugccguuugcuggcc

SEQ ID NO: 1589820 - RNA, 13 nt, Pseudomonas putida KT2440
ugccgucagaaag

SEQ ID NO: 1589821 - RNA, 16 nt, Pseudomonas putida KT2440
ugccgugcaggucagc

SEQ ID NO: 1589822 - RNA, 21 nt, Pseudomonas putida KT2440
ugccgucaaaaaucucgacga

SEQ ID NO: 1589823 - RNA, 16 nt, Pseudomonas putida KT2440
ugccgcgccagcuccg

SEQ ID NO: 1589824 - RNA, 22 nt, Pseudomonas putida KT2440
ugccgcggaaauaccagacgca

SEQ ID NO: 1589825 - RNA, 14 nt, Pseudomonas putida KT2440
ugcggccacagccg

SEQ ID NO: 1589826 - RNA, 15 nt, Pseudomonas putida KT2440
ugcggcccaucgcau

SEQ ID NO: 1589827 - RNA, 15 nt, Pseudomonas putida KT2440
ugcggcaucagggcc

SEQ ID NO: 1589828 - RNA, 22 nt, Pseudomonas putida KT2440
ugcggauaccgcuggccgccac

SEQ ID NO: 1589829 - RNA, 20 nt, Pseudomonas putida KT2440
ugcggaucaucuccaugaag

SEQ ID NO: 1589830 - RNA, 16 nt, Pseudomonas putida KT2440
ugcggcagccagcauc

SEQ ID NO: 1589831 - RNA, 17 nt, Pseudomonas putida KT2440
ugcggcagguaggccca

SEQ ID NO: 1589832 - RNA, 14 nt, Pseudomonas putida KT2440
ugcgcuggccaaug

SEQ ID NO: 1589833 - RNA, 12 nt, Pseudomonas putida KT2440
ugcgcuggccac

SEQ ID NO: 1589834 - RNA, 16 nt, Pseudomonas putida KT2440
ugcgcugcugguacau

SEQ ID NO: 1589835 - RNA, 13 nt, Pseudomonas putida KT2440
ugcggaccaccug

SEQ ID NO: 1589836 - RNA, 18 nt, Pseudomonas putida KT2440
ugcggaacaggaucagcg

SEQ ID NO: 1589837 - RNA, 21 nt, Pseudomonas putida KT2440
ugcggaacauacgcaucagcg

SEQ ID NO: 1589838 - RNA, 20 nt, Pseudomonas putida KT2440
ugcgcugaucgugcaccguc

SEQ ID NO: 1589839 - RNA, 17 nt, Pseudomonas putida KT2440
ugcgcucguaggcugca

SEQ ID NO: 1589840 - RNA, 16 nt, Pseudomonas putida KT2440
ugcgcucgcugccggc

SEQ ID NO: 1589841 - RNA, 16 nt, Pseudomonas putida KT2440
ugcgcugccugcuggc

SEQ ID NO: 1589842 - RNA, 17 nt, Pseudomonas putida KT2440
ugcgcugccugcuggcg

SEQ ID NO: 1589843 - RNA, 16 nt, Pseudomonas putida KT2440
ugcgcucaaccagccg

SEQ ID NO: 1589844 - RNA, 18 nt, Pseudomonas putida KT2440
ugcgcguauccuugccca

SEQ ID NO: 1589845 - RNA, 21 nt, Pseudomonas putida KT2440
ugcgcgucucuuucaggcaca

SEQ ID NO: 1589846 - RNA, 14 nt, Pseudomonas putida KT2440
ugcgcgccauggcg

SEQ ID NO: 1589847 - RNA, 13 nt, Pseudomonas putida KT2440
ugcgcgccagcgg

SEQ ID NO: 1589848 - RNA, 12 nt, Pseudomonas putida KT2440
ugcgcgccagcg

SEQ ID NO: 1589849 - RNA, 13 nt, Pseudomonas putida KT2440
ugcgcgaucagcg

SEQ ID NO: 1589850 - RNA, 17 nt, Pseudomonas putida KT2440
ugcgcgcaacagugccc

SEQ ID NO: 1589851 - RNA, 15 nt, Pseudomonas putida KT2440
ugcgcggcaccggcu

SEQ ID NO: 1589852 - RNA, 19 nt, Pseudomonas putida KT2440
ugcgcgcuugaagggggcu

SEQ ID NO: 1589853 - RNA, 20 nt, Pseudomonas putida KT2440
ugcgcgccuugcgccaggug

SEQ ID NO: 1589854 - RNA, 18 nt, Pseudomonas putida KT2440
ugcgcaugcaacggcaca

SEQ ID NO: 1589855 - RNA, 13 nt, Pseudomonas putida KT2440
ugcgcauggccgc

SEQ ID NO: 1589856 - RNA, 17 nt, Pseudomonas putida KT2440
ugcgcauggccgccaca

SEQ ID NO: 1589857 - RNA, 21 nt, Pseudomonas putida KT2440
ugcgccgcucugcccgcgcca

SEQ ID NO: 1589858 - RNA, 14 nt, Pseudomonas putida KT2440
ugcgccuggcccgc

SEQ ID NO: 1589859 - RNA, 17 nt, Pseudomonas putida KT2440
ugcgccugaacagcauc

SEQ ID NO: 1589860 - RNA, 22 nt, Pseudomonas putida KT2440
ugcgccugcaguucgcugcgca

SEQ ID NO: 1589861 - RNA, 17 nt, Pseudomonas putida KT2440
ugcgccugccgggccag

SEQ ID NO: 1589862 - RNA, 20 nt, Pseudomonas putida KT2440
ugcgccugcugguacagccg

SEQ ID NO: 1589863 - RNA, 21 nt, Pseudomonas putida KT2440
ugcgccugcugguacagccgg

SEQ ID NO: 1589864 - RNA, 23 nt, Pseudomonas putida KT2440
ugcgcgacagcaucaucaggccg

SEQ ID NO: 1589865 - RNA, 15 nt, Pseudomonas putida KT2440
ugcgccuugcuuggc

SEQ ID NO: 1589866 - RNA, 12 nt, Pseudomonas putida KT2440
uguccaccgcgc

SEQ ID NO: 1589867 - RNA, 21 nt, Pseudomonas putida KT2440
uguccaccgcgcaacgcgcca

SEQ ID NO: 1589868 - RNA, 20 nt, Pseudomonas putida KT2440
uguccacccccgcuccuacg

SEQ ID NO: 1589869 - RNA, 18 nt, Pseudomonas putida KT2440
ugucaucugaggcccgaa

SEQ ID NO: 1589870 - RNA, 20 nt, Pseudomonas putida KT2440
ugucauccacaucacugcug

SEQ ID NO: 1589871 - RNA, 23 nt, Pseudomonas putida KT2440
ugucagucucuuucaacagcugg

SEQ ID NO: 1589872 - RNA, 17 nt, Pseudomonas putida KT2440
ugguucuugccgagcag

SEQ ID NO: 1589873 - RNA, 15 nt, Pseudomonas putida KT2440
ugguucaucgacugg

SEQ ID NO: 1589874 - RNA, 23 nt, Pseudomonas putida KT2440
ugguuauuuuuuaacaaggcacg

SEQ ID NO: 1589875 - RNA, 18 nt, Pseudomonas putida KT2440
ugucgauacucacccgcu

SEQ ID NO: 1589876 - RNA, 19 nt, Pseudomonas putida KT2440
ugucgaacagcauccagcg

SEQ ID NO: 1589877 - RNA, 23 nt, Pseudomonas putida KT2440
ugucgaacagcauccagcgccag

SEQ ID NO: 1589878 - RNA, 19 nt, Pseudomonas putida KT2440
uguccggcgugaaauccuc

SEQ ID NO: 1589879 - RNA, 22 nt, Pseudomonas putida KT2440
uguccggcaugugcacuggcag

SEQ ID NO: 1589880 - RNA, 14 nt, Pseudomonas putida KT2440
uguccagcagcagc

SEQ ID NO: 1589881 - RNA, 22 nt, Pseudomonas putida KT2440
uguccagcagcagcgcaccgug

SEQ ID NO: 1589882 - RNA, 17 nt, Pseudomonas putida KT2440
uguccagcaagggccug

SEQ ID NO: 1589883 - RNA, 12 nt, Pseudomonas putida KT2440
uguccagcgcau

SEQ ID NO: 1589884 - RNA, 23 nt, Pseudomonas putida KT2440
uguccagcagguuggacagcgcc

SEQ ID NO: 1589885 - RNA, 12 nt, Pseudomonas putida KT2440
ugucccgcacga

SEQ ID NO: 1589886 - RNA, 15 nt, Pseudomonas putida KT2440
uguccauugagcacu

SEQ ID NO: 1589887 - RNA, 23 nt, Pseudomonas putida KT2440
uggugacugccagcacgaucaug

SEQ ID NO: 1589888 - RNA, 20 nt, Pseudomonas putida KT2440
uggucgcggcaaagaucgcc

SEQ ID NO: 1589889 - RNA, 18 nt, Pseudomonas putida KT2440
uggucgcggcgcuggccg

SEQ ID NO: 1589890 - RNA, 14 nt, Pseudomonas putida KT2440
uggucgcgugccgc

SEQ ID NO: 1589891 - RNA, 20 nt, Pseudomonas putida KT2440
uggugucguucgaacuccgc

SEQ ID NO: 1589892 - RNA, 22 nt, Pseudomonas putida KT2440
ugguguccuugucggcgaaggc

SEQ ID NO: 1589893 - RNA, 19 nt, Pseudomonas putida KT2440
uggugguuuauccggcaca

SEQ ID NO: 1589894 - RNA, 22 nt, Pseudomonas putida KT2440
ugguccuccccuucccgccauu

SEQ ID NO: 1589895 - RNA, 19 nt, Pseudomonas putida KT2440
uggucgccaggaucaccuc

SEQ ID NO: 1589896 - RNA, 21 nt, Pseudomonas putida KT2440
uggucgaggcaaagaacagcg

SEQ ID NO: 1589897 - RNA, 15 nt, Pseudomonas putida KT2440
uggucgaucccggcu

SEQ ID NO: 1589898 - RNA, 20 nt, Pseudomonas putida KT2440
uggucgacgucggcguccuu

SEQ ID NO: 1589899 - RNA, 20 nt, Pseudomonas putida KT2440
uggucgaaccgcaacuggcc

SEQ ID NO: 1589900 - RNA, 13 nt, Pseudomonas putida KT2440
uggucgaccgaca

SEQ ID NO: 1589901 - RNA, 19 nt, Pseudomonas putida KT2440
uggucagauaacccuuggc

SEQ ID NO: 1589902 - RNA, 15 nt, Pseudomonas putida KT2440
uggucagcaucaccg

SEQ ID NO: 1589903 - RNA, 16 nt, Pseudomonas putida KT2440
uggucagcgcuucgcu

SEQ ID NO: 1589904 - RNA, 18 nt, Pseudomonas putida KT2440
uggucagcggaccaggug

SEQ ID NO: 1589905 - RNA, 16 nt, Pseudomonas putida KT2440
uggucacccugacgcu

SEQ ID NO: 1589906 - RNA, 18 nt, Pseudomonas putida KT2440
uggucacgcucggccagu

SEQ ID NO: 1589907 - RNA, 13 nt, Pseudomonas putida KT2440
ugguacagccggc

SEQ ID NO: 1589908 - RNA, 23 nt, Pseudomonas putida KT2440
ugggcgaaguugaagcgccggua

SEQ ID NO: 1589909 - RNA, 18 nt, Pseudomonas putida KT2440
ugggcgaacgccugcagg

SEQ ID NO: 1589910 - RNA, 23 nt, Pseudomonas putida KT2440
ugggcgaacgccugcagggccug

SEQ ID NO: 1589911 - RNA, 14 nt, Pseudomonas putida KT2440
ugggccuugcucaa

SEQ ID NO: 1589912 - RNA, 14 nt, Pseudomonas putida KT2440
ugggccugugccgg

SEQ ID NO: 1589913 - RNA, 16 nt, Pseudomonas putida KT2440
ugggccugcacgaucg

SEQ ID NO: 1589914 - RNA, 13 nt, Pseudomonas putida KT2440
ugggccgugcagg

SEQ ID NO: 1589915 - RNA, 22 nt, Pseudomonas putida KT2440
ugggccgguccuuucgcgggua

SEQ ID NO: 1589916 - RNA, 15 nt, Pseudomonas putida KT2440
ugggccggcgcaggu

SEQ ID NO: 1589917 - RNA, 17 nt, Pseudomonas putida KT2440
ugggccggcgcccugca

SEQ ID NO: 1589918 - RNA, 20 nt, Pseudomonas putida KT2440
ugggccacggucuggcgcag

SEQ ID NO: 1589919 - RNA, 13 nt, Pseudomonas putida KT2440
ugggccacuucgc

SEQ ID NO: 1589920 - RNA, 22 nt, Pseudomonas putida KT2440
uggguccaggcacaccgagcca

SEQ ID NO: 1589921 - RNA, 20 nt, Pseudomonas putida KT2440
ugggucgggaacagcucugg

SEQ ID NO: 1589922 - RNA, 14 nt, Pseudomonas putida KT2440
ugguaacuggccag

SEQ ID NO: 1589923 - RNA, 21 nt, Pseudomonas putida KT2440
uggguaacccugcucgccauc

SEQ ID NO: 1589924 - RNA, 23 nt, Pseudomonas putida KT2440
ugggucagcgcugacucagcggc

SEQ ID NO: 1589925 - RNA, 19 nt, Pseudomonas putida KT2440
ugggcaaccacauggccgu

SEQ ID NO: 1589926 - RNA, 22 nt, Pseudomonas putida KT2440
ugggagcggccuugugucgcga

SEQ ID NO: 1589927 - RNA, 19 nt, Pseudomonas putida KT2440
ugggagcgggacugcccgc

SEQ ID NO: 1589928 - RNA, 20 nt, Pseudomonas putida KT2440
ugggagcgggcgugcccgcg

SEQ ID NO: 1589929 - RNA, 21 nt, Pseudomonas putida KT2440
ugggagcgggcgugcccgcga

SEQ ID NO: 1589930 - RNA, 12 nt, Pseudomonas putida KT2440
ugggagcgggcu

SEQ ID NO: 1589931 - RNA, 21 nt, Pseudomonas putida KT2440
ugggagcgggcuugcccgcga

SEQ ID NO: 1589932 - RNA, 14 nt, Pseudomonas putida KT2440
ugggagagcgccug

SEQ ID NO: 1589933 - RNA, 16 nt, Pseudomonas putida KT2440
ugggcaugaucgcgcu

SEQ ID NO: 1589934 - RNA, 12 nt, Pseudomonas putida KT2440
ugggcaucgaca

SEQ ID NO: 1589935 - RNA, 20 nt, Pseudomonas putida KT2440
ugggcauccagcuugccacc

SEQ ID NO: 1589936 - RNA, 19 nt, Pseudomonas putida KT2440
ugggcagaguaaccgcggc

SEQ ID NO: 1589937 - RNA, 17 nt, Pseudomonas putida KT2440
ugggcaauguucgcugc

SEQ ID NO: 1589938 - RNA, 19 nt, Pseudomonas putida KT2440
ugggaaaccuccggcauca

SEQ ID NO: 1589939 - RNA, 18 nt, Pseudomonas putida KT2440
ugggaaugugucagggcu

SEQ ID NO: 1589940 - RNA, 16 nt, Pseudomonas putida KT2440
uggcuuccugcuggcu

SEQ ID NO: 1589941 - RNA, 15 nt, Pseudomonas putida KT2440
uggcuuacagcgugg

SEQ ID NO: 1589942 - RNA, 17 nt, Pseudomonas putida KT2440
uggcuuagcgcgggccu

SEQ ID NO: 1589943 - RNA, 19 nt, Pseudomonas putida KT2440
uggcuggugaagcccuucg

SEQ ID NO: 1589944 - RNA, 20 nt, Pseudomonas putida KT2440
uggcugggcuucgacaaccg

SEQ ID NO: 1589945 - RNA, 15 nt, Pseudomonas putida KT2440
uggcuggcaccggcu

SEQ ID NO: 1589946 - RNA, 21 nt, Pseudomonas putida KT2440
uggcuggcagccggcgccggu

SEQ ID NO: 1589947 - RNA, 16 nt, Pseudomonas putida KT2440
uggcugccggccucga

SEQ ID NO: 1589948 - RNA, 20 nt, Pseudomonas putida KT2440
uggcugccguccaacgggcg

SEQ ID NO: 1589949 - RNA, 21 nt, Pseudomonas putida KT2440
uggcugcacugggcgauggcg

SEQ ID NO: 1589950 - RNA, 14 nt, Pseudomonas putida KT2440
uggcugcacuucga

SEQ ID NO: 1589951 - RNA, 15 nt, Pseudomonas putida KT2440
uggcugauagccgcc

SEQ ID NO: 1589952 - RNA, 19 nt, Pseudomonas putida KT2440
uggcugauagccgccagca

SEQ ID NO: 1589953 - RNA, 21 nt, Pseudomonas putida KT2440
uggcugauagccgccagcauc

SEQ ID NO: 1589954 - RNA, 14 nt, Pseudomonas putida KT2440
uggcgugcccggca

SEQ ID NO: 1589955 - RNA, 19 nt, Pseudomonas putida KT2440
uggcgugcucgcgcaugau

SEQ ID NO: 1589956 - RNA, 14 nt, Pseudomonas putida KT2440
uggcgucuucgcca

SEQ ID NO: 1589957 - RNA, 12 nt, Pseudomonas putida KT2440
uggcguaggccu

SEQ ID NO: 1589958 - RNA, 17 nt, Pseudomonas putida KT2440
uggcgguugaccagggc

SEQ ID NO: 1589959 - RNA, 15 nt, Pseudomonas putida KT2440
uggcggccgcagccc

SEQ ID NO: 1589960 - RNA, 21 nt, Pseudomonas putida KT2440
uggcucuucaacaccagcaug

SEQ ID NO: 1589961 - RNA, 14 nt, Pseudomonas putida KT2440
uggcucgcagccaa

SEQ ID NO: 1589962 - RNA, 17 nt, Pseudomonas putida KT2440
uggcucgacacgcuugc

SEQ ID NO: 1589963 - RNA, 22 nt, Pseudomonas putida KT2440
uggcuccaugguaaagcccgaa

SEQ ID NO: 1589964 - RNA, 21 nt, Pseudomonas putida KT2440
uggcucaugcgccagggcuga

SEQ ID NO: 1589965 - RNA, 14 nt, Pseudomonas putida KT2440
uggcucacacccag

SEQ ID NO: 1589966 - RNA, 23 nt, Pseudomonas putida KT2440
uggcucacacccaggcucgcccg

SEQ ID NO: 1589967 - RNA, 18 nt, Pseudomonas putida KT2440
uggcucaucaccggcguu

SEQ ID NO: 1589968 - RNA, 13 nt, Pseudomonas putida KT2440
uggcguugcucaa

SEQ ID NO: 1589969 - RNA, 16 nt, Pseudomonas putida KT2440
uggcguuguccagcag

SEQ ID NO: 1589970 - RNA, 17 nt, Pseudomonas putida KT2440
uggcuacagaucagcca

SEQ ID NO: 1589971 - RNA, 22 nt, Pseudomonas putida KT2440
uggcuacgugauugacccgacg

SEQ ID NO: 1589972 - RNA, 17 nt, Pseudomonas putida KT2440
uggcuagccucaucaga

SEQ ID NO: 1589973 - RNA, 15 nt, Pseudomonas putida KT2440
uggccugcuugauca

SEQ ID NO: 1589974 - RNA, 21 nt, Pseudomonas putida KT2440
uggccuggucgaaggucaggc

SEQ ID NO: 1589975 - RNA, 19 nt, Pseudomonas putida KT2440
uggccuggcgagucagggc

SEQ ID NO: 1589976 - RNA, 22 nt, Pseudomonas putida KT2440
uggccuuggacaccaggcuggu

SEQ ID NO: 1589977 - RNA, 14 nt, Pseudomonas putida KT2440
uggccuugcccgaa

SEQ ID NO: 1589978 - RNA, 22 nt, Pseudomonas putida KT2440
uggccucggcgaucgccaggug

SEQ ID NO: 1589979 - RNA, 16 nt, Pseudomonas putida KT2440
uggccugcucacccga

SEQ ID NO: 1589980 - RNA, 20 nt, Pseudomonas putida KT2440
uggccucuucgcgggcaagc

SEQ ID NO: 1589981 - RNA, 14 nt, Pseudomonas putida KT2440
uggccugcaagccg

SEQ ID NO: 1589982 - RNA, 13 nt, Pseudomonas putida KT2440
uggccuccagcaa

SEQ ID NO: 1589983 - RNA, 16 nt, Pseudomonas putida KT2440
uggccucgaacauggc

SEQ ID NO: 1589984 - RNA, 21 nt, Pseudomonas putida KT2440
uggccucgaacauggccacgg

SEQ ID NO: 1589985 - RNA, 14 nt, Pseudomonas putida KT2440
uggccgugacgccg

SEQ ID NO: 1589986 - RNA, 20 nt, Pseudomonas putida KT2440
uggccguguucgacgaucga

SEQ ID NO: 1589987 - RNA, 21 nt, Pseudomonas putida KT2440
uggccggccgggcucugggca

SEQ ID NO: 1589988 - RNA, 21 nt, Pseudomonas putida KT2440
uggccgcuggcccuucgcgga

SEQ ID NO: 1589989 - RNA, 19 nt, Pseudomonas putida KT2440
uggcauccacacgcugcug

SEQ ID NO: 1589990 - RNA, 12 nt, Pseudomonas putida KT2440
uggcaucugcug

SEQ ID NO: 1589991 - RNA, 11 nt, Pseudomonas putida KT2440
uggcaugcccc

SEQ ID NO: 1589992 - RNA, 22 nt, Pseudomonas putida KT2440
uggcaugccccucgaacagcgc

SEQ ID NO: 1589993 - RNA, 12 nt, Pseudomonas putida KT2440
uggcaucgcugc

SEQ ID NO: 1589994 - RNA, 18 nt, Pseudomonas putida KT2440
uggcaucggacgcguggu

SEQ ID NO: 1589995 - RNA, 13 nt, Pseudomonas putida KT2440
uggcauccggcag

SEQ ID NO: 1589996 - RNA, 17 nt, Pseudomonas putida KT2440
uggcauccggcagcuca

SEQ ID NO: 1589997 - RNA, 23 nt, Pseudomonas putida KT2440
uggcggaucagcgcguccagcaa

SEQ ID NO: 1589998 - RNA, 19 nt, Pseudomonas putida KT2440
uggcgcgcugugcucagca

SEQ ID NO: 1589999 - RNA, 22 nt, Pseudomonas putida KT2440
uggcgcgccuugggcaacaccg

SEQ ID NO: 1590000 - RNA, 16 nt, Pseudomonas putida KT2440
uggcgcgccaugcccc

SEQ ID NO: 1590001 - RNA, 15 nt, Pseudomonas putida KT2440
uggcgccgcccugga

SEQ ID NO: 1590002 - RNA, 19 nt, Pseudomonas putida KT2440
uggcgcagguacucuguca

SEQ ID NO: 1590003 - RNA, 14 nt, Pseudomonas putida KT2440
uggcgcauggccug

SEQ ID NO: 1590004 - RNA, 14 nt, Pseudomonas putida KT2440
uggcgccagggcau

SEQ ID NO: 1590005 - RNA, 21 nt, Pseudomonas putida KT2440
uggcgcccggggcaaugccga

SEQ ID NO: 1590006 - RNA, 23 nt, Pseudomonas putida KT2440
uggcgaaccgcuguucugcccgg

SEQ ID NO: 1590007 - RNA, 13 nt, Pseudomonas putida KT2440
uggcgaccggcgu

SEQ ID NO: 1590008 - RNA, 14 nt, Pseudomonas putida KT2440
uggcgaccggcgug

SEQ ID NO: 1590009 - RNA, 16 nt, Pseudomonas putida KT2440
uggcgacuucgugcgc

SEQ ID NO: 1590010 - RNA, 16 nt, Pseudomonas putida KT2440
uggcgagaauacccau

SEQ ID NO: 1590011 - RNA, 12 nt, Pseudomonas putida KT2440
uggcgagcaggu

SEQ ID NO: 1590012 - RNA, 18 nt, Pseudomonas putida KT2440
uggcgacgugcccagauc

SEQ ID NO: 1590013 - RNA, 17 nt, Pseudomonas putida KT2440
gugcauucugccaugau

SEQ ID NO: 1590014 - RNA, 20 nt, Pseudomonas putida KT2440
gugcauucugccaugauccg

SEQ ID NO: 1590015 - RNA, 12 nt, Pseudomonas putida KT2440
gugcauccugca

SEQ ID NO: 1590016 - RNA, 16 nt, Pseudomonas putida KT2440
gugcauccugcacugc

SEQ ID NO: 1590017 - RNA, 22 nt, Pseudomonas putida KT2440
gugccaucgccucggcacugca

SEQ ID NO: 1590018 - RNA, 19 nt, Pseudomonas putida KT2440
gugccagcgccaaucgcau

SEQ ID NO: 1590019 - RNA, 15 nt, Pseudomonas putida KT2440
gugcacaagcugcug

SEQ ID NO: 1590020 - RNA, 19 nt, Pseudomonas putida KT2440
gugcacaagcugcugauaa

SEQ ID NO: 1590021 - RNA, 19 nt, Pseudomonas putida KT2440
gugcacacgcaacugaugg

SEQ ID NO: 1590022 - RNA, 21 nt, Pseudomonas putida KT2440
gugcacagggcggccaaggcg

SEQ ID NO: 1590023 - RNA, 22 nt, Pseudomonas putida KT2440
gugcaccagcuugugccgcugc

SEQ ID NO: 1590024 - RNA, 19 nt, Pseudomonas putida KT2440
gugcacagguuagggucga

SEQ ID NO: 1590025 - RNA, 17 nt, Pseudomonas putida KT2440
gugcaccaacacuucca

SEQ ID NO: 1590026 - RNA, 21 nt, Pseudomonas putida KT2440
gugcacgaacacguccagccc

SEQ ID NO: 1590027 - RNA, 15 nt, Pseudomonas putida KT2440
gugauagaccugcaa

SEQ ID NO: 1590028 - RNA, 21 nt, Pseudomonas putida KT2440
gugauacagcacgcgcaugcc

SEQ ID NO: 1590029 - RNA, 22 nt, Pseudomonas putida KT2440
gugagggcguuccagccaggcg

SEQ ID NO: 1590030 - RNA, 22 nt, Pseudomonas putida KT2440
gugcccggcauccgccucaucc

SEQ ID NO: 1590031 - RNA, 14 nt, Pseudomonas putida KT2440
gugccgcagucccg

SEQ ID NO: 1590032 - RNA, 12 nt, Pseudomonas putida KT2440
gugccgccaugu

SEQ ID NO: 1590033 - RNA, 16 nt, Pseudomonas putida KT2440
gugccguccaauagcc

SEQ ID NO: 1590034 - RNA, 15 nt, Pseudomonas putida KT2440
gugccuguaggagcg

SEQ ID NO: 1590035 - RNA, 22 nt, Pseudomonas putida KT2440
gugccugggucagcuccucugc

SEQ ID NO: 1590036 - RNA, 12 nt, Pseudomonas putida KT2440
gugccuugucga

SEQ ID NO: 1590037 - RNA, 23 nt, Pseudomonas putida KT2440
gugccguauggcguugcucaaca

SEQ ID NO: 1590038 - RNA, 20 nt, Pseudomonas putida KT2440
gugccguaccugugggagcg

SEQ ID NO: 1590039 - RNA, 21 nt, Pseudomonas putida KT2440
gugccggucacuggcaacggg

SEQ ID NO: 1590040 - RNA, 19 nt, Pseudomonas putida KT2440
gugccgggccgucgaugcc

SEQ ID NO: 1590041 - RNA, 19 nt, Pseudomonas putida KT2440
gugcgggcuuguccgcgaa

SEQ ID NO: 1590042 - RNA, 23 nt, Pseudomonas putida KT2440
gugcggggcaaacuucucgauga

SEQ ID NO: 1590043 - RNA, 20 nt, Pseudomonas putida KT2440
gugcggcuuuagccgugaag

SEQ ID NO: 1590044 - RNA, 15 nt, Pseudomonas putida KT2440
gugcggauaccgcug

SEQ ID NO: 1590045 - RNA, 17 nt, Pseudomonas putida KT2440
gugcuucacagcguugc

SEQ ID NO: 1590046 - RNA, 12 nt, Pseudomonas putida KT2440
gugcugugcacu

SEQ ID NO: 1590047 - RNA, 23 nt, Pseudomonas putida KT2440
gugcuugcgggcaaggucgaugc

SEQ ID NO: 1590048 - RNA, 16 nt, Pseudomonas putida KT2440
gugcuugcaccgacaa

SEQ ID NO: 1590049 - RNA, 18 nt, Pseudomonas putida KT2440
gugcucgaugcgcacggc

SEQ ID NO: 1590050 - RNA, 19 nt, Pseudomonas putida KT2440
gugcucggguucguacagg

SEQ ID NO: 1590051 - RNA, 22 nt, Pseudomonas putida KT2440
gugcucggcaugcaugcguugc

SEQ ID NO: 1590052 - RNA, 12 nt, Pseudomonas putida KT2440
gugcucggccug

SEQ ID NO: 1590053 - RNA, 20 nt, Pseudomonas putida KT2440
gugcucgccucacagcgccg

SEQ ID NO: 1590054 - RNA, 16 nt, Pseudomonas putida KT2440
guggaaauuggccagc

SEQ ID NO: 1590055 - RNA, 18 nt, Pseudomonas putida KT2440
gugcuugugcucccacag

SEQ ID NO: 1590056 - RNA, 15 nt, Pseudomonas putida KT2440
guggaagcgcggguu

SEQ ID NO: 1590057 - RNA, 20 nt, Pseudomonas putida KT2440
guggaagcgggcgugcccgc

SEQ ID NO: 1590058 - RNA, 20 nt, Pseudomonas putida KT2440
guggaagugggcuugcccgc

SEQ ID NO: 1590059 - RNA, 15 nt, Pseudomonas putida KT2440
guggauauccagcga

SEQ ID NO: 1590060 - RNA, 23 nt, Pseudomonas putida KT2440
guggcaauggccugcaugucggc

SEQ ID NO: 1590061 - RNA, 18 nt, Pseudomonas putida KT2440
guggcacaccaugggcaa

SEQ ID NO: 1590062 - RNA, 19 nt, Pseudomonas putida KT2440
guggcacaccaugggcaau

SEQ ID NO: 1590063 - RNA, 13 nt, Pseudomonas putida KT2440
guggaucagccgc

SEQ ID NO: 1590064 - RNA, 14 nt, Pseudomonas putida KT2440
guggaugaucggcu

SEQ ID NO: 1590065 - RNA, 16 nt, Pseudomonas putida KT2440
guggauggucagcgcu

SEQ ID NO: 1590066 - RNA, 15 nt, Pseudomonas putida KT2440
gugucugcgccugcu

SEQ ID NO: 1590067 - RNA, 21 nt, Pseudomonas putida KT2440
gugucgguggcggccagcgca

SEQ ID NO: 1590068 - RNA, 15 nt, Pseudomonas putida KT2440
guguccggcaugugc

SEQ ID NO: 1590069 - RNA, 22 nt, Pseudomonas putida KT2440
guguccgccacaacccuugcag

SEQ ID NO: 1590070 - RNA, 13 nt, Pseudomonas putida KT2440
guggugaauggcg

SEQ ID NO: 1590071 - RNA, 23 nt, Pseudomonas putida KT2440
guggcaggcaguucgagcgccug

SEQ ID NO: 1590072 - RNA, 19 nt, Pseudomonas putida KT2440
guggcacgcucgcgcagga

SEQ ID NO: 1590073 - RNA, 19 nt, Pseudomonas putida KT2440
guggcacccacagcgccug

SEQ ID NO: 1590074 - RNA, 13 nt, Pseudomonas putida KT2440
guggcaccggcga

SEQ ID NO: 1590075 - RNA, 16 nt, Pseudomonas putida KT2440
guggcauuggcgugcu

SEQ ID NO: 1590076 - RNA, 12 nt, Pseudomonas putida KT2440
guggcauccuuu

SEQ ID NO: 1590077 - RNA, 20 nt, Pseudomonas putida KT2440
gugggagcggccuugcgucg

SEQ ID NO: 1590078 - RNA, 20 nt, Pseudomonas putida KT2440
gugggagcggccuugugucg

SEQ ID NO: 1590079 - RNA, 20 nt, Pseudomonas putida KT2440
gugggagcgggcaugcccgc

SEQ ID NO: 1590080 - RNA, 13 nt, Pseudomonas putida KT2440
gugggagcgggcg

SEQ ID NO: 1590081 - RNA, 20 nt, Pseudomonas putida KT2440
gugggagcgggcgugcccgc

SEQ ID NO: 1590082 - RNA, 16 nt, Pseudomonas putida KT2440
gugggagcgggcuugc

SEQ ID NO: 1590083 - RNA, 18 nt, Pseudomonas putida KT2440
gugggagcacaagcacgc

SEQ ID NO: 1590084 - RNA, 16 nt, Pseudomonas putida KT2440
gugggccgugcaggcg

SEQ ID NO: 1590085 - RNA, 21 nt, Pseudomonas putida KT2440
guggcugccacgggcauagcc

SEQ ID NO: 1590086 - RNA, 17 nt, Pseudomonas putida KT2440
guggcugccagcgcgcu

SEQ ID NO: 1590087 - RNA, 16 nt, Pseudomonas putida KT2440
guggcuguucgucggc

SEQ ID NO: 1590088 - RNA, 14 nt, Pseudomonas putida KT2440
guggucagccaggc

SEQ ID NO: 1590089 - RNA, 18 nt, Pseudomonas putida KT2440
gugggcgaugaucgcggc

SEQ ID NO: 1590090 - RNA, 23 nt, Pseudomonas putida KT2440
gugggugccguacauagcaggau

SEQ ID NO: 1590091 - RNA, 16 nt, Pseudomonas putida KT2440
gugguaaugcgcugau

SEQ ID NO: 1590092 - RNA, 20 nt, Pseudomonas putida KT2440
guucacuguugccgccacca

SEQ ID NO: 1590093 - RNA, 20 nt, Pseudomonas putida KT2440
guucacccgcgaaagggcca

SEQ ID NO: 1590094 - RNA, 20 nt, Pseudomonas putida KT2440
guucacccgcgaaagggccg

SEQ ID NO: 1590095 - RNA, 19 nt, Pseudomonas putida KT2440
guucagcuugucgaccagg

SEQ ID NO: 1590096 - RNA, 15 nt, Pseudomonas putida KT2440
guuauccugcagcac

SEQ ID NO: 1590097 - RNA, 12 nt, Pseudomonas putida KT2440
guuauccagcac

SEQ ID NO: 1590098 - RNA, 18 nt, Pseudomonas putida KT2440
aaguggugcccgccaggc

SEQ ID NO: 1590099 - RNA, 23 nt, Pseudomonas putida KT2440
guuacuggccaauugcgccauca

SEQ ID NO: 1590100 - RNA, 17 nt, Pseudomonas putida KT2440
guuagcgucgaugcggc

SEQ ID NO: 1590101 - RNA, 19 nt, Pseudomonas putida KT2440
guuaggcgagaucgacagg

SEQ ID NO: 1590102 - RNA, 22 nt, Pseudomonas putida KT2440
guguuugaccaccagacgggca

SEQ ID NO: 1590103 - RNA, 19 nt, Pseudomonas putida KT2440
guguuggaugcuucgcggg

SEQ ID NO: 1590104 - RNA, 16 nt, Pseudomonas putida KT2440
guguugucugugcccg

SEQ ID NO: 1590105 - RNA, 14 nt, Pseudomonas putida KT2440
guucaucgaaggcc

SEQ ID NO: 1590106 - RNA, 15 nt, Pseudomonas putida KT2440
guucauccagaucgg

SEQ ID NO: 1590107 - RNA, 13 nt, Pseudomonas putida KT2440
guucagucagugc

SEQ ID NO: 1590108 - RNA, 16 nt, Pseudomonas putida KT2440
guucagggcaauagcc

SEQ ID NO: 1590109 - RNA, 17 nt, Pseudomonas putida KT2440
guucaggucgcgcugca

SEQ ID NO: 1590110 - RNA, 16 nt, Pseudomonas putida KT2440
guuccagcaucggcac

SEQ ID NO: 1590111 - RNA, 23 nt, Pseudomonas putida KT2440
guuccgccgcuuuguuugcuggc

SEQ ID NO: 1590112 - RNA, 18 nt, Pseudomonas putida KT2440
guuccggcccuuucgcgg

SEQ ID NO: 1590113 - RNA, 19 nt, Pseudomonas putida KT2440
guuccggcccuuucgcggg

SEQ ID NO: 1590114 - RNA, 20 nt, Pseudomonas putida KT2440
guuccuucuugugcacaaag

SEQ ID NO: 1590115 - RNA, 12 nt, Pseudomonas putida KT2440
guucccagcacc

SEQ ID NO: 1590116 - RNA, 18 nt, Pseudomonas putida KT2440
guuccauuucccuacagc

SEQ ID NO: 1590117 - RNA, 15 nt, Pseudomonas putida KT2440
guucccgugcgccua

SEQ ID NO: 1590118 - RNA, 13 nt, Pseudomonas putida KT2440
guucccgccaugu

SEQ ID NO: 1590119 - RNA, 21 nt, Pseudomonas putida KT2440
guugguguccuugucggcgaa

SEQ ID NO: 1590120 - RNA, 20 nt, Pseudomonas putida KT2440
guuggucaaagaacguggac

SEQ ID NO: 1590121 - RNA, 13 nt, Pseudomonas putida KT2440
guuugccaaggca

SEQ ID NO: 1590122 - RNA, 19 nt, Pseudomonas putida KT2440
guuugaagccauaucccgc

SEQ ID NO: 1590123 - RNA, 12 nt, Pseudomonas putida KT2440
guuugagccggc

SEQ ID NO: 1590124 - RNA, 16 nt, Pseudomonas putida KT2440
guuuggcuuugccggc

SEQ ID NO: 1590125 - RNA, 18 nt, Pseudomonas putida KT2440
guuugggccugugccggc

SEQ ID NO: 1590126 - RNA, 17 nt, Pseudomonas putida KT2440
guuuggccuguccaggc

SEQ ID NO: 1590127 - RNA, 15 nt, Pseudomonas putida KT2440
guuuuucacacgcca

SEQ ID NO: 1590128 - RNA, 14 nt, Pseudomonas putida KT2440
guuuuuugggagcg

SEQ ID NO: 1590129 - RNA, 12 nt, Pseudomonas putida KT2440
guuuucaaggcg

SEQ ID NO: 1590130 - RNA, 15 nt, Pseudomonas putida KT2440
uaaaaacuggccagc

SEQ ID NO: 1590131 - RNA, 22 nt, Pseudomonas putida KT2440
guugcggaacucuggcgugaag

SEQ ID NO: 1590132 - RNA, 20 nt, Pseudomonas putida KT2440
guugccgaugaugcgggcaa

SEQ ID NO: 1590133 - RNA, 14 nt, Pseudomonas putida KT2440
guugcccggcauga

SEQ ID NO: 1590134 - RNA, 13 nt, Pseudomonas putida KT2440
guugcccggcgag

SEQ ID NO: 1590135 - RNA, 17 nt, Pseudomonas putida KT2440
guugcggcccuucgcgg

SEQ ID NO: 1590136 - RNA, 21 nt, Pseudomonas putida KT2440
guugcggcccuucgcgggcac

SEQ ID NO: 1590137 - RNA, 11 nt, Pseudomonas putida KT2440
guugccaaugc

SEQ ID NO: 1590138 - RNA, 24 nt, Pseudomonas putida KT2440
guugccacccagaucaucaucggc

SEQ ID NO: 1590139 - RNA, 20 nt, Pseudomonas putida KT2440
guugcccagcaugcgcuuga

SEQ ID NO: 1590140 - RNA, 16 nt, Pseudomonas putida KT2440
guugcccgacaccuca

SEQ ID NO: 1590141 - RNA, 18 nt, Pseudomonas putida KT2440
guugggcgggccgccgaa

SEQ ID NO: 1590142 - RNA, 17 nt, Pseudomonas putida KT2440
guuggcuuguccagcca

SEQ ID NO: 1590143 - RNA, 20 nt, Pseudomonas putida KT2440
guugcuggcgacgcugccca

SEQ ID NO: 1590144 - RNA, 14 nt, Pseudomonas putida KT2440
guuggccggcaugg

SEQ ID NO: 1590145 - RNA, 16 nt, Pseudomonas putida KT2440
guugcugauguuggcc

SEQ ID NO: 1590146 - RNA, 14 nt, Pseudomonas putida KT2440
guugcgggucagcu

SEQ ID NO: 1590147 - RNA, 23 nt, Pseudomonas putida KT2440
guugaccgugaucaucagcgccg

SEQ ID NO: 1590148 - RNA, 17 nt, Pseudomonas putida KT2440
guugaccgccgccacca

SEQ ID NO: 1590149 - RNA, 23 nt, Pseudomonas putida KT2440
guugacggugugcggaucgccgc

SEQ ID NO: 1590150 - RNA, 22 nt, Pseudomonas putida KT2440
guucuggucacccagcgcuuga

SEQ ID NO: 1590151 - RNA, 20 nt, Pseudomonas putida KT2440
guucgacagguugugguagu

SEQ ID NO: 1590152 - RNA, 21 nt, Pseudomonas putida KT2440
guugaacgcaaaaaaccgcac

SEQ ID NO: 1590153 - RNA, 19 nt, Pseudomonas putida KT2440
guucuuucucccaggccga

SEQ ID NO: 1590154 - RNA, 14 nt, Pseudomonas putida KT2440
guugaucucuucgg

SEQ ID NO: 1590155 - RNA, 20 nt, Pseudomonas putida KT2440
guugaucagcgacaccgcca

SEQ ID NO: 1590156 - RNA, 23 nt, Pseudomonas putida KT2440
guugagugggguggaaguuccug

SEQ ID NO: 1590157 - RNA, 15 nt, Pseudomonas putida KT2440
guugcagccauagcc

SEQ ID NO: 1590158 - RNA, 24 nt, Pseudomonas putida KT2440
guugcacgucauaguuguggcaac

SEQ ID NO: 1590159 - RNA, 19 nt, Pseudomonas putida KT2440
guugcagcacacuccacga

SEQ ID NO: 1590160 - RNA, 14 nt, Pseudomonas putida KT2440
guugcaggcgagcu

SEQ ID NO: 1590161 - RNA, 17 nt, Pseudomonas putida KT2440
guugcaggauuugcccg

SEQ ID NO: 1590162 - RNA, 17 nt, Pseudomonas putida KT2440
uacauccagcuccagca

SEQ ID NO: 1590163 - RNA, 15 nt, Pseudomonas putida KT2440
uacauccaugccuag

SEQ ID NO: 1590164 - RNA, 15 nt, Pseudomonas putida KT2440
uaccaacaccggcga

SEQ ID NO: 1590165 - RNA, 16 nt, Pseudomonas putida KT2440
uaccacgccgcugcca

SEQ ID NO: 1590166 - RNA, 20 nt, Pseudomonas putida KT2440
uaccacguuauccagcugca

SEQ ID NO: 1590167 - RNA, 13 nt, Pseudomonas putida KT2440
uacagccagaaag

SEQ ID NO: 1590168 - RNA, 12 nt, Pseudomonas putida KT2440
uacagccagcaa

SEQ ID NO: 1590169 - RNA, 13 nt, Pseudomonas putida KT2440
uacagcacgcgca

SEQ ID NO: 1590170 - RNA, 19 nt, Pseudomonas putida KT2440
uacaggcugccgccgaaca

SEQ ID NO: 1590171 - RNA, 21 nt, Pseudomonas putida KT2440
uacagcuugcccaucaccucg

SEQ ID NO: 1590172 - RNA, 14 nt, Pseudomonas putida KT2440
uacagcucacuggc

SEQ ID NO: 1590173 - RNA, 15 nt, Pseudomonas putida KT2440
uacagcucacuggcc

SEQ ID NO: 1590174 - RNA, 22 nt, Pseudomonas putida KT2440
uacaggaaucugucagccuuuc

SEQ ID NO: 1590175 - RNA, 13 nt, Pseudomonas putida KT2440
uacaggaccaggc

SEQ ID NO: 1590176 - RNA, 17 nt, Pseudomonas putida KT2440
uacaggauggccgcagg

SEQ ID NO: 1590177 - RNA, 16 nt, Pseudomonas putida KT2440
uacaggcaaccgcauc

SEQ ID NO: 1590178 - RNA, 22 nt, Pseudomonas putida KT2440
uacaccggccuggauaaucgcc

SEQ ID NO: 1590179 - RNA, 15 nt, Pseudomonas putida KT2440
uacaacaggaacagc

SEQ ID NO: 1590180 - RNA, 16 nt, Pseudomonas putida KT2440
uacaacaggaacagcg

SEQ ID NO: 1590181 - RNA, 18 nt, Pseudomonas putida KT2440
uaauugugcccuugaacg

SEQ ID NO: 1590182 - RNA, 15 nt, Pseudomonas putida KT2440
uaagccaugcgcagg

SEQ ID NO: 1590183 - RNA, 17 nt, Pseudomonas putida KT2440
uaagcgaaacaccagca

SEQ ID NO: 1590184 - RNA, 17 nt, Pseudomonas putida KT2440
uaacgcgccgcugccug

SEQ ID NO: 1590185 - RNA, 17 nt, Pseudomonas putida KT2440
uaaccggcccugaaggc

SEQ ID NO: 1590186 - RNA, 15 nt, Pseudomonas putida KT2440
uaaccgcccgccaua

SEQ ID NO: 1590187 - RNA, 15 nt, Pseudomonas putida KT2440
uaacgcgggcaaugu

SEQ ID NO: 1590188 - RNA, 16 nt, Pseudomonas putida KT2440
uaacgcuuggccagac

SEQ ID NO: 1590189 - RNA, 17 nt, Pseudomonas putida KT2440
uaaccaauuggucguag

SEQ ID NO: 1590190 - RNA, 13 nt, Pseudomonas putida KT2440
uaaaccugccacc

SEQ ID NO: 1590191 - RNA, 17 nt, Pseudomonas putida KT2440
ucauugcccaagcgcuc

SEQ ID NO: 1590192 - RNA, 23 nt, Pseudomonas putida KT2440
ucauugcugcgguaccggccagc

SEQ ID NO: 1590193 - RNA, 23 nt, Pseudomonas putida KT2440
ucauggcuugagcuuagcgcgca

SEQ ID NO: 1590194 - RNA, 16 nt, Pseudomonas putida KT2440
ucaugguccuugaacg

SEQ ID NO: 1590195 - RNA, 14 nt, Pseudomonas putida KT2440
ucauggucgaccgc

SEQ ID NO: 1590196 - RNA, 14 nt, Pseudomonas putida KT2440
ucauguccuugcug

SEQ ID NO: 1590197 - RNA, 22 nt, Pseudomonas putida KT2440
ucaugucgccguauucaccggu

SEQ ID NO: 1590198 - RNA, 15 nt, Pseudomonas putida KT2440
ucaugucggcagcca

SEQ ID NO: 1590199 - RNA, 14 nt, Pseudomonas putida KT2440
ucaucaucggcaug

SEQ ID NO: 1590200 - RNA, 16 nt, Pseudomonas putida KT2440
ucaucaucggcaugca

SEQ ID NO: 1590201 - RNA, 15 nt, Pseudomonas putida KT2440
ucaucaggacgguca

SEQ ID NO: 1590202 - RNA, 13 nt, Pseudomonas putida KT2440
ucaucaggucgcc

SEQ ID NO: 1590203 - RNA, 19 nt, Pseudomonas putida KT2440
ucaucaggucgccuugaaa

SEQ ID NO: 1590204 - RNA, 15 nt, Pseudomonas putida KT2440
ucaucaucagcaggc

SEQ ID NO: 1590205 - RNA, 20 nt, Pseudomonas putida KT2440
ucauccgggccgucaccgcu

SEQ ID NO: 1590206 - RNA, 22 nt, Pseudomonas putida KT2440
ucauccaccacccuggcaugcc

SEQ ID NO: 1590207 - RNA, 17 nt, Pseudomonas putida KT2440
ucauccucgacgaccag

SEQ ID NO: 1590208 - RNA, 13 nt, Pseudomonas putida KT2440
ucauccucgccca

SEQ ID NO: 1590209 - RNA, 21 nt, Pseudomonas putida KT2440
ucaucguccaccgcgccauca

SEQ ID NO: 1590210 - RNA, 16 nt, Pseudomonas putida KT2440
ucaucgagauguggcc

SEQ ID NO: 1590211 - RNA, 15 nt, Pseudomonas putida KT2440
ucaucgauacccacg

SEQ ID NO: 1590212 - RNA, 18 nt, Pseudomonas putida KT2440
ucaucgacuggaugcucg

SEQ ID NO: 1590213 - RNA, 22 nt, Pseudomonas putida KT2440
ucaggcccaccagucugcucag

SEQ ID NO: 1590214 - RNA, 15 nt, Pseudomonas putida KT2440
ucaggcaugccagca

SEQ ID NO: 1590215 - RNA, 18 nt, Pseudomonas putida KT2440
ucaguugcagcaacgccu

SEQ ID NO: 1590216 - RNA, 18 nt, Pseudomonas putida KT2440
uccauacgugcaccggcc

SEQ ID NO: 1590217 - RNA, 16 nt, Pseudomonas putida KT2440
uccauacuuggccgac

SEQ ID NO: 1590218 - RNA, 20 nt, Pseudomonas putida KT2440
uccauccagucggcgcugga

SEQ ID NO: 1590219 - RNA, 11 nt, Pseudomonas putida KT2440
uccaucaccug

SEQ ID NO: 1590220 - RNA, 13 nt, Pseudomonas putida KT2440
uccaucaccugcc

SEQ ID NO: 1590221 - RNA, 15 nt, Pseudomonas putida KT2440
uccaucuccagcuca

SEQ ID NO: 1590222 - RNA, 21 nt, Pseudomonas putida KT2440
uccauguucaccguacccgcc

SEQ ID NO: 1590223 - RNA, 18 nt, Pseudomonas putida KT2440
uccauucggugcagcggc

SEQ ID NO: 1590224 - RNA, 18 nt, Pseudomonas putida KT2440
uccauguaggagcggguu

SEQ ID NO: 1590225 - RNA, 21 nt, Pseudomonas putida KT2440
uccauguaggagcggguuuac

SEQ ID NO: 1590226 - RNA, 17 nt, Pseudomonas putida KT2440
uccauuucacuggcuuc

SEQ ID NO: 1590227 - RNA, 15 nt, Pseudomonas putida KT2440
uccauuugcgcuggc

SEQ ID NO: 1590228 - RNA, 16 nt, Pseudomonas putida KT2440
uccauugcgccuguca

SEQ ID NO: 1590229 - RNA, 14 nt, Pseudomonas putida KT2440
uccaugcgcgcagc

SEQ ID NO: 1590230 - RNA, 22 nt, Pseudomonas putida KT2440
uccaugaaggccggcaucgacg

SEQ ID NO: 1590231 - RNA, 15 nt, Pseudomonas putida KT2440
uccaucuucaccuug

SEQ ID NO: 1590232 - RNA, 19 nt, Pseudomonas putida KT2440
uccaguugcaagccuucgu

SEQ ID NO: 1590233 - RNA, 18 nt, Pseudomonas putida KT2440
uccagugcuucacugccg

SEQ ID NO: 1590234 - RNA, 21 nt, Pseudomonas putida KT2440
uccagucggccugaugccuca

SEQ ID NO: 1590235 - RNA, 22 nt, Pseudomonas putida KT2440
uccagcgguggguggcucauca

SEQ ID NO: 1590236 - RNA, 19 nt, Pseudomonas putida KT2440
uccagcucgcgcagggcau

SEQ ID NO: 1590237 - RNA, 17 nt, Pseudomonas putida KT2440
uccagcuccuggcccgc

SEQ ID NO: 1590238 - RNA, 19 nt, Pseudomonas putida KT2440
uccaggugaaucagcggca

SEQ ID NO: 1590239 - RNA, 16 nt, Pseudomonas putida KT2440
uccaggugcucgauga

SEQ ID NO: 1590240 - RNA, 14 nt, Pseudomonas putida KT2440
uccaggugcugcga

SEQ ID NO: 1590241 - RNA, 18 nt, Pseudomonas putida KT2440
uccacacucgacgcugcc

SEQ ID NO: 1590242 - RNA, 17 nt, Pseudomonas putida KT2440
uccacaccuucggcaug

SEQ ID NO: 1590243 - RNA, 15 nt, Pseudomonas putida KT2440
uccaaugcgucaucg

SEQ ID NO: 1590244 - RNA, 19 nt, Pseudomonas putida KT2440
uccacacccagcgcggcaa

SEQ ID NO: 1590245 - RNA, 15 nt, Pseudomonas putida KT2440
uccagccugcagcac

SEQ ID NO: 1590246 - RNA, 15 nt, Pseudomonas putida KT2440
uccagcccuggcgac

SEQ ID NO: 1590247 - RNA, 20 nt, Pseudomonas putida KT2440
uccagcccuuccaccacauc

SEQ ID NO: 1590248 - RNA, 22 nt, Pseudomonas putida KT2440
uccagcccguucuggccuuggc

SEQ ID NO: 1590249 - RNA, 14 nt, Pseudomonas putida KT2440
uccagcccugcucg

SEQ ID NO: 1590250 - RNA, 15 nt, Pseudomonas putida KT2440
uccagcccgauggcc

SEQ ID NO: 1590251 - RNA, 11 nt, Pseudomonas putida KT2440
uccagcccgaa

SEQ ID NO: 1590252 - RNA, 17 nt, Pseudomonas putida KT2440
uccagcccaccacgaac

SEQ ID NO: 1590253 - RNA, 21 nt, Pseudomonas putida KT2440
uccagcagcgcauccaccucg

SEQ ID NO: 1590254 - RNA, 19 nt, Pseudomonas putida KT2440
uccagcagcgacaccagcg

SEQ ID NO: 1590255 - RNA, 15 nt, Pseudomonas putida KT2440
uccagaucggcagug

SEQ ID NO: 1590256 - RNA, 16 nt, Pseudomonas putida KT2440
uccagagggccugcau

SEQ ID NO: 1590257 - RNA, 13 nt, Pseudomonas putida KT2440
uccagcaccucgc

SEQ ID NO: 1590258 - RNA, 14 nt, Pseudomonas putida KT2440
uccagcacccgcuu

SEQ ID NO: 1590259 - RNA, 21 nt, Pseudomonas putida KT2440
uccagcaaagugcgcaugccc

SEQ ID NO: 1590260 - RNA, 20 nt, Pseudomonas putida KT2440
uccagcaacaacgccuuggc

SEQ ID NO: 1590261 - RNA, 23 nt, Pseudomonas putida KT2440
ucagccgucgccgcuucggcaug

SEQ ID NO: 1590262 - RNA, 17 nt, Pseudomonas putida KT2440
ucagcgccgguagcggc

SEQ ID NO: 1590263 - RNA, 19 nt, Pseudomonas putida KT2440
ucagcgccgcuucagccuu

SEQ ID NO: 1590264 - RNA, 16 nt, Pseudomonas putida KT2440
ucagccaaaucagcug

SEQ ID NO: 1590265 - RNA, 16 nt, Pseudomonas putida KT2440
ucagcaucaccgcgcc

SEQ ID NO: 1590266 - RNA, 17 nt, Pseudomonas putida KT2440
ucagcaugcccagcgcc

SEQ ID NO: 1590267 - RNA, 13 nt, Pseudomonas putida KT2440
ucagccagacgac

SEQ ID NO: 1590268 - RNA, 18 nt, Pseudomonas putida KT2440
ucagccagacgaccagca

SEQ ID NO: 1590269 - RNA, 19 nt, Pseudomonas putida KT2440
ucagcccauuucaccugcu

SEQ ID NO: 1590270 - RNA, 18 nt, Pseudomonas putida KT2440
ucagauaggcgccgugcu

SEQ ID NO: 1590271 - RNA, 13 nt, Pseudomonas putida KT2440
ucagcuccaugcg

SEQ ID NO: 1590272 - RNA, 14 nt, Pseudomonas putida KT2440
ucagcucacaggcu

SEQ ID NO: 1590273 - RNA, 23 nt, Pseudomonas putida KT2440
ucagcucacguuugggcggcgug

SEQ ID NO: 1590274 - RNA, 20 nt, Pseudomonas putida KT2440
ucagcgggucgagccaggcg

SEQ ID NO: 1590275 - RNA, 18 nt, Pseudomonas putida KT2440
ucagcggcaacaccagca

SEQ ID NO: 1590276 - RNA, 20 nt, Pseudomonas putida KT2440
ucagcggcaacaccagcagc

SEQ ID NO: 1590277 - RNA, 16 nt, Pseudomonas putida KT2440
ucagcguacacugcag

SEQ ID NO: 1590278 - RNA, 19 nt, Pseudomonas putida KT2440
ucagcguacacugcaggag

SEQ ID NO: 1590279 - RNA, 20 nt, Pseudomonas putida KT2440
ucagcgguucgaccaauggc

SEQ ID NO: 1590280 - RNA, 13 nt, Pseudomonas putida KT2440
ucagcgcggugac

SEQ ID NO: 1590281 - RNA, 14 nt, Pseudomonas putida KT2440
ucagcgcguccagc

SEQ ID NO: 1590282 - RNA, 15 nt, Pseudomonas putida KT2440
ucagcgcguccagca

SEQ ID NO: 1590283 - RNA, 18 nt, Pseudomonas putida KT2440
ucagcgcguccagcaaca

SEQ ID NO: 1590284 - RNA, 21 nt, Pseudomonas putida KT2440
ucagcgcguccagcaacagcu

SEQ ID NO: 1590285 - RNA, 16 nt, Pseudomonas putida KT2440
ucagcuugucgaccag

SEQ ID NO: 1590286 - RNA, 14 nt, Pseudomonas putida KT2440
ucagcuucauggcg

SEQ ID NO: 1590287 - RNA, 20 nt, Pseudomonas putida KT2440
ucagcuucucgcgcuuggcc

SEQ ID NO: 1590288 - RNA, 20 nt, Pseudomonas putida KT2440
ucagcugguucugcugcagc

SEQ ID NO: 1590289 - RNA, 23 nt, Pseudomonas putida KT2440
ucagcugggcguuuccagguucc

SEQ ID NO: 1590290 - RNA, 19 nt, Pseudomonas putida KT2440
ucagcuggucgaggcggcu

SEQ ID NO: 1590291 - RNA, 13 nt, Pseudomonas putida KT2440
ucaggaacagcuc

SEQ ID NO: 1590292 - RNA, 14 nt, Pseudomonas putida KT2440
ucaggaaggcacca

SEQ ID NO: 1590293 - RNA, 22 nt, Pseudomonas putida KT2440
ucagcucggaaaggucggcggc

SEQ ID NO: 1590294 - RNA, 23 nt, Pseudomonas putida KT2440
ucagcucggcaacgauggucgcc

SEQ ID NO: 1590295 - RNA, 16 nt, Pseudomonas putida KT2440
ucagcucggcacugua

SEQ ID NO: 1590296 - RNA, 19 nt, Pseudomonas putida KT2440
ucagcucggccacccgcgu

SEQ ID NO: 1590297 - RNA, 15 nt, Pseudomonas putida KT2440
ucaggcaggccagca

SEQ ID NO: 1590298 - RNA, 21 nt, Pseudomonas putida KT2440
ucaggcagaagguaggcaccc

SEQ ID NO: 1590299 - RNA, 17 nt, Pseudomonas putida KT2440
ucaggaugcuucggcug

SEQ ID NO: 1590300 - RNA, 13 nt, Pseudomonas putida KT2440
ucaggauugccgc

SEQ ID NO: 1590301 - RNA, 21 nt, Pseudomonas putida KT2440
ucaggcaauggcgaaccgcug

SEQ ID NO: 1590302 - RNA, 21 nt, Pseudomonas putida KT2440
ucaccugguaccccucgacgc

SEQ ID NO: 1590303 - RNA, 15 nt, Pseudomonas putida KT2440
ucaccuuguccagca

SEQ ID NO: 1590304 - RNA, 14 nt, Pseudomonas putida KT2440
ucacgcucggccag

SEQ ID NO: 1590305 - RNA, 20 nt, Pseudomonas putida KT2440
ucacacaggcugucggcaug

SEQ ID NO: 1590306 - RNA, 16 nt, Pseudomonas putida KT2440
ucacacauaucagcca

SEQ ID NO: 1590307 - RNA, 17 nt, Pseudomonas putida KT2440
ucacacauaucagccaa

SEQ ID NO: 1590308 - RNA, 13 nt, Pseudomonas putida KT2440
ucacggcgcgggu

SEQ ID NO: 1590309 - RNA, 18 nt, Pseudomonas putida KT2440
ucacggccacccauggcg

SEQ ID NO: 1590310 - RNA, 14 nt, Pseudomonas putida KT2440
ucacgcuggccauu

SEQ ID NO: 1590311 - RNA, 16 nt, Pseudomonas putida KT2440
ucacggaucgccagga

SEQ ID NO: 1590312 - RNA, 12 nt, Pseudomonas putida KT2440
ucacggucaggc

SEQ ID NO: 1590313 - RNA, 23 nt, Pseudomonas putida KT2440
ucacguuguagcccaccaccuuc

SEQ ID NO: 1590314 - RNA, 18 nt, Pseudomonas putida KT2440
ucacguuuggcagugcca

SEQ ID NO: 1590315 - RNA, 16 nt, Pseudomonas putida KT2440
ucacucaaccaccgcu

SEQ ID NO: 1590316 - RNA, 17 nt, Pseudomonas putida KT2440
ucacucaaccaccgcuc

SEQ ID NO: 1590317 - RNA, 21 nt, Pseudomonas putida KT2440
uaucguucuccagcuccuggc

SEQ ID NO: 1590318 - RNA, 14 nt, Pseudomonas putida KT2440
uaugauucgccucc

SEQ ID NO: 1590319 - RNA, 16 nt, Pseudomonas putida KT2440
uaugcagggccuuuuc

SEQ ID NO: 1590320 - RNA, 14 nt, Pseudomonas putida KT2440
uaugcagguaccag

SEQ ID NO: 1590321 - RNA, 23 nt, Pseudomonas putida KT2440
uaggguucgaugggcaugccgcg

SEQ ID NO: 1590322 - RNA, 21 nt, Pseudomonas putida KT2440
uaggggcuaaaaccgguucag

SEQ ID NO: 1590323 - RNA, 21 nt, Pseudomonas putida KT2440
uaucaggcaugccagcagcug

SEQ ID NO: 1590324 - RNA, 15 nt, Pseudomonas putida KT2440
uaucagcgccagcac

SEQ ID NO: 1590325 - RNA, 13 nt, Pseudomonas putida KT2440
ucaauauccagcc

SEQ ID NO: 1590326 - RNA, 18 nt, Pseudomonas putida KT2440
ucaauuggagcggccuug

SEQ ID NO: 1590327 - RNA, 21 nt, Pseudomonas putida KT2440
ucaauggcacccucaccaacu

SEQ ID NO: 1590328 - RNA, 22 nt, Pseudomonas putida KT2440
ucaaugccccgaccaccgccuc

SEQ ID NO: 1590329 - RNA, 22 nt, Pseudomonas putida KT2440
ucaaugcccagguaucgcaccg

SEQ ID NO: 1590330 - RNA, 18 nt, Pseudomonas putida KT2440
ucaagcuccccagcaacg

SEQ ID NO: 1590331 - RNA, 18 nt, Pseudomonas putida KT2440
ucaaggucacggcuguca

SEQ ID NO: 1590332 - RNA, 15 nt, Pseudomonas putida KT2440
ucaagguuucacgcc

SEQ ID NO: 1590333 - RNA, 14 nt, Pseudomonas putida KT2440
ucaaaggcagccuc

SEQ ID NO: 1590334 - RNA, 19 nt, Pseudomonas putida KT2440
ucaaagcgguacgccgucu

SEQ ID NO: 1590335 - RNA, 22 nt, Pseudomonas putida KT2440
ucaaagcgcaaaaccaccagcc

SEQ ID NO: 1590336 - RNA, 14 nt, Pseudomonas putida KT2440
ucaaagcagacagc

SEQ ID NO: 1590337 - RNA, 16 nt, Pseudomonas putida KT2440
ucaaccaggcgcagca

SEQ ID NO: 1590338 - RNA, 21 nt, Pseudomonas putida KT2440
ucaaccaguucagcgcccgca

SEQ ID NO: 1590339 - RNA, 18 nt, Pseudomonas putida KT2440
ucaacguucccaauguca

SEQ ID NO: 1590340 - RNA, 21 nt, Pseudomonas putida KT2440
ucaaccgugguucuugccgag

SEQ ID NO: 1590341 - RNA, 19 nt, Pseudomonas putida KT2440
ucaaccuguuccggccucu

SEQ ID NO: 1590342 - RNA, 17 nt, Pseudomonas putida KT2440
ucaaccuuugcggcaca

SEQ ID NO: 1590343 - RNA, 16 nt, Pseudomonas putida KT2440
ucaacuggcaggguuc

SEQ ID NO: 1590344 - RNA, 23 nt, Pseudomonas putida KT2440
uacgcaaucucgacaagcgcauu

SEQ ID NO: 1590345 - RNA, 16 nt, Pseudomonas putida KT2440
uacgcacacgaccuug

SEQ ID NO: 1590346 - RNA, 19 nt, Pseudomonas putida KT2440
uacgaauacggucgaucuu

SEQ ID NO: 1590347 - RNA, 21 nt, Pseudomonas putida KT2440
uacgaagcucuggucgaucuu

SEQ ID NO: 1590348 - RNA, 20 nt, Pseudomonas putida KT2440
uaccagcaguuggcugccgg

SEQ ID NO: 1590349 - RNA, 13 nt, Pseudomonas putida KT2440
uaccagcaccauc

SEQ ID NO: 1590350 - RNA, 17 nt, Pseudomonas putida KT2440
uaccagacgcaggcaaa

SEQ ID NO: 1590351 - RNA, 13 nt, Pseudomonas putida KT2440
uaccagagagcug

SEQ ID NO: 1590352 - RNA, 19 nt, Pseudomonas putida KT2440
uaccagcgccccgccgcau

SEQ ID NO: 1590353 - RNA, 18 nt, Pseudomonas putida KT2440
uacgaaaaggccugcacu

SEQ ID NO: 1590354 - RNA, 13 nt, Pseudomonas putida KT2440
uacgaacgccagu

SEQ ID NO: 1590355 - RNA, 20 nt, Pseudomonas putida KT2440
uacgaacggguuggcauggc

SEQ ID NO: 1590356 - RNA, 16 nt, Pseudomonas putida KT2440
uacgaacuacgcgcca

SEQ ID NO: 1590357 - RNA, 16 nt, Pseudomonas putida KT2440
uacggcccaugucgau

SEQ ID NO: 1590358 - RNA, 11 nt, Pseudomonas putida KT2440
uacggccaaug

SEQ ID NO: 1590359 - RNA, 14 nt, Pseudomonas putida KT2440
uacggccgugcagg

SEQ ID NO: 1590360 - RNA, 16 nt, Pseudomonas putida KT2440
uacggcgccgacccug

SEQ ID NO: 1590361 - RNA, 16 nt, Pseudomonas putida KT2440
uacgggcaaccgcauc

SEQ ID NO: 1590362 - RNA, 18 nt, Pseudomonas putida KT2440
uacgggucgugcgcgauc

SEQ ID NO: 1590363 - RNA, 20 nt, Pseudomonas putida KT2440
uacgcgccauccgccacauc

SEQ ID NO: 1590364 - RNA, 18 nt, Pseudomonas putida KT2440
uacgcgccugcaccuggc

SEQ ID NO: 1590365 - RNA, 20 nt, Pseudomonas putida KT2440
uacgcgagccaccgucgaac

SEQ ID NO: 1590366 - RNA, 20 nt, Pseudomonas putida KT2440
uacugcagaacauggccgag

SEQ ID NO: 1590367 - RNA, 13 nt, Pseudomonas putida KT2440
uacugacugacgu

SEQ ID NO: 1590368 - RNA, 15 nt, Pseudomonas putida KT2440
uacucuucgcgggcu

SEQ ID NO: 1590369 - RNA, 16 nt, Pseudomonas putida KT2440
uacgguugcagcacac

SEQ ID NO: 1590370 - RNA, 17 nt, Pseudomonas putida KT2440
uacguaagucaggccga

SEQ ID NO: 1590371 - RNA, 16 nt, Pseudomonas putida KT2440
uacuugcaggugcagg

SEQ ID NO: 1590372 - RNA, 13 nt, Pseudomonas putida KT2440
uagaccaccagcg

SEQ ID NO: 1590373 - RNA, 15 nt, Pseudomonas putida KT2440
uagccgugcggccaa

SEQ ID NO: 1590374 - RNA, 14 nt, Pseudomonas putida KT2440
uagccuucagcggc

SEQ ID NO: 1590375 - RNA, 20 nt, Pseudomonas putida KT2440
uagcaccgguaccgcucugc

SEQ ID NO: 1590376 - RNA, 23 nt, Pseudomonas putida KT2440
uagcggcagcgacgauaccggcg

SEQ ID NO: 1590377 - RNA, 15 nt, Pseudomonas putida KT2440
uagcgcucgcgcagg

SEQ ID NO: 1590378 - RNA, 14 nt, Pseudomonas putida KT2440
uagcgcuugaaguu

SEQ ID NO: 1590379 - RNA, 14 nt, Pseudomonas putida KT2440
uagcgcuucagcuc

SEQ ID NO: 1590380 - RNA, 22 nt, Pseudomonas putida KT2440
aaguugcaggcaucgaacgccg

SEQ ID NO: 1590381 - RNA, 17 nt, Pseudomonas putida KT2440
uaggcuugcgcugaagg

SEQ ID NO: 1590382 - RNA, 20 nt, Pseudomonas putida KT2440
uaggcgcggguuuacccgcg

SEQ ID NO: 1590383 - RNA, 21 nt, Pseudomonas putida KT2440
uaggcgcggguuuacccgcga

SEQ ID NO: 1590384 - RNA, 19 nt, Pseudomonas putida KT2440
uaggccugcgaaaggcgcu

SEQ ID NO: 1590385 - RNA, 21 nt, Pseudomonas putida KT2440
uaggcgcaacucagcgcagcu

SEQ ID NO: 1590386 - RNA, 19 nt, Pseudomonas putida KT2440
uaggcgaacuuuucgccac

SEQ ID NO: 1590387 - RNA, 18 nt, Pseudomonas putida KT2440
uaggccgucagcagcagg

SEQ ID NO: 1590388 - RNA, 15 nt, Pseudomonas putida KT2440
uaggcauucggugug

SEQ ID NO: 1590389 - RNA, 22 nt, Pseudomonas putida KT2440
uaggccaagguugccaccagca

SEQ ID NO: 1590390 - RNA, 22 nt, Pseudomonas putida KT2440
uaggccgcagccaugccgccga

SEQ ID NO: 1590391 - RNA, 16 nt, Pseudomonas putida KT2440
uaggaauuucggcguu

SEQ ID NO: 1590392 - RNA, 12 nt, Pseudomonas putida KT2440
uaggagcgggcu

SEQ ID NO: 1590393 - RNA, 20 nt, Pseudomonas putida KT2440
uaggagcgggcuuacccgcg

SEQ ID NO: 1590394 - RNA, 22 nt, Pseudomonas putida KT2440
uaggagcgggcuuacccgcgaa

SEQ ID NO: 1590395 - RNA, 20 nt, Pseudomonas putida KT2440
uaggagcgggcuugcccgcg

SEQ ID NO: 1590396 - RNA, 22 nt, Pseudomonas putida KT2440
uaggagcgggcuugcccgcgaa

SEQ ID NO: 1590397 - RNA, 21 nt, Pseudomonas putida KT2440
uaggagcggguucacccgcga

SEQ ID NO: 1590398 - RNA, 22 nt, Pseudomonas putida KT2440
uaggagcggguucacccgcgaa

SEQ ID NO: 1590399 - RNA, 20 nt, Pseudomonas putida KT2440
uaggagcggguuuacccgcg

SEQ ID NO: 1590400 - RNA, 22 nt, Pseudomonas putida KT2440
uaggagcggguuuacccgcgaa

SEQ ID NO: 1590401 - RNA, 22 nt, Pseudomonas putida KT2440
uaggagcugauucagcacaccg

SEQ ID NO: 1590402 - RNA, 15 nt, Pseudomonas putida KT2440
uaggacugcuucagg

SEQ ID NO: 1590403 - RNA, 17 nt, Pseudomonas putida KT2440
uaggacugcuucaggcc

SEQ ID NO: 1590404 - RNA, 20 nt, Pseudomonas putida KT2440
uaggccaccguugcgcucga

SEQ ID NO: 1590405 - RNA, 20 nt, Pseudomonas putida KT2440
uaggcacggucgguagccug

SEQ ID NO: 1590406 - RNA, 21 nt, Pseudomonas putida KT2440
uaggaucggguuuacccgcga

SEQ ID NO: 1590407 - RNA, 19 nt, Pseudomonas putida KT2440
uaggcaaacagcucgacaa

SEQ ID NO: 1590408 - RNA, 15 nt, Pseudomonas putida KT2440
ucggccucagccggc

SEQ ID NO: 1590409 - RNA, 16 nt, Pseudomonas putida KT2440
ucggccucagccggcu

SEQ ID NO: 1590410 - RNA, 13 nt, Pseudomonas putida KT2440
ucggccugcccgg

SEQ ID NO: 1590411 - RNA, 12 nt, Pseudomonas putida KT2440
ucggccugcgcu

SEQ ID NO: 1590412 - RNA, 21 nt, Pseudomonas putida KT2440
ucggccugcgcuccagcagcu

SEQ ID NO: 1590413 - RNA, 13 nt, Pseudomonas putida KT2440
ucggcgaucagcu

SEQ ID NO: 1590414 - RNA, 12 nt, Pseudomonas putida KT2440
ucggcgaucagc

SEQ ID NO: 1590415 - RNA, 16 nt, Pseudomonas putida KT2440
ucggcgucguggccuu

SEQ ID NO: 1590416 - RNA, 19 nt, Pseudomonas putida KT2440
ucggcgucguggccuucgc

SEQ ID NO: 1590417 - RNA, 14 nt, Pseudomonas putida KT2440
ucggcgucagccgc

SEQ ID NO: 1590418 - RNA, 18 nt, Pseudomonas putida KT2440
ucggcuccagcgcacgca

SEQ ID NO: 1590419 - RNA, 21 nt, Pseudomonas putida KT2440
ucggcuacgccgccgcuggcg

SEQ ID NO: 1590420 - RNA, 19 nt, Pseudomonas putida KT2440
ucggcgucgcuucaucggc

SEQ ID NO: 1590421 - RNA, 16 nt, Pseudomonas putida KT2440
ucggcgugguccagcg

SEQ ID NO: 1590422 - RNA, 19 nt, Pseudomonas putida KT2440
ucggcguggaacaacggcu

SEQ ID NO: 1590423 - RNA, 17 nt, Pseudomonas putida KT2440
ucggcguauggcuucac

SEQ ID NO: 1590424 - RNA, 20 nt, Pseudomonas putida KT2440
ucggcguauggcuucacggc

SEQ ID NO: 1590425 - RNA, 21 nt, Pseudomonas putida KT2440
ucggccaugaucucgcccaug

SEQ ID NO: 1590426 - RNA, 15 nt, Pseudomonas putida KT2440
ucggccauggccgag

SEQ ID NO: 1590427 - RNA, 13 nt, Pseudomonas putida KT2440
ucggccgcuucuu

SEQ ID NO: 1590428 - RNA, 22 nt, Pseudomonas putida KT2440
ucggcaaacagguucucggcac

SEQ ID NO: 1590429 - RNA, 16 nt, Pseudomonas putida KT2440
ucggcagcgaucagcg

SEQ ID NO: 1590430 - RNA, 19 nt, Pseudomonas putida KT2440
ucggcaacauucaccagcc

SEQ ID NO: 1590431 - RNA, 20 nt, Pseudomonas putida KT2440
ucggcagccaugcugucgau

SEQ ID NO: 1590432 - RNA, 21 nt, Pseudomonas putida KT2440
ucggcaguagagcccccagca

SEQ ID NO: 1590433 - RNA, 13 nt, Pseudomonas putida KT2440
ucggcaucgacga

SEQ ID NO: 1590434 - RNA, 19 nt, Pseudomonas putida KT2440
ucggcauccucaagcugca

SEQ ID NO: 1590435 - RNA, 15 nt, Pseudomonas putida KT2440
ucggcaucgaacagc

SEQ ID NO: 1590436 - RNA, 17 nt, Pseudomonas putida KT2440
ucggcaucgaacagcuu

SEQ ID NO: 1590437 - RNA, 23 nt, Pseudomonas putida KT2440
ucggcaguuugccgaugaucgaa

SEQ ID NO: 1590438 - RNA, 21 nt, Pseudomonas putida KT2440
ucgcgggcacgcccgcuccca

SEQ ID NO: 1590439 - RNA, 17 nt, Pseudomonas putida KT2440
ucgcgggcaaacccgcg

SEQ ID NO: 1590440 - RNA, 18 nt, Pseudomonas putida KT2440
ucgcgggcaaacccgcgc

SEQ ID NO: 1590441 - RNA, 21 nt, Pseudomonas putida KT2440
ucgcgggcaagcccgcuccca

SEQ ID NO: 1590442 - RNA, 18 nt, Pseudomonas putida KT2440
ucgcgggcgugcccgcga

SEQ ID NO: 1590443 - RNA, 21 nt, Pseudomonas putida KT2440
ucgcgggcgcgcccgcuccca

SEQ ID NO: 1590444 - RNA, 17 nt, Pseudomonas putida KT2440
ucgcugucaccgguauc

SEQ ID NO: 1590445 - RNA, 22 nt, Pseudomonas putida KT2440
ucgcugagggaaaacucgguca

SEQ ID NO: 1590446 - RNA, 18 nt, Pseudomonas putida KT2440
ucgcugacuuccagcagc

SEQ ID NO: 1590447 - RNA, 16 nt, Pseudomonas putida KT2440
ucgcugcccaacgccu

SEQ ID NO: 1590448 - RNA, 17 nt, Pseudomonas putida KT2440
ucgcugcccaacgccug

SEQ ID NO: 1590449 - RNA, 18 nt, Pseudomonas putida KT2440
ucgcugcccaacgccuga

SEQ ID NO: 1590450 - RNA, 18 nt, Pseudomonas putida KT2440
ucggacagggucagcggg

SEQ ID NO: 1590451 - RNA, 22 nt, Pseudomonas putida KT2440
ucggauccaauguuagcccgac

SEQ ID NO: 1590452 - RNA, 20 nt, Pseudomonas putida KT2440
ucgcugugcaacagcgccug

SEQ ID NO: 1590453 - RNA, 17 nt, Pseudomonas putida KT2440
ucgcugucguccagcuc

SEQ ID NO: 1590454 - RNA, 20 nt, Pseudomonas putida KT2440
ucgcugucguccagcucgcg

SEQ ID NO: 1590455 - RNA, 22 nt, Pseudomonas putida KT2440
ucgcugugcggcguauacccgg

SEQ ID NO: 1590456 - RNA, 20 nt, Pseudomonas putida KT2440
ucgcgcugccaggccggguc

SEQ ID NO: 1590457 - RNA, 15 nt, Pseudomonas putida KT2440
ucgcgcucugcgccu

SEQ ID NO: 1590458 - RNA, 22 nt, Pseudomonas putida KT2440
ucgcgcucgaacaacgccucgg

SEQ ID NO: 1590459 - RNA, 17 nt, Pseudomonas putida KT2440
ucgcgcuaaaggccgcu

SEQ ID NO: 1590460 - RNA, 19 nt, Pseudomonas putida KT2440
ucgcgcuugcgguccugca

SEQ ID NO: 1590461 - RNA, 22 nt, Pseudomonas putida KT2440
ucgcgcuugcgguccugcacca

SEQ ID NO: 1590462 - RNA, 15 nt, Pseudomonas putida KT2440
ucgcgcuuggcaccg

SEQ ID NO: 1590463 - RNA, 18 nt, Pseudomonas putida KT2440
ucgcggaagauacccgcc

SEQ ID NO: 1590464 - RNA, 15 nt, Pseudomonas putida KT2440
ucgcggaacucggcg

SEQ ID NO: 1590465 - RNA, 22 nt, Pseudomonas putida KT2440
ucgcggcaaagaucgcccagcu

SEQ ID NO: 1590466 - RNA, 20 nt, Pseudomonas putida KT2440
ucgcggcaagcccgcuccua

SEQ ID NO: 1590467 - RNA, 20 nt, Pseudomonas putida KT2440
ucgcggcggcuaagcgccag

SEQ ID NO: 1590468 - RNA, 18 nt, Pseudomonas putida KT2440
ucgcggcguugucagccu

SEQ ID NO: 1590469 - RNA, 15 nt, Pseudomonas putida KT2440
ucgcggcgcaccgcu

SEQ ID NO: 1590470 - RNA, 21 nt, Pseudomonas putida KT2440
ucgcggcgcaccgcuugcgca

SEQ ID NO: 1590471 - RNA, 18 nt, Pseudomonas putida KT2440
ucgcgagugucgaugucg

SEQ ID NO: 1590472 - RNA, 20 nt, Pseudomonas putida KT2440
ucgcgagccagaucauggcg

SEQ ID NO: 1590473 - RNA, 19 nt, Pseudomonas putida KT2440
ucgccggugugcauccagc

SEQ ID NO: 1590474 - RNA, 20 nt, Pseudomonas putida KT2440
ucgccggugugcauccagcc

SEQ ID NO: 1590475 - RNA, 17 nt, Pseudomonas putida KT2440
ucgcgccuucgcuggcg

SEQ ID NO: 1590476 - RNA, 19 nt, Pseudomonas putida KT2440
ucgcgccuucgcuggcgac

SEQ ID NO: 1590477 - RNA, 20 nt, Pseudomonas putida KT2440
ucgcgcagguuguucggcag

SEQ ID NO: 1590478 - RNA, 14 nt, Pseudomonas putida KT2440
ucgcgcauccagcc

SEQ ID NO: 1590479 - RNA, 21 nt, Pseudomonas putida KT2440
ucgcgcaggcggucgauacug

SEQ ID NO: 1590480 - RNA, 18 nt, Pseudomonas putida KT2440
ucgccgccgucgggugcg

SEQ ID NO: 1590481 - RNA, 23 nt, Pseudomonas putida KT2440
ucgccgccacccaccacggccug

SEQ ID NO: 1590482 - RNA, 16 nt, Pseudomonas putida KT2440
ucgccgccacgaucga

SEQ ID NO: 1590483 - RNA, 13 nt, Pseudomonas putida KT2440
ucgccgaggcguu

SEQ ID NO: 1590484 - RNA, 18 nt, Pseudomonas putida KT2440
ucgccgggcgcaccacga

SEQ ID NO: 1590485 - RNA, 12 nt, Pseudomonas putida KT2440
ucgccggccauu

SEQ ID NO: 1590486 - RNA, 21 nt, Pseudomonas putida KT2440
ucgccggcaucgccuccagcg

SEQ ID NO: 1590487 - RNA, 19 nt, Pseudomonas putida KT2440
ucgccggcaagcuggucag

SEQ ID NO: 1590488 - RNA, 21 nt, Pseudomonas putida KT2440
ucgccggcaagcuggucaggu

SEQ ID NO: 1590489 - RNA, 16 nt, Pseudomonas putida KT2440
ucgccaucgcgcaggu

SEQ ID NO: 1590490 - RNA, 21 nt, Pseudomonas putida KT2440
ucgccauaagcugucagcacc

SEQ ID NO: 1590491 - RNA, 22 nt, Pseudomonas putida KT2440
ucgccauaagcugucagcaccu

SEQ ID NO: 1590492 - RNA, 17 nt, Pseudomonas putida KT2440
ucgcccaggccgccgau

SEQ ID NO: 1590493 - RNA, 15 nt, Pseudomonas putida KT2440
ucgcccagcgcucgu

SEQ ID NO: 1590494 - RNA, 23 nt, Pseudomonas putida KT2440
ucgcagagggccgcgcaggcggc

SEQ ID NO: 1590495 - RNA, 19 nt, Pseudomonas putida KT2440
ucgccaggccuucaucggc

SEQ ID NO: 1590496 - RNA, 20 nt, Pseudomonas putida KT2440
ucgccaggccuucaucggcc

SEQ ID NO: 1590497 - RNA, 22 nt, Pseudomonas putida KT2440
ucgccaggcuucagaucacccu

SEQ ID NO: 1590498 - RNA, 18 nt, Pseudomonas putida KT2440
ucgccaggugcucagcca

SEQ ID NO: 1590499 - RNA, 19 nt, Pseudomonas putida KT2440
ucgccaggugcucagccac

SEQ ID NO: 1590500 - RNA, 20 nt, Pseudomonas putida KT2440
ucgccagguggaagcgcgca

SEQ ID NO: 1590501 - RNA, 13 nt, Pseudomonas putida KT2440
ucgcccgccucgc

SEQ ID NO: 1590502 - RNA, 19 nt, Pseudomonas putida KT2440
ucgcccgguuuggccugac

SEQ ID NO: 1590503 - RNA, 17 nt, Pseudomonas putida KT2440
ucgcccuugucagccgc

SEQ ID NO: 1590504 - RNA, 21 nt, Pseudomonas putida KT2440
ucgcccuuugguacugcgccg

SEQ ID NO: 1590505 - RNA, 18 nt, Pseudomonas putida KT2440
ucgccgaacgggccacca

SEQ ID NO: 1590506 - RNA, 18 nt, Pseudomonas putida KT2440
ucgaccgucgcuggacgc

SEQ ID NO: 1590507 - RNA, 19 nt, Pseudomonas putida KT2440
ucgaccugccacugcgcua

SEQ ID NO: 1590508 - RNA, 18 nt, Pseudomonas putida KT2440
ucgaccugccagucgcac

SEQ ID NO: 1590509 - RNA, 14 nt, Pseudomonas putida KT2440
ucgaccucgaucuc

SEQ ID NO: 1590510 - RNA, 15 nt, Pseudomonas putida KT2440
ucgacgccuuggcgc

SEQ ID NO: 1590511 - RNA, 20 nt, Pseudomonas putida KT2440
ucgacgaacacgguaccgaa

SEQ ID NO: 1590512 - RNA, 14 nt, Pseudomonas putida KT2440
ucgaccuggcucuu

SEQ ID NO: 1590513 - RNA, 19 nt, Pseudomonas putida KT2440
ucgacauacagguucgggu

SEQ ID NO: 1590514 - RNA, 17 nt, Pseudomonas putida KT2440
ucgacagugaauuccuu

SEQ ID NO: 1590515 - RNA, 12 nt, Pseudomonas putida KT2440
ucgacaguucaa

SEQ ID NO: 1590516 - RNA, 20 nt, Pseudomonas putida KT2440
ucgacccccuugccagcaug

SEQ ID NO: 1590517 - RNA, 13 nt, Pseudomonas putida KT2440
ucgacccuggcau

SEQ ID NO: 1590518 - RNA, 19 nt, Pseudomonas putida KT2440
ucgacaaccccagcccgaa

SEQ ID NO: 1590519 - RNA, 12 nt, Pseudomonas putida KT2440
ucgacaaugucu

SEQ ID NO: 1590520 - RNA, 13 nt, Pseudomonas putida KT2440
ucgacacccagca

SEQ ID NO: 1590521 - RNA, 16 nt, Pseudomonas putida KT2440
ucgaagauauccgccu

SEQ ID NO: 1590522 - RNA, 18 nt, Pseudomonas putida KT2440
ucgaaugguuuucggcgg

SEQ ID NO: 1590523 - RNA, 19 nt, Pseudomonas putida KT2440
ucgaacugaugaccggccu

SEQ ID NO: 1590524 - RNA, 20 nt, Pseudomonas putida KT2440
ucgaacucuuccagcucgcu

SEQ ID NO: 1590525 - RNA, 16 nt, Pseudomonas putida KT2440
ucgaacuucuccagcg

SEQ ID NO: 1590526 - RNA, 23 nt, Pseudomonas putida KT2440
ucgaacaacuugugcaucaaguc

SEQ ID NO: 1590527 - RNA, 14 nt, Pseudomonas putida KT2440
ucgaacacggcgug

SEQ ID NO: 1590528 - RNA, 16 nt, Pseudomonas putida KT2440
uccucgcccaccagcu

SEQ ID NO: 1590529 - RNA, 13 nt, Pseudomonas putida KT2440
uccucgcgggcaa

SEQ ID NO: 1590530 - RNA, 20 nt, Pseudomonas putida KT2440
uccucgcgggcaaacccgcg

SEQ ID NO: 1590531 - RNA, 23 nt, Pseudomonas putida KT2440
uccugugccgcuuuggcagcagc

SEQ ID NO: 1590532 - RNA, 18 nt, Pseudomonas putida KT2440
uccuguggaagcgggcgu

SEQ ID NO: 1590533 - RNA, 19 nt, Pseudomonas putida KT2440
uccugugggagcggccuug

SEQ ID NO: 1590534 - RNA, 17 nt, Pseudomonas putida KT2440
uccugugggagcgggcg

SEQ ID NO: 1590535 - RNA, 13 nt, Pseudomonas putida KT2440
uccucggccaugc

SEQ ID NO: 1590536 - RNA, 18 nt, Pseudomonas putida KT2440
uccucggccaggcccacc

SEQ ID NO: 1590537 - RNA, 19 nt, Pseudomonas putida KT2440
uccuugaagaacaccugca

SEQ ID NO: 1590538 - RNA, 19 nt, Pseudomonas putida KT2440
ucgaaauacaggcgcgugu

SEQ ID NO: 1590539 - RNA, 21 nt, Pseudomonas putida KT2440
ucgcaccacguccggccagca

SEQ ID NO: 1590540 - RNA, 19 nt, Pseudomonas putida KT2440
ucgauuucgccaucgcccg

SEQ ID NO: 1590541 - RNA, 19 nt, Pseudomonas putida KT2440
ucgauguaggcagcugccu

SEQ ID NO: 1590542 - RNA, 22 nt, Pseudomonas putida KT2440
ucgauguaggcagcugccuugg

SEQ ID NO: 1590543 - RNA, 11 nt, Pseudomonas putida KT2440
ucgaugcccgu

SEQ ID NO: 1590544 - RNA, 22 nt, Pseudomonas putida KT2440
ucgaugcacguaccuggcugca

SEQ ID NO: 1590545 - RNA, 18 nt, Pseudomonas putida KT2440
ucgaugcaauccgccaca

SEQ ID NO: 1590546 - RNA, 16 nt, Pseudomonas putida KT2440
ucgaugaugcgugccu

SEQ ID NO: 1590547 - RNA, 14 nt, Pseudomonas putida KT2440
ucgaugauggcugc

SEQ ID NO: 1590548 - RNA, 17 nt, Pseudomonas putida KT2440
ucgaugccuacugcugg

SEQ ID NO: 1590549 - RNA, 21 nt, Pseudomonas putida KT2440
ucgaugggcaugccgcgcacu

SEQ ID NO: 1590550 - RNA, 14 nt, Pseudomonas putida KT2440
ucgaggaugcggcu

SEQ ID NO: 1590551 - RNA, 19 nt, Pseudomonas putida KT2440
ucgaggauuuucaccuucg

SEQ ID NO: 1590552 - RNA, 21 nt, Pseudomonas putida KT2440
ucgagcagcuuauugcgcagg

SEQ ID NO: 1590553 - RNA, 16 nt, Pseudomonas putida KT2440
uccgugcaccgcucag

SEQ ID NO: 1590554 - RNA, 21 nt, Pseudomonas putida KT2440
uccuacauggaucgcauugcc

SEQ ID NO: 1590555 - RNA, 15 nt, Pseudomonas putida KT2440
uccuacaaagcggcg

SEQ ID NO: 1590556 - RNA, 14 nt, Pseudomonas putida KT2440
uccuacaacgaucu

SEQ ID NO: 1590557 - RNA, 15 nt, Pseudomonas putida KT2440
uccuacgacggccug

SEQ ID NO: 1590558 - RNA, 23 nt, Pseudomonas putida KT2440
uccuacggaaucugcaccgccuu

SEQ ID NO: 1590559 - RNA, 14 nt, Pseudomonas putida KT2440
uccuacgggcaacc

SEQ ID NO: 1590560 - RNA, 18 nt, Pseudomonas putida KT2440
uccggcagcucaccggca

SEQ ID NO: 1590561 - RNA, 17 nt, Pseudomonas putida KT2440
uccggcgacagcucaag

SEQ ID NO: 1590562 - RNA, 19 nt, Pseudomonas putida KT2440
uccggcaugugcacuggca

SEQ ID NO: 1590563 - RNA, 21 nt, Pseudomonas putida KT2440
uccgcgagggcaucagcgcac

SEQ ID NO: 1590564 - RNA, 23 nt, Pseudomonas putida KT2440
uccgcgcaagcgguugcccgcug

SEQ ID NO: 1590565 - RNA, 13 nt, Pseudomonas putida KT2440
uccgccgggaugg

SEQ ID NO: 1590566 - RNA, 20 nt, Pseudomonas putida KT2440
uccgccgcgcugaccaaggc

SEQ ID NO: 1590567 - RNA, 22 nt, Pseudomonas putida KT2440
uccgcgccagcggccagcgccu

SEQ ID NO: 1590568 - RNA, 23 nt, Pseudomonas putida KT2440
uccgaccggucauacauccagcu

SEQ ID NO: 1590569 - RNA, 15 nt, Pseudomonas putida KT2440
ucccggucaccugca

SEQ ID NO: 1590570 - RNA, 15 nt, Pseudomonas putida KT2440
uccgaccccagcaug

SEQ ID NO: 1590571 - RNA, 20 nt, Pseudomonas putida KT2440
uccgacagcuugcccagcug

SEQ ID NO: 1590572 - RNA, 19 nt, Pseudomonas putida KT2440
uccgaggucagcaccagcu

SEQ ID NO: 1590573 - RNA, 20 nt, Pseudomonas putida KT2440
uccgauccgguggccuugcc

SEQ ID NO: 1590574 - RNA, 19 nt, Pseudomonas putida KT2440
uccgcaacaugaagccaug

SEQ ID NO: 1590575 - RNA, 13 nt, Pseudomonas putida KT2440
uccgccaccagau

SEQ ID NO: 1590576 - RNA, 16 nt, Pseudomonas putida KT2440
uccgccaacaccaccu

SEQ ID NO: 1590577 - RNA, 15 nt, Pseudomonas putida KT2440
uccgccaagcacgca

SEQ ID NO: 1590578 - RNA, 20 nt, Pseudomonas putida KT2440
uccgccaaaccccagcaagg

SEQ ID NO: 1590579 - RNA, 16 nt, Pseudomonas putida KT2440
ucccgggaucaccgca

SEQ ID NO: 1590580 - RNA, 19 nt, Pseudomonas putida KT2440
ucccggcuacgcacccgca

SEQ ID NO: 1590581 - RNA, 13 nt, Pseudomonas putida KT2440
ucccgcaaguccg

SEQ ID NO: 1590582 - RNA, 18 nt, Pseudomonas putida KT2440
ucccgccauauucgcggc

SEQ ID NO: 1590583 - RNA, 21 nt, Pseudomonas putida KT2440
ucccgccccaaaggaagucaa

SEQ ID NO: 1590584 - RNA, 15 nt, Pseudomonas putida KT2440
ucccacaaaggccgc

SEQ ID NO: 1590585 - RNA, 23 nt, Pseudomonas putida KT2440
ucccaaagauaccccugcgccug

SEQ ID NO: 1590586 - RNA, 20 nt, Pseudomonas putida KT2440
ucccacagguaagucacagg

SEQ ID NO: 1590587 - RNA, 16 nt, Pseudomonas putida KT2440
ucccacagguccagcg

SEQ ID NO: 1590588 - RNA, 21 nt, Pseudomonas putida KT2440
ucccacagguuuagcgcuggc

SEQ ID NO: 1590589 - RNA, 18 nt, Pseudomonas putida KT2440
ugauuggcaucgcugccc

SEQ ID NO: 1590590 - RNA, 23 nt, Pseudomonas putida KT2440
ugauguugaagaagaucaggucg

SEQ ID NO: 1590591 - RNA, 22 nt, Pseudomonas putida KT2440
ugaugucuacccacaagcgcag

SEQ ID NO: 1590592 - RNA, 12 nt, Pseudomonas putida KT2440
ugauccggcacu

SEQ ID NO: 1590593 - RNA, 19 nt, Pseudomonas putida KT2440
ugaugccccugcgccgcca

SEQ ID NO: 1590594 - RNA, 13 nt, Pseudomonas putida KT2440
ugaugaucugcuc

SEQ ID NO: 1590595 - RNA, 20 nt, Pseudomonas putida KT2440
ugaucauccccagcauggcc

SEQ ID NO: 1590596 - RNA, 19 nt, Pseudomonas putida KT2440
ugaucagguuacuggccaa

SEQ ID NO: 1590597 - RNA, 20 nt, Pseudomonas putida KT2440
ugaucagcugccacucuuca

SEQ ID NO: 1590598 - RNA, 17 nt, Pseudomonas putida KT2440
ugaucaggaaggcgucg

SEQ ID NO: 1590599 - RNA, 21 nt, Pseudomonas putida KT2440
ugcaccggcaguucgacgccu

SEQ ID NO: 1590600 - RNA, 23 nt, Pseudomonas putida KT2440
ugcaccggccucuucgcgggcaa

SEQ ID NO: 1590601 - RNA, 23 nt, Pseudomonas putida KT2440
ugcacccgugcagggcugcgaua

SEQ ID NO: 1590602 - RNA, 18 nt, Pseudomonas putida KT2440
ugcacagggcggccaagg

SEQ ID NO: 1590603 - RNA, 17 nt, Pseudomonas putida KT2440
ugcacagguaucgccgc

SEQ ID NO: 1590604 - RNA, 11 nt, Pseudomonas putida KT2440
ugcacccgcgc

SEQ ID NO: 1590605 - RNA, 22 nt, Pseudomonas putida KT2440
ugcacauacaaaaugugccggc

SEQ ID NO: 1590606 - RNA, 19 nt, Pseudomonas putida KT2440
ugcacagcgagcagccugg

SEQ ID NO: 1590607 - RNA, 21 nt, Pseudomonas putida KT2440
ugcacagcucccucguaggag

SEQ ID NO: 1590608 - RNA, 23 nt, Pseudomonas putida KT2440
ugcacaggccagccccagcggca

SEQ ID NO: 1590609 - RNA, 23 nt, Pseudomonas putida KT2440
ugcaauggucauugaaggccagu

SEQ ID NO: 1590610 - RNA, 13 nt, Pseudomonas putida KT2440
ugcaauccgccac

SEQ ID NO: 1590611 - RNA, 22 nt, Pseudomonas putida KT2440
ugcaauugcaguugaaugccgc

SEQ ID NO: 1590612 - RNA, 15 nt, Pseudomonas putida KT2440
ugcacaaucagcucg

SEQ ID NO: 1590613 - RNA, 18 nt, Pseudomonas putida KT2440
ugcacaacgcgcgggcaa

SEQ ID NO: 1590614 - RNA, 19 nt, Pseudomonas putida KT2440
ugcaacccggccuuggccg

SEQ ID NO: 1590615 - RNA, 14 nt, Pseudomonas putida KT2440
ugcaaccgacgcga

SEQ ID NO: 1590616 - RNA, 18 nt, Pseudomonas putida KT2440
ugcaacagaaaaugcccg

SEQ ID NO: 1590617 - RNA, 14 nt, Pseudomonas putida KT2440
ugcaaggaucacca

SEQ ID NO: 1590618 - RNA, 19 nt, Pseudomonas putida KT2440
ugcaagcgcaccugcaggu

SEQ ID NO: 1590619 - RNA, 14 nt, Pseudomonas putida KT2440
ugcaaauacggcca

SEQ ID NO: 1590620 - RNA, 12 nt, Pseudomonas putida KT2440
ugcaaagcgccc

SEQ ID NO: 1590621 - RNA, 20 nt, Pseudomonas putida KT2440
ugcaaaaauguuucagcgac

SEQ ID NO: 1590622 - RNA, 16 nt, Pseudomonas putida KT2440
ugagccuggccggugu

SEQ ID NO: 1590623 - RNA, 20 nt, Pseudomonas putida KT2440
ugagccguccggcaaucugc

SEQ ID NO: 1590624 - RNA, 13 nt, Pseudomonas putida KT2440
ugagccaguucac

SEQ ID NO: 1590625 - RNA, 18 nt, Pseudomonas putida KT2440
ugagggccucuucgcggg

SEQ ID NO: 1590626 - RNA, 20 nt, Pseudomonas putida KT2440
ugagggccucuucgcgggua

SEQ ID NO: 1590627 - RNA, 12 nt, Pseudomonas putida KT2440
ugagggucagcu

SEQ ID NO: 1590628 - RNA, 20 nt, Pseudomonas putida KT2440
ugagcuguuucaugcugcga

SEQ ID NO: 1590629 - RNA, 13 nt, Pseudomonas putida KT2440
ugagcggcucgcg

SEQ ID NO: 1590630 - RNA, 16 nt, Pseudomonas putida KT2440
ugagcguggcaaaccc

SEQ ID NO: 1590631 - RNA, 13 nt, Pseudomonas putida KT2440
ugagugcaugcug

SEQ ID NO: 1590632 - RNA, 14 nt, Pseudomonas putida KT2440
ugaucagcgccugc

SEQ ID NO: 1590633 - RNA, 17 nt, Pseudomonas putida KT2440
ugaucagcaaugccagu

SEQ ID NO: 1590634 - RNA, 14 nt, Pseudomonas putida KT2440
ugagucuguggaua

SEQ ID NO: 1590635 - RNA, 14 nt, Pseudomonas putida KT2440
ugaccauuuccggg

SEQ ID NO: 1590636 - RNA, 15 nt, Pseudomonas putida KT2440
ugaccaucagccugu

SEQ ID NO: 1590637 - RNA, 13 nt, Pseudomonas putida KT2440
ugacccgcuccca

SEQ ID NO: 1590638 - RNA, 16 nt, Pseudomonas putida KT2440
ugacccaguucgcgga

SEQ ID NO: 1590639 - RNA, 14 nt, Pseudomonas putida KT2440
ugaccccgccgcug

SEQ ID NO: 1590640 - RNA, 19 nt, Pseudomonas putida KT2440
ugagcacgaaacugcgcug

SEQ ID NO: 1590641 - RNA, 20 nt, Pseudomonas putida KT2440
ugagcauggcaaacagcacc

SEQ ID NO: 1590642 - RNA, 22 nt, Pseudomonas putida KT2440
ugagcacccccgguucacucga

SEQ ID NO: 1590643 - RNA, 22 nt, Pseudomonas putida KT2440
ugagcaagacgggaucaccgug

SEQ ID NO: 1590644 - RNA, 14 nt, Pseudomonas putida KT2440
ugacuuccagguag

SEQ ID NO: 1590645 - RNA, 14 nt, Pseudomonas putida KT2440
ugacuucgcugccc

SEQ ID NO: 1590646 - RNA, 20 nt, Pseudomonas putida KT2440
ugagaccugcaaugccgcug

SEQ ID NO: 1590647 - RNA, 17 nt, Pseudomonas putida KT2440
ugagaaagaucugcgug

SEQ ID NO: 1590648 - RNA, 22 nt, Pseudomonas putida KT2440
ugagaaagaucugcguggcagu

SEQ ID NO: 1590649 - RNA, 14 nt, Pseudomonas putida KT2440
ugccaggcucaggc

SEQ ID NO: 1590650 - RNA, 21 nt, Pseudomonas putida KT2440
ugccaggcuggcgcuaccccu

SEQ ID NO: 1590651 - RNA, 20 nt, Pseudomonas putida KT2440
ugccaggugauaguccagca

SEQ ID NO: 1590652 - RNA, 14 nt, Pseudomonas putida KT2440
ugccaguccuuggc

SEQ ID NO: 1590653 - RNA, 16 nt, Pseudomonas putida KT2440
ugccaguguucgaacg

SEQ ID NO: 1590654 - RNA, 16 nt, Pseudomonas putida KT2440
ugccaguucaugcagc

SEQ ID NO: 1590655 - RNA, 19 nt, Pseudomonas putida KT2440
ugccaguugaucaccgucg

SEQ ID NO: 1590656 - RNA, 14 nt, Pseudomonas putida KT2440
ugccaguaaggcuu

SEQ ID NO: 1590657 - RNA, 19 nt, Pseudomonas putida KT2440
ugccacagguacugcgcaa

SEQ ID NO: 1590658 - RNA, 17 nt, Pseudomonas putida KT2440
ugccacccaggcccuga

SEQ ID NO: 1590659 - RNA, 21 nt, Pseudomonas putida KT2440
ugccacccaggcccugacgcc

SEQ ID NO: 1590660 - RNA, 22 nt, Pseudomonas putida KT2440
ugccacccaggcccugacgcca

SEQ ID NO: 1590661 - RNA, 20 nt, Pseudomonas putida KT2440
ugccacccaugccacccaua

SEQ ID NO: 1590662 - RNA, 20 nt, Pseudomonas putida KT2440
ugccacccauucccacauca

SEQ ID NO: 1590663 - RNA, 13 nt, Pseudomonas putida KT2440
ugccaccagcauc

SEQ ID NO: 1590664 - RNA, 16 nt, Pseudomonas putida KT2440
ugccaccaucgaccug

SEQ ID NO: 1590665 - RNA, 17 nt, Pseudomonas putida KT2440
ugccacccacaggcacg

SEQ ID NO: 1590666 - RNA, 18 nt, Pseudomonas putida KT2440
ugccagcguguuccauca

SEQ ID NO: 1590667 - RNA, 21 nt, Pseudomonas putida KT2440
ugccagcguucucgcucaggu

SEQ ID NO: 1590668 - RNA, 19 nt, Pseudomonas putida KT2440
ugccagcuuggucagggca

SEQ ID NO: 1590669 - RNA, 16 nt, Pseudomonas putida KT2440
ugccaccggcgcugcg

SEQ ID NO: 1590670 - RNA, 15 nt, Pseudomonas putida KT2440
ugccauagcgcugca

SEQ ID NO: 1590671 - RNA, 14 nt, Pseudomonas putida KT2440
ugccauacagccag

SEQ ID NO: 1590672 - RNA, 13 nt, Pseudomonas putida KT2440
ugccaucagggcg

SEQ ID NO: 1590673 - RNA, 17 nt, Pseudomonas putida KT2440
ugccaucagggcgaugc

SEQ ID NO: 1590674 - RNA, 20 nt, Pseudomonas putida KT2440
ugccauagcaccagcgggcc

SEQ ID NO: 1590675 - RNA, 17 nt, Pseudomonas putida KT2440
ugcccaaguacaccggc

SEQ ID NO: 1590676 - RNA, 18 nt, Pseudomonas putida KT2440
ugcccaaguacaccggca

SEQ ID NO: 1590677 - RNA, 19 nt, Pseudomonas putida KT2440
ugcccaaguaguguucgcc

SEQ ID NO: 1590678 - RNA, 22 nt, Pseudomonas putida KT2440
ugcccaaacgccaacagcaccc

SEQ ID NO: 1590679 - RNA, 23 nt, Pseudomonas putida KT2440
ugcccaaagcccgugccgcauca

SEQ ID NO: 1590680 - RNA, 22 nt, Pseudomonas putida KT2440
ugcccacauagcgcacuugcac

SEQ ID NO: 1590681 - RNA, 14 nt, Pseudomonas putida KT2440
ugcccaaugccgug

SEQ ID NO: 1590682 - RNA, 12 nt, Pseudomonas putida KT2440
ugccccagcguc

SEQ ID NO: 1590683 - RNA, 22 nt, Pseudomonas putida KT2440
ugccccagcaucaacgcugcca

SEQ ID NO: 1590684 - RNA, 19 nt, Pseudomonas putida KT2440
ugcccccaaugggcaccgg

SEQ ID NO: 1590685 - RNA, 16 nt, Pseudomonas putida KT2440
ugccccaugcgaacug

SEQ ID NO: 1590686 - RNA, 19 nt, Pseudomonas putida KT2440
ugccccaugcgaacugcag

SEQ ID NO: 1590687 - RNA, 20 nt, Pseudomonas putida KT2440
ugccccgaccaccgccucga

SEQ ID NO: 1590688 - RNA, 17 nt, Pseudomonas putida KT2440
ugcccccgccgaagcca

SEQ ID NO: 1590689 - RNA, 18 nt, Pseudomonas putida KT2440
ugcccccgccgaagccau

SEQ ID NO: 1590690 - RNA, 23 nt, Pseudomonas putida KT2440
ugcccccgccgaagccaugagcg

SEQ ID NO: 1590691 - RNA, 14 nt, Pseudomonas putida KT2440
ugccccacucggcg

SEQ ID NO: 1590692 - RNA, 13 nt, Pseudomonas putida KT2440
ugcccauggccag

SEQ ID NO: 1590693 - RNA, 17 nt, Pseudomonas putida KT2440
ugcccauggccagcgug

SEQ ID NO: 1590694 - RNA, 22 nt, Pseudomonas putida KT2440
ugcccaccgcauugcaggccag

SEQ ID NO: 1590695 - RNA, 20 nt, Pseudomonas putida KT2440
ugcccaccgcguuggccagg

SEQ ID NO: 1590696 - RNA, 16 nt, Pseudomonas putida KT2440
ugcaggcucggccacc

SEQ ID NO: 1590697 - RNA, 19 nt, Pseudomonas putida KT2440
ugcaggcucggccaccacu

SEQ ID NO: 1590698 - RNA, 23 nt, Pseudomonas putida KT2440
ugcaggcgcagggugugcugcug

SEQ ID NO: 1590699 - RNA, 22 nt, Pseudomonas putida KT2440
ugcaggcgcggugccggcagcu

SEQ ID NO: 1590700 - RNA, 21 nt, Pseudomonas putida KT2440
ugcaggcguaacucagcaacg

SEQ ID NO: 1590701 - RNA, 18 nt, Pseudomonas putida KT2440
ugcaccuuguuacccgca

SEQ ID NO: 1590702 - RNA, 21 nt, Pseudomonas putida KT2440
ugcaccuaaccagugggagcg

SEQ ID NO: 1590703 - RNA, 19 nt, Pseudomonas putida KT2440
ugcaccucggaugccacgc

SEQ ID NO: 1590704 - RNA, 17 nt, Pseudomonas putida KT2440
ugcauccaacgcugccu

SEQ ID NO: 1590705 - RNA, 15 nt, Pseudomonas putida KT2440
ugcaucgaagcaggc

SEQ ID NO: 1590706 - RNA, 20 nt, Pseudomonas putida KT2440
ugcagguaaugcgccgcacc

SEQ ID NO: 1590707 - RNA, 19 nt, Pseudomonas putida KT2440
ugcaggucgaccugccagu

SEQ ID NO: 1590708 - RNA, 15 nt, Pseudomonas putida KT2440
ugcaggucgacgauc

SEQ ID NO: 1590709 - RNA, 18 nt, Pseudomonas putida KT2440
ugcaggucgacgaucgcc

SEQ ID NO: 1590710 - RNA, 20 nt, Pseudomonas putida KT2440
ugcagguggauguugaugcc

SEQ ID NO: 1590711 - RNA, 22 nt, Pseudomonas putida KT2440
ugcauuuucggcaaggcgaccu

SEQ ID NO: 1590712 - RNA, 20 nt, Pseudomonas putida KT2440
ugccaauaaccggcacaagc

SEQ ID NO: 1590713 - RNA, 15 nt, Pseudomonas putida KT2440
ugccaaggaucagcu

SEQ ID NO: 1590714 - RNA, 21 nt, Pseudomonas putida KT2440
ugccaaggaucagcucggcaa

SEQ ID NO: 1590715 - RNA, 23 nt, Pseudomonas putida KT2440
ugccaaggaucagcucggcaacg

SEQ ID NO: 1590716 - RNA, 21 nt, Pseudomonas putida KT2440
ugccaacagcaguugcugcug

SEQ ID NO: 1590717 - RNA, 15 nt, Pseudomonas putida KT2440
ugccaacaggcagca

SEQ ID NO: 1590718 - RNA, 13 nt, Pseudomonas putida KT2440
ugccaacgggaua

SEQ ID NO: 1590719 - RNA, 19 nt, Pseudomonas putida KT2440
ugcaucgcgcacuugccag

SEQ ID NO: 1590720 - RNA, 19 nt, Pseudomonas putida KT2440
ugcauggcauaggcuguca

SEQ ID NO: 1590721 - RNA, 17 nt, Pseudomonas putida KT2440
ugcauggcucgcagcca

SEQ ID NO: 1590722 - RNA, 15 nt, Pseudomonas putida KT2440
ugcaugggccaggga

SEQ ID NO: 1590723 - RNA, 18 nt, Pseudomonas putida KT2440
ugcaugcaagcagccacc

SEQ ID NO: 1590724 - RNA, 21 nt, Pseudomonas putida KT2440
ugcaugccaguagaagcccag

SEQ ID NO: 1590725 - RNA, 19 nt, Pseudomonas putida KT2440
ugcaugcguugcacgugca

SEQ ID NO: 1590726 - RNA, 21 nt, Pseudomonas putida KT2440
ugcaugcucaucgcggccgaa

SEQ ID NO: 1590727 - RNA, 23 nt, Pseudomonas putida KT2440
ugcccguugaggguggcaaugcu

SEQ ID NO: 1590728 - RNA, 16 nt, Pseudomonas putida KT2440
ugcccguugcgcauca

SEQ ID NO: 1590729 - RNA, 16 nt, Pseudomonas putida KT2440
ugcccgugccucgcgc

SEQ ID NO: 1590730 - RNA, 21 nt, Pseudomonas putida KT2440
ugcccgugcugucggugaagc

SEQ ID NO: 1590731 - RNA, 15 nt, Pseudomonas putida KT2440
ugcccgugguacacg

SEQ ID NO: 1590732 - RNA, 19 nt, Pseudomonas putida KT2440
ugccccuguaggaucgggu

SEQ ID NO: 1590733 - RNA, 21 nt, Pseudomonas putida KT2440
ugcccgacaccggccuugcgc

SEQ ID NO: 1590734 - RNA, 15 nt, Pseudomonas putida KT2440
ugccccgguccagca

SEQ ID NO: 1590735 - RNA, 23 nt, Pseudomonas putida KT2440
ugccccgguccagcacacugagc

SEQ ID NO: 1590736 - RNA, 13 nt, Pseudomonas putida KT2440
ugccgaagcccag

SEQ ID NO: 1590737 - RNA, 16 nt, Pseudomonas putida KT2440
ugcccucgcaugcggc

SEQ ID NO: 1590738 - RNA, 18 nt, Pseudomonas putida KT2440
ugcccucggccaccuggc

SEQ ID NO: 1590739 - RNA, 23 nt, Pseudomonas putida KT2440
ugccgauagacaaaaaaaucggc

SEQ ID NO: 1590740 - RNA, 16 nt, Pseudomonas putida KT2440
ugccgaggcgccgacg

SEQ ID NO: 1590741 - RNA, 21 nt, Pseudomonas putida KT2440
ugccgaucuucgcccugggcg

SEQ ID NO: 1590742 - RNA, 16 nt, Pseudomonas putida KT2440
ugccgaugaccugcgu

SEQ ID NO: 1590743 - RNA, 23 nt, Pseudomonas putida KT2440
ugccgaucagguugcccagcaug

SEQ ID NO: 1590744 - RNA, 14 nt, Pseudomonas putida KT2440
ugccgcaccugccu

SEQ ID NO: 1590745 - RNA, 12 nt, Pseudomonas putida KT2440
ugccgcauggca

SEQ ID NO: 1590746 - RNA, 17 nt, Pseudomonas putida KT2440
ugccgcauucgcgggug

SEQ ID NO: 1590747 - RNA, 16 nt, Pseudomonas putida KT2440
ugccgccaaccagcuc

SEQ ID NO: 1590748 - RNA, 16 nt, Pseudomonas putida KT2440
ugccgcagcaccgucg

SEQ ID NO: 1590749 - RNA, 22 nt, Pseudomonas putida KT2440
ucuaguacuuuuucagguuuac

SEQ ID NO: 1590750 - RNA, 16 nt, Pseudomonas putida KT2440
ucuccagccgcugcug

SEQ ID NO: 1590751 - RNA, 22 nt, Pseudomonas putida KT2440
ucuccagcaccgccccggccag

SEQ ID NO: 1590752 - RNA, 21 nt, Pseudomonas putida KT2440
ucuccuaugagacuagcaguc

SEQ ID NO: 1590753 - RNA, 14 nt, Pseudomonas putida KT2440
ucuccauugcgccu

SEQ ID NO: 1590754 - RNA, 22 nt, Pseudomonas putida KT2440
ucuaccugagcuucaacgcgac

SEQ ID NO: 1590755 - RNA, 16 nt, Pseudomonas putida KT2440
ucuaccaacugagcua

SEQ ID NO: 1590756 - RNA, 14 nt, Pseudomonas putida KT2440
ucguuuucgcugau

SEQ ID NO: 1590757 - RNA, 20 nt, Pseudomonas putida KT2440
ucguugaagcgguugaccgc

SEQ ID NO: 1590758 - RNA, 17 nt, Pseudomonas putida KT2440
ucguugaaguagcgggu

SEQ ID NO: 1590759 - RNA, 13 nt, Pseudomonas putida KT2440
ucguucgcgggca

SEQ ID NO: 1590760 - RNA, 18 nt, Pseudomonas putida KT2440
ucguugaccguccacacc

SEQ ID NO: 1590761 - RNA, 12 nt, Pseudomonas putida KT2440
ucguuggccagc

SEQ ID NO: 1590762 - RNA, 18 nt, Pseudomonas putida KT2440
ucgugcucacgccccuug

SEQ ID NO: 1590763 - RNA, 16 nt, Pseudomonas putida KT2440
ucgguggucaccagca

SEQ ID NO: 1590764 - RNA, 14 nt, Pseudomonas putida KT2440
ucggugcuggcgcu

SEQ ID NO: 1590765 - RNA, 22 nt, Pseudomonas putida KT2440
ucggugcuuucugcugugucgg

SEQ ID NO: 1590766 - RNA, 19 nt, Pseudomonas putida KT2440
ucgguggaaauuggccagc

SEQ ID NO: 1590767 - RNA, 19 nt, Pseudomonas putida KT2440
ucggcucuucuuucaggua

SEQ ID NO: 1590768 - RNA, 20 nt, Pseudomonas putida KT2440
ucgguaaacaauucccagcc

SEQ ID NO: 1590769 - RNA, 18 nt, Pseudomonas putida KT2440
ucgguagacuucugcgug

SEQ ID NO: 1590770 - RNA, 15 nt, Pseudomonas putida KT2440
ucgguaccuggccgu

SEQ ID NO: 1590771 - RNA, 16 nt, Pseudomonas putida KT2440
ucggugaagccgacca

SEQ ID NO: 1590772 - RNA, 18 nt, Pseudomonas putida KT2440
ucgucgagcaacuugcgc

SEQ ID NO: 1590773 - RNA, 13 nt, Pseudomonas putida KT2440
ucgucgcccaggc

SEQ ID NO: 1590774 - RNA, 21 nt, Pseudomonas putida KT2440
ucgucgaggcugucgaucaga

SEQ ID NO: 1590775 - RNA, 18 nt, Pseudomonas putida KT2440
ucgucggcaagcuugcca

SEQ ID NO: 1590776 - RNA, 23 nt, Pseudomonas putida KT2440
ucgucggcaagcuugccagcguc

SEQ ID NO: 1590777 - RNA, 23 nt, Pseudomonas putida KT2440
ucgucaccugacacauaggcagc

SEQ ID NO: 1590778 - RNA, 14 nt, Pseudomonas putida KT2440
ucguagacgaagcc

SEQ ID NO: 1590779 - RNA, 14 nt, Pseudomonas putida KT2440
ucgucaugcagcgc

SEQ ID NO: 1590780 - RNA, 15 nt, Pseudomonas putida KT2440
ucgucaugcagcgcc

SEQ ID NO: 1590781 - RNA, 12 nt, Pseudomonas putida KT2440
ucuggcugggcu

SEQ ID NO: 1590782 - RNA, 23 nt, Pseudomonas putida KT2440
ucugcucgacgaaggucuugccg

SEQ ID NO: 1590783 - RNA, 21 nt, Pseudomonas putida KT2440
ucucgaacggcgccagcagug

SEQ ID NO: 1590784 - RNA, 18 nt, Pseudomonas putida KT2440
ucuccuggguaacccgcu

SEQ ID NO: 1590785 - RNA, 19 nt, Pseudomonas putida KT2440
ucuccugugccggccucuu

SEQ ID NO: 1590786 - RNA, 16 nt, Pseudomonas putida KT2440
ucucgaccacuuccca

SEQ ID NO: 1590787 - RNA, 23 nt, Pseudomonas putida KT2440
ucugcggugggcacacaccgggu

SEQ ID NO: 1590788 - RNA, 13 nt, Pseudomonas putida KT2440
ucugcgugcaccc

SEQ ID NO: 1590789 - RNA, 22 nt, Pseudomonas putida KT2440
ucuggucgaucuucagcgcauc

SEQ ID NO: 1590790 - RNA, 23 nt, Pseudomonas putida KT2440
ucugguaauaccacauccccgcc

SEQ ID NO: 1590791 - RNA, 21 nt, Pseudomonas putida KT2440
ucuggugaaagucgaccagca

SEQ ID NO: 1590792 - RNA, 21 nt, Pseudomonas putida KT2440
ucugguugaccgagaacaggc

SEQ ID NO: 1590793 - RNA, 17 nt, Pseudomonas putida KT2440
ucugguugccgccagcc

SEQ ID NO: 1590794 - RNA, 15 nt, Pseudomonas putida KT2440
ucuguccuccugccg

SEQ ID NO: 1590795 - RNA, 16 nt, Pseudomonas putida KT2440
ucuguaucgaacaggc

SEQ ID NO: 1590796 - RNA, 22 nt, Pseudomonas putida KT2440
ucugugauuuccagcgucagca

SEQ ID NO: 1590797 - RNA, 13 nt, Pseudomonas putida KT2440
ucuugcaccgcuc

SEQ ID NO: 1590798 - RNA, 20 nt, Pseudomonas putida KT2440
ucuuccugccgcagcgcaug

SEQ ID NO: 1590799 - RNA, 16 nt, Pseudomonas putida KT2440
ucuucccccgggcuug

SEQ ID NO: 1590800 - RNA, 16 nt, Pseudomonas putida KT2440
ucuuccuggcuggcag

SEQ ID NO: 1590801 - RNA, 17 nt, Pseudomonas putida KT2440
ucuuccuggcuggcagc

SEQ ID NO: 1590802 - RNA, 22 nt, Pseudomonas putida KT2440
ucuucgacacugaucucgcgca

SEQ ID NO: 1590803 - RNA, 15 nt, Pseudomonas putida KT2440
ugaaaaggcccugca

SEQ ID NO: 1590804 - RNA, 13 nt, Pseudomonas putida KT2440
ucuugugcugcga

SEQ ID NO: 1590805 - RNA, 16 nt, Pseudomonas putida KT2440
ucuuuacgcauugccg

SEQ ID NO: 1590806 - RNA, 12 nt, Pseudomonas putida KT2440
ucuuugccuggg

SEQ ID NO: 1590807 - RNA, 15 nt, Pseudomonas putida KT2440
ugaauacagccaaug

SEQ ID NO: 1590808 - RNA, 17 nt, Pseudomonas putida KT2440
ugaagucgguggucacc

SEQ ID NO: 1590809 - RNA, 19 nt, Pseudomonas putida KT2440
ugaaucagcggcaggcugg

SEQ ID NO: 1590810 - RNA, 21 nt, Pseudomonas putida KT2440
ugaauagcaggccgcauuucg

SEQ ID NO: 1590811 - RNA, 16 nt, Pseudomonas putida KT2440
ugaaguaguccccauc

SEQ ID NO: 1590812 - RNA, 14 nt, Pseudomonas putida KT2440
ugaaguacucggca

SEQ ID NO: 1590813 - RNA, 14 nt, Pseudomonas putida KT2440
ugaaggccggcauc

SEQ ID NO: 1590814 - RNA, 22 nt, Pseudomonas putida KT2440
ugaaggcgaaugagaggcgggu

SEQ ID NO: 1590815 - RNA, 22 nt, Pseudomonas putida KT2440
ugaagcgaaaccuaaacugugg

SEQ ID NO: 1590816 - RNA, 15 nt, Pseudomonas putida KT2440
ugaaggcaggucagc

SEQ ID NO: 1590817 - RNA, 16 nt, Pseudomonas putida KT2440
ugaaggcauugcggcc

SEQ ID NO: 1590818 - RNA, 12 nt, Pseudomonas putida KT2440
ugaaggccagug

SEQ ID NO: 1590819 - RNA, 14 nt, Pseudomonas putida KT2440
ugaagcgguugacc

SEQ ID NO: 1590820 - RNA, 17 nt, Pseudomonas putida KT2440
ugaagcgguugaccgcc

SEQ ID NO: 1590821 - RNA, 22 nt, Pseudomonas putida KT2440
ugaagcgguugaccgccgccac

SEQ ID NO: 1590822 - RNA, 20 nt, Pseudomonas putida KT2440
ugaagacgcuugcgcauggc

SEQ ID NO: 1590823 - RNA, 23 nt, Pseudomonas putida KT2440
ugaagacgcuugcgcauggccgc

SEQ ID NO: 1590824 - RNA, 21 nt, Pseudomonas putida KT2440
ugaagaguggaucguggccgg

SEQ ID NO: 1590825 - RNA, 16 nt, Pseudomonas putida KT2440
ugaagcccugcugcug

SEQ ID NO: 1590826 - RNA, 21 nt, Pseudomonas putida KT2440
ugaagcaccagguuugcugcc

SEQ ID NO: 1590827 - RNA, 16 nt, Pseudomonas putida KT2440
ugaacugcaacuugcc

SEQ ID NO: 1590828 - RNA, 13 nt, Pseudomonas putida KT2440
ugaccacgaaggc

SEQ ID NO: 1590829 - RNA, 18 nt, Pseudomonas putida KT2440
ugaccacgaugcccaugg

SEQ ID NO: 1590830 - RNA, 19 nt, Pseudomonas putida KT2440
ugaccaaggaacugcgcug

SEQ ID NO: 1590831 - RNA, 19 nt, Pseudomonas putida KT2440
ugaccaggcccagcaggua

SEQ ID NO: 1590832 - RNA, 13 nt, Pseudomonas putida KT2440
ugaccagcggcag

SEQ ID NO: 1590833 - RNA, 23 nt, Pseudomonas putida KT2440
ugacaggcagucaugggccaugc

SEQ ID NO: 1590834 - RNA, 21 nt, Pseudomonas putida KT2440
ugacagcaggaacagcggcag

SEQ ID NO: 1590835 - RNA, 22 nt, Pseudomonas putida KT2440
ugacaguggcagguucgaccac

SEQ ID NO: 1590836 - RNA, 15 nt, Pseudomonas putida KT2440
ugaauuggagcugaa

SEQ ID NO: 1590837 - RNA, 12 nt, Pseudomonas putida KT2440
ugaauuggccgg

SEQ ID NO: 1590838 - RNA, 18 nt, Pseudomonas putida KT2440
ugaaugccgccauccucg

SEQ ID NO: 1590839 - RNA, 19 nt, Pseudomonas putida KT2440
ugacaccgcugccgggcaa

SEQ ID NO: 1590840 - RNA, 19 nt, Pseudomonas putida KT2440
ugacacauaggcagccacc

SEQ ID NO: 1590841 - RNA, 17 nt, Pseudomonas putida KT2440
ugacaacgaugugcgag

SEQ ID NO: 1590842 - RNA, 23 nt, Pseudomonas putida KT2440
agcucggcuggcugucgaaggcu

SEQ ID NO: 1590843 - RNA, 23 nt, Pseudomonas putida KT2440
agcucggugaacagguugcgcgc

SEQ ID NO: 1590844 - RNA, 23 nt, Pseudomonas putida KT2440
agcugcaacagaaaaugcccgcu

SEQ ID NO: 1590845 - RNA, 18 nt, Pseudomonas putida KT2440
agcucggccgaugccagg

SEQ ID NO: 1590846 - RNA, 23 nt, Pseudomonas putida KT2440
agcucggcauguucaucaccggc

SEQ ID NO: 1590847 - RNA, 17 nt, Pseudomonas putida KT2440
agcucggccacccgcgu

SEQ ID NO: 1590848 - RNA, 21 nt, Pseudomonas putida KT2440
agcucggccacccgcguuugc

SEQ ID NO: 1590849 - RNA, 22 nt, Pseudomonas putida KT2440
agcugccggaacguuuccagca

SEQ ID NO: 1590850 - RNA, 20 nt, Pseudomonas putida KT2440
agcugcauuggcggcaggcg

SEQ ID NO: 1590851 - RNA, 12 nt, Pseudomonas putida KT2440
agcugcagcagc

SEQ ID NO: 1590852 - RNA, 12 nt, Pseudomonas putida KT2440
agcugcccacca

SEQ ID NO: 1590853 - RNA, 16 nt, Pseudomonas putida KT2440
agcucgaaaccggccu

SEQ ID NO: 1590854 - RNA, 20 nt, Pseudomonas putida KT2440
agcucgacaacccgcgcugc

SEQ ID NO: 1590855 - RNA, 21 nt, Pseudomonas putida KT2440
agcuccaccaguugguaaaac

SEQ ID NO: 1590856 - RNA, 13 nt, Pseudomonas putida KT2440
agcuccuggcccg

SEQ ID NO: 1590857 - RNA, 20 nt, Pseudomonas putida KT2440
agcuccuggcccgcgcccuu

SEQ ID NO: 1590858 - RNA, 14 nt, Pseudomonas putida KT2440
agcuccuggcucag

SEQ ID NO: 1590859 - RNA, 16 nt, Pseudomonas putida KT2440
agcucgcacgcauguc

SEQ ID NO: 1590860 - RNA, 19 nt, Pseudomonas putida KT2440
agcucgccauucucgauca

SEQ ID NO: 1590861 - RNA, 17 nt, Pseudomonas putida KT2440
agcuccucugccgacaa

SEQ ID NO: 1590862 - RNA, 19 nt, Pseudomonas putida KT2440
agcucagcgugacgauggc

SEQ ID NO: 1590863 - RNA, 20 nt, Pseudomonas putida KT2440
agcucagcgugacgauggcc

SEQ ID NO: 1590864 - RNA, 20 nt, Pseudomonas putida KT2440
agcucagucgguagagcaaa

SEQ ID NO: 1590865 - RNA, 14 nt, Pseudomonas putida KT2440
agcgguugcccgcu

SEQ ID NO: 1590866 - RNA, 16 nt, Pseudomonas putida KT2440
agcgggcuuacccgcg

SEQ ID NO: 1590867 - RNA, 20 nt, Pseudomonas putida KT2440
agcgggcuuacccgcgaaga

SEQ ID NO: 1590868 - RNA, 20 nt, Pseudomonas putida KT2440
agcgggcuugcccgcgaaga

SEQ ID NO: 1590869 - RNA, 20 nt, Pseudomonas putida KT2440
agcgggcuugcccgcgaagg

SEQ ID NO: 1590870 - RNA, 17 nt, Pseudomonas putida KT2440
agcguacacugcaggag

SEQ ID NO: 1590871 - RNA, 19 nt, Pseudomonas putida KT2440
agcguacgcauggucacgu

SEQ ID NO: 1590872 - RNA, 14 nt, Pseudomonas putida KT2440
agcguaagcuggcu

SEQ ID NO: 1590873 - RNA, 17 nt, Pseudomonas putida KT2440
agcgucagcagggccaa

SEQ ID NO: 1590874 - RNA, 19 nt, Pseudomonas putida KT2440
agcgucaugaacucaguua

SEQ ID NO: 1590875 - RNA, 18 nt, Pseudomonas putida KT2440
agcgucgcgcgcccaggc

SEQ ID NO: 1590876 - RNA, 16 nt, Pseudomonas putida KT2440
agcgucggcagagcgc

SEQ ID NO: 1590877 - RNA, 21 nt, Pseudomonas putida KT2440
agcggcaauucggccggccag

SEQ ID NO: 1590878 - RNA, 19 nt, Pseudomonas putida KT2440
agcggcaaccugacccgcg

SEQ ID NO: 1590879 - RNA, 16 nt, Pseudomonas putida KT2440
agcggcaacaccagca

SEQ ID NO: 1590880 - RNA, 14 nt, Pseudomonas putida KT2440
agcggcccugagcc

SEQ ID NO: 1590881 - RNA, 22 nt, Pseudomonas putida KT2440
agcggccccaucacccccgaau

SEQ ID NO: 1590882 - RNA, 23 nt, Pseudomonas putida KT2440
agcggcgauagggaacagggcag

SEQ ID NO: 1590883 - RNA, 22 nt, Pseudomonas putida KT2440
agcggccgaggccgauuuggcc

SEQ ID NO: 1590884 - RNA, 20 nt, Pseudomonas putida KT2440
agcggcgaaggauggaccga

SEQ ID NO: 1590885 - RNA, 20 nt, Pseudomonas putida KT2440
agcggccuucagggccgguu

SEQ ID NO: 1590886 - RNA, 19 nt, Pseudomonas putida KT2440
agcggccuugcgucgcgaa

SEQ ID NO: 1590887 - RNA, 20 nt, Pseudomonas putida KT2440
agcggccuugcgucgcgaug

SEQ ID NO: 1590888 - RNA, 19 nt, Pseudomonas putida KT2440
agcggccuugucgcgaaag

SEQ ID NO: 1590889 - RNA, 20 nt, Pseudomonas putida KT2440
agcggccuugugucgcgaua

SEQ ID NO: 1590890 - RNA, 20 nt, Pseudomonas putida KT2440
agcggccuuguguugcgaug

SEQ ID NO: 1590891 - RNA, 20 nt, Pseudomonas putida KT2440
agcgggcaugcccgcgaagg

SEQ ID NO: 1590892 - RNA, 21 nt, Pseudomonas putida KT2440
agcgggcaugcccgcgaaggc

SEQ ID NO: 1590893 - RNA, 16 nt, Pseudomonas putida KT2440
agcgggcgugcccgcg

SEQ ID NO: 1590894 - RNA, 19 nt, Pseudomonas putida KT2440
agcgggcgugcccgcgaac

SEQ ID NO: 1590895 - RNA, 20 nt, Pseudomonas putida KT2440
agcgggcgugcccgcgaaca

SEQ ID NO: 1590896 - RNA, 20 nt, Pseudomonas putida KT2440
agcgggcgugcccgcgaagg

SEQ ID NO: 1590897 - RNA, 18 nt, Pseudomonas putida KT2440
agcggcguuguagccgaa

SEQ ID NO: 1590898 - RNA, 20 nt, Pseudomonas putida KT2440
agcgccggcgggguaucgau

SEQ ID NO: 1590899 - RNA, 20 nt, Pseudomonas putida KT2440
agcgccgugcucggccuugc

SEQ ID NO: 1590900 - RNA, 16 nt, Pseudomonas putida KT2440
agcgcgucauccgcca

SEQ ID NO: 1590901 - RNA, 18 nt, Pseudomonas putida KT2440
agcgcgucauccgccaac

SEQ ID NO: 1590902 - RNA, 22 nt, Pseudomonas putida KT2440
agcgcucgacauccagcgccgc

SEQ ID NO: 1590903 - RNA, 22 nt, Pseudomonas putida KT2440
agcgcucgagaaaugccucggc

SEQ ID NO: 1590904 - RNA, 19 nt, Pseudomonas putida KT2440
agcgcugacucagcggccu

SEQ ID NO: 1590905 - RNA, 15 nt, Pseudomonas putida KT2440
agcgcugacugccag

SEQ ID NO: 1590906 - RNA, 23 nt, Pseudomonas putida KT2440
agcggaaguucacacucagccgc

SEQ ID NO: 1590907 - RNA, 17 nt, Pseudomonas putida KT2440
agcggaaucaccgguac

SEQ ID NO: 1590908 - RNA, 14 nt, Pseudomonas putida KT2440
agcuggcgcgaucc

SEQ ID NO: 1590909 - RNA, 15 nt, Pseudomonas putida KT2440
agcugcggcuggguc

SEQ ID NO: 1590910 - RNA, 16 nt, Pseudomonas putida KT2440
agcugcgcgcgagagc

SEQ ID NO: 1590911 - RNA, 21 nt, Pseudomonas putida KT2440
agcuggcuacccgcucggccu

SEQ ID NO: 1590912 - RNA, 18 nt, Pseudomonas putida KT2440
agcuucagguucugccgg

SEQ ID NO: 1590913 - RNA, 18 nt, Pseudomonas putida KT2440
agcuggugggcgaugauc

SEQ ID NO: 1590914 - RNA, 15 nt, Pseudomonas putida KT2440
agcuguacgcuggcc

SEQ ID NO: 1590915 - RNA, 17 nt, Pseudomonas putida KT2440
agcuguacgcuggccaa

SEQ ID NO: 1590916 - RNA, 19 nt, Pseudomonas putida KT2440
agcuguacagcgcauaggc

SEQ ID NO: 1590917 - RNA, 12 nt, Pseudomonas putida KT2440
agcugucagcac

SEQ ID NO: 1590918 - RNA, 22 nt, Pseudomonas putida KT2440
agcuugcgcgccuugcgccagg

SEQ ID NO: 1590919 - RNA, 16 nt, Pseudomonas putida KT2440
agcuuggacaggcccc

SEQ ID NO: 1590920 - RNA, 18 nt, Pseudomonas putida KT2440
agcuugccgcgugcgaug

SEQ ID NO: 1590921 - RNA, 22 nt, Pseudomonas putida KT2440
agcuugccaccaucgaccuggc

SEQ ID NO: 1590922 - RNA, 14 nt, Pseudomonas putida KT2440
agcuugccagcguc

SEQ ID NO: 1590923 - RNA, 23 nt, Pseudomonas putida KT2440
agcuugcccaucaccucgucgcu

SEQ ID NO: 1590924 - RNA, 19 nt, Pseudomonas putida KT2440
agcuuggccauuuccggcc

SEQ ID NO: 1590925 - RNA, 13 nt, Pseudomonas putida KT2440
agcuuggcgucca

SEQ ID NO: 1590926 - RNA, 23 nt, Pseudomonas putida KT2440
agcuuggggcgauguuggccgag

SEQ ID NO: 1590927 - RNA, 18 nt, Pseudomonas putida KT2440
agcuugugaucccgcgag

SEQ ID NO: 1590928 - RNA, 20 nt, Pseudomonas putida KT2440
agcuugaggcaugugcuguc

SEQ ID NO: 1590929 - RNA, 13 nt, Pseudomonas putida KT2440
agcuugaggccca

SEQ ID NO: 1590930 - RNA, 17 nt, Pseudomonas putida KT2440
agcuucucgcgcuuggc

SEQ ID NO: 1590931 - RNA, 23 nt, Pseudomonas putida KT2440
agcuuccaguuggccggcauggc

SEQ ID NO: 1590932 - RNA, 14 nt, Pseudomonas putida KT2440
aggaccaggccgau

SEQ ID NO: 1590933 - RNA, 19 nt, Pseudomonas putida KT2440
aggaauagccggugccgaa

SEQ ID NO: 1590934 - RNA, 20 nt, Pseudomonas putida KT2440
aggaagucgauguucagcac

SEQ ID NO: 1590935 - RNA, 14 nt, Pseudomonas putida KT2440
aggaaugucaccgc

SEQ ID NO: 1590936 - RNA, 18 nt, Pseudomonas putida KT2440
aggaacuggcugccgcug

SEQ ID NO: 1590937 - RNA, 19 nt, Pseudomonas putida KT2440
aggaacuggcugccgcuga

SEQ ID NO: 1590938 - RNA, 13 nt, Pseudomonas putida KT2440
aggaaacccgcgc

SEQ ID NO: 1590939 - RNA, 14 nt, Pseudomonas putida KT2440
aggaacagcgccac

SEQ ID NO: 1590940 - RNA, 14 nt, Pseudomonas putida KT2440
aggaacagcggcag

SEQ ID NO: 1590941 - RNA, 11 nt, Pseudomonas putida KT2440
aggagcgggcu

SEQ ID NO: 1590942 - RNA, 19 nt, Pseudomonas putida KT2440
aggagcgggcuugcccgcg

SEQ ID NO: 1590943 - RNA, 20 nt, Pseudomonas putida KT2440
aggagcgggcuugcccgcga

SEQ ID NO: 1590944 - RNA, 21 nt, Pseudomonas putida KT2440
aggagcgggcuugcccgcgaa

SEQ ID NO: 1590945 - RNA, 20 nt, Pseudomonas putida KT2440
aggagcgggucuacccgcga

SEQ ID NO: 1590946 - RNA, 20 nt, Pseudomonas putida KT2440
aggagcggguucacccgcga

SEQ ID NO: 1590947 - RNA, 20 nt, Pseudomonas putida KT2440
aggagcggguuuacccgcga

SEQ ID NO: 1590948 - RNA, 22 nt, Pseudomonas putida KT2440
aggauggcaccgaucaccuggg

SEQ ID NO: 1590949 - RNA, 17 nt, Pseudomonas putida KT2440
aggauggugacugccag

SEQ ID NO: 1590950 - RNA, 20 nt, Pseudomonas putida KT2440
aggaucggguuuacccgcga

SEQ ID NO: 1590951 - RNA, 14 nt, Pseudomonas putida KT2440
aggaucagcgcauc

SEQ ID NO: 1590952 - RNA, 15 nt, Pseudomonas putida KT2440
aggaucacuggccug

SEQ ID NO: 1590953 - RNA, 17 nt, Pseudomonas putida KT2440
aggaucaacugccgcgc

SEQ ID NO: 1590954 - RNA, 17 nt, Pseudomonas putida KT2440
aggccaccggcagcacc

SEQ ID NO: 1590955 - RNA, 12 nt, Pseudomonas putida KT2440
aggccaugcugc

SEQ ID NO: 1590956 - RNA, 17 nt, Pseudomonas putida KT2440
aggccaugcugcgccag

SEQ ID NO: 1590957 - RNA, 20 nt, Pseudomonas putida KT2440
aggccauauugcugagccag

SEQ ID NO: 1590958 - RNA, 22 nt, Pseudomonas putida KT2440
aggccauauugcugagccaguu

SEQ ID NO: 1590959 - RNA, 14 nt, Pseudomonas putida KT2440
aggccaaguacggc

SEQ ID NO: 1590960 - RNA, 17 nt, Pseudomonas putida KT2440
aggccaaguacggccag

SEQ ID NO: 1590961 - RNA, 20 nt, Pseudomonas putida KT2440
aggcauugagguugacggug

SEQ ID NO: 1590962 - RNA, 20 nt, Pseudomonas putida KT2440
aggccaaugcccaugcccag

SEQ ID NO: 1590963 - RNA, 16 nt, Pseudomonas putida KT2440
aggccauucaccuguu

SEQ ID NO: 1590964 - RNA, 13 nt, Pseudomonas putida KT2440
aggcccugacgcc

SEQ ID NO: 1590965 - RNA, 20 nt, Pseudomonas putida KT2440
aggcccugacgccagcgcug

SEQ ID NO: 1590966 - RNA, 14 nt, Pseudomonas putida KT2440
aggcccgugacgaa

SEQ ID NO: 1590967 - RNA, 20 nt, Pseudomonas putida KT2440
aggcccugcagcgcuucgug

SEQ ID NO: 1590968 - RNA, 17 nt, Pseudomonas putida KT2440
aggcacggcaccagcac

SEQ ID NO: 1590969 - RNA, 15 nt, Pseudomonas putida KT2440
aggcaccagcgcugc

SEQ ID NO: 1590970 - RNA, 21 nt, Pseudomonas putida KT2440
aggcaaugcccauggccaggc

SEQ ID NO: 1590971 - RNA, 13 nt, Pseudomonas putida KT2440
aggcaaucgugau

SEQ ID NO: 1590972 - RNA, 17 nt, Pseudomonas putida KT2440
aggcaaucgcgcccggu

SEQ ID NO: 1590973 - RNA, 16 nt, Pseudomonas putida KT2440
aggcaauugugccgcg

SEQ ID NO: 1590974 - RNA, 21 nt, Pseudomonas putida KT2440
aggcaauugugccgcgccagc

SEQ ID NO: 1590975 - RNA, 19 nt, Pseudomonas putida KT2440
aggcaaacgcggucagcga

SEQ ID NO: 1590976 - RNA, 22 nt, Pseudomonas putida KT2440
aggcaaacgcggucagcgaaua

SEQ ID NO: 1590977 - RNA, 14 nt, Pseudomonas putida KT2440
aggcaaccgcaucc

SEQ ID NO: 1590978 - RNA, 16 nt, Pseudomonas putida KT2440
aggcaaaggucugcug

SEQ ID NO: 1590979 - RNA, 17 nt, Pseudomonas putida KT2440
aggcaaaggucugcugc

SEQ ID NO: 1590980 - RNA, 18 nt, Pseudomonas putida KT2440
aggcaaguggaagcgcgg

SEQ ID NO: 1590981 - RNA, 15 nt, Pseudomonas putida KT2440
agcaggccgccgacg

SEQ ID NO: 1590982 - RNA, 18 nt, Pseudomonas putida KT2440
agcagcguucucggugua

SEQ ID NO: 1590983 - RNA, 15 nt, Pseudomonas putida KT2440
agcagcuccagcguu

SEQ ID NO: 1590984 - RNA, 17 nt, Pseudomonas putida KT2440
agcagcucccgagccag

SEQ ID NO: 1590985 - RNA, 14 nt, Pseudomonas putida KT2440
agcaggcgcucggg

SEQ ID NO: 1590986 - RNA, 17 nt, Pseudomonas putida KT2440
agcaggcuugccagcuu

SEQ ID NO: 1590987 - RNA, 13 nt, Pseudomonas putida KT2440
agccauaccgcau

SEQ ID NO: 1590988 - RNA, 13 nt, Pseudomonas putida KT2440
agccagugcugcc

SEQ ID NO: 1590989 - RNA, 18 nt, Pseudomonas putida KT2440
agccagucugcuccaccg

SEQ ID NO: 1590990 - RNA, 15 nt, Pseudomonas putida KT2440
agccaguucgacagg

SEQ ID NO: 1590991 - RNA, 17 nt, Pseudomonas putida KT2440
agccaguucgacagguu

SEQ ID NO: 1590992 - RNA, 16 nt, Pseudomonas putida KT2440
agccagcgacagcauc

SEQ ID NO: 1590993 - RNA, 23 nt, Pseudomonas putida KT2440
agccacgggugcgggcuccacug

SEQ ID NO: 1590994 - RNA, 14 nt, Pseudomonas putida KT2440
agccacgcugccag

SEQ ID NO: 1590995 - RNA, 14 nt, Pseudomonas putida KT2440
agccacgcuggcac

SEQ ID NO: 1590996 - RNA, 15 nt, Pseudomonas putida KT2440
agccacgcuggcacc

SEQ ID NO: 1590997 - RNA, 15 nt, Pseudomonas putida KT2440
agccacgaugaucug

SEQ ID NO: 1590998 - RNA, 21 nt, Pseudomonas putida KT2440
agcaugcgaagccgccagcgu

SEQ ID NO: 1590999 - RNA, 21 nt, Pseudomonas putida KT2440
agcaugcccagcgccaccggc

SEQ ID NO: 1591000 - RNA, 17 nt, Pseudomonas putida KT2440
agcaugcgcuugagcga

SEQ ID NO: 1591001 - RNA, 16 nt, Pseudomonas putida KT2440
agcauggcaaacagca

SEQ ID NO: 1591002 - RNA, 23 nt, Pseudomonas putida KT2440
agcaugaugauguccgcgccagc

SEQ ID NO: 1591003 - RNA, 14 nt, Pseudomonas putida KT2440
agcaugaucaccgc

SEQ ID NO: 1591004 - RNA, 22 nt, Pseudomonas putida KT2440
agcaugaauagcgcacugagca

SEQ ID NO: 1591005 - RNA, 21 nt, Pseudomonas putida KT2440
agccaacgccccacccgcuca

SEQ ID NO: 1591006 - RNA, 23 nt, Pseudomonas putida KT2440
agccaccggacagaaucgcgguc

SEQ ID NO: 1591007 - RNA, 12 nt, Pseudomonas putida KT2440
agccaccggcau

SEQ ID NO: 1591008 - RNA, 16 nt, Pseudomonas putida KT2440
agccaccgcgauggau

SEQ ID NO: 1591009 - RNA, 21 nt, Pseudomonas putida KT2440
agccaccgcgauggauggcac

SEQ ID NO: 1591010 - RNA, 22 nt, Pseudomonas putida KT2440
agcauggccgaaaccagccccu

SEQ ID NO: 1591011 - RNA, 14 nt, Pseudomonas putida KT2440
agcccgauggccuu

SEQ ID NO: 1591012 - RNA, 20 nt, Pseudomonas putida KT2440
agcccgauggccuugaucag

SEQ ID NO: 1591013 - RNA, 19 nt, Pseudomonas putida KT2440
agcccgcguucaugccggc

SEQ ID NO: 1591014 - RNA, 21 nt, Pseudomonas putida KT2440
agcccgcucauguccagguca

SEQ ID NO: 1591015 - RNA, 17 nt, Pseudomonas putida KT2440
agcccggcaaacuccac

SEQ ID NO: 1591016 - RNA, 23 nt, Pseudomonas putida KT2440
agcccucggcaaucugcagcagc

SEQ ID NO: 1591017 - RNA, 22 nt, Pseudomonas putida KT2440
agcccugcucguccaucaccgc

SEQ ID NO: 1591018 - RNA, 22 nt, Pseudomonas putida KT2440
agccccgcaugcucgcugcugc

SEQ ID NO: 1591019 - RNA, 23 nt, Pseudomonas putida KT2440
agccccgccaacaacaagcgcug

SEQ ID NO: 1591020 - RNA, 22 nt, Pseudomonas putida KT2440
agcccccggaugcgcaagcaac

SEQ ID NO: 1591021 - RNA, 22 nt, Pseudomonas putida KT2440
agcccccgcugcucgaggaagc

SEQ ID NO: 1591022 - RNA, 20 nt, Pseudomonas putida KT2440
agccccagcccgcccacaug

SEQ ID NO: 1591023 - RNA, 21 nt, Pseudomonas putida KT2440
agccccagggcccucaacccu

SEQ ID NO: 1591024 - RNA, 21 nt, Pseudomonas putida KT2440
agccccccuguaggagcgggu

SEQ ID NO: 1591025 - RNA, 12 nt, Pseudomonas putida KT2440
agccccaugcga

SEQ ID NO: 1591026 - RNA, 13 nt, Pseudomonas putida KT2440
agcccccagcaca

SEQ ID NO: 1591027 - RNA, 15 nt, Pseudomonas putida KT2440
agccauaucccgcca

SEQ ID NO: 1591028 - RNA, 17 nt, Pseudomonas putida KT2440
agccaugccggcaacga

SEQ ID NO: 1591029 - RNA, 14 nt, Pseudomonas putida KT2440
agccaugcgcaggc

SEQ ID NO: 1591030 - RNA, 20 nt, Pseudomonas putida KT2440
agccaugggcaggucgaccc

SEQ ID NO: 1591031 - RNA, 19 nt, Pseudomonas putida KT2440
agccgccagcaucacgccg

SEQ ID NO: 1591032 - RNA, 17 nt, Pseudomonas putida KT2440
agccgcgaacgccccga

SEQ ID NO: 1591033 - RNA, 19 nt, Pseudomonas putida KT2440
agccgcaggccaaugcagc

SEQ ID NO: 1591034 - RNA, 15 nt, Pseudomonas putida KT2440
agccgcauuggccgg

SEQ ID NO: 1591035 - RNA, 15 nt, Pseudomonas putida KT2440
agccgccaacccgug

SEQ ID NO: 1591036 - RNA, 19 nt, Pseudomonas putida KT2440
agccgauacggugccaaua

SEQ ID NO: 1591037 - RNA, 20 nt, Pseudomonas putida KT2440
agcccuugcugcagcaggcu

SEQ ID NO: 1591038 - RNA, 22 nt, Pseudomonas putida KT2440
agccgcgggcucguuauccgcg

SEQ ID NO: 1591039 - RNA, 23 nt, Pseudomonas putida KT2440
agccgcgggcucguuauccgcga

SEQ ID NO: 1591040 - RNA, 21 nt, Pseudomonas putida KT2440
agccgcugccacagguacugc

SEQ ID NO: 1591041 - RNA, 20 nt, Pseudomonas putida KT2440
agccgcugcgccugccgggc

SEQ ID NO: 1591042 - RNA, 18 nt, Pseudomonas putida KT2440
agccggcaauuuccugcg

SEQ ID NO: 1591043 - RNA, 18 nt, Pseudomonas putida KT2440
agccggcaccgccauggu

SEQ ID NO: 1591044 - RNA, 22 nt, Pseudomonas putida KT2440
agccgcuuucggucagggcgau

SEQ ID NO: 1591045 - RNA, 19 nt, Pseudomonas putida KT2440
agccggcuaucggccagca

SEQ ID NO: 1591046 - RNA, 17 nt, Pseudomonas putida KT2440
agccggcccggcuggcc

SEQ ID NO: 1591047 - RNA, 19 nt, Pseudomonas putida KT2440
agccggcccggcuggccac

SEQ ID NO: 1591048 - RNA, 22 nt, Pseudomonas putida KT2440
agccgugaagaggccagugagc

SEQ ID NO: 1591049 - RNA, 22 nt, Pseudomonas putida KT2440
agccgggccugauuggcaucgc

SEQ ID NO: 1591050 - RNA, 21 nt, Pseudomonas putida KT2440
agccgucgccgcuucggcaug

SEQ ID NO: 1591051 - RNA, 23 nt, Pseudomonas putida KT2440
agccgggcgguugucgaccuggc

SEQ ID NO: 1591052 - RNA, 13 nt, Pseudomonas putida KT2440
agccucgagcgcu

SEQ ID NO: 1591053 - RNA, 16 nt, Pseudomonas putida KT2440
agccuaccaacgcagc

SEQ ID NO: 1591054 - RNA, 20 nt, Pseudomonas putida KT2440
agccuaccaacgcagcaugc

SEQ ID NO: 1591055 - RNA, 16 nt, Pseudomonas putida KT2440
agccuuuggcuggacu

SEQ ID NO: 1591056 - RNA, 16 nt, Pseudomonas putida KT2440
agcgaaacccggcgca

SEQ ID NO: 1591057 - RNA, 23 nt, Pseudomonas putida KT2440
agccuuucgagagccgggcaaug

SEQ ID NO: 1591058 - RNA, 21 nt, Pseudomonas putida KT2440
agcgaaauagguaaagccacc

SEQ ID NO: 1591059 - RNA, 21 nt, Pseudomonas putida KT2440
agccuuugaaacggucagcgg

SEQ ID NO: 1591060 - RNA, 19 nt, Pseudomonas putida KT2440
agccuucacggauggcagc

SEQ ID NO: 1591061 - RNA, 18 nt, Pseudomonas putida KT2440
agccuucgucgcuggcca

SEQ ID NO: 1591062 - RNA, 14 nt, Pseudomonas putida KT2440
agccuucggccaug

SEQ ID NO: 1591063 - RNA, 17 nt, Pseudomonas putida KT2440
agccucggucagguacu

SEQ ID NO: 1591064 - RNA, 18 nt, Pseudomonas putida KT2440
agccugacgcgccgccaa

SEQ ID NO: 1591065 - RNA, 15 nt, Pseudomonas putida KT2440
agccugcacccagcg

SEQ ID NO: 1591066 - RNA, 13 nt, Pseudomonas putida KT2440
agccugcagcacc

SEQ ID NO: 1591067 - RNA, 13 nt, Pseudomonas putida KT2440
agccuucagcagg

SEQ ID NO: 1591068 - RNA, 14 nt, Pseudomonas putida KT2440
agccugcugacgca

SEQ ID NO: 1591069 - RNA, 20 nt, Pseudomonas putida KT2440
agcgcaucgaccggcaggcg

SEQ ID NO: 1591070 - RNA, 14 nt, Pseudomonas putida KT2440
agcgcaucggccac

SEQ ID NO: 1591071 - RNA, 17 nt, Pseudomonas putida KT2440
agcgcaucuuccggcac

SEQ ID NO: 1591072 - RNA, 14 nt, Pseudomonas putida KT2440
agcgccaccggcag

SEQ ID NO: 1591073 - RNA, 15 nt, Pseudomonas putida KT2440
agcgccacgccugca

SEQ ID NO: 1591074 - RNA, 16 nt, Pseudomonas putida KT2440
agcgcauugcccgcga

SEQ ID NO: 1591075 - RNA, 21 nt, Pseudomonas putida KT2440
agcgcauggcucaacuggcag

SEQ ID NO: 1591076 - RNA, 15 nt, Pseudomonas putida KT2440
agcgccaauaccgcg

SEQ ID NO: 1591077 - RNA, 20 nt, Pseudomonas putida KT2440
agcgccaauaccgcgcauca

SEQ ID NO: 1591078 - RNA, 22 nt, Pseudomonas putida KT2440
agcgcccgcccaccaccagccc

SEQ ID NO: 1591079 - RNA, 15 nt, Pseudomonas putida KT2440
agcgccgcgcccaug

SEQ ID NO: 1591080 - RNA, 18 nt, Pseudomonas putida KT2440
agcgccgcuucagccuuu

SEQ ID NO: 1591081 - RNA, 20 nt, Pseudomonas putida KT2440
agcgccggcaguugcuccuu

SEQ ID NO: 1591082 - RNA, 19 nt, Pseudomonas putida KT2440
agcgccaugagugcaggca

SEQ ID NO: 1591083 - RNA, 21 nt, Pseudomonas putida KT2440
agcgccaugagugcaggcaua

SEQ ID NO: 1591084 - RNA, 23 nt, Pseudomonas putida KT2440
agcgcccagaucagcagcaccga

SEQ ID NO: 1591085 - RNA, 23 nt, Pseudomonas putida KT2440
agcgccagcaacgcagccaggau

SEQ ID NO: 1591086 - RNA, 20 nt, Pseudomonas putida KT2440
agcgccagcacgcaggccag

SEQ ID NO: 1591087 - RNA, 13 nt, Pseudomonas putida KT2440
agcgccagcagcc

SEQ ID NO: 1591088 - RNA, 15 nt, Pseudomonas putida KT2440
agcgccagcagccgg

SEQ ID NO: 1591089 - RNA, 17 nt, Pseudomonas putida KT2440
agcgauugcccagcguu

SEQ ID NO: 1591090 - RNA, 12 nt, Pseudomonas putida KT2440
agcgaugccggg

SEQ ID NO: 1591091 - RNA, 18 nt, Pseudomonas putida KT2440
agcgauggcggaucagcg

SEQ ID NO: 1591092 - RNA, 22 nt, Pseudomonas putida KT2440
agcgcagcaucuuccugccacu

SEQ ID NO: 1591093 - RNA, 16 nt, Pseudomonas putida KT2440
agcgcagacuggguga

SEQ ID NO: 1591094 - RNA, 21 nt, Pseudomonas putida KT2440
agcgcacugaacagcgccuug

SEQ ID NO: 1591095 - RNA, 17 nt, Pseudomonas putida KT2440
agcgcacugagcaacgc

SEQ ID NO: 1591096 - RNA, 22 nt, Pseudomonas putida KT2440
agcgcaccuggauguugugcga

SEQ ID NO: 1591097 - RNA, 22 nt, Pseudomonas putida KT2440
agcgacccugagucuggcgccu

SEQ ID NO: 1591098 - RNA, 21 nt, Pseudomonas putida KT2440
agcgaagccagcacgccggca

SEQ ID NO: 1591099 - RNA, 14 nt, Pseudomonas putida KT2440
agcgacugccaaug

SEQ ID NO: 1591100 - RNA, 15 nt, Pseudomonas putida KT2440
agcgacugccaaugc

SEQ ID NO: 1591101 - RNA, 18 nt, Pseudomonas putida KT2440
agcgagagcuucagaccu

SEQ ID NO: 1591102 - RNA, 13 nt, Pseudomonas putida KT2440
agcgagcauggcg

SEQ ID NO: 1591103 - RNA, 22 nt, Pseudomonas putida KT2440
agcgagcccgcgcgcgaugcgc

SEQ ID NO: 1591104 - RNA, 19 nt, Pseudomonas putida KT2440
agcgauaaaccagcagcgc

SEQ ID NO: 1591105 - RNA, 15 nt, Pseudomonas putida KT2440
agcgagcaccggcag

SEQ ID NO: 1591106 - RNA, 14 nt, Pseudomonas putida KT2440
agcgagcagccugg

SEQ ID NO: 1591107 - RNA, 23 nt, Pseudomonas putida KT2440
auccaucuucaccuugccuaccu

SEQ ID NO: 1591108 - RNA, 20 nt, Pseudomonas putida KT2440
auccauuuguaggagcgggu

SEQ ID NO: 1591109 - RNA, 21 nt, Pseudomonas putida KT2440
aucccuggcacgcccggcacc

SEQ ID NO: 1591110 - RNA, 16 nt, Pseudomonas putida KT2440
aucccuuugcccgcca

SEQ ID NO: 1591111 - RNA, 20 nt, Pseudomonas putida KT2440
auccccuguaggagcgggcu

SEQ ID NO: 1591112 - RNA, 21 nt, Pseudomonas putida KT2440
aucccgacaaaguggaaggca

SEQ ID NO: 1591113 - RNA, 19 nt, Pseudomonas putida KT2440
aucccgaggucagcagugg

SEQ ID NO: 1591114 - RNA, 13 nt, Pseudomonas putida KT2440
aucccgccagguc

SEQ ID NO: 1591115 - RNA, 21 nt, Pseudomonas putida KT2440
aucccgcucgguaucggccag

SEQ ID NO: 1591116 - RNA, 15 nt, Pseudomonas putida KT2440
auccacacgcugcug

SEQ ID NO: 1591117 - RNA, 15 nt, Pseudomonas putida KT2440
auccacaaucagcac

SEQ ID NO: 1591118 - RNA, 20 nt, Pseudomonas putida KT2440
auccaccaggcuggccacca

SEQ ID NO: 1591119 - RNA, 13 nt, Pseudomonas putida KT2440
auccacauuaccg

SEQ ID NO: 1591120 - RNA, 14 nt, Pseudomonas putida KT2440
aucaugcuggccag

SEQ ID NO: 1591121 - RNA, 15 nt, Pseudomonas putida KT2440
aucaugcuggccagg

SEQ ID NO: 1591122 - RNA, 22 nt, Pseudomonas putida KT2440
auccagcgccgcgccaccgauc

SEQ ID NO: 1591123 - RNA, 20 nt, Pseudomonas putida KT2440
auccagcgaggcgggccgca

SEQ ID NO: 1591124 - RNA, 15 nt, Pseudomonas putida KT2440
auccaggcuggccag

SEQ ID NO: 1591125 - RNA, 21 nt, Pseudomonas putida KT2440
auccagcugcuggauugccug

SEQ ID NO: 1591126 - RNA, 15 nt, Pseudomonas putida KT2440
auccagcaccggcgu

SEQ ID NO: 1591127 - RNA, 19 nt, Pseudomonas putida KT2440
auccagaucggcagugccg

SEQ ID NO: 1591128 - RNA, 22 nt, Pseudomonas putida KT2440
auccagcacugccuggccacug

SEQ ID NO: 1591129 - RNA, 20 nt, Pseudomonas putida KT2440
auccagcaggguggccagca

SEQ ID NO: 1591130 - RNA, 20 nt, Pseudomonas putida KT2440
auccuguggaagcgggcgug

SEQ ID NO: 1591131 - RNA, 20 nt, Pseudomonas putida KT2440
auccuugaucaacugacgca

SEQ ID NO: 1591132 - RNA, 15 nt, Pseudomonas putida KT2440
auccugcucgacaag

SEQ ID NO: 1591133 - RNA, 11 nt, Pseudomonas putida KT2440
auccugcagca

SEQ ID NO: 1591134 - RNA, 13 nt, Pseudomonas putida KT2440
auccggggccgca

SEQ ID NO: 1591135 - RNA, 21 nt, Pseudomonas putida KT2440
auccgguggcaucaccggcag

SEQ ID NO: 1591136 - RNA, 13 nt, Pseudomonas putida KT2440
auccgguggccuu

SEQ ID NO: 1591137 - RNA, 14 nt, Pseudomonas putida KT2440
auccgugagccagg

SEQ ID NO: 1591138 - RNA, 21 nt, Pseudomonas putida KT2440
auccggccguguucaggcacg

SEQ ID NO: 1591139 - RNA, 18 nt, Pseudomonas putida KT2440
auccggccuuuucauccg

SEQ ID NO: 1591140 - RNA, 22 nt, Pseudomonas putida KT2440
auccggcgcaucgacgggcaug

SEQ ID NO: 1591141 - RNA, 19 nt, Pseudomonas putida KT2440
auccggcacuccagcgagu

SEQ ID NO: 1591142 - RNA, 18 nt, Pseudomonas putida KT2440
auccgccaugggccugca

SEQ ID NO: 1591143 - RNA, 23 nt, Pseudomonas putida KT2440
auccgccucauccucgcccacca

SEQ ID NO: 1591144 - RNA, 20 nt, Pseudomonas putida KT2440
auccgcgaguaaagccagca

SEQ ID NO: 1591145 - RNA, 21 nt, Pseudomonas putida KT2440
auccgcgcccagucaccguuc

SEQ ID NO: 1591146 - RNA, 19 nt, Pseudomonas putida KT2440
auccgccccuacgcugguu

SEQ ID NO: 1591147 - RNA, 23 nt, Pseudomonas putida KT2440
auccgccagguauucggcaaugc

SEQ ID NO: 1591148 - RNA, 14 nt, Pseudomonas putida KT2440
auccgcaccgggca

SEQ ID NO: 1591149 - RNA, 17 nt, Pseudomonas putida KT2440
auccgcacgcaugucag

SEQ ID NO: 1591150 - RNA, 14 nt, Pseudomonas putida KT2440
auccgcacacgcuc

SEQ ID NO: 1591151 - RNA, 14 nt, Pseudomonas putida KT2440
aucagcucggaaag

SEQ ID NO: 1591152 - RNA, 16 nt, Pseudomonas putida KT2440
aucaggucaucgaaga

SEQ ID NO: 1591153 - RNA, 22 nt, Pseudomonas putida KT2440
aucaggggccgcgcagcggccc

SEQ ID NO: 1591154 - RNA, 11 nt, Pseudomonas putida KT2440
aucagcuucug

SEQ ID NO: 1591155 - RNA, 14 nt, Pseudomonas putida KT2440
aucaggucgacacc

SEQ ID NO: 1591156 - RNA, 16 nt, Pseudomonas putida KT2440
aucagguugcccagca

SEQ ID NO: 1591157 - RNA, 16 nt, Pseudomonas putida KT2440
aucagguggaucagcc

SEQ ID NO: 1591158 - RNA, 15 nt, Pseudomonas putida KT2440
aucagguucagcagg

SEQ ID NO: 1591159 - RNA, 20 nt, Pseudomonas putida KT2440
aucagguugagcaccgggca

SEQ ID NO: 1591160 - RNA, 21 nt, Pseudomonas putida KT2440
aucaguacgaugcugcgggcg

SEQ ID NO: 1591161 - RNA, 18 nt, Pseudomonas putida KT2440
aucaguaaucugccggcg

SEQ ID NO: 1591162 - RNA, 14 nt, Pseudomonas putida KT2440
aucagugcaggugc

SEQ ID NO: 1591163 - RNA, 14 nt, Pseudomonas putida KT2440
aucaugccgacggu

SEQ ID NO: 1591164 - RNA, 17 nt, Pseudomonas putida KT2440
aucaucaucuucgaggu

SEQ ID NO: 1591165 - RNA, 16 nt, Pseudomonas putida KT2440
aucaucaugcccaaug

SEQ ID NO: 1591166 - RNA, 15 nt, Pseudomonas putida KT2440
aucauccugcucgac

SEQ ID NO: 1591167 - RNA, 20 nt, Pseudomonas putida KT2440
aucagcgacaccaaugccuu

SEQ ID NO: 1591168 - RNA, 17 nt, Pseudomonas putida KT2440
aucagcggcacggccac

SEQ ID NO: 1591169 - RNA, 21 nt, Pseudomonas putida KT2440
aucagccagauaccgccuaug

SEQ ID NO: 1591170 - RNA, 13 nt, Pseudomonas putida KT2440
aucagaccgccga

SEQ ID NO: 1591171 - RNA, 20 nt, Pseudomonas putida KT2440
aucacgcuccugcaugccuu

SEQ ID NO: 1591172 - RNA, 17 nt, Pseudomonas putida KT2440
aucacgcggcgucaccg

SEQ ID NO: 1591173 - RNA, 18 nt, Pseudomonas putida KT2440
aucacuguugucggccag

SEQ ID NO: 1591174 - RNA, 16 nt, Pseudomonas putida KT2440
aucacggguaagccgg

SEQ ID NO: 1591175 - RNA, 16 nt, Pseudomonas putida KT2440
aucacuuccuggccgc

SEQ ID NO: 1591176 - RNA, 17 nt, Pseudomonas putida KT2440
aucacuuccaccugcgc

SEQ ID NO: 1591177 - RNA, 17 nt, Pseudomonas putida KT2440
aucacgcaggcccagca

SEQ ID NO: 1591178 - RNA, 23 nt, Pseudomonas putida KT2440
aucacgcaaccucguugcuggug

SEQ ID NO: 1591179 - RNA, 19 nt, Pseudomonas putida KT2440
aucaccgccagguccaggc

SEQ ID NO: 1591180 - RNA, 18 nt, Pseudomonas putida KT2440
aucaagguuucagcagcg

SEQ ID NO: 1591181 - RNA, 14 nt, Pseudomonas putida KT2440
aucaacgcugccau

SEQ ID NO: 1591182 - RNA, 14 nt, Pseudomonas putida KT2440
auaucccgccaggu

SEQ ID NO: 1591183 - RNA, 13 nt, Pseudomonas putida KT2440
auagucgaaggcu

SEQ ID NO: 1591184 - RNA, 17 nt, Pseudomonas putida KT2440
auacagcucccgcgcau

SEQ ID NO: 1591185 - RNA, 13 nt, Pseudomonas putida KT2440
auacccacgccau

SEQ ID NO: 1591186 - RNA, 15 nt, Pseudomonas putida KT2440
auacccgcaacgauc

SEQ ID NO: 1591187 - RNA, 18 nt, Pseudomonas putida KT2440
auagcgugcuuccaccuc

SEQ ID NO: 1591188 - RNA, 19 nt, Pseudomonas putida KT2440
auacaccagcuugaugcug

SEQ ID NO: 1591189 - RNA, 15 nt, Pseudomonas putida KT2440
auaaucuugcuugag

SEQ ID NO: 1591190 - RNA, 15 nt, Pseudomonas putida KT2440
auaaugcuccgccac

SEQ ID NO: 1591191 - RNA, 21 nt, Pseudomonas putida KT2440
auaacaagaacaacacggcag

SEQ ID NO: 1591192 - RNA, 14 nt, Pseudomonas putida KT2440
aguucaaugccagc

SEQ ID NO: 1591193 - RNA, 17 nt, Pseudomonas putida KT2440
aguucagccaggguuuc

SEQ ID NO: 1591194 - RNA, 20 nt, Pseudomonas putida KT2440
aguucacacucagccgcugc

SEQ ID NO: 1591195 - RNA, 20 nt, Pseudomonas putida KT2440
aguuggccaucaauaccggc

SEQ ID NO: 1591196 - RNA, 21 nt, Pseudomonas putida KT2440
aguuggccgacgauuucugcc

SEQ ID NO: 1591197 - RNA, 14 nt, Pseudomonas putida KT2440
auaaaccagcagcg

SEQ ID NO: 1591198 - RNA, 17 nt, Pseudomonas putida KT2440
agucguacuagcggugc

SEQ ID NO: 1591199 - RNA, 18 nt, Pseudomonas putida KT2440
agucguacuagcggugca

SEQ ID NO: 1591200 - RNA, 13 nt, Pseudomonas putida KT2440
agucggcgcugga

SEQ ID NO: 1591201 - RNA, 15 nt, Pseudomonas putida KT2440
agucggcgcuggaca

SEQ ID NO: 1591202 - RNA, 18 nt, Pseudomonas putida KT2440
agucgguagagcaaauga

SEQ ID NO: 1591203 - RNA, 22 nt, Pseudomonas putida KT2440
agucuauggaugccagcggugc

SEQ ID NO: 1591204 - RNA, 21 nt, Pseudomonas putida KT2440
agugccagcaacaagcuggac

SEQ ID NO: 1591205 - RNA, 22 nt, Pseudomonas putida KT2440
agugcauaaucguucugcuugu

SEQ ID NO: 1591206 - RNA, 22 nt, Pseudomonas putida KT2440
agugccgugaguggccucgaac

SEQ ID NO: 1591207 - RNA, 15 nt, Pseudomonas putida KT2440
aguggccacggauca

SEQ ID NO: 1591208 - RNA, 15 nt, Pseudomonas putida KT2440
aguggccucgaacau

SEQ ID NO: 1591209 - RNA, 23 nt, Pseudomonas putida KT2440
aguggccuugguaagcgacugca

SEQ ID NO: 1591210 - RNA, 14 nt, Pseudomonas putida KT2440
aguggcgccggauu

SEQ ID NO: 1591211 - RNA, 21 nt, Pseudomonas putida KT2440
agugcccccgucagcggcaac

SEQ ID NO: 1591212 - RNA, 14 nt, Pseudomonas putida KT2440
agugccgccucguu

SEQ ID NO: 1591213 - RNA, 20 nt, Pseudomonas putida KT2440
agucgcacaugaagccgcgc

SEQ ID NO: 1591214 - RNA, 23 nt, Pseudomonas putida KT2440
agucgccccgccagcgccuggcg

SEQ ID NO: 1591215 - RNA, 19 nt, Pseudomonas putida KT2440
agucgcaucgacaggucca

SEQ ID NO: 1591216 - RNA, 20 nt, Pseudomonas putida KT2440
agucgccacaccacagcugc

SEQ ID NO: 1591217 - RNA, 18 nt, Pseudomonas putida KT2440
agucgccgauacccgcac

SEQ ID NO: 1591218 - RNA, 14 nt, Pseudomonas putida KT2440
agucgccaggccgu

SEQ ID NO: 1591219 - RNA, 22 nt, Pseudomonas putida KT2440
agucgcucaggcggcgcagguu

SEQ ID NO: 1591220 - RNA, 16 nt, Pseudomonas putida KT2440
agucgcuuugcgggca

SEQ ID NO: 1591221 - RNA, 17 nt, Pseudomonas putida KT2440
agucggcaaucagcagg

SEQ ID NO: 1591222 - RNA, 20 nt, Pseudomonas putida KT2440
aguccgguaacgaaggccug

SEQ ID NO: 1591223 - RNA, 17 nt, Pseudomonas putida KT2440
aguccgccucgucgaug

SEQ ID NO: 1591224 - RNA, 13 nt, Pseudomonas putida KT2440
agucgagcgccgc

SEQ ID NO: 1591225 - RNA, 18 nt, Pseudomonas putida KT2440
agucgaaggggaucagca

SEQ ID NO: 1591226 - RNA, 18 nt, Pseudomonas putida KT2440
aguccuuggccaaugcca

SEQ ID NO: 1591227 - RNA, 17 nt, Pseudomonas putida KT2440
aguccugcagcggcaag

SEQ ID NO: 1591228 - RNA, 13 nt, Pseudomonas putida KT2440
agucagccagguu

SEQ ID NO: 1591229 - RNA, 13 nt, Pseudomonas putida KT2440
agucauccauggc

SEQ ID NO: 1591230 - RNA, 19 nt, Pseudomonas putida KT2440
aguagcuccagcccagcgc

SEQ ID NO: 1591231 - RNA, 12 nt, Pseudomonas putida KT2440
aguaggcacgau

SEQ ID NO: 1591232 - RNA, 15 nt, Pseudomonas putida KT2440
aguccaucaccggcg

SEQ ID NO: 1591233 - RNA, 17 nt, Pseudomonas putida KT2440
aguccccaccggcacca

SEQ ID NO: 1591234 - RNA, 16 nt, Pseudomonas putida KT2440
aguccagcaucagcac

SEQ ID NO: 1591235 - RNA, 14 nt, Pseudomonas putida KT2440
aguccaggccaaca

SEQ ID NO: 1591236 - RNA, 14 nt, Pseudomonas putida KT2440
agguugauccagcc

SEQ ID NO: 1591237 - RNA, 21 nt, Pseudomonas putida KT2440
agguucuguagcgcaaugccc

SEQ ID NO: 1591238 - RNA, 18 nt, Pseudomonas putida KT2440
agguguuguugcaaccag

SEQ ID NO: 1591239 - RNA, 19 nt, Pseudomonas putida KT2440
aguaccuucuggcuggagc

SEQ ID NO: 1591240 - RNA, 22 nt, Pseudomonas putida KT2440
aguagccaucgaggaaguggca

SEQ ID NO: 1591241 - RNA, 16 nt, Pseudomonas putida KT2440
aguacgaugcugcggg

SEQ ID NO: 1591242 - RNA, 24 nt, Pseudomonas putida KT2440
agguugcccggcgagcgcaggaac

SEQ ID NO: 1591243 - RNA, 12 nt, Pseudomonas putida KT2440
aguacaccggca

SEQ ID NO: 1591244 - RNA, 17 nt, Pseudomonas putida KT2440
agguaucgccgcccuug

SEQ ID NO: 1591245 - RNA, 19 nt, Pseudomonas putida KT2440
aggucggagaucgagugcu

SEQ ID NO: 1591246 - RNA, 20 nt, Pseudomonas putida KT2440
aggucgcgcugcagcuccuu

SEQ ID NO: 1591247 - RNA, 14 nt, Pseudomonas putida KT2440
agguaguuggccgg

SEQ ID NO: 1591248 - RNA, 19 nt, Pseudomonas putida KT2440
agguaggccgcagccaugc

SEQ ID NO: 1591249 - RNA, 17 nt, Pseudomonas putida KT2440
agguagcggggccgcuu

SEQ ID NO: 1591250 - RNA, 15 nt, Pseudomonas putida KT2440
agguaggcagcaacg

SEQ ID NO: 1591251 - RNA, 14 nt, Pseudomonas putida KT2440
agguacagcagcug

SEQ ID NO: 1591252 - RNA, 15 nt, Pseudomonas putida KT2440
agguacagcagcugc

SEQ ID NO: 1591253 - RNA, 16 nt, Pseudomonas putida KT2440
agguacagcagcuugc

SEQ ID NO: 1591254 - RNA, 21 nt, Pseudomonas putida KT2440
agguaccaggcugccacggcg

SEQ ID NO: 1591255 - RNA, 20 nt, Pseudomonas putida KT2440
agguagcgcucgacauccag

SEQ ID NO: 1591256 - RNA, 18 nt, Pseudomonas putida KT2440
agguacucagcggcuggc

SEQ ID NO: 1591257 - RNA, 16 nt, Pseudomonas putida KT2440
aggugcuacggaacug

SEQ ID NO: 1591258 - RNA, 18 nt, Pseudomonas putida KT2440
agguggcauuggcgugcu

SEQ ID NO: 1591259 - RNA, 17 nt, Pseudomonas putida KT2440
agguggucgaggcaaag

SEQ ID NO: 1591260 - RNA, 17 nt, Pseudomonas putida KT2440
aggugguaacuggccag

SEQ ID NO: 1591261 - RNA, 16 nt, Pseudomonas putida KT2440
aggugguagucggcaa

SEQ ID NO: 1591262 - RNA, 21 nt, Pseudomonas putida KT2440
aggucugcgcgggaagcccgu

SEQ ID NO: 1591263 - RNA, 14 nt, Pseudomonas putida KT2440
aggucugcugcggc

SEQ ID NO: 1591264 - RNA, 14 nt, Pseudomonas putida KT2440
aggucuucgaucuc

SEQ ID NO: 1591265 - RNA, 16 nt, Pseudomonas putida KT2440
aggucuucgaucucgg

SEQ ID NO: 1591266 - RNA, 22 nt, Pseudomonas putida KT2440
aggucuucgaucucggccagca

SEQ ID NO: 1591267 - RNA, 15 nt, Pseudomonas putida KT2440
aggugcucaaggcac

SEQ ID NO: 1591268 - RNA, 23 nt, Pseudomonas putida KT2440
aggugcucagccacgcuggcacc

SEQ ID NO: 1591269 - RNA, 20 nt, Pseudomonas putida KT2440
agguggaucggcgugcggcu

SEQ ID NO: 1591270 - RNA, 14 nt, Pseudomonas putida KT2440
aggugcuuggggcu

SEQ ID NO: 1591271 - RNA, 23 nt, Pseudomonas putida KT2440
aggucuaaccgcgcugguaagcc

SEQ ID NO: 1591272 - RNA, 23 nt, Pseudomonas putida KT2440
aggccgauguuguggcuguucag

SEQ ID NO: 1591273 - RNA, 13 nt, Pseudomonas putida KT2440
aggccgccgacga

SEQ ID NO: 1591274 - RNA, 19 nt, Pseudomonas putida KT2440
aggcguggaaaaggcgcug

SEQ ID NO: 1591275 - RNA, 19 nt, Pseudomonas putida KT2440
aggcugaugcgcuggcccu

SEQ ID NO: 1591276 - RNA, 14 nt, Pseudomonas putida KT2440
aggcugcagcgaac

SEQ ID NO: 1591277 - RNA, 21 nt, Pseudomonas putida KT2440
aggcugcgcaucaggcugcgc

SEQ ID NO: 1591278 - RNA, 20 nt, Pseudomonas putida KT2440
aggcuggccaccaugaacag

SEQ ID NO: 1591279 - RNA, 15 nt, Pseudomonas putida KT2440
agggcaaagcccagu

SEQ ID NO: 1591280 - RNA, 16 nt, Pseudomonas putida KT2440
agggcacauacggcuu

SEQ ID NO: 1591281 - RNA, 17 nt, Pseudomonas putida KT2440
agggcaccaguugcagg

SEQ ID NO: 1591282 - RNA, 19 nt, Pseudomonas putida KT2440
agggcaaacacauccacau

SEQ ID NO: 1591283 - RNA, 13 nt, Pseudomonas putida KT2440
agggaccgcaucu

SEQ ID NO: 1591284 - RNA, 16 nt, Pseudomonas putida KT2440
agggcgcgcuggcgca

SEQ ID NO: 1591285 - RNA, 18 nt, Pseudomonas putida KT2440
agggcgcuugcccgcgaa

SEQ ID NO: 1591286 - RNA, 15 nt, Pseudomonas putida KT2440
agggcggcgcccagu

SEQ ID NO: 1591287 - RNA, 17 nt, Pseudomonas putida KT2440
agggcggccaaggcgug

SEQ ID NO: 1591288 - RNA, 17 nt, Pseudomonas putida KT2440
agggcgaaccaggugcg

SEQ ID NO: 1591289 - RNA, 14 nt, Pseudomonas putida KT2440
agggccucgaugcg

SEQ ID NO: 1591290 - RNA, 14 nt, Pseudomonas putida KT2440
agggcaucgaccag

SEQ ID NO: 1591291 - RNA, 14 nt, Pseudomonas putida KT2440
agggcaucggacag

SEQ ID NO: 1591292 - RNA, 17 nt, Pseudomonas putida KT2440
agggcaucggacaggua

SEQ ID NO: 1591293 - RNA, 20 nt, Pseudomonas putida KT2440
agggcagggugaucgcgcug

SEQ ID NO: 1591294 - RNA, 17 nt, Pseudomonas putida KT2440
aggguuuucagcgccgc

SEQ ID NO: 1591295 - RNA, 14 nt, Pseudomonas putida KT2440
aggguugucccggu

SEQ ID NO: 1591296 - RNA, 17 nt, Pseudomonas putida KT2440
aggguugcaucgcgcac

SEQ ID NO: 1591297 - RNA, 21 nt, Pseudomonas putida KT2440
aggguuaccacauaacugccg

SEQ ID NO: 1591298 - RNA, 14 nt, Pseudomonas putida KT2440
aggguucgauccac

SEQ ID NO: 1591299 - RNA, 16 nt, Pseudomonas putida KT2440
agggggaugucgcugu

SEQ ID NO: 1591300 - RNA, 15 nt, Pseudomonas putida KT2440
agggucagggccagg

SEQ ID NO: 1591301 - RNA, 22 nt, Pseudomonas putida KT2440
augucgcugccgccaaccagcu

SEQ ID NO: 1591302 - RNA, 23 nt, Pseudomonas putida KT2440
augucgcugccgccaaccagcuc

SEQ ID NO: 1591303 - RNA, 20 nt, Pseudomonas putida KT2440
augucgcggcuacgcucguc

SEQ ID NO: 1591304 - RNA, 13 nt, Pseudomonas putida KT2440
augucgaucagcg

SEQ ID NO: 1591305 - RNA, 18 nt, Pseudomonas putida KT2440
augucgauccacucgucg

SEQ ID NO: 1591306 - RNA, 20 nt, Pseudomonas putida KT2440
augucgagcaugaucaccgc

SEQ ID NO: 1591307 - RNA, 22 nt, Pseudomonas putida KT2440
auuacaaacggcuuggcugccg

SEQ ID NO: 1591308 - RNA, 14 nt, Pseudomonas putida KT2440
auuacaagggccug

SEQ ID NO: 1591309 - RNA, 20 nt, Pseudomonas putida KT2440
auuacuucuuggagcggccu

SEQ ID NO: 1591310 - RNA, 23 nt, Pseudomonas putida KT2440
auuccaggcuagccggucaccga

SEQ ID NO: 1591311 - RNA, 17 nt, Pseudomonas putida KT2440
auucacggaucagccgc

SEQ ID NO: 1591312 - RNA, 12 nt, Pseudomonas putida KT2440
auucgagcuuga

SEQ ID NO: 1591313 - RNA, 23 nt, Pseudomonas putida KT2440
auucgauagccugcaaacgccgc

SEQ ID NO: 1591314 - RNA, 24 nt, Pseudomonas putida KT2440
auucgauagccugcaaacgccgcu

SEQ ID NO: 1591315 - RNA, 21 nt, Pseudomonas putida KT2440
auucgacccgcgucucgccgc

SEQ ID NO: 1591316 - RNA, 15 nt, Pseudomonas putida KT2440
auuccgggcugcugc

SEQ ID NO: 1591317 - RNA, 18 nt, Pseudomonas putida KT2440
auuccgggcugcugcgca

SEQ ID NO: 1591318 - RNA, 16 nt, Pseudomonas putida KT2440
auuuccucuucaccgu

SEQ ID NO: 1591319 - RNA, 16 nt, Pseudomonas putida KT2440
auuuccugcgcggccu

SEQ ID NO: 1591320 - RNA, 19 nt, Pseudomonas putida KT2440
auuuccgggcaaugcaggc

SEQ ID NO: 1591321 - RNA, 20 nt, Pseudomonas putida KT2440
auuucggugaagaucgccgc

SEQ ID NO: 1591322 - RNA, 14 nt, Pseudomonas putida KT2440
auuucguccaggcu

SEQ ID NO: 1591323 - RNA, 17 nt, Pseudomonas putida KT2440
auuucguccaggcucag

SEQ ID NO: 1591324 - RNA, 16 nt, Pseudomonas putida KT2440
auuucacgcacggccu

SEQ ID NO: 1591325 - RNA, 16 nt, Pseudomonas putida KT2440
auuucacuuucuugaa

SEQ ID NO: 1591326 - RNA, 18 nt, Pseudomonas putida KT2440
auugcaguugaaugccgc

SEQ ID NO: 1591327 - RNA, 23 nt, Pseudomonas putida KT2440
auugccaacuucgugcucggcac

SEQ ID NO: 1591328 - RNA, 21 nt, Pseudomonas putida KT2440
auugccccuguaggaucgggu

SEQ ID NO: 1591329 - RNA, 21 nt, Pseudomonas putida KT2440
auugcgaguugaucucaagcu

SEQ ID NO: 1591330 - RNA, 16 nt, Pseudomonas putida KT2440
auugcgccagccgcuc

SEQ ID NO: 1591331 - RNA, 20 nt, Pseudomonas putida KT2440
auucgcgggcaagcccgcuc

SEQ ID NO: 1591332 - RNA, 18 nt, Pseudomonas putida KT2440
auucuccccgcugaacag

SEQ ID NO: 1591333 - RNA, 16 nt, Pseudomonas putida KT2440
auuggcgccaucgccc

SEQ ID NO: 1591334 - RNA, 18 nt, Pseudomonas putida KT2440
auuggcgccaucgcccac

SEQ ID NO: 1591335 - RNA, 19 nt, Pseudomonas putida KT2440
auugugcccuugaacggcc

SEQ ID NO: 1591336 - RNA, 14 nt, Pseudomonas putida KT2440
auuugaucggccgc

SEQ ID NO: 1591337 - RNA, 17 nt, Pseudomonas putida KT2440
caaaaccuuccaugcgc

SEQ ID NO: 1591338 - RNA, 17 nt, Pseudomonas putida KT2440
auuuuucuggugccggc

SEQ ID NO: 1591339 - RNA, 17 nt, Pseudomonas putida KT2440
caacaauuuucgaccaa

SEQ ID NO: 1591340 - RNA, 22 nt, Pseudomonas putida KT2440
caaagcugucgcuacgcgccau

SEQ ID NO: 1591341 - RNA, 13 nt, Pseudomonas putida KT2440
caaagcaccauga

SEQ ID NO: 1591342 - RNA, 14 nt, Pseudomonas putida KT2440
caaagcagacccag

SEQ ID NO: 1591343 - RNA, 18 nt, Pseudomonas putida KT2440
caaaggcccuuuaggcac

SEQ ID NO: 1591344 - RNA, 15 nt, Pseudomonas putida KT2440
caaaggccggcaccg

SEQ ID NO: 1591345 - RNA, 12 nt, Pseudomonas putida KT2440
caaaggccucuu

SEQ ID NO: 1591346 - RNA, 15 nt, Pseudomonas putida KT2440
caaaggcaugggcca

SEQ ID NO: 1591347 - RNA, 17 nt, Pseudomonas putida KT2440
caaaggcgucgcuguuc

SEQ ID NO: 1591348 - RNA, 18 nt, Pseudomonas putida KT2440
caaagauaccccugcgcc

SEQ ID NO: 1591349 - RNA, 22 nt, Pseudomonas putida KT2440
caaacugcuggaaaaagaacag

SEQ ID NO: 1591350 - RNA, 14 nt, Pseudomonas putida KT2440
caaagaacagcgug

SEQ ID NO: 1591351 - RNA, 17 nt, Pseudomonas putida KT2440
caaaggcuugcgcgauc

SEQ ID NO: 1591352 - RNA, 18 nt, Pseudomonas putida KT2440
caaaguccagcaucagca

SEQ ID NO: 1591353 - RNA, 14 nt, Pseudomonas putida KT2440
caaagucuucagcc

SEQ ID NO: 1591354 - RNA, 18 nt, Pseudomonas putida KT2440
caaacguaccagccgcac

SEQ ID NO: 1591355 - RNA, 19 nt, Pseudomonas putida KT2440
caaacggcuagccaucgca

SEQ ID NO: 1591356 - RNA, 22 nt, Pseudomonas putida KT2440
caaacccgcgccuacaggcaac

SEQ ID NO: 1591357 - RNA, 21 nt, Pseudomonas putida KT2440
caaaccaggccguugaucagc

SEQ ID NO: 1591358 - RNA, 15 nt, Pseudomonas putida KT2440
caaaccgcacccggc

SEQ ID NO: 1591359 - RNA, 15 nt, Pseudomonas putida KT2440
caaaccgacccugcu

SEQ ID NO: 1591360 - RNA, 22 nt, Pseudomonas putida KT2440
caaacgaaaucugccugcugca

SEQ ID NO: 1591361 - RNA, 18 nt, Pseudomonas putida KT2440
caaacagacggugcgccu

SEQ ID NO: 1591362 - RNA, 17 nt, Pseudomonas putida KT2440
caaacagccgcccaguu

SEQ ID NO: 1591363 - RNA, 18 nt, Pseudomonas putida KT2440
caaacaaaaaagccgcuc

SEQ ID NO: 1591364 - RNA, 14 nt, Pseudomonas putida KT2440
caaacagcucgaca

SEQ ID NO: 1591365 - RNA, 21 nt, Pseudomonas putida KT2440
caaacagcucgacaacccgcg

SEQ ID NO: 1591366 - RNA, 18 nt, Pseudomonas putida KT2440
augaaggcggggagcgaa

SEQ ID NO: 1591367 - RNA, 12 nt, Pseudomonas putida KT2440
aucuucuugccg

SEQ ID NO: 1591368 - RNA, 12 nt, Pseudomonas putida KT2440
aucuuggccagg

SEQ ID NO: 1591369 - RNA, 15 nt, Pseudomonas putida KT2440
aucuugcgcgccagc

SEQ ID NO: 1591370 - RNA, 14 nt, Pseudomonas putida KT2440
aucuugcuggccgg

SEQ ID NO: 1591371 - RNA, 13 nt, Pseudomonas putida KT2440
augcagcggccag

SEQ ID NO: 1591372 - RNA, 17 nt, Pseudomonas putida KT2440
augcagguucgaccaga

SEQ ID NO: 1591373 - RNA, 21 nt, Pseudomonas putida KT2440
augcagguugcccucggccac

SEQ ID NO: 1591374 - RNA, 13 nt, Pseudomonas putida KT2440
augcagggccuuu

SEQ ID NO: 1591375 - RNA, 15 nt, Pseudomonas putida KT2440
augcaggucgaccug

SEQ ID NO: 1591376 - RNA, 20 nt, Pseudomonas putida KT2440
augcaggucgaccugccagu

SEQ ID NO: 1591377 - RNA, 22 nt, Pseudomonas putida KT2440
augcaggcaguaggccaccguu

SEQ ID NO: 1591378 - RNA, 21 nt, Pseudomonas putida KT2440
augcacucgccgauaaagcgu

SEQ ID NO: 1591379 - RNA, 12 nt, Pseudomonas putida KT2440
augcaacccgca

SEQ ID NO: 1591380 - RNA, 13 nt, Pseudomonas putida KT2440
augcacagcgagc

SEQ ID NO: 1591381 - RNA, 13 nt, Pseudomonas putida KT2440
augcaagcagcca

SEQ ID NO: 1591382 - RNA, 18 nt, Pseudomonas putida KT2440
augagcaagacgggauca

SEQ ID NO: 1591383 - RNA, 13 nt, Pseudomonas putida KT2440
aucgggaucagca

SEQ ID NO: 1591384 - RNA, 15 nt, Pseudomonas putida KT2440
aucgggaucaugccg

SEQ ID NO: 1591385 - RNA, 16 nt, Pseudomonas putida KT2440
aucgaauagcccaccu

SEQ ID NO: 1591386 - RNA, 15 nt, Pseudomonas putida KT2440
aucgacaaucggcuc

SEQ ID NO: 1591387 - RNA, 16 nt, Pseudomonas putida KT2440
aucgaaccagcagcac

SEQ ID NO: 1591388 - RNA, 20 nt, Pseudomonas putida KT2440
aucgaaccagcagcaccugc

SEQ ID NO: 1591389 - RNA, 18 nt, Pseudomonas putida KT2440
aucgaagcagugcugcca

SEQ ID NO: 1591390 - RNA, 17 nt, Pseudomonas putida KT2440
aucguagccugaggggu

SEQ ID NO: 1591391 - RNA, 19 nt, Pseudomonas putida KT2440
aucgucggccccggcccca

SEQ ID NO: 1591392 - RNA, 19 nt, Pseudomonas putida KT2440
aucuccaugaaggccggca

SEQ ID NO: 1591393 - RNA, 14 nt, Pseudomonas putida KT2440
aucucacggccauc

SEQ ID NO: 1591394 - RNA, 19 nt, Pseudomonas putida KT2440
aucucugugggagcgggcg

SEQ ID NO: 1591395 - RNA, 15 nt, Pseudomonas putida KT2440
aucucuuccagcguc

SEQ ID NO: 1591396 - RNA, 20 nt, Pseudomonas putida KT2440
aucugaaaccguuggucagc

SEQ ID NO: 1591397 - RNA, 17 nt, Pseudomonas putida KT2440
aucugaaaguucagcgc

SEQ ID NO: 1591398 - RNA, 13 nt, Pseudomonas putida KT2440
aucugacggcgcu

SEQ ID NO: 1591399 - RNA, 23 nt, Pseudomonas putida KT2440
auggcacccucaccaacugccug

SEQ ID NO: 1591400 - RNA, 13 nt, Pseudomonas putida KT2440
auggcaccgauca

SEQ ID NO: 1591401 - RNA, 23 nt, Pseudomonas putida KT2440
auggccgagcugauccgccuggc

SEQ ID NO: 1591402 - RNA, 15 nt, Pseudomonas putida KT2440
auggccgagcaggag

SEQ ID NO: 1591403 - RNA, 19 nt, Pseudomonas putida KT2440
auggccgccaaggcgaugc

SEQ ID NO: 1591404 - RNA, 20 nt, Pseudomonas putida KT2440
auggccacacgcugcugcug

SEQ ID NO: 1591405 - RNA, 21 nt, Pseudomonas putida KT2440
auggccaccaggguggcgauc

SEQ ID NO: 1591406 - RNA, 14 nt, Pseudomonas putida KT2440
auggcgcacagggc

SEQ ID NO: 1591407 - RNA, 13 nt, Pseudomonas putida KT2440
augcuggccagga

SEQ ID NO: 1591408 - RNA, 13 nt, Pseudomonas putida KT2440
augcucgucacca

SEQ ID NO: 1591409 - RNA, 12 nt, Pseudomonas putida KT2440
augcucggccag

SEQ ID NO: 1591410 - RNA, 19 nt, Pseudomonas putida KT2440
augcuggcaauccagcgug

SEQ ID NO: 1591411 - RNA, 19 nt, Pseudomonas putida KT2440
auggucagauaacccuugg

SEQ ID NO: 1591412 - RNA, 19 nt, Pseudomonas putida KT2440
auggucagccggcagucac

SEQ ID NO: 1591413 - RNA, 16 nt, Pseudomonas putida KT2440
augguugacagcgcuu

SEQ ID NO: 1591414 - RNA, 16 nt, Pseudomonas putida KT2440
augguugucgaacagc

SEQ ID NO: 1591415 - RNA, 18 nt, Pseudomonas putida KT2440
augguuuaaaccgcgaag

SEQ ID NO: 1591416 - RNA, 23 nt, Pseudomonas putida KT2440
auggcgguggccuucaucgcugc

SEQ ID NO: 1591417 - RNA, 17 nt, Pseudomonas putida KT2440
augggugagcacggcuu

SEQ ID NO: 1591418 - RNA, 23 nt, Pseudomonas putida KT2440
augggcuuuucguuggccagcuu

SEQ ID NO: 1591419 - RNA, 19 nt, Pseudomonas putida KT2440
augcccaguucgcgugcca

SEQ ID NO: 1591420 - RNA, 13 nt, Pseudomonas putida KT2440
augcccaggcccg

SEQ ID NO: 1591421 - RNA, 14 nt, Pseudomonas putida KT2440
augcccagcgccac

SEQ ID NO: 1591422 - RNA, 20 nt, Pseudomonas putida KT2440
augcccagcgccaccggcag

SEQ ID NO: 1591423 - RNA, 20 nt, Pseudomonas putida KT2440
augccagcuaucucccagcc

SEQ ID NO: 1591424 - RNA, 20 nt, Pseudomonas putida KT2440
augccagcaaaugcccacug

SEQ ID NO: 1591425 - RNA, 13 nt, Pseudomonas putida KT2440
augccaccgccac

SEQ ID NO: 1591426 - RNA, 18 nt, Pseudomonas putida KT2440
augcccgcgucugccgca

SEQ ID NO: 1591427 - RNA, 20 nt, Pseudomonas putida KT2440
augcccgcucccacagggac

SEQ ID NO: 1591428 - RNA, 12 nt, Pseudomonas putida KT2440
augcccgcucgc

SEQ ID NO: 1591429 - RNA, 20 nt, Pseudomonas putida KT2440
augcccgccaaaaggcccga

SEQ ID NO: 1591430 - RNA, 16 nt, Pseudomonas putida KT2440
augccccgggugcagc

SEQ ID NO: 1591431 - RNA, 15 nt, Pseudomonas putida KT2440
augccccuaccgcca

SEQ ID NO: 1591432 - RNA, 20 nt, Pseudomonas putida KT2440
augcccgcgcaaaucgccgc

SEQ ID NO: 1591433 - RNA, 16 nt, Pseudomonas putida KT2440
augccgaaggccuuca

SEQ ID NO: 1591434 - RNA, 17 nt, Pseudomonas putida KT2440
augccgacggugccggu

SEQ ID NO: 1591435 - RNA, 23 nt, Pseudomonas putida KT2440
augccgcccaucaccggcaccgg

SEQ ID NO: 1591436 - RNA, 22 nt, Pseudomonas putida KT2440
augcuccugcgccaccucggcg

SEQ ID NO: 1591437 - RNA, 19 nt, Pseudomonas putida KT2440
augcucgauaccguacugg

SEQ ID NO: 1591438 - RNA, 22 nt, Pseudomonas putida KT2440
augcucgauaccguacugguaa

SEQ ID NO: 1591439 - RNA, 16 nt, Pseudomonas putida KT2440
augcuccgccaccaga

SEQ ID NO: 1591440 - RNA, 15 nt, Pseudomonas putida KT2440
augcgggacucgauc

SEQ ID NO: 1591441 - RNA, 16 nt, Pseudomonas putida KT2440
augcgcgacagcauca

SEQ ID NO: 1591442 - RNA, 20 nt, Pseudomonas putida KT2440
augcgcgacagcaucaucag

SEQ ID NO: 1591443 - RNA, 16 nt, Pseudomonas putida KT2440
augcgcgcagcgaacg

SEQ ID NO: 1591444 - RNA, 19 nt, Pseudomonas putida KT2440
augcgcggcucgcugcgcu

SEQ ID NO: 1591445 - RNA, 22 nt, Pseudomonas putida KT2440
augcgcggcucgcugcgcuggc

SEQ ID NO: 1591446 - RNA, 16 nt, Pseudomonas putida KT2440
augcgcccuggcggcc

SEQ ID NO: 1591447 - RNA, 14 nt, Pseudomonas putida KT2440
augccgggaaggug

SEQ ID NO: 1591448 - RNA, 21 nt, Pseudomonas putida KT2440
augccuuccaggcgacggaac

SEQ ID NO: 1591449 - RNA, 14 nt, Pseudomonas putida KT2440
augccugugucgaa

SEQ ID NO: 1591450 - RNA, 16 nt, Pseudomonas putida KT2440
caagugccagaaccag

SEQ ID NO: 1591451 - RNA, 19 nt, Pseudomonas putida KT2440
caauaaccggcacaagcgu

SEQ ID NO: 1591452 - RNA, 14 nt, Pseudomonas putida KT2440
caaggucagcaagc

SEQ ID NO: 1591453 - RNA, 17 nt, Pseudomonas putida KT2440
caaggucagccagacga

SEQ ID NO: 1591454 - RNA, 20 nt, Pseudomonas putida KT2440
caaggucagcuucuggguau

SEQ ID NO: 1591455 - RNA, 19 nt, Pseudomonas putida KT2440
caagguaaucuggcugucg

SEQ ID NO: 1591456 - RNA, 16 nt, Pseudomonas putida KT2440
caagguccagccacga

SEQ ID NO: 1591457 - RNA, 20 nt, Pseudomonas putida KT2440
caagguagccugcugacgca

SEQ ID NO: 1591458 - RNA, 19 nt, Pseudomonas putida KT2440
caagguagcggcggcaaug

SEQ ID NO: 1591459 - RNA, 19 nt, Pseudomonas putida KT2440
caagucgcccaguuccaug

SEQ ID NO: 1591460 - RNA, 17 nt, Pseudomonas putida KT2440
caagcgucccugcccga

SEQ ID NO: 1591461 - RNA, 13 nt, Pseudomonas putida KT2440
caagcgcaccugc

SEQ ID NO: 1591462 - RNA, 24 nt, Pseudomonas putida KT2440
caagcgcaggcgguuggccauguu

SEQ ID NO: 1591463 - RNA, 14 nt, Pseudomonas putida KT2440
caagcgccagggca

SEQ ID NO: 1591464 - RNA, 23 nt, Pseudomonas putida KT2440
caagcccgcuccuacaacgaucu

SEQ ID NO: 1591465 - RNA, 19 nt, Pseudomonas putida KT2440
caagcccgcuccuacaggg

SEQ ID NO: 1591466 - RNA, 20 nt, Pseudomonas putida KT2440
caagcccgcuccuacagguu

SEQ ID NO: 1591467 - RNA, 19 nt, Pseudomonas putida KT2440
caagcggcagaacacaucg

SEQ ID NO: 1591468 - RNA, 19 nt, Pseudomonas putida KT2440
caacuggaccaucacggaa

SEQ ID NO: 1591469 - RNA, 22 nt, Pseudomonas putida KT2440
caacucaucacucuugcgccag

SEQ ID NO: 1591470 - RNA, 16 nt, Pseudomonas putida KT2440
caacuccccacccagg

SEQ ID NO: 1591471 - RNA, 20 nt, Pseudomonas putida KT2440
caacucgccaaaccauggcg

SEQ ID NO: 1591472 - RNA, 19 nt, Pseudomonas putida KT2440
caacuccucgaucaccugc

SEQ ID NO: 1591473 - RNA, 20 nt, Pseudomonas putida KT2440
caagcagccacccuccgcac

SEQ ID NO: 1591474 - RNA, 19 nt, Pseudomonas putida KT2440
caagcagcgaaugcagcuc

SEQ ID NO: 1591475 - RNA, 21 nt, Pseudomonas putida KT2440
caagcagcgaaugcagcucga

SEQ ID NO: 1591476 - RNA, 14 nt, Pseudomonas putida KT2440
caagcacgcacagu

SEQ ID NO: 1591477 - RNA, 15 nt, Pseudomonas putida KT2440
caagcaccgcgcaca

SEQ ID NO: 1591478 - RNA, 15 nt, Pseudomonas putida KT2440
caagccccuggaagc

SEQ ID NO: 1591479 - RNA, 22 nt, Pseudomonas putida KT2440
caagcauucgcauuaccagcac

SEQ ID NO: 1591480 - RNA, 23 nt, Pseudomonas putida KT2440
caagccaaugguauugcccgaca

SEQ ID NO: 1591481 - RNA, 14 nt, Pseudomonas putida KT2440
caagccacgcaccu

SEQ ID NO: 1591482 - RNA, 17 nt, Pseudomonas putida KT2440
caagaacugcgacgaac

SEQ ID NO: 1591483 - RNA, 23 nt, Pseudomonas putida KT2440
caagaauuucuaccaaccugcca

SEQ ID NO: 1591484 - RNA, 13 nt, Pseudomonas putida KT2440
caagaaugcccgg

SEQ ID NO: 1591485 - RNA, 16 nt, Pseudomonas putida KT2440
cacaccacagcugcac

SEQ ID NO: 1591486 - RNA, 13 nt, Pseudomonas putida KT2440
cacacagaugccg

SEQ ID NO: 1591487 - RNA, 22 nt, Pseudomonas putida KT2440
cacacagaugccgccgcugcca

SEQ ID NO: 1591488 - RNA, 22 nt, Pseudomonas putida KT2440
cacacaagccccccuguaggag

SEQ ID NO: 1591489 - RNA, 19 nt, Pseudomonas putida KT2440
cacaagcgucccugcccga

SEQ ID NO: 1591490 - RNA, 15 nt, Pseudomonas putida KT2440
cacaagggccagguc

SEQ ID NO: 1591491 - RNA, 16 nt, Pseudomonas putida KT2440
cacaaguccgaacucc

SEQ ID NO: 1591492 - RNA, 19 nt, Pseudomonas putida KT2440
caauugccaccggcgcugc

SEQ ID NO: 1591493 - RNA, 19 nt, Pseudomonas putida KT2440
caauugcggguguggccac

SEQ ID NO: 1591494 - RNA, 18 nt, Pseudomonas putida KT2440
caaugucuaaaagcuggc

SEQ ID NO: 1591495 - RNA, 20 nt, Pseudomonas putida KT2440
caaugguuuaguccugcagc

SEQ ID NO: 1591496 - RNA, 18 nt, Pseudomonas putida KT2440
cacaacccaucacggccu

SEQ ID NO: 1591497 - RNA, 14 nt, Pseudomonas putida KT2440
cacaaccacugcaa

SEQ ID NO: 1591498 - RNA, 15 nt, Pseudomonas putida KT2440
caauuucuacccgcc

SEQ ID NO: 1591499 - RNA, 14 nt, Pseudomonas putida KT2440
caaucaggucaucg

SEQ ID NO: 1591500 - RNA, 18 nt, Pseudomonas putida KT2440
caaucaggucaucgaaga

SEQ ID NO: 1591501 - RNA, 14 nt, Pseudomonas putida KT2440
caaucaucuugcca

SEQ ID NO: 1591502 - RNA, 14 nt, Pseudomonas putida KT2440
caauaccgacaagu

SEQ ID NO: 1591503 - RNA, 18 nt, Pseudomonas putida KT2440
caauacccgcaacgaucg

SEQ ID NO: 1591504 - RNA, 13 nt, Pseudomonas putida KT2440
caauaccagccug

SEQ ID NO: 1591505 - RNA, 15 nt, Pseudomonas putida KT2440
caaucagcgacaacg

SEQ ID NO: 1591506 - RNA, 16 nt, Pseudomonas putida KT2440
caaucagcucacaggc

SEQ ID NO: 1591507 - RNA, 14 nt, Pseudomonas putida KT2440
caaugacuccgccc

SEQ ID NO: 1591508 - RNA, 24 nt, Pseudomonas putida KT2440
caaugacaauugucgguacuggcu

SEQ ID NO: 1591509 - RNA, 22 nt, Pseudomonas putida KT2440
caaucgguucgcccgguuccag

SEQ ID NO: 1591510 - RNA, 22 nt, Pseudomonas putida KT2440
caaucgggauggcaccggcagu

SEQ ID NO: 1591511 - RNA, 20 nt, Pseudomonas putida KT2440
caaucggcucaacagccacg

SEQ ID NO: 1591512 - RNA, 17 nt, Pseudomonas putida KT2440
caaugcgcgcgaaggcc

SEQ ID NO: 1591513 - RNA, 16 nt, Pseudomonas putida KT2440
caaugccuuggcccuc

SEQ ID NO: 1591514 - RNA, 14 nt, Pseudomonas putida KT2440
caaugcgguccucc

SEQ ID NO: 1591515 - RNA, 14 nt, Pseudomonas putida KT2440
caaugccgccuugc

SEQ ID NO: 1591516 - RNA, 20 nt, Pseudomonas putida KT2440
cacccagcacccgcaggcga

SEQ ID NO: 1591517 - RNA, 12 nt, Pseudomonas putida KT2440
cacccagcgcau

SEQ ID NO: 1591518 - RNA, 16 nt, Pseudomonas putida KT2440
cacccagcucgccaac

SEQ ID NO: 1591519 - RNA, 16 nt, Pseudomonas putida KT2440
cacccaaccugccgau

SEQ ID NO: 1591520 - RNA, 20 nt, Pseudomonas putida KT2440
cacccaacgaacggaacagg

SEQ ID NO: 1591521 - RNA, 22 nt, Pseudomonas putida KT2440
cacccagaacagccacagcugc

SEQ ID NO: 1591522 - RNA, 23 nt, Pseudomonas putida KT2440
cacccacuuggaaaacagcgcgc

SEQ ID NO: 1591523 - RNA, 21 nt, Pseudomonas putida KT2440
cacccaccacggccuggccug

SEQ ID NO: 1591524 - RNA, 14 nt, Pseudomonas putida KT2440
caccaggucgcggu

SEQ ID NO: 1591525 - RNA, 14 nt, Pseudomonas putida KT2440
caccaggccgauca

SEQ ID NO: 1591526 - RNA, 15 nt, Pseudomonas putida KT2440
caccaggccgaucac

SEQ ID NO: 1591527 - RNA, 23 nt, Pseudomonas putida KT2440
caccaggauugccgggcuacgca

SEQ ID NO: 1591528 - RNA, 17 nt, Pseudomonas putida KT2440
caccaggauuggccgca

SEQ ID NO: 1591529 - RNA, 14 nt, Pseudomonas putida KT2440
caccaggcccgcaa

SEQ ID NO: 1591530 - RNA, 18 nt, Pseudomonas putida KT2440
caccaggcaauugugccg

SEQ ID NO: 1591531 - RNA, 22 nt, Pseudomonas putida KT2440
caccagucugcucagccaaccg

SEQ ID NO: 1591532 - RNA, 18 nt, Pseudomonas putida KT2440
caccaucaggcacaggcc

SEQ ID NO: 1591533 - RNA, 14 nt, Pseudomonas putida KT2440
caccaucggcucca

SEQ ID NO: 1591534 - RNA, 17 nt, Pseudomonas putida KT2440
caccaucggcuccagcg

SEQ ID NO: 1591535 - RNA, 14 nt, Pseudomonas putida KT2440
caccaucuccagcu

SEQ ID NO: 1591536 - RNA, 22 nt, Pseudomonas putida KT2440
caccaucggugcggcccccugg

SEQ ID NO: 1591537 - RNA, 14 nt, Pseudomonas putida KT2440
caccaucgaccugg

SEQ ID NO: 1591538 - RNA, 15 nt, Pseudomonas putida KT2440
caccaucgaccuggc

SEQ ID NO: 1591539 - RNA, 20 nt, Pseudomonas putida KT2440
caccacugucagccagcggu

SEQ ID NO: 1591540 - RNA, 23 nt, Pseudomonas putida KT2440
caccacgaacuuguuggccacca

SEQ ID NO: 1591541 - RNA, 20 nt, Pseudomonas putida KT2440
caccacgaacaguggcccga

SEQ ID NO: 1591542 - RNA, 20 nt, Pseudomonas putida KT2440
caccaccugcagggucaggc

SEQ ID NO: 1591543 - RNA, 14 nt, Pseudomonas putida KT2440
caccaccgauccgg

SEQ ID NO: 1591544 - RNA, 14 nt, Pseudomonas putida KT2440
caccagcaccagcu

SEQ ID NO: 1591545 - RNA, 15 nt, Pseudomonas putida KT2440
caccagcaccagcuc

SEQ ID NO: 1591546 - RNA, 17 nt, Pseudomonas putida KT2440
caccagauucaagcccg

SEQ ID NO: 1591547 - RNA, 14 nt, Pseudomonas putida KT2440
caccagaccagcag

SEQ ID NO: 1591548 - RNA, 15 nt, Pseudomonas putida KT2440
caccagaccagcagc

SEQ ID NO: 1591549 - RNA, 14 nt, Pseudomonas putida KT2440
caccagcauaugga

SEQ ID NO: 1591550 - RNA, 20 nt, Pseudomonas putida KT2440
caccagcaccugcagguaca

SEQ ID NO: 1591551 - RNA, 14 nt, Pseudomonas putida KT2440
caccagcacugccu

SEQ ID NO: 1591552 - RNA, 16 nt, Pseudomonas putida KT2440
caccagcacugcugcg

SEQ ID NO: 1591553 - RNA, 16 nt, Pseudomonas putida KT2440
caccagccccagcgcc

SEQ ID NO: 1591554 - RNA, 21 nt, Pseudomonas putida KT2440
cacacgcuccgggugcggcau

SEQ ID NO: 1591555 - RNA, 14 nt, Pseudomonas putida KT2440
cacacgggcguuca

SEQ ID NO: 1591556 - RNA, 11 nt, Pseudomonas putida KT2440
cacacggcggu

SEQ ID NO: 1591557 - RNA, 22 nt, Pseudomonas putida KT2440
cacacccucgccccgcgcaagc

SEQ ID NO: 1591558 - RNA, 13 nt, Pseudomonas putida KT2440
cacaccgcgcacc

SEQ ID NO: 1591559 - RNA, 13 nt, Pseudomonas putida KT2440
cacaccggcaauc

SEQ ID NO: 1591560 - RNA, 12 nt, Pseudomonas putida KT2440
cacacccugcga

SEQ ID NO: 1591561 - RNA, 22 nt, Pseudomonas putida KT2440
cacacccugucgaucacgggca

SEQ ID NO: 1591562 - RNA, 20 nt, Pseudomonas putida KT2440
cacaccccagaacggcacgc

SEQ ID NO: 1591563 - RNA, 17 nt, Pseudomonas putida KT2440
cacacccagcgcggcaa

SEQ ID NO: 1591564 - RNA, 16 nt, Pseudomonas putida KT2440
cacagauaaaccugcc

SEQ ID NO: 1591565 - RNA, 15 nt, Pseudomonas putida KT2440
cacagaucaacgccg

SEQ ID NO: 1591566 - RNA, 14 nt, Pseudomonas putida KT2440
cacagaugccgccg

SEQ ID NO: 1591567 - RNA, 15 nt, Pseudomonas putida KT2440
cacagcgccugcugc

SEQ ID NO: 1591568 - RNA, 17 nt, Pseudomonas putida KT2440
cacagcgagcagccugg

SEQ ID NO: 1591569 - RNA, 16 nt, Pseudomonas putida KT2440
cacacuucgccgugcu

SEQ ID NO: 1591570 - RNA, 16 nt, Pseudomonas putida KT2440
cacacuggucacgcuc

SEQ ID NO: 1591571 - RNA, 13 nt, Pseudomonas putida KT2440
cacagagacaccg

SEQ ID NO: 1591572 - RNA, 20 nt, Pseudomonas putida KT2440
cacacucuuccugccgcagc

SEQ ID NO: 1591573 - RNA, 19 nt, Pseudomonas putida KT2440
cacacucagccgcugcgcc

SEQ ID NO: 1591574 - RNA, 23 nt, Pseudomonas putida KT2440
cacacucagccgcugcgccugcc

SEQ ID NO: 1591575 - RNA, 19 nt, Pseudomonas putida KT2440
cacacguuguccgacagcu

SEQ ID NO: 1591576 - RNA, 15 nt, Pseudomonas putida KT2440
caccacaagaacugc

SEQ ID NO: 1591577 - RNA, 19 nt, Pseudomonas putida KT2440
caccacaaaccacagcggc

SEQ ID NO: 1591578 - RNA, 20 nt, Pseudomonas putida KT2440
caccaacuggucggccuugc

SEQ ID NO: 1591579 - RNA, 20 nt, Pseudomonas putida KT2440
caccaccccggggcgcucca

SEQ ID NO: 1591580 - RNA, 23 nt, Pseudomonas putida KT2440
caccaccccggggcgcuccagca

SEQ ID NO: 1591581 - RNA, 19 nt, Pseudomonas putida KT2440
caccaccgagccuuccggg

SEQ ID NO: 1591582 - RNA, 17 nt, Pseudomonas putida KT2440
caccaccgaccgcaccg

SEQ ID NO: 1591583 - RNA, 21 nt, Pseudomonas putida KT2440
caccacccccagcgaccagcu

SEQ ID NO: 1591584 - RNA, 20 nt, Pseudomonas putida KT2440
caccacccccagcgccucca

SEQ ID NO: 1591585 - RNA, 16 nt, Pseudomonas putida KT2440
caccacagcugcacau

SEQ ID NO: 1591586 - RNA, 15 nt, Pseudomonas putida KT2440
caccacaucggcggc

SEQ ID NO: 1591587 - RNA, 15 nt, Pseudomonas putida KT2440
caccacauacggcgc

SEQ ID NO: 1591588 - RNA, 16 nt, Pseudomonas putida KT2440
caccacauacggcgca

SEQ ID NO: 1591589 - RNA, 22 nt, Pseudomonas putida KT2440
cacagguuuagcgcuggcuuug

SEQ ID NO: 1591590 - RNA, 21 nt, Pseudomonas putida KT2440
cacagguacugcgcaaucccu

SEQ ID NO: 1591591 - RNA, 21 nt, Pseudomonas putida KT2440
cacaggucauuugcagugcuu

SEQ ID NO: 1591592 - RNA, 22 nt, Pseudomonas putida KT2440
cacaggggaucgcgcaagccuu

SEQ ID NO: 1591593 - RNA, 13 nt, Pseudomonas putida KT2440
cacagggcggcca

SEQ ID NO: 1591594 - RNA, 17 nt, Pseudomonas putida KT2440
cacagggcggccaaggc

SEQ ID NO: 1591595 - RNA, 22 nt, Pseudomonas putida KT2440
cacaggcuacgcagcacccggu

SEQ ID NO: 1591596 - RNA, 18 nt, Pseudomonas putida KT2440
cacagcggccccaucacc

SEQ ID NO: 1591597 - RNA, 20 nt, Pseudomonas putida KT2440
cacagcgcucgaugcggugg

SEQ ID NO: 1591598 - RNA, 16 nt, Pseudomonas putida KT2440
cacauccucaaaggca

SEQ ID NO: 1591599 - RNA, 15 nt, Pseudomonas putida KT2440
cacaucggcggcaau

SEQ ID NO: 1591600 - RNA, 23 nt, Pseudomonas putida KT2440
cacaucggcggcaaugucgucca

SEQ ID NO: 1591601 - RNA, 15 nt, Pseudomonas putida KT2440
cacaucggcaaucgc

SEQ ID NO: 1591602 - RNA, 15 nt, Pseudomonas putida KT2440
cacaucgcuucugca

SEQ ID NO: 1591603 - RNA, 18 nt, Pseudomonas putida KT2440
cacaucgguuucgccggu

SEQ ID NO: 1591604 - RNA, 18 nt, Pseudomonas putida KT2440
cacgacgcucggacagcu

SEQ ID NO: 1591605 - RNA, 20 nt, Pseudomonas putida KT2440
cacgacgauggccaccagca

SEQ ID NO: 1591606 - RNA, 22 nt, Pseudomonas putida KT2440
cacgacgauggccaccagcacc

SEQ ID NO: 1591607 - RNA, 17 nt, Pseudomonas putida KT2440
cacgacgcaggucgcca

SEQ ID NO: 1591608 - RNA, 19 nt, Pseudomonas putida KT2440
cacgaccggcucaacagca

SEQ ID NO: 1591609 - RNA, 19 nt, Pseudomonas putida KT2440
cacgacaggggcgcagagc

SEQ ID NO: 1591610 - RNA, 14 nt, Pseudomonas putida KT2440
cacgaaguaacggc

SEQ ID NO: 1591611 - RNA, 19 nt, Pseudomonas putida KT2440
cacgaaguugagcaccggc

SEQ ID NO: 1591612 - RNA, 21 nt, Pseudomonas putida KT2440
cacgaaguugagcaccggcag

SEQ ID NO: 1591613 - RNA, 17 nt, Pseudomonas putida KT2440
cacgaucaugcuggcca

SEQ ID NO: 1591614 - RNA, 15 nt, Pseudomonas putida KT2440
cacgaucagcagcaa

SEQ ID NO: 1591615 - RNA, 18 nt, Pseudomonas putida KT2440
cacgaucagcgcggcaaa

SEQ ID NO: 1591616 - RNA, 18 nt, Pseudomonas putida KT2440
cacgaucucuucaccgua

SEQ ID NO: 1591617 - RNA, 18 nt, Pseudomonas putida KT2440
cacgaucucacgcgccac

SEQ ID NO: 1591618 - RNA, 22 nt, Pseudomonas putida KT2440
cacgauagcgucagcagggcca

SEQ ID NO: 1591619 - RNA, 16 nt, Pseudomonas putida KT2440
cacgagacauccgcaa

SEQ ID NO: 1591620 - RNA, 19 nt, Pseudomonas putida KT2440
cacgagacauccgcaacau

SEQ ID NO: 1591621 - RNA, 18 nt, Pseudomonas putida KT2440
caccuugugcggcccucg

SEQ ID NO: 1591622 - RNA, 18 nt, Pseudomonas putida KT2440
caccuuucuccaggugga

SEQ ID NO: 1591623 - RNA, 17 nt, Pseudomonas putida KT2440
caccuugggagucggcu

SEQ ID NO: 1591624 - RNA, 13 nt, Pseudomonas putida KT2440
caccuugggcgag

SEQ ID NO: 1591625 - RNA, 18 nt, Pseudomonas putida KT2440
caccuuggugcgcgcauc

SEQ ID NO: 1591626 - RNA, 20 nt, Pseudomonas putida KT2440
caccuuggugcgcgcaucca

SEQ ID NO: 1591627 - RNA, 14 nt, Pseudomonas putida KT2440
cacgaaggccagca

SEQ ID NO: 1591628 - RNA, 14 nt, Pseudomonas putida KT2440
cacgaagcccaguu

SEQ ID NO: 1591629 - RNA, 15 nt, Pseudomonas putida KT2440
cacgaaaaagccagc

SEQ ID NO: 1591630 - RNA, 13 nt, Pseudomonas putida KT2440
caccuuugaccgu

SEQ ID NO: 1591631 - RNA, 18 nt, Pseudomonas putida KT2440
cacgaaacgccacgccca

SEQ ID NO: 1591632 - RNA, 14 nt, Pseudomonas putida KT2440
cacgaacaggcgcu

SEQ ID NO: 1591633 - RNA, 19 nt, Pseudomonas putida KT2440
caccuguucccccaccggc

SEQ ID NO: 1591634 - RNA, 18 nt, Pseudomonas putida KT2440
caccuucgagccaccggc

SEQ ID NO: 1591635 - RNA, 14 nt, Pseudomonas putida KT2440
caccuucaccccgu

SEQ ID NO: 1591636 - RNA, 22 nt, Pseudomonas putida KT2440
caccugggcgaucacauaaggc

SEQ ID NO: 1591637 - RNA, 12 nt, Pseudomonas putida KT2440
caccugcgccuu

SEQ ID NO: 1591638 - RNA, 22 nt, Pseudomonas putida KT2440
caccugccccagcgucacccgu

SEQ ID NO: 1591639 - RNA, 22 nt, Pseudomonas putida KT2440
caccugccgcgauaagcgcgau

SEQ ID NO: 1591640 - RNA, 13 nt, Pseudomonas putida KT2440
caccugccgggca

SEQ ID NO: 1591641 - RNA, 19 nt, Pseudomonas putida KT2440
caccugcucggcgcgguca

SEQ ID NO: 1591642 - RNA, 14 nt, Pseudomonas putida KT2440
caccugcuccagca

SEQ ID NO: 1591643 - RNA, 23 nt, Pseudomonas putida KT2440
caccuggcccugcucacgcagcu

SEQ ID NO: 1591644 - RNA, 17 nt, Pseudomonas putida KT2440
caccuggcagccgaagc

SEQ ID NO: 1591645 - RNA, 21 nt, Pseudomonas putida KT2440
caccuggccguguucgacgau

SEQ ID NO: 1591646 - RNA, 22 nt, Pseudomonas putida KT2440
caccuggaauucgcugcgcauc

SEQ ID NO: 1591647 - RNA, 20 nt, Pseudomonas putida KT2440
caccugcuugccgcuggcau

SEQ ID NO: 1591648 - RNA, 21 nt, Pseudomonas putida KT2440
cacgcacgaucucccggcuca

SEQ ID NO: 1591649 - RNA, 13 nt, Pseudomonas putida KT2440
cacgcacaguggu

SEQ ID NO: 1591650 - RNA, 19 nt, Pseudomonas putida KT2440
cacgcacauucaggaugcu

SEQ ID NO: 1591651 - RNA, 15 nt, Pseudomonas putida KT2440
cacgcaacaggucga

SEQ ID NO: 1591652 - RNA, 17 nt, Pseudomonas putida KT2440
cacgcaggccagcgcac

SEQ ID NO: 1591653 - RNA, 15 nt, Pseudomonas putida KT2440
cacgcaggcccagca

SEQ ID NO: 1591654 - RNA, 12 nt, Pseudomonas putida KT2440
cacgcaggcgca

SEQ ID NO: 1591655 - RNA, 14 nt, Pseudomonas putida KT2440
cacgcagggccaga

SEQ ID NO: 1591656 - RNA, 12 nt, Pseudomonas putida KT2440
cacgcagcucgg

SEQ ID NO: 1591657 - RNA, 22 nt, Pseudomonas putida KT2440
cacgcaaaaccugagucaggcg

SEQ ID NO: 1591658 - RNA, 17 nt, Pseudomonas putida KT2440
cacgaugccugggcggu

SEQ ID NO: 1591659 - RNA, 18 nt, Pseudomonas putida KT2440
cacgaugcccauggcgca

SEQ ID NO: 1591660 - RNA, 15 nt, Pseudomonas putida KT2440
cacgcauggccgagg

SEQ ID NO: 1591661 - RNA, 15 nt, Pseudomonas putida KT2440
cacgcaucugcaccu

SEQ ID NO: 1591662 - RNA, 18 nt, Pseudomonas putida KT2440
cacgcaucugcgcuaccu

SEQ ID NO: 1591663 - RNA, 17 nt, Pseudomonas putida KT2440
cacgcaugcgcgacagc

SEQ ID NO: 1591664 - RNA, 16 nt, Pseudomonas putida KT2440
cacgcaguuggccauc

SEQ ID NO: 1591665 - RNA, 18 nt, Pseudomonas putida KT2440
cacgccagccaguacggc

SEQ ID NO: 1591666 - RNA, 18 nt, Pseudomonas putida KT2440
cacgccagaaccugacaa

SEQ ID NO: 1591667 - RNA, 14 nt, Pseudomonas putida KT2440
cacgccacggaaca

SEQ ID NO: 1591668 - RNA, 20 nt, Pseudomonas putida KT2440
cacgccacggaacaucgagg

SEQ ID NO: 1591669 - RNA, 16 nt, Pseudomonas putida KT2440
cacgccagccguugau

SEQ ID NO: 1591670 - RNA, 14 nt, Pseudomonas putida KT2440
cacgcccaggcgcu

SEQ ID NO: 1591671 - RNA, 22 nt, Pseudomonas putida KT2440
cacgccauguaccgggcggcca

SEQ ID NO: 1591672 - RNA, 17 nt, Pseudomonas putida KT2440
cacgcccaucaggaaca

SEQ ID NO: 1591673 - RNA, 19 nt, Pseudomonas putida KT2440
cacgcccaucaggaacagc

SEQ ID NO: 1591674 - RNA, 21 nt, Pseudomonas putida KT2440
cacgcccaucaggaacagcuc

SEQ ID NO: 1591675 - RNA, 23 nt, Pseudomonas putida KT2440
cacgcccaucaggaacagcucga

SEQ ID NO: 1591676 - RNA, 16 nt, Pseudomonas putida KT2440
cacgcccgacuggcug

SEQ ID NO: 1591677 - RNA, 20 nt, Pseudomonas putida KT2440
cacgcccgacuggcuggccu

SEQ ID NO: 1591678 - RNA, 20 nt, Pseudomonas putida KT2440
cacgccccuuggcacggcca

SEQ ID NO: 1591679 - RNA, 23 nt, Pseudomonas putida KT2440
cacgccccuuggcacggccagcc

SEQ ID NO: 1591680 - RNA, 12 nt, Pseudomonas putida KT2440
cacgccugcgcc

SEQ ID NO: 1591681 - RNA, 19 nt, Pseudomonas putida KT2440
cacgccugcgccgcucgug

SEQ ID NO: 1591682 - RNA, 13 nt, Pseudomonas putida KT2440
cacgcccuuggcu

SEQ ID NO: 1591683 - RNA, 13 nt, Pseudomonas putida KT2440
cacgcccgucacc

SEQ ID NO: 1591684 - RNA, 17 nt, Pseudomonas putida KT2440
cacgcccgugcucacgc

SEQ ID NO: 1591685 - RNA, 19 nt, Pseudomonas putida KT2440
cacgcccgugcucacgcac

SEQ ID NO: 1591686 - RNA, 16 nt, Pseudomonas putida KT2440
cacgcccgggccaggc

SEQ ID NO: 1591687 - RNA, 22 nt, Pseudomonas putida KT2440
cacgcccgcucccacaggugca

SEQ ID NO: 1591688 - RNA, 22 nt, Pseudomonas putida KT2440
cacgccgccgauaccgaacacc

SEQ ID NO: 1591689 - RNA, 18 nt, Pseudomonas putida KT2440
caccgguagcggcguugu

SEQ ID NO: 1591690 - RNA, 16 nt, Pseudomonas putida KT2440
caccgguauagcgaca

SEQ ID NO: 1591691 - RNA, 14 nt, Pseudomonas putida KT2440
caccgggaucgaga

SEQ ID NO: 1591692 - RNA, 23 nt, Pseudomonas putida KT2440
caccgggaucgagaucaggugga

SEQ ID NO: 1591693 - RNA, 16 nt, Pseudomonas putida KT2440
caccggaggacacauc

SEQ ID NO: 1591694 - RNA, 19 nt, Pseudomonas putida KT2440
caccggcuuugccgguguu

SEQ ID NO: 1591695 - RNA, 13 nt, Pseudomonas putida KT2440
caccggcuucgcc

SEQ ID NO: 1591696 - RNA, 15 nt, Pseudomonas putida KT2440
caccggcuucgccgg

SEQ ID NO: 1591697 - RNA, 20 nt, Pseudomonas putida KT2440
caccggcuucgccgguguuc

SEQ ID NO: 1591698 - RNA, 16 nt, Pseudomonas putida KT2440
caccggcuucuaccac

SEQ ID NO: 1591699 - RNA, 18 nt, Pseudomonas putida KT2440
caccggcugcgccggugu

SEQ ID NO: 1591700 - RNA, 18 nt, Pseudomonas putida KT2440
caccggcucugccggugu

SEQ ID NO: 1591701 - RNA, 14 nt, Pseudomonas putida KT2440
caccuccgcccggu

SEQ ID NO: 1591702 - RNA, 14 nt, Pseudomonas putida KT2440
caccugcagcgcgu

SEQ ID NO: 1591703 - RNA, 18 nt, Pseudomonas putida KT2440
caccugcagguacagcag

SEQ ID NO: 1591704 - RNA, 14 nt, Pseudomonas putida KT2440
caccugccaggcca

SEQ ID NO: 1591705 - RNA, 15 nt, Pseudomonas putida KT2440
caccugccaggccaa

SEQ ID NO: 1591706 - RNA, 15 nt, Pseudomonas putida KT2440
caccugccagccgca

SEQ ID NO: 1591707 - RNA, 16 nt, Pseudomonas putida KT2440
caccucuggguagugc

SEQ ID NO: 1591708 - RNA, 13 nt, Pseudomonas putida KT2440
caccgcacccggc

SEQ ID NO: 1591709 - RNA, 14 nt, Pseudomonas putida KT2440
caccgcacccggcg

SEQ ID NO: 1591710 - RNA, 15 nt, Pseudomonas putida KT2440
caccgcaacccagcc

SEQ ID NO: 1591711 - RNA, 17 nt, Pseudomonas putida KT2440
caccgcaagcugcaccg

SEQ ID NO: 1591712 - RNA, 15 nt, Pseudomonas putida KT2440
caccgccagcggcaa

SEQ ID NO: 1591713 - RNA, 13 nt, Pseudomonas putida KT2440
caccgccagcagc

SEQ ID NO: 1591714 - RNA, 19 nt, Pseudomonas putida KT2440
caccgccagcagcuggucg

SEQ ID NO: 1591715 - RNA, 16 nt, Pseudomonas putida KT2440
caccgcauacacaucg

SEQ ID NO: 1591716 - RNA, 18 nt, Pseudomonas putida KT2440
caccgcaggucacugcgu

SEQ ID NO: 1591717 - RNA, 20 nt, Pseudomonas putida KT2440
caccgagcugcccaaguaca

SEQ ID NO: 1591718 - RNA, 21 nt, Pseudomonas putida KT2440
caccgagugcggcaggccgaa

SEQ ID NO: 1591719 - RNA, 16 nt, Pseudomonas putida KT2440
caccccaaggcugcca

SEQ ID NO: 1591720 - RNA, 18 nt, Pseudomonas putida KT2440
caccccauagggccagcg

SEQ ID NO: 1591721 - RNA, 12 nt, Pseudomonas putida KT2440
caccccggcagu

SEQ ID NO: 1591722 - RNA, 18 nt, Pseudomonas putida KT2440
caccccggcguucagccg

SEQ ID NO: 1591723 - RNA, 18 nt, Pseudomonas putida KT2440
caccgagaugaucgcggc

SEQ ID NO: 1591724 - RNA, 16 nt, Pseudomonas putida KT2440
caccgagacgaucacc

SEQ ID NO: 1591725 - RNA, 22 nt, Pseudomonas putida KT2440
caccgacccacaggcacaggcc

SEQ ID NO: 1591726 - RNA, 14 nt, Pseudomonas putida KT2440
caccgacuggcgua

SEQ ID NO: 1591727 - RNA, 23 nt, Pseudomonas putida KT2440
caccgacucgguacgcacuguag

SEQ ID NO: 1591728 - RNA, 15 nt, Pseudomonas putida KT2440
caccgacagcaacgc

SEQ ID NO: 1591729 - RNA, 14 nt, Pseudomonas putida KT2440
caccgcgcgccagu

SEQ ID NO: 1591730 - RNA, 14 nt, Pseudomonas putida KT2440
caccgcuugcgcac

SEQ ID NO: 1591731 - RNA, 16 nt, Pseudomonas putida KT2440
caccgcuucacccucg

SEQ ID NO: 1591732 - RNA, 20 nt, Pseudomonas putida KT2440
caccgcuucacccucgcgca

SEQ ID NO: 1591733 - RNA, 14 nt, Pseudomonas putida KT2440
caccgcgccagccu

SEQ ID NO: 1591734 - RNA, 21 nt, Pseudomonas putida KT2440
caccgcgcacacuucgccggu

SEQ ID NO: 1591735 - RNA, 14 nt, Pseudomonas putida KT2440
caccgccagcgggc

SEQ ID NO: 1591736 - RNA, 17 nt, Pseudomonas putida KT2440
caccgccauggccaggu

SEQ ID NO: 1591737 - RNA, 16 nt, Pseudomonas putida KT2440
caccgccccagcgcgc

SEQ ID NO: 1591738 - RNA, 15 nt, Pseudomonas putida KT2440
cagccgcugcgccug

SEQ ID NO: 1591739 - RNA, 17 nt, Pseudomonas putida KT2440
cagccgcuguucugcag

SEQ ID NO: 1591740 - RNA, 14 nt, Pseudomonas putida KT2440
cagccgcacccagg

SEQ ID NO: 1591741 - RNA, 17 nt, Pseudomonas putida KT2440
cagccgccacaugcccg

SEQ ID NO: 1591742 - RNA, 17 nt, Pseudomonas putida KT2440
cagccggucucccagcg

SEQ ID NO: 1591743 - RNA, 20 nt, Pseudomonas putida KT2440
cagccggucucccagcgcug

SEQ ID NO: 1591744 - RNA, 16 nt, Pseudomonas putida KT2440
cagccggcgcuggaca

SEQ ID NO: 1591745 - RNA, 21 nt, Pseudomonas putida KT2440
cagccggcgcuggacagcggc

SEQ ID NO: 1591746 - RNA, 16 nt, Pseudomonas putida KT2440
cagccggcuuccagcg

SEQ ID NO: 1591747 - RNA, 23 nt, Pseudomonas putida KT2440
cagccgggcgguugucgaccugg

SEQ ID NO: 1591748 - RNA, 22 nt, Pseudomonas putida KT2440
cagccacgggcuuuaucgauga

SEQ ID NO: 1591749 - RNA, 15 nt, Pseudomonas putida KT2440
cagccacgcuggcac

SEQ ID NO: 1591750 - RNA, 12 nt, Pseudomonas putida KT2440
cagccacgcccg

SEQ ID NO: 1591751 - RNA, 13 nt, Pseudomonas putida KT2440
cagccacgucgcc

SEQ ID NO: 1591752 - RNA, 16 nt, Pseudomonas putida KT2440
cagccacgucgccagc

SEQ ID NO: 1591753 - RNA, 23 nt, Pseudomonas putida KT2440
cagccccuugcucuguucgcugg

SEQ ID NO: 1591754 - RNA, 19 nt, Pseudomonas putida KT2440
cagccacccggcgcgcagc

SEQ ID NO: 1591755 - RNA, 18 nt, Pseudomonas putida KT2440
cagccacccuccgcacag

SEQ ID NO: 1591756 - RNA, 14 nt, Pseudomonas putida KT2440
cagccaacgcccca

SEQ ID NO: 1591757 - RNA, 12 nt, Pseudomonas putida KT2440
cagccaacggcg

SEQ ID NO: 1591758 - RNA, 12 nt, Pseudomonas putida KT2440
cagccaacgguc

SEQ ID NO: 1591759 - RNA, 12 nt, Pseudomonas putida KT2440
cagccaccagcu

SEQ ID NO: 1591760 - RNA, 17 nt, Pseudomonas putida KT2440
cagcccggcggccagca

SEQ ID NO: 1591761 - RNA, 20 nt, Pseudomonas putida KT2440
cagcccggcggccagcacga

SEQ ID NO: 1591762 - RNA, 20 nt, Pseudomonas putida KT2440
cagcccgccaagggucgaca

SEQ ID NO: 1591763 - RNA, 15 nt, Pseudomonas putida KT2440
cagcccgaagcgcag

SEQ ID NO: 1591764 - RNA, 15 nt, Pseudomonas putida KT2440
cagcccuucgcaggc

SEQ ID NO: 1591765 - RNA, 14 nt, Pseudomonas putida KT2440
cagcccuucgcggg

SEQ ID NO: 1591766 - RNA, 21 nt, Pseudomonas putida KT2440
cagcccuucgcgggcacgccc

SEQ ID NO: 1591767 - RNA, 17 nt, Pseudomonas putida KT2440
cagcccuugcucggcca

SEQ ID NO: 1591768 - RNA, 12 nt, Pseudomonas putida KT2440
cagcccugcucg

SEQ ID NO: 1591769 - RNA, 21 nt, Pseudomonas putida KT2440
cagcccuucacuguggucauc

SEQ ID NO: 1591770 - RNA, 17 nt, Pseudomonas putida KT2440
cagcccggcuccgcgca

SEQ ID NO: 1591771 - RNA, 12 nt, Pseudomonas putida KT2440
cagcccguccgc

SEQ ID NO: 1591772 - RNA, 14 nt, Pseudomonas putida KT2440
cagcccggugcccu

SEQ ID NO: 1591773 - RNA, 18 nt, Pseudomonas putida KT2440
cagcgacgguggcguggc

SEQ ID NO: 1591774 - RNA, 20 nt, Pseudomonas putida KT2440
cagcgacaacggcuggcgga

SEQ ID NO: 1591775 - RNA, 17 nt, Pseudomonas putida KT2440
cagcgacaccagcgcac

SEQ ID NO: 1591776 - RNA, 16 nt, Pseudomonas putida KT2440
cagcgaagggcucaac

SEQ ID NO: 1591777 - RNA, 17 nt, Pseudomonas putida KT2440
cagcgaaugcagcucga

SEQ ID NO: 1591778 - RNA, 23 nt, Pseudomonas putida KT2440
cagccgucgccgcuucggcaugc

SEQ ID NO: 1591779 - RNA, 15 nt, Pseudomonas putida KT2440
cagcgaagccagcac

SEQ ID NO: 1591780 - RNA, 21 nt, Pseudomonas putida KT2440
cagccguucaccuuugagugc

SEQ ID NO: 1591781 - RNA, 22 nt, Pseudomonas putida KT2440
cagcgauaaaccagcagcgccu

SEQ ID NO: 1591782 - RNA, 23 nt, Pseudomonas putida KT2440
cagcgagucguaguucggcggaa

SEQ ID NO: 1591783 - RNA, 15 nt, Pseudomonas putida KT2440
cagcgcaaucaccgc

SEQ ID NO: 1591784 - RNA, 13 nt, Pseudomonas putida KT2440
cagcgaucagugc

SEQ ID NO: 1591785 - RNA, 15 nt, Pseudomonas putida KT2440
cagcgaucagugccu

SEQ ID NO: 1591786 - RNA, 14 nt, Pseudomonas putida KT2440
cagcgcaccgcuga

SEQ ID NO: 1591787 - RNA, 17 nt, Pseudomonas putida KT2440
cagcgcacagcugccgg

SEQ ID NO: 1591788 - RNA, 18 nt, Pseudomonas putida KT2440
cagcgcacagcugccggc

SEQ ID NO: 1591789 - RNA, 23 nt, Pseudomonas putida KT2440
cagcgcacagcugccggccagcg

SEQ ID NO: 1591790 - RNA, 16 nt, Pseudomonas putida KT2440
cagcgcaccacuguuc

SEQ ID NO: 1591791 - RNA, 16 nt, Pseudomonas putida KT2440
cagcgcaccgugcacc

SEQ ID NO: 1591792 - RNA, 17 nt, Pseudomonas putida KT2440
cagcgcaccgugcacca

SEQ ID NO: 1591793 - RNA, 20 nt, Pseudomonas putida KT2440
cagcgcaccgugcaccagca

SEQ ID NO: 1591794 - RNA, 11 nt, Pseudomonas putida KT2440
cagcgccagca

SEQ ID NO: 1591795 - RNA, 20 nt, Pseudomonas putida KT2440
cagcgccagcacgcaggcca

SEQ ID NO: 1591796 - RNA, 21 nt, Pseudomonas putida KT2440
cagcgcaggcuucaaggccac

SEQ ID NO: 1591797 - RNA, 23 nt, Pseudomonas putida KT2440
cagcgcagggaagguggccggca

SEQ ID NO: 1591798 - RNA, 17 nt, Pseudomonas putida KT2440
cagcgcagccaccagcu

SEQ ID NO: 1591799 - RNA, 17 nt, Pseudomonas putida KT2440
cagcgcagaaaccgcau

SEQ ID NO: 1591800 - RNA, 16 nt, Pseudomonas putida KT2440
cagcgcccgcugcgcc

SEQ ID NO: 1591801 - RNA, 15 nt, Pseudomonas putida KT2440
cagcgcccgguucca

SEQ ID NO: 1591802 - RNA, 17 nt, Pseudomonas putida KT2440
cagcgcccggcgcagca

SEQ ID NO: 1591803 - RNA, 19 nt, Pseudomonas putida KT2440
cagcgccgcaacggccgaa

SEQ ID NO: 1591804 - RNA, 16 nt, Pseudomonas putida KT2440
cagcgccgauggccaa

SEQ ID NO: 1591805 - RNA, 16 nt, Pseudomonas putida KT2440
cagcgccuggcgcagu

SEQ ID NO: 1591806 - RNA, 20 nt, Pseudomonas putida KT2440
cagcgccugugagaucgagc

SEQ ID NO: 1591807 - RNA, 16 nt, Pseudomonas putida KT2440
cagcgccuugaagcug

SEQ ID NO: 1591808 - RNA, 20 nt, Pseudomonas putida KT2440
cagcgccuuggccugcucac

SEQ ID NO: 1591809 - RNA, 13 nt, Pseudomonas putida KT2440
cagcgccuggcga

SEQ ID NO: 1591810 - RNA, 15 nt, Pseudomonas putida KT2440
cagcgccugcugcca

SEQ ID NO: 1591811 - RNA, 13 nt, Pseudomonas putida KT2440
cagcgccugcagc

SEQ ID NO: 1591812 - RNA, 14 nt, Pseudomonas putida KT2440
cagcgccugcagcg

SEQ ID NO: 1591813 - RNA, 15 nt, Pseudomonas putida KT2440
cagcgccugcagcgc

SEQ ID NO: 1591814 - RNA, 16 nt, Pseudomonas putida KT2440
cagcgccugcaggccc

SEQ ID NO: 1591815 - RNA, 17 nt, Pseudomonas putida KT2440
cagcgccugcaggccca

SEQ ID NO: 1591816 - RNA, 22 nt, Pseudomonas putida KT2440
cagcgccugcaggcccaggugu

SEQ ID NO: 1591817 - RNA, 22 nt, Pseudomonas putida KT2440
cagcgggcucgcccacacggca

SEQ ID NO: 1591818 - RNA, 18 nt, Pseudomonas putida KT2440
cagcgggcccagcaggug

SEQ ID NO: 1591819 - RNA, 21 nt, Pseudomonas putida KT2440
cagcgggauguuggucuugau

SEQ ID NO: 1591820 - RNA, 15 nt, Pseudomonas putida KT2440
cagcgggaugcaguc

SEQ ID NO: 1591821 - RNA, 14 nt, Pseudomonas putida KT2440
cagcggcuggcgcu

SEQ ID NO: 1591822 - RNA, 17 nt, Pseudomonas putida KT2440
cagcggcuggcgcucgu

SEQ ID NO: 1591823 - RNA, 16 nt, Pseudomonas putida KT2440
cagcgugcccgccaca

SEQ ID NO: 1591824 - RNA, 19 nt, Pseudomonas putida KT2440
cagcgugcccgccacaccu

SEQ ID NO: 1591825 - RNA, 20 nt, Pseudomonas putida KT2440
cagcgugacgauggccacca

SEQ ID NO: 1591826 - RNA, 22 nt, Pseudomonas putida KT2440
cagcgugacgauggccaccagg

SEQ ID NO: 1591827 - RNA, 16 nt, Pseudomonas putida KT2440
cagcggucugcugcgu

SEQ ID NO: 1591828 - RNA, 21 nt, Pseudomonas putida KT2440
cagcggucugcugcgucagca

SEQ ID NO: 1591829 - RNA, 14 nt, Pseudomonas putida KT2440
cagcgguggcaaau

SEQ ID NO: 1591830 - RNA, 23 nt, Pseudomonas putida KT2440
cagcgguucgaccaauggcugcg

SEQ ID NO: 1591831 - RNA, 19 nt, Pseudomonas putida KT2440
cagcguacacugcaggagc

SEQ ID NO: 1591832 - RNA, 16 nt, Pseudomonas putida KT2440
cagcggaucaccgacg

SEQ ID NO: 1591833 - RNA, 19 nt, Pseudomonas putida KT2440
cagcggaucaccgacgugc

SEQ ID NO: 1591834 - RNA, 16 nt, Pseudomonas putida KT2440
cagcggaaucaccggu

SEQ ID NO: 1591835 - RNA, 22 nt, Pseudomonas putida KT2440
cagcggcaacaccagcagccac

SEQ ID NO: 1591836 - RNA, 21 nt, Pseudomonas putida KT2440
cagcggcaaggucaacggcaa

SEQ ID NO: 1591837 - RNA, 11 nt, Pseudomonas putida KT2440
cagcggcagac

SEQ ID NO: 1591838 - RNA, 22 nt, Pseudomonas putida KT2440
cagcggccacuuacacgcaagc

SEQ ID NO: 1591839 - RNA, 16 nt, Pseudomonas putida KT2440
cagcggccacagcgcc

SEQ ID NO: 1591840 - RNA, 22 nt, Pseudomonas putida KT2440
cagcggccccaucacccccgaa

SEQ ID NO: 1591841 - RNA, 15 nt, Pseudomonas putida KT2440
cagcggcgccaccca

SEQ ID NO: 1591842 - RNA, 16 nt, Pseudomonas putida KT2440
cagcggcgcgaucauc

SEQ ID NO: 1591843 - RNA, 18 nt, Pseudomonas putida KT2440
cagcggcgaacggucggu

SEQ ID NO: 1591844 - RNA, 20 nt, Pseudomonas putida KT2440
cagcgcucguaggcuucacg

SEQ ID NO: 1591845 - RNA, 14 nt, Pseudomonas putida KT2440
cagcgcucgaugcg

SEQ ID NO: 1591846 - RNA, 17 nt, Pseudomonas putida KT2440
cagcgcugcaagcgcac

SEQ ID NO: 1591847 - RNA, 20 nt, Pseudomonas putida KT2440
cagcgcuucgaucgccggca

SEQ ID NO: 1591848 - RNA, 18 nt, Pseudomonas putida KT2440
cagcgcugauaccgaacu

SEQ ID NO: 1591849 - RNA, 20 nt, Pseudomonas putida KT2440
cagcgcugcggguggcguag

SEQ ID NO: 1591850 - RNA, 17 nt, Pseudomonas putida KT2440
cagcgcggccgggucga

SEQ ID NO: 1591851 - RNA, 15 nt, Pseudomonas putida KT2440
cagcgcguacagcga

SEQ ID NO: 1591852 - RNA, 16 nt, Pseudomonas putida KT2440
cagcgcguacagcgac

SEQ ID NO: 1591853 - RNA, 16 nt, Pseudomonas putida KT2440
cagcgcgucauccgcc

SEQ ID NO: 1591854 - RNA, 14 nt, Pseudomonas putida KT2440
cagcgcggugacca

SEQ ID NO: 1591855 - RNA, 23 nt, Pseudomonas putida KT2440
cagcgcggugaccagcggcagca

SEQ ID NO: 1591856 - RNA, 18 nt, Pseudomonas putida KT2440
cagcgcggucugcggcag

SEQ ID NO: 1591857 - RNA, 20 nt, Pseudomonas putida KT2440
cagcgcggucugcggcagca

SEQ ID NO: 1591858 - RNA, 21 nt, Pseudomonas putida KT2440
cagcgcgaucaccagccccuc

SEQ ID NO: 1591859 - RNA, 21 nt, Pseudomonas putida KT2440
cagcgcgaaacccucacgcgc

SEQ ID NO: 1591860 - RNA, 22 nt, Pseudomonas putida KT2440
cagcgcgaaacccucacgcgcc

SEQ ID NO: 1591861 - RNA, 16 nt, Pseudomonas putida KT2440
cagcgcgacgcagcag

SEQ ID NO: 1591862 - RNA, 17 nt, Pseudomonas putida KT2440
cagcgcgacgcagcagc

SEQ ID NO: 1591863 - RNA, 18 nt, Pseudomonas putida KT2440
cagcgcgacgcagcagcg

SEQ ID NO: 1591864 - RNA, 14 nt, Pseudomonas putida KT2440
cagcgcgccgaacu

SEQ ID NO: 1591865 - RNA, 19 nt, Pseudomonas putida KT2440
cagcgcgccgaacuugccg

SEQ ID NO: 1591866 - RNA, 14 nt, Pseudomonas putida KT2440
cagauccaggugcc

SEQ ID NO: 1591867 - RNA, 16 nt, Pseudomonas putida KT2440
cagaucaucaucggca

SEQ ID NO: 1591868 - RNA, 17 nt, Pseudomonas putida KT2440
cagaucaucaucggcau

SEQ ID NO: 1591869 - RNA, 17 nt, Pseudomonas putida KT2440
cagauccugcagccgca

SEQ ID NO: 1591870 - RNA, 14 nt, Pseudomonas putida KT2440
cagaucgagcgccg

SEQ ID NO: 1591871 - RNA, 16 nt, Pseudomonas putida KT2440
cagaucaccagcucgc

SEQ ID NO: 1591872 - RNA, 15 nt, Pseudomonas putida KT2440
cagaucagcagcacc

SEQ ID NO: 1591873 - RNA, 14 nt, Pseudomonas putida KT2440
cagaucagccacgg

SEQ ID NO: 1591874 - RNA, 19 nt, Pseudomonas putida KT2440
cagaucaacgccgccagcg

SEQ ID NO: 1591875 - RNA, 23 nt, Pseudomonas putida KT2440
cagauaacccugguacagauggc

SEQ ID NO: 1591876 - RNA, 13 nt, Pseudomonas putida KT2440
cagaguaaccgcg

SEQ ID NO: 1591877 - RNA, 18 nt, Pseudomonas putida KT2440
cagaguaaccgcggcuga

SEQ ID NO: 1591878 - RNA, 14 nt, Pseudomonas putida KT2440
cagagcgccagcau

SEQ ID NO: 1591879 - RNA, 18 nt, Pseudomonas putida KT2440
cagagcgugaagcggaca

SEQ ID NO: 1591880 - RNA, 12 nt, Pseudomonas putida KT2440
cagaggcgcgua

SEQ ID NO: 1591881 - RNA, 14 nt, Pseudomonas putida KT2440
cagacagaagccug

SEQ ID NO: 1591882 - RNA, 15 nt, Pseudomonas putida KT2440
cagacagaagccugu

SEQ ID NO: 1591883 - RNA, 22 nt, Pseudomonas putida KT2440
cagaaugugcucggccugggca

SEQ ID NO: 1591884 - RNA, 17 nt, Pseudomonas putida KT2440
cagacucaaucaggcag

SEQ ID NO: 1591885 - RNA, 16 nt, Pseudomonas putida KT2440
cagagcgcgccacgca

SEQ ID NO: 1591886 - RNA, 13 nt, Pseudomonas putida KT2440
cagagagauugag

SEQ ID NO: 1591887 - RNA, 20 nt, Pseudomonas putida KT2440
cacugccagcccggcggcca

SEQ ID NO: 1591888 - RNA, 18 nt, Pseudomonas putida KT2440
cacugccagcgccucacc

SEQ ID NO: 1591889 - RNA, 13 nt, Pseudomonas putida KT2440
cacugcaggagcg

SEQ ID NO: 1591890 - RNA, 16 nt, Pseudomonas putida KT2440
cacugcaggagcgggc

SEQ ID NO: 1591891 - RNA, 17 nt, Pseudomonas putida KT2440
cacugcaggagcgggca

SEQ ID NO: 1591892 - RNA, 19 nt, Pseudomonas putida KT2440
cacugaugucguugaccgu

SEQ ID NO: 1591893 - RNA, 20 nt, Pseudomonas putida KT2440
cacugcacccgugcagggcu

SEQ ID NO: 1591894 - RNA, 22 nt, Pseudomonas putida KT2440
cacuggaacucgaucggcaccc

SEQ ID NO: 1591895 - RNA, 23 nt, Pseudomonas putida KT2440
cacuggaacucgaucggcacccc

SEQ ID NO: 1591896 - RNA, 22 nt, Pseudomonas putida KT2440
cacugcuguaaucggcgcugac

SEQ ID NO: 1591897 - RNA, 14 nt, Pseudomonas putida KT2440
cacugcucagugcu

SEQ ID NO: 1591898 - RNA, 16 nt, Pseudomonas putida KT2440
cacugcucaucugcgc

SEQ ID NO: 1591899 - RNA, 14 nt, Pseudomonas putida KT2440
cacugcgcgccguu

SEQ ID NO: 1591900 - RNA, 16 nt, Pseudomonas putida KT2440
cacugcgcgccguugc

SEQ ID NO: 1591901 - RNA, 23 nt, Pseudomonas putida KT2440
cacugcgcuacgacccaccgacc

SEQ ID NO: 1591902 - RNA, 14 nt, Pseudomonas putida KT2440
cacugaucgcuugc

SEQ ID NO: 1591903 - RNA, 20 nt, Pseudomonas putida KT2440
cacucccacagauauugcac

SEQ ID NO: 1591904 - RNA, 20 nt, Pseudomonas putida KT2440
cacuccgcuuucagccgagc

SEQ ID NO: 1591905 - RNA, 21 nt, Pseudomonas putida KT2440
cacuccccucgacgacacggc

SEQ ID NO: 1591906 - RNA, 16 nt, Pseudomonas putida KT2440
cacucauaaugaaaac

SEQ ID NO: 1591907 - RNA, 22 nt, Pseudomonas putida KT2440
cacgcgacgggaagugcacugc

SEQ ID NO: 1591908 - RNA, 13 nt, Pseudomonas putida KT2440
cacgcgcaggcca

SEQ ID NO: 1591909 - RNA, 21 nt, Pseudomonas putida KT2440
cacgcgccacauagcuggcac

SEQ ID NO: 1591910 - RNA, 13 nt, Pseudomonas putida KT2440
cacgcgccagcag

SEQ ID NO: 1591911 - RNA, 14 nt, Pseudomonas putida KT2440
cacgcgccagcagc

SEQ ID NO: 1591912 - RNA, 15 nt, Pseudomonas putida KT2440
cacgcgccagcagcg

SEQ ID NO: 1591913 - RNA, 24 nt, Pseudomonas putida KT2440
cacgcgcaguucgauguaggcagc

SEQ ID NO: 1591914 - RNA, 20 nt, Pseudomonas putida KT2440
cacguugcugccugugccgg

SEQ ID NO: 1591915 - RNA, 16 nt, Pseudomonas putida KT2440
cacucaaccaccgcuc

SEQ ID NO: 1591916 - RNA, 20 nt, Pseudomonas putida KT2440
cacucaagaaaucgggucau

SEQ ID NO: 1591917 - RNA, 15 nt, Pseudomonas putida KT2440
cacuggcaggccuug

SEQ ID NO: 1591918 - RNA, 19 nt, Pseudomonas putida KT2440
cacuggcaggcucagggca

SEQ ID NO: 1591919 - RNA, 12 nt, Pseudomonas putida KT2440
cacuggcauccg

SEQ ID NO: 1591920 - RNA, 17 nt, Pseudomonas putida KT2440
cacuggccaacucccca

SEQ ID NO: 1591921 - RNA, 19 nt, Pseudomonas putida KT2440
cacuggccacauggaucag

SEQ ID NO: 1591922 - RNA, 13 nt, Pseudomonas putida KT2440
cacuucauccagc

SEQ ID NO: 1591923 - RNA, 14 nt, Pseudomonas putida KT2440
cacuuccagcagcu

SEQ ID NO: 1591924 - RNA, 19 nt, Pseudomonas putida KT2440
cacuuccaggaaggccucg

SEQ ID NO: 1591925 - RNA, 22 nt, Pseudomonas putida KT2440
cacuucccguucgcggucgguc

SEQ ID NO: 1591926 - RNA, 22 nt, Pseudomonas putida KT2440
cacuugauugggcuuggcagca

SEQ ID NO: 1591927 - RNA, 22 nt, Pseudomonas putida KT2440
cacuugcucggugcugcugcca

SEQ ID NO: 1591928 - RNA, 17 nt, Pseudomonas putida KT2440
cacuugcuugacagcgu

SEQ ID NO: 1591929 - RNA, 14 nt, Pseudomonas putida KT2440
cacuucugccggua

SEQ ID NO: 1591930 - RNA, 22 nt, Pseudomonas putida KT2440
cacuucugcggccagggcaucg

SEQ ID NO: 1591931 - RNA, 18 nt, Pseudomonas putida KT2440
cacuucugcuaaucgcug

SEQ ID NO: 1591932 - RNA, 14 nt, Pseudomonas putida KT2440
cacuucgacauggc

SEQ ID NO: 1591933 - RNA, 23 nt, Pseudomonas putida KT2440
cacuucgcgagcgagcgguugca

SEQ ID NO: 1591934 - RNA, 16 nt, Pseudomonas putida KT2440
cagaacauggccgagc

SEQ ID NO: 1591935 - RNA, 20 nt, Pseudomonas putida KT2440
cagaacacaucgguacgccg

SEQ ID NO: 1591936 - RNA, 21 nt, Pseudomonas putida KT2440
cagaacacaucgguacgccgc

SEQ ID NO: 1591937 - RNA, 15 nt, Pseudomonas putida KT2440
cacuuguugcgcagg

SEQ ID NO: 1591938 - RNA, 15 nt, Pseudomonas putida KT2440
cagaacggcacgccc

SEQ ID NO: 1591939 - RNA, 16 nt, Pseudomonas putida KT2440
cagcaggaacagcggc

SEQ ID NO: 1591940 - RNA, 12 nt, Pseudomonas putida KT2440
cagcaggccgaa

SEQ ID NO: 1591941 - RNA, 17 nt, Pseudomonas putida KT2440
cagcagcucccgagcca

SEQ ID NO: 1591942 - RNA, 19 nt, Pseudomonas putida KT2440
cagcagcucaugcggguca

SEQ ID NO: 1591943 - RNA, 17 nt, Pseudomonas putida KT2440
cagcagcuucuggcgcg

SEQ ID NO: 1591944 - RNA, 19 nt, Pseudomonas putida KT2440
cagcagcuucuggcgcgug

SEQ ID NO: 1591945 - RNA, 21 nt, Pseudomonas putida KT2440
cagcagcuucuucacaccggc

SEQ ID NO: 1591946 - RNA, 15 nt, Pseudomonas putida KT2440
cagcagcuguugcug

SEQ ID NO: 1591947 - RNA, 21 nt, Pseudomonas putida KT2440
cagcagcuucagccagggcga

SEQ ID NO: 1591948 - RNA, 23 nt, Pseudomonas putida KT2440
cagcagcgcgccgaacuugccga

SEQ ID NO: 1591949 - RNA, 16 nt, Pseudomonas putida KT2440
cagcagcgccugcagc

SEQ ID NO: 1591950 - RNA, 16 nt, Pseudomonas putida KT2440
cagcagcgccugguca

SEQ ID NO: 1591951 - RNA, 14 nt, Pseudomonas putida KT2440
cagcagcagcgcac

SEQ ID NO: 1591952 - RNA, 13 nt, Pseudomonas putida KT2440
cagcagcgggcac

SEQ ID NO: 1591953 - RNA, 18 nt, Pseudomonas putida KT2440
cagcagcgggcacaggcc

SEQ ID NO: 1591954 - RNA, 17 nt, Pseudomonas putida KT2440
cagcagcagccccagcg

SEQ ID NO: 1591955 - RNA, 21 nt, Pseudomonas putida KT2440
cagcagacugaauuggccggc

SEQ ID NO: 1591956 - RNA, 18 nt, Pseudomonas putida KT2440
cagcagugcggcaaccac

SEQ ID NO: 1591957 - RNA, 22 nt, Pseudomonas putida KT2440
cagcagugcccccgucagcggc

SEQ ID NO: 1591958 - RNA, 14 nt, Pseudomonas putida KT2440
cagcaguucgcgca

SEQ ID NO: 1591959 - RNA, 22 nt, Pseudomonas putida KT2440
cagcaguucgcgcaccaucggc

SEQ ID NO: 1591960 - RNA, 14 nt, Pseudomonas putida KT2440
cagcaguucgcggu

SEQ ID NO: 1591961 - RNA, 21 nt, Pseudomonas putida KT2440
cagcaguucgcggucgccgug

SEQ ID NO: 1591962 - RNA, 15 nt, Pseudomonas putida KT2440
cagcaguugcugcug

SEQ ID NO: 1591963 - RNA, 16 nt, Pseudomonas putida KT2440
cagcaguugcugcugc

SEQ ID NO: 1591964 - RNA, 14 nt, Pseudomonas putida KT2440
cagcaguuggccga

SEQ ID NO: 1591965 - RNA, 23 nt, Pseudomonas putida KT2440
cagcaguuggcugccggccucga

SEQ ID NO: 1591966 - RNA, 18 nt, Pseudomonas putida KT2440
cagcaucaucucugccga

SEQ ID NO: 1591967 - RNA, 19 nt, Pseudomonas putida KT2440
cagcaucagugcaggugca

SEQ ID NO: 1591968 - RNA, 16 nt, Pseudomonas putida KT2440
cagcaggccgccgacg

SEQ ID NO: 1591969 - RNA, 23 nt, Pseudomonas putida KT2440
cagcaggcuugccagcuugguca

SEQ ID NO: 1591970 - RNA, 20 nt, Pseudomonas putida KT2440
cagcagggcaggggacagcc

SEQ ID NO: 1591971 - RNA, 13 nt, Pseudomonas putida KT2440
cagcagggccaac

SEQ ID NO: 1591972 - RNA, 19 nt, Pseudomonas putida KT2440
cagcagggccaacgacacu

SEQ ID NO: 1591973 - RNA, 23 nt, Pseudomonas putida KT2440
cagcauggugcagggcguugccg

SEQ ID NO: 1591974 - RNA, 21 nt, Pseudomonas putida KT2440
cagcauguccugcugcaggcu

SEQ ID NO: 1591975 - RNA, 20 nt, Pseudomonas putida KT2440
cagccaacccucgaccucga

SEQ ID NO: 1591976 - RNA, 13 nt, Pseudomonas putida KT2440
cagcauggccgaa

SEQ ID NO: 1591977 - RNA, 14 nt, Pseudomonas putida KT2440
cagcaucgaccugc

SEQ ID NO: 1591978 - RNA, 18 nt, Pseudomonas putida KT2440
cagcaugcccagcgccac

SEQ ID NO: 1591979 - RNA, 18 nt, Pseudomonas putida KT2440
cagcauccagccauucca

SEQ ID NO: 1591980 - RNA, 16 nt, Pseudomonas putida KT2440
cagcacccacacccuc

SEQ ID NO: 1591981 - RNA, 16 nt, Pseudomonas putida KT2440
cagcacccgcaggcga

SEQ ID NO: 1591982 - RNA, 21 nt, Pseudomonas putida KT2440
cagcacccgcaggcgacgagc

SEQ ID NO: 1591983 - RNA, 13 nt, Pseudomonas putida KT2440
cagcaccgauuca

SEQ ID NO: 1591984 - RNA, 15 nt, Pseudomonas putida KT2440
cagcaccgaucagcg

SEQ ID NO: 1591985 - RNA, 15 nt, Pseudomonas putida KT2440
cagcaccgcgacgac

SEQ ID NO: 1591986 - RNA, 17 nt, Pseudomonas putida KT2440
cagcaccugacgcaagc

SEQ ID NO: 1591987 - RNA, 15 nt, Pseudomonas putida KT2440
cagcaccggccaggc

SEQ ID NO: 1591988 - RNA, 23 nt, Pseudomonas putida KT2440
cagcaccgcuucacccucgcgca

SEQ ID NO: 1591989 - RNA, 18 nt, Pseudomonas putida KT2440
cagcaccugccagccgca

SEQ ID NO: 1591990 - RNA, 16 nt, Pseudomonas putida KT2440
cagcacgaaggccagc

SEQ ID NO: 1591991 - RNA, 18 nt, Pseudomonas putida KT2440
cagcacugugcucgcccg

SEQ ID NO: 1591992 - RNA, 15 nt, Pseudomonas putida KT2440
cagcacugcugcgca

SEQ ID NO: 1591993 - RNA, 22 nt, Pseudomonas putida KT2440
cagcacugcauuggccacgccc

SEQ ID NO: 1591994 - RNA, 19 nt, Pseudomonas putida KT2440
cagcacugccugcaugcgu

SEQ ID NO: 1591995 - RNA, 16 nt, Pseudomonas putida KT2440
cagcacugccuggcca

SEQ ID NO: 1591996 - RNA, 21 nt, Pseudomonas putida KT2440
cagcacgcgaucggcagcgau

SEQ ID NO: 1591997 - RNA, 14 nt, Pseudomonas putida KT2440
cagcacgaucagcg

SEQ ID NO: 1591998 - RNA, 13 nt, Pseudomonas putida KT2440
cagcacgccggca

SEQ ID NO: 1591999 - RNA, 20 nt, Pseudomonas putida KT2440
cagcacgccguugcggucgg

SEQ ID NO: 1592000 - RNA, 15 nt, Pseudomonas putida KT2440
cagaugcugcugcag

SEQ ID NO: 1592001 - RNA, 18 nt, Pseudomonas putida KT2440
cagaugcugcugcagugc

SEQ ID NO: 1592002 - RNA, 20 nt, Pseudomonas putida KT2440
cagaugcugcugcagugccu

SEQ ID NO: 1592003 - RNA, 12 nt, Pseudomonas putida KT2440
cagaugcgcgcu

SEQ ID NO: 1592004 - RNA, 18 nt, Pseudomonas putida KT2440
cagauggggggauuugag

SEQ ID NO: 1592005 - RNA, 21 nt, Pseudomonas putida KT2440
cagcaacugcgcccaaugcag

SEQ ID NO: 1592006 - RNA, 17 nt, Pseudomonas putida KT2440
cagcaacaagcuggaca

SEQ ID NO: 1592007 - RNA, 18 nt, Pseudomonas putida KT2440
cagcaacacgacgauggc

SEQ ID NO: 1592008 - RNA, 19 nt, Pseudomonas putida KT2440
cagcaacacgacgauggcc

SEQ ID NO: 1592009 - RNA, 15 nt, Pseudomonas putida KT2440
cagcaacagcugccg

SEQ ID NO: 1592010 - RNA, 18 nt, Pseudomonas putida KT2440
cagcaaaugcccacugcg

SEQ ID NO: 1592011 - RNA, 15 nt, Pseudomonas putida KT2440
cagcaaagucuucag

SEQ ID NO: 1592012 - RNA, 18 nt, Pseudomonas putida KT2440
cagcaaugcccgcucgcu

SEQ ID NO: 1592013 - RNA, 22 nt, Pseudomonas putida KT2440
cagcaaucggcagcgcgcaggu

SEQ ID NO: 1592014 - RNA, 18 nt, Pseudomonas putida KT2440
cagcaaucgccgccugga

SEQ ID NO: 1592015 - RNA, 20 nt, Pseudomonas putida KT2440
cagcaaugaugaaagcaggu

SEQ ID NO: 1592016 - RNA, 16 nt, Pseudomonas putida KT2440
cagcaagcgcauaggc

SEQ ID NO: 1592017 - RNA, 18 nt, Pseudomonas putida KT2440
cagcaagcgcauaggcaa

SEQ ID NO: 1592018 - RNA, 16 nt, Pseudomonas putida KT2440
cagcaagccgccgacc

SEQ ID NO: 1592019 - RNA, 13 nt, Pseudomonas putida KT2440
cagcaagcuggca

SEQ ID NO: 1592020 - RNA, 15 nt, Pseudomonas putida KT2440
cagcaagcuggcacc

SEQ ID NO: 1592021 - RNA, 19 nt, Pseudomonas putida KT2440
cagcaaggcauccagcggu

SEQ ID NO: 1592022 - RNA, 12 nt, Pseudomonas putida KT2440
cagcaagggccu

SEQ ID NO: 1592023 - RNA, 15 nt, Pseudomonas putida KT2440
cagcaagggccugug

SEQ ID NO: 1592024 - RNA, 16 nt, Pseudomonas putida KT2440
cagcaagggccugugc

SEQ ID NO: 1592025 - RNA, 18 nt, Pseudomonas putida KT2440
caucguccuugcagggca

SEQ ID NO: 1592026 - RNA, 23 nt, Pseudomonas putida KT2440
caucguauuacccuucaucgccg

SEQ ID NO: 1592027 - RNA, 19 nt, Pseudomonas putida KT2440
caucugcucgccaucuggc

SEQ ID NO: 1592028 - RNA, 20 nt, Pseudomonas putida KT2440
caucugcugaucuucccggg

SEQ ID NO: 1592029 - RNA, 20 nt, Pseudomonas putida KT2440
caucugcaccggcagcgcaa

SEQ ID NO: 1592030 - RNA, 14 nt, Pseudomonas putida KT2440
caucucggucgaca

SEQ ID NO: 1592031 - RNA, 20 nt, Pseudomonas putida KT2440
caucucggucgacaggggca

SEQ ID NO: 1592032 - RNA, 19 nt, Pseudomonas putida KT2440
caucuccauagguuaucca

SEQ ID NO: 1592033 - RNA, 16 nt, Pseudomonas putida KT2440
caucucgaucaugucg

SEQ ID NO: 1592034 - RNA, 20 nt, Pseudomonas putida KT2440
caucucgaucaugucgccgu

SEQ ID NO: 1592035 - RNA, 17 nt, Pseudomonas putida KT2440
caucggcguugcggugc

SEQ ID NO: 1592036 - RNA, 18 nt, Pseudomonas putida KT2440
caucgggcgcgucgucau

SEQ ID NO: 1592037 - RNA, 21 nt, Pseudomonas putida KT2440
caucggucggccccucgacca

SEQ ID NO: 1592038 - RNA, 23 nt, Pseudomonas putida KT2440
caucggugguuggacacaggccg

SEQ ID NO: 1592039 - RNA, 20 nt, Pseudomonas putida KT2440
caucgcuguccuuggccaac

SEQ ID NO: 1592040 - RNA, 14 nt, Pseudomonas putida KT2440
caucggcgcgaagg

SEQ ID NO: 1592041 - RNA, 19 nt, Pseudomonas putida KT2440
caugaucgcggcaaugcgc

SEQ ID NO: 1592042 - RNA, 17 nt, Pseudomonas putida KT2440
caugaucugcaagcgca

SEQ ID NO: 1592043 - RNA, 20 nt, Pseudomonas putida KT2440
caugaugaaguugcaggcau

SEQ ID NO: 1592044 - RNA, 14 nt, Pseudomonas putida KT2440
caugcacgcagcaa

SEQ ID NO: 1592045 - RNA, 20 nt, Pseudomonas putida KT2440
caugcacaacgcgcgggcaa

SEQ ID NO: 1592046 - RNA, 20 nt, Pseudomonas putida KT2440
caugcagcgucggcagagcg

SEQ ID NO: 1592047 - RNA, 22 nt, Pseudomonas putida KT2440
caugcagcgucggcagagcgcc

SEQ ID NO: 1592048 - RNA, 18 nt, Pseudomonas putida KT2440
caugcagauggggcagac

SEQ ID NO: 1592049 - RNA, 14 nt, Pseudomonas putida KT2440
caugcagcaccucc

SEQ ID NO: 1592050 - RNA, 15 nt, Pseudomonas putida KT2440
caugcaggucgacga

SEQ ID NO: 1592051 - RNA, 22 nt, Pseudomonas putida KT2440
caugcaguucuaccagcagcuc

SEQ ID NO: 1592052 - RNA, 12 nt, Pseudomonas putida KT2440
caugccgaacga

SEQ ID NO: 1592053 - RNA, 17 nt, Pseudomonas putida KT2440
caugcccgcgucugccg

SEQ ID NO: 1592054 - RNA, 21 nt, Pseudomonas putida KT2440
caugccagcuaucucccagcc

SEQ ID NO: 1592055 - RNA, 20 nt, Pseudomonas putida KT2440
caugcccagcucgcuggcca

SEQ ID NO: 1592056 - RNA, 17 nt, Pseudomonas putida KT2440
caugcccauggccagcg

SEQ ID NO: 1592057 - RNA, 14 nt, Pseudomonas putida KT2440
caugcccagcgcca

SEQ ID NO: 1592058 - RNA, 19 nt, Pseudomonas putida KT2440
caugcccagcgccaccggc

SEQ ID NO: 1592059 - RNA, 22 nt, Pseudomonas putida KT2440
caugccauuggugccaccgaug

SEQ ID NO: 1592060 - RNA, 23 nt, Pseudomonas putida KT2440
caugcccaccgcauugcaggcca

SEQ ID NO: 1592061 - RNA, 23 nt, Pseudomonas putida KT2440
caugccgaugucggcgugcacca

SEQ ID NO: 1592062 - RNA, 16 nt, Pseudomonas putida KT2440
caucuuccagccugca

SEQ ID NO: 1592063 - RNA, 15 nt, Pseudomonas putida KT2440
caucuucugcagcca

SEQ ID NO: 1592064 - RNA, 15 nt, Pseudomonas putida KT2440
caucuugcugcucug

SEQ ID NO: 1592065 - RNA, 15 nt, Pseudomonas putida KT2440
caugagccuggccgg

SEQ ID NO: 1592066 - RNA, 16 nt, Pseudomonas putida KT2440
caugagccuggccggu

SEQ ID NO: 1592067 - RNA, 17 nt, Pseudomonas putida KT2440
caugacuuccagguagc

SEQ ID NO: 1592068 - RNA, 15 nt, Pseudomonas putida KT2440
caugaaggcccagcu

SEQ ID NO: 1592069 - RNA, 21 nt, Pseudomonas putida KT2440
caugaaggcggggagcgaacu

SEQ ID NO: 1592070 - RNA, 14 nt, Pseudomonas putida KT2440
cagugcuuccagca

SEQ ID NO: 1592071 - RNA, 19 nt, Pseudomonas putida KT2440
cagugucccggccagggcu

SEQ ID NO: 1592072 - RNA, 22 nt, Pseudomonas putida KT2440
cagugcugggcaugagccuggc

SEQ ID NO: 1592073 - RNA, 21 nt, Pseudomonas putida KT2440
cagugcuucacagcguugcag

SEQ ID NO: 1592074 - RNA, 13 nt, Pseudomonas putida KT2440
cagugucaccgag

SEQ ID NO: 1592075 - RNA, 12 nt, Pseudomonas putida KT2440
cauacugcugac

SEQ ID NO: 1592076 - RNA, 16 nt, Pseudomonas putida KT2440
cauacugcuucugccg

SEQ ID NO: 1592077 - RNA, 18 nt, Pseudomonas putida KT2440
cauacuccagcgucacca

SEQ ID NO: 1592078 - RNA, 20 nt, Pseudomonas putida KT2440
cauagaacagguucggcuca

SEQ ID NO: 1592079 - RNA, 23 nt, Pseudomonas putida KT2440
cauacgcaaucucgacaagcgca

SEQ ID NO: 1592080 - RNA, 23 nt, Pseudomonas putida KT2440
cauaccgguagccucgacccgcu

SEQ ID NO: 1592081 - RNA, 17 nt, Pseudomonas putida KT2440
cauacaagaucaagccc

SEQ ID NO: 1592082 - RNA, 17 nt, Pseudomonas putida KT2440
cauaccgcaacaccugc

SEQ ID NO: 1592083 - RNA, 19 nt, Pseudomonas putida KT2440
cauaccgcaacaccugccg

SEQ ID NO: 1592084 - RNA, 21 nt, Pseudomonas putida KT2440
cauaccgcaacaccugccgca

SEQ ID NO: 1592085 - RNA, 13 nt, Pseudomonas putida KT2440
caucagagcgcca

SEQ ID NO: 1592086 - RNA, 14 nt, Pseudomonas putida KT2440
caucagagcgccag

SEQ ID NO: 1592087 - RNA, 16 nt, Pseudomonas putida KT2440
caucagcaagccgccg

SEQ ID NO: 1592088 - RNA, 17 nt, Pseudomonas putida KT2440
caucagcagcugccgga

SEQ ID NO: 1592089 - RNA, 18 nt, Pseudomonas putida KT2440
caucacguuuggcagugc

SEQ ID NO: 1592090 - RNA, 20 nt, Pseudomonas putida KT2440
caucacguuuggcagugcca

SEQ ID NO: 1592091 - RNA, 12 nt, Pseudomonas putida KT2440
caucacuuccgg

SEQ ID NO: 1592092 - RNA, 22 nt, Pseudomonas putida KT2440
caucacuugcagcucguugugc

SEQ ID NO: 1592093 - RNA, 15 nt, Pseudomonas putida KT2440
caucacuuggcgauc

SEQ ID NO: 1592094 - RNA, 19 nt, Pseudomonas putida KT2440
caucaccucgucgcucggg

SEQ ID NO: 1592095 - RNA, 15 nt, Pseudomonas putida KT2440
caucaccuuggccgc

SEQ ID NO: 1592096 - RNA, 20 nt, Pseudomonas putida KT2440
caucacgaucaugcuggcca

SEQ ID NO: 1592097 - RNA, 21 nt, Pseudomonas putida KT2440
caucacggccugcgaugcacg

SEQ ID NO: 1592098 - RNA, 15 nt, Pseudomonas putida KT2440
caucaccggcguugg

SEQ ID NO: 1592099 - RNA, 20 nt, Pseudomonas putida KT2440
cauagcccgaaaccgccagc

SEQ ID NO: 1592100 - RNA, 13 nt, Pseudomonas putida KT2440
cauagcaccagcg

SEQ ID NO: 1592101 - RNA, 15 nt, Pseudomonas putida KT2440
caucccgucagccga

SEQ ID NO: 1592102 - RNA, 17 nt, Pseudomonas putida KT2440
cauccggcagcucaccg

SEQ ID NO: 1592103 - RNA, 22 nt, Pseudomonas putida KT2440
cauccgggccgucaccgcugcc

SEQ ID NO: 1592104 - RNA, 19 nt, Pseudomonas putida KT2440
cauccucaagguuguauuu

SEQ ID NO: 1592105 - RNA, 20 nt, Pseudomonas putida KT2440
cauccucaaaggcagccucg

SEQ ID NO: 1592106 - RNA, 21 nt, Pseudomonas putida KT2440
cauccucaaaggcagccucgu

SEQ ID NO: 1592107 - RNA, 12 nt, Pseudomonas putida KT2440
cauccaggcggg

SEQ ID NO: 1592108 - RNA, 22 nt, Pseudomonas putida KT2440
cauccagguuaucuagcaggug

SEQ ID NO: 1592109 - RNA, 23 nt, Pseudomonas putida KT2440
cauccagucgaucagcgacacca

SEQ ID NO: 1592110 - RNA, 13 nt, Pseudomonas putida KT2440
caucaggucugcc

SEQ ID NO: 1592111 - RNA, 17 nt, Pseudomonas putida KT2440
caucaggucugccagug

SEQ ID NO: 1592112 - RNA, 16 nt, Pseudomonas putida KT2440
cauccagcucggcaag

SEQ ID NO: 1592113 - RNA, 14 nt, Pseudomonas putida KT2440
cauccagcuugcca

SEQ ID NO: 1592114 - RNA, 21 nt, Pseudomonas putida KT2440
caucgaccuggcccgaacgca

SEQ ID NO: 1592115 - RNA, 18 nt, Pseudomonas putida KT2440
caucgccacgggcgugac

SEQ ID NO: 1592116 - RNA, 21 nt, Pseudomonas putida KT2440
caucgacucacgcucguuguc

SEQ ID NO: 1592117 - RNA, 17 nt, Pseudomonas putida KT2440
caucgccaggugcucag

SEQ ID NO: 1592118 - RNA, 13 nt, Pseudomonas putida KT2440
caucgccagcagc

SEQ ID NO: 1592119 - RNA, 20 nt, Pseudomonas putida KT2440
caucgcugacuuccagcagc

SEQ ID NO: 1592120 - RNA, 18 nt, Pseudomonas putida KT2440
caucgcucaccguucuuc

SEQ ID NO: 1592121 - RNA, 13 nt, Pseudomonas putida KT2440
caucgcggccgaa

SEQ ID NO: 1592122 - RNA, 22 nt, Pseudomonas putida KT2440
caucgcggccgaaggcgcuggc

SEQ ID NO: 1592123 - RNA, 22 nt, Pseudomonas putida KT2440
caggccaucuaagccuccagag

SEQ ID NO: 1592124 - RNA, 16 nt, Pseudomonas putida KT2440
caggccauccagcggc

SEQ ID NO: 1592125 - RNA, 23 nt, Pseudomonas putida KT2440
caggccauccagcggcgacaggu

SEQ ID NO: 1592126 - RNA, 14 nt, Pseudomonas putida KT2440
caggcccaccaccg

SEQ ID NO: 1592127 - RNA, 15 nt, Pseudomonas putida KT2440
caggcccaacagcgc

SEQ ID NO: 1592128 - RNA, 13 nt, Pseudomonas putida KT2440
caggcccaacggg

SEQ ID NO: 1592129 - RNA, 21 nt, Pseudomonas putida KT2440
caggcccaccagucugcucag

SEQ ID NO: 1592130 - RNA, 13 nt, Pseudomonas putida KT2440
caggcccagcagg

SEQ ID NO: 1592131 - RNA, 17 nt, Pseudomonas putida KT2440
caggcccacggcgucca

SEQ ID NO: 1592132 - RNA, 15 nt, Pseudomonas putida KT2440
caggcccagcaacag

SEQ ID NO: 1592133 - RNA, 16 nt, Pseudomonas putida KT2440
caggcagucuucaagc

SEQ ID NO: 1592134 - RNA, 19 nt, Pseudomonas putida KT2440
caggcagucuucaagcucg

SEQ ID NO: 1592135 - RNA, 20 nt, Pseudomonas putida KT2440
caggcaguccugcaacucgg

SEQ ID NO: 1592136 - RNA, 19 nt, Pseudomonas putida KT2440
caggcaguucgagcgccug

SEQ ID NO: 1592137 - RNA, 20 nt, Pseudomonas putida KT2440
caggcauacaggaccaggcc

SEQ ID NO: 1592138 - RNA, 15 nt, Pseudomonas putida KT2440
caggcauacgaggcc

SEQ ID NO: 1592139 - RNA, 16 nt, Pseudomonas putida KT2440
caggccauacagggcc

SEQ ID NO: 1592140 - RNA, 17 nt, Pseudomonas putida KT2440
caggcaggaacuggcug

SEQ ID NO: 1592141 - RNA, 13 nt, Pseudomonas putida KT2440
caggcaggccagc

SEQ ID NO: 1592142 - RNA, 14 nt, Pseudomonas putida KT2440
caggcaggccagca

SEQ ID NO: 1592143 - RNA, 15 nt, Pseudomonas putida KT2440
caggcaggccagcac

SEQ ID NO: 1592144 - RNA, 23 nt, Pseudomonas putida KT2440
caggcaggccagcacggccagca

SEQ ID NO: 1592145 - RNA, 21 nt, Pseudomonas putida KT2440
caggcaguaggugcaggcgua

SEQ ID NO: 1592146 - RNA, 16 nt, Pseudomonas putida KT2440
caggcagcucgaugua

SEQ ID NO: 1592147 - RNA, 16 nt, Pseudomonas putida KT2440
caggccgccgacgauc

SEQ ID NO: 1592148 - RNA, 16 nt, Pseudomonas putida KT2440
caggccgacaacagca

SEQ ID NO: 1592149 - RNA, 19 nt, Pseudomonas putida KT2440
caggccgacaacagcaugc

SEQ ID NO: 1592150 - RNA, 16 nt, Pseudomonas putida KT2440
caggccgacaacggug

SEQ ID NO: 1592151 - RNA, 13 nt, Pseudomonas putida KT2440
caggccgaaggcc

SEQ ID NO: 1592152 - RNA, 18 nt, Pseudomonas putida KT2440
caggcccuuucgcgggua

SEQ ID NO: 1592153 - RNA, 22 nt, Pseudomonas putida KT2440
caggcccgccagagcauggcca

SEQ ID NO: 1592154 - RNA, 21 nt, Pseudomonas putida KT2440
caggcccgcuauccucgaucg

SEQ ID NO: 1592155 - RNA, 17 nt, Pseudomonas putida KT2440
caggccccagucauccg

SEQ ID NO: 1592156 - RNA, 18 nt, Pseudomonas putida KT2440
caggccccaggccaucca

SEQ ID NO: 1592157 - RNA, 22 nt, Pseudomonas putida KT2440
caggccccuuggccaacggcau

SEQ ID NO: 1592158 - RNA, 17 nt, Pseudomonas putida KT2440
caggagucuacggaccu

SEQ ID NO: 1592159 - RNA, 17 nt, Pseudomonas putida KT2440
cagcgucggcagagcgc

SEQ ID NO: 1592160 - RNA, 13 nt, Pseudomonas putida KT2440
cagcgugcgcuca

SEQ ID NO: 1592161 - RNA, 13 nt, Pseudomonas putida KT2440
cagcguggccagc

SEQ ID NO: 1592162 - RNA, 23 nt, Pseudomonas putida KT2440
caggaccgcggaaugaaccgcga

SEQ ID NO: 1592163 - RNA, 16 nt, Pseudomonas putida KT2440
caggaucagguaaucc

SEQ ID NO: 1592164 - RNA, 18 nt, Pseudomonas putida KT2440
caggaucaugugcgccac

SEQ ID NO: 1592165 - RNA, 19 nt, Pseudomonas putida KT2440
caggauggcauuggccaac

SEQ ID NO: 1592166 - RNA, 13 nt, Pseudomonas putida KT2440
caggauggccgca

SEQ ID NO: 1592167 - RNA, 20 nt, Pseudomonas putida KT2440
caggauggugacugccagca

SEQ ID NO: 1592168 - RNA, 13 nt, Pseudomonas putida KT2440
caggcagaucgaa

SEQ ID NO: 1592169 - RNA, 16 nt, Pseudomonas putida KT2440
caggcagccugccagg

SEQ ID NO: 1592170 - RNA, 13 nt, Pseudomonas putida KT2440
caggcacuggcca

SEQ ID NO: 1592171 - RNA, 14 nt, Pseudomonas putida KT2440
caggcacuggccag

SEQ ID NO: 1592172 - RNA, 16 nt, Pseudomonas putida KT2440
caggcagaccacgcgc

SEQ ID NO: 1592173 - RNA, 17 nt, Pseudomonas putida KT2440
caggcacggcaccagca

SEQ ID NO: 1592174 - RNA, 13 nt, Pseudomonas putida KT2440
caggcaaccgcau

SEQ ID NO: 1592175 - RNA, 21 nt, Pseudomonas putida KT2440
caggcaaacgcggucagcgaa

SEQ ID NO: 1592176 - RNA, 17 nt, Pseudomonas putida KT2440
caggcugccgccgaaca

SEQ ID NO: 1592177 - RNA, 18 nt, Pseudomonas putida KT2440
caggcugcacaaggugcu

SEQ ID NO: 1592178 - RNA, 16 nt, Pseudomonas putida KT2440
caggcugcacuggcau

SEQ ID NO: 1592179 - RNA, 22 nt, Pseudomonas putida KT2440
caggcugaugcgcuggcccuug

SEQ ID NO: 1592180 - RNA, 17 nt, Pseudomonas putida KT2440
caggcugaucaccgccg

SEQ ID NO: 1592181 - RNA, 14 nt, Pseudomonas putida KT2440
caggcguaacucag

SEQ ID NO: 1592182 - RNA, 21 nt, Pseudomonas putida KT2440
caggcguaaacccagguacga

SEQ ID NO: 1592183 - RNA, 19 nt, Pseudomonas putida KT2440
caggcguauucggccacca

SEQ ID NO: 1592184 - RNA, 14 nt, Pseudomonas putida KT2440
caggcgguccagca

SEQ ID NO: 1592185 - RNA, 21 nt, Pseudomonas putida KT2440
caggcggcugaccuguucgcg

SEQ ID NO: 1592186 - RNA, 14 nt, Pseudomonas putida KT2440
caggcggucggcca

SEQ ID NO: 1592187 - RNA, 15 nt, Pseudomonas putida KT2440
caggcgggcagcgca

SEQ ID NO: 1592188 - RNA, 20 nt, Pseudomonas putida KT2440
cagggcccgggcacgggcca

SEQ ID NO: 1592189 - RNA, 20 nt, Pseudomonas putida KT2440
cagggcaucgaccaguacga

SEQ ID NO: 1592190 - RNA, 15 nt, Pseudomonas putida KT2440
cagggcaucggcgug

SEQ ID NO: 1592191 - RNA, 12 nt, Pseudomonas putida KT2440
cagggcccagcc

SEQ ID NO: 1592192 - RNA, 14 nt, Pseudomonas putida KT2440
cagggcccucaacc

SEQ ID NO: 1592193 - RNA, 23 nt, Pseudomonas putida KT2440
cagggcaggggacagccacaugc

SEQ ID NO: 1592194 - RNA, 20 nt, Pseudomonas putida KT2440
cagggcaaaaugcagcaagc

SEQ ID NO: 1592195 - RNA, 14 nt, Pseudomonas putida KT2440
cagggcaaucgcca

SEQ ID NO: 1592196 - RNA, 20 nt, Pseudomonas putida KT2440
caggcuggguggugucgacc

SEQ ID NO: 1592197 - RNA, 15 nt, Pseudomonas putida KT2440
caggcugcgcccgca

SEQ ID NO: 1592198 - RNA, 15 nt, Pseudomonas putida KT2440
caggcuguguggccg

SEQ ID NO: 1592199 - RNA, 21 nt, Pseudomonas putida KT2440
cagggauacugcugaaccuga

SEQ ID NO: 1592200 - RNA, 18 nt, Pseudomonas putida KT2440
caggcuuacuuggucacc

SEQ ID NO: 1592201 - RNA, 13 nt, Pseudomonas putida KT2440
caggcuucaaggc

SEQ ID NO: 1592202 - RNA, 19 nt, Pseudomonas putida KT2440
caggcuucagaagccuugg

SEQ ID NO: 1592203 - RNA, 14 nt, Pseudomonas putida KT2440
caggcuugaagcug

SEQ ID NO: 1592204 - RNA, 13 nt, Pseudomonas putida KT2440
caggccgcugagg

SEQ ID NO: 1592205 - RNA, 15 nt, Pseudomonas putida KT2440
caggccgcggccgaa

SEQ ID NO: 1592206 - RNA, 20 nt, Pseudomonas putida KT2440
caggccgcugaacaacuccg

SEQ ID NO: 1592207 - RNA, 23 nt, Pseudomonas putida KT2440
caggcgcacauacgucuugauca

SEQ ID NO: 1592208 - RNA, 12 nt, Pseudomonas putida KT2440
caggcgcagcag

SEQ ID NO: 1592209 - RNA, 14 nt, Pseudomonas putida KT2440
caggcgcaggugca

SEQ ID NO: 1592210 - RNA, 11 nt, Pseudomonas putida KT2440
caggcgccauu

SEQ ID NO: 1592211 - RNA, 14 nt, Pseudomonas putida KT2440
caggcgcgacauga

SEQ ID NO: 1592212 - RNA, 13 nt, Pseudomonas putida KT2440
caggcggccaaac

SEQ ID NO: 1592213 - RNA, 19 nt, Pseudomonas putida KT2440
caggcggccaaacuggaug

SEQ ID NO: 1592214 - RNA, 12 nt, Pseudomonas putida KT2440
caggcggcgaca

SEQ ID NO: 1592215 - RNA, 16 nt, Pseudomonas putida KT2440
cagguggaucggcgug

SEQ ID NO: 1592216 - RNA, 14 nt, Pseudomonas putida KT2440
cagguggaucagcc

SEQ ID NO: 1592217 - RNA, 13 nt, Pseudomonas putida KT2440
cagguugcgcgcc

SEQ ID NO: 1592218 - RNA, 16 nt, Pseudomonas putida KT2440
cagguuggacagcgcc

SEQ ID NO: 1592219 - RNA, 19 nt, Pseudomonas putida KT2440
cagguugagcaccgggcac

SEQ ID NO: 1592220 - RNA, 16 nt, Pseudomonas putida KT2440
cagguugaacagcagc

SEQ ID NO: 1592221 - RNA, 21 nt, Pseudomonas putida KT2440
cagguugaacagcagcgccgc

SEQ ID NO: 1592222 - RNA, 14 nt, Pseudomonas putida KT2440
cagguugcccagca

SEQ ID NO: 1592223 - RNA, 13 nt, Pseudomonas putida KT2440
cagguugcccgca

SEQ ID NO: 1592224 - RNA, 15 nt, Pseudomonas putida KT2440
cagguucucggcacc

SEQ ID NO: 1592225 - RNA, 23 nt, Pseudomonas putida KT2440
cagguucgaccaccgcaggugca

SEQ ID NO: 1592226 - RNA, 21 nt, Pseudomonas putida KT2440
cagguucgacucccgcugccu

SEQ ID NO: 1592227 - RNA, 12 nt, Pseudomonas putida KT2440
caguacuucgcg

SEQ ID NO: 1592228 - RNA, 23 nt, Pseudomonas putida KT2440
caguaucgccccggucagcagga

SEQ ID NO: 1592229 - RNA, 18 nt, Pseudomonas putida KT2440
caguagcuuaaucccgca

SEQ ID NO: 1592230 - RNA, 14 nt, Pseudomonas putida KT2440
caguaccuucuggc

SEQ ID NO: 1592231 - RNA, 14 nt, Pseudomonas putida KT2440
caguacgaacuacg

SEQ ID NO: 1592232 - RNA, 15 nt, Pseudomonas putida KT2440
caguacgcgccugca

SEQ ID NO: 1592233 - RNA, 21 nt, Pseudomonas putida KT2440
caguacgcgccugcaccuggc

SEQ ID NO: 1592234 - RNA, 20 nt, Pseudomonas putida KT2440
caguacgggcccuuucgcgg

SEQ ID NO: 1592235 - RNA, 20 nt, Pseudomonas putida KT2440
cagugcaucgaagcaggccg

SEQ ID NO: 1592236 - RNA, 13 nt, Pseudomonas putida KT2440
cagugcaggugca

SEQ ID NO: 1592237 - RNA, 14 nt, Pseudomonas putida KT2440
cagugcacuugcgg

SEQ ID NO: 1592238 - RNA, 15 nt, Pseudomonas putida KT2440
cagugccaucgccuc

SEQ ID NO: 1592239 - RNA, 22 nt, Pseudomonas putida KT2440
cagugccaucgccucggcacug

SEQ ID NO: 1592240 - RNA, 14 nt, Pseudomonas putida KT2440
cagugcccagucga

SEQ ID NO: 1592241 - RNA, 18 nt, Pseudomonas putida KT2440
cagugcccagucgauggg

SEQ ID NO: 1592242 - RNA, 13 nt, Pseudomonas putida KT2440
cagugcggcaacc

SEQ ID NO: 1592243 - RNA, 17 nt, Pseudomonas putida KT2440
cagugcggucaggccaa

SEQ ID NO: 1592244 - RNA, 20 nt, Pseudomonas putida KT2440
cagugcgucggccaccaccg

SEQ ID NO: 1592245 - RNA, 23 nt, Pseudomonas putida KT2440
cagugcgguggauggcaccggcu

SEQ ID NO: 1592246 - RNA, 15 nt, Pseudomonas putida KT2440
cagugcaacguucac

SEQ ID NO: 1592247 - RNA, 15 nt, Pseudomonas putida KT2440
cagucugcuccaccg

SEQ ID NO: 1592248 - RNA, 22 nt, Pseudomonas putida KT2440
cagucgccccgccagcgccugg

SEQ ID NO: 1592249 - RNA, 23 nt, Pseudomonas putida KT2440
cagucgccccgccagcgccuggc

SEQ ID NO: 1592250 - RNA, 23 nt, Pseudomonas putida KT2440
cagucgccgauacccgcacgaac

SEQ ID NO: 1592251 - RNA, 15 nt, Pseudomonas putida KT2440
cagucgaucagcgac

SEQ ID NO: 1592252 - RNA, 17 nt, Pseudomonas putida KT2440
cagucgaucagcgacac

SEQ ID NO: 1592253 - RNA, 19 nt, Pseudomonas putida KT2440
cagucgaucagcgacacca

SEQ ID NO: 1592254 - RNA, 16 nt, Pseudomonas putida KT2440
cagucgagucgacagu

SEQ ID NO: 1592255 - RNA, 15 nt, Pseudomonas putida KT2440
cagucgaccgggcag

SEQ ID NO: 1592256 - RNA, 20 nt, Pseudomonas putida KT2440
cagucgaaggggaucagcac

SEQ ID NO: 1592257 - RNA, 22 nt, Pseudomonas putida KT2440
cagucgaaggggaucagcacgc

SEQ ID NO: 1592258 - RNA, 16 nt, Pseudomonas putida KT2440
cagucagggucucggc

SEQ ID NO: 1592259 - RNA, 17 nt, Pseudomonas putida KT2440
cagucagugcgucggcc

SEQ ID NO: 1592260 - RNA, 12 nt, Pseudomonas putida KT2440
cagucauccaga

SEQ ID NO: 1592261 - RNA, 23 nt, Pseudomonas putida KT2440
cagucauccgggccgucaccgcu

SEQ ID NO: 1592262 - RNA, 13 nt, Pseudomonas putida KT2440
cagucaccuggcc

SEQ ID NO: 1592263 - RNA, 16 nt, Pseudomonas putida KT2440
cagucacccaccggcu

SEQ ID NO: 1592264 - RNA, 16 nt, Pseudomonas putida KT2440
caguccacuugcguuc

SEQ ID NO: 1592265 - RNA, 15 nt, Pseudomonas putida KT2440
cagggcgcccguuac

SEQ ID NO: 1592266 - RNA, 15 nt, Pseudomonas putida KT2440
cagggcgaagaucgg

SEQ ID NO: 1592267 - RNA, 15 nt, Pseudomonas putida KT2440
cagggccuuggccug

SEQ ID NO: 1592268 - RNA, 16 nt, Pseudomonas putida KT2440
cagggccucgaugcgg

SEQ ID NO: 1592269 - RNA, 13 nt, Pseudomonas putida KT2440
cagggcgccguug

SEQ ID NO: 1592270 - RNA, 18 nt, Pseudomonas putida KT2440
cagggcgcgaaaagccug

SEQ ID NO: 1592271 - RNA, 21 nt, Pseudomonas putida KT2440
cagggcgcguguagcccgcug

SEQ ID NO: 1592272 - RNA, 16 nt, Pseudomonas putida KT2440
cagggcggccucggcc

SEQ ID NO: 1592273 - RNA, 12 nt, Pseudomonas putida KT2440
caggggugacca

SEQ ID NO: 1592274 - RNA, 18 nt, Pseudomonas putida KT2440
caggguacgauagggcgg

SEQ ID NO: 1592275 - RNA, 19 nt, Pseudomonas putida KT2440
caggguaccgccguccacc

SEQ ID NO: 1592276 - RNA, 20 nt, Pseudomonas putida KT2440
caggguaccgccguccacca

SEQ ID NO: 1592277 - RNA, 20 nt, Pseudomonas putida KT2440
caggggcugccuugcagccc

SEQ ID NO: 1592278 - RNA, 18 nt, Pseudomonas putida KT2440
caggggcgcagagcgccc

SEQ ID NO: 1592279 - RNA, 19 nt, Pseudomonas putida KT2440
cagggggguaaggcuggcu

SEQ ID NO: 1592280 - RNA, 20 nt, Pseudomonas putida KT2440
cagggcuuuuuccagcgcca

SEQ ID NO: 1592281 - RNA, 21 nt, Pseudomonas putida KT2440
cagggcuuuuuccagcgccac

SEQ ID NO: 1592282 - RNA, 15 nt, Pseudomonas putida KT2440
cagggcugguuccug

SEQ ID NO: 1592283 - RNA, 16 nt, Pseudomonas putida KT2440
caggggacagccacau

SEQ ID NO: 1592284 - RNA, 20 nt, Pseudomonas putida KT2440
caggggacagccacaugcca

SEQ ID NO: 1592285 - RNA, 20 nt, Pseudomonas putida KT2440
caggggcacggguacccgcg

SEQ ID NO: 1592286 - RNA, 14 nt, Pseudomonas putida KT2440
caggggaugcgcga

SEQ ID NO: 1592287 - RNA, 12 nt, Pseudomonas putida KT2440
caggggaugcgg

SEQ ID NO: 1592288 - RNA, 23 nt, Pseudomonas putida KT2440
caggguauugaacggcgcaucca

SEQ ID NO: 1592289 - RNA, 20 nt, Pseudomonas putida KT2440
cagggucgggcacaggccca

SEQ ID NO: 1592290 - RNA, 16 nt, Pseudomonas putida KT2440
cagggucugucggugg

SEQ ID NO: 1592291 - RNA, 22 nt, Pseudomonas putida KT2440
cagguacgcgcaggcagcucga

SEQ ID NO: 1592292 - RNA, 19 nt, Pseudomonas putida KT2440
cagguagcgauugcggccu

SEQ ID NO: 1592293 - RNA, 20 nt, Pseudomonas putida KT2440
cagguagaucugcucuucgc

SEQ ID NO: 1592294 - RNA, 14 nt, Pseudomonas putida KT2440
cagguccaccuggu

SEQ ID NO: 1592295 - RNA, 18 nt, Pseudomonas putida KT2440
cagguccaccugguucug

SEQ ID NO: 1592296 - RNA, 17 nt, Pseudomonas putida KT2440
cagguccaggccagcuu

SEQ ID NO: 1592297 - RNA, 14 nt, Pseudomonas putida KT2440
cagguccaggcgca

SEQ ID NO: 1592298 - RNA, 18 nt, Pseudomonas putida KT2440
caggucgauccgggugcu

SEQ ID NO: 1592299 - RNA, 20 nt, Pseudomonas putida KT2440
caggucgauguccaggccga

SEQ ID NO: 1592300 - RNA, 17 nt, Pseudomonas putida KT2440
caggucggccagcucgg

SEQ ID NO: 1592301 - RNA, 13 nt, Pseudomonas putida KT2440
caggucggccagc

SEQ ID NO: 1592302 - RNA, 14 nt, Pseudomonas putida KT2440
caggucggcaacca

SEQ ID NO: 1592303 - RNA, 14 nt, Pseudomonas putida KT2440
caggucgacccgcg

SEQ ID NO: 1592304 - RNA, 14 nt, Pseudomonas putida KT2440
caggucgaccgaga

SEQ ID NO: 1592305 - RNA, 21 nt, Pseudomonas putida KT2440
caggucgaccugccagucgca

SEQ ID NO: 1592306 - RNA, 16 nt, Pseudomonas putida KT2440
ccgaaggcgucacccg

SEQ ID NO: 1592307 - RNA, 22 nt, Pseudomonas putida KT2440
ccgaagcuaucgccagcaggcc

SEQ ID NO: 1592308 - RNA, 20 nt, Pseudomonas putida KT2440
ccgaagcaccacuggaugac

SEQ ID NO: 1592309 - RNA, 15 nt, Pseudomonas putida KT2440
ccgaacgcagcgccg

SEQ ID NO: 1592310 - RNA, 21 nt, Pseudomonas putida KT2440
ccgaacuccccaccaggcaau

SEQ ID NO: 1592311 - RNA, 13 nt, Pseudomonas putida KT2440
ccgaacgggccac

SEQ ID NO: 1592312 - RNA, 20 nt, Pseudomonas putida KT2440
cccucgaccacgcacagcug

SEQ ID NO: 1592313 - RNA, 14 nt, Pseudomonas putida KT2440
cccucgaacagcgc

SEQ ID NO: 1592314 - RNA, 14 nt, Pseudomonas putida KT2440
cccuccuucaggua

SEQ ID NO: 1592315 - RNA, 22 nt, Pseudomonas putida KT2440
cccuaccgccaacgaaucagcc

SEQ ID NO: 1592316 - RNA, 20 nt, Pseudomonas putida KT2440
cccuacagccuuggguaacc

SEQ ID NO: 1592317 - RNA, 18 nt, Pseudomonas putida KT2440
cccuccgccugcggcacc

SEQ ID NO: 1592318 - RNA, 14 nt, Pseudomonas putida KT2440
cccugcccgaucgc

SEQ ID NO: 1592319 - RNA, 13 nt, Pseudomonas putida KT2440
cccugccgaggcc

SEQ ID NO: 1592320 - RNA, 16 nt, Pseudomonas putida KT2440
cccugcgccaggcauu

SEQ ID NO: 1592321 - RNA, 20 nt, Pseudomonas putida KT2440
cccugccuuagaacagaucc

SEQ ID NO: 1592322 - RNA, 21 nt, Pseudomonas putida KT2440
cccuggaaacccuugcgcaac

SEQ ID NO: 1592323 - RNA, 23 nt, Pseudomonas putida KT2440
cccuugggcgugcgcugcauggc

SEQ ID NO: 1592324 - RNA, 18 nt, Pseudomonas putida KT2440
cccuugggcucagccgcc

SEQ ID NO: 1592325 - RNA, 13 nt, Pseudomonas putida KT2440
cccuuuaggcacg

SEQ ID NO: 1592326 - RNA, 19 nt, Pseudomonas putida KT2440
cccuuucgcgacgcaaggc

SEQ ID NO: 1592327 - RNA, 12 nt, Pseudomonas putida KT2440
cccuuucgcggg

SEQ ID NO: 1592328 - RNA, 22 nt, Pseudomonas putida KT2440
cccuuucgcggguagacccgcu

SEQ ID NO: 1592329 - RNA, 19 nt, Pseudomonas putida KT2440
cccuuuuucaccaggcggu

SEQ ID NO: 1592330 - RNA, 23 nt, Pseudomonas putida KT2440
cccuuggcgguuuucgcaacgcu

SEQ ID NO: 1592331 - RNA, 17 nt, Pseudomonas putida KT2440
cccuugcugcagcaggc

SEQ ID NO: 1592332 - RNA, 22 nt, Pseudomonas putida KT2440
cccuggaguaccgucgucguca

SEQ ID NO: 1592333 - RNA, 13 nt, Pseudomonas putida KT2440
cccuggaugacac

SEQ ID NO: 1592334 - RNA, 18 nt, Pseudomonas putida KT2440
cccuucgacuucccgcaa

SEQ ID NO: 1592335 - RNA, 14 nt, Pseudomonas putida KT2440
cccuucgcgggcac

SEQ ID NO: 1592336 - RNA, 17 nt, Pseudomonas putida KT2440
cccuucgcggguaaacc

SEQ ID NO: 1592337 - RNA, 23 nt, Pseudomonas putida KT2440
cccuucggcaaucaccgccaggu

SEQ ID NO: 1592338 - RNA, 20 nt, Pseudomonas putida KT2440
cccggucagcauggccaguu

SEQ ID NO: 1592339 - RNA, 17 nt, Pseudomonas putida KT2440
cccggguaaucagcuug

SEQ ID NO: 1592340 - RNA, 18 nt, Pseudomonas putida KT2440
cccggggcguggaagugc

SEQ ID NO: 1592341 - RNA, 12 nt, Pseudomonas putida KT2440
cccggcuucaca

SEQ ID NO: 1592342 - RNA, 14 nt, Pseudomonas putida KT2440
cccgggaacggcug

SEQ ID NO: 1592343 - RNA, 15 nt, Pseudomonas putida KT2440
cccgggaacagcagc

SEQ ID NO: 1592344 - RNA, 13 nt, Pseudomonas putida KT2440
cccguccgccuug

SEQ ID NO: 1592345 - RNA, 12 nt, Pseudomonas putida KT2440
cccguccagccc

SEQ ID NO: 1592346 - RNA, 22 nt, Pseudomonas putida KT2440
cccgucaucgauccccaguuca

SEQ ID NO: 1592347 - RNA, 18 nt, Pseudomonas putida KT2440
cccguguucgcgggcaag

SEQ ID NO: 1592348 - RNA, 19 nt, Pseudomonas putida KT2440
cccguguucgcgggcaagc

SEQ ID NO: 1592349 - RNA, 19 nt, Pseudomonas putida KT2440
cccguuccuacgcaggcac

SEQ ID NO: 1592350 - RNA, 22 nt, Pseudomonas putida KT2440
cccguugcgcagcagcaggccc

SEQ ID NO: 1592351 - RNA, 15 nt, Pseudomonas putida KT2440
ccgacaggguuacca

SEQ ID NO: 1592352 - RNA, 19 nt, Pseudomonas putida KT2440
ccgacaucgaagcagugcu

SEQ ID NO: 1592353 - RNA, 21 nt, Pseudomonas putida KT2440
ccgacagccaccgcgagcugu

SEQ ID NO: 1592354 - RNA, 14 nt, Pseudomonas putida KT2440
ccgacagcaacgcg

SEQ ID NO: 1592355 - RNA, 16 nt, Pseudomonas putida KT2440
ccgacagcgcagucac

SEQ ID NO: 1592356 - RNA, 19 nt, Pseudomonas putida KT2440
ccgacaaagaagcgccgca

SEQ ID NO: 1592357 - RNA, 16 nt, Pseudomonas putida KT2440
ccgacaagccacgcac

SEQ ID NO: 1592358 - RNA, 22 nt, Pseudomonas putida KT2440
ccgaccugcaacgucgccacgc

SEQ ID NO: 1592359 - RNA, 13 nt, Pseudomonas putida KT2440
ccgaccgccagcc

SEQ ID NO: 1592360 - RNA, 15 nt, Pseudomonas putida KT2440
ccgacccgggccagc

SEQ ID NO: 1592361 - RNA, 16 nt, Pseudomonas putida KT2440
ccgaccauuugccauc

SEQ ID NO: 1592362 - RNA, 15 nt, Pseudomonas putida KT2440
ccgacccacaggcac

SEQ ID NO: 1592363 - RNA, 21 nt, Pseudomonas putida KT2440
ccgacgccaggaaggucacca

SEQ ID NO: 1592364 - RNA, 21 nt, Pseudomonas putida KT2440
ccgacgcauucgcgggugaac

SEQ ID NO: 1592365 - RNA, 22 nt, Pseudomonas putida KT2440
ccgacgcauucgcgggugaacc

SEQ ID NO: 1592366 - RNA, 15 nt, Pseudomonas putida KT2440
ccgagaacaggcggc

SEQ ID NO: 1592367 - RNA, 16 nt, Pseudomonas putida KT2440
ccgagaacaggcggcc

SEQ ID NO: 1592368 - RNA, 14 nt, Pseudomonas putida KT2440
ccgagaggcgcugc

SEQ ID NO: 1592369 - RNA, 18 nt, Pseudomonas putida KT2440
ccgagacgaucaccaggu

SEQ ID NO: 1592370 - RNA, 20 nt, Pseudomonas putida KT2440
ccgagcaaagcccgccccaa

SEQ ID NO: 1592371 - RNA, 21 nt, Pseudomonas putida KT2440
ccgacuugucgaagucgaacu

SEQ ID NO: 1592372 - RNA, 13 nt, Pseudomonas putida KT2440
ccgacugacgcua

SEQ ID NO: 1592373 - RNA, 14 nt, Pseudomonas putida KT2440
ccgacucgguacgc

SEQ ID NO: 1592374 - RNA, 19 nt, Pseudomonas putida KT2440
ccgacucauguaucggauu

SEQ ID NO: 1592375 - RNA, 21 nt, Pseudomonas putida KT2440
ccgacuccaacuggaccauca

SEQ ID NO: 1592376 - RNA, 17 nt, Pseudomonas putida KT2440
cccaggugaugcaggca

SEQ ID NO: 1592377 - RNA, 23 nt, Pseudomonas putida KT2440
cccagguuuucucgucuggcgcg

SEQ ID NO: 1592378 - RNA, 16 nt, Pseudomonas putida KT2440
cccagggggcagcugc

SEQ ID NO: 1592379 - RNA, 15 nt, Pseudomonas putida KT2440
cccagcuacgcgagc

SEQ ID NO: 1592380 - RNA, 14 nt, Pseudomonas putida KT2440
cccagcucgcuggc

SEQ ID NO: 1592381 - RNA, 22 nt, Pseudomonas putida KT2440
cccagcucgcuggccaccagca

SEQ ID NO: 1592382 - RNA, 20 nt, Pseudomonas putida KT2440
cccagggcccucaacccucg

SEQ ID NO: 1592383 - RNA, 20 nt, Pseudomonas putida KT2440
cccagggaucgaugcccugg

SEQ ID NO: 1592384 - RNA, 23 nt, Pseudomonas putida KT2440
cccagcuucuccagcaagcgcuc

SEQ ID NO: 1592385 - RNA, 17 nt, Pseudomonas putida KT2440
cccagcuugaagcggcc

SEQ ID NO: 1592386 - RNA, 20 nt, Pseudomonas putida KT2440
cccagcuggcucaucugccg

SEQ ID NO: 1592387 - RNA, 19 nt, Pseudomonas putida KT2440
cccagcagcaacgcaucga

SEQ ID NO: 1592388 - RNA, 16 nt, Pseudomonas putida KT2440
cccagcacgaaggcca

SEQ ID NO: 1592389 - RNA, 19 nt, Pseudomonas putida KT2440
cccagcacgaaggccagca

SEQ ID NO: 1592390 - RNA, 18 nt, Pseudomonas putida KT2440
cccagaauguugcaagga

SEQ ID NO: 1592391 - RNA, 15 nt, Pseudomonas putida KT2440
cccagcagcgggcac

SEQ ID NO: 1592392 - RNA, 15 nt, Pseudomonas putida KT2440
cccagcauggccgaa

SEQ ID NO: 1592393 - RNA, 12 nt, Pseudomonas putida KT2440
cccagcaggccg

SEQ ID NO: 1592394 - RNA, 14 nt, Pseudomonas putida KT2440
cccagcaggccgaa

SEQ ID NO: 1592395 - RNA, 14 nt, Pseudomonas putida KT2440
cccagcggcaaccu

SEQ ID NO: 1592396 - RNA, 18 nt, Pseudomonas putida KT2440
cccagucgccccgccagc

SEQ ID NO: 1592397 - RNA, 20 nt, Pseudomonas putida KT2440
cccagucuucguacaugcgc

SEQ ID NO: 1592398 - RNA, 14 nt, Pseudomonas putida KT2440
cccagucgccuucg

SEQ ID NO: 1592399 - RNA, 16 nt, Pseudomonas putida KT2440
cccagucaccuugcuc

SEQ ID NO: 1592400 - RNA, 14 nt, Pseudomonas putida KT2440
cccagucagucgcc

SEQ ID NO: 1592401 - RNA, 18 nt, Pseudomonas putida KT2440
cccaguaaaaacuggcca

SEQ ID NO: 1592402 - RNA, 17 nt, Pseudomonas putida KT2440
cccagugcgcgcaacag

SEQ ID NO: 1592403 - RNA, 19 nt, Pseudomonas putida KT2440
cccaguucgcggaucugcu

SEQ ID NO: 1592404 - RNA, 16 nt, Pseudomonas putida KT2440
cccaguucuuggcggc

SEQ ID NO: 1592405 - RNA, 13 nt, Pseudomonas putida KT2440
cccaguucggcgu

SEQ ID NO: 1592406 - RNA, 15 nt, Pseudomonas putida KT2440
cccaguuucgccagu

SEQ ID NO: 1592407 - RNA, 19 nt, Pseudomonas putida KT2440
cccaguucacgcaggcgca

SEQ ID NO: 1592408 - RNA, 16 nt, Pseudomonas putida KT2440
cccaucaggaacagcu

SEQ ID NO: 1592409 - RNA, 14 nt, Pseudomonas putida KT2440
cccaucagcagcug

SEQ ID NO: 1592410 - RNA, 23 nt, Pseudomonas putida KT2440
cccauaucaggcaugccagcagc

SEQ ID NO: 1592411 - RNA, 16 nt, Pseudomonas putida KT2440
cccaucauucgauagc

SEQ ID NO: 1592412 - RNA, 18 nt, Pseudomonas putida KT2440
cccaucauucgauagccu

SEQ ID NO: 1592413 - RNA, 18 nt, Pseudomonas putida KT2440
cccauccaacgcauccag

SEQ ID NO: 1592414 - RNA, 19 nt, Pseudomonas putida KT2440
cccauagggccagcggcuu

SEQ ID NO: 1592415 - RNA, 17 nt, Pseudomonas putida KT2440
cccaucaccuuggccgc

SEQ ID NO: 1592416 - RNA, 22 nt, Pseudomonas putida KT2440
cccaucugcucggcguacucca

SEQ ID NO: 1592417 - RNA, 21 nt, Pseudomonas putida KT2440
cccaucggcacccgcacaugc

SEQ ID NO: 1592418 - RNA, 18 nt, Pseudomonas putida KT2440
cccaugaucuugcugccg

SEQ ID NO: 1592419 - RNA, 19 nt, Pseudomonas putida KT2440
cccauguagaccaccagcg

SEQ ID NO: 1592420 - RNA, 20 nt, Pseudomonas putida KT2440
cccauuucugcauguccagc

SEQ ID NO: 1592421 - RNA, 19 nt, Pseudomonas putida KT2440
cccauucgcgggcaagccc

SEQ ID NO: 1592422 - RNA, 23 nt, Pseudomonas putida KT2440
cccauucgcggguaaacccgcgc

SEQ ID NO: 1592423 - RNA, 18 nt, Pseudomonas putida KT2440
cccaaccuuccagcaaag

SEQ ID NO: 1592424 - RNA, 14 nt, Pseudomonas putida KT2440
cccaacuccagcgc

SEQ ID NO: 1592425 - RNA, 24 nt, Pseudomonas putida KT2440
cccaccaagggugucaacaggcug

SEQ ID NO: 1592426 - RNA, 14 nt, Pseudomonas putida KT2440
cccaccacauccga

SEQ ID NO: 1592427 - RNA, 16 nt, Pseudomonas putida KT2440
ccauuuccgggcaaug

SEQ ID NO: 1592428 - RNA, 14 nt, Pseudomonas putida KT2440
ccauuugcgcuggc

SEQ ID NO: 1592429 - RNA, 16 nt, Pseudomonas putida KT2440
ccauuucgcgggucag

SEQ ID NO: 1592430 - RNA, 17 nt, Pseudomonas putida KT2440
ccauuucgcgggucagg

SEQ ID NO: 1592431 - RNA, 19 nt, Pseudomonas putida KT2440
cccaacagcauccaaagcc

SEQ ID NO: 1592432 - RNA, 12 nt, Pseudomonas putida KT2440
cccaacagcgcg

SEQ ID NO: 1592433 - RNA, 14 nt, Pseudomonas putida KT2440
cccaaaccgcucga

SEQ ID NO: 1592434 - RNA, 18 nt, Pseudomonas putida KT2440
cccaccgcaggucacugc

SEQ ID NO: 1592435 - RNA, 14 nt, Pseudomonas putida KT2440
cccaccggcaccau

SEQ ID NO: 1592436 - RNA, 21 nt, Pseudomonas putida KT2440
cccaccagucugcucagccaa

SEQ ID NO: 1592437 - RNA, 13 nt, Pseudomonas putida KT2440
cccaccagcacug

SEQ ID NO: 1592438 - RNA, 16 nt, Pseudomonas putida KT2440
cccaccagcacugcug

SEQ ID NO: 1592439 - RNA, 13 nt, Pseudomonas putida KT2440
cccaccaggcacc

SEQ ID NO: 1592440 - RNA, 14 nt, Pseudomonas putida KT2440
cccacccaaccgcg

SEQ ID NO: 1592441 - RNA, 14 nt, Pseudomonas putida KT2440
cccaccccagcguu

SEQ ID NO: 1592442 - RNA, 22 nt, Pseudomonas putida KT2440
cccacggcaauucgccggcagc

SEQ ID NO: 1592443 - RNA, 15 nt, Pseudomonas putida KT2440
cccagaacggcacgc

SEQ ID NO: 1592444 - RNA, 21 nt, Pseudomonas putida KT2440
cccagaacuucaccccguaca

SEQ ID NO: 1592445 - RNA, 23 nt, Pseudomonas putida KT2440
ccauugcaccacccccagcgccu

SEQ ID NO: 1592446 - RNA, 16 nt, Pseudomonas putida KT2440
ccauucgcggguaaac

SEQ ID NO: 1592447 - RNA, 17 nt, Pseudomonas putida KT2440
ccauucgcggguaaacc

SEQ ID NO: 1592448 - RNA, 18 nt, Pseudomonas putida KT2440
ccauucucgccgccgcug

SEQ ID NO: 1592449 - RNA, 16 nt, Pseudomonas putida KT2440
ccauuccggcugcagc

SEQ ID NO: 1592450 - RNA, 19 nt, Pseudomonas putida KT2440
ccauuccgggucgccagug

SEQ ID NO: 1592451 - RNA, 22 nt, Pseudomonas putida KT2440
ccauuauuugcguagggcgcug

SEQ ID NO: 1592452 - RNA, 13 nt, Pseudomonas putida KT2440
ccaugcgccgcug

SEQ ID NO: 1592453 - RNA, 14 nt, Pseudomonas putida KT2440
ccaugcgcgcagcg

SEQ ID NO: 1592454 - RNA, 15 nt, Pseudomonas putida KT2440
ccaugcgcaggcagc

SEQ ID NO: 1592455 - RNA, 17 nt, Pseudomonas putida KT2440
ccauguaggagcggguu

SEQ ID NO: 1592456 - RNA, 17 nt, Pseudomonas putida KT2440
ccaugcucggccagcuc

SEQ ID NO: 1592457 - RNA, 17 nt, Pseudomonas putida KT2440
ccagucgaucagcgaca

SEQ ID NO: 1592458 - RNA, 19 nt, Pseudomonas putida KT2440
ccagucgcacagguccagc

SEQ ID NO: 1592459 - RNA, 23 nt, Pseudomonas putida KT2440
ccagucgcacagguccagccgcc

SEQ ID NO: 1592460 - RNA, 18 nt, Pseudomonas putida KT2440
ccagucgccccgccagcg

SEQ ID NO: 1592461 - RNA, 15 nt, Pseudomonas putida KT2440
ccaguccguuaccac

SEQ ID NO: 1592462 - RNA, 13 nt, Pseudomonas putida KT2440
ccaguacugggcg

SEQ ID NO: 1592463 - RNA, 21 nt, Pseudomonas putida KT2440
ccaguacgcgccugcaccugg

SEQ ID NO: 1592464 - RNA, 16 nt, Pseudomonas putida KT2440
ccaguacggcgccacu

SEQ ID NO: 1592465 - RNA, 12 nt, Pseudomonas putida KT2440
cccccagcagcg

SEQ ID NO: 1592466 - RNA, 12 nt, Pseudomonas putida KT2440
cccccagcacag

SEQ ID NO: 1592467 - RNA, 23 nt, Pseudomonas putida KT2440
cccccagcacagauaaaccugcc

SEQ ID NO: 1592468 - RNA, 17 nt, Pseudomonas putida KT2440
ccccgcggucuggcaca

SEQ ID NO: 1592469 - RNA, 16 nt, Pseudomonas putida KT2440
ccccgcccaagcggca

SEQ ID NO: 1592470 - RNA, 13 nt, Pseudomonas putida KT2440
ccccgccccugcu

SEQ ID NO: 1592471 - RNA, 11 nt, Pseudomonas putida KT2440
ccccgcuccua

SEQ ID NO: 1592472 - RNA, 12 nt, Pseudomonas putida KT2440
ccccgcugcaca

SEQ ID NO: 1592473 - RNA, 13 nt, Pseudomonas putida KT2440
ccccggaugcgca

SEQ ID NO: 1592474 - RNA, 22 nt, Pseudomonas putida KT2440
ccccggcaauacaacgaucagc

SEQ ID NO: 1592475 - RNA, 18 nt, Pseudomonas putida KT2440
ccccacagagccgcaaag

SEQ ID NO: 1592476 - RNA, 20 nt, Pseudomonas putida KT2440
ccccacagagccgcaaagcg

SEQ ID NO: 1592477 - RNA, 23 nt, Pseudomonas putida KT2440
ccccacagagccgcaaagcggcc

SEQ ID NO: 1592478 - RNA, 16 nt, Pseudomonas putida KT2440
ccccaaccuuccagca

SEQ ID NO: 1592479 - RNA, 21 nt, Pseudomonas putida KT2440
ccccaaccuuccagcaaagug

SEQ ID NO: 1592480 - RNA, 21 nt, Pseudomonas putida KT2440
ccccaagguggaaaucgccug

SEQ ID NO: 1592481 - RNA, 19 nt, Pseudomonas putida KT2440
ccccaauaaaaaaccggcc

SEQ ID NO: 1592482 - RNA, 20 nt, Pseudomonas putida KT2440
ccccaaaaaaucuagcgcaa

SEQ ID NO: 1592483 - RNA, 20 nt, Pseudomonas putida KT2440
ccccagccggucauccagca

SEQ ID NO: 1592484 - RNA, 13 nt, Pseudomonas putida KT2440
ccccagccaacgc

SEQ ID NO: 1592485 - RNA, 14 nt, Pseudomonas putida KT2440
ccccagccaacgcc

SEQ ID NO: 1592486 - RNA, 19 nt, Pseudomonas putida KT2440
ccccaccaggaagcuggcc

SEQ ID NO: 1592487 - RNA, 14 nt, Pseudomonas putida KT2440
ccccaucagcagcu

SEQ ID NO: 1592488 - RNA, 22 nt, Pseudomonas putida KT2440
ccccaucagcgggcgauugcca

SEQ ID NO: 1592489 - RNA, 14 nt, Pseudomonas putida KT2440
ccccaucaguugca

SEQ ID NO: 1592490 - RNA, 22 nt, Pseudomonas putida KT2440
ccccaucaguugcagcaacgcc

SEQ ID NO: 1592491 - RNA, 16 nt, Pseudomonas putida KT2440
ccccagcgcgccagca

SEQ ID NO: 1592492 - RNA, 13 nt, Pseudomonas putida KT2440
ccccaucggcacc

SEQ ID NO: 1592493 - RNA, 20 nt, Pseudomonas putida KT2440
ccccauucgcugcgucaggc

SEQ ID NO: 1592494 - RNA, 15 nt, Pseudomonas putida KT2440
ccccauguggcgcag

SEQ ID NO: 1592495 - RNA, 14 nt, Pseudomonas putida KT2440
cccccacagggcaa

SEQ ID NO: 1592496 - RNA, 19 nt, Pseudomonas putida KT2440
ccccggugcagguuggagc

SEQ ID NO: 1592497 - RNA, 18 nt, Pseudomonas putida KT2440
ccccggucagcauggcca

SEQ ID NO: 1592498 - RNA, 19 nt, Pseudomonas putida KT2440
ccccguaggagcggguuua

SEQ ID NO: 1592499 - RNA, 20 nt, Pseudomonas putida KT2440
ccccugcuugaccauggcga

SEQ ID NO: 1592500 - RNA, 22 nt, Pseudomonas putida KT2440
ccccguucgcccugcgccugca

SEQ ID NO: 1592501 - RNA, 22 nt, Pseudomonas putida KT2440
ccccugguuuuccaccggcacg

SEQ ID NO: 1592502 - RNA, 18 nt, Pseudomonas putida KT2440
ccccuguaggagcgggcu

SEQ ID NO: 1592503 - RNA, 20 nt, Pseudomonas putida KT2440
ccccuguaggagcggguuua

SEQ ID NO: 1592504 - RNA, 21 nt, Pseudomonas putida KT2440
ccccuucgucgauguccagcg

SEQ ID NO: 1592505 - RNA, 17 nt, Pseudomonas putida KT2440
ccccuuccccaggccgc

SEQ ID NO: 1592506 - RNA, 17 nt, Pseudomonas putida KT2440
cccgaaaccaugcaggu

SEQ ID NO: 1592507 - RNA, 16 nt, Pseudomonas putida KT2440
ccccuuucgcgacaca

SEQ ID NO: 1592508 - RNA, 16 nt, Pseudomonas putida KT2440
ccccuuggccaacggc

SEQ ID NO: 1592509 - RNA, 22 nt, Pseudomonas putida KT2440
cccgaggaaguacgccggcgca

SEQ ID NO: 1592510 - RNA, 18 nt, Pseudomonas putida KT2440
cccgaggcaaucagcggu

SEQ ID NO: 1592511 - RNA, 15 nt, Pseudomonas putida KT2440
cccgaggucagcagu

SEQ ID NO: 1592512 - RNA, 18 nt, Pseudomonas putida KT2440
cccgagcaaggcgcagcc

SEQ ID NO: 1592513 - RNA, 16 nt, Pseudomonas putida KT2440
cccgacaccggccuug

SEQ ID NO: 1592514 - RNA, 16 nt, Pseudomonas putida KT2440
cccgaaagggccgcaa

SEQ ID NO: 1592515 - RNA, 17 nt, Pseudomonas putida KT2440
cccgacaaaguggaagg

SEQ ID NO: 1592516 - RNA, 15 nt, Pseudomonas putida KT2440
cccgacaacagcugc

SEQ ID NO: 1592517 - RNA, 13 nt, Pseudomonas putida KT2440
cccgcagacagcu

SEQ ID NO: 1592518 - RNA, 17 nt, Pseudomonas putida KT2440
cccgcaucguuugaugc

SEQ ID NO: 1592519 - RNA, 19 nt, Pseudomonas putida KT2440
cccgcaucguuugaugcgg

SEQ ID NO: 1592520 - RNA, 17 nt, Pseudomonas putida KT2440
cccgcacgaacagcggc

SEQ ID NO: 1592521 - RNA, 15 nt, Pseudomonas putida KT2440
cccgcacugcugccg

SEQ ID NO: 1592522 - RNA, 17 nt, Pseudomonas putida KT2440
cccgaucuccccaccau

SEQ ID NO: 1592523 - RNA, 15 nt, Pseudomonas putida KT2440
cccgaucggguacuc

SEQ ID NO: 1592524 - RNA, 21 nt, Pseudomonas putida KT2440
cccgcgaagggccgcaacgcg

SEQ ID NO: 1592525 - RNA, 22 nt, Pseudomonas putida KT2440
cccgcgaauacgagggugaacc

SEQ ID NO: 1592526 - RNA, 22 nt, Pseudomonas putida KT2440
cccgcgaauacgguagcggcag

SEQ ID NO: 1592527 - RNA, 16 nt, Pseudomonas putida KT2440
cccgcgaauacggucg

SEQ ID NO: 1592528 - RNA, 18 nt, Pseudomonas putida KT2440
cccgcgaaugggccgcag

SEQ ID NO: 1592529 - RNA, 21 nt, Pseudomonas putida KT2440
cccgcgacgaaacccaguacg

SEQ ID NO: 1592530 - RNA, 14 nt, Pseudomonas putida KT2440
cccgccccaaagga

SEQ ID NO: 1592531 - RNA, 14 nt, Pseudomonas putida KT2440
cccgcccagcuggc

SEQ ID NO: 1592532 - RNA, 21 nt, Pseudomonas putida KT2440
cccgcccgaagggcagggcga

SEQ ID NO: 1592533 - RNA, 14 nt, Pseudomonas putida KT2440
cccgcccgccaugc

SEQ ID NO: 1592534 - RNA, 18 nt, Pseudomonas putida KT2440
cccgcccagcagcaacgc

SEQ ID NO: 1592535 - RNA, 20 nt, Pseudomonas putida KT2440
cccgcccagcccaugaacag

SEQ ID NO: 1592536 - RNA, 13 nt, Pseudomonas putida KT2440
cccgccacaccga

SEQ ID NO: 1592537 - RNA, 15 nt, Pseudomonas putida KT2440
cccgcgcuucccggg

SEQ ID NO: 1592538 - RNA, 15 nt, Pseudomonas putida KT2440
cccgcgacgugaccg

SEQ ID NO: 1592539 - RNA, 15 nt, Pseudomonas putida KT2440
cccgcgcaugaucag

SEQ ID NO: 1592540 - RNA, 20 nt, Pseudomonas putida KT2440
cccgcgaguccuccaacucg

SEQ ID NO: 1592541 - RNA, 14 nt, Pseudomonas putida KT2440
cccgcggcgaacac

SEQ ID NO: 1592542 - RNA, 21 nt, Pseudomonas putida KT2440
cccgcggcucacccaccagcc

SEQ ID NO: 1592543 - RNA, 13 nt, Pseudomonas putida KT2440
cccgcgguaaugc

SEQ ID NO: 1592544 - RNA, 23 nt, Pseudomonas putida KT2440
cccgcggaucgcgccuucgcugg

SEQ ID NO: 1592545 - RNA, 15 nt, Pseudomonas putida KT2440
cccggaccagcgccg

SEQ ID NO: 1592546 - RNA, 14 nt, Pseudomonas putida KT2440
cccggauggugugc

SEQ ID NO: 1592547 - RNA, 20 nt, Pseudomonas putida KT2440
cccggauggcggugaugcgc

SEQ ID NO: 1592548 - RNA, 21 nt, Pseudomonas putida KT2440
cccgcuuuuggcugugcaccc

SEQ ID NO: 1592549 - RNA, 16 nt, Pseudomonas putida KT2440
cccgcucucacaggga

SEQ ID NO: 1592550 - RNA, 20 nt, Pseudomonas putida KT2440
cccgcugcacgucgcgcagg

SEQ ID NO: 1592551 - RNA, 22 nt, Pseudomonas putida KT2440
cccgcugcaugcucggcggugc

SEQ ID NO: 1592552 - RNA, 23 nt, Pseudomonas putida KT2440
cccgcugccaccuuccaggucga

SEQ ID NO: 1592553 - RNA, 18 nt, Pseudomonas putida KT2440
ccagggcggcgcccagua

SEQ ID NO: 1592554 - RNA, 15 nt, Pseudomonas putida KT2440
ccagggccugaccgc

SEQ ID NO: 1592555 - RNA, 16 nt, Pseudomonas putida KT2440
ccagggccuuggccug

SEQ ID NO: 1592556 - RNA, 20 nt, Pseudomonas putida KT2440
ccagggcaucgaccaguacg

SEQ ID NO: 1592557 - RNA, 17 nt, Pseudomonas putida KT2440
ccagguacucgcgcugu

SEQ ID NO: 1592558 - RNA, 20 nt, Pseudomonas putida KT2440
ccagguaguacggcaggcga

SEQ ID NO: 1592559 - RNA, 17 nt, Pseudomonas putida KT2440
ccagguauggccagagc

SEQ ID NO: 1592560 - RNA, 19 nt, Pseudomonas putida KT2440
ccagggcuggcagcgggua

SEQ ID NO: 1592561 - RNA, 21 nt, Pseudomonas putida KT2440
ccagggcugauugagcagcug

SEQ ID NO: 1592562 - RNA, 15 nt, Pseudomonas putida KT2440
ccagguacaggcaaa

SEQ ID NO: 1592563 - RNA, 19 nt, Pseudomonas putida KT2440
ccaguaccgcgccuccagc

SEQ ID NO: 1592564 - RNA, 15 nt, Pseudomonas putida KT2440
ccaguaccagcagca

SEQ ID NO: 1592565 - RNA, 16 nt, Pseudomonas putida KT2440
ccaguaccagcagcac

SEQ ID NO: 1592566 - RNA, 22 nt, Pseudomonas putida KT2440
ccaguaccuuggcguaggccug

SEQ ID NO: 1592567 - RNA, 21 nt, Pseudomonas putida KT2440
ccaguacgccacccagaugcg

SEQ ID NO: 1592568 - RNA, 17 nt, Pseudomonas putida KT2440
ccaguacgccagcagcg

SEQ ID NO: 1592569 - RNA, 18 nt, Pseudomonas putida KT2440
ccaguacgccagcagcgc

SEQ ID NO: 1592570 - RNA, 20 nt, Pseudomonas putida KT2440
ccaguacgccagcagcgcau

SEQ ID NO: 1592571 - RNA, 14 nt, Pseudomonas putida KT2440
ccaguaccacagcc

SEQ ID NO: 1592572 - RNA, 17 nt, Pseudomonas putida KT2440
ccagguguuugggcuug

SEQ ID NO: 1592573 - RNA, 20 nt, Pseudomonas putida KT2440
ccagguuauccacagggccu

SEQ ID NO: 1592574 - RNA, 22 nt, Pseudomonas putida KT2440
ccaggugguaacuggccaguug

SEQ ID NO: 1592575 - RNA, 16 nt, Pseudomonas putida KT2440
ccaggugguagucggc

SEQ ID NO: 1592576 - RNA, 18 nt, Pseudomonas putida KT2440
ccagguggaucggcgugc

SEQ ID NO: 1592577 - RNA, 14 nt, Pseudomonas putida KT2440
ccaggucggacagg

SEQ ID NO: 1592578 - RNA, 17 nt, Pseudomonas putida KT2440
ccaggucgccggugugc

SEQ ID NO: 1592579 - RNA, 21 nt, Pseudomonas putida KT2440
ccagguaaucaguucgcagcc

SEQ ID NO: 1592580 - RNA, 14 nt, Pseudomonas putida KT2440
ccaggucgccagca

SEQ ID NO: 1592581 - RNA, 19 nt, Pseudomonas putida KT2440
ccaggcaguuucaggcgcu

SEQ ID NO: 1592582 - RNA, 20 nt, Pseudomonas putida KT2440
ccaggcaguuucaggcgcuc

SEQ ID NO: 1592583 - RNA, 21 nt, Pseudomonas putida KT2440
ccaggcauacagcuggccuug

SEQ ID NO: 1592584 - RNA, 14 nt, Pseudomonas putida KT2440
ccaggcacuggcca

SEQ ID NO: 1592585 - RNA, 17 nt, Pseudomonas putida KT2440
ccaggcacuggccagcg

SEQ ID NO: 1592586 - RNA, 18 nt, Pseudomonas putida KT2440
ccaggcacaggcgcacac

SEQ ID NO: 1592587 - RNA, 21 nt, Pseudomonas putida KT2440
ccaggcacaccgagccauuga

SEQ ID NO: 1592588 - RNA, 17 nt, Pseudomonas putida KT2440
ccaggccgcacgcgccu

SEQ ID NO: 1592589 - RNA, 20 nt, Pseudomonas putida KT2440
ccaggcauuccccggucagc

SEQ ID NO: 1592590 - RNA, 22 nt, Pseudomonas putida KT2440
ccaggccucaagccucgcgcaa

SEQ ID NO: 1592591 - RNA, 14 nt, Pseudomonas putida KT2440
ccaggccugcggca

SEQ ID NO: 1592592 - RNA, 21 nt, Pseudomonas putida KT2440
ccaggcuagccggucaccgac

SEQ ID NO: 1592593 - RNA, 19 nt, Pseudomonas putida KT2440
ccaggcucgcccgggucag

SEQ ID NO: 1592594 - RNA, 20 nt, Pseudomonas putida KT2440
ccaggcucgcccgggucagg

SEQ ID NO: 1592595 - RNA, 17 nt, Pseudomonas putida KT2440
ccaggcugagcccggca

SEQ ID NO: 1592596 - RNA, 21 nt, Pseudomonas putida KT2440
ccaggcugccaaaccgcccca

SEQ ID NO: 1592597 - RNA, 18 nt, Pseudomonas putida KT2440
ccaggcugcgcgccaugg

SEQ ID NO: 1592598 - RNA, 21 nt, Pseudomonas putida KT2440
ccaggcugcgcgccauggcga

SEQ ID NO: 1592599 - RNA, 12 nt, Pseudomonas putida KT2440
ccaggcgcgccu

SEQ ID NO: 1592600 - RNA, 15 nt, Pseudomonas putida KT2440
ccaggcgcgccugca

SEQ ID NO: 1592601 - RNA, 15 nt, Pseudomonas putida KT2440
ccaggcgcgguucga

SEQ ID NO: 1592602 - RNA, 17 nt, Pseudomonas putida KT2440
ccagcguucucgcucag

SEQ ID NO: 1592603 - RNA, 22 nt, Pseudomonas putida KT2440
ccagcucaaaccccccaugcuc

SEQ ID NO: 1592604 - RNA, 13 nt, Pseudomonas putida KT2440
ccagcuccaggcg

SEQ ID NO: 1592605 - RNA, 13 nt, Pseudomonas putida KT2440
ccagcuccagcac

SEQ ID NO: 1592606 - RNA, 22 nt, Pseudomonas putida KT2440
ccagcucacgcaagcggcccug

SEQ ID NO: 1592607 - RNA, 14 nt, Pseudomonas putida KT2440
ccagcucacagcac

SEQ ID NO: 1592608 - RNA, 12 nt, Pseudomonas putida KT2440
ccagcucgcccg

SEQ ID NO: 1592609 - RNA, 14 nt, Pseudomonas putida KT2440
ccagcucgccaaca

SEQ ID NO: 1592610 - RNA, 16 nt, Pseudomonas putida KT2440
ccagcuccgacucguc

SEQ ID NO: 1592611 - RNA, 18 nt, Pseudomonas putida KT2440
ccagcucggccgaugcca

SEQ ID NO: 1592612 - RNA, 21 nt, Pseudomonas putida KT2440
ccagcucuuugggggugcuga

SEQ ID NO: 1592613 - RNA, 15 nt, Pseudomonas putida KT2440
ccagcugcaacagcg

SEQ ID NO: 1592614 - RNA, 20 nt, Pseudomonas putida KT2440
ccagcugcaacagcggcgag

SEQ ID NO: 1592615 - RNA, 16 nt, Pseudomonas putida KT2440
ccagcuguucggucag

SEQ ID NO: 1592616 - RNA, 13 nt, Pseudomonas putida KT2440
ccagcuggccacc

SEQ ID NO: 1592617 - RNA, 12 nt, Pseudomonas putida KT2440
ccagcuggccau

SEQ ID NO: 1592618 - RNA, 22 nt, Pseudomonas putida KT2440
ccagcuggagacgaacagcgcc

SEQ ID NO: 1592619 - RNA, 22 nt, Pseudomonas putida KT2440
ccagcugcgggaugcgguugac

SEQ ID NO: 1592620 - RNA, 14 nt, Pseudomonas putida KT2440
ccagcugcgcacgc

SEQ ID NO: 1592621 - RNA, 14 nt, Pseudomonas putida KT2440
ccaggauauugccg

SEQ ID NO: 1592622 - RNA, 15 nt, Pseudomonas putida KT2440
ccaggaucacuggcc

SEQ ID NO: 1592623 - RNA, 17 nt, Pseudomonas putida KT2440
ccaggaucacuggccug

SEQ ID NO: 1592624 - RNA, 14 nt, Pseudomonas putida KT2440
ccaggagggcuggu

SEQ ID NO: 1592625 - RNA, 24 nt, Pseudomonas putida KT2440
ccaggagggcugguggcggcauac

SEQ ID NO: 1592626 - RNA, 20 nt, Pseudomonas putida KT2440
ccaggaguucugcacagcgc

SEQ ID NO: 1592627 - RNA, 20 nt, Pseudomonas putida KT2440
ccaggacuucccggcaccgc

SEQ ID NO: 1592628 - RNA, 19 nt, Pseudomonas putida KT2440
ccaggagaacacccagcgc

SEQ ID NO: 1592629 - RNA, 18 nt, Pseudomonas putida KT2440
ccaggauugccgggcuac

SEQ ID NO: 1592630 - RNA, 20 nt, Pseudomonas putida KT2440
ccaggauugccgggcuacgc

SEQ ID NO: 1592631 - RNA, 17 nt, Pseudomonas putida KT2440
ccaggauuggccgcaac

SEQ ID NO: 1592632 - RNA, 19 nt, Pseudomonas putida KT2440
ccaggauuggccgcaacac

SEQ ID NO: 1592633 - RNA, 15 nt, Pseudomonas putida KT2440
ccaggaacagcgcag

SEQ ID NO: 1592634 - RNA, 15 nt, Pseudomonas putida KT2440
ccagcuucuccagca

SEQ ID NO: 1592635 - RNA, 17 nt, Pseudomonas putida KT2440
ccagcuucuccagcaag

SEQ ID NO: 1592636 - RNA, 17 nt, Pseudomonas putida KT2440
ccagcuucugcuggucc

SEQ ID NO: 1592637 - RNA, 17 nt, Pseudomonas putida KT2440
ccagcuugccaccaucg

SEQ ID NO: 1592638 - RNA, 21 nt, Pseudomonas putida KT2440
ccagcuugccaccaucgaccu

SEQ ID NO: 1592639 - RNA, 13 nt, Pseudomonas putida KT2440
ccaggaagcucgc

SEQ ID NO: 1592640 - RNA, 15 nt, Pseudomonas putida KT2440
ccaggaagcuggcca

SEQ ID NO: 1592641 - RNA, 22 nt, Pseudomonas putida KT2440
ccaggaagucgauguucagcac

SEQ ID NO: 1592642 - RNA, 16 nt, Pseudomonas putida KT2440
ccagccgcgccagguc

SEQ ID NO: 1592643 - RNA, 22 nt, Pseudomonas putida KT2440
ccagccgggcugcaaagcgggc

SEQ ID NO: 1592644 - RNA, 16 nt, Pseudomonas putida KT2440
ccagcgacagcaucgg

SEQ ID NO: 1592645 - RNA, 20 nt, Pseudomonas putida KT2440
ccagccggucauccagcagc

SEQ ID NO: 1592646 - RNA, 20 nt, Pseudomonas putida KT2440
ccagcgacugcaagcgaugc

SEQ ID NO: 1592647 - RNA, 13 nt, Pseudomonas putida KT2440
ccagcgcacagcu

SEQ ID NO: 1592648 - RNA, 23 nt, Pseudomonas putida KT2440
ccagcgcauacagcuugcccauc

SEQ ID NO: 1592649 - RNA, 17 nt, Pseudomonas putida KT2440
ccagcgcaucaacgccu

SEQ ID NO: 1592650 - RNA, 14 nt, Pseudomonas putida KT2440
ccagccgcccaagc

SEQ ID NO: 1592651 - RNA, 22 nt, Pseudomonas putida KT2440
ccagccgcaaccgggucggcgc

SEQ ID NO: 1592652 - RNA, 12 nt, Pseudomonas putida KT2440
ccagccgcgaac

SEQ ID NO: 1592653 - RNA, 13 nt, Pseudomonas putida KT2440
ccagcccgccugc

SEQ ID NO: 1592654 - RNA, 15 nt, Pseudomonas putida KT2440
ccagcccaccacgaa

SEQ ID NO: 1592655 - RNA, 18 nt, Pseudomonas putida KT2440
ccagcaucaacaggucgc

SEQ ID NO: 1592656 - RNA, 19 nt, Pseudomonas putida KT2440
ccagcaucagcacacccag

SEQ ID NO: 1592657 - RNA, 23 nt, Pseudomonas putida KT2440
ccagcaucacccucacgaugacc

SEQ ID NO: 1592658 - RNA, 21 nt, Pseudomonas putida KT2440
ccagcagugcaucgaagcagg

SEQ ID NO: 1592659 - RNA, 14 nt, Pseudomonas putida KT2440
ccagcagugcggca

SEQ ID NO: 1592660 - RNA, 19 nt, Pseudomonas putida KT2440
ccagcagugcggcaaccac

SEQ ID NO: 1592661 - RNA, 18 nt, Pseudomonas putida KT2440
ccagcaguucgcgcacca

SEQ ID NO: 1592662 - RNA, 21 nt, Pseudomonas putida KT2440
ccagcaguucgcgcaccaucg

SEQ ID NO: 1592663 - RNA, 19 nt, Pseudomonas putida KT2440
ccagcaccugacgcaagcg

SEQ ID NO: 1592664 - RNA, 19 nt, Pseudomonas putida KT2440
ccagcaggucagcacgcgc

SEQ ID NO: 1592665 - RNA, 14 nt, Pseudomonas putida KT2440
ccagcaggucaggc

SEQ ID NO: 1592666 - RNA, 15 nt, Pseudomonas putida KT2440
ccagccacggaucac

SEQ ID NO: 1592667 - RNA, 17 nt, Pseudomonas putida KT2440
ccagccaacgcugguag

SEQ ID NO: 1592668 - RNA, 23 nt, Pseudomonas putida KT2440
ccagccaacgccccacccgcuca

SEQ ID NO: 1592669 - RNA, 16 nt, Pseudomonas putida KT2440
ccagccaccaccaugc

SEQ ID NO: 1592670 - RNA, 13 nt, Pseudomonas putida KT2440
ccagcaucggcac

SEQ ID NO: 1592671 - RNA, 23 nt, Pseudomonas putida KT2440
ccagccaaacccggccgcgguaa

SEQ ID NO: 1592672 - RNA, 13 nt, Pseudomonas putida KT2440
ccagcccagcgcc

SEQ ID NO: 1592673 - RNA, 20 nt, Pseudomonas putida KT2440
ccagcggcaaccugacccgc

SEQ ID NO: 1592674 - RNA, 23 nt, Pseudomonas putida KT2440
ccagcggcaaggucaacggcaac

SEQ ID NO: 1592675 - RNA, 17 nt, Pseudomonas putida KT2440
ccagcgcguacagcgac

SEQ ID NO: 1592676 - RNA, 22 nt, Pseudomonas putida KT2440
ccagcgcguacagcgacaugcc

SEQ ID NO: 1592677 - RNA, 12 nt, Pseudomonas putida KT2440
ccagcggcgugu

SEQ ID NO: 1592678 - RNA, 15 nt, Pseudomonas putida KT2440
ccagcgcgccagcag

SEQ ID NO: 1592679 - RNA, 17 nt, Pseudomonas putida KT2440
ccagcgcaugcaucugc

SEQ ID NO: 1592680 - RNA, 18 nt, Pseudomonas putida KT2440
ccagcgcggucugcggca

SEQ ID NO: 1592681 - RNA, 22 nt, Pseudomonas putida KT2440
ccagcgcggucugcggcagcac

SEQ ID NO: 1592682 - RNA, 20 nt, Pseudomonas putida KT2440
ccagcgguggguggcucauc

SEQ ID NO: 1592683 - RNA, 13 nt, Pseudomonas putida KT2440
ccagcggugccag

SEQ ID NO: 1592684 - RNA, 14 nt, Pseudomonas putida KT2440
ccagcgucagugac

SEQ ID NO: 1592685 - RNA, 18 nt, Pseudomonas putida KT2440
ccagcgucagugacaggc

SEQ ID NO: 1592686 - RNA, 17 nt, Pseudomonas putida KT2440
ccagcgucccggucaac

SEQ ID NO: 1592687 - RNA, 20 nt, Pseudomonas putida KT2440
ccagcgggaugcagucgacc

SEQ ID NO: 1592688 - RNA, 22 nt, Pseudomonas putida KT2440
ccagcggucugcugcgucagca

SEQ ID NO: 1592689 - RNA, 17 nt, Pseudomonas putida KT2440
ccagcgggucgucgccc

SEQ ID NO: 1592690 - RNA, 22 nt, Pseudomonas putida KT2440
ccagcggguggucgcugcggca

SEQ ID NO: 1592691 - RNA, 13 nt, Pseudomonas putida KT2440
ccagcguggccug

SEQ ID NO: 1592692 - RNA, 21 nt, Pseudomonas putida KT2440
ccagcguggccugcaagccgg

SEQ ID NO: 1592693 - RNA, 19 nt, Pseudomonas putida KT2440
ccagcgugcccgccacacc

SEQ ID NO: 1592694 - RNA, 20 nt, Pseudomonas putida KT2440
ccagcgucguguucgccugu

SEQ ID NO: 1592695 - RNA, 16 nt, Pseudomonas putida KT2440
ccacgcugccaggacc

SEQ ID NO: 1592696 - RNA, 13 nt, Pseudomonas putida KT2440
ccacgcuggcacc

SEQ ID NO: 1592697 - RNA, 15 nt, Pseudomonas putida KT2440
ccacggaucaccugg

SEQ ID NO: 1592698 - RNA, 15 nt, Pseudomonas putida KT2440
ccacgcgcaggccac

SEQ ID NO: 1592699 - RNA, 17 nt, Pseudomonas putida KT2440
ccacgcggguccagcgc

SEQ ID NO: 1592700 - RNA, 17 nt, Pseudomonas putida KT2440
ccacgcaaaaccugagu

SEQ ID NO: 1592701 - RNA, 19 nt, Pseudomonas putida KT2440
ccacgcaccaccaagucga

SEQ ID NO: 1592702 - RNA, 14 nt, Pseudomonas putida KT2440
ccacgcaguuggcc

SEQ ID NO: 1592703 - RNA, 16 nt, Pseudomonas putida KT2440
ccacgaucucacgcgc

SEQ ID NO: 1592704 - RNA, 20 nt, Pseudomonas putida KT2440
ccacgaucucacgcgccaca

SEQ ID NO: 1592705 - RNA, 23 nt, Pseudomonas putida KT2440
ccaccugcggcaggugggucacg

SEQ ID NO: 1592706 - RNA, 23 nt, Pseudomonas putida KT2440
ccaccugcagggucaggcggauu

SEQ ID NO: 1592707 - RNA, 22 nt, Pseudomonas putida KT2440
ccaccuuguucgagcgccauga

SEQ ID NO: 1592708 - RNA, 17 nt, Pseudomonas putida KT2440
ccaccugcuccagcacc

SEQ ID NO: 1592709 - RNA, 13 nt, Pseudomonas putida KT2440
ccaccugacgcgc

SEQ ID NO: 1592710 - RNA, 20 nt, Pseudomonas putida KT2440
ccaccucgucaugcagcgcc

SEQ ID NO: 1592711 - RNA, 15 nt, Pseudomonas putida KT2440
ccaccucucagcacc

SEQ ID NO: 1592712 - RNA, 15 nt, Pseudomonas putida KT2440
ccaccucugcggccu

SEQ ID NO: 1592713 - RNA, 15 nt, Pseudomonas putida KT2440
ccaccggccacgcgc

SEQ ID NO: 1592714 - RNA, 21 nt, Pseudomonas putida KT2440
ccaccggccgacccgccuggu

SEQ ID NO: 1592715 - RNA, 24 nt, Pseudomonas putida KT2440
aaaggccgcguuagucguacuagc

SEQ ID NO: 1592716 - RNA, 23 nt, Pseudomonas putida KT2440
aaaggccggcaccgacagcaacg

SEQ ID NO: 1592717 - RNA, 16 nt, Pseudomonas putida KT2440
ccaccgucaggcucag

SEQ ID NO: 1592718 - RNA, 14 nt, Pseudomonas putida KT2440
ccaccggcgcugcg

SEQ ID NO: 1592719 - RNA, 15 nt, Pseudomonas putida KT2440
ccacuguugcagcgc

SEQ ID NO: 1592720 - RNA, 16 nt, Pseudomonas putida KT2440
ccacuguugcagcgcc

SEQ ID NO: 1592721 - RNA, 17 nt, Pseudomonas putida KT2440
ccacuggugccggcacg

SEQ ID NO: 1592722 - RNA, 18 nt, Pseudomonas putida KT2440
ccacugguacagcucacg

SEQ ID NO: 1592723 - RNA, 22 nt, Pseudomonas putida KT2440
ccacugcuguuccagaagcggc

SEQ ID NO: 1592724 - RNA, 21 nt, Pseudomonas putida KT2440
ccacugcuucugagccagccg

SEQ ID NO: 1592725 - RNA, 19 nt, Pseudomonas putida KT2440
ccagaacagccacagcugc

SEQ ID NO: 1592726 - RNA, 13 nt, Pseudomonas putida KT2440
ccagaaccaggau

SEQ ID NO: 1592727 - RNA, 16 nt, Pseudomonas putida KT2440
ccacugucagccagcg

SEQ ID NO: 1592728 - RNA, 15 nt, Pseudomonas putida KT2440
ccacucgcgcagcac

SEQ ID NO: 1592729 - RNA, 11 nt, Pseudomonas putida KT2440
ccacucggcaa

SEQ ID NO: 1592730 - RNA, 21 nt, Pseudomonas putida KT2440
ccacucccauguagaccacca

SEQ ID NO: 1592731 - RNA, 18 nt, Pseudomonas putida KT2440
ccacgucuuccuggcgga

SEQ ID NO: 1592732 - RNA, 19 nt, Pseudomonas putida KT2440
ccacgucuuccuggcggaa

SEQ ID NO: 1592733 - RNA, 16 nt, Pseudomonas putida KT2440
ccacgguacgggcaaa

SEQ ID NO: 1592734 - RNA, 20 nt, Pseudomonas putida KT2440
ccacggucagcauccagcca

SEQ ID NO: 1592735 - RNA, 17 nt, Pseudomonas putida KT2440
ccacggucggccugcgc

SEQ ID NO: 1592736 - RNA, 15 nt, Pseudomonas putida KT2440
ccacggucuggcgca

SEQ ID NO: 1592737 - RNA, 13 nt, Pseudomonas putida KT2440
ccacggccuggcc

SEQ ID NO: 1592738 - RNA, 15 nt, Pseudomonas putida KT2440
ccagcaacaacgccu

SEQ ID NO: 1592739 - RNA, 19 nt, Pseudomonas putida KT2440
ccagcaacaacgccuuggc

SEQ ID NO: 1592740 - RNA, 18 nt, Pseudomonas putida KT2440
ccagcaacacgcagucga

SEQ ID NO: 1592741 - RNA, 12 nt, Pseudomonas putida KT2440
ccagcaccagcg

SEQ ID NO: 1592742 - RNA, 18 nt, Pseudomonas putida KT2440
ccagcaccaucagagcgc

SEQ ID NO: 1592743 - RNA, 22 nt, Pseudomonas putida KT2440
ccagcaccaucagagcgccagc

SEQ ID NO: 1592744 - RNA, 22 nt, Pseudomonas putida KT2440
ccagcaccaucaggcacaggcc

SEQ ID NO: 1592745 - RNA, 17 nt, Pseudomonas putida KT2440
ccagaugcgggcccugg

SEQ ID NO: 1592746 - RNA, 22 nt, Pseudomonas putida KT2440
ccagcaaauacgguugcagcac

SEQ ID NO: 1592747 - RNA, 21 nt, Pseudomonas putida KT2440
ccagauucaagcccggcgccu

SEQ ID NO: 1592748 - RNA, 16 nt, Pseudomonas putida KT2440
ccagaucggcagugcc

SEQ ID NO: 1592749 - RNA, 15 nt, Pseudomonas putida KT2440
ccagaucucgcgcuu

SEQ ID NO: 1592750 - RNA, 14 nt, Pseudomonas putida KT2440
ccagaaggcucagu

SEQ ID NO: 1592751 - RNA, 18 nt, Pseudomonas putida KT2440
ccagaacggcacgcccau

SEQ ID NO: 1592752 - RNA, 17 nt, Pseudomonas putida KT2440
ccagacgcuguacgucc

SEQ ID NO: 1592753 - RNA, 13 nt, Pseudomonas putida KT2440
ccagacggccuuc

SEQ ID NO: 1592754 - RNA, 16 nt, Pseudomonas putida KT2440
ccagacgcgcgcuggc

SEQ ID NO: 1592755 - RNA, 14 nt, Pseudomonas putida KT2440
ccagaccuugcgca

SEQ ID NO: 1592756 - RNA, 20 nt, Pseudomonas putida KT2440
ccaccaaaggccuugaucgc

SEQ ID NO: 1592757 - RNA, 20 nt, Pseudomonas putida KT2440
ccaccaacagcaccggccag

SEQ ID NO: 1592758 - RNA, 22 nt, Pseudomonas putida KT2440
ccacacugcucgucaaaccggc

SEQ ID NO: 1592759 - RNA, 19 nt, Pseudomonas putida KT2440
ccacacugucccggcacaa

SEQ ID NO: 1592760 - RNA, 21 nt, Pseudomonas putida KT2440
ccacacggcaagccacgccag

SEQ ID NO: 1592761 - RNA, 17 nt, Pseudomonas putida KT2440
ccaccacgguacuuggc

SEQ ID NO: 1592762 - RNA, 14 nt, Pseudomonas putida KT2440
ccaccaccuucuca

SEQ ID NO: 1592763 - RNA, 18 nt, Pseudomonas putida KT2440
ccaccacgaacaguggcc

SEQ ID NO: 1592764 - RNA, 21 nt, Pseudomonas putida KT2440
ccaccacauccgaccccagca

SEQ ID NO: 1592765 - RNA, 24 nt, Pseudomonas putida KT2440
ccaccacaaaccacagcggccaca

SEQ ID NO: 1592766 - RNA, 16 nt, Pseudomonas putida KT2440
ccaccagcgcccuuca

SEQ ID NO: 1592767 - RNA, 21 nt, Pseudomonas putida KT2440
ccaccaggugcuugcggaaca

SEQ ID NO: 1592768 - RNA, 17 nt, Pseudomonas putida KT2440
ccacccgcucaaagcgc

SEQ ID NO: 1592769 - RNA, 15 nt, Pseudomonas putida KT2440
ccacccgguagaagc

SEQ ID NO: 1592770 - RNA, 21 nt, Pseudomonas putida KT2440
ccaccagugccggguccaguu

SEQ ID NO: 1592771 - RNA, 16 nt, Pseudomonas putida KT2440
ccaccgcgcgccaguu

SEQ ID NO: 1592772 - RNA, 13 nt, Pseudomonas putida KT2440
ccaccgccgugcc

SEQ ID NO: 1592773 - RNA, 23 nt, Pseudomonas putida KT2440
ccaccgcgaaacacagcaggcca

SEQ ID NO: 1592774 - RNA, 13 nt, Pseudomonas putida KT2440
ccaccgcagguca

SEQ ID NO: 1592775 - RNA, 12 nt, Pseudomonas putida KT2440
ccaccgcaggug

SEQ ID NO: 1592776 - RNA, 17 nt, Pseudomonas putida KT2440
ccaccgauccgguguag

SEQ ID NO: 1592777 - RNA, 19 nt, Pseudomonas putida KT2440
ccacccggucggccagcug

SEQ ID NO: 1592778 - RNA, 20 nt, Pseudomonas putida KT2440
ccaccgagugcggcaggccg

SEQ ID NO: 1592779 - RNA, 23 nt, Pseudomonas putida KT2440
aaagcguucgcccuccugcagca

SEQ ID NO: 1592780 - RNA, 19 nt, Pseudomonas putida KT2440
aaagcugaaugaaaaagcc

SEQ ID NO: 1592781 - RNA, 15 nt, Pseudomonas putida KT2440
ccaacgauuggcagu

SEQ ID NO: 1592782 - RNA, 14 nt, Pseudomonas putida KT2440
ccaacgccugaagc

SEQ ID NO: 1592783 - RNA, 15 nt, Pseudomonas putida KT2440
ccaacgcaccgacca

SEQ ID NO: 1592784 - RNA, 21 nt, Pseudomonas putida KT2440
ccaacgcauccaggcguucau

SEQ ID NO: 1592785 - RNA, 14 nt, Pseudomonas putida KT2440
ccaaccugccaugc

SEQ ID NO: 1592786 - RNA, 21 nt, Pseudomonas putida KT2440
caugccguaagccgcaggcca

SEQ ID NO: 1592787 - RNA, 15 nt, Pseudomonas putida KT2440
ccaaaggaggcuguu

SEQ ID NO: 1592788 - RNA, 21 nt, Pseudomonas putida KT2440
ccaaagguuucggcauagcgc

SEQ ID NO: 1592789 - RNA, 18 nt, Pseudomonas putida KT2440
ccaaccagccagccacca

SEQ ID NO: 1592790 - RNA, 18 nt, Pseudomonas putida KT2440
ccaaccacgccugcgccg

SEQ ID NO: 1592791 - RNA, 16 nt, Pseudomonas putida KT2440
ccaacaguugaccaag

SEQ ID NO: 1592792 - RNA, 12 nt, Pseudomonas putida KT2440
ccaacagaggcc

SEQ ID NO: 1592793 - RNA, 17 nt, Pseudomonas putida KT2440
ccaaucgagauguaguc

SEQ ID NO: 1592794 - RNA, 18 nt, Pseudomonas putida KT2440
ccaaucuccagcccgaaa

SEQ ID NO: 1592795 - RNA, 17 nt, Pseudomonas putida KT2440
ccaaucugguuacccaa

SEQ ID NO: 1592796 - RNA, 14 nt, Pseudomonas putida KT2440
ccaagguugccacc

SEQ ID NO: 1592797 - RNA, 18 nt, Pseudomonas putida KT2440
ccaaggugcacaccuugg

SEQ ID NO: 1592798 - RNA, 22 nt, Pseudomonas putida KT2440
ccaaggguuugccaggcgcagu

SEQ ID NO: 1592799 - RNA, 16 nt, Pseudomonas putida KT2440
ccaaggucagcaagcc

SEQ ID NO: 1592800 - RNA, 18 nt, Pseudomonas putida KT2440
ccaaggucagcaagccgc

SEQ ID NO: 1592801 - RNA, 15 nt, Pseudomonas putida KT2440
ccaaggccgcccagu

SEQ ID NO: 1592802 - RNA, 24 nt, Pseudomonas putida KT2440
ccaagccaccgccaccaucggcca

SEQ ID NO: 1592803 - RNA, 18 nt, Pseudomonas putida KT2440
ccaagccacuggccagca

SEQ ID NO: 1592804 - RNA, 22 nt, Pseudomonas putida KT2440
ccacaaacucuccuugcguugc

SEQ ID NO: 1592805 - RNA, 16 nt, Pseudomonas putida KT2440
ccacaauaagaugcgg

SEQ ID NO: 1592806 - RNA, 16 nt, Pseudomonas putida KT2440
ccacaacccuugcagc

SEQ ID NO: 1592807 - RNA, 21 nt, Pseudomonas putida KT2440
ccacaacccuugcagcgccug

SEQ ID NO: 1592808 - RNA, 16 nt, Pseudomonas putida KT2440
ccaaugccgugauggu

SEQ ID NO: 1592809 - RNA, 13 nt, Pseudomonas putida KT2440
ccaaugcacgccu

SEQ ID NO: 1592810 - RNA, 14 nt, Pseudomonas putida KT2440
aaagcgcucgaagu

SEQ ID NO: 1592811 - RNA, 21 nt, Pseudomonas putida KT2440
aaagcggccccuucgauucag

SEQ ID NO: 1592812 - RNA, 18 nt, Pseudomonas putida KT2440
ccaaugaucgagcgcacc

SEQ ID NO: 1592813 - RNA, 17 nt, Pseudomonas putida KT2440
cgauguuggucaccacg

SEQ ID NO: 1592814 - RNA, 15 nt, Pseudomonas putida KT2440
cgauuacaagggccu

SEQ ID NO: 1592815 - RNA, 18 nt, Pseudomonas putida KT2440
cgauuagcuccaccagcg

SEQ ID NO: 1592816 - RNA, 19 nt, Pseudomonas putida KT2440
cgauuagcuccaccagcgg

SEQ ID NO: 1592817 - RNA, 18 nt, Pseudomonas putida KT2440
cgauuccuugcagcgccg

SEQ ID NO: 1592818 - RNA, 15 nt, Pseudomonas putida KT2440
cgauucugccagcuc

SEQ ID NO: 1592819 - RNA, 23 nt, Pseudomonas putida KT2440
cgcaaacccucggccacaucggc

SEQ ID NO: 1592820 - RNA, 14 nt, Pseudomonas putida KT2440
cgcaaaaaaccgca

SEQ ID NO: 1592821 - RNA, 19 nt, Pseudomonas putida KT2440
cgcaaaaaaccgcacccag

SEQ ID NO: 1592822 - RNA, 20 nt, Pseudomonas putida KT2440
cgcaaaaaaugugcgcauca

SEQ ID NO: 1592823 - RNA, 16 nt, Pseudomonas putida KT2440
cgcaaaaccaccagcc

SEQ ID NO: 1592824 - RNA, 19 nt, Pseudomonas putida KT2440
cgauugccugggcgagcca

SEQ ID NO: 1592825 - RNA, 23 nt, Pseudomonas putida KT2440
cgauugccugggcgagccacucg

SEQ ID NO: 1592826 - RNA, 18 nt, Pseudomonas putida KT2440
cgauugccagggugccag

SEQ ID NO: 1592827 - RNA, 19 nt, Pseudomonas putida KT2440
cgauugccagggugccaga

SEQ ID NO: 1592828 - RNA, 16 nt, Pseudomonas putida KT2440
cgaugggcuguuccag

SEQ ID NO: 1592829 - RNA, 19 nt, Pseudomonas putida KT2440
cgaugggcaggccauucac

SEQ ID NO: 1592830 - RNA, 15 nt, Pseudomonas putida KT2440
cgauggugaaggcca

SEQ ID NO: 1592831 - RNA, 20 nt, Pseudomonas putida KT2440
cgaugggugcaaaaccugcc

SEQ ID NO: 1592832 - RNA, 16 nt, Pseudomonas putida KT2440
cgauggucaaccggcc

SEQ ID NO: 1592833 - RNA, 20 nt, Pseudomonas putida KT2440
cgauggucaaccggccaccg

SEQ ID NO: 1592834 - RNA, 15 nt, Pseudomonas putida KT2440
cgauguacggcagaa

SEQ ID NO: 1592835 - RNA, 18 nt, Pseudomonas putida KT2440
cgauguacucgaacagcu

SEQ ID NO: 1592836 - RNA, 22 nt, Pseudomonas putida KT2440
cgauguacaccccgaccaaggc

SEQ ID NO: 1592837 - RNA, 15 nt, Pseudomonas putida KT2440
cgauguagaugccgu

SEQ ID NO: 1592838 - RNA, 23 nt, Pseudomonas putida KT2440
cgaugguguucugguugaacugc

SEQ ID NO: 1592839 - RNA, 14 nt, Pseudomonas putida KT2440
cgaugucgauccac

SEQ ID NO: 1592840 - RNA, 18 nt, Pseudomonas putida KT2440
cgauguccuugcuggcca

SEQ ID NO: 1592841 - RNA, 21 nt, Pseudomonas putida KT2440
cgauguccuugcuggccaccg

SEQ ID NO: 1592842 - RNA, 16 nt, Pseudomonas putida KT2440
cgauguccaggccgaa

SEQ ID NO: 1592843 - RNA, 19 nt, Pseudomonas putida KT2440
cgaugucuuccagaccaga

SEQ ID NO: 1592844 - RNA, 20 nt, Pseudomonas putida KT2440
cgaugugcgcaucggcgcga

SEQ ID NO: 1592845 - RNA, 14 nt, Pseudomonas putida KT2440
cgaugaucaucccg

SEQ ID NO: 1592846 - RNA, 21 nt, Pseudomonas putida KT2440
cgaugaucaucccggcgacgu

SEQ ID NO: 1592847 - RNA, 16 nt, Pseudomonas putida KT2440
cgaugaucaggccgcu

SEQ ID NO: 1592848 - RNA, 22 nt, Pseudomonas putida KT2440
cgaugacgaacucgucaccgcc

SEQ ID NO: 1592849 - RNA, 17 nt, Pseudomonas putida KT2440
cgaugcacguaccuggc

SEQ ID NO: 1592850 - RNA, 14 nt, Pseudomonas putida KT2440
cgaucuucgccggc

SEQ ID NO: 1592851 - RNA, 21 nt, Pseudomonas putida KT2440
cgaucuucgccggcaucgccu

SEQ ID NO: 1592852 - RNA, 17 nt, Pseudomonas putida KT2440
cgaugaaauucaccugc

SEQ ID NO: 1592853 - RNA, 18 nt, Pseudomonas putida KT2440
cgaugaaauucaccugcc

SEQ ID NO: 1592854 - RNA, 22 nt, Pseudomonas putida KT2440
cgaucuuguuggucaggccaug

SEQ ID NO: 1592855 - RNA, 21 nt, Pseudomonas putida KT2440
cgaugaagacgcucgacagca

SEQ ID NO: 1592856 - RNA, 18 nt, Pseudomonas putida KT2440
cgaucuggaucacugcca

SEQ ID NO: 1592857 - RNA, 20 nt, Pseudomonas putida KT2440
cgaucuggaucacugccagc

SEQ ID NO: 1592858 - RNA, 17 nt, Pseudomonas putida KT2440
cgaucaaaugaucgcca

SEQ ID NO: 1592859 - RNA, 17 nt, Pseudomonas putida KT2440
cgauggccuugaucagg

SEQ ID NO: 1592860 - RNA, 20 nt, Pseudomonas putida KT2440
cgcagcguaauagcugguga

SEQ ID NO: 1592861 - RNA, 17 nt, Pseudomonas putida KT2440
cgcagcuuccgccacca

SEQ ID NO: 1592862 - RNA, 19 nt, Pseudomonas putida KT2440
cgcagcuuccgccaccacg

SEQ ID NO: 1592863 - RNA, 20 nt, Pseudomonas putida KT2440
cgcagcuuccgccaccacga

SEQ ID NO: 1592864 - RNA, 16 nt, Pseudomonas putida KT2440
cgcaggcgacgagcca

SEQ ID NO: 1592865 - RNA, 14 nt, Pseudomonas putida KT2440
cgcaggcgcaggug

SEQ ID NO: 1592866 - RNA, 15 nt, Pseudomonas putida KT2440
cgcaggcgcaggugc

SEQ ID NO: 1592867 - RNA, 15 nt, Pseudomonas putida KT2440
cgcaggguagccccg

SEQ ID NO: 1592868 - RNA, 19 nt, Pseudomonas putida KT2440
cgcaggcucuccacgucca

SEQ ID NO: 1592869 - RNA, 19 nt, Pseudomonas putida KT2440
cgcaggcgguuggccaugu

SEQ ID NO: 1592870 - RNA, 22 nt, Pseudomonas putida KT2440
cgcaggcuaugccggucagcag

SEQ ID NO: 1592871 - RNA, 21 nt, Pseudomonas putida KT2440
cgcagcgcaaaaaacgccgca

SEQ ID NO: 1592872 - RNA, 14 nt, Pseudomonas putida KT2440
cgcagcgcagcgua

SEQ ID NO: 1592873 - RNA, 14 nt, Pseudomonas putida KT2440
cgcagcgcaugcuc

SEQ ID NO: 1592874 - RNA, 20 nt, Pseudomonas putida KT2440
cgcagccaaucggcgccagg

SEQ ID NO: 1592875 - RNA, 21 nt, Pseudomonas putida KT2440
cgcagacaaaacgcugcgacu

SEQ ID NO: 1592876 - RNA, 14 nt, Pseudomonas putida KT2440
cgcagaaggccccg

SEQ ID NO: 1592877 - RNA, 21 nt, Pseudomonas putida KT2440
cgcacuugaucuugcgcccca

SEQ ID NO: 1592878 - RNA, 16 nt, Pseudomonas putida KT2440
cgcacuuguuccagcc

SEQ ID NO: 1592879 - RNA, 22 nt, Pseudomonas putida KT2440
cgcacuuguuccagccgcgcca

SEQ ID NO: 1592880 - RNA, 17 nt, Pseudomonas putida KT2440
cgcacccgccuccggcg

SEQ ID NO: 1592881 - RNA, 14 nt, Pseudomonas putida KT2440
cgcacccaggugcg

SEQ ID NO: 1592882 - RNA, 21 nt, Pseudomonas putida KT2440
cgcaacaugaagccaugggca

SEQ ID NO: 1592883 - RNA, 22 nt, Pseudomonas putida KT2440
cgcaaccgggucggcgccaggc

SEQ ID NO: 1592884 - RNA, 13 nt, Pseudomonas putida KT2440
cgcaacgaucggc

SEQ ID NO: 1592885 - RNA, 16 nt, Pseudomonas putida KT2440
cgcaacgaucggcauc

SEQ ID NO: 1592886 - RNA, 15 nt, Pseudomonas putida KT2440
cgcaccaacuggucg

SEQ ID NO: 1592887 - RNA, 17 nt, Pseudomonas putida KT2440
cgcaccaacuggucggc

SEQ ID NO: 1592888 - RNA, 17 nt, Pseudomonas putida KT2440
cgcaccagguuggccgc

SEQ ID NO: 1592889 - RNA, 14 nt, Pseudomonas putida KT2440
cgcaccagguccac

SEQ ID NO: 1592890 - RNA, 20 nt, Pseudomonas putida KT2440
cgcaccacguccggccagca

SEQ ID NO: 1592891 - RNA, 12 nt, Pseudomonas putida KT2440
cgcaccgcggau

SEQ ID NO: 1592892 - RNA, 16 nt, Pseudomonas putida KT2440
cgcaccgcggaugcgc

SEQ ID NO: 1592893 - RNA, 18 nt, Pseudomonas putida KT2440
cgcaccgcggaugcgccu

SEQ ID NO: 1592894 - RNA, 15 nt, Pseudomonas putida KT2440
cgcaccgcugaccac

SEQ ID NO: 1592895 - RNA, 15 nt, Pseudomonas putida KT2440
cgcacgcgcucugca

SEQ ID NO: 1592896 - RNA, 16 nt, Pseudomonas putida KT2440
cgcacgcgccucuugc

SEQ ID NO: 1592897 - RNA, 16 nt, Pseudomonas putida KT2440
cgcacgcauguccuug

SEQ ID NO: 1592898 - RNA, 16 nt, Pseudomonas putida KT2440
cgcacgcugcccaggu

SEQ ID NO: 1592899 - RNA, 20 nt, Pseudomonas putida KT2440
cgcacgcugcccaggugcca

SEQ ID NO: 1592900 - RNA, 24 nt, Pseudomonas putida KT2440
cgcacuuccacacccagcgcggca

SEQ ID NO: 1592901 - RNA, 16 nt, Pseudomonas putida KT2440
cgcacuucguagcgcc

SEQ ID NO: 1592902 - RNA, 19 nt, Pseudomonas putida KT2440
cgcacgguuuuauaccggc

SEQ ID NO: 1592903 - RNA, 15 nt, Pseudomonas putida KT2440
cgcacguuuggagcg

SEQ ID NO: 1592904 - RNA, 15 nt, Pseudomonas putida KT2440
cgccacgccgccaga

SEQ ID NO: 1592905 - RNA, 19 nt, Pseudomonas putida KT2440
cgccacgcccauggcucca

SEQ ID NO: 1592906 - RNA, 23 nt, Pseudomonas putida KT2440
cgccacgcaccagggcuggcagc

SEQ ID NO: 1592907 - RNA, 15 nt, Pseudomonas putida KT2440
cgccacggcggcauc

SEQ ID NO: 1592908 - RNA, 14 nt, Pseudomonas putida KT2440
cgccacgccugcag

SEQ ID NO: 1592909 - RNA, 15 nt, Pseudomonas putida KT2440
cgccaccaugcucgg

SEQ ID NO: 1592910 - RNA, 17 nt, Pseudomonas putida KT2440
cgccaccaguuccaccg

SEQ ID NO: 1592911 - RNA, 18 nt, Pseudomonas putida KT2440
cgccaccggucgccugua

SEQ ID NO: 1592912 - RNA, 15 nt, Pseudomonas putida KT2440
cgccacccaggcaua

SEQ ID NO: 1592913 - RNA, 14 nt, Pseudomonas putida KT2440
cgccaccggcagca

SEQ ID NO: 1592914 - RNA, 18 nt, Pseudomonas putida KT2440
cgccacccccgccgccag

SEQ ID NO: 1592915 - RNA, 15 nt, Pseudomonas putida KT2440
cgcauuggccggguc

SEQ ID NO: 1592916 - RNA, 21 nt, Pseudomonas putida KT2440
cgcauuguaucggaaagccga

SEQ ID NO: 1592917 - RNA, 17 nt, Pseudomonas putida KT2440
cgcauugaucaugccca

SEQ ID NO: 1592918 - RNA, 17 nt, Pseudomonas putida KT2440
cgccaaaaccuguucca

SEQ ID NO: 1592919 - RNA, 15 nt, Pseudomonas putida KT2440
cgcauuucacgcacg

SEQ ID NO: 1592920 - RNA, 13 nt, Pseudomonas putida KT2440
cgccaaaaggccc

SEQ ID NO: 1592921 - RNA, 13 nt, Pseudomonas putida KT2440
cgcaggguggcgc

SEQ ID NO: 1592922 - RNA, 17 nt, Pseudomonas putida KT2440
cgcagggugugcugcug

SEQ ID NO: 1592923 - RNA, 16 nt, Pseudomonas putida KT2440
cgcagguagucgaagu

SEQ ID NO: 1592924 - RNA, 16 nt, Pseudomonas putida KT2440
cgcagguccaggcgca

SEQ ID NO: 1592925 - RNA, 17 nt, Pseudomonas putida KT2440
cgcauucgcgcccgcag

SEQ ID NO: 1592926 - RNA, 20 nt, Pseudomonas putida KT2440
cgcauucgcgggugaacccg

SEQ ID NO: 1592927 - RNA, 17 nt, Pseudomonas putida KT2440
cgcauucuuggccagga

SEQ ID NO: 1592928 - RNA, 14 nt, Pseudomonas putida KT2440
cgccaacuucgccg

SEQ ID NO: 1592929 - RNA, 13 nt, Pseudomonas putida KT2440
cgccaaagccugg

SEQ ID NO: 1592930 - RNA, 16 nt, Pseudomonas putida KT2440
cgccaaauucgaccag

SEQ ID NO: 1592931 - RNA, 18 nt, Pseudomonas putida KT2440
cgccaaauucgaccagca

SEQ ID NO: 1592932 - RNA, 12 nt, Pseudomonas putida KT2440
cgccaaggcacg

SEQ ID NO: 1592933 - RNA, 17 nt, Pseudomonas putida KT2440
cgccaaggccucgaaca

SEQ ID NO: 1592934 - RNA, 15 nt, Pseudomonas putida KT2440
cgccaagguccagcc

SEQ ID NO: 1592935 - RNA, 13 nt, Pseudomonas putida KT2440
cgccaccaccgcu

SEQ ID NO: 1592936 - RNA, 15 nt, Pseudomonas putida KT2440
cgccaauugcgccag

SEQ ID NO: 1592937 - RNA, 12 nt, Pseudomonas putida KT2440
cgccaaucucgu

SEQ ID NO: 1592938 - RNA, 20 nt, Pseudomonas putida KT2440
cgccaaucucguugcgccag

SEQ ID NO: 1592939 - RNA, 19 nt, Pseudomonas putida KT2440
cgccaaucagguuguucac

SEQ ID NO: 1592940 - RNA, 15 nt, Pseudomonas putida KT2440
cgccaaucaucgcca

SEQ ID NO: 1592941 - RNA, 18 nt, Pseudomonas putida KT2440
cgccaaucaucgccagca

SEQ ID NO: 1592942 - RNA, 18 nt, Pseudomonas putida KT2440
cgccaauaccgcgcauca

SEQ ID NO: 1592943 - RNA, 17 nt, Pseudomonas putida KT2440
cgccagccguugcgccg

SEQ ID NO: 1592944 - RNA, 13 nt, Pseudomonas putida KT2440
cgccagcgccacc

SEQ ID NO: 1592945 - RNA, 14 nt, Pseudomonas putida KT2440
cgccagcgaugcug

SEQ ID NO: 1592946 - RNA, 20 nt, Pseudomonas putida KT2440
cgccagccgcucagccaccu

SEQ ID NO: 1592947 - RNA, 18 nt, Pseudomonas putida KT2440
cgccagccccagcccggu

SEQ ID NO: 1592948 - RNA, 19 nt, Pseudomonas putida KT2440
cgccagcagcgcgugcugg

SEQ ID NO: 1592949 - RNA, 16 nt, Pseudomonas putida KT2440
cgccagcaguuucagc

SEQ ID NO: 1592950 - RNA, 19 nt, Pseudomonas putida KT2440
cgccagcaguuucagcggc

SEQ ID NO: 1592951 - RNA, 20 nt, Pseudomonas putida KT2440
cgccagcaguuucagcggcc

SEQ ID NO: 1592952 - RNA, 20 nt, Pseudomonas putida KT2440
cgccagcaggccaccggcag

SEQ ID NO: 1592953 - RNA, 14 nt, Pseudomonas putida KT2440
cgccagcagcuggu

SEQ ID NO: 1592954 - RNA, 16 nt, Pseudomonas putida KT2440
cgccagcagcuggucg

SEQ ID NO: 1592955 - RNA, 16 nt, Pseudomonas putida KT2440
cgccagcauggaccau

SEQ ID NO: 1592956 - RNA, 22 nt, Pseudomonas putida KT2440
cgccagccaaccgcgugcuuca

SEQ ID NO: 1592957 - RNA, 16 nt, Pseudomonas putida KT2440
cgccagagcauggcca

SEQ ID NO: 1592958 - RNA, 18 nt, Pseudomonas putida KT2440
cgccagagcauggccagc

SEQ ID NO: 1592959 - RNA, 17 nt, Pseudomonas putida KT2440
cgccagacaacuggcca

SEQ ID NO: 1592960 - RNA, 21 nt, Pseudomonas putida KT2440
cgccagacaacuggccagggu

SEQ ID NO: 1592961 - RNA, 18 nt, Pseudomonas putida KT2440
cgccagcaauugcgaggu

SEQ ID NO: 1592962 - RNA, 19 nt, Pseudomonas putida KT2440
cgccacucccauguagacc

SEQ ID NO: 1592963 - RNA, 22 nt, Pseudomonas putida KT2440
cgccacuggcgacuucggcgau

SEQ ID NO: 1592964 - RNA, 21 nt, Pseudomonas putida KT2440
cgccagaagcguaccgccagu

SEQ ID NO: 1592965 - RNA, 21 nt, Pseudomonas putida KT2440
cgccacuaccguauucgcggg

SEQ ID NO: 1592966 - RNA, 16 nt, Pseudomonas putida KT2440
cgccacggccaccuug

SEQ ID NO: 1592967 - RNA, 16 nt, Pseudomonas putida KT2440
cgccacgggcgugacc

SEQ ID NO: 1592968 - RNA, 16 nt, Pseudomonas putida KT2440
cgccacggugccgaac

SEQ ID NO: 1592969 - RNA, 23 nt, Pseudomonas putida KT2440
cgccagugggugcuguggcgcac

SEQ ID NO: 1592970 - RNA, 18 nt, Pseudomonas putida KT2440
cgccaguuccacgaccgu

SEQ ID NO: 1592971 - RNA, 20 nt, Pseudomonas putida KT2440
cgccaguuccacgaccguga

SEQ ID NO: 1592972 - RNA, 14 nt, Pseudomonas putida KT2440
cgccaguucgacgc

SEQ ID NO: 1592973 - RNA, 17 nt, Pseudomonas putida KT2440
cgccaguucgacgcugc

SEQ ID NO: 1592974 - RNA, 19 nt, Pseudomonas putida KT2440
cgccaguucgacgcugcug

SEQ ID NO: 1592975 - RNA, 15 nt, Pseudomonas putida KT2440
cgccagguggaagcg

SEQ ID NO: 1592976 - RNA, 21 nt, Pseudomonas putida KT2440
cgccagguggaagcgcgcauc

SEQ ID NO: 1592977 - RNA, 17 nt, Pseudomonas putida KT2440
cgccaggugcucagcca

SEQ ID NO: 1592978 - RNA, 20 nt, Pseudomonas putida KT2440
cgccaguacgccagcagcgc

SEQ ID NO: 1592979 - RNA, 15 nt, Pseudomonas putida KT2440
cgccaggcugcgcuc

SEQ ID NO: 1592980 - RNA, 13 nt, Pseudomonas putida KT2440
cgccaggcguugu

SEQ ID NO: 1592981 - RNA, 18 nt, Pseudomonas putida KT2440
cgccaggcgcaagccuuc

SEQ ID NO: 1592982 - RNA, 12 nt, Pseudomonas putida KT2440
cgccaggcgcag

SEQ ID NO: 1592983 - RNA, 23 nt, Pseudomonas putida KT2440
cgccaggccuucaucggccuccu

SEQ ID NO: 1592984 - RNA, 22 nt, Pseudomonas putida KT2440
cgccaggguugcaucgcgcacu

SEQ ID NO: 1592985 - RNA, 20 nt, Pseudomonas putida KT2440
cgccaggguuugcaagcggc

SEQ ID NO: 1592986 - RNA, 22 nt, Pseudomonas putida KT2440
cgccaggguuugcaagcggcga

SEQ ID NO: 1592987 - RNA, 23 nt, Pseudomonas putida KT2440
cgccaggguuugcaagcggcgau

SEQ ID NO: 1592988 - RNA, 16 nt, Pseudomonas putida KT2440
cgccagguacaguucc

SEQ ID NO: 1592989 - RNA, 13 nt, Pseudomonas putida KT2440
cgccagggcaucg

SEQ ID NO: 1592990 - RNA, 19 nt, Pseudomonas putida KT2440
cgccagggcaaaaugcagc

SEQ ID NO: 1592991 - RNA, 21 nt, Pseudomonas putida KT2440
cgccagggcaaucgccaaggu

SEQ ID NO: 1592992 - RNA, 19 nt, Pseudomonas putida KT2440
cgccagcggccagcgccug

SEQ ID NO: 1592993 - RNA, 23 nt, Pseudomonas putida KT2440
cgccagcggcaguugcaggcgca

SEQ ID NO: 1592994 - RNA, 23 nt, Pseudomonas putida KT2440
cgccagcggcaaacacacccucg

SEQ ID NO: 1592995 - RNA, 13 nt, Pseudomonas putida KT2440
cgccagcggcaag

SEQ ID NO: 1592996 - RNA, 14 nt, Pseudomonas putida KT2440
cgccagcuccacca

SEQ ID NO: 1592997 - RNA, 19 nt, Pseudomonas putida KT2440
cgccaggaguucugcacag

SEQ ID NO: 1592998 - RNA, 15 nt, Pseudomonas putida KT2440
cgccaggaucaacug

SEQ ID NO: 1592999 - RNA, 22 nt, Pseudomonas putida KT2440
cgccaggaucgagaccuugccu

SEQ ID NO: 1593000 - RNA, 21 nt, Pseudomonas putida KT2440
cgccaggaucggcacgaagcc

SEQ ID NO: 1593001 - RNA, 22 nt, Pseudomonas putida KT2440
cgccaggaagucgauguucagc

SEQ ID NO: 1593002 - RNA, 16 nt, Pseudomonas putida KT2440
cgccaggcagcagacu

SEQ ID NO: 1593003 - RNA, 22 nt, Pseudomonas putida KT2440
cgccaugagugcaggcauauca

SEQ ID NO: 1593004 - RNA, 18 nt, Pseudomonas putida KT2440
cgccaucgcgcaggucga

SEQ ID NO: 1593005 - RNA, 14 nt, Pseudomonas putida KT2440
cgccaucgcccacg

SEQ ID NO: 1593006 - RNA, 14 nt, Pseudomonas putida KT2440
cgccauccgccaca

SEQ ID NO: 1593007 - RNA, 22 nt, Pseudomonas putida KT2440
cgccauacaagaucaagccccu

SEQ ID NO: 1593008 - RNA, 15 nt, Pseudomonas putida KT2440
cgccaguuucaccug

SEQ ID NO: 1593009 - RNA, 18 nt, Pseudomonas putida KT2440
cgccaguuucaccugacc

SEQ ID NO: 1593010 - RNA, 20 nt, Pseudomonas putida KT2440
cgccaguuucaccugaccau

SEQ ID NO: 1593011 - RNA, 17 nt, Pseudomonas putida KT2440
cgccaguuugcacuggc

SEQ ID NO: 1593012 - RNA, 23 nt, Pseudomonas putida KT2440
cgccaguuguaguucccgcgcaa

SEQ ID NO: 1593013 - RNA, 17 nt, Pseudomonas putida KT2440
cgccaguugucgcuggg

SEQ ID NO: 1593014 - RNA, 18 nt, Pseudomonas putida KT2440
cgccauaucaggauugcc

SEQ ID NO: 1593015 - RNA, 14 nt, Pseudomonas putida KT2440
cgccauccaccugu

SEQ ID NO: 1593016 - RNA, 19 nt, Pseudomonas putida KT2440
cgccauccccccagcccuu

SEQ ID NO: 1593017 - RNA, 20 nt, Pseudomonas putida KT2440
cgccauggccucgucgcggu

SEQ ID NO: 1593018 - RNA, 12 nt, Pseudomonas putida KT2440
cgccauggccug

SEQ ID NO: 1593019 - RNA, 20 nt, Pseudomonas putida KT2440
cgccauggcgacaauggcgc

SEQ ID NO: 1593020 - RNA, 22 nt, Pseudomonas putida KT2440
cgccauugacuaccagguagcc

SEQ ID NO: 1593021 - RNA, 15 nt, Pseudomonas putida KT2440
cgccauugaugccga

SEQ ID NO: 1593022 - RNA, 11 nt, Pseudomonas putida KT2440
cgccauugccc

SEQ ID NO: 1593023 - RNA, 21 nt, Pseudomonas putida KT2440
cgccauucuucuccaggugcu

SEQ ID NO: 1593024 - RNA, 15 nt, Pseudomonas putida KT2440
cgccaugugcgcccg

SEQ ID NO: 1593025 - RNA, 22 nt, Pseudomonas putida KT2440
cgccauguguacgccgcuguca

SEQ ID NO: 1593026 - RNA, 17 nt, Pseudomonas putida KT2440
cgccaugguuuugggca

SEQ ID NO: 1593027 - RNA, 15 nt, Pseudomonas putida KT2440
cgcccaaucggguaa

SEQ ID NO: 1593028 - RNA, 19 nt, Pseudomonas putida KT2440
cgcccacgcggguccagcg

SEQ ID NO: 1593029 - RNA, 17 nt, Pseudomonas putida KT2440
cgcccacgccggcaacc

SEQ ID NO: 1593030 - RNA, 17 nt, Pseudomonas putida KT2440
cgcccaaggucagccag

SEQ ID NO: 1593031 - RNA, 18 nt, Pseudomonas putida KT2440
cgcccaauacgcaccgcu

SEQ ID NO: 1593032 - RNA, 14 nt, Pseudomonas putida KT2440
cgccauuguucgcc

SEQ ID NO: 1593033 - RNA, 16 nt, Pseudomonas putida KT2440
cgccauuguucgccuc

SEQ ID NO: 1593034 - RNA, 17 nt, Pseudomonas putida KT2440
cgaccagcaugcgaagc

SEQ ID NO: 1593035 - RNA, 22 nt, Pseudomonas putida KT2440
cgaccaggugguaacuggccag

SEQ ID NO: 1593036 - RNA, 21 nt, Pseudomonas putida KT2440
cgaccagggccuuggccuggg

SEQ ID NO: 1593037 - RNA, 15 nt, Pseudomonas putida KT2440
cgaccaguucgacgc

SEQ ID NO: 1593038 - RNA, 14 nt, Pseudomonas putida KT2440
cgaccaucaccagu

SEQ ID NO: 1593039 - RNA, 17 nt, Pseudomonas putida KT2440
cgacccccuugccagca

SEQ ID NO: 1593040 - RNA, 14 nt, Pseudomonas putida KT2440
cgacccgcuggccg

SEQ ID NO: 1593041 - RNA, 17 nt, Pseudomonas putida KT2440
cgacccgcuggccggac

SEQ ID NO: 1593042 - RNA, 14 nt, Pseudomonas putida KT2440
cgacccgcuggcga

SEQ ID NO: 1593043 - RNA, 18 nt, Pseudomonas putida KT2440
cgacccgccuggugccag

SEQ ID NO: 1593044 - RNA, 22 nt, Pseudomonas putida KT2440
cgacccgccuggugccagcggc

SEQ ID NO: 1593045 - RNA, 16 nt, Pseudomonas putida KT2440
cgacccgcgccagggu

SEQ ID NO: 1593046 - RNA, 17 nt, Pseudomonas putida KT2440
cgaccggguaaucgcca

SEQ ID NO: 1593047 - RNA, 13 nt, Pseudomonas putida KT2440
cgaccgcgcgcac

SEQ ID NO: 1593048 - RNA, 20 nt, Pseudomonas putida KT2440
cgacccugugggagcgggcu

SEQ ID NO: 1593049 - RNA, 22 nt, Pseudomonas putida KT2440
cgaccgauaaagagaagcugca

SEQ ID NO: 1593050 - RNA, 14 nt, Pseudomonas putida KT2440
cgaccgcaccggcc

SEQ ID NO: 1593051 - RNA, 18 nt, Pseudomonas putida KT2440
cgaccgcaccggccaccg

SEQ ID NO: 1593052 - RNA, 12 nt, Pseudomonas putida KT2440
cgaccugccagu

SEQ ID NO: 1593053 - RNA, 15 nt, Pseudomonas putida KT2440
cgaccugccagucgc

SEQ ID NO: 1593054 - RNA, 18 nt, Pseudomonas putida KT2440
cgaccugcaacgucgcca

SEQ ID NO: 1593055 - RNA, 12 nt, Pseudomonas putida KT2440
cgaccugcacaa

SEQ ID NO: 1593056 - RNA, 16 nt, Pseudomonas putida KT2440
cgaccugcaggcccug

SEQ ID NO: 1593057 - RNA, 20 nt, Pseudomonas putida KT2440
cgaccucuucgcggguaaac

SEQ ID NO: 1593058 - RNA, 15 nt, Pseudomonas putida KT2440
cgacgaccugcacaa

SEQ ID NO: 1593059 - RNA, 13 nt, Pseudomonas putida KT2440
cgacgaccaguuc

SEQ ID NO: 1593060 - RNA, 18 nt, Pseudomonas putida KT2440
cgacgaaggccuuggcca

SEQ ID NO: 1593061 - RNA, 19 nt, Pseudomonas putida KT2440
cgacgaaggccuuggccac

SEQ ID NO: 1593062 - RNA, 12 nt, Pseudomonas putida KT2440
cgacgcagcagc

SEQ ID NO: 1593063 - RNA, 15 nt, Pseudomonas putida KT2440
cgacgcagagguggu

SEQ ID NO: 1593064 - RNA, 13 nt, Pseudomonas putida KT2440
cgacgcacuucac

SEQ ID NO: 1593065 - RNA, 14 nt, Pseudomonas putida KT2440
cgacgcgacccguc

SEQ ID NO: 1593066 - RNA, 17 nt, Pseudomonas putida KT2440
cgacgccccggccugca

SEQ ID NO: 1593067 - RNA, 15 nt, Pseudomonas putida KT2440
cgacgcaucagggca

SEQ ID NO: 1593068 - RNA, 21 nt, Pseudomonas putida KT2440
cgacgcaguuacucggcuacc

SEQ ID NO: 1593069 - RNA, 18 nt, Pseudomonas putida KT2440
cgaacuccccaccaggca

SEQ ID NO: 1593070 - RNA, 17 nt, Pseudomonas putida KT2440
cgaacucaugcuccugc

SEQ ID NO: 1593071 - RNA, 20 nt, Pseudomonas putida KT2440
ccuguaccgaccucuucgcg

SEQ ID NO: 1593072 - RNA, 20 nt, Pseudomonas putida KT2440
ccuguaccgcccucuucgcg

SEQ ID NO: 1593073 - RNA, 16 nt, Pseudomonas putida KT2440
ccuguaacucagcuua

SEQ ID NO: 1593074 - RNA, 21 nt, Pseudomonas putida KT2440
ccuguaggaauuucggcguug

SEQ ID NO: 1593075 - RNA, 23 nt, Pseudomonas putida KT2440
ccuguaggaucggguuuacccgc

SEQ ID NO: 1593076 - RNA, 17 nt, Pseudomonas putida KT2440
ccuguaggcgcggguuu

SEQ ID NO: 1593077 - RNA, 19 nt, Pseudomonas putida KT2440
ccuguaggcgcggguuuac

SEQ ID NO: 1593078 - RNA, 18 nt, Pseudomonas putida KT2440
ccuguaggcgcggguuug

SEQ ID NO: 1593079 - RNA, 18 nt, Pseudomonas putida KT2440
ccugguuuuccaccggca

SEQ ID NO: 1593080 - RNA, 15 nt, Pseudomonas putida KT2440
ccugguuuucgcggu

SEQ ID NO: 1593081 - RNA, 18 nt, Pseudomonas putida KT2440
cgaacguuucgucaucca

SEQ ID NO: 1593082 - RNA, 20 nt, Pseudomonas putida KT2440
ccuguaucggccucuucgcg

SEQ ID NO: 1593083 - RNA, 20 nt, Pseudomonas putida KT2440
ccuguaggugcggcuuuagc

SEQ ID NO: 1593084 - RNA, 19 nt, Pseudomonas putida KT2440
cgaagcaggcugcgcuuug

SEQ ID NO: 1593085 - RNA, 16 nt, Pseudomonas putida KT2440
cgaagcagugcugcca

SEQ ID NO: 1593086 - RNA, 22 nt, Pseudomonas putida KT2440
cgaagccaagcgccgucgaacg

SEQ ID NO: 1593087 - RNA, 14 nt, Pseudomonas putida KT2440
cgaagcagccacca

SEQ ID NO: 1593088 - RNA, 14 nt, Pseudomonas putida KT2440
cgaagaggccggca

SEQ ID NO: 1593089 - RNA, 23 nt, Pseudomonas putida KT2440
cgaagaggccggcacagacaccg

SEQ ID NO: 1593090 - RNA, 16 nt, Pseudomonas putida KT2440
cgaagaggccagcaca

SEQ ID NO: 1593091 - RNA, 14 nt, Pseudomonas putida KT2440
cgaagaggcccgaa

SEQ ID NO: 1593092 - RNA, 15 nt, Pseudomonas putida KT2440
cgaagaucagcaccg

SEQ ID NO: 1593093 - RNA, 12 nt, Pseudomonas putida KT2440
cgaagggccgca

SEQ ID NO: 1593094 - RNA, 16 nt, Pseudomonas putida KT2440
cgaagggccgcaacgc

SEQ ID NO: 1593095 - RNA, 22 nt, Pseudomonas putida KT2440
cgaaggggaucagcacgcgauc

SEQ ID NO: 1593096 - RNA, 17 nt, Pseudomonas putida KT2440
cgaaggcgauaccgcca

SEQ ID NO: 1593097 - RNA, 15 nt, Pseudomonas putida KT2440
cgaaggcgcuggcga

SEQ ID NO: 1593098 - RNA, 16 nt, Pseudomonas putida KT2440
cgaauggguggcggca

SEQ ID NO: 1593099 - RNA, 20 nt, Pseudomonas putida KT2440
cgaagucagguaggugcuga

SEQ ID NO: 1593100 - RNA, 17 nt, Pseudomonas putida KT2440
cgaagucgaacaccagu

SEQ ID NO: 1593101 - RNA, 17 nt, Pseudomonas putida KT2440
cgacagacagggccuug

SEQ ID NO: 1593102 - RNA, 16 nt, Pseudomonas putida KT2440
cgacagccaccgcgag

SEQ ID NO: 1593103 - RNA, 15 nt, Pseudomonas putida KT2440
cgacagccaccugcc

SEQ ID NO: 1593104 - RNA, 15 nt, Pseudomonas putida KT2440
cgacaggucggcgau

SEQ ID NO: 1593105 - RNA, 16 nt, Pseudomonas putida KT2440
cgacaggucggcgaug

SEQ ID NO: 1593106 - RNA, 20 nt, Pseudomonas putida KT2440
cgacaggucggcgaugguca

SEQ ID NO: 1593107 - RNA, 20 nt, Pseudomonas putida KT2440
cgacaggugccccuugagca

SEQ ID NO: 1593108 - RNA, 14 nt, Pseudomonas putida KT2440
cgacagguccaccg

SEQ ID NO: 1593109 - RNA, 22 nt, Pseudomonas putida KT2440
cgacaggcuugaagcugcgcuc

SEQ ID NO: 1593110 - RNA, 19 nt, Pseudomonas putida KT2440
cgacaggggcacggguacc

SEQ ID NO: 1593111 - RNA, 19 nt, Pseudomonas putida KT2440
cgacagcguugcuccagcu

SEQ ID NO: 1593112 - RNA, 20 nt, Pseudomonas putida KT2440
cgacagccucaaggccggca

SEQ ID NO: 1593113 - RNA, 15 nt, Pseudomonas putida KT2440
cgacaccagcgcacc

SEQ ID NO: 1593114 - RNA, 17 nt, Pseudomonas putida KT2440
cgacacagucgucggca

SEQ ID NO: 1593115 - RNA, 24 nt, Pseudomonas putida KT2440
cgacacauaaccccccacccagcu

SEQ ID NO: 1593116 - RNA, 13 nt, Pseudomonas putida KT2440
cgacaaucgccag

SEQ ID NO: 1593117 - RNA, 21 nt, Pseudomonas putida KT2440
cgacaauacgguaagccgccg

SEQ ID NO: 1593118 - RNA, 22 nt, Pseudomonas putida KT2440
cgacaaccgaaaaggccaacca

SEQ ID NO: 1593119 - RNA, 12 nt, Pseudomonas putida KT2440
cgacaagccacg

SEQ ID NO: 1593120 - RNA, 22 nt, Pseudomonas putida KT2440
cgacaagccacgcaccucggcc

SEQ ID NO: 1593121 - RNA, 22 nt, Pseudomonas putida KT2440
cgacaagggcuacgaaaccguc

SEQ ID NO: 1593122 - RNA, 21 nt, Pseudomonas putida KT2440
cgacaagguagcggccagccc

SEQ ID NO: 1593123 - RNA, 19 nt, Pseudomonas putida KT2440
cgacacccuggucaugcag

SEQ ID NO: 1593124 - RNA, 18 nt, Pseudomonas putida KT2440
cgacaccggccuugcgca

SEQ ID NO: 1593125 - RNA, 18 nt, Pseudomonas putida KT2440
cgacacccagcacccgca

SEQ ID NO: 1593126 - RNA, 18 nt, Pseudomonas putida KT2440
aacaacuccgggugcucc

SEQ ID NO: 1593127 - RNA, 22 nt, Pseudomonas putida KT2440
aacaacgacuggucauacucca

SEQ ID NO: 1593128 - RNA, 17 nt, Pseudomonas putida KT2440
cgagguguacgcgaagg

SEQ ID NO: 1593129 - RNA, 16 nt, Pseudomonas putida KT2440
cgagguugcgcuccau

SEQ ID NO: 1593130 - RNA, 16 nt, Pseudomonas putida KT2440
cgaguccugccuucca

SEQ ID NO: 1593131 - RNA, 21 nt, Pseudomonas putida KT2440
cgaggcauccacacccugcga

SEQ ID NO: 1593132 - RNA, 20 nt, Pseudomonas putida KT2440
cgaggcaaucagcgguucga

SEQ ID NO: 1593133 - RNA, 15 nt, Pseudomonas putida KT2440
cgaggucagguagcu

SEQ ID NO: 1593134 - RNA, 18 nt, Pseudomonas putida KT2440
cgagguaggccgucagca

SEQ ID NO: 1593135 - RNA, 20 nt, Pseudomonas putida KT2440
cgaggguuccaggccacggu

SEQ ID NO: 1593136 - RNA, 18 nt, Pseudomonas putida KT2440
cgauaucagguugacgca

SEQ ID NO: 1593137 - RNA, 18 nt, Pseudomonas putida KT2440
cgauacccaggcgcgccu

SEQ ID NO: 1593138 - RNA, 21 nt, Pseudomonas putida KT2440
cgauacccaggcgcgccugca

SEQ ID NO: 1593139 - RNA, 17 nt, Pseudomonas putida KT2440
cgauacccagccagcca

SEQ ID NO: 1593140 - RNA, 18 nt, Pseudomonas putida KT2440
cgauaccuggguccaggc

SEQ ID NO: 1593141 - RNA, 15 nt, Pseudomonas putida KT2440
cgaguuuggccagcc

SEQ ID NO: 1593142 - RNA, 20 nt, Pseudomonas putida KT2440
cgaguuuaccuccaucacca

SEQ ID NO: 1593143 - RNA, 22 nt, Pseudomonas putida KT2440
cgauaaaccagcagcgccugca

SEQ ID NO: 1593144 - RNA, 20 nt, Pseudomonas putida KT2440
cgaguugaacuuggcgauga

SEQ ID NO: 1593145 - RNA, 15 nt, Pseudomonas putida KT2440
cgaguugccgguggu

SEQ ID NO: 1593146 - RNA, 20 nt, Pseudomonas putida KT2440
cgaguucaggcgcccugcgc

SEQ ID NO: 1593147 - RNA, 17 nt, Pseudomonas putida KT2440
cgagcgccugauuaccc

SEQ ID NO: 1593148 - RNA, 20 nt, Pseudomonas putida KT2440
cgagccucuguuugcugguc

SEQ ID NO: 1593149 - RNA, 22 nt, Pseudomonas putida KT2440
cgagccucuguuugcuggucag

SEQ ID NO: 1593150 - RNA, 13 nt, Pseudomonas putida KT2440
cgagccuuccggg

SEQ ID NO: 1593151 - RNA, 17 nt, Pseudomonas putida KT2440
cgagccugggucacggc

SEQ ID NO: 1593152 - RNA, 16 nt, Pseudomonas putida KT2440
cgagcgagugaccuug

SEQ ID NO: 1593153 - RNA, 15 nt, Pseudomonas putida KT2440
cgagccuuggccagc

SEQ ID NO: 1593154 - RNA, 17 nt, Pseudomonas putida KT2440
cgagccuuggccagcgu

SEQ ID NO: 1593155 - RNA, 17 nt, Pseudomonas putida KT2440
cgagccgcauuggccgg

SEQ ID NO: 1593156 - RNA, 14 nt, Pseudomonas putida KT2440
cgagccgcugccaa

SEQ ID NO: 1593157 - RNA, 17 nt, Pseudomonas putida KT2440
cgagccgcugccaaagu

SEQ ID NO: 1593158 - RNA, 16 nt, Pseudomonas putida KT2440
cgagccggguccaccc

SEQ ID NO: 1593159 - RNA, 24 nt, Pseudomonas putida KT2440
cgaggaaguacgccggcgcacgca

SEQ ID NO: 1593160 - RNA, 13 nt, Pseudomonas putida KT2440
cgaggaccugcgu

SEQ ID NO: 1593161 - RNA, 15 nt, Pseudomonas putida KT2440
cgagcuggagaucuu

SEQ ID NO: 1593162 - RNA, 13 nt, Pseudomonas putida KT2440
cgagcucgaucgg

SEQ ID NO: 1593163 - RNA, 19 nt, Pseudomonas putida KT2440
cgagcuaccugacuugccu

SEQ ID NO: 1593164 - RNA, 18 nt, Pseudomonas putida KT2440
cgagcgcggcgcccagca

SEQ ID NO: 1593165 - RNA, 23 nt, Pseudomonas putida KT2440
cgagcgcgugcggggcaucgccg

SEQ ID NO: 1593166 - RNA, 20 nt, Pseudomonas putida KT2440
cgagcgcuuucagccguuca

SEQ ID NO: 1593167 - RNA, 13 nt, Pseudomonas putida KT2440
cgagcgcgggcag

SEQ ID NO: 1593168 - RNA, 12 nt, Pseudomonas putida KT2440
cgacgucggcgu

SEQ ID NO: 1593169 - RNA, 15 nt, Pseudomonas putida KT2440
cgacgcggugcucga

SEQ ID NO: 1593170 - RNA, 16 nt, Pseudomonas putida KT2440
cgacgcgggccaaggu

SEQ ID NO: 1593171 - RNA, 14 nt, Pseudomonas putida KT2440
aacaagcuggacau

SEQ ID NO: 1593172 - RNA, 23 nt, Pseudomonas putida KT2440
cgacgugcuuggcagugaugccg

SEQ ID NO: 1593173 - RNA, 20 nt, Pseudomonas putida KT2440
cgacgugguacgcguggucg

SEQ ID NO: 1593174 - RNA, 22 nt, Pseudomonas putida KT2440
cgacucaaggaugucggucaug

SEQ ID NO: 1593175 - RNA, 16 nt, Pseudomonas putida KT2440
cgacgucguugaaggc

SEQ ID NO: 1593176 - RNA, 18 nt, Pseudomonas putida KT2440
cgagaaacgccagcuguu

SEQ ID NO: 1593177 - RNA, 15 nt, Pseudomonas putida KT2440
cgacuucgaccacgg

SEQ ID NO: 1593178 - RNA, 18 nt, Pseudomonas putida KT2440
cgacuucgaccacggccg

SEQ ID NO: 1593179 - RNA, 13 nt, Pseudomonas putida KT2440
cgacucccgcugc

SEQ ID NO: 1593180 - RNA, 17 nt, Pseudomonas putida KT2440
cgagacgguggcugcca

SEQ ID NO: 1593181 - RNA, 22 nt, Pseudomonas putida KT2440
cgagagcggcuucuaccgcacu

SEQ ID NO: 1593182 - RNA, 17 nt, Pseudomonas putida KT2440
cgagaugaucgcggcaa

SEQ ID NO: 1593183 - RNA, 19 nt, Pseudomonas putida KT2440
cgagagugcuggggccgca

SEQ ID NO: 1593184 - RNA, 16 nt, Pseudomonas putida KT2440
cgagauuugucaacaa

SEQ ID NO: 1593185 - RNA, 17 nt, Pseudomonas putida KT2440
cgagauguaguccaccc

SEQ ID NO: 1593186 - RNA, 16 nt, Pseudomonas putida KT2440
cgagcaaggcgcagcc

SEQ ID NO: 1593187 - RNA, 15 nt, Pseudomonas putida KT2440
aacaccccccagcag

SEQ ID NO: 1593188 - RNA, 17 nt, Pseudomonas putida KT2440
cgagcagcggcaccuac

SEQ ID NO: 1593189 - RNA, 20 nt, Pseudomonas putida KT2440
cgagccauaugaaaaggccc

SEQ ID NO: 1593190 - RNA, 21 nt, Pseudomonas putida KT2440
cgagccauaugaaaaggcccu

SEQ ID NO: 1593191 - RNA, 13 nt, Pseudomonas putida KT2440
cgagcccgccagc

SEQ ID NO: 1593192 - RNA, 14 nt, Pseudomonas putida KT2440
cgagcccgccagca

SEQ ID NO: 1593193 - RNA, 20 nt, Pseudomonas putida KT2440
cgagcccgccagcaggccac

SEQ ID NO: 1593194 - RNA, 12 nt, Pseudomonas putida KT2440
cgagccgaucag

SEQ ID NO: 1593195 - RNA, 23 nt, Pseudomonas putida KT2440
cgagcccgcgcgcgaugcgccgc

SEQ ID NO: 1593196 - RNA, 21 nt, Pseudomonas putida KT2440
cgagcagguucaggcgcagca

SEQ ID NO: 1593197 - RNA, 18 nt, Pseudomonas putida KT2440
cgagcaucuuccagccug

SEQ ID NO: 1593198 - RNA, 23 nt, Pseudomonas putida KT2440
cgagcaucuuccagccugcagca

SEQ ID NO: 1593199 - RNA, 17 nt, Pseudomonas putida KT2440
cgagcaugccgaggaca

SEQ ID NO: 1593200 - RNA, 22 nt, Pseudomonas putida KT2440
cgagccaauuucaacgcucgcg

SEQ ID NO: 1593201 - RNA, 17 nt, Pseudomonas putida KT2440
ccggcucugccgguguu

SEQ ID NO: 1593202 - RNA, 15 nt, Pseudomonas putida KT2440
ccggcucaccgcagc

SEQ ID NO: 1593203 - RNA, 16 nt, Pseudomonas putida KT2440
ccggcucaccgcagcc

SEQ ID NO: 1593204 - RNA, 15 nt, Pseudomonas putida KT2440
ccggcuaucggacga

SEQ ID NO: 1593205 - RNA, 18 nt, Pseudomonas putida KT2440
ccggcuaucggccagcaa

SEQ ID NO: 1593206 - RNA, 19 nt, Pseudomonas putida KT2440
ccggcuaucucaggccagu

SEQ ID NO: 1593207 - RNA, 17 nt, Pseudomonas putida KT2440
ccggcuuugccgguguu

SEQ ID NO: 1593208 - RNA, 15 nt, Pseudomonas putida KT2440
ccgggaacagccgcg

SEQ ID NO: 1593209 - RNA, 16 nt, Pseudomonas putida KT2440
ccgggaaaucuuccgc

SEQ ID NO: 1593210 - RNA, 14 nt, Pseudomonas putida KT2440
ccggcuuguagccg

SEQ ID NO: 1593211 - RNA, 15 nt, Pseudomonas putida KT2440
ccggcuuguagccgg

SEQ ID NO: 1593212 - RNA, 18 nt, Pseudomonas putida KT2440
ccggcuuguagccggcag

SEQ ID NO: 1593213 - RNA, 22 nt, Pseudomonas putida KT2440
ccggcuugaccguuugcagcgu

SEQ ID NO: 1593214 - RNA, 23 nt, Pseudomonas putida KT2440
ccggcuugagacauucaccgccu

SEQ ID NO: 1593215 - RNA, 19 nt, Pseudomonas putida KT2440
ccggcuugcaccaacggcu

SEQ ID NO: 1593216 - RNA, 16 nt, Pseudomonas putida KT2440
ccggcuggauggcgcg

SEQ ID NO: 1593217 - RNA, 17 nt, Pseudomonas putida KT2440
ccggcuggauggcgcgg

SEQ ID NO: 1593218 - RNA, 22 nt, Pseudomonas putida KT2440
ccggcugcugguucucuucacu

SEQ ID NO: 1593219 - RNA, 21 nt, Pseudomonas putida KT2440
ccggcuggucgaaccaguacu

SEQ ID NO: 1593220 - RNA, 13 nt, Pseudomonas putida KT2440
ccgggccaugcuu

SEQ ID NO: 1593221 - RNA, 23 nt, Pseudomonas putida KT2440
ccgggcggccaccggccacgcgc

SEQ ID NO: 1593222 - RNA, 21 nt, Pseudomonas putida KT2440
ccgggcgcgguuuuuucaugc

SEQ ID NO: 1593223 - RNA, 18 nt, Pseudomonas putida KT2440
ccgggccaacuugcgcag

SEQ ID NO: 1593224 - RNA, 17 nt, Pseudomonas putida KT2440
ccgggcacuuggcauug

SEQ ID NO: 1593225 - RNA, 16 nt, Pseudomonas putida KT2440
ccgggcaugcaggucg

SEQ ID NO: 1593226 - RNA, 17 nt, Pseudomonas putida KT2440
ccgggcacgggccagcg

SEQ ID NO: 1593227 - RNA, 19 nt, Pseudomonas putida KT2440
ccgggaagcaggucucgac

SEQ ID NO: 1593228 - RNA, 21 nt, Pseudomonas putida KT2440
ccgggaagcgcccgcccacca

SEQ ID NO: 1593229 - RNA, 21 nt, Pseudomonas putida KT2440
ccgggacagcaccaugcgcgg

SEQ ID NO: 1593230 - RNA, 23 nt, Pseudomonas putida KT2440
ccgggacagcaccaugcgcgggu

SEQ ID NO: 1593231 - RNA, 16 nt, Pseudomonas putida KT2440
ccggggucaucaggac

SEQ ID NO: 1593232 - RNA, 21 nt, Pseudomonas putida KT2440
ccgggguagaccuucuggcag

SEQ ID NO: 1593233 - RNA, 15 nt, Pseudomonas putida KT2440
ccgggucaggccgau

SEQ ID NO: 1593234 - RNA, 17 nt, Pseudomonas putida KT2440
ccggguccagcaaccgg

SEQ ID NO: 1593235 - RNA, 16 nt, Pseudomonas putida KT2440
ccggguccacccggua

SEQ ID NO: 1593236 - RNA, 13 nt, Pseudomonas putida KT2440
ccgggucggccug

SEQ ID NO: 1593237 - RNA, 17 nt, Pseudomonas putida KT2440
ccggguuccaccagggg

SEQ ID NO: 1593238 - RNA, 23 nt, Pseudomonas putida KT2440
ccggguuacccaucugcucgcca

SEQ ID NO: 1593239 - RNA, 19 nt, Pseudomonas putida KT2440
ccggguuuuuugugccugu

SEQ ID NO: 1593240 - RNA, 19 nt, Pseudomonas putida KT2440
ccgguaaaaccgcucgaac

SEQ ID NO: 1593241 - RNA, 18 nt, Pseudomonas putida KT2440
ccgguaacgggccagccg

SEQ ID NO: 1593242 - RNA, 16 nt, Pseudomonas putida KT2440
ccgguacagccagcaa

SEQ ID NO: 1593243 - RNA, 21 nt, Pseudomonas putida KT2440
ccgguacagccuaccaacgca

SEQ ID NO: 1593244 - RNA, 22 nt, Pseudomonas putida KT2440
ccgguaccggcguuucuucgag

SEQ ID NO: 1593245 - RNA, 22 nt, Pseudomonas putida KT2440
ccgguaccgccaccaaucuggu

SEQ ID NO: 1593246 - RNA, 15 nt, Pseudomonas putida KT2440
ccgguaacuggccca

SEQ ID NO: 1593247 - RNA, 23 nt, Pseudomonas putida KT2440
ccggucacccccaucagcgggcg

SEQ ID NO: 1593248 - RNA, 14 nt, Pseudomonas putida KT2440
ccggucaccgacca

SEQ ID NO: 1593249 - RNA, 13 nt, Pseudomonas putida KT2440
ccgguauagcgac

SEQ ID NO: 1593250 - RNA, 15 nt, Pseudomonas putida KT2440
ccgguauagcgacag

SEQ ID NO: 1593251 - RNA, 16 nt, Pseudomonas putida KT2440
ccgguaggugcucaag

SEQ ID NO: 1593252 - RNA, 13 nt, Pseudomonas putida KT2440
ccggucagcagga

SEQ ID NO: 1593253 - RNA, 16 nt, Pseudomonas putida KT2440
ccggucagcauggcca

SEQ ID NO: 1593254 - RNA, 18 nt, Pseudomonas putida KT2440
ccgugcugucggugaagc

SEQ ID NO: 1593255 - RNA, 14 nt, Pseudomonas putida KT2440
ccgugcuuucaagc

SEQ ID NO: 1593256 - RNA, 13 nt, Pseudomonas putida KT2440
ccguggcaacgcc

SEQ ID NO: 1593257 - RNA, 17 nt, Pseudomonas putida KT2440
ccgugcgccuaucaggc

SEQ ID NO: 1593258 - RNA, 17 nt, Pseudomonas putida KT2440
ccgugcggccaaagcug

SEQ ID NO: 1593259 - RNA, 15 nt, Pseudomonas putida KT2440
ccgugagggcgccga

SEQ ID NO: 1593260 - RNA, 23 nt, Pseudomonas putida KT2440
ccgucuuccucgacccagccacc

SEQ ID NO: 1593261 - RNA, 14 nt, Pseudomonas putida KT2440
ccgugcaccagcac

SEQ ID NO: 1593262 - RNA, 19 nt, Pseudomonas putida KT2440
ccguccggcaugcgccgau

SEQ ID NO: 1593263 - RNA, 19 nt, Pseudomonas putida KT2440
ccguccggcuugcugugag

SEQ ID NO: 1593264 - RNA, 15 nt, Pseudomonas putida KT2440
ccgucgcgcccaccg

SEQ ID NO: 1593265 - RNA, 13 nt, Pseudomonas putida KT2440
ccgucgguaaaca

SEQ ID NO: 1593266 - RNA, 21 nt, Pseudomonas putida KT2440
ccgucguguaggagcggguuc

SEQ ID NO: 1593267 - RNA, 21 nt, Pseudomonas putida KT2440
ccgguguaggagcggguuuac

SEQ ID NO: 1593268 - RNA, 14 nt, Pseudomonas putida KT2440
ccgguguucgcggg

SEQ ID NO: 1593269 - RNA, 17 nt, Pseudomonas putida KT2440
ccgguguucgcgggcau

SEQ ID NO: 1593270 - RNA, 18 nt, Pseudomonas putida KT2440
ccgguguucgcgggcaug

SEQ ID NO: 1593271 - RNA, 17 nt, Pseudomonas putida KT2440
ccggugcgcgggcgucg

SEQ ID NO: 1593272 - RNA, 15 nt, Pseudomonas putida KT2440
ccggugccgcgccau

SEQ ID NO: 1593273 - RNA, 15 nt, Pseudomonas putida KT2440
ccggucauccagcag

SEQ ID NO: 1593274 - RNA, 14 nt, Pseudomonas putida KT2440
ccgucaccuugcca

SEQ ID NO: 1593275 - RNA, 14 nt, Pseudomonas putida KT2440
ccgucaacgaggcc

SEQ ID NO: 1593276 - RNA, 14 nt, Pseudomonas putida KT2440
ccgucaccagcguc

SEQ ID NO: 1593277 - RNA, 17 nt, Pseudomonas putida KT2440
ccguccaacgggcggaa

SEQ ID NO: 1593278 - RNA, 13 nt, Pseudomonas putida KT2440
ccguccacagcga

SEQ ID NO: 1593279 - RNA, 13 nt, Pseudomonas putida KT2440
ccgucagcagcag

SEQ ID NO: 1593280 - RNA, 19 nt, Pseudomonas putida KT2440
ccgucagcagcaggcgcga

SEQ ID NO: 1593281 - RNA, 12 nt, Pseudomonas putida KT2440
ccgucagcagca

SEQ ID NO: 1593282 - RNA, 15 nt, Pseudomonas putida KT2440
ccguagcgcugacca

SEQ ID NO: 1593283 - RNA, 22 nt, Pseudomonas putida KT2440
ccguagccaaccgagucaacac

SEQ ID NO: 1593284 - RNA, 21 nt, Pseudomonas putida KT2440
ccgguugcgcagccggccuug

SEQ ID NO: 1593285 - RNA, 17 nt, Pseudomonas putida KT2440
ccgguugcuccagcgug

SEQ ID NO: 1593286 - RNA, 16 nt, Pseudomonas putida KT2440
ccguaggagcgggcuu

SEQ ID NO: 1593287 - RNA, 17 nt, Pseudomonas putida KT2440
ccguaggagcggguuua

SEQ ID NO: 1593288 - RNA, 18 nt, Pseudomonas putida KT2440
ccguaggagcggguuuac

SEQ ID NO: 1593289 - RNA, 19 nt, Pseudomonas putida KT2440
ccguagggggccgcuuugc

SEQ ID NO: 1593290 - RNA, 18 nt, Pseudomonas putida KT2440
ccguaguaggagcggguu

SEQ ID NO: 1593291 - RNA, 20 nt, Pseudomonas putida KT2440
ccguaguaggagcggguuua

SEQ ID NO: 1593292 - RNA, 13 nt, Pseudomonas putida KT2440
ccguauucgcggg

SEQ ID NO: 1593293 - RNA, 17 nt, Pseudomonas putida KT2440
ccguauugguagccacg

SEQ ID NO: 1593294 - RNA, 22 nt, Pseudomonas putida KT2440
ccguaguaagccagcccugccg

SEQ ID NO: 1593295 - RNA, 12 nt, Pseudomonas putida KT2440
ccguauacccau

SEQ ID NO: 1593296 - RNA, 20 nt, Pseudomonas putida KT2440
ccucggcaaucugcagcagc

SEQ ID NO: 1593297 - RNA, 18 nt, Pseudomonas putida KT2440
ccucgcagguaaucggcc

SEQ ID NO: 1593298 - RNA, 20 nt, Pseudomonas putida KT2440
ccucgaugucuuccagacca

SEQ ID NO: 1593299 - RNA, 20 nt, Pseudomonas putida KT2440
ccucggcuacgccgccgcug

SEQ ID NO: 1593300 - RNA, 17 nt, Pseudomonas putida KT2440
ccucggcguucagcucg

SEQ ID NO: 1593301 - RNA, 18 nt, Pseudomonas putida KT2440
ccucguaacgagccuugg

SEQ ID NO: 1593302 - RNA, 14 nt, Pseudomonas putida KT2440
ccucguaaggccug

SEQ ID NO: 1593303 - RNA, 18 nt, Pseudomonas putida KT2440
ccucgucaugcagcgcca

SEQ ID NO: 1593304 - RNA, 17 nt, Pseudomonas putida KT2440
ccucgugaccgaccacc

SEQ ID NO: 1593305 - RNA, 19 nt, Pseudomonas putida KT2440
ccucggccaugucguacca

SEQ ID NO: 1593306 - RNA, 15 nt, Pseudomonas putida KT2440
ccucggccaggccca

SEQ ID NO: 1593307 - RNA, 20 nt, Pseudomonas putida KT2440
ccucggcaucgaacagcuug

SEQ ID NO: 1593308 - RNA, 16 nt, Pseudomonas putida KT2440
ccgugguagcaccgga

SEQ ID NO: 1593309 - RNA, 21 nt, Pseudomonas putida KT2440
ccguggucgccuucacugcgc

SEQ ID NO: 1593310 - RNA, 22 nt, Pseudomonas putida KT2440
ccguggucgccuucacugcgcg

SEQ ID NO: 1593311 - RNA, 17 nt, Pseudomonas putida KT2440
ccguggucgugaggugc

SEQ ID NO: 1593312 - RNA, 13 nt, Pseudomonas putida KT2440
ccucacgcgccag

SEQ ID NO: 1593313 - RNA, 18 nt, Pseudomonas putida KT2440
ccucacgcgccaggucgg

SEQ ID NO: 1593314 - RNA, 11 nt, Pseudomonas putida KT2440
ccucagcgcca

SEQ ID NO: 1593315 - RNA, 22 nt, Pseudomonas putida KT2440
ccucagcgccaauaccgcgcau

SEQ ID NO: 1593316 - RNA, 21 nt, Pseudomonas putida KT2440
ccucagccaggcugagcccgg

SEQ ID NO: 1593317 - RNA, 18 nt, Pseudomonas putida KT2440
ccucgacgggcaggcggu

SEQ ID NO: 1593318 - RNA, 14 nt, Pseudomonas putida KT2440
ccucgaacagcagu

SEQ ID NO: 1593319 - RNA, 15 nt, Pseudomonas putida KT2440
ccucgaacagcgccg

SEQ ID NO: 1593320 - RNA, 17 nt, Pseudomonas putida KT2440
ccuccuucagguaaucc

SEQ ID NO: 1593321 - RNA, 13 nt, Pseudomonas putida KT2440
ccuccgacagcgc

SEQ ID NO: 1593322 - RNA, 17 nt, Pseudomonas putida KT2440
ccucccgcacugcugcc

SEQ ID NO: 1593323 - RNA, 13 nt, Pseudomonas putida KT2440
ccuccagcccugc

SEQ ID NO: 1593324 - RNA, 14 nt, Pseudomonas putida KT2440
ccuccagcccugcu

SEQ ID NO: 1593325 - RNA, 13 nt, Pseudomonas putida KT2440
ccucugcccgcag

SEQ ID NO: 1593326 - RNA, 18 nt, Pseudomonas putida KT2440
ccucuucaccgucggcgc

SEQ ID NO: 1593327 - RNA, 23 nt, Pseudomonas putida KT2440
ccucuuagcgggcaaauccgccc

SEQ ID NO: 1593328 - RNA, 15 nt, Pseudomonas putida KT2440
ccucucagcaccauu

SEQ ID NO: 1593329 - RNA, 18 nt, Pseudomonas putida KT2440
ccucguugcgaagcggcc

SEQ ID NO: 1593330 - RNA, 12 nt, Pseudomonas putida KT2440
ccucuucgcggg

SEQ ID NO: 1593331 - RNA, 17 nt, Pseudomonas putida KT2440
ccucuucgcggguaaac

SEQ ID NO: 1593332 - RNA, 19 nt, Pseudomonas putida KT2440
ccucuucgcggguaaaccc

SEQ ID NO: 1593333 - RNA, 18 nt, Pseudomonas putida KT2440
ccucuucgcggguaagcc

SEQ ID NO: 1593334 - RNA, 18 nt, Pseudomonas putida KT2440
ccucuucgcgggugaacc

SEQ ID NO: 1593335 - RNA, 15 nt, Pseudomonas putida KT2440
ccucuucggccagca

SEQ ID NO: 1593336 - RNA, 18 nt, Pseudomonas putida KT2440
ccugaacgcugcgcgggu

SEQ ID NO: 1593337 - RNA, 23 nt, Pseudomonas putida KT2440
ccugaaccaccgggaucuuggcg

SEQ ID NO: 1593338 - RNA, 21 nt, Pseudomonas putida KT2440
ccugagccuuguucgcgcagg

SEQ ID NO: 1593339 - RNA, 18 nt, Pseudomonas putida KT2440
ccugagucuggcgccuga

SEQ ID NO: 1593340 - RNA, 17 nt, Pseudomonas putida KT2440
ccugagggagcgggcuu

SEQ ID NO: 1593341 - RNA, 20 nt, Pseudomonas putida KT2440
ccugagggagcgggcuugcc

SEQ ID NO: 1593342 - RNA, 17 nt, Pseudomonas putida KT2440
ccugaccuugcugcuca

SEQ ID NO: 1593343 - RNA, 15 nt, Pseudomonas putida KT2440
ccugacgcugcacuu

SEQ ID NO: 1593344 - RNA, 22 nt, Pseudomonas putida KT2440
ccugacaagcgagguaggccgu

SEQ ID NO: 1593345 - RNA, 15 nt, Pseudomonas putida KT2440
ccugaaucuugcgcg

SEQ ID NO: 1593346 - RNA, 13 nt, Pseudomonas putida KT2440
ccugaccauuggc

SEQ ID NO: 1593347 - RNA, 17 nt, Pseudomonas putida KT2440
ccugaccauuggccaac

SEQ ID NO: 1593348 - RNA, 23 nt, Pseudomonas putida KT2440
ccugaaugucaucugaggcccga

SEQ ID NO: 1593349 - RNA, 23 nt, Pseudomonas putida KT2440
ccugcauggcauucgccacuugc

SEQ ID NO: 1593350 - RNA, 17 nt, Pseudomonas putida KT2440
ccugcaugcucaucgcg

SEQ ID NO: 1593351 - RNA, 18 nt, Pseudomonas putida KT2440
ccugcagguaucacgcga

SEQ ID NO: 1593352 - RNA, 24 nt, Pseudomonas putida KT2440
ccugcagguaucacgcgagcuguu

SEQ ID NO: 1593353 - RNA, 18 nt, Pseudomonas putida KT2440
ccugcagguacagcagcu

SEQ ID NO: 1593354 - RNA, 20 nt, Pseudomonas putida KT2440
ccugcagguacagcagcugc

SEQ ID NO: 1593355 - RNA, 19 nt, Pseudomonas putida KT2440
ccugcaggcgcggugccgg

SEQ ID NO: 1593356 - RNA, 15 nt, Pseudomonas putida KT2440
ccugcagcccggcaa

SEQ ID NO: 1593357 - RNA, 23 nt, Pseudomonas putida KT2440
ccugcaccuggcugagguucagc

SEQ ID NO: 1593358 - RNA, 15 nt, Pseudomonas putida KT2440
ccugcaggcccugua

SEQ ID NO: 1593359 - RNA, 19 nt, Pseudomonas putida KT2440
ccugcaggcccuguagaua

SEQ ID NO: 1593360 - RNA, 16 nt, Pseudomonas putida KT2440
ccugcaggcccaggug

SEQ ID NO: 1593361 - RNA, 17 nt, Pseudomonas putida KT2440
ccugcaggagcggguuc

SEQ ID NO: 1593362 - RNA, 22 nt, Pseudomonas putida KT2440
ccugcaggagcggguucacccg

SEQ ID NO: 1593363 - RNA, 19 nt, Pseudomonas putida KT2440
ccugcagcucagccagcaa

SEQ ID NO: 1593364 - RNA, 21 nt, Pseudomonas putida KT2440
ccugcagcuucccggccuggc

SEQ ID NO: 1593365 - RNA, 22 nt, Pseudomonas putida KT2440
ccugcagcgcggcgaucaacgc

SEQ ID NO: 1593366 - RNA, 16 nt, Pseudomonas putida KT2440
ccugcaacucggccuu

SEQ ID NO: 1593367 - RNA, 21 nt, Pseudomonas putida KT2440
ccugcaaggcaaugcccaugg

SEQ ID NO: 1593368 - RNA, 22 nt, Pseudomonas putida KT2440
ccugcaaggcaaugcccauggc

SEQ ID NO: 1593369 - RNA, 16 nt, Pseudomonas putida KT2440
ccugcacccaggcucu

SEQ ID NO: 1593370 - RNA, 15 nt, Pseudomonas putida KT2440
ccugcacaucacgcg

SEQ ID NO: 1593371 - RNA, 20 nt, Pseudomonas putida KT2440
ccugcacaaacuucgggcug

SEQ ID NO: 1593372 - RNA, 22 nt, Pseudomonas putida KT2440
ccugaucaagguuucagcagcg

SEQ ID NO: 1593373 - RNA, 14 nt, Pseudomonas putida KT2440
ccugauguggcugc

SEQ ID NO: 1593374 - RNA, 16 nt, Pseudomonas putida KT2440
ccugcaaacgcaggug

SEQ ID NO: 1593375 - RNA, 17 nt, Pseudomonas putida KT2440
ccugcaaacgcaggugc

SEQ ID NO: 1593376 - RNA, 19 nt, Pseudomonas putida KT2440
ccugaugcaccaggcccag

SEQ ID NO: 1593377 - RNA, 13 nt, Pseudomonas putida KT2440
ccugaugcagcag

SEQ ID NO: 1593378 - RNA, 14 nt, Pseudomonas putida KT2440
ccugaugcagcagu

SEQ ID NO: 1593379 - RNA, 19 nt, Pseudomonas putida KT2440
ccuggacgguauaggcccc

SEQ ID NO: 1593380 - RNA, 20 nt, Pseudomonas putida KT2440
ccuggacuggcccuuucgcg

SEQ ID NO: 1593381 - RNA, 14 nt, Pseudomonas putida KT2440
ccugcuuggccgac

SEQ ID NO: 1593382 - RNA, 18 nt, Pseudomonas putida KT2440
ccuggaaaauccgcuuga

SEQ ID NO: 1593383 - RNA, 23 nt, Pseudomonas putida KT2440
ccuggaaaaugcccccgccgaag

SEQ ID NO: 1593384 - RNA, 17 nt, Pseudomonas putida KT2440
ccuggaucgccaggcug

SEQ ID NO: 1593385 - RNA, 15 nt, Pseudomonas putida KT2440
ccuggaugcgggcuu

SEQ ID NO: 1593386 - RNA, 17 nt, Pseudomonas putida KT2440
ccuggcagccgaagcug

SEQ ID NO: 1593387 - RNA, 16 nt, Pseudomonas putida KT2440
ccuggccacuguugca

SEQ ID NO: 1593388 - RNA, 17 nt, Pseudomonas putida KT2440
ccuggcgcuccuccagc

SEQ ID NO: 1593389 - RNA, 19 nt, Pseudomonas putida KT2440
ccuggcgccugcgccagug

SEQ ID NO: 1593390 - RNA, 24 nt, Pseudomonas putida KT2440
ccuggcguacccgucgcucuucaa

SEQ ID NO: 1593391 - RNA, 18 nt, Pseudomonas putida KT2440
ccuggcgguugaccaggg

SEQ ID NO: 1593392 - RNA, 13 nt, Pseudomonas putida KT2440
ccuggcggguuuc

SEQ ID NO: 1593393 - RNA, 21 nt, Pseudomonas putida KT2440
ccuggcccugcucacgcagcu

SEQ ID NO: 1593394 - RNA, 16 nt, Pseudomonas putida KT2440
ccuggcccgcagcgcu

SEQ ID NO: 1593395 - RNA, 16 nt, Pseudomonas putida KT2440
ccuggccuuccagcug

SEQ ID NO: 1593396 - RNA, 13 nt, Pseudomonas putida KT2440
ccuggccugcaga

SEQ ID NO: 1593397 - RNA, 15 nt, Pseudomonas putida KT2440
ccuggccgugacgcc

SEQ ID NO: 1593398 - RNA, 16 nt, Pseudomonas putida KT2440
ccuggucgcgggccag

SEQ ID NO: 1593399 - RNA, 13 nt, Pseudomonas putida KT2440
ccuggugcgccuu

SEQ ID NO: 1593400 - RNA, 14 nt, Pseudomonas putida KT2440
ccugguucaucgac

SEQ ID NO: 1593401 - RNA, 17 nt, Pseudomonas putida KT2440
ccuggugccagcggcca

SEQ ID NO: 1593402 - RNA, 21 nt, Pseudomonas putida KT2440
ccugggucaaccccaggugcu

SEQ ID NO: 1593403 - RNA, 15 nt, Pseudomonas putida KT2440
ccugggucagcuccu

SEQ ID NO: 1593404 - RNA, 14 nt, Pseudomonas putida KT2440
ccugggucaggcgu

SEQ ID NO: 1593405 - RNA, 16 nt, Pseudomonas putida KT2440
ccuggucacggccacc

SEQ ID NO: 1593406 - RNA, 22 nt, Pseudomonas putida KT2440
ccuggucaugcagcgggucgca

SEQ ID NO: 1593407 - RNA, 22 nt, Pseudomonas putida KT2440
ccugguccccauagcuuuccag

SEQ ID NO: 1593408 - RNA, 19 nt, Pseudomonas putida KT2440
ccugggauuucggcggcga

SEQ ID NO: 1593409 - RNA, 12 nt, Pseudomonas putida KT2440
ccuggcuggcag

SEQ ID NO: 1593410 - RNA, 18 nt, Pseudomonas putida KT2440
ccuggcuggcagccggcg

SEQ ID NO: 1593411 - RNA, 23 nt, Pseudomonas putida KT2440
ccuggcuggcagccggcgccggu

SEQ ID NO: 1593412 - RNA, 20 nt, Pseudomonas putida KT2440
ccuggcuuuccagguccuug

SEQ ID NO: 1593413 - RNA, 23 nt, Pseudomonas putida KT2440
ccugggccggugggcaacagcug

SEQ ID NO: 1593414 - RNA, 15 nt, Pseudomonas putida KT2440
ccugggccuucgccc

SEQ ID NO: 1593415 - RNA, 14 nt, Pseudomonas putida KT2440
ccugggcgcuuugc

SEQ ID NO: 1593416 - RNA, 18 nt, Pseudomonas putida KT2440
ccuggggcaggcccggca

SEQ ID NO: 1593417 - RNA, 12 nt, Pseudomonas putida KT2440
ccugggcugucg

SEQ ID NO: 1593418 - RNA, 21 nt, Pseudomonas putida KT2440
ccugggguuuuuuuggcuggu

SEQ ID NO: 1593419 - RNA, 15 nt, Pseudomonas putida KT2440
ccugcuccggaaucc

SEQ ID NO: 1593420 - RNA, 15 nt, Pseudomonas putida KT2440
ccugcucgacaagcc

SEQ ID NO: 1593421 - RNA, 19 nt, Pseudomonas putida KT2440
ccugcucgacaagccgcug

SEQ ID NO: 1593422 - RNA, 16 nt, Pseudomonas putida KT2440
ccugcugcaacagcuc

SEQ ID NO: 1593423 - RNA, 21 nt, Pseudomonas putida KT2440
ccugcucguugcugagcaagc

SEQ ID NO: 1593424 - RNA, 16 nt, Pseudomonas putida KT2440
ccugcucuggcccgaa

SEQ ID NO: 1593425 - RNA, 19 nt, Pseudomonas putida KT2440
ccugcucuggcccgaacag

SEQ ID NO: 1593426 - RNA, 13 nt, Pseudomonas putida KT2440
ccugcuugccggg

SEQ ID NO: 1593427 - RNA, 16 nt, Pseudomonas putida KT2440
ccugcuugccgggugc

SEQ ID NO: 1593428 - RNA, 19 nt, Pseudomonas putida KT2440
ccugcuucgcgggcacgcc

SEQ ID NO: 1593429 - RNA, 15 nt, Pseudomonas putida KT2440
ccugcuguagcgccc

SEQ ID NO: 1593430 - RNA, 18 nt, Pseudomonas putida KT2440
ccugcuggcucagcgagc

SEQ ID NO: 1593431 - RNA, 22 nt, Pseudomonas putida KT2440
ccugcuggcucagcgagcgguu

SEQ ID NO: 1593432 - RNA, 14 nt, Pseudomonas putida KT2440
ccugcuggccaauc

SEQ ID NO: 1593433 - RNA, 15 nt, Pseudomonas putida KT2440
ccugcuggcccgcga

SEQ ID NO: 1593434 - RNA, 13 nt, Pseudomonas putida KT2440
ccugcugcucgcu

SEQ ID NO: 1593435 - RNA, 16 nt, Pseudomonas putida KT2440
ccugcugccaggccgc

SEQ ID NO: 1593436 - RNA, 15 nt, Pseudomonas putida KT2440
ccugcugcuggauca

SEQ ID NO: 1593437 - RNA, 12 nt, Pseudomonas putida KT2440
ccugcucacccg

SEQ ID NO: 1593438 - RNA, 13 nt, Pseudomonas putida KT2440
ccugcucacgcag

SEQ ID NO: 1593439 - RNA, 19 nt, Pseudomonas putida KT2440
ccugcggcuguucgcagca

SEQ ID NO: 1593440 - RNA, 16 nt, Pseudomonas putida KT2440
ccugcggccaggccgg

SEQ ID NO: 1593441 - RNA, 19 nt, Pseudomonas putida KT2440
ccugccccagcgucacccg

SEQ ID NO: 1593442 - RNA, 14 nt, Pseudomonas putida KT2440
ccugcccgguacgc

SEQ ID NO: 1593443 - RNA, 16 nt, Pseudomonas putida KT2440
ccugcccgaucgccuc

SEQ ID NO: 1593444 - RNA, 18 nt, Pseudomonas putida KT2440
ccugccaggucaccgccc

SEQ ID NO: 1593445 - RNA, 17 nt, Pseudomonas putida KT2440
ccugccagcaccagcgc

SEQ ID NO: 1593446 - RNA, 17 nt, Pseudomonas putida KT2440
ccugccagccgcaaccg

SEQ ID NO: 1593447 - RNA, 14 nt, Pseudomonas putida KT2440
ccugccagucgcac

SEQ ID NO: 1593448 - RNA, 17 nt, Pseudomonas putida KT2440
ccugccaugcaggucga

SEQ ID NO: 1593449 - RNA, 23 nt, Pseudomonas putida KT2440
ccugccgaugggcacuggccacc

SEQ ID NO: 1593450 - RNA, 23 nt, Pseudomonas putida KT2440
ccugcccucgacaaucgccaggu

SEQ ID NO: 1593451 - RNA, 16 nt, Pseudomonas putida KT2440
ccugccgaucuucgcc

SEQ ID NO: 1593452 - RNA, 13 nt, Pseudomonas putida KT2440
ccugccgaggcca

SEQ ID NO: 1593453 - RNA, 18 nt, Pseudomonas putida KT2440
ccugccgggguaaaacgc

SEQ ID NO: 1593454 - RNA, 21 nt, Pseudomonas putida KT2440
ccugccgggucaaggccagcg

SEQ ID NO: 1593455 - RNA, 22 nt, Pseudomonas putida KT2440
ccugccgggucaaggccagcgc

SEQ ID NO: 1593456 - RNA, 18 nt, Pseudomonas putida KT2440
ccugccuaccaccgcauc

SEQ ID NO: 1593457 - RNA, 23 nt, Pseudomonas putida KT2440
ccugcgccuugcuuggcagcggc

SEQ ID NO: 1593458 - RNA, 16 nt, Pseudomonas putida KT2440
ccugcgccgccaccug

SEQ ID NO: 1593459 - RNA, 21 nt, Pseudomonas putida KT2440
ccugcgcccaguagcgccacc

SEQ ID NO: 1593460 - RNA, 20 nt, Pseudomonas putida KT2440
ccugcgccaccucggcgaaa

SEQ ID NO: 1593461 - RNA, 20 nt, Pseudomonas putida KT2440
ccugcgcaugcaacggcaca

SEQ ID NO: 1593462 - RNA, 22 nt, Pseudomonas putida KT2440
ccugcgcaugcaacggcacacg

SEQ ID NO: 1593463 - RNA, 21 nt, Pseudomonas putida KT2440
ccugcgaauacgguagcggcg

SEQ ID NO: 1593464 - RNA, 15 nt, Pseudomonas putida KT2440
ccugcgaaaggcgcu

SEQ ID NO: 1593465 - RNA, 17 nt, Pseudomonas putida KT2440
ccgccagcggcaguugc

SEQ ID NO: 1593466 - RNA, 21 nt, Pseudomonas putida KT2440
ccgccauaucaggauugccgc

SEQ ID NO: 1593467 - RNA, 19 nt, Pseudomonas putida KT2440
ccgccaguuucaccugacc

SEQ ID NO: 1593468 - RNA, 22 nt, Pseudomonas putida KT2440
ccgccaguuucaccugaccauc

SEQ ID NO: 1593469 - RNA, 23 nt, Pseudomonas putida KT2440
ccgccaguuucaccugaccauca

SEQ ID NO: 1593470 - RNA, 16 nt, Pseudomonas putida KT2440
ccgccagugaccgcug

SEQ ID NO: 1593471 - RNA, 22 nt, Pseudomonas putida KT2440
ccgccagguauucggcaaugcg

SEQ ID NO: 1593472 - RNA, 16 nt, Pseudomonas putida KT2440
ccgccaggucgccggu

SEQ ID NO: 1593473 - RNA, 21 nt, Pseudomonas putida KT2440
ccgcaguacuuauaagcagca

SEQ ID NO: 1593474 - RNA, 12 nt, Pseudomonas putida KT2440
ccgcaggccgca

SEQ ID NO: 1593475 - RNA, 11 nt, Pseudomonas putida KT2440
ccgcaggcgcc

SEQ ID NO: 1593476 - RNA, 17 nt, Pseudomonas putida KT2440
ccgcaggcgcccccugg

SEQ ID NO: 1593477 - RNA, 20 nt, Pseudomonas putida KT2440
ccgcauagaaauuaagcgcc

SEQ ID NO: 1593478 - RNA, 22 nt, Pseudomonas putida KT2440
ccgcaucccaauguggauaguc

SEQ ID NO: 1593479 - RNA, 14 nt, Pseudomonas putida KT2440
ccgcagcuggcgca

SEQ ID NO: 1593480 - RNA, 20 nt, Pseudomonas putida KT2440
ccgagcaucuuccagccugc

SEQ ID NO: 1593481 - RNA, 23 nt, Pseudomonas putida KT2440
ccgccgaacucuggcaacagcuc

SEQ ID NO: 1593482 - RNA, 20 nt, Pseudomonas putida KT2440
ccgccgaagccaugagcgag

SEQ ID NO: 1593483 - RNA, 14 nt, Pseudomonas putida KT2440
ccgccgaccaggug

SEQ ID NO: 1593484 - RNA, 22 nt, Pseudomonas putida KT2440
ccgccgaccaggugguaacugg

SEQ ID NO: 1593485 - RNA, 17 nt, Pseudomonas putida KT2440
ccgccgaacauggugcu

SEQ ID NO: 1593486 - RNA, 21 nt, Pseudomonas putida KT2440
ccgccgaacaggccggcugca

SEQ ID NO: 1593487 - RNA, 22 nt, Pseudomonas putida KT2440
ccgccgaacaggccggcugcag

SEQ ID NO: 1593488 - RNA, 23 nt, Pseudomonas putida KT2440
ccgcccucuucgcgggcaugccc

SEQ ID NO: 1593489 - RNA, 22 nt, Pseudomonas putida KT2440
ccgccaucgaucaggguuucca

SEQ ID NO: 1593490 - RNA, 20 nt, Pseudomonas putida KT2440
ccgccgaucgaagcagcagc

SEQ ID NO: 1593491 - RNA, 17 nt, Pseudomonas putida KT2440
ccgccgauagcagcacc

SEQ ID NO: 1593492 - RNA, 18 nt, Pseudomonas putida KT2440
ccgccgauguagucgucc

SEQ ID NO: 1593493 - RNA, 13 nt, Pseudomonas putida KT2440
ccgccgcccaggu

SEQ ID NO: 1593494 - RNA, 17 nt, Pseudomonas putida KT2440
ccgccgccugucgcgac

SEQ ID NO: 1593495 - RNA, 20 nt, Pseudomonas putida KT2440
ccgcgcuacggcgucgacac

SEQ ID NO: 1593496 - RNA, 15 nt, Pseudomonas putida KT2440
ccgcgcugauaucga

SEQ ID NO: 1593497 - RNA, 23 nt, Pseudomonas putida KT2440
ccgcgcgggugcgagaggcgcuu

SEQ ID NO: 1593498 - RNA, 17 nt, Pseudomonas putida KT2440
ccgcgcgguuaagcgcc

SEQ ID NO: 1593499 - RNA, 18 nt, Pseudomonas putida KT2440
ccgcgcgguuaagcgcca

SEQ ID NO: 1593500 - RNA, 14 nt, Pseudomonas putida KT2440
ccgcgccauugccc

SEQ ID NO: 1593501 - RNA, 20 nt, Pseudomonas putida KT2440
ccgcgccauugcccaguucg

SEQ ID NO: 1593502 - RNA, 19 nt, Pseudomonas putida KT2440
ccgcgccgacagccucaag

SEQ ID NO: 1593503 - RNA, 13 nt, Pseudomonas putida KT2440
ccgcgccuacagc

SEQ ID NO: 1593504 - RNA, 19 nt, Pseudomonas putida KT2440
ccgcgccuacaggcaaccg

SEQ ID NO: 1593505 - RNA, 14 nt, Pseudomonas putida KT2440
ccgcgccaccagcc

SEQ ID NO: 1593506 - RNA, 15 nt, Pseudomonas putida KT2440
ccgcgccacccgcug

SEQ ID NO: 1593507 - RNA, 14 nt, Pseudomonas putida KT2440
ccgcgccagcggcc

SEQ ID NO: 1593508 - RNA, 20 nt, Pseudomonas putida KT2440
ccgcgccaucaaggccgaca

SEQ ID NO: 1593509 - RNA, 15 nt, Pseudomonas putida KT2440
ccgcgccaucagcug

SEQ ID NO: 1593510 - RNA, 13 nt, Pseudomonas putida KT2440
ccgcgcaacgcgc

SEQ ID NO: 1593511 - RNA, 15 nt, Pseudomonas putida KT2440
ccgcgcacgcaucug

SEQ ID NO: 1593512 - RNA, 19 nt, Pseudomonas putida KT2440
ccgcgcaccuccugcggca

SEQ ID NO: 1593513 - RNA, 20 nt, Pseudomonas putida KT2440
ccgcgcaccuccugcggcag

SEQ ID NO: 1593514 - RNA, 15 nt, Pseudomonas putida KT2440
ccgcgaagggccgca

SEQ ID NO: 1593515 - RNA, 16 nt, Pseudomonas putida KT2440
ccgcgaagcaggcugc

SEQ ID NO: 1593516 - RNA, 22 nt, Pseudomonas putida KT2440
ccgcgaagaagcuaacccgguc

SEQ ID NO: 1593517 - RNA, 18 nt, Pseudomonas putida KT2440
ccgcgaagaggccggcac

SEQ ID NO: 1593518 - RNA, 17 nt, Pseudomonas putida KT2440
ccgcgaagagggcgaca

SEQ ID NO: 1593519 - RNA, 14 nt, Pseudomonas putida KT2440
ccgcgagggcauca

SEQ ID NO: 1593520 - RNA, 18 nt, Pseudomonas putida KT2440
ccgcgagggcaucagcgc

SEQ ID NO: 1593521 - RNA, 21 nt, Pseudomonas putida KT2440
ccgcgagggcaucagcgcacc

SEQ ID NO: 1593522 - RNA, 23 nt, Pseudomonas putida KT2440
ccgcgaguccuccaacucgcgca

SEQ ID NO: 1593523 - RNA, 18 nt, Pseudomonas putida KT2440
ccgcgauacgccgacagc

SEQ ID NO: 1593524 - RNA, 20 nt, Pseudomonas putida KT2440
ccgcgauagcucagucggua

SEQ ID NO: 1593525 - RNA, 17 nt, Pseudomonas putida KT2440
ccgcgauaucagcgcca

SEQ ID NO: 1593526 - RNA, 20 nt, Pseudomonas putida KT2440
ccgcgauaucagcgccagca

SEQ ID NO: 1593527 - RNA, 15 nt, Pseudomonas putida KT2440
ccgccgggaugguaa

SEQ ID NO: 1593528 - RNA, 18 nt, Pseudomonas putida KT2440
ccgccggcucgucacugc

SEQ ID NO: 1593529 - RNA, 20 nt, Pseudomonas putida KT2440
ccgccguaccuucggcgaca

SEQ ID NO: 1593530 - RNA, 19 nt, Pseudomonas putida KT2440
ccgccgguuucucgcagca

SEQ ID NO: 1593531 - RNA, 23 nt, Pseudomonas putida KT2440
ccgccgguuucucgcagcagcac

SEQ ID NO: 1593532 - RNA, 18 nt, Pseudomonas putida KT2440
ccgccuuguuuguacggc

SEQ ID NO: 1593533 - RNA, 21 nt, Pseudomonas putida KT2440
ccgcgaaacacagcaggccaa

SEQ ID NO: 1593534 - RNA, 19 nt, Pseudomonas putida KT2440
ccgcgaacacgggcgaagc

SEQ ID NO: 1593535 - RNA, 17 nt, Pseudomonas putida KT2440
ccgcgaacaaggcucag

SEQ ID NO: 1593536 - RNA, 20 nt, Pseudomonas putida KT2440
ccgcgaaagggccaguccag

SEQ ID NO: 1593537 - RNA, 15 nt, Pseudomonas putida KT2440
ccgccuggcgccugc

SEQ ID NO: 1593538 - RNA, 12 nt, Pseudomonas putida KT2440
ccgccuggguca

SEQ ID NO: 1593539 - RNA, 14 nt, Pseudomonas putida KT2440
ccgccugggucagg

SEQ ID NO: 1593540 - RNA, 15 nt, Pseudomonas putida KT2440
ccgccugggucaggc

SEQ ID NO: 1593541 - RNA, 18 nt, Pseudomonas putida KT2440
ccgccugggucaggcgua

SEQ ID NO: 1593542 - RNA, 15 nt, Pseudomonas putida KT2440
ccgccugcggcaccg

SEQ ID NO: 1593543 - RNA, 16 nt, Pseudomonas putida KT2440
ccggauugucaugcgg

SEQ ID NO: 1593544 - RNA, 23 nt, Pseudomonas putida KT2440
ccggcaaacacauccaccaggcu

SEQ ID NO: 1593545 - RNA, 15 nt, Pseudomonas putida KT2440
ccggaugacguccgg

SEQ ID NO: 1593546 - RNA, 20 nt, Pseudomonas putida KT2440
ccggaucguugcgggucagc

SEQ ID NO: 1593547 - RNA, 16 nt, Pseudomonas putida KT2440
ccggaucggugccacc

SEQ ID NO: 1593548 - RNA, 13 nt, Pseudomonas putida KT2440
ccggcaaucgcca

SEQ ID NO: 1593549 - RNA, 14 nt, Pseudomonas putida KT2440
ccggcaaucgccag

SEQ ID NO: 1593550 - RNA, 22 nt, Pseudomonas putida KT2440
ccggcaaucgggauggcaccgg

SEQ ID NO: 1593551 - RNA, 19 nt, Pseudomonas putida KT2440
ccggcaaucgccaggcgca

SEQ ID NO: 1593552 - RNA, 17 nt, Pseudomonas putida KT2440
ccggcaaucugcccaca

SEQ ID NO: 1593553 - RNA, 16 nt, Pseudomonas putida KT2440
ccggcacaagcguccc

SEQ ID NO: 1593554 - RNA, 16 nt, Pseudomonas putida KT2440
ccggcacagaccgcaa

SEQ ID NO: 1593555 - RNA, 16 nt, Pseudomonas putida KT2440
ccggcacagcccagcu

SEQ ID NO: 1593556 - RNA, 15 nt, Pseudomonas putida KT2440
ccggcacaggaaggc

SEQ ID NO: 1593557 - RNA, 18 nt, Pseudomonas putida KT2440
ccggcacagugccaagga

SEQ ID NO: 1593558 - RNA, 12 nt, Pseudomonas putida KT2440
ccggcaacggcc

SEQ ID NO: 1593559 - RNA, 14 nt, Pseudomonas putida KT2440
ccggcaacggccac

SEQ ID NO: 1593560 - RNA, 15 nt, Pseudomonas putida KT2440
ccggcaacuggcaca

SEQ ID NO: 1593561 - RNA, 19 nt, Pseudomonas putida KT2440
ccggcaacuugcgggucag

SEQ ID NO: 1593562 - RNA, 22 nt, Pseudomonas putida KT2440
ccggcaacuugcgggucagcag

SEQ ID NO: 1593563 - RNA, 17 nt, Pseudomonas putida KT2440
ccggcaacuccuccagc

SEQ ID NO: 1593564 - RNA, 20 nt, Pseudomonas putida KT2440
ccggcaauaccggccacgcg

SEQ ID NO: 1593565 - RNA, 21 nt, Pseudomonas putida KT2440
ccggcaguacauagaacagca

SEQ ID NO: 1593566 - RNA, 19 nt, Pseudomonas putida KT2440
ccggcaggucggcaaccau

SEQ ID NO: 1593567 - RNA, 12 nt, Pseudomonas putida KT2440
ccggcagccacc

SEQ ID NO: 1593568 - RNA, 11 nt, Pseudomonas putida KT2440
ccggcagcagc

SEQ ID NO: 1593569 - RNA, 13 nt, Pseudomonas putida KT2440
ccggcagcagcaa

SEQ ID NO: 1593570 - RNA, 12 nt, Pseudomonas putida KT2440
ccggcagcaccu

SEQ ID NO: 1593571 - RNA, 20 nt, Pseudomonas putida KT2440
ccggcagcaccugccagccg

SEQ ID NO: 1593572 - RNA, 23 nt, Pseudomonas putida KT2440
ccggcagcaccugccagccgcaa

SEQ ID NO: 1593573 - RNA, 16 nt, Pseudomonas putida KT2440
ccggcagcaccggcaa

SEQ ID NO: 1593574 - RNA, 14 nt, Pseudomonas putida KT2440
ccggcagcgaugcc

SEQ ID NO: 1593575 - RNA, 12 nt, Pseudomonas putida KT2440
ccggcacugcac

SEQ ID NO: 1593576 - RNA, 17 nt, Pseudomonas putida KT2440
ccggcacuuccucguga

SEQ ID NO: 1593577 - RNA, 15 nt, Pseudomonas putida KT2440
ccggcagcaaacccg

SEQ ID NO: 1593578 - RNA, 22 nt, Pseudomonas putida KT2440
ccggcagaagcgcugacugcca

SEQ ID NO: 1593579 - RNA, 15 nt, Pseudomonas putida KT2440
ccggcacgacuucgc

SEQ ID NO: 1593580 - RNA, 20 nt, Pseudomonas putida KT2440
ccggcaccgccucuaccacg

SEQ ID NO: 1593581 - RNA, 22 nt, Pseudomonas putida KT2440
ccggcaccgggaugcucugcag

SEQ ID NO: 1593582 - RNA, 16 nt, Pseudomonas putida KT2440
ccggcaccgcuugcac

SEQ ID NO: 1593583 - RNA, 23 nt, Pseudomonas putida KT2440
ccggccguggguccugcgccagg

SEQ ID NO: 1593584 - RNA, 18 nt, Pseudomonas putida KT2440
ccggccguguucaggcac

SEQ ID NO: 1593585 - RNA, 23 nt, Pseudomonas putida KT2440
ccggccuugaccucgaccaggcg

SEQ ID NO: 1593586 - RNA, 13 nt, Pseudomonas putida KT2440
ccggccuugccgc

SEQ ID NO: 1593587 - RNA, 20 nt, Pseudomonas putida KT2440
ccggccuugccgcuggcgau

SEQ ID NO: 1593588 - RNA, 17 nt, Pseudomonas putida KT2440
ccggccuugcuccaguu

SEQ ID NO: 1593589 - RNA, 16 nt, Pseudomonas putida KT2440
ccggcgaauccagcag

SEQ ID NO: 1593590 - RNA, 14 nt, Pseudomonas putida KT2440
ccggccuuggccag

SEQ ID NO: 1593591 - RNA, 15 nt, Pseudomonas putida KT2440
ccggccuuggccagc

SEQ ID NO: 1593592 - RNA, 21 nt, Pseudomonas putida KT2440
ccggcgacagcucaagcccug

SEQ ID NO: 1593593 - RNA, 22 nt, Pseudomonas putida KT2440
ccggcgacagcucaagcccugc

SEQ ID NO: 1593594 - RNA, 16 nt, Pseudomonas putida KT2440
ccggcaucgccaacag

SEQ ID NO: 1593595 - RNA, 15 nt, Pseudomonas putida KT2440
ccggcaucgcucaac

SEQ ID NO: 1593596 - RNA, 20 nt, Pseudomonas putida KT2440
ccggcauccuugggguacac

SEQ ID NO: 1593597 - RNA, 15 nt, Pseudomonas putida KT2440
ccggcauagcgcaag

SEQ ID NO: 1593598 - RNA, 18 nt, Pseudomonas putida KT2440
ccggcagugccuggaugc

SEQ ID NO: 1593599 - RNA, 20 nt, Pseudomonas putida KT2440
ccggcagugccuggaugcgg

SEQ ID NO: 1593600 - RNA, 20 nt, Pseudomonas putida KT2440
ccggcauacuugggcgcagu

SEQ ID NO: 1593601 - RNA, 14 nt, Pseudomonas putida KT2440
ccggcccaaggcac

SEQ ID NO: 1593602 - RNA, 19 nt, Pseudomonas putida KT2440
ccggcccaaggcaccaacu

SEQ ID NO: 1593603 - RNA, 17 nt, Pseudomonas putida KT2440
ccggcccauucgcgggu

SEQ ID NO: 1593604 - RNA, 18 nt, Pseudomonas putida KT2440
ccggccccccagccagca

SEQ ID NO: 1593605 - RNA, 19 nt, Pseudomonas putida KT2440
ccggccccccagccagcag

SEQ ID NO: 1593606 - RNA, 17 nt, Pseudomonas putida KT2440
ccggcccggcuggccac

SEQ ID NO: 1593607 - RNA, 14 nt, Pseudomonas putida KT2440
ccgcucgcccagca

SEQ ID NO: 1593608 - RNA, 21 nt, Pseudomonas putida KT2440
ccgcucggccuugucuggcac

SEQ ID NO: 1593609 - RNA, 18 nt, Pseudomonas putida KT2440
ccgcugcacgucgcgcag

SEQ ID NO: 1593610 - RNA, 23 nt, Pseudomonas putida KT2440
ccgcugccaaaguccggcgaagc

SEQ ID NO: 1593611 - RNA, 18 nt, Pseudomonas putida KT2440
ccgcugccacccacaggc

SEQ ID NO: 1593612 - RNA, 16 nt, Pseudomonas putida KT2440
ccgcugcacaggccag

SEQ ID NO: 1593613 - RNA, 15 nt, Pseudomonas putida KT2440
ccgcugccagcaggg

SEQ ID NO: 1593614 - RNA, 18 nt, Pseudomonas putida KT2440
ccgcugccauagcgcugc

SEQ ID NO: 1593615 - RNA, 14 nt, Pseudomonas putida KT2440
ccgcugccagcugc

SEQ ID NO: 1593616 - RNA, 15 nt, Pseudomonas putida KT2440
ccgcugaccacaaag

SEQ ID NO: 1593617 - RNA, 17 nt, Pseudomonas putida KT2440
ccgcugaccacgccgaa

SEQ ID NO: 1593618 - RNA, 19 nt, Pseudomonas putida KT2440
ccgcugaccacgccgaagc

SEQ ID NO: 1593619 - RNA, 16 nt, Pseudomonas putida KT2440
ccgcuacaccggccug

SEQ ID NO: 1593620 - RNA, 22 nt, Pseudomonas putida KT2440
ccgcuacgacccugaagcccug

SEQ ID NO: 1593621 - RNA, 23 nt, Pseudomonas putida KT2440
ccgcuacgacccugaagcccugg

SEQ ID NO: 1593622 - RNA, 16 nt, Pseudomonas putida KT2440
ccgcucgaacaagcgc

SEQ ID NO: 1593623 - RNA, 17 nt, Pseudomonas putida KT2440
ccgcuccuacaacggcu

SEQ ID NO: 1593624 - RNA, 16 nt, Pseudomonas putida KT2440
ccgcuccuacacgcgg

SEQ ID NO: 1593625 - RNA, 18 nt, Pseudomonas putida KT2440
ccgcuccuacaggcgacc

SEQ ID NO: 1593626 - RNA, 19 nt, Pseudomonas putida KT2440
ccgcuccuacgacggccug

SEQ ID NO: 1593627 - RNA, 20 nt, Pseudomonas putida KT2440
ccgcuccuacggaaucugca

SEQ ID NO: 1593628 - RNA, 22 nt, Pseudomonas putida KT2440
ccgcuccuacggaaucugcacc

SEQ ID NO: 1593629 - RNA, 19 nt, Pseudomonas putida KT2440
ccgcgucguucggcaucga

SEQ ID NO: 1593630 - RNA, 15 nt, Pseudomonas putida KT2440
ccgcgucugccgcag

SEQ ID NO: 1593631 - RNA, 16 nt, Pseudomonas putida KT2440
ccgcgucugccgcagc

SEQ ID NO: 1593632 - RNA, 17 nt, Pseudomonas putida KT2440
ccgcgcuggcgcgcugu

SEQ ID NO: 1593633 - RNA, 21 nt, Pseudomonas putida KT2440
ccgcggguaccaccugggcgc

SEQ ID NO: 1593634 - RNA, 13 nt, Pseudomonas putida KT2440
ccgcguacagcug

SEQ ID NO: 1593635 - RNA, 14 nt, Pseudomonas putida KT2440
ccgcguacagcugc

SEQ ID NO: 1593636 - RNA, 20 nt, Pseudomonas putida KT2440
ccgcguccuggacccgcagc

SEQ ID NO: 1593637 - RNA, 16 nt, Pseudomonas putida KT2440
ccgcguccuugacggg

SEQ ID NO: 1593638 - RNA, 15 nt, Pseudomonas putida KT2440
ccgcgucagcucaag

SEQ ID NO: 1593639 - RNA, 22 nt, Pseudomonas putida KT2440
ccggaauuucugcaccuugccc

SEQ ID NO: 1593640 - RNA, 18 nt, Pseudomonas putida KT2440
ccggaaugcccgggcgca

SEQ ID NO: 1593641 - RNA, 16 nt, Pseudomonas putida KT2440
ccggaauguuaccggc

SEQ ID NO: 1593642 - RNA, 14 nt, Pseudomonas putida KT2440
ccggaccagcgccg

SEQ ID NO: 1593643 - RNA, 12 nt, Pseudomonas putida KT2440
ccggaccugccg

SEQ ID NO: 1593644 - RNA, 14 nt, Pseudomonas putida KT2440
ccggaccugccgca

SEQ ID NO: 1593645 - RNA, 20 nt, Pseudomonas putida KT2440
ccggaacaaccccuugcuca

SEQ ID NO: 1593646 - RNA, 23 nt, Pseudomonas putida KT2440
ccgcuggcauccaccaggucggu

SEQ ID NO: 1593647 - RNA, 15 nt, Pseudomonas putida KT2440
ccgcugccgaucagc

SEQ ID NO: 1593648 - RNA, 16 nt, Pseudomonas putida KT2440
ccgcugccgaucagca

SEQ ID NO: 1593649 - RNA, 20 nt, Pseudomonas putida KT2440
ccgcugccgaucagcacgcc

SEQ ID NO: 1593650 - RNA, 19 nt, Pseudomonas putida KT2440
ccggauagagcccggcgca

SEQ ID NO: 1593651 - RNA, 22 nt, Pseudomonas putida KT2440
ccggauagagcccggcgcagcc

SEQ ID NO: 1593652 - RNA, 20 nt, Pseudomonas putida KT2440
ccggagcuccccucagacag

SEQ ID NO: 1593653 - RNA, 16 nt, Pseudomonas putida KT2440
ccggagcuggagccgg

SEQ ID NO: 1593654 - RNA, 22 nt, Pseudomonas putida KT2440
ccggaggugucaccgcgagcag

SEQ ID NO: 1593655 - RNA, 16 nt, Pseudomonas putida KT2440
ccggacugcaccaggu

SEQ ID NO: 1593656 - RNA, 15 nt, Pseudomonas putida KT2440
ccggagaugugcgcg

SEQ ID NO: 1593657 - RNA, 17 nt, Pseudomonas putida KT2440
ccggagaugugcgcggu

SEQ ID NO: 1593658 - RNA, 17 nt, Pseudomonas putida KT2440
ccggacuucuucaacgc

SEQ ID NO: 1593659 - RNA, 13 nt, Pseudomonas putida KT2440
cggcgaaggcugg

SEQ ID NO: 1593660 - RNA, 17 nt, Pseudomonas putida KT2440
cggcgacagggcgaaga

SEQ ID NO: 1593661 - RNA, 23 nt, Pseudomonas putida KT2440
cggcgaaauacccaacuccagcg

SEQ ID NO: 1593662 - RNA, 15 nt, Pseudomonas putida KT2440
cggcgaaagccagca

SEQ ID NO: 1593663 - RNA, 19 nt, Pseudomonas putida KT2440
cggccuugcuccaguucau

SEQ ID NO: 1593664 - RNA, 20 nt, Pseudomonas putida KT2440
cggccuugccguagaugccg

SEQ ID NO: 1593665 - RNA, 13 nt, Pseudomonas putida KT2440
cggccuugcgagc

SEQ ID NO: 1593666 - RNA, 17 nt, Pseudomonas putida KT2440
cggccuugcgcugggca

SEQ ID NO: 1593667 - RNA, 13 nt, Pseudomonas putida KT2440
cggccugcgaugc

SEQ ID NO: 1593668 - RNA, 18 nt, Pseudomonas putida KT2440
cggccugcucgcuggcuu

SEQ ID NO: 1593669 - RNA, 15 nt, Pseudomonas putida KT2440
cggccggcagcgcgg

SEQ ID NO: 1593670 - RNA, 22 nt, Pseudomonas putida KT2440
cggcgacguucuugccgguggu

SEQ ID NO: 1593671 - RNA, 13 nt, Pseudomonas putida KT2440
cggcgcaggucga

SEQ ID NO: 1593672 - RNA, 14 nt, Pseudomonas putida KT2440
cggcgcagguugca

SEQ ID NO: 1593673 - RNA, 20 nt, Pseudomonas putida KT2440
cggcgccaaacgccagggcc

SEQ ID NO: 1593674 - RNA, 18 nt, Pseudomonas putida KT2440
cggcgccaaucaucgcca

SEQ ID NO: 1593675 - RNA, 21 nt, Pseudomonas putida KT2440
cggcgccaaucaucgccagca

SEQ ID NO: 1593676 - RNA, 16 nt, Pseudomonas putida KT2440
cggcgcauccaccacg

SEQ ID NO: 1593677 - RNA, 18 nt, Pseudomonas putida KT2440
cggcgcaucgacgggcau

SEQ ID NO: 1593678 - RNA, 15 nt, Pseudomonas putida KT2440
cggcgccgccaggca

SEQ ID NO: 1593679 - RNA, 14 nt, Pseudomonas putida KT2440
cggcgcccuggccg

SEQ ID NO: 1593680 - RNA, 16 nt, Pseudomonas putida KT2440
cggcgcugggacaggu

SEQ ID NO: 1593681 - RNA, 22 nt, Pseudomonas putida KT2440
cggcgcugggacagguccaugu

SEQ ID NO: 1593682 - RNA, 12 nt, Pseudomonas putida KT2440
cggcgcuggccg

SEQ ID NO: 1593683 - RNA, 15 nt, Pseudomonas putida KT2440
cggcgcugaucagcu

SEQ ID NO: 1593684 - RNA, 20 nt, Pseudomonas putida KT2440
cggcgcucggucucacaggc

SEQ ID NO: 1593685 - RNA, 23 nt, Pseudomonas putida KT2440
cggcgcucggucucacaggcgcu

SEQ ID NO: 1593686 - RNA, 20 nt, Pseudomonas putida KT2440
cggcgcucggucucauaggc

SEQ ID NO: 1593687 - RNA, 15 nt, Pseudomonas putida KT2440
cggcgcugcuggccu

SEQ ID NO: 1593688 - RNA, 16 nt, Pseudomonas putida KT2440
cggcgcugcuggccuu

SEQ ID NO: 1593689 - RNA, 22 nt, Pseudomonas putida KT2440
cggcggauagccccgcccagca

SEQ ID NO: 1593690 - RNA, 12 nt, Pseudomonas putida KT2440
cggcggccagca

SEQ ID NO: 1593691 - RNA, 15 nt, Pseudomonas putida KT2440
cggcgcucaagcgug

SEQ ID NO: 1593692 - RNA, 17 nt, Pseudomonas putida KT2440
cggcgcucagcgggcgu

SEQ ID NO: 1593693 - RNA, 22 nt, Pseudomonas putida KT2440
cggcgcgcagcgcacuuccaca

SEQ ID NO: 1593694 - RNA, 17 nt, Pseudomonas putida KT2440
cggcgcgaaucagcgcc

SEQ ID NO: 1593695 - RNA, 22 nt, Pseudomonas putida KT2440
cggcgcgacagcguugcuccag

SEQ ID NO: 1593696 - RNA, 18 nt, Pseudomonas putida KT2440
cggcagauccugcagccg

SEQ ID NO: 1593697 - RNA, 19 nt, Pseudomonas putida KT2440
cggcagauccugcagccgc

SEQ ID NO: 1593698 - RNA, 16 nt, Pseudomonas putida KT2440
cggcagagcgccagca

SEQ ID NO: 1593699 - RNA, 17 nt, Pseudomonas putida KT2440
cggcagaacacaucggu

SEQ ID NO: 1593700 - RNA, 17 nt, Pseudomonas putida KT2440
cggcagaacggcuucga

SEQ ID NO: 1593701 - RNA, 23 nt, Pseudomonas putida KT2440
cggcacuucguuacccucggcau

SEQ ID NO: 1593702 - RNA, 23 nt, Pseudomonas putida KT2440
cggcacuccagcgaguggccacg

SEQ ID NO: 1593703 - RNA, 19 nt, Pseudomonas putida KT2440
cggcacugcacagcucccu

SEQ ID NO: 1593704 - RNA, 23 nt, Pseudomonas putida KT2440
cggcacuaccaggcccaacagcg

SEQ ID NO: 1593705 - RNA, 22 nt, Pseudomonas putida KT2440
cggcacguucacgcaagcgccu

SEQ ID NO: 1593706 - RNA, 22 nt, Pseudomonas putida KT2440
aacaguggcccgaugaucaggc

SEQ ID NO: 1593707 - RNA, 16 nt, Pseudomonas putida KT2440
cggcagcaugaacagc

SEQ ID NO: 1593708 - RNA, 22 nt, Pseudomonas putida KT2440
aacaguuuucaaugcugcucgc

SEQ ID NO: 1593709 - RNA, 18 nt, Pseudomonas putida KT2440
cggcagcaaacccgacaa

SEQ ID NO: 1593710 - RNA, 23 nt, Pseudomonas putida KT2440
cggcagcaacacgacgauggcca

SEQ ID NO: 1593711 - RNA, 16 nt, Pseudomonas putida KT2440
cggcaccugccgggca

SEQ ID NO: 1593712 - RNA, 20 nt, Pseudomonas putida KT2440
cggcaccucguccagguuga

SEQ ID NO: 1593713 - RNA, 17 nt, Pseudomonas putida KT2440
cggcaccugcuugccgc

SEQ ID NO: 1593714 - RNA, 13 nt, Pseudomonas putida KT2440
aacaggaucagcg

SEQ ID NO: 1593715 - RNA, 20 nt, Pseudomonas putida KT2440
aacaggaucuccucggccag

SEQ ID NO: 1593716 - RNA, 17 nt, Pseudomonas putida KT2440
cggcaccuuucuccagg

SEQ ID NO: 1593717 - RNA, 21 nt, Pseudomonas putida KT2440
cggcaccuuucuccaggugga

SEQ ID NO: 1593718 - RNA, 20 nt, Pseudomonas putida KT2440
cggcaccccuuucuccagca

SEQ ID NO: 1593719 - RNA, 17 nt, Pseudomonas putida KT2440
cggcacccgcacaugcc

SEQ ID NO: 1593720 - RNA, 17 nt, Pseudomonas putida KT2440
cggcacggcgugcucca

SEQ ID NO: 1593721 - RNA, 22 nt, Pseudomonas putida KT2440
cggcacgcguaccccuggcgcu

SEQ ID NO: 1593722 - RNA, 15 nt, Pseudomonas putida KT2440
cggcacgcgccagca

SEQ ID NO: 1593723 - RNA, 15 nt, Pseudomonas putida KT2440
cggcacgcgcccggu

SEQ ID NO: 1593724 - RNA, 13 nt, Pseudomonas putida KT2440
aacaggcucucca

SEQ ID NO: 1593725 - RNA, 19 nt, Pseudomonas putida KT2440
cggcauaccaucuucugca

SEQ ID NO: 1593726 - RNA, 17 nt, Pseudomonas putida KT2440
cggcaugcacggcagca

SEQ ID NO: 1593727 - RNA, 13 nt, Pseudomonas putida KT2440
cggcaugaucagc

SEQ ID NO: 1593728 - RNA, 17 nt, Pseudomonas putida KT2440
cggcaguugcaggcgca

SEQ ID NO: 1593729 - RNA, 18 nt, Pseudomonas putida KT2440
cggcaguugcaggcgcag

SEQ ID NO: 1593730 - RNA, 16 nt, Pseudomonas putida KT2440
cggcaguugccugccu

SEQ ID NO: 1593731 - RNA, 22 nt, Pseudomonas putida KT2440
cggcaguuugccgaugaucgaa

SEQ ID NO: 1593732 - RNA, 22 nt, Pseudomonas putida KT2440
cggcagucagggucucggccaa

SEQ ID NO: 1593733 - RNA, 19 nt, Pseudomonas putida KT2440
cggccaagccgcugccaca

SEQ ID NO: 1593734 - RNA, 22 nt, Pseudomonas putida KT2440
cggccaagccgcugccacaggu

SEQ ID NO: 1593735 - RNA, 19 nt, Pseudomonas putida KT2440
cggccaaguacaaacgcca

SEQ ID NO: 1593736 - RNA, 18 nt, Pseudomonas putida KT2440
cggccaauaucuggugca

SEQ ID NO: 1593737 - RNA, 18 nt, Pseudomonas putida KT2440
cggccaaugcacgccugu

SEQ ID NO: 1593738 - RNA, 13 nt, Pseudomonas putida KT2440
cggccaaucgcgg

SEQ ID NO: 1593739 - RNA, 23 nt, Pseudomonas putida KT2440
cggcaugcccgccccugccagca

SEQ ID NO: 1593740 - RNA, 17 nt, Pseudomonas putida KT2440
cggccaacauucacggc

SEQ ID NO: 1593741 - RNA, 18 nt, Pseudomonas putida KT2440
cggccaacauucacggcg

SEQ ID NO: 1593742 - RNA, 15 nt, Pseudomonas putida KT2440
cggccaacaacgacu

SEQ ID NO: 1593743 - RNA, 22 nt, Pseudomonas putida KT2440
cggcagcgaugccggggcuuug

SEQ ID NO: 1593744 - RNA, 17 nt, Pseudomonas putida KT2440
cggcagccaugcugucg

SEQ ID NO: 1593745 - RNA, 15 nt, Pseudomonas putida KT2440
cggcaggcuggcgug

SEQ ID NO: 1593746 - RNA, 17 nt, Pseudomonas putida KT2440
cggcaggcucugcucca

SEQ ID NO: 1593747 - RNA, 23 nt, Pseudomonas putida KT2440
cggcaggcgaaugcgcccggcca

SEQ ID NO: 1593748 - RNA, 16 nt, Pseudomonas putida KT2440
cggcaggcgcagcugc

SEQ ID NO: 1593749 - RNA, 21 nt, Pseudomonas putida KT2440
cggcaguagagcccccagcac

SEQ ID NO: 1593750 - RNA, 18 nt, Pseudomonas putida KT2440
cggcaggugggucacggu

SEQ ID NO: 1593751 - RNA, 14 nt, Pseudomonas putida KT2440
cggccccucgacca

SEQ ID NO: 1593752 - RNA, 24 nt, Pseudomonas putida KT2440
cggccccggcgccgccaggcagca

SEQ ID NO: 1593753 - RNA, 15 nt, Pseudomonas putida KT2440
cggcccuuucgcggg

SEQ ID NO: 1593754 - RNA, 17 nt, Pseudomonas putida KT2440
cggcccuuucgcgggua

SEQ ID NO: 1593755 - RNA, 18 nt, Pseudomonas putida KT2440
cggcccuuucgcggguaa

SEQ ID NO: 1593756 - RNA, 18 nt, Pseudomonas putida KT2440
cggcccuaucgcgacgca

SEQ ID NO: 1593757 - RNA, 22 nt, Pseudomonas putida KT2440
cggcccgcugccaccuuccagg

SEQ ID NO: 1593758 - RNA, 16 nt, Pseudomonas putida KT2440
cggcccgccggcaacu

SEQ ID NO: 1593759 - RNA, 19 nt, Pseudomonas putida KT2440
cggccgaaggcgcuggcga

SEQ ID NO: 1593760 - RNA, 14 nt, Pseudomonas putida KT2440
cggccgcuccagcu

SEQ ID NO: 1593761 - RNA, 20 nt, Pseudomonas putida KT2440
cggccgcgcaauugccgguc

SEQ ID NO: 1593762 - RNA, 12 nt, Pseudomonas putida KT2440
cggccagcgcau

SEQ ID NO: 1593763 - RNA, 16 nt, Pseudomonas putida KT2440
cggccagcgacccuga

SEQ ID NO: 1593764 - RNA, 21 nt, Pseudomonas putida KT2440
cggccagcacgaacagcaaca

SEQ ID NO: 1593765 - RNA, 13 nt, Pseudomonas putida KT2440
cggccagcaacag

SEQ ID NO: 1593766 - RNA, 23 nt, Pseudomonas putida KT2440
cggccagcaacuggugaaucagc

SEQ ID NO: 1593767 - RNA, 18 nt, Pseudomonas putida KT2440
cggccagaucggccagcu

SEQ ID NO: 1593768 - RNA, 19 nt, Pseudomonas putida KT2440
cggccagaucggccagcuu

SEQ ID NO: 1593769 - RNA, 15 nt, Pseudomonas putida KT2440
cggccagcucggccg

SEQ ID NO: 1593770 - RNA, 13 nt, Pseudomonas putida KT2440
cggccagcugcgc

SEQ ID NO: 1593771 - RNA, 20 nt, Pseudomonas putida KT2440
cggccagcugcgcaccggcu

SEQ ID NO: 1593772 - RNA, 16 nt, Pseudomonas putida KT2440
cggccagcugcugcgg

SEQ ID NO: 1593773 - RNA, 13 nt, Pseudomonas putida KT2440
cggccagcgccug

SEQ ID NO: 1593774 - RNA, 16 nt, Pseudomonas putida KT2440
cggcccaggggcaggu

SEQ ID NO: 1593775 - RNA, 23 nt, Pseudomonas putida KT2440
cggcccccuguagauaggcuguu

SEQ ID NO: 1593776 - RNA, 14 nt, Pseudomonas putida KT2440
cggcccccacgccg

SEQ ID NO: 1593777 - RNA, 17 nt, Pseudomonas putida KT2440
cggccccccagccagca

SEQ ID NO: 1593778 - RNA, 16 nt, Pseudomonas putida KT2440
cggcccaaucgccaca

SEQ ID NO: 1593779 - RNA, 21 nt, Pseudomonas putida KT2440
cggcccaaggcaccaacugca

SEQ ID NO: 1593780 - RNA, 21 nt, Pseudomonas putida KT2440
cggccaguaccaggucgccag

SEQ ID NO: 1593781 - RNA, 20 nt, Pseudomonas putida KT2440
cggccagugaagcucgaucu

SEQ ID NO: 1593782 - RNA, 21 nt, Pseudomonas putida KT2440
cggccagugaagcucgaucug

SEQ ID NO: 1593783 - RNA, 23 nt, Pseudomonas putida KT2440
aacaucgaggcgcgcgccugggu

SEQ ID NO: 1593784 - RNA, 12 nt, Pseudomonas putida KT2440
cgguccaucagg

SEQ ID NO: 1593785 - RNA, 22 nt, Pseudomonas putida KT2440
cgguccgcccuugccaccagug

SEQ ID NO: 1593786 - RNA, 13 nt, Pseudomonas putida KT2440
cggucgagcuuuu

SEQ ID NO: 1593787 - RNA, 20 nt, Pseudomonas putida KT2440
cgguccuucaugccgaacga

SEQ ID NO: 1593788 - RNA, 18 nt, Pseudomonas putida KT2440
cggucaguaccuggccgc

SEQ ID NO: 1593789 - RNA, 14 nt, Pseudomonas putida KT2440
cggucagguacucg

SEQ ID NO: 1593790 - RNA, 15 nt, Pseudomonas putida KT2440
cggucaggccaagua

SEQ ID NO: 1593791 - RNA, 15 nt, Pseudomonas putida KT2440
cggucauacauccag

SEQ ID NO: 1593792 - RNA, 14 nt, Pseudomonas putida KT2440
cggucaucacgcuc

SEQ ID NO: 1593793 - RNA, 21 nt, Pseudomonas putida KT2440
cggucaucaccacccccagcg

SEQ ID NO: 1593794 - RNA, 16 nt, Pseudomonas putida KT2440
cggucagcauggccag

SEQ ID NO: 1593795 - RNA, 16 nt, Pseudomonas putida KT2440
cggucacugagccagg

SEQ ID NO: 1593796 - RNA, 20 nt, Pseudomonas putida KT2440
cggucacugagccaggccga

SEQ ID NO: 1593797 - RNA, 12 nt, Pseudomonas putida KT2440
cggucagacgcg

SEQ ID NO: 1593798 - RNA, 14 nt, Pseudomonas putida KT2440
cggucagcgcugcg

SEQ ID NO: 1593799 - RNA, 15 nt, Pseudomonas putida KT2440
cgguacccgccagca

SEQ ID NO: 1593800 - RNA, 22 nt, Pseudomonas putida KT2440
cgguaccacugcuucugagcca

SEQ ID NO: 1593801 - RNA, 14 nt, Pseudomonas putida KT2440
cgguaccgccacca

SEQ ID NO: 1593802 - RNA, 14 nt, Pseudomonas putida KT2440
cgguaccgcucugc

SEQ ID NO: 1593803 - RNA, 20 nt, Pseudomonas putida KT2440
cgguaccggccagcugcgca

SEQ ID NO: 1593804 - RNA, 15 nt, Pseudomonas putida KT2440
cgguacagcacccag

SEQ ID NO: 1593805 - RNA, 22 nt, Pseudomonas putida KT2440
cgguacagcacugcauuggcca

SEQ ID NO: 1593806 - RNA, 16 nt, Pseudomonas putida KT2440
cgguaaacgucggcag

SEQ ID NO: 1593807 - RNA, 21 nt, Pseudomonas putida KT2440
cgguaaacgucggcagccaug

SEQ ID NO: 1593808 - RNA, 13 nt, Pseudomonas putida KT2440
cgguaaugcccgc

SEQ ID NO: 1593809 - RNA, 18 nt, Pseudomonas putida KT2440
cgguaauggccggcugug

SEQ ID NO: 1593810 - RNA, 21 nt, Pseudomonas putida KT2440
cggguuguggcuggcgucgau

SEQ ID NO: 1593811 - RNA, 20 nt, Pseudomonas putida KT2440
cggguuuacccgcgaauacg

SEQ ID NO: 1593812 - RNA, 19 nt, Pseudomonas putida KT2440
cggguuuacccgcgaaugg

SEQ ID NO: 1593813 - RNA, 19 nt, Pseudomonas putida KT2440
cggguuuaccugcgaauac

SEQ ID NO: 1593814 - RNA, 20 nt, Pseudomonas putida KT2440
cggguuuaccugcgaauacg

SEQ ID NO: 1593815 - RNA, 22 nt, Pseudomonas putida KT2440
cggguuuuuuuaugcuugccgg

SEQ ID NO: 1593816 - RNA, 20 nt, Pseudomonas putida KT2440
cggguuuucucgcgaaugcg

SEQ ID NO: 1593817 - RNA, 18 nt, Pseudomonas putida KT2440
cgguagauuucaccgagu

SEQ ID NO: 1593818 - RNA, 13 nt, Pseudomonas putida KT2440
cgguagagcaaau

SEQ ID NO: 1593819 - RNA, 20 nt, Pseudomonas putida KT2440
cgguacugcgucuuguaguu

SEQ ID NO: 1593820 - RNA, 18 nt, Pseudomonas putida KT2440
cgguaccguucgccagcu

SEQ ID NO: 1593821 - RNA, 18 nt, Pseudomonas putida KT2440
cgguagcggcugggcgcg

SEQ ID NO: 1593822 - RNA, 14 nt, Pseudomonas putida KT2440
cgguagcggcagca

SEQ ID NO: 1593823 - RNA, 17 nt, Pseudomonas putida KT2440
cgguagccucgacccgc

SEQ ID NO: 1593824 - RNA, 22 nt, Pseudomonas putida KT2440
cgguagccucgacccgcuggcg

SEQ ID NO: 1593825 - RNA, 22 nt, Pseudomonas putida KT2440
cgguauauaucucgggcuucca

SEQ ID NO: 1593826 - RNA, 19 nt, Pseudomonas putida KT2440
cgguaugcccaugcucugc

SEQ ID NO: 1593827 - RNA, 15 nt, Pseudomonas putida KT2440
cgggucgaugaugcg

SEQ ID NO: 1593828 - RNA, 14 nt, Pseudomonas putida KT2440
cggguccagcgcgg

SEQ ID NO: 1593829 - RNA, 13 nt, Pseudomonas putida KT2440
cgggucagcucgc

SEQ ID NO: 1593830 - RNA, 17 nt, Pseudomonas putida KT2440
cgggucacgcuccuucg

SEQ ID NO: 1593831 - RNA, 22 nt, Pseudomonas putida KT2440
cgggucacgcuccuucgccacg

SEQ ID NO: 1593832 - RNA, 16 nt, Pseudomonas putida KT2440
cgggucacugcgcgcc

SEQ ID NO: 1593833 - RNA, 14 nt, Pseudomonas putida KT2440
cgggucaaggccag

SEQ ID NO: 1593834 - RNA, 16 nt, Pseudomonas putida KT2440
cgggucaaggccagcg

SEQ ID NO: 1593835 - RNA, 12 nt, Pseudomonas putida KT2440
cgggucaccacg

SEQ ID NO: 1593836 - RNA, 17 nt, Pseudomonas putida KT2440
cggguaguccuccaaca

SEQ ID NO: 1593837 - RNA, 16 nt, Pseudomonas putida KT2440
cggguaguugcccggg

SEQ ID NO: 1593838 - RNA, 19 nt, Pseudomonas putida KT2440
cggguauagccaugcaccg

SEQ ID NO: 1593839 - RNA, 17 nt, Pseudomonas putida KT2440
cgggcucguuauccgcg

SEQ ID NO: 1593840 - RNA, 14 nt, Pseudomonas putida KT2440
cggggugcugcgca

SEQ ID NO: 1593841 - RNA, 12 nt, Pseudomonas putida KT2440
cgggguggccgg

SEQ ID NO: 1593842 - RNA, 14 nt, Pseudomonas putida KT2440
aaccaccaccgacc

SEQ ID NO: 1593843 - RNA, 17 nt, Pseudomonas putida KT2440
aaccaccaccgaccgca

SEQ ID NO: 1593844 - RNA, 17 nt, Pseudomonas putida KT2440
aaccacagcggccacag

SEQ ID NO: 1593845 - RNA, 14 nt, Pseudomonas putida KT2440
cgggguguggccaa

SEQ ID NO: 1593846 - RNA, 20 nt, Pseudomonas putida KT2440
cgggugaccaggcccagcag

SEQ ID NO: 1593847 - RNA, 20 nt, Pseudomonas putida KT2440
cgggugaacccgcuccuaca

SEQ ID NO: 1593848 - RNA, 20 nt, Pseudomonas putida KT2440
cgggugaacccgcuccuacc

SEQ ID NO: 1593849 - RNA, 20 nt, Pseudomonas putida KT2440
cgggugaacccgcuccugca

SEQ ID NO: 1593850 - RNA, 20 nt, Pseudomonas putida KT2440
cgggucuuuuuucauucagg

SEQ ID NO: 1593851 - RNA, 23 nt, Pseudomonas putida KT2440
cgggucuacccgcgaaagggcca

SEQ ID NO: 1593852 - RNA, 23 nt, Pseudomonas putida KT2440
cgggucguucaacuucgguggcu

SEQ ID NO: 1593853 - RNA, 18 nt, Pseudomonas putida KT2440
cgggugcagccgcaccca

SEQ ID NO: 1593854 - RNA, 12 nt, Pseudomonas putida KT2440
aaccaggcgcag

SEQ ID NO: 1593855 - RNA, 16 nt, Pseudomonas putida KT2440
aaccaguucagcgccc

SEQ ID NO: 1593856 - RNA, 22 nt, Pseudomonas putida KT2440
aaccagucgauaaaccgugcaa

SEQ ID NO: 1593857 - RNA, 21 nt, Pseudomonas putida KT2440
cgggugcgcucaacaggucca

SEQ ID NO: 1593858 - RNA, 21 nt, Pseudomonas putida KT2440
cggguggaaauuggcgagcag

SEQ ID NO: 1593859 - RNA, 20 nt, Pseudomonas putida KT2440
cggguguuggacacaggccg

SEQ ID NO: 1593860 - RNA, 23 nt, Pseudomonas putida KT2440
cggguugaagaugguuuccagcu

SEQ ID NO: 1593861 - RNA, 19 nt, Pseudomonas putida KT2440
cggguucugguugccgguc

SEQ ID NO: 1593862 - RNA, 17 nt, Pseudomonas putida KT2440
cggguugcucaggcgcu

SEQ ID NO: 1593863 - RNA, 18 nt, Pseudomonas putida KT2440
cggguucagcuucucgcg

SEQ ID NO: 1593864 - RNA, 23 nt, Pseudomonas putida KT2440
cggguucaagggcagggugaucg

SEQ ID NO: 1593865 - RNA, 19 nt, Pseudomonas putida KT2440
cggguucacccgcgaaugg

SEQ ID NO: 1593866 - RNA, 22 nt, Pseudomonas putida KT2440
cggcgucuggucgcuuuccaga

SEQ ID NO: 1593867 - RNA, 21 nt, Pseudomonas putida KT2440
cggcguacucucgucgaggcu

SEQ ID NO: 1593868 - RNA, 15 nt, Pseudomonas putida KT2440
cggcguacugcacgc

SEQ ID NO: 1593869 - RNA, 17 nt, Pseudomonas putida KT2440
cggcggcccggccaaca

SEQ ID NO: 1593870 - RNA, 20 nt, Pseudomonas putida KT2440
cggcgucaccggccaugccg

SEQ ID NO: 1593871 - RNA, 19 nt, Pseudomonas putida KT2440
cggcguagaccagugcaac

SEQ ID NO: 1593872 - RNA, 17 nt, Pseudomonas putida KT2440
cggcgucaguucgacgc

SEQ ID NO: 1593873 - RNA, 15 nt, Pseudomonas putida KT2440
cggcgucagcguggu

SEQ ID NO: 1593874 - RNA, 16 nt, Pseudomonas putida KT2440
cggcguggugcugcau

SEQ ID NO: 1593875 - RNA, 13 nt, Pseudomonas putida KT2440
cggcgugcuccac

SEQ ID NO: 1593876 - RNA, 14 nt, Pseudomonas putida KT2440
cggcgugcuccaca

SEQ ID NO: 1593877 - RNA, 13 nt, Pseudomonas putida KT2440
cggcgugcugcgu

SEQ ID NO: 1593878 - RNA, 14 nt, Pseudomonas putida KT2440
cggcguugauccgg

SEQ ID NO: 1593879 - RNA, 20 nt, Pseudomonas putida KT2440
cggcuaaagccgcaccuaca

SEQ ID NO: 1593880 - RNA, 14 nt, Pseudomonas putida KT2440
cggcuaagcgccag

SEQ ID NO: 1593881 - RNA, 19 nt, Pseudomonas putida KT2440
cggcuaccgcauucuuggc

SEQ ID NO: 1593882 - RNA, 23 nt, Pseudomonas putida KT2440
cggcuacgcucguccaggcccug

SEQ ID NO: 1593883 - RNA, 22 nt, Pseudomonas putida KT2440
cggcuacgaaaccgacuugauu

SEQ ID NO: 1593884 - RNA, 22 nt, Pseudomonas putida KT2440
cggcguuggcuuccacggcgcg

SEQ ID NO: 1593885 - RNA, 19 nt, Pseudomonas putida KT2440
cggcuccaggcacaggcgc

SEQ ID NO: 1593886 - RNA, 22 nt, Pseudomonas putida KT2440
cggcuccaggugaaucagcggc

SEQ ID NO: 1593887 - RNA, 14 nt, Pseudomonas putida KT2440
cggcucaucaggcg

SEQ ID NO: 1593888 - RNA, 13 nt, Pseudomonas putida KT2440
cggcuagcgccug

SEQ ID NO: 1593889 - RNA, 14 nt, Pseudomonas putida KT2440
cggcuaucucaggc

SEQ ID NO: 1593890 - RNA, 19 nt, Pseudomonas putida KT2440
cggcucacccaccagccaa

SEQ ID NO: 1593891 - RNA, 20 nt, Pseudomonas putida KT2440
cggcucaacaccaucuucau

SEQ ID NO: 1593892 - RNA, 19 nt, Pseudomonas putida KT2440
cggcucaacagcaggugca

SEQ ID NO: 1593893 - RNA, 17 nt, Pseudomonas putida KT2440
cggcucaacagccacgc

SEQ ID NO: 1593894 - RNA, 14 nt, Pseudomonas putida KT2440
cggcuccgcgcaag

SEQ ID NO: 1593895 - RNA, 17 nt, Pseudomonas putida KT2440
cggcucgcaugagccgg

SEQ ID NO: 1593896 - RNA, 18 nt, Pseudomonas putida KT2440
cggcucgaccaagccuga

SEQ ID NO: 1593897 - RNA, 16 nt, Pseudomonas putida KT2440
cggcuccuugaugcug

SEQ ID NO: 1593898 - RNA, 17 nt, Pseudomonas putida KT2440
cggcucgcugaacacgc

SEQ ID NO: 1593899 - RNA, 17 nt, Pseudomonas putida KT2440
cggcuggugucggccag

SEQ ID NO: 1593900 - RNA, 19 nt, Pseudomonas putida KT2440
cggcugucaguggucuuca

SEQ ID NO: 1593901 - RNA, 15 nt, Pseudomonas putida KT2440
cggcuggauggcgcg

SEQ ID NO: 1593902 - RNA, 17 nt, Pseudomonas putida KT2440
cggcuggauggcgcggu

SEQ ID NO: 1593903 - RNA, 19 nt, Pseudomonas putida KT2440
cggcugcgacggcgaauga

SEQ ID NO: 1593904 - RNA, 18 nt, Pseudomonas putida KT2440
cggcucgucacugccguc

SEQ ID NO: 1593905 - RNA, 20 nt, Pseudomonas putida KT2440
cggcucguugaccguccaca

SEQ ID NO: 1593906 - RNA, 18 nt, Pseudomonas putida KT2440
cggcugaaaccgcgaauc

SEQ ID NO: 1593907 - RNA, 19 nt, Pseudomonas putida KT2440
cggcucugccgguguucgc

SEQ ID NO: 1593908 - RNA, 15 nt, Pseudomonas putida KT2440
cgggcggaaugcucg

SEQ ID NO: 1593909 - RNA, 18 nt, Pseudomonas putida KT2440
cgggcggagauuggccag

SEQ ID NO: 1593910 - RNA, 21 nt, Pseudomonas putida KT2440
cgggcggagauuggccagcag

SEQ ID NO: 1593911 - RNA, 13 nt, Pseudomonas putida KT2440
cgggcgcaggcaa

SEQ ID NO: 1593912 - RNA, 18 nt, Pseudomonas putida KT2440
cgggcucgcccgcgaaga

SEQ ID NO: 1593913 - RNA, 13 nt, Pseudomonas putida KT2440
cgggcgggugcau

SEQ ID NO: 1593914 - RNA, 18 nt, Pseudomonas putida KT2440
cgggcgguugggcaagug

SEQ ID NO: 1593915 - RNA, 14 nt, Pseudomonas putida KT2440
cgggccggcguugg

SEQ ID NO: 1593916 - RNA, 19 nt, Pseudomonas putida KT2440
cgggccugauuggcaucgc

SEQ ID NO: 1593917 - RNA, 19 nt, Pseudomonas putida KT2440
cgggcgaagcccgugccau

SEQ ID NO: 1593918 - RNA, 15 nt, Pseudomonas putida KT2440
cgggcgauugccagg

SEQ ID NO: 1593919 - RNA, 13 nt, Pseudomonas putida KT2440
cgggcgcaccacg

SEQ ID NO: 1593920 - RNA, 18 nt, Pseudomonas putida KT2440
cgggccgccguggugccg

SEQ ID NO: 1593921 - RNA, 13 nt, Pseudomonas putida KT2440
cgggccgccgaac

SEQ ID NO: 1593922 - RNA, 14 nt, Pseudomonas putida KT2440
cgggccgccgaaca

SEQ ID NO: 1593923 - RNA, 14 nt, Pseudomonas putida KT2440
cgggccaacuugcg

SEQ ID NO: 1593924 - RNA, 17 nt, Pseudomonas putida KT2440
cgggccaccaaaggccu

SEQ ID NO: 1593925 - RNA, 19 nt, Pseudomonas putida KT2440
cgggcacgaucagcagcaa

SEQ ID NO: 1593926 - RNA, 22 nt, Pseudomonas putida KT2440
cgggcaugcaggucgaccugcc

SEQ ID NO: 1593927 - RNA, 13 nt, Pseudomonas putida KT2440
cgggcaugcccgc

SEQ ID NO: 1593928 - RNA, 14 nt, Pseudomonas putida KT2440
cgggcaugcccgcg

SEQ ID NO: 1593929 - RNA, 20 nt, Pseudomonas putida KT2440
cgggcaugcccgcucccaca

SEQ ID NO: 1593930 - RNA, 12 nt, Pseudomonas putida KT2440
cgggcacgcccg

SEQ ID NO: 1593931 - RNA, 15 nt, Pseudomonas putida KT2440
cgggagucgaaccug

SEQ ID NO: 1593932 - RNA, 23 nt, Pseudomonas putida KT2440
cggcuugauauccagcaccggcg

SEQ ID NO: 1593933 - RNA, 16 nt, Pseudomonas putida KT2440
cgggcaaagcaccaug

SEQ ID NO: 1593934 - RNA, 13 nt, Pseudomonas putida KT2440
cgggcaaagccca

SEQ ID NO: 1593935 - RNA, 21 nt, Pseudomonas putida KT2440
cgggcaaacaggcugauguug

SEQ ID NO: 1593936 - RNA, 14 nt, Pseudomonas putida KT2440
cgggcaaacccgcg

SEQ ID NO: 1593937 - RNA, 20 nt, Pseudomonas putida KT2440
cgggcaaacccgcgccuaca

SEQ ID NO: 1593938 - RNA, 15 nt, Pseudomonas putida KT2440
cgggcacaucaccag

SEQ ID NO: 1593939 - RNA, 17 nt, Pseudomonas putida KT2440
cgggcacaucaccagca

SEQ ID NO: 1593940 - RNA, 22 nt, Pseudomonas putida KT2440
cgggcacaucaccagcagcuuc

SEQ ID NO: 1593941 - RNA, 14 nt, Pseudomonas putida KT2440
cgggcacaggccca

SEQ ID NO: 1593942 - RNA, 13 nt, Pseudomonas putida KT2440
cgggcacaggccg

SEQ ID NO: 1593943 - RNA, 18 nt, Pseudomonas putida KT2440
cgcugggcgguacccacc

SEQ ID NO: 1593944 - RNA, 16 nt, Pseudomonas putida KT2440
cgcugggcguccaggu

SEQ ID NO: 1593945 - RNA, 17 nt, Pseudomonas putida KT2440
cgcugggcuuacggucu

SEQ ID NO: 1593946 - RNA, 13 nt, Pseudomonas putida KT2440
cgcugggcuucuu

SEQ ID NO: 1593947 - RNA, 17 nt, Pseudomonas putida KT2440
cgcuggcuuguucggca

SEQ ID NO: 1593948 - RNA, 20 nt, Pseudomonas putida KT2440
cgcuggccuguucguuccca

SEQ ID NO: 1593949 - RNA, 15 nt, Pseudomonas putida KT2440
cgcuggccggacgac

SEQ ID NO: 1593950 - RNA, 14 nt, Pseudomonas putida KT2440
cgcuggcgaucagg

SEQ ID NO: 1593951 - RNA, 21 nt, Pseudomonas putida KT2440
cgcuggcgaucaggcaggcca

SEQ ID NO: 1593952 - RNA, 18 nt, Pseudomonas putida KT2440
cgcuggcgcagagggucu

SEQ ID NO: 1593953 - RNA, 23 nt, Pseudomonas putida KT2440
cgcuggcgaccggcguguugccg

SEQ ID NO: 1593954 - RNA, 15 nt, Pseudomonas putida KT2440
cgcuggcgacgaagc

SEQ ID NO: 1593955 - RNA, 18 nt, Pseudomonas putida KT2440
cgcuggcgacgaagcugc

SEQ ID NO: 1593956 - RNA, 13 nt, Pseudomonas putida KT2440
cgcuggcgggcaa

SEQ ID NO: 1593957 - RNA, 21 nt, Pseudomonas putida KT2440
cgcuggcgccagccgccacga

SEQ ID NO: 1593958 - RNA, 23 nt, Pseudomonas putida KT2440
cgcuggcgccagccgccacgacc

SEQ ID NO: 1593959 - RNA, 13 nt, Pseudomonas putida KT2440
cgcuggcgcuggu

SEQ ID NO: 1593960 - RNA, 16 nt, Pseudomonas putida KT2440
cgcuggagaacagcgu

SEQ ID NO: 1593961 - RNA, 18 nt, Pseudomonas putida KT2440
cgcuggagaacagcguca

SEQ ID NO: 1593962 - RNA, 13 nt, Pseudomonas putida KT2440
cgcuggagcggga

SEQ ID NO: 1593963 - RNA, 12 nt, Pseudomonas putida KT2440
cgcuggcaccca

SEQ ID NO: 1593964 - RNA, 15 nt, Pseudomonas putida KT2440
cgcuggccaccagca

SEQ ID NO: 1593965 - RNA, 15 nt, Pseudomonas putida KT2440
cgcuggccgcaccca

SEQ ID NO: 1593966 - RNA, 19 nt, Pseudomonas putida KT2440
cgcuggccgcacccagcag

SEQ ID NO: 1593967 - RNA, 17 nt, Pseudomonas putida KT2440
cgcuggcccuucgcgga

SEQ ID NO: 1593968 - RNA, 13 nt, Pseudomonas putida KT2440
cgcuggcccuugc

SEQ ID NO: 1593969 - RNA, 15 nt, Pseudomonas putida KT2440
cgcuggacagguaga

SEQ ID NO: 1593970 - RNA, 15 nt, Pseudomonas putida KT2440
cgcuggacgcuguca

SEQ ID NO: 1593971 - RNA, 21 nt, Pseudomonas putida KT2440
cgcuggaauuauuggccagca

SEQ ID NO: 1593972 - RNA, 13 nt, Pseudomonas putida KT2440
cgcuggacagcgg

SEQ ID NO: 1593973 - RNA, 17 nt, Pseudomonas putida KT2440
cgcuggacagcggcagc

SEQ ID NO: 1593974 - RNA, 21 nt, Pseudomonas putida KT2440
cgcugcugguacaugccgccg

SEQ ID NO: 1593975 - RNA, 22 nt, Pseudomonas putida KT2440
cgcugcugguccucgacgggca

SEQ ID NO: 1593976 - RNA, 21 nt, Pseudomonas putida KT2440
cgcugcuggcgcuccauguaa

SEQ ID NO: 1593977 - RNA, 13 nt, Pseudomonas putida KT2440
cgcugcucggccu

SEQ ID NO: 1593978 - RNA, 22 nt, Pseudomonas putida KT2440
cgcugcucggccucgaccacga

SEQ ID NO: 1593979 - RNA, 15 nt, Pseudomonas putida KT2440
cgcugcgucaggcca

SEQ ID NO: 1593980 - RNA, 21 nt, Pseudomonas putida KT2440
cgcugcgccgcucugcccgcg

SEQ ID NO: 1593981 - RNA, 16 nt, Pseudomonas putida KT2440
cgcugcgcaucacccg

SEQ ID NO: 1593982 - RNA, 21 nt, Pseudomonas putida KT2440
cgcugccuuuggccgccagcg

SEQ ID NO: 1593983 - RNA, 23 nt, Pseudomonas putida KT2440
cgcugccuugcccagcuccagca

SEQ ID NO: 1593984 - RNA, 16 nt, Pseudomonas putida KT2440
cgcugccugggcacca

SEQ ID NO: 1593985 - RNA, 13 nt, Pseudomonas putida KT2440
cgcugcgacucgc

SEQ ID NO: 1593986 - RNA, 20 nt, Pseudomonas putida KT2440
cgcugcgacucgcggccggu

SEQ ID NO: 1593987 - RNA, 19 nt, Pseudomonas putida KT2440
cgcugcgaggaucagcgca

SEQ ID NO: 1593988 - RNA, 23 nt, Pseudomonas putida KT2440
cgcugccuccacaccgacaucca

SEQ ID NO: 1593989 - RNA, 22 nt, Pseudomonas putida KT2440
cgcugccgucucgucacuggcu

SEQ ID NO: 1593990 - RNA, 16 nt, Pseudomonas putida KT2440
cgcugcccaacgccug

SEQ ID NO: 1593991 - RNA, 14 nt, Pseudomonas putida KT2440
cgcugccaggaagc

SEQ ID NO: 1593992 - RNA, 16 nt, Pseudomonas putida KT2440
cgcugccaggccgggu

SEQ ID NO: 1593993 - RNA, 18 nt, Pseudomonas putida KT2440
cgcugccauagcgcugca

SEQ ID NO: 1593994 - RNA, 21 nt, Pseudomonas putida KT2440
cgcugccauagcgcugcaccg

SEQ ID NO: 1593995 - RNA, 14 nt, Pseudomonas putida KT2440
cgcugccaugcgcu

SEQ ID NO: 1593996 - RNA, 18 nt, Pseudomonas putida KT2440
cgcugccaugcgcugcag

SEQ ID NO: 1593997 - RNA, 19 nt, Pseudomonas putida KT2440
cgcugccagcguuuccggg

SEQ ID NO: 1593998 - RNA, 19 nt, Pseudomonas putida KT2440
cgcugccagcugcgcugcc

SEQ ID NO: 1593999 - RNA, 15 nt, Pseudomonas putida KT2440
cgcugccacgcaugc

SEQ ID NO: 1594000 - RNA, 20 nt, Pseudomonas putida KT2440
cgcugcauugucauugccca

SEQ ID NO: 1594001 - RNA, 20 nt, Pseudomonas putida KT2440
cgcugccacagguacugcgc

SEQ ID NO: 1594002 - RNA, 19 nt, Pseudomonas putida KT2440
cgcugccaaaucagugacc

SEQ ID NO: 1594003 - RNA, 21 nt, Pseudomonas putida KT2440
cgcugccaaaguccggcgaag

SEQ ID NO: 1594004 - RNA, 22 nt, Pseudomonas putida KT2440
cgcugccaaaguccggcgaagc

SEQ ID NO: 1594005 - RNA, 16 nt, Pseudomonas putida KT2440
cgcugccgcaccugcc

SEQ ID NO: 1594006 - RNA, 15 nt, Pseudomonas putida KT2440
cgcugcccucggccg

SEQ ID NO: 1594007 - RNA, 14 nt, Pseudomonas putida KT2440
cgcugcccgggcaa

SEQ ID NO: 1594008 - RNA, 17 nt, Pseudomonas putida KT2440
cgcugcccgggcaaagc

SEQ ID NO: 1594009 - RNA, 19 nt, Pseudomonas putida KT2440
cgcugcccagcugaagugc

SEQ ID NO: 1594010 - RNA, 17 nt, Pseudomonas putida KT2440
cgcugcccaggugccag

SEQ ID NO: 1594011 - RNA, 18 nt, Pseudomonas putida KT2440
cgcugcccaggugccagg

SEQ ID NO: 1594012 - RNA, 19 nt, Pseudomonas putida KT2440
cgcugccccaagugccaga

SEQ ID NO: 1594013 - RNA, 19 nt, Pseudomonas putida KT2440
cgcugauccgcuuucggca

SEQ ID NO: 1594014 - RNA, 17 nt, Pseudomonas putida KT2440
cgcugaucgaaagcugc

SEQ ID NO: 1594015 - RNA, 23 nt, Pseudomonas putida KT2440
cgcugagggaaaacucggucagg

SEQ ID NO: 1594016 - RNA, 14 nt, Pseudomonas putida KT2440
cgcugauaaccugc

SEQ ID NO: 1594017 - RNA, 20 nt, Pseudomonas putida KT2440
cgcuccuggucaucgaagcc

SEQ ID NO: 1594018 - RNA, 16 nt, Pseudomonas putida KT2440
cgcuccuacaggccgc

SEQ ID NO: 1594019 - RNA, 19 nt, Pseudomonas putida KT2440
cgcuccuacauggaucgca

SEQ ID NO: 1594020 - RNA, 16 nt, Pseudomonas putida KT2440
cgcuccuacgacggcc

SEQ ID NO: 1594021 - RNA, 21 nt, Pseudomonas putida KT2440
cgcuccuacgacggccugcgc

SEQ ID NO: 1594022 - RNA, 14 nt, Pseudomonas putida KT2440
cgcuccuacgcggg

SEQ ID NO: 1594023 - RNA, 22 nt, Pseudomonas putida KT2440
cgcuccuacgcggggcagcgca

SEQ ID NO: 1594024 - RNA, 21 nt, Pseudomonas putida KT2440
cgcuccuacggaaucugcacc

SEQ ID NO: 1594025 - RNA, 17 nt, Pseudomonas putida KT2440
cgcuccuacggccgaca

SEQ ID NO: 1594026 - RNA, 16 nt, Pseudomonas putida KT2440
cgcuccuacuacggcc

SEQ ID NO: 1594027 - RNA, 17 nt, Pseudomonas putida KT2440
cgcuccuacuacggccu

SEQ ID NO: 1594028 - RNA, 15 nt, Pseudomonas putida KT2440
cgcucgaacaagcgc

SEQ ID NO: 1594029 - RNA, 14 nt, Pseudomonas putida KT2440
cgcucgacauccag

SEQ ID NO: 1594030 - RNA, 23 nt, Pseudomonas putida KT2440
cgcugcaccgaaggccgccggca

SEQ ID NO: 1594031 - RNA, 19 nt, Pseudomonas putida KT2440
cgcugcaaucgagccgaac

SEQ ID NO: 1594032 - RNA, 14 nt, Pseudomonas putida KT2440
cgcugcacaggcca

SEQ ID NO: 1594033 - RNA, 15 nt, Pseudomonas putida KT2440
cgcugcacaggccag

SEQ ID NO: 1594034 - RNA, 13 nt, Pseudomonas putida KT2440
cgcugaucgcggg

SEQ ID NO: 1594035 - RNA, 22 nt, Pseudomonas putida KT2440
cgcugauggccaauaccgcugc

SEQ ID NO: 1594036 - RNA, 17 nt, Pseudomonas putida KT2440
cgcugcauggcggcacc

SEQ ID NO: 1594037 - RNA, 17 nt, Pseudomonas putida KT2440
cgcuuuccaaaccugcg

SEQ ID NO: 1594038 - RNA, 16 nt, Pseudomonas putida KT2440
cgcuuugcacccgcgc

SEQ ID NO: 1594039 - RNA, 20 nt, Pseudomonas putida KT2440
cgcuuugcacccgcgcgcug

SEQ ID NO: 1594040 - RNA, 24 nt, Pseudomonas putida KT2440
cgcuuguaaagaauucggacugug

SEQ ID NO: 1594041 - RNA, 20 nt, Pseudomonas putida KT2440
cgcuuggcaccggcagcagc

SEQ ID NO: 1594042 - RNA, 16 nt, Pseudomonas putida KT2440
cgcuuggccaccacgu

SEQ ID NO: 1594043 - RNA, 18 nt, Pseudomonas putida KT2440
cgcuugcgguccugcacc

SEQ ID NO: 1594044 - RNA, 23 nt, Pseudomonas putida KT2440
cgcuuggaguugcucgagugcga

SEQ ID NO: 1594045 - RNA, 22 nt, Pseudomonas putida KT2440
cgcuuggaaauguucaacagcc

SEQ ID NO: 1594046 - RNA, 23 nt, Pseudomonas putida KT2440
cgcuuggaaauguucaacagccg

SEQ ID NO: 1594047 - RNA, 16 nt, Pseudomonas putida KT2440
cgcuuugcgcaaccga

SEQ ID NO: 1594048 - RNA, 18 nt, Pseudomonas putida KT2440
cgcuuuucuucgcugcug

SEQ ID NO: 1594049 - RNA, 23 nt, Pseudomonas putida KT2440
cggaacagguugaccaacgccag

SEQ ID NO: 1594050 - RNA, 20 nt, Pseudomonas putida KT2440
cggaaaacuccugcuggucg

SEQ ID NO: 1594051 - RNA, 15 nt, Pseudomonas putida KT2440
cggacaaccaagcga

SEQ ID NO: 1594052 - RNA, 15 nt, Pseudomonas putida KT2440
cggacaacaccguug

SEQ ID NO: 1594053 - RNA, 19 nt, Pseudomonas putida KT2440
cggacaauuucugcgucgu

SEQ ID NO: 1594054 - RNA, 22 nt, Pseudomonas putida KT2440
cggacaacuuggcaccgacccg

SEQ ID NO: 1594055 - RNA, 20 nt, Pseudomonas putida KT2440
cggaauucgcggcggcgcga

SEQ ID NO: 1594056 - RNA, 14 nt, Pseudomonas putida KT2440
cggaaugcucguca

SEQ ID NO: 1594057 - RNA, 15 nt, Pseudomonas putida KT2440
cggaaugucggcguu

SEQ ID NO: 1594058 - RNA, 22 nt, Pseudomonas putida KT2440
cggaacagugguuugcguugau

SEQ ID NO: 1594059 - RNA, 19 nt, Pseudomonas putida KT2440
cggaacaugguguugggca

SEQ ID NO: 1594060 - RNA, 12 nt, Pseudomonas putida KT2440
cggaacucggcg

SEQ ID NO: 1594061 - RNA, 18 nt, Pseudomonas putida KT2440
cggaacucggcgaucugg

SEQ ID NO: 1594062 - RNA, 22 nt, Pseudomonas putida KT2440
cggaacucggcgaucuggucga

SEQ ID NO: 1594063 - RNA, 21 nt, Pseudomonas putida KT2440
cggaacgucguugcaguucac

SEQ ID NO: 1594064 - RNA, 16 nt, Pseudomonas putida KT2440
cggaacguuuccagca

SEQ ID NO: 1594065 - RNA, 22 nt, Pseudomonas putida KT2440
cggaaggcgucacgcagggcca

SEQ ID NO: 1594066 - RNA, 16 nt, Pseudomonas putida KT2440
cggaagcucuccaggg

SEQ ID NO: 1594067 - RNA, 20 nt, Pseudomonas putida KT2440
cggaagaucaccuggucgac

SEQ ID NO: 1594068 - RNA, 21 nt, Pseudomonas putida KT2440
cggaagaucaccuggucgacc

SEQ ID NO: 1594069 - RNA, 22 nt, Pseudomonas putida KT2440
cgcugucggucagcaucugggu

SEQ ID NO: 1594070 - RNA, 22 nt, Pseudomonas putida KT2440
cgcugucuucugccagaggcgc

SEQ ID NO: 1594071 - RNA, 13 nt, Pseudomonas putida KT2440
cgcugucguccag

SEQ ID NO: 1594072 - RNA, 23 nt, Pseudomonas putida KT2440
cgcugucguccagcucgcgcagg

SEQ ID NO: 1594073 - RNA, 13 nt, Pseudomonas putida KT2440
cgcugugccagcg

SEQ ID NO: 1594074 - RNA, 21 nt, Pseudomonas putida KT2440
cgcuguggcgcccggcgcugg

SEQ ID NO: 1594075 - RNA, 13 nt, Pseudomonas putida KT2440
cgcuguuggcagc

SEQ ID NO: 1594076 - RNA, 15 nt, Pseudomonas putida KT2440
cgcuguuggcagcca

SEQ ID NO: 1594077 - RNA, 14 nt, Pseudomonas putida KT2440
cgcuguugagcagc

SEQ ID NO: 1594078 - RNA, 13 nt, Pseudomonas putida KT2440
cgcugugcucagc

SEQ ID NO: 1594079 - RNA, 22 nt, Pseudomonas putida KT2440
cgcuuacagaugucuggcauca

SEQ ID NO: 1594080 - RNA, 14 nt, Pseudomonas putida KT2440
cgcuguacguccaa

SEQ ID NO: 1594081 - RNA, 14 nt, Pseudomonas putida KT2440
cgcuguccagcgca

SEQ ID NO: 1594082 - RNA, 19 nt, Pseudomonas putida KT2440
cgcugucccccagcccuga

SEQ ID NO: 1594083 - RNA, 21 nt, Pseudomonas putida KT2440
cgcuguaggggcgggccugcu

SEQ ID NO: 1594084 - RNA, 22 nt, Pseudomonas putida KT2440
cgcugucauccugcguggcggu

SEQ ID NO: 1594085 - RNA, 20 nt, Pseudomonas putida KT2440
cgcugucgauuuccagugcc

SEQ ID NO: 1594086 - RNA, 19 nt, Pseudomonas putida KT2440
cgcuugcgcauggccgcca

SEQ ID NO: 1594087 - RNA, 21 nt, Pseudomonas putida KT2440
cgcuugcgcauggccgccaca

SEQ ID NO: 1594088 - RNA, 16 nt, Pseudomonas putida KT2440
cgcuugcccggcucca

SEQ ID NO: 1594089 - RNA, 19 nt, Pseudomonas putida KT2440
cgcuugccacccaggcccu

SEQ ID NO: 1594090 - RNA, 21 nt, Pseudomonas putida KT2440
cgcuugccacggcguggagcg

SEQ ID NO: 1594091 - RNA, 16 nt, Pseudomonas putida KT2440
cgcuugaggcuuucaa

SEQ ID NO: 1594092 - RNA, 21 nt, Pseudomonas putida KT2440
cgcuugaucugccaggcacca

SEQ ID NO: 1594093 - RNA, 16 nt, Pseudomonas putida KT2440
cgcuugaagaagccuu

SEQ ID NO: 1594094 - RNA, 18 nt, Pseudomonas putida KT2440
cgcuucuuugcgauccag

SEQ ID NO: 1594095 - RNA, 21 nt, Pseudomonas putida KT2440
cgcuucuggacaagaagcggc

SEQ ID NO: 1594096 - RNA, 18 nt, Pseudomonas putida KT2440
cgcuucggcgcgggcacc

SEQ ID NO: 1594097 - RNA, 17 nt, Pseudomonas putida KT2440
cgcuucgaucgccggca

SEQ ID NO: 1594098 - RNA, 13 nt, Pseudomonas putida KT2440
cgcuucgcggcca

SEQ ID NO: 1594099 - RNA, 15 nt, Pseudomonas putida KT2440
cgcuucgccgcgcug

SEQ ID NO: 1594100 - RNA, 20 nt, Pseudomonas putida KT2440
cgcuucacccucgcgcagca

SEQ ID NO: 1594101 - RNA, 20 nt, Pseudomonas putida KT2440
cgcuucacgucuggcaccag

SEQ ID NO: 1594102 - RNA, 23 nt, Pseudomonas putida KT2440
cgcgucgacaaaccgcacccggc

SEQ ID NO: 1594103 - RNA, 15 nt, Pseudomonas putida KT2440
cgcguccuugaucag

SEQ ID NO: 1594104 - RNA, 21 nt, Pseudomonas putida KT2440
cgcguccuggacccgcagcag

SEQ ID NO: 1594105 - RNA, 14 nt, Pseudomonas putida KT2440
cgcgucccccggua

SEQ ID NO: 1594106 - RNA, 17 nt, Pseudomonas putida KT2440
cgcgucccccgguacca

SEQ ID NO: 1594107 - RNA, 14 nt, Pseudomonas putida KT2440
cgcgucagcucaag

SEQ ID NO: 1594108 - RNA, 18 nt, Pseudomonas putida KT2440
cgcggugggucgacgaac

SEQ ID NO: 1594109 - RNA, 22 nt, Pseudomonas putida KT2440
cgcguacgaagcucuggucgau

SEQ ID NO: 1594110 - RNA, 14 nt, Pseudomonas putida KT2440
cgcguacgaauacg

SEQ ID NO: 1594111 - RNA, 22 nt, Pseudomonas putida KT2440
cgcgguaaagaacaugaucaag

SEQ ID NO: 1594112 - RNA, 13 nt, Pseudomonas putida KT2440
cgcgguaccugug

SEQ ID NO: 1594113 - RNA, 19 nt, Pseudomonas putida KT2440
cgcgguaccuguggggcaa

SEQ ID NO: 1594114 - RNA, 23 nt, Pseudomonas putida KT2440
cgcgguaaugcgcacggcuucgc

SEQ ID NO: 1594115 - RNA, 20 nt, Pseudomonas putida KT2440
cgcgguacaccgggaacagg

SEQ ID NO: 1594116 - RNA, 20 nt, Pseudomonas putida KT2440
cgcgguaagauugcaggcca

SEQ ID NO: 1594117 - RNA, 20 nt, Pseudomonas putida KT2440
cgcggguuuacccgcgaaga

SEQ ID NO: 1594118 - RNA, 20 nt, Pseudomonas putida KT2440
cgcgggcaagcccgcaccca

SEQ ID NO: 1594119 - RNA, 20 nt, Pseudomonas putida KT2440
cgcgggcaagcccgcuccca

SEQ ID NO: 1594120 - RNA, 21 nt, Pseudomonas putida KT2440
cgcgggcaauguccaggugcu

SEQ ID NO: 1594121 - RNA, 20 nt, Pseudomonas putida KT2440
cgcgggcaaacccgcgccua

SEQ ID NO: 1594122 - RNA, 21 nt, Pseudomonas putida KT2440
cgcgggcaaacccgcgccuac

SEQ ID NO: 1594123 - RNA, 22 nt, Pseudomonas putida KT2440
cgcgggcaaacccgcgccuaca

SEQ ID NO: 1594124 - RNA, 21 nt, Pseudomonas putida KT2440
cgcgggcacgcccgcucccac

SEQ ID NO: 1594125 - RNA, 23 nt, Pseudomonas putida KT2440
cgcggucuuguaucccaggcgcu

SEQ ID NO: 1594126 - RNA, 19 nt, Pseudomonas putida KT2440
cgcggugaccagcggcagc

SEQ ID NO: 1594127 - RNA, 20 nt, Pseudomonas putida KT2440
cgcggugaccagcggcagca

SEQ ID NO: 1594128 - RNA, 22 nt, Pseudomonas putida KT2440
cgcggugauggcgcauggccug

SEQ ID NO: 1594129 - RNA, 14 nt, Pseudomonas putida KT2440
cgcgguccuugccg

SEQ ID NO: 1594130 - RNA, 17 nt, Pseudomonas putida KT2440
cgcggucugcggcagca

SEQ ID NO: 1594131 - RNA, 16 nt, Pseudomonas putida KT2440
cgcucaccggccagcg

SEQ ID NO: 1594132 - RNA, 20 nt, Pseudomonas putida KT2440
cgcucaccggccagcgcgcu

SEQ ID NO: 1594133 - RNA, 18 nt, Pseudomonas putida KT2440
cgcucaccuacugccguc

SEQ ID NO: 1594134 - RNA, 23 nt, Pseudomonas putida KT2440
cgcuacgagagaucgcagcgagc

SEQ ID NO: 1594135 - RNA, 21 nt, Pseudomonas putida KT2440
cgcucagccgauacgcuguac

SEQ ID NO: 1594136 - RNA, 16 nt, Pseudomonas putida KT2440
cgcucaggccaugcug

SEQ ID NO: 1594137 - RNA, 18 nt, Pseudomonas putida KT2440
cgcucaggccaugcugcg

SEQ ID NO: 1594138 - RNA, 17 nt, Pseudomonas putida KT2440
cgcuccaucaugcgguc

SEQ ID NO: 1594139 - RNA, 20 nt, Pseudomonas putida KT2440
cgcuccauccagucggcgcu

SEQ ID NO: 1594140 - RNA, 20 nt, Pseudomonas putida KT2440
cgcucccacagggaucgcgc

SEQ ID NO: 1594141 - RNA, 22 nt, Pseudomonas putida KT2440
cgcucccacagggaucgcgcca

SEQ ID NO: 1594142 - RNA, 23 nt, Pseudomonas putida KT2440
cgcucccacagguccagcgcagg

SEQ ID NO: 1594143 - RNA, 20 nt, Pseudomonas putida KT2440
cgcucccacgaggaccugcg

SEQ ID NO: 1594144 - RNA, 16 nt, Pseudomonas putida KT2440
cgcucagguaggcagc

SEQ ID NO: 1594145 - RNA, 15 nt, Pseudomonas putida KT2440
cgcucaggugcaccu

SEQ ID NO: 1594146 - RNA, 16 nt, Pseudomonas putida KT2440
cgcucaggugcaccuc

SEQ ID NO: 1594147 - RNA, 23 nt, Pseudomonas putida KT2440
cgcuccgccaauugcgccagccg

SEQ ID NO: 1594148 - RNA, 19 nt, Pseudomonas putida KT2440
cgcuccgacaaaugcacca

SEQ ID NO: 1594149 - RNA, 19 nt, Pseudomonas putida KT2440
cgcguucaugccggcccca

SEQ ID NO: 1594150 - RNA, 13 nt, Pseudomonas putida KT2440
cgcguuggcagca

SEQ ID NO: 1594151 - RNA, 16 nt, Pseudomonas putida KT2440
cgcguuguucagcagc

SEQ ID NO: 1594152 - RNA, 19 nt, Pseudomonas putida KT2440
cgcguuucggcggccugca

SEQ ID NO: 1594153 - RNA, 14 nt, Pseudomonas putida KT2440
cgcguuucgaucuc

SEQ ID NO: 1594154 - RNA, 13 nt, Pseudomonas putida KT2440
cgcguugucaggc

SEQ ID NO: 1594155 - RNA, 13 nt, Pseudomonas putida KT2440
cgcgugcgauguu

SEQ ID NO: 1594156 - RNA, 17 nt, Pseudomonas putida KT2440
cgcgugccugagccuug

SEQ ID NO: 1594157 - RNA, 21 nt, Pseudomonas putida KT2440
cgcgucgauacgcugcugguc

SEQ ID NO: 1594158 - RNA, 22 nt, Pseudomonas putida KT2440
cgcggcgaacacagcggccuug

SEQ ID NO: 1594159 - RNA, 16 nt, Pseudomonas putida KT2440
cgcggccuugccguag

SEQ ID NO: 1594160 - RNA, 15 nt, Pseudomonas putida KT2440
cgcggccugcuccac

SEQ ID NO: 1594161 - RNA, 16 nt, Pseudomonas putida KT2440
cgcggcccagcccagu

SEQ ID NO: 1594162 - RNA, 23 nt, Pseudomonas putida KT2440
cgcggcccccuguagauaggcug

SEQ ID NO: 1594163 - RNA, 22 nt, Pseudomonas putida KT2440
cgcggccgaaguggcggcucgc

SEQ ID NO: 1594164 - RNA, 19 nt, Pseudomonas putida KT2440
aacagcagcgccgccaggc

SEQ ID NO: 1594165 - RNA, 17 nt, Pseudomonas putida KT2440
cgcggcgcaucgcgagc

SEQ ID NO: 1594166 - RNA, 15 nt, Pseudomonas putida KT2440
aacagcaguugcugc

SEQ ID NO: 1594167 - RNA, 18 nt, Pseudomonas putida KT2440
aacagcauccaaagccaa

SEQ ID NO: 1594168 - RNA, 13 nt, Pseudomonas putida KT2440
aacagccgggcag

SEQ ID NO: 1594169 - RNA, 22 nt, Pseudomonas putida KT2440
aacagccccaucaccagcccga

SEQ ID NO: 1594170 - RNA, 21 nt, Pseudomonas putida KT2440
cgcggcucgcugcgcuggcca

SEQ ID NO: 1594171 - RNA, 14 nt, Pseudomonas putida KT2440
cgcggcuacgcucg

SEQ ID NO: 1594172 - RNA, 14 nt, Pseudomonas putida KT2440
cgcggcuucgaugc

SEQ ID NO: 1594173 - RNA, 19 nt, Pseudomonas putida KT2440
cgcggcuucgaugcccggc

SEQ ID NO: 1594174 - RNA, 14 nt, Pseudomonas putida KT2440
cgcgcuguuccagc

SEQ ID NO: 1594175 - RNA, 21 nt, Pseudomonas putida KT2440
cgcgcuuggagaagcgaucga

SEQ ID NO: 1594176 - RNA, 13 nt, Pseudomonas putida KT2440
cgcggcaugcccg

SEQ ID NO: 1594177 - RNA, 16 nt, Pseudomonas putida KT2440
cgcggcaugugcgggu

SEQ ID NO: 1594178 - RNA, 19 nt, Pseudomonas putida KT2440
cgcggcagcaugaacagcg

SEQ ID NO: 1594179 - RNA, 14 nt, Pseudomonas putida KT2440
cgcggcagcagcag

SEQ ID NO: 1594180 - RNA, 17 nt, Pseudomonas putida KT2440
cgcggcaaucacgaaca

SEQ ID NO: 1594181 - RNA, 14 nt, Pseudomonas putida KT2440
cgcggcaagcccgc

SEQ ID NO: 1594182 - RNA, 13 nt, Pseudomonas putida KT2440
cgcggcaaccugc

SEQ ID NO: 1594183 - RNA, 14 nt, Pseudomonas putida KT2440
cgcggcaaccugca

SEQ ID NO: 1594184 - RNA, 21 nt, Pseudomonas putida KT2440
cgcggcaaacuucucgccuca

SEQ ID NO: 1594185 - RNA, 21 nt, Pseudomonas putida KT2440
cgcggcaaagaucgcccagcu

SEQ ID NO: 1594186 - RNA, 19 nt, Pseudomonas putida KT2440
cgcggcaaagguggcaccg

SEQ ID NO: 1594187 - RNA, 12 nt, Pseudomonas putida KT2440
cgcgacgcagca

SEQ ID NO: 1594188 - RNA, 15 nt, Pseudomonas putida KT2440
cgcgaccucagccgu

SEQ ID NO: 1594189 - RNA, 23 nt, Pseudomonas putida KT2440
cgcgagccucuguuugcugguca

SEQ ID NO: 1594190 - RNA, 18 nt, Pseudomonas putida KT2440
cgcgagccuugccaacgg

SEQ ID NO: 1594191 - RNA, 20 nt, Pseudomonas putida KT2440
cgcgaggaaacccgcgccua

SEQ ID NO: 1594192 - RNA, 19 nt, Pseudomonas putida KT2440
cgcgagggcaucagcgcac

SEQ ID NO: 1594193 - RNA, 18 nt, Pseudomonas putida KT2440
cgcgagcguuaccaacag

SEQ ID NO: 1594194 - RNA, 23 nt, Pseudomonas putida KT2440
cgcgagcuggagaucuugucgac

SEQ ID NO: 1594195 - RNA, 17 nt, Pseudomonas putida KT2440
cgcgaucacgcaggccc

SEQ ID NO: 1594196 - RNA, 17 nt, Pseudomonas putida KT2440
cgcgaguaaagccagca

SEQ ID NO: 1594197 - RNA, 18 nt, Pseudomonas putida KT2440
cgcgaguaaagccagcag

SEQ ID NO: 1594198 - RNA, 21 nt, Pseudomonas putida KT2440
cgcgaguaaagccagcagccu

SEQ ID NO: 1594199 - RNA, 14 nt, Pseudomonas putida KT2440
cgcgaguaacgccc

SEQ ID NO: 1594200 - RNA, 19 nt, Pseudomonas putida KT2440
cgcgagugucgaugucgau

SEQ ID NO: 1594201 - RNA, 19 nt, Pseudomonas putida KT2440
cgcgagucaggcugcacaa

SEQ ID NO: 1594202 - RNA, 17 nt, Pseudomonas putida KT2440
cgcgauucguagcgguu

SEQ ID NO: 1594203 - RNA, 17 nt, Pseudomonas putida KT2440
cgcgauugaucagcgcc

SEQ ID NO: 1594204 - RNA, 19 nt, Pseudomonas putida KT2440
cgcgauugaucagcgccuc

SEQ ID NO: 1594205 - RNA, 22 nt, Pseudomonas putida KT2440
cgcgcaacagcaaggcaucggc

SEQ ID NO: 1594206 - RNA, 17 nt, Pseudomonas putida KT2440
cgcgcaaaggcuagcag

SEQ ID NO: 1594207 - RNA, 16 nt, Pseudomonas putida KT2440
cgcgcaaaucgccgca

SEQ ID NO: 1594208 - RNA, 17 nt, Pseudomonas putida KT2440
cgcgcaaaugcuugccc

SEQ ID NO: 1594209 - RNA, 16 nt, Pseudomonas putida KT2440
cgcgcaacaaggccaa

SEQ ID NO: 1594210 - RNA, 15 nt, Pseudomonas putida KT2440
cgcgcaacaccgcca

SEQ ID NO: 1594211 - RNA, 20 nt, Pseudomonas putida KT2440
cgcgcagauuccgcgauagc

SEQ ID NO: 1594212 - RNA, 22 nt, Pseudomonas putida KT2440
cgcgcagcacaucacacagcgg

SEQ ID NO: 1594213 - RNA, 16 nt, Pseudomonas putida KT2440
cgcgcauccuccgccc

SEQ ID NO: 1594214 - RNA, 23 nt, Pseudomonas putida KT2440
cgcgcauccggaauuucugcacc

SEQ ID NO: 1594215 - RNA, 18 nt, Pseudomonas putida KT2440
cgcgcauccacaggcgcc

SEQ ID NO: 1594216 - RNA, 12 nt, Pseudomonas putida KT2440
cgcgcaggcgcu

SEQ ID NO: 1594217 - RNA, 18 nt, Pseudomonas putida KT2440
cgcgccagcaaugcccgc

SEQ ID NO: 1594218 - RNA, 13 nt, Pseudomonas putida KT2440
cgcgccagcgcau

SEQ ID NO: 1594219 - RNA, 15 nt, Pseudomonas putida KT2440
cgcgccagcgcaugc

SEQ ID NO: 1594220 - RNA, 13 nt, Pseudomonas putida KT2440
cgcgccauggccu

SEQ ID NO: 1594221 - RNA, 22 nt, Pseudomonas putida KT2440
cgcgccauggccucgucgcggu

SEQ ID NO: 1594222 - RNA, 17 nt, Pseudomonas putida KT2440
cgcgccaucuucacggc

SEQ ID NO: 1594223 - RNA, 19 nt, Pseudomonas putida KT2440
cgcgccgauugcugccgac

SEQ ID NO: 1594224 - RNA, 18 nt, Pseudomonas putida KT2440
cgcgccgcaaagacugcc

SEQ ID NO: 1594225 - RNA, 20 nt, Pseudomonas putida KT2440
cgcgcccaaggucagccaga

SEQ ID NO: 1594226 - RNA, 14 nt, Pseudomonas putida KT2440
cgcgccauuggccg

SEQ ID NO: 1594227 - RNA, 20 nt, Pseudomonas putida KT2440
cgcgcccugcucauccagca

SEQ ID NO: 1594228 - RNA, 15 nt, Pseudomonas putida KT2440
cgcgcccugugggag

SEQ ID NO: 1594229 - RNA, 16 nt, Pseudomonas putida KT2440
cgcgacagcguugcuc

SEQ ID NO: 1594230 - RNA, 18 nt, Pseudomonas putida KT2440
cgcgacaugaucagcggg

SEQ ID NO: 1594231 - RNA, 20 nt, Pseudomonas putida KT2440
cgcgaccaucaccgccagca

SEQ ID NO: 1594232 - RNA, 21 nt, Pseudomonas putida KT2440
cgcgaccaucaccgccagcau

SEQ ID NO: 1594233 - RNA, 18 nt, Pseudomonas putida KT2440
cgcgaaugcuccggcgac

SEQ ID NO: 1594234 - RNA, 21 nt, Pseudomonas putida KT2440
cgcgaaugcuccggcgacagc

SEQ ID NO: 1594235 - RNA, 15 nt, Pseudomonas putida KT2440
cgcgaaucgccuuca

SEQ ID NO: 1594236 - RNA, 18 nt, Pseudomonas putida KT2440
cgcgaaucagcgccucca

SEQ ID NO: 1594237 - RNA, 19 nt, Pseudomonas putida KT2440
cgcgaaucagcgccuccag

SEQ ID NO: 1594238 - RNA, 22 nt, Pseudomonas putida KT2440
cgcgaaugggccgcaaagcggc

SEQ ID NO: 1594239 - RNA, 22 nt, Pseudomonas putida KT2440
cgcgaaugggccgccaagcggc

SEQ ID NO: 1594240 - RNA, 18 nt, Pseudomonas putida KT2440
cgcgaauacgauagcggc

SEQ ID NO: 1594241 - RNA, 22 nt, Pseudomonas putida KT2440
cgcgaauacgguagcggcagca

SEQ ID NO: 1594242 - RNA, 21 nt, Pseudomonas putida KT2440
cgcgaauacgguaguggcggc

SEQ ID NO: 1594243 - RNA, 22 nt, Pseudomonas putida KT2440
cgcgaauacgguggcggcagca

SEQ ID NO: 1594244 - RNA, 20 nt, Pseudomonas putida KT2440
cgcgaagggccgcaaagcgg

SEQ ID NO: 1594245 - RNA, 16 nt, Pseudomonas putida KT2440
cgcgaagaggccagca

SEQ ID NO: 1594246 - RNA, 17 nt, Pseudomonas putida KT2440
cgcgaagaggccagcac

SEQ ID NO: 1594247 - RNA, 22 nt, Pseudomonas putida KT2440
cgcgaagagggcgacaccgguc

SEQ ID NO: 1594248 - RNA, 13 nt, Pseudomonas putida KT2440
cgccuugcgccag

SEQ ID NO: 1594249 - RNA, 13 nt, Pseudomonas putida KT2440
cgccuugcgcacg

SEQ ID NO: 1594250 - RNA, 15 nt, Pseudomonas putida KT2440
cgccuuggcgcagca

SEQ ID NO: 1594251 - RNA, 14 nt, Pseudomonas putida KT2440
cgccuuggcuuccu

SEQ ID NO: 1594252 - RNA, 15 nt, Pseudomonas putida KT2440
cgccuugucggcacg

SEQ ID NO: 1594253 - RNA, 20 nt, Pseudomonas putida KT2440
cgccuucguacaucggguaa

SEQ ID NO: 1594254 - RNA, 17 nt, Pseudomonas putida KT2440
cgccuugaagcuggccg

SEQ ID NO: 1594255 - RNA, 16 nt, Pseudomonas putida KT2440
cgcgaaagggccagca

SEQ ID NO: 1594256 - RNA, 20 nt, Pseudomonas putida KT2440
cgcgaaagggccgcgacgcg

SEQ ID NO: 1594257 - RNA, 20 nt, Pseudomonas putida KT2440
cgcgaaaggggcgcaaugcg

SEQ ID NO: 1594258 - RNA, 15 nt, Pseudomonas putida KT2440
cgcgaaacgcggcaa

SEQ ID NO: 1594259 - RNA, 22 nt, Pseudomonas putida KT2440
cgcgaaagcgaagaagcuaaag

SEQ ID NO: 1594260 - RNA, 13 nt, Pseudomonas putida KT2440
cgccuuguuccgc

SEQ ID NO: 1594261 - RNA, 17 nt, Pseudomonas putida KT2440
cgccuuuuccaccagcc

SEQ ID NO: 1594262 - RNA, 15 nt, Pseudomonas putida KT2440
cgccugcaauucgau

SEQ ID NO: 1594263 - RNA, 20 nt, Pseudomonas putida KT2440
cgccugauuacccugcgcca

SEQ ID NO: 1594264 - RNA, 23 nt, Pseudomonas putida KT2440
cgccugcccgccccccaccuggc

SEQ ID NO: 1594265 - RNA, 17 nt, Pseudomonas putida KT2440
cgccugcgccagcgggu

SEQ ID NO: 1594266 - RNA, 21 nt, Pseudomonas putida KT2440
cgccugccgaugggcacuggc

SEQ ID NO: 1594267 - RNA, 18 nt, Pseudomonas putida KT2440
cgccugccgggucaaggc

SEQ ID NO: 1594268 - RNA, 14 nt, Pseudomonas putida KT2440
cgccucgugcagcu

SEQ ID NO: 1594269 - RNA, 19 nt, Pseudomonas putida KT2440
cgccucgggcgcucgcggu

SEQ ID NO: 1594270 - RNA, 16 nt, Pseudomonas putida KT2440
cgccucgacgcagaca

SEQ ID NO: 1594271 - RNA, 12 nt, Pseudomonas putida KT2440
cgccuccugcug

SEQ ID NO: 1594272 - RNA, 15 nt, Pseudomonas putida KT2440
cgccuccugcugcug

SEQ ID NO: 1594273 - RNA, 14 nt, Pseudomonas putida KT2440
cgccuccagcuggc

SEQ ID NO: 1594274 - RNA, 19 nt, Pseudomonas putida KT2440
cgccuccaggcguugcggg

SEQ ID NO: 1594275 - RNA, 16 nt, Pseudomonas putida KT2440
cgccuccacggucagc

SEQ ID NO: 1594276 - RNA, 24 nt, Pseudomonas putida KT2440
cgccuccaccuggaauucgcugcg

SEQ ID NO: 1594277 - RNA, 11 nt, Pseudomonas putida KT2440
cgccuccagca

SEQ ID NO: 1594278 - RNA, 17 nt, Pseudomonas putida KT2440
cgccuccagcaggggca

SEQ ID NO: 1594279 - RNA, 14 nt, Pseudomonas putida KT2440
cgccuccaccggga

SEQ ID NO: 1594280 - RNA, 18 nt, Pseudomonas putida KT2440
cgccuccaccgggauggc

SEQ ID NO: 1594281 - RNA, 12 nt, Pseudomonas putida KT2440
cgccuggcgcag

SEQ ID NO: 1594282 - RNA, 12 nt, Pseudomonas putida KT2440
cgccuggccaua

SEQ ID NO: 1594283 - RNA, 15 nt, Pseudomonas putida KT2440
cgccuggccgcugcg

SEQ ID NO: 1594284 - RNA, 22 nt, Pseudomonas putida KT2440
cgccugggaaaccgugucgggc

SEQ ID NO: 1594285 - RNA, 14 nt, Pseudomonas putida KT2440
cgccugcuuggcac

SEQ ID NO: 1594286 - RNA, 14 nt, Pseudomonas putida KT2440
cgccugcuggccgc

SEQ ID NO: 1594287 - RNA, 14 nt, Pseudomonas putida KT2440
cgccuggugccagc

SEQ ID NO: 1594288 - RNA, 17 nt, Pseudomonas putida KT2440
cgccuggugccagcggc

SEQ ID NO: 1594289 - RNA, 13 nt, Pseudomonas putida KT2440
cgccuguguucgc

SEQ ID NO: 1594290 - RNA, 20 nt, Pseudomonas putida KT2440
cgccugugcggccaaugcac

SEQ ID NO: 1594291 - RNA, 20 nt, Pseudomonas putida KT2440
cgccugugagaucgagcgcc

SEQ ID NO: 1594292 - RNA, 17 nt, Pseudomonas putida KT2440
cgccuucagcagccggu

SEQ ID NO: 1594293 - RNA, 14 nt, Pseudomonas putida KT2440
cgccuguuucgggu

SEQ ID NO: 1594294 - RNA, 13 nt, Pseudomonas putida KT2440
cgccuguuucuca

SEQ ID NO: 1594295 - RNA, 12 nt, Pseudomonas putida KT2440
cgccguccagca

SEQ ID NO: 1594296 - RNA, 12 nt, Pseudomonas putida KT2440
cgccgucaucga

SEQ ID NO: 1594297 - RNA, 15 nt, Pseudomonas putida KT2440
cgccguccaccaucu

SEQ ID NO: 1594298 - RNA, 17 nt, Pseudomonas putida KT2440
cgccguauucaccggua

SEQ ID NO: 1594299 - RNA, 22 nt, Pseudomonas putida KT2440
cgccguagccaaccgagucaac

SEQ ID NO: 1594300 - RNA, 21 nt, Pseudomonas putida KT2440
cgccgguuucucgcagcagca

SEQ ID NO: 1594301 - RNA, 22 nt, Pseudomonas putida KT2440
cgccgguuucucgcagcagcac

SEQ ID NO: 1594302 - RNA, 18 nt, Pseudomonas putida KT2440
cgccgguuucccgaugaa

SEQ ID NO: 1594303 - RNA, 14 nt, Pseudomonas putida KT2440
cgccgguuucguca

SEQ ID NO: 1594304 - RNA, 19 nt, Pseudomonas putida KT2440
cgccgguuucgucaggaag

SEQ ID NO: 1594305 - RNA, 13 nt, Pseudomonas putida KT2440
cgccgguaucacc

SEQ ID NO: 1594306 - RNA, 19 nt, Pseudomonas putida KT2440
cgccgggccuugaccagca

SEQ ID NO: 1594307 - RNA, 14 nt, Pseudomonas putida KT2440
aacacgaacaccgg

SEQ ID NO: 1594308 - RNA, 21 nt, Pseudomonas putida KT2440
cgccgguagcggcugggcgcg

SEQ ID NO: 1594309 - RNA, 18 nt, Pseudomonas putida KT2440
cgccgguagcugcgcagg

SEQ ID NO: 1594310 - RNA, 22 nt, Pseudomonas putida KT2440
aacaccgcguuaugacuggccu

SEQ ID NO: 1594311 - RNA, 21 nt, Pseudomonas putida KT2440
aacaccgccagcccgccaagg

SEQ ID NO: 1594312 - RNA, 17 nt, Pseudomonas putida KT2440
cgccggccggcucgcca

SEQ ID NO: 1594313 - RNA, 18 nt, Pseudomonas putida KT2440
cgccggccggcucgccau

SEQ ID NO: 1594314 - RNA, 14 nt, Pseudomonas putida KT2440
cgccggccugccgc

SEQ ID NO: 1594315 - RNA, 20 nt, Pseudomonas putida KT2440
cgccggcacgcccgcuccca

SEQ ID NO: 1594316 - RNA, 14 nt, Pseudomonas putida KT2440
cgccggcagcugau

SEQ ID NO: 1594317 - RNA, 19 nt, Pseudomonas putida KT2440
cgccgcugcugcgccucgc

SEQ ID NO: 1594318 - RNA, 14 nt, Pseudomonas putida KT2440
cgccgcuggcuuca

SEQ ID NO: 1594319 - RNA, 13 nt, Pseudomonas putida KT2440
cgccgcugccagc

SEQ ID NO: 1594320 - RNA, 15 nt, Pseudomonas putida KT2440
cgccgcugccagcag

SEQ ID NO: 1594321 - RNA, 12 nt, Pseudomonas putida KT2440
cgccgcggccaa

SEQ ID NO: 1594322 - RNA, 14 nt, Pseudomonas putida KT2440
cgccgcggccaaca

SEQ ID NO: 1594323 - RNA, 19 nt, Pseudomonas putida KT2440
cgccgcgcuggcgcgcugu

SEQ ID NO: 1594324 - RNA, 21 nt, Pseudomonas putida KT2440
cgccgccuucgccaaggucca

SEQ ID NO: 1594325 - RNA, 13 nt, Pseudomonas putida KT2440
cgccgcgaucaau

SEQ ID NO: 1594326 - RNA, 19 nt, Pseudomonas putida KT2440
cgccgccgauagcagcacc

SEQ ID NO: 1594327 - RNA, 22 nt, Pseudomonas putida KT2440
cgccgccgagcugaugccggag

SEQ ID NO: 1594328 - RNA, 23 nt, Pseudomonas putida KT2440
cgccgcccuugaggggcggcguu

SEQ ID NO: 1594329 - RNA, 19 nt, Pseudomonas putida KT2440
cgccgcccuuggugcacca

SEQ ID NO: 1594330 - RNA, 15 nt, Pseudomonas putida KT2440
cgccgccagaccacc

SEQ ID NO: 1594331 - RNA, 20 nt, Pseudomonas putida KT2440
cgccgccaccugcggcaggu

SEQ ID NO: 1594332 - RNA, 15 nt, Pseudomonas putida KT2440
cgccgccacgaucga

SEQ ID NO: 1594333 - RNA, 14 nt, Pseudomonas putida KT2440
cgccgccaggccca

SEQ ID NO: 1594334 - RNA, 15 nt, Pseudomonas putida KT2440
cgccgccaggcagca

SEQ ID NO: 1594335 - RNA, 13 nt, Pseudomonas putida KT2440
cgccgccagcggc

SEQ ID NO: 1594336 - RNA, 14 nt, Pseudomonas putida KT2440
cgccgccaggcggu

SEQ ID NO: 1594337 - RNA, 14 nt, Pseudomonas putida KT2440
cgccgccagggcaa

SEQ ID NO: 1594338 - RNA, 19 nt, Pseudomonas putida KT2440
cgccgcccgguauucgggu

SEQ ID NO: 1594339 - RNA, 20 nt, Pseudomonas putida KT2440
cgccgccccacucgcgcagc

SEQ ID NO: 1594340 - RNA, 21 nt, Pseudomonas putida KT2440
cgccgccccacucgcgcagca

SEQ ID NO: 1594341 - RNA, 23 nt, Pseudomonas putida KT2440
cgccgcccccuucacugaucggg

SEQ ID NO: 1594342 - RNA, 19 nt, Pseudomonas putida KT2440
cgccgcccaguaccggggu

SEQ ID NO: 1594343 - RNA, 12 nt, Pseudomonas putida KT2440
cgccgcccagcu

SEQ ID NO: 1594344 - RNA, 15 nt, Pseudomonas putida KT2440
cgccgcccaauacgc

SEQ ID NO: 1594345 - RNA, 13 nt, Pseudomonas putida KT2440
cgccgauagcagc

SEQ ID NO: 1594346 - RNA, 22 nt, Pseudomonas putida KT2440
cgccgauagcagcaccgaucag

SEQ ID NO: 1594347 - RNA, 23 nt, Pseudomonas putida KT2440
cgccgauagcagcaccgaucagc

SEQ ID NO: 1594348 - RNA, 14 nt, Pseudomonas putida KT2440
cgccgaggcguugg

SEQ ID NO: 1594349 - RNA, 14 nt, Pseudomonas putida KT2440
cgcccagaaucuca

SEQ ID NO: 1594350 - RNA, 17 nt, Pseudomonas putida KT2440
cgcccagaucagcagca

SEQ ID NO: 1594351 - RNA, 23 nt, Pseudomonas putida KT2440
cgcccagaucagcagcaccgagg

SEQ ID NO: 1594352 - RNA, 17 nt, Pseudomonas putida KT2440
cgccgaucauugcugcg

SEQ ID NO: 1594353 - RNA, 14 nt, Pseudomonas putida KT2440
cgccgaucaggaag

SEQ ID NO: 1594354 - RNA, 12 nt, Pseudomonas putida KT2440
cgccgaucagcu

SEQ ID NO: 1594355 - RNA, 20 nt, Pseudomonas putida KT2440
cgccgcaaacgcugagcgau

SEQ ID NO: 1594356 - RNA, 16 nt, Pseudomonas putida KT2440
cgccgcagguccaccu

SEQ ID NO: 1594357 - RNA, 13 nt, Pseudomonas putida KT2440
cgccgcaucgcca

SEQ ID NO: 1594358 - RNA, 20 nt, Pseudomonas putida KT2440
cgccgcaucguuauccagca

SEQ ID NO: 1594359 - RNA, 18 nt, Pseudomonas putida KT2440
cgccgcagcaguuggccg

SEQ ID NO: 1594360 - RNA, 21 nt, Pseudomonas putida KT2440
cgccgcagcaaucugcugguu

SEQ ID NO: 1594361 - RNA, 17 nt, Pseudomonas putida KT2440
gucguggucgccgucgc

SEQ ID NO: 1594362 - RNA, 13 nt, Pseudomonas putida KT2440
gucgugugcugcg

SEQ ID NO: 1594363 - RNA, 17 nt, Pseudomonas putida KT2440
gucgugaggugcgcuuc

SEQ ID NO: 1594364 - RNA, 19 nt, Pseudomonas putida KT2440
gucguggccuucgcgggcu

SEQ ID NO: 1594365 - RNA, 20 nt, Pseudomonas putida KT2440
gucguggccuucgcgggcuc

SEQ ID NO: 1594366 - RNA, 20 nt, Pseudomonas putida KT2440
gucguaaucgcccgcugcuu

SEQ ID NO: 1594367 - RNA, 15 nt, Pseudomonas putida KT2440
gucgguggcgaaggu

SEQ ID NO: 1594368 - RNA, 13 nt, Pseudomonas putida KT2440
gucgguggcggcc

SEQ ID NO: 1594369 - RNA, 16 nt, Pseudomonas putida KT2440
gucguccuggguaauc

SEQ ID NO: 1594370 - RNA, 16 nt, Pseudomonas putida KT2440
gucguaggcgcggguu

SEQ ID NO: 1594371 - RNA, 22 nt, Pseudomonas putida KT2440
gucguaggagcggguucacccg

SEQ ID NO: 1594372 - RNA, 16 nt, Pseudomonas putida KT2440
gucggcucaacaccau

SEQ ID NO: 1594373 - RNA, 18 nt, Pseudomonas putida KT2440
gucgggaauugcagcccg

SEQ ID NO: 1594374 - RNA, 14 nt, Pseudomonas putida KT2440
gucgcggcgcuggc

SEQ ID NO: 1594375 - RNA, 19 nt, Pseudomonas putida KT2440
gucggucagcaccuggcag

SEQ ID NO: 1594376 - RNA, 12 nt, Pseudomonas putida KT2440
gucggucaggua

SEQ ID NO: 1594377 - RNA, 11 nt, Pseudomonas putida KT2440
gucgguacugg

SEQ ID NO: 1594378 - RNA, 19 nt, Pseudomonas putida KT2440
gucggguuggucgccagga

SEQ ID NO: 1594379 - RNA, 19 nt, Pseudomonas putida KT2440
gucggucucgguaccacgc

SEQ ID NO: 1594380 - RNA, 20 nt, Pseudomonas putida KT2440
gugacgaccucggccagguc

SEQ ID NO: 1594381 - RNA, 16 nt, Pseudomonas putida KT2440
gugacgccgugggcua

SEQ ID NO: 1594382 - RNA, 14 nt, Pseudomonas putida KT2440
gugacugccagcac

SEQ ID NO: 1594383 - RNA, 23 nt, Pseudomonas putida KT2440
gugaggccuucagcgcggcaacc

SEQ ID NO: 1594384 - RNA, 14 nt, Pseudomonas putida KT2440
gugagcugcgcgcg

SEQ ID NO: 1594385 - RNA, 11 nt, Pseudomonas putida KT2440
gugagcacggc

SEQ ID NO: 1594386 - RNA, 12 nt, Pseudomonas putida KT2440
gugagcauggca

SEQ ID NO: 1594387 - RNA, 21 nt, Pseudomonas putida KT2440
gugagccaugccguaagccgc

SEQ ID NO: 1594388 - RNA, 15 nt, Pseudomonas putida KT2440
gugagcgaaucccgc

SEQ ID NO: 1594389 - RNA, 17 nt, Pseudomonas putida KT2440
gugacccaguucgcgga

SEQ ID NO: 1594390 - RNA, 17 nt, Pseudomonas putida KT2440
gugaacccgcuccuaca

SEQ ID NO: 1594391 - RNA, 22 nt, Pseudomonas putida KT2440
gugaacgaucagggaugcugga

SEQ ID NO: 1594392 - RNA, 22 nt, Pseudomonas putida KT2440
gugaacuuaugguugucgaaca

SEQ ID NO: 1594393 - RNA, 18 nt, Pseudomonas putida KT2440
gugaagcggccaccugcc

SEQ ID NO: 1594394 - RNA, 20 nt, Pseudomonas putida KT2440
gucuucaaucgucaugaucg

SEQ ID NO: 1594395 - RNA, 18 nt, Pseudomonas putida KT2440
gucuuccggcagggugaa

SEQ ID NO: 1594396 - RNA, 20 nt, Pseudomonas putida KT2440
gucuuccagcugcgccugca

SEQ ID NO: 1594397 - RNA, 17 nt, Pseudomonas putida KT2440
gucuuccuggcggaacg

SEQ ID NO: 1594398 - RNA, 18 nt, Pseudomonas putida KT2440
gucuuccugguuuucgcg

SEQ ID NO: 1594399 - RNA, 17 nt, Pseudomonas putida KT2440
gucuucguacaugcgcg

SEQ ID NO: 1594400 - RNA, 22 nt, Pseudomonas putida KT2440
gugaaaaugcuggucgaacaac

SEQ ID NO: 1594401 - RNA, 22 nt, Pseudomonas putida KT2440
gugaaacgcagcuuugguucaa

SEQ ID NO: 1594402 - RNA, 17 nt, Pseudomonas putida KT2440
gucuuguaucccaggcg

SEQ ID NO: 1594403 - RNA, 15 nt, Pseudomonas putida KT2440
gucuucuuucgacau

SEQ ID NO: 1594404 - RNA, 14 nt, Pseudomonas putida KT2440
gucugcguaaggua

SEQ ID NO: 1594405 - RNA, 18 nt, Pseudomonas putida KT2440
gucugcugcgucagcauc

SEQ ID NO: 1594406 - RNA, 23 nt, Pseudomonas putida KT2440
gucuguggauaacuuacaucugc

SEQ ID NO: 1594407 - RNA, 21 nt, Pseudomonas putida KT2440
gucuggugccugucgucagcu

SEQ ID NO: 1594408 - RNA, 13 nt, Pseudomonas putida KT2440
gucuccgcgcuug

SEQ ID NO: 1594409 - RNA, 20 nt, Pseudomonas putida KT2440
gucuccaacgucaaccgugc

SEQ ID NO: 1594410 - RNA, 20 nt, Pseudomonas putida KT2440
gucucuuucaacagcuggcu

SEQ ID NO: 1594411 - RNA, 18 nt, Pseudomonas putida KT2440
gucugccgguaccacugc

SEQ ID NO: 1594412 - RNA, 19 nt, Pseudomonas putida KT2440
gucugccgguaccacugcu

SEQ ID NO: 1594413 - RNA, 15 nt, Pseudomonas putida KT2440
gucugauagccaggg

SEQ ID NO: 1594414 - RNA, 15 nt, Pseudomonas putida KT2440
gucugcaacugccca

SEQ ID NO: 1594415 - RNA, 20 nt, Pseudomonas putida KT2440
gucgcccuuugguacugcgc

SEQ ID NO: 1594416 - RNA, 13 nt, Pseudomonas putida KT2440
gucgccugaacgc

SEQ ID NO: 1594417 - RNA, 20 nt, Pseudomonas putida KT2440
gucgccuguaggagcggguu

SEQ ID NO: 1594418 - RNA, 22 nt, Pseudomonas putida KT2440
gucgccuucguacaucggguaa

SEQ ID NO: 1594419 - RNA, 19 nt, Pseudomonas putida KT2440
gucgccacauaguaggcaa

SEQ ID NO: 1594420 - RNA, 13 nt, Pseudomonas putida KT2440
gucgccacgcggg

SEQ ID NO: 1594421 - RNA, 19 nt, Pseudomonas putida KT2440
gucgcccaguuccaugucg

SEQ ID NO: 1594422 - RNA, 16 nt, Pseudomonas putida KT2440
gucgauguucagcacc

SEQ ID NO: 1594423 - RNA, 23 nt, Pseudomonas putida KT2440
gucgcacagguccagccgccauu

SEQ ID NO: 1594424 - RNA, 16 nt, Pseudomonas putida KT2440
gucgauggcggugcgc

SEQ ID NO: 1594425 - RNA, 17 nt, Pseudomonas putida KT2440
gucgaugccugugucga

SEQ ID NO: 1594426 - RNA, 21 nt, Pseudomonas putida KT2440
gucgaugccugugucgaacca

SEQ ID NO: 1594427 - RNA, 22 nt, Pseudomonas putida KT2440
gucgaugccuuccaggcgacgg

SEQ ID NO: 1594428 - RNA, 14 nt, Pseudomonas putida KT2440
gucgaugaucgccg

SEQ ID NO: 1594429 - RNA, 13 nt, Pseudomonas putida KT2440
gucgaugaugcgu

SEQ ID NO: 1594430 - RNA, 20 nt, Pseudomonas putida KT2440
gucgaugauggucgcgacga

SEQ ID NO: 1594431 - RNA, 15 nt, Pseudomonas putida KT2440
gucgaugcaggagcg

SEQ ID NO: 1594432 - RNA, 20 nt, Pseudomonas putida KT2440
gucgagcaggucgaucccgg

SEQ ID NO: 1594433 - RNA, 15 nt, Pseudomonas putida KT2440
gucgaucuccaggug

SEQ ID NO: 1594434 - RNA, 14 nt, Pseudomonas putida KT2440
gucgaucccgaggu

SEQ ID NO: 1594435 - RNA, 16 nt, Pseudomonas putida KT2440
gucgagcaccacggcg

SEQ ID NO: 1594436 - RNA, 13 nt, Pseudomonas putida KT2440
gucgagcaaggca

SEQ ID NO: 1594437 - RNA, 14 nt, Pseudomonas putida KT2440
gucgacgaucgccg

SEQ ID NO: 1594438 - RNA, 14 nt, Pseudomonas putida KT2440
guccggcugcgggu

SEQ ID NO: 1594439 - RNA, 19 nt, Pseudomonas putida KT2440
guccuugucggcgaaggcu

SEQ ID NO: 1594440 - RNA, 23 nt, Pseudomonas putida KT2440
guccuuucgcgacacaaggccgc

SEQ ID NO: 1594441 - RNA, 21 nt, Pseudomonas putida KT2440
guccuugcuggccaccgcgcu

SEQ ID NO: 1594442 - RNA, 21 nt, Pseudomonas putida KT2440
gucgaacaccaguucgccauc

SEQ ID NO: 1594443 - RNA, 15 nt, Pseudomonas putida KT2440
gucgaacccagcuug

SEQ ID NO: 1594444 - RNA, 23 nt, Pseudomonas putida KT2440
gucgaacucgcgcccacgcgggu

SEQ ID NO: 1594445 - RNA, 23 nt, Pseudomonas putida KT2440
guccaugaucuccacggcaaucg

SEQ ID NO: 1594446 - RNA, 16 nt, Pseudomonas putida KT2440
guccaguauccauggg

SEQ ID NO: 1594447 - RNA, 18 nt, Pseudomonas putida KT2440
guccauguaggagcgggu

SEQ ID NO: 1594448 - RNA, 19 nt, Pseudomonas putida KT2440
guccauguaggagcggguu

SEQ ID NO: 1594449 - RNA, 15 nt, Pseudomonas putida KT2440
gucccccaucggcac

SEQ ID NO: 1594450 - RNA, 17 nt, Pseudomonas putida KT2440
guccagguaguacggca

SEQ ID NO: 1594451 - RNA, 21 nt, Pseudomonas putida KT2440
guccagcagguuuuccagccc

SEQ ID NO: 1594452 - RNA, 23 nt, Pseudomonas putida KT2440
guccagcagguuuuccagcccgu

SEQ ID NO: 1594453 - RNA, 14 nt, Pseudomonas putida KT2440
guccagcagugcca

SEQ ID NO: 1594454 - RNA, 16 nt, Pseudomonas putida KT2440
guccagcaucagcaca

SEQ ID NO: 1594455 - RNA, 19 nt, Pseudomonas putida KT2440
guccagcguucggccagca

SEQ ID NO: 1594456 - RNA, 15 nt, Pseudomonas putida KT2440
guccagcucaacgcg

SEQ ID NO: 1594457 - RNA, 19 nt, Pseudomonas putida KT2440
guccggccuauucgcgggu

SEQ ID NO: 1594458 - RNA, 21 nt, Pseudomonas putida KT2440
guccgccaagauccgcggcau

SEQ ID NO: 1594459 - RNA, 20 nt, Pseudomonas putida KT2440
guccgccaagguaaucuggc

SEQ ID NO: 1594460 - RNA, 13 nt, Pseudomonas putida KT2440
guccgccagcaca

SEQ ID NO: 1594461 - RNA, 18 nt, Pseudomonas putida KT2440
guccgcgaagcagacaac

SEQ ID NO: 1594462 - RNA, 16 nt, Pseudomonas putida KT2440
guccgaggucagcacc

SEQ ID NO: 1594463 - RNA, 14 nt, Pseudomonas putida KT2440
gucccuguaggcgc

SEQ ID NO: 1594464 - RNA, 16 nt, Pseudomonas putida KT2440
gucagcuggccuucga

SEQ ID NO: 1594465 - RNA, 20 nt, Pseudomonas putida KT2440
guauagccaugcaccgucug

SEQ ID NO: 1594466 - RNA, 12 nt, Pseudomonas putida KT2440
guaucgaacagg

SEQ ID NO: 1594467 - RNA, 19 nt, Pseudomonas putida KT2440
guaucgaacaggcagacca

SEQ ID NO: 1594468 - RNA, 13 nt, Pseudomonas putida KT2440
gucaggcugcaca

SEQ ID NO: 1594469 - RNA, 17 nt, Pseudomonas putida KT2440
gucaggcugcacaaggu

SEQ ID NO: 1594470 - RNA, 15 nt, Pseudomonas putida KT2440
gucaggcucagcagg

SEQ ID NO: 1594471 - RNA, 17 nt, Pseudomonas putida KT2440
gucagguccgccaaggu

SEQ ID NO: 1594472 - RNA, 22 nt, Pseudomonas putida KT2440
gucaguaccuggccgcguucgc

SEQ ID NO: 1594473 - RNA, 16 nt, Pseudomonas putida KT2440
gucagugacaggcagu

SEQ ID NO: 1594474 - RNA, 15 nt, Pseudomonas putida KT2440
gucauaccucgaccg

SEQ ID NO: 1594475 - RNA, 16 nt, Pseudomonas putida KT2440
gucaucugaggcccga

SEQ ID NO: 1594476 - RNA, 19 nt, Pseudomonas putida KT2440
gucaugcaggucaucgaac

SEQ ID NO: 1594477 - RNA, 20 nt, Pseudomonas putida KT2440
gucauggcaccaaucgagau

SEQ ID NO: 1594478 - RNA, 16 nt, Pseudomonas putida KT2440
gucaugcgguacagca

SEQ ID NO: 1594479 - RNA, 18 nt, Pseudomonas putida KT2440
gucaugcgguacagcacu

SEQ ID NO: 1594480 - RNA, 14 nt, Pseudomonas putida KT2440
guccacgcuuacag

SEQ ID NO: 1594481 - RNA, 18 nt, Pseudomonas putida KT2440
guccacuaccuccagccc

SEQ ID NO: 1594482 - RNA, 16 nt, Pseudomonas putida KT2440
guccacucaccggcau

SEQ ID NO: 1594483 - RNA, 12 nt, Pseudomonas putida KT2440
guccagcagcag

SEQ ID NO: 1594484 - RNA, 19 nt, Pseudomonas putida KT2440
guccagcacacugagcacc

SEQ ID NO: 1594485 - RNA, 20 nt, Pseudomonas putida KT2440
guccaccccacccucguaac

SEQ ID NO: 1594486 - RNA, 19 nt, Pseudomonas putida KT2440
guccacccccgucucggca

SEQ ID NO: 1594487 - RNA, 22 nt, Pseudomonas putida KT2440
guccaccgcgccaucaaggccg

SEQ ID NO: 1594488 - RNA, 15 nt, Pseudomonas putida KT2440
guccacagcgaugaa

SEQ ID NO: 1594489 - RNA, 19 nt, Pseudomonas putida KT2440
guccaaccgcaagcggcuc

SEQ ID NO: 1594490 - RNA, 20 nt, Pseudomonas putida KT2440
guccaaggcggugcauucug

SEQ ID NO: 1594491 - RNA, 17 nt, Pseudomonas putida KT2440
gggugaucgcgcuggca

SEQ ID NO: 1594492 - RNA, 13 nt, Pseudomonas putida KT2440
gggugaugcccgc

SEQ ID NO: 1594493 - RNA, 21 nt, Pseudomonas putida KT2440
gggugaagaagaacuccucca

SEQ ID NO: 1594494 - RNA, 19 nt, Pseudomonas putida KT2440
gggugaacccgcuccuaca

SEQ ID NO: 1594495 - RNA, 20 nt, Pseudomonas putida KT2440
gggugaacccgcuccuaccg

SEQ ID NO: 1594496 - RNA, 20 nt, Pseudomonas putida KT2440
gggugaacccgcuccuacga

SEQ ID NO: 1594497 - RNA, 13 nt, Pseudomonas putida KT2440
gggugaccaccag

SEQ ID NO: 1594498 - RNA, 19 nt, Pseudomonas putida KT2440
gggucugcccggccagcag

SEQ ID NO: 1594499 - RNA, 18 nt, Pseudomonas putida KT2440
gggucgguggcaugcucc

SEQ ID NO: 1594500 - RNA, 11 nt, Pseudomonas putida KT2440
gguacgcucac

SEQ ID NO: 1594501 - RNA, 21 nt, Pseudomonas putida KT2440
gguacucugucacccgcugca

SEQ ID NO: 1594502 - RNA, 21 nt, Pseudomonas putida KT2440
gguacugcuucaugaagucag

SEQ ID NO: 1594503 - RNA, 16 nt, Pseudomonas putida KT2440
gguagaacaagucgcg

SEQ ID NO: 1594504 - RNA, 18 nt, Pseudomonas putida KT2440
gguagccucgacccgcug

SEQ ID NO: 1594505 - RNA, 18 nt, Pseudomonas putida KT2440
gguagcgcccgggcauca

SEQ ID NO: 1594506 - RNA, 23 nt, Pseudomonas putida KT2440
gguaaacaauucccagccuuucu

SEQ ID NO: 1594507 - RNA, 18 nt, Pseudomonas putida KT2440
ggguuuucucgcgaaugc

SEQ ID NO: 1594508 - RNA, 16 nt, Pseudomonas putida KT2440
gguacauguuggucag

SEQ ID NO: 1594509 - RNA, 15 nt, Pseudomonas putida KT2440
gguacagcagcugca

SEQ ID NO: 1594510 - RNA, 18 nt, Pseudomonas putida KT2440
gguacagcucacuggcca

SEQ ID NO: 1594511 - RNA, 20 nt, Pseudomonas putida KT2440
ggguuuacccgcgaacaggc

SEQ ID NO: 1594512 - RNA, 18 nt, Pseudomonas putida KT2440
ggguuuacccgcgaauac

SEQ ID NO: 1594513 - RNA, 18 nt, Pseudomonas putida KT2440
ggguuuaccugugaaugc

SEQ ID NO: 1594514 - RNA, 21 nt, Pseudomonas putida KT2440
ggguuaccugcgcgagaaugc

SEQ ID NO: 1594515 - RNA, 14 nt, Pseudomonas putida KT2440
ggguuggcauggcc

SEQ ID NO: 1594516 - RNA, 15 nt, Pseudomonas putida KT2440
ggguucacagccggc

SEQ ID NO: 1594517 - RNA, 14 nt, Pseudomonas putida KT2440
ggggcucacagccc

SEQ ID NO: 1594518 - RNA, 20 nt, Pseudomonas putida KT2440
ggggcggauuugcccgcuaa

SEQ ID NO: 1594519 - RNA, 15 nt, Pseudomonas putida KT2440
ggggcugacgcgccg

SEQ ID NO: 1594520 - RNA, 20 nt, Pseudomonas putida KT2440
ggggcugccuugcagccccu

SEQ ID NO: 1594521 - RNA, 18 nt, Pseudomonas putida KT2440
ggggcugcuuugcagccc

SEQ ID NO: 1594522 - RNA, 16 nt, Pseudomonas putida KT2440
ggggggcucagcccgc

SEQ ID NO: 1594523 - RNA, 22 nt, Pseudomonas putida KT2440
ggggguauuaagggcauggccg

SEQ ID NO: 1594524 - RNA, 17 nt, Pseudomonas putida KT2440
ggggucgcggccuaccc

SEQ ID NO: 1594525 - RNA, 15 nt, Pseudomonas putida KT2440
ggggucgaucuccag

SEQ ID NO: 1594526 - RNA, 17 nt, Pseudomonas putida KT2440
gggaaguuacgggucga

SEQ ID NO: 1594527 - RNA, 14 nt, Pseudomonas putida KT2440
gggaagguggccgg

SEQ ID NO: 1594528 - RNA, 21 nt, Pseudomonas putida KT2440
ggggcagacuaccaacaccgg

SEQ ID NO: 1594529 - RNA, 15 nt, Pseudomonas putida KT2440
gggucgauagccagc

SEQ ID NO: 1594530 - RNA, 13 nt, Pseudomonas putida KT2440
gggucgacgcgca

SEQ ID NO: 1594531 - RNA, 18 nt, Pseudomonas putida KT2440
gggucgagguggagacca

SEQ ID NO: 1594532 - RNA, 15 nt, Pseudomonas putida KT2440
gggucaggaugccgu

SEQ ID NO: 1594533 - RNA, 21 nt, Pseudomonas putida KT2440
ggguccaggauacccaucucg

SEQ ID NO: 1594534 - RNA, 13 nt, Pseudomonas putida KT2440
ggguaguccucca

SEQ ID NO: 1594535 - RNA, 13 nt, Pseudomonas putida KT2440
ggguaucgaauag

SEQ ID NO: 1594536 - RNA, 19 nt, Pseudomonas putida KT2440
ggguaaacccauuccuaca

SEQ ID NO: 1594537 - RNA, 14 nt, Pseudomonas putida KT2440
ggguaaacccgcgc

SEQ ID NO: 1594538 - RNA, 20 nt, Pseudomonas putida KT2440
ggguaaacccgcgccuacaa

SEQ ID NO: 1594539 - RNA, 20 nt, Pseudomonas putida KT2440
ggguaaacccgcucccacaa

SEQ ID NO: 1594540 - RNA, 20 nt, Pseudomonas putida KT2440
ggguaaacccgcuccuacag

SEQ ID NO: 1594541 - RNA, 20 nt, Pseudomonas putida KT2440
ggguaaacccgcuccuacau

SEQ ID NO: 1594542 - RNA, 19 nt, Pseudomonas putida KT2440
ggguaaacccgcuccuacg

SEQ ID NO: 1594543 - RNA, 21 nt, Pseudomonas putida KT2440
ggguaaacccgcuccuacgac

SEQ ID NO: 1594544 - RNA, 20 nt, Pseudomonas putida KT2440
ggguaaacccgcuccuacgc

SEQ ID NO: 1594545 - RNA, 21 nt, Pseudomonas putida KT2440
ggguaaacccgcuccuacuac

SEQ ID NO: 1594546 - RNA, 23 nt, Pseudomonas putida KT2440
ggguaaacccgcuccuacuacgg

SEQ ID NO: 1594547 - RNA, 13 nt, Pseudomonas putida KT2440
ggguaagccaugc

SEQ ID NO: 1594548 - RNA, 16 nt, Pseudomonas putida KT2440
ggguaauggcgcugga

SEQ ID NO: 1594549 - RNA, 14 nt, Pseudomonas putida KT2440
ggguaaccgccuga

SEQ ID NO: 1594550 - RNA, 22 nt, Pseudomonas putida KT2440
ggguacuucucgaccagcgcca

SEQ ID NO: 1594551 - RNA, 21 nt, Pseudomonas putida KT2440
ggguagaucauuaccugcagg

SEQ ID NO: 1594552 - RNA, 16 nt, Pseudomonas putida KT2440
gguccgagugcucgau

SEQ ID NO: 1594553 - RNA, 20 nt, Pseudomonas putida KT2440
gguccgagugcucgaucaga

SEQ ID NO: 1594554 - RNA, 17 nt, Pseudomonas putida KT2440
ggucaugcaggucaucg

SEQ ID NO: 1594555 - RNA, 17 nt, Pseudomonas putida KT2440
ggucaucgaacaccucu

SEQ ID NO: 1594556 - RNA, 23 nt, Pseudomonas putida KT2440
ggucagcgcugacucagcggccu

SEQ ID NO: 1594557 - RNA, 13 nt, Pseudomonas putida KT2440
gguaguggcggca

SEQ ID NO: 1594558 - RNA, 21 nt, Pseudomonas putida KT2440
gguaguggcggcaacggugaa

SEQ ID NO: 1594559 - RNA, 16 nt, Pseudomonas putida KT2440
gguagggaaauccucg

SEQ ID NO: 1594560 - RNA, 17 nt, Pseudomonas putida KT2440
gguagggaaauccucgg

SEQ ID NO: 1594561 - RNA, 14 nt, Pseudomonas putida KT2440
gguaguccuugccg

SEQ ID NO: 1594562 - RNA, 16 nt, Pseudomonas putida KT2440
gguaguccaugaugaa

SEQ ID NO: 1594563 - RNA, 16 nt, Pseudomonas putida KT2440
ggucagcucgaucagg

SEQ ID NO: 1594564 - RNA, 23 nt, Pseudomonas putida KT2440
ggucagcguugccgaugaccugc

SEQ ID NO: 1594565 - RNA, 17 nt, Pseudomonas putida KT2440
ggucgaucuucagcgca

SEQ ID NO: 1594566 - RNA, 20 nt, Pseudomonas putida KT2440
ggucgaucuucagcgcaucg

SEQ ID NO: 1594567 - RNA, 14 nt, Pseudomonas putida KT2440
ggucgaucuucgcc

SEQ ID NO: 1594568 - RNA, 21 nt, Pseudomonas putida KT2440
ggucgaucuucgccggcaucg

SEQ ID NO: 1594569 - RNA, 14 nt, Pseudomonas putida KT2440
ggucgccagcacca

SEQ ID NO: 1594570 - RNA, 16 nt, Pseudomonas putida KT2440
ggucgcgacgauggac

SEQ ID NO: 1594571 - RNA, 16 nt, Pseudomonas putida KT2440
ggucgcgccgacaucg

SEQ ID NO: 1594572 - RNA, 14 nt, Pseudomonas putida KT2440
ggucgacugaccgc

SEQ ID NO: 1594573 - RNA, 20 nt, Pseudomonas putida KT2440
gguccggaaacucacgcgcc

SEQ ID NO: 1594574 - RNA, 21 nt, Pseudomonas putida KT2440
gguccggacuuggaccccgaa

SEQ ID NO: 1594575 - RNA, 20 nt, Pseudomonas putida KT2440
gguccuuguaagagcggccu

SEQ ID NO: 1594576 - RNA, 18 nt, Pseudomonas putida KT2440
ggucggcucgucgaacag

SEQ ID NO: 1594577 - RNA, 21 nt, Pseudomonas putida KT2440
ggucggcggggcccggacagg

SEQ ID NO: 1594578 - RNA, 17 nt, Pseudomonas putida KT2440
ggucggcguagccguuu

SEQ ID NO: 1594579 - RNA, 22 nt, Pseudomonas putida KT2440
ggucggagaucgagugcucgaa

SEQ ID NO: 1594580 - RNA, 13 nt, Pseudomonas putida KT2440
ggucgcugccgug

SEQ ID NO: 1594581 - RNA, 23 nt, Pseudomonas putida KT2440
ggucgcucaacuccauggccagg

SEQ ID NO: 1594582 - RNA, 17 nt, Pseudomonas putida KT2440
ggucgcgucgcccagac

SEQ ID NO: 1594583 - RNA, 19 nt, Pseudomonas putida KT2440
ggugaguggcccuggagcg

SEQ ID NO: 1594584 - RNA, 12 nt, Pseudomonas putida KT2440
ggucucgcggcu

SEQ ID NO: 1594585 - RNA, 15 nt, Pseudomonas putida KT2440
ggucucgaucagcga

SEQ ID NO: 1594586 - RNA, 14 nt, Pseudomonas putida KT2440
ggucugagcgucau

SEQ ID NO: 1594587 - RNA, 15 nt, Pseudomonas putida KT2440
ggugaacgaucaggg

SEQ ID NO: 1594588 - RNA, 14 nt, Pseudomonas putida KT2440
ggugaagaucgccg

SEQ ID NO: 1594589 - RNA, 13 nt, Pseudomonas putida KT2440
ggugaacccgcuc

SEQ ID NO: 1594590 - RNA, 13 nt, Pseudomonas putida KT2440
guacucaggggca

SEQ ID NO: 1594591 - RNA, 21 nt, Pseudomonas putida KT2440
guacggcccaugucgaucagc

SEQ ID NO: 1594592 - RNA, 17 nt, Pseudomonas putida KT2440
guacgcuggccaaggcc

SEQ ID NO: 1594593 - RNA, 21 nt, Pseudomonas putida KT2440
guacgcguggucgccggcgaa

SEQ ID NO: 1594594 - RNA, 18 nt, Pseudomonas putida KT2440
guacgcgaaggcggucgc

SEQ ID NO: 1594595 - RNA, 18 nt, Pseudomonas putida KT2440
guacgccgcaaacgcuga

SEQ ID NO: 1594596 - RNA, 21 nt, Pseudomonas putida KT2440
guacgccgcaaacgcugagcg

SEQ ID NO: 1594597 - RNA, 18 nt, Pseudomonas putida KT2440
guacagcucacuggccaa

SEQ ID NO: 1594598 - RNA, 12 nt, Pseudomonas putida KT2440
guaccagcaggc

SEQ ID NO: 1594599 - RNA, 17 nt, Pseudomonas putida KT2440
guaccaggucgccagca

SEQ ID NO: 1594600 - RNA, 19 nt, Pseudomonas putida KT2440
guaccaggucgccagcacc

SEQ ID NO: 1594601 - RNA, 19 nt, Pseudomonas putida KT2440
guaccgccguccaccaucu

SEQ ID NO: 1594602 - RNA, 16 nt, Pseudomonas putida KT2440
guaccgggguagaccu

SEQ ID NO: 1594603 - RNA, 12 nt, Pseudomonas putida KT2440
guaccggcaacc

SEQ ID NO: 1594604 - RNA, 17 nt, Pseudomonas putida KT2440
gguuucggugcgcugcu

SEQ ID NO: 1594605 - RNA, 15 nt, Pseudomonas putida KT2440
gguuuccagcccuuc

SEQ ID NO: 1594606 - RNA, 19 nt, Pseudomonas putida KT2440
guaaacccgcuccuacaag

SEQ ID NO: 1594607 - RNA, 18 nt, Pseudomonas putida KT2440
guaaacccgcuccuacgg

SEQ ID NO: 1594608 - RNA, 19 nt, Pseudomonas putida KT2440
gguuugcguugaugcguga

SEQ ID NO: 1594609 - RNA, 18 nt, Pseudomonas putida KT2440
gguuugccaggcgcagug

SEQ ID NO: 1594610 - RNA, 16 nt, Pseudomonas putida KT2440
gguuugcccgcgagga

SEQ ID NO: 1594611 - RNA, 14 nt, Pseudomonas putida KT2440
guaacaggcgcaca

SEQ ID NO: 1594612 - RNA, 21 nt, Pseudomonas putida KT2440
guaaagaaaagccgcuggccc

SEQ ID NO: 1594613 - RNA, 23 nt, Pseudomonas putida KT2440
guaaaccugccugauugccuggc

SEQ ID NO: 1594614 - RNA, 19 nt, Pseudomonas putida KT2440
guacacugcaggagcgggc

SEQ ID NO: 1594615 - RNA, 14 nt, Pseudomonas putida KT2440
guaaugcgcacggc

SEQ ID NO: 1594616 - RNA, 22 nt, Pseudomonas putida KT2440
guaaugcuggugguggcccuga

SEQ ID NO: 1594617 - RNA, 21 nt, Pseudomonas putida KT2440
guaacggcggauguuggccac

SEQ ID NO: 1594618 - RNA, 19 nt, Pseudomonas putida KT2440
guaacgagccuuggccagc

SEQ ID NO: 1594619 - RNA, 16 nt, Pseudomonas putida KT2440
guaaccgcccgccaua

SEQ ID NO: 1594620 - RNA, 23 nt, Pseudomonas putida KT2440
guaaccgcugccauagcgcugca

SEQ ID NO: 1594621 - RNA, 20 nt, Pseudomonas putida KT2440
guaggcgcggguuuacccgc

SEQ ID NO: 1594622 - RNA, 20 nt, Pseudomonas putida KT2440
guaggccgucagcagcaggc

SEQ ID NO: 1594623 - RNA, 20 nt, Pseudomonas putida KT2440
guaggagcgggcuuacccgc

SEQ ID NO: 1594624 - RNA, 12 nt, Pseudomonas putida KT2440
guaggagcgggu

SEQ ID NO: 1594625 - RNA, 20 nt, Pseudomonas putida KT2440
guaggagcgggucuacccgc

SEQ ID NO: 1594626 - RNA, 22 nt, Pseudomonas putida KT2440
guaggagcgggucuacccgcga

SEQ ID NO: 1594627 - RNA, 20 nt, Pseudomonas putida KT2440
guaggagcggguucacccgc

SEQ ID NO: 1594628 - RNA, 22 nt, Pseudomonas putida KT2440
guaggagcggguucacccgcga

SEQ ID NO: 1594629 - RNA, 19 nt, Pseudomonas putida KT2440
guaggagcggguuuacccg

SEQ ID NO: 1594630 - RNA, 20 nt, Pseudomonas putida KT2440
guaggagcggguuuacccgc

SEQ ID NO: 1594631 - RNA, 17 nt, Pseudomonas putida KT2440
guaggcacgaugaccgu

SEQ ID NO: 1594632 - RNA, 19 nt, Pseudomonas putida KT2440
guaggcacggucgguagcc

SEQ ID NO: 1594633 - RNA, 13 nt, Pseudomonas putida KT2440
guaggcagcugcc

SEQ ID NO: 1594634 - RNA, 20 nt, Pseudomonas putida KT2440
guaggaucggguuuacccgc

SEQ ID NO: 1594635 - RNA, 14 nt, Pseudomonas putida KT2440
guaggccgcagcca

SEQ ID NO: 1594636 - RNA, 17 nt, Pseudomonas putida KT2440
guaguucucgacagcca

SEQ ID NO: 1594637 - RNA, 23 nt, Pseudomonas putida KT2440
guaguucucgacagccaccugcc

SEQ ID NO: 1594638 - RNA, 12 nt, Pseudomonas putida KT2440
guaguucggcgg

SEQ ID NO: 1594639 - RNA, 23 nt, Pseudomonas putida KT2440
guauagguccagcucuggucacc

SEQ ID NO: 1594640 - RNA, 14 nt, Pseudomonas putida KT2440
guauacccaucggu

SEQ ID NO: 1594641 - RNA, 19 nt, Pseudomonas putida KT2440
guagguaucacgcuccugc

SEQ ID NO: 1594642 - RNA, 20 nt, Pseudomonas putida KT2440
guaggucuaaccgcgcuggu

SEQ ID NO: 1594643 - RNA, 13 nt, Pseudomonas putida KT2440
guaggugcaggcg

SEQ ID NO: 1594644 - RNA, 19 nt, Pseudomonas putida KT2440
guaggcugcagcgaacacu

SEQ ID NO: 1594645 - RNA, 18 nt, Pseudomonas putida KT2440
guagauaggcuguuggcg

SEQ ID NO: 1594646 - RNA, 13 nt, Pseudomonas putida KT2440
guagauauugacc

SEQ ID NO: 1594647 - RNA, 14 nt, Pseudomonas putida KT2440
guagccacgcugcc

SEQ ID NO: 1594648 - RNA, 12 nt, Pseudomonas putida KT2440
guagccaggcau

SEQ ID NO: 1594649 - RNA, 22 nt, Pseudomonas putida KT2440
guagacuucugcgugcguuggg

SEQ ID NO: 1594650 - RNA, 19 nt, Pseudomonas putida KT2440
guagaagggggcaaugcgg

SEQ ID NO: 1594651 - RNA, 20 nt, Pseudomonas putida KT2440
guagaaggucggugcggcaa

SEQ ID NO: 1594652 - RNA, 13 nt, Pseudomonas putida KT2440
guagaacacccgc

SEQ ID NO: 1594653 - RNA, 16 nt, Pseudomonas putida KT2440
guagcccgggcagccg

SEQ ID NO: 1594654 - RNA, 15 nt, Pseudomonas putida KT2440
guagccccagccggc

SEQ ID NO: 1594655 - RNA, 17 nt, Pseudomonas putida KT2440
guagcgguggcguugcc

SEQ ID NO: 1594656 - RNA, 16 nt, Pseudomonas putida KT2440
guagcggucguugauc

SEQ ID NO: 1594657 - RNA, 19 nt, Pseudomonas putida KT2440
gguggcgcugaccaacagg

SEQ ID NO: 1594658 - RNA, 20 nt, Pseudomonas putida KT2440
gguggccuugcccgaagcca

SEQ ID NO: 1594659 - RNA, 16 nt, Pseudomonas putida KT2440
ggugcuggcucgcugc

SEQ ID NO: 1594660 - RNA, 13 nt, Pseudomonas putida KT2440
ggugcugcgagua

SEQ ID NO: 1594661 - RNA, 23 nt, Pseudomonas putida KT2440
ggugcuuuuccugcgggucaucc

SEQ ID NO: 1594662 - RNA, 15 nt, Pseudomonas putida KT2440
ggugaugcggcccuu

SEQ ID NO: 1594663 - RNA, 17 nt, Pseudomonas putida KT2440
ggugcucugccgcacca

SEQ ID NO: 1594664 - RNA, 19 nt, Pseudomonas putida KT2440
ggugcucugccgcaccagg

SEQ ID NO: 1594665 - RNA, 14 nt, Pseudomonas putida KT2440
ggugcugcagaccc

SEQ ID NO: 1594666 - RNA, 16 nt, Pseudomonas putida KT2440
ggugcugcagacccgc

SEQ ID NO: 1594667 - RNA, 14 nt, Pseudomonas putida KT2440
ggugcuccaggccu

SEQ ID NO: 1594668 - RNA, 13 nt, Pseudomonas putida KT2440
ggugguuggacac

SEQ ID NO: 1594669 - RNA, 21 nt, Pseudomonas putida KT2440
ggugucguucgaacuccgcga

SEQ ID NO: 1594670 - RNA, 17 nt, Pseudomonas putida KT2440
gguguccuugucggcga

SEQ ID NO: 1594671 - RNA, 15 nt, Pseudomonas putida KT2440
gguguccuugcacuc

SEQ ID NO: 1594672 - RNA, 19 nt, Pseudomonas putida KT2440
gguggcucacaucaucgcc

SEQ ID NO: 1594673 - RNA, 14 nt, Pseudomonas putida KT2440
gguggcguccacga

SEQ ID NO: 1594674 - RNA, 23 nt, Pseudomonas putida KT2440
gguucuguagcgcaaugcccagc

SEQ ID NO: 1594675 - RNA, 18 nt, Pseudomonas putida KT2440
gguugaacagcagcgccg

SEQ ID NO: 1594676 - RNA, 23 nt, Pseudomonas putida KT2440
gguugaccagggcgucgaacacg

SEQ ID NO: 1594677 - RNA, 15 nt, Pseudomonas putida KT2440
gguugaagaucaggu

SEQ ID NO: 1594678 - RNA, 17 nt, Pseudomonas putida KT2440
gguugaccuuguccugc

SEQ ID NO: 1594679 - RNA, 17 nt, Pseudomonas putida KT2440
gguugaccgagaacagg

SEQ ID NO: 1594680 - RNA, 18 nt, Pseudomonas putida KT2440
gguugaccgagaacaggc

SEQ ID NO: 1594681 - RNA, 19 nt, Pseudomonas putida KT2440
gguugcccagcaugcgcuu

SEQ ID NO: 1594682 - RNA, 21 nt, Pseudomonas putida KT2440
gguugcaccucggaugccacg

SEQ ID NO: 1594683 - RNA, 14 nt, Pseudomonas putida KT2440
gguugauccagccc

SEQ ID NO: 1594684 - RNA, 23 nt, Pseudomonas putida KT2440
gguugccggucggggugcugcgc

SEQ ID NO: 1594685 - RNA, 17 nt, Pseudomonas putida KT2440
gguugcccaugcacagc

SEQ ID NO: 1594686 - RNA, 17 nt, Pseudomonas putida KT2440
gguugcguugaccugcu

SEQ ID NO: 1594687 - RNA, 15 nt, Pseudomonas putida KT2440
gguuggacagcgccc

SEQ ID NO: 1594688 - RNA, 20 nt, Pseudomonas putida KT2440
gguuuacccgcgaaagggcc

SEQ ID NO: 1594689 - RNA, 20 nt, Pseudomonas putida KT2440
gguuuacccgcgaacaggcc

SEQ ID NO: 1594690 - RNA, 19 nt, Pseudomonas putida KT2440
gguuuacccgcgaagaggc

SEQ ID NO: 1594691 - RNA, 20 nt, Pseudomonas putida KT2440
gguuuacccgcgaauacggu

SEQ ID NO: 1594692 - RNA, 18 nt, Pseudomonas putida KT2440
ggugugcgccgucaccag

SEQ ID NO: 1594693 - RNA, 15 nt, Pseudomonas putida KT2440
gguguucgcgggcau

SEQ ID NO: 1594694 - RNA, 20 nt, Pseudomonas putida KT2440
gguguucgcgggcaugcccg

SEQ ID NO: 1594695 - RNA, 19 nt, Pseudomonas putida KT2440
gguguucaccacgcccugc

SEQ ID NO: 1594696 - RNA, 13 nt, Pseudomonas putida KT2440
gguguuacgccag

SEQ ID NO: 1594697 - RNA, 23 nt, Pseudomonas putida KT2440
gguguugggcgggccgccgaaca

SEQ ID NO: 1594698 - RNA, 15 nt, Pseudomonas putida KT2440
gguuacgcaccagcu

SEQ ID NO: 1594699 - RNA, 20 nt, Pseudomonas putida KT2440
gguuaagcgccaccaccgcu

SEQ ID NO: 1594700 - RNA, 19 nt, Pseudomonas putida KT2440
gguuacgugcaggcgcaca

SEQ ID NO: 1594701 - RNA, 18 nt, Pseudomonas putida KT2440
gguguuuccacagguacc

SEQ ID NO: 1594702 - RNA, 14 nt, Pseudomonas putida KT2440
gguucagcgucaug

SEQ ID NO: 1594703 - RNA, 23 nt, Pseudomonas putida KT2440
gguucaagcacuacaucuaccug

SEQ ID NO: 1594704 - RNA, 12 nt, Pseudomonas putida KT2440
ggcuggcgacgc

SEQ ID NO: 1594705 - RNA, 12 nt, Pseudomonas putida KT2440
ggcuggcgcuuc

SEQ ID NO: 1594706 - RNA, 14 nt, Pseudomonas putida KT2440
ggcugggccccagg

SEQ ID NO: 1594707 - RNA, 18 nt, Pseudomonas putida KT2440
ggcuggcugucgaaggcu

SEQ ID NO: 1594708 - RNA, 15 nt, Pseudomonas putida KT2440
ggcuggcggggacga

SEQ ID NO: 1594709 - RNA, 17 nt, Pseudomonas putida KT2440
ggcugcuuugcagccca

SEQ ID NO: 1594710 - RNA, 21 nt, Pseudomonas putida KT2440
ggcugcuuugcagcccauucg

SEQ ID NO: 1594711 - RNA, 20 nt, Pseudomonas putida KT2440
ggcuggcacccgcaggacgg

SEQ ID NO: 1594712 - RNA, 17 nt, Pseudomonas putida KT2440
ggcuggcagcacgauca

SEQ ID NO: 1594713 - RNA, 18 nt, Pseudomonas putida KT2440
ggcuggcagcacgaucag

SEQ ID NO: 1594714 - RNA, 20 nt, Pseudomonas putida KT2440
ggcuggccaccaugaacagc

SEQ ID NO: 1594715 - RNA, 21 nt, Pseudomonas putida KT2440
ggcuggccaccaugaacagca

SEQ ID NO: 1594716 - RNA, 21 nt, Pseudomonas putida KT2440
ggcuggccagcaagugccccu

SEQ ID NO: 1594717 - RNA, 14 nt, Pseudomonas putida KT2440
ggcuucaggccgcc

SEQ ID NO: 1594718 - RNA, 22 nt, Pseudomonas putida KT2440
ggcuucaaacagcucacuggca

SEQ ID NO: 1594719 - RNA, 18 nt, Pseudomonas putida KT2440
ggcuuacaucggcgacga

SEQ ID NO: 1594720 - RNA, 20 nt, Pseudomonas putida KT2440
ggcuuacccgcgaagaggcc

SEQ ID NO: 1594721 - RNA, 13 nt, Pseudomonas putida KT2440
ggcuguugcgguu

SEQ ID NO: 1594722 - RNA, 13 nt, Pseudomonas putida KT2440
ggcuguuggcggu

SEQ ID NO: 1594723 - RNA, 16 nt, Pseudomonas putida KT2440
ggcugugguucaccgu

SEQ ID NO: 1594724 - RNA, 12 nt, Pseudomonas putida KT2440
ggcugugcaccc

SEQ ID NO: 1594725 - RNA, 12 nt, Pseudomonas putida KT2440
ggcugucuggga

SEQ ID NO: 1594726 - RNA, 23 nt, Pseudomonas putida KT2440
ggcugugaacccccguaggagcg

SEQ ID NO: 1594727 - RNA, 12 nt, Pseudomonas putida KT2440
ggcugucgagca

SEQ ID NO: 1594728 - RNA, 14 nt, Pseudomonas putida KT2440
ggcugucgccuaca

SEQ ID NO: 1594729 - RNA, 17 nt, Pseudomonas putida KT2440
ggcuggugucggccagg

SEQ ID NO: 1594730 - RNA, 13 nt, Pseudomonas putida KT2440
ggcuggugaacca

SEQ ID NO: 1594731 - RNA, 22 nt, Pseudomonas putida KT2440
ggcuggugaagcccuucgaugc

SEQ ID NO: 1594732 - RNA, 14 nt, Pseudomonas putida KT2440
ggcuggugaaggca

SEQ ID NO: 1594733 - RNA, 12 nt, Pseudomonas putida KT2440
gggaacagcucu

SEQ ID NO: 1594734 - RNA, 14 nt, Pseudomonas putida KT2440
gggaacagcagcac

SEQ ID NO: 1594735 - RNA, 23 nt, Pseudomonas putida KT2440
ggcuuuuuuugguuugccugacg

SEQ ID NO: 1594736 - RNA, 14 nt, Pseudomonas putida KT2440
ggcuuuuuccagcg

SEQ ID NO: 1594737 - RNA, 20 nt, Pseudomonas putida KT2440
ggcuuuuucguuauggaagg

SEQ ID NO: 1594738 - RNA, 18 nt, Pseudomonas putida KT2440
ggcuuuugaagucggcgu

SEQ ID NO: 1594739 - RNA, 16 nt, Pseudomonas putida KT2440
ggcuugugcaucagcg

SEQ ID NO: 1594740 - RNA, 22 nt, Pseudomonas putida KT2440
ggcuuguccuuguugaccccgg

SEQ ID NO: 1594741 - RNA, 13 nt, Pseudomonas putida KT2440
ggcuuugggagca

SEQ ID NO: 1594742 - RNA, 14 nt, Pseudomonas putida KT2440
ggcuuucggccacc

SEQ ID NO: 1594743 - RNA, 20 nt, Pseudomonas putida KT2440
ggcuuccucuucaaggccca

SEQ ID NO: 1594744 - RNA, 16 nt, Pseudomonas putida KT2440
ggcuucgaugcccggc

SEQ ID NO: 1594745 - RNA, 21 nt, Pseudomonas putida KT2440
ggcuucgcccguguucgcggg

SEQ ID NO: 1594746 - RNA, 21 nt, Pseudomonas putida KT2440
ggcuuggcagcaccgcugcca

SEQ ID NO: 1594747 - RNA, 21 nt, Pseudomonas putida KT2440
ggcuugcgacuugugcauccu

SEQ ID NO: 1594748 - RNA, 22 nt, Pseudomonas putida KT2440
ggcuucuucgcgggcaugcccg

SEQ ID NO: 1594749 - RNA, 16 nt, Pseudomonas putida KT2440
ggcuugaaucagccuu

SEQ ID NO: 1594750 - RNA, 19 nt, Pseudomonas putida KT2440
ggcuucuuugcaagccuug

SEQ ID NO: 1594751 - RNA, 18 nt, Pseudomonas putida KT2440
ggcugcaguagucgccag

SEQ ID NO: 1594752 - RNA, 15 nt, Pseudomonas putida KT2440
ggcugauugagcagc

SEQ ID NO: 1594753 - RNA, 18 nt, Pseudomonas putida KT2440
ggcugcaaugcagccccu

SEQ ID NO: 1594754 - RNA, 20 nt, Pseudomonas putida KT2440
ggcugcaagguccaggcgug

SEQ ID NO: 1594755 - RNA, 23 nt, Pseudomonas putida KT2440
ggcugcaagguguuggucagggc

SEQ ID NO: 1594756 - RNA, 16 nt, Pseudomonas putida KT2440
ggcugcaaagcgggca

SEQ ID NO: 1594757 - RNA, 17 nt, Pseudomonas putida KT2440
ggcugcaaagcgggcaa

SEQ ID NO: 1594758 - RNA, 20 nt, Pseudomonas putida KT2440
ggcugcaaagcgggcaacug

SEQ ID NO: 1594759 - RNA, 18 nt, Pseudomonas putida KT2440
ggcugcauugcagcccca

SEQ ID NO: 1594760 - RNA, 20 nt, Pseudomonas putida KT2440
ggcugccacgggcauagccc

SEQ ID NO: 1594761 - RNA, 20 nt, Pseudomonas putida KT2440
ggcugccagcgcgcugcgca

SEQ ID NO: 1594762 - RNA, 14 nt, Pseudomonas putida KT2440
ggcugagcagacca

SEQ ID NO: 1594763 - RNA, 16 nt, Pseudomonas putida KT2440
ggcugagcagaccagc

SEQ ID NO: 1594764 - RNA, 13 nt, Pseudomonas putida KT2440
ggcugagccggcu

SEQ ID NO: 1594765 - RNA, 19 nt, Pseudomonas putida KT2440
ggcugagccggcuggcguc

SEQ ID NO: 1594766 - RNA, 13 nt, Pseudomonas putida KT2440
ggcugaucaccgc

SEQ ID NO: 1594767 - RNA, 22 nt, Pseudomonas putida KT2440
ggcugaucaccgccgccaccga

SEQ ID NO: 1594768 - RNA, 21 nt, Pseudomonas putida KT2440
ggcugaggaaguuguccgggu

SEQ ID NO: 1594769 - RNA, 15 nt, Pseudomonas putida KT2440
ggcugaugcgcuggc

SEQ ID NO: 1594770 - RNA, 22 nt, Pseudomonas putida KT2440
ggcugaugcgcuggcccuugcc

SEQ ID NO: 1594771 - RNA, 18 nt, Pseudomonas putida KT2440
ggcugcgugccugcugcu

SEQ ID NO: 1594772 - RNA, 20 nt, Pseudomonas putida KT2440
ggcugcgugccugcugcucg

SEQ ID NO: 1594773 - RNA, 20 nt, Pseudomonas putida KT2440
ggcugcguucaggcaggaac

SEQ ID NO: 1594774 - RNA, 15 nt, Pseudomonas putida KT2440
ggcugcguugcgguc

SEQ ID NO: 1594775 - RNA, 12 nt, Pseudomonas putida KT2440
ggcugcgcgcca

SEQ ID NO: 1594776 - RNA, 15 nt, Pseudomonas putida KT2440
ggcugcgcgcccagg

SEQ ID NO: 1594777 - RNA, 13 nt, Pseudomonas putida KT2440
ggcugcgccgauc

SEQ ID NO: 1594778 - RNA, 23 nt, Pseudomonas putida KT2440
ggcugcgccgccuccaccgggau

SEQ ID NO: 1594779 - RNA, 16 nt, Pseudomonas putida KT2440
ggcugcgacggcgaau

SEQ ID NO: 1594780 - RNA, 15 nt, Pseudomonas putida KT2440
ggcugcgcccgcaca

SEQ ID NO: 1594781 - RNA, 20 nt, Pseudomonas putida KT2440
ggcugccuugcagcccuucg

SEQ ID NO: 1594782 - RNA, 23 nt, Pseudomonas putida KT2440
ggcugccguccaacgggcggaac

SEQ ID NO: 1594783 - RNA, 23 nt, Pseudomonas putida KT2440
ggcucggcugggcuuugggagca

SEQ ID NO: 1594784 - RNA, 21 nt, Pseudomonas putida KT2440
ggcucgcucaggcgcagcgca

SEQ ID NO: 1594785 - RNA, 13 nt, Pseudomonas putida KT2440
ggcucgacggcgc

SEQ ID NO: 1594786 - RNA, 16 nt, Pseudomonas putida KT2440
ggcucgccauugaugc

SEQ ID NO: 1594787 - RNA, 22 nt, Pseudomonas putida KT2440
ggcucgccauugaugcucagga

SEQ ID NO: 1594788 - RNA, 20 nt, Pseudomonas putida KT2440
ggcucgcccacacggcaagc

SEQ ID NO: 1594789 - RNA, 18 nt, Pseudomonas putida KT2440
ggcucgcagccaaugcug

SEQ ID NO: 1594790 - RNA, 18 nt, Pseudomonas putida KT2440
ggcucugccgguguucgc

SEQ ID NO: 1594791 - RNA, 13 nt, Pseudomonas putida KT2440
ggcucucagccca

SEQ ID NO: 1594792 - RNA, 13 nt, Pseudomonas putida KT2440
ggcugaccggcac

SEQ ID NO: 1594793 - RNA, 22 nt, Pseudomonas putida KT2440
ggcugaacuuccaggucggggu

SEQ ID NO: 1594794 - RNA, 21 nt, Pseudomonas putida KT2440
ggcugaaaccgcgaaucgcuc

SEQ ID NO: 1594795 - RNA, 19 nt, Pseudomonas putida KT2440
ggcgucgacgaugaugcgg

SEQ ID NO: 1594796 - RNA, 18 nt, Pseudomonas putida KT2440
ggcgucgcgaucacgcag

SEQ ID NO: 1594797 - RNA, 15 nt, Pseudomonas putida KT2440
ggcgucggcaccggc

SEQ ID NO: 1594798 - RNA, 17 nt, Pseudomonas putida KT2440
ggcgucggcaccggcga

SEQ ID NO: 1594799 - RNA, 16 nt, Pseudomonas putida KT2440
ggcgucgaacaacggc

SEQ ID NO: 1594800 - RNA, 22 nt, Pseudomonas putida KT2440
ggcgugacggauacaucgcaua

SEQ ID NO: 1594801 - RNA, 12 nt, Pseudomonas putida KT2440
ggcgucggcgcg

SEQ ID NO: 1594802 - RNA, 16 nt, Pseudomonas putida KT2440
ggcgucggcgcgcaac

SEQ ID NO: 1594803 - RNA, 15 nt, Pseudomonas putida KT2440
ggcgugcccgcgaac

SEQ ID NO: 1594804 - RNA, 22 nt, Pseudomonas putida KT2440
ggcgugcccggcaaucgccagg

SEQ ID NO: 1594805 - RNA, 17 nt, Pseudomonas putida KT2440
ggcguggauuaugccgg

SEQ ID NO: 1594806 - RNA, 23 nt, Pseudomonas putida KT2440
ggcgugcgcugcauggcggcacc

SEQ ID NO: 1594807 - RNA, 16 nt, Pseudomonas putida KT2440
ggcgugccgucgagca

SEQ ID NO: 1594808 - RNA, 22 nt, Pseudomonas putida KT2440
ggcucgacacgcuugcgaagga

SEQ ID NO: 1594809 - RNA, 23 nt, Pseudomonas putida KT2440
ggcuccuucucgaacagcuggcg

SEQ ID NO: 1594810 - RNA, 20 nt, Pseudomonas putida KT2440
ggcuccggcguguccagcag

SEQ ID NO: 1594811 - RNA, 14 nt, Pseudomonas putida KT2440
ggcucaucugccgg

SEQ ID NO: 1594812 - RNA, 15 nt, Pseudomonas putida KT2440
ggcucaucugccggc

SEQ ID NO: 1594813 - RNA, 20 nt, Pseudomonas putida KT2440
ggcucagucgcaucgacagg

SEQ ID NO: 1594814 - RNA, 21 nt, Pseudomonas putida KT2440
ggcuccaccacagcugcgcca

SEQ ID NO: 1594815 - RNA, 21 nt, Pseudomonas putida KT2440
ggcuccaccgaaaucagcaac

SEQ ID NO: 1594816 - RNA, 16 nt, Pseudomonas putida KT2440
ggcucaacuacccuga

SEQ ID NO: 1594817 - RNA, 15 nt, Pseudomonas putida KT2440
ggcucaacagccacg

SEQ ID NO: 1594818 - RNA, 18 nt, Pseudomonas putida KT2440
ggcuaccgcugcgcacca

SEQ ID NO: 1594819 - RNA, 23 nt, Pseudomonas putida KT2440
ggcuaccgcugcgcaccaaggcg

SEQ ID NO: 1594820 - RNA, 22 nt, Pseudomonas putida KT2440
ggcuauagcucagcugggagag

SEQ ID NO: 1594821 - RNA, 13 nt, Pseudomonas putida KT2440
ggcuaugccgguc

SEQ ID NO: 1594822 - RNA, 18 nt, Pseudomonas putida KT2440
ggcguggugaauggcgag

SEQ ID NO: 1594823 - RNA, 20 nt, Pseudomonas putida KT2440
ggcguggcugcguucaggca

SEQ ID NO: 1594824 - RNA, 22 nt, Pseudomonas putida KT2440
ggcguucagcuugucgaccagg

SEQ ID NO: 1594825 - RNA, 18 nt, Pseudomonas putida KT2440
ggcguguugccgcugugc

SEQ ID NO: 1594826 - RNA, 13 nt, Pseudomonas putida KT2440
ggcguugggcacg

SEQ ID NO: 1594827 - RNA, 12 nt, Pseudomonas putida KT2440
ggcguuggcagu

SEQ ID NO: 1594828 - RNA, 17 nt, Pseudomonas putida KT2440
ggcguugauccggcacu

SEQ ID NO: 1594829 - RNA, 21 nt, Pseudomonas putida KT2440
ggcguugagccgccaacccgu

SEQ ID NO: 1594830 - RNA, 16 nt, Pseudomonas putida KT2440
ggcguugccuucgcga

SEQ ID NO: 1594831 - RNA, 15 nt, Pseudomonas putida KT2440
ggcguugcgaaggcg

SEQ ID NO: 1594832 - RNA, 15 nt, Pseudomonas putida KT2440
ggcguugucagccuu

SEQ ID NO: 1594833 - RNA, 22 nt, Pseudomonas putida KT2440
ggcguuuucguuuacacgguau

SEQ ID NO: 1594834 - RNA, 23 nt, Pseudomonas putida KT2440
ggcguuucuucgaggaugcggcu

SEQ ID NO: 1594835 - RNA, 22 nt, Pseudomonas putida KT2440
ggcguuuuuugugccuggcgcu

SEQ ID NO: 1594836 - RNA, 17 nt, Pseudomonas putida KT2440
ggcgcgacaaucaggcg

SEQ ID NO: 1594837 - RNA, 17 nt, Pseudomonas putida KT2440
ggcgcgaaggucacgcc

SEQ ID NO: 1594838 - RNA, 15 nt, Pseudomonas putida KT2440
ggcgcgaaaagccug

SEQ ID NO: 1594839 - RNA, 16 nt, Pseudomonas putida KT2440
ggcgcgaacagggccu

SEQ ID NO: 1594840 - RNA, 18 nt, Pseudomonas putida KT2440
ggcgcggaauucgcggcg

SEQ ID NO: 1594841 - RNA, 14 nt, Pseudomonas putida KT2440
ggcgcgcuggcgca

SEQ ID NO: 1594842 - RNA, 16 nt, Pseudomonas putida KT2440
ggcgcgggcgcaggca

SEQ ID NO: 1594843 - RNA, 20 nt, Pseudomonas putida KT2440
ggcgcgggcacccuggcggu

SEQ ID NO: 1594844 - RNA, 20 nt, Pseudomonas putida KT2440
ggcgcguaguacuccagcag

SEQ ID NO: 1594845 - RNA, 22 nt, Pseudomonas putida KT2440
ggcgcguaguacuccagcagcg

SEQ ID NO: 1594846 - RNA, 17 nt, Pseudomonas putida KT2440
ggcgcggugaggcaacg

SEQ ID NO: 1594847 - RNA, 19 nt, Pseudomonas putida KT2440
ggcgcggugaggcaacggc

SEQ ID NO: 1594848 - RNA, 20 nt, Pseudomonas putida KT2440
ggcgcugaucaagcccgcuc

SEQ ID NO: 1594849 - RNA, 19 nt, Pseudomonas putida KT2440
ggcgcugaucaucgacagg

SEQ ID NO: 1594850 - RNA, 17 nt, Pseudomonas putida KT2440
ggcgcuggacagcggca

SEQ ID NO: 1594851 - RNA, 22 nt, Pseudomonas putida KT2440
ggcgcuggcgggcaaacuggcg

SEQ ID NO: 1594852 - RNA, 17 nt, Pseudomonas putida KT2440
ggcgcugaccaacaggc

SEQ ID NO: 1594853 - RNA, 13 nt, Pseudomonas putida KT2440
ggcgcugaaacug

SEQ ID NO: 1594854 - RNA, 13 nt, Pseudomonas putida KT2440
ggcgcucgcucca

SEQ ID NO: 1594855 - RNA, 16 nt, Pseudomonas putida KT2440
ggcggcgcagcgcacg

SEQ ID NO: 1594856 - RNA, 13 nt, Pseudomonas putida KT2440
ggcggcggcguga

SEQ ID NO: 1594857 - RNA, 15 nt, Pseudomonas putida KT2440
ggcggcgaucagcgc

SEQ ID NO: 1594858 - RNA, 19 nt, Pseudomonas putida KT2440
ggcggccucgugucgcgaa

SEQ ID NO: 1594859 - RNA, 22 nt, Pseudomonas putida KT2440
ggcggcgguugucgucgaccgc

SEQ ID NO: 1594860 - RNA, 16 nt, Pseudomonas putida KT2440
ggcggcugagccggcu

SEQ ID NO: 1594861 - RNA, 17 nt, Pseudomonas putida KT2440
ggcggcgugaccagccc

SEQ ID NO: 1594862 - RNA, 20 nt, Pseudomonas putida KT2440
ggcggcgugaccagcccggc

SEQ ID NO: 1594863 - RNA, 15 nt, Pseudomonas putida KT2440
ggcgggccgccgaac

SEQ ID NO: 1594864 - RNA, 15 nt, Pseudomonas putida KT2440
ggcgggccaucugcu

SEQ ID NO: 1594865 - RNA, 15 nt, Pseudomonas putida KT2440
ggcggccaucgcuuc

SEQ ID NO: 1594866 - RNA, 18 nt, Pseudomonas putida KT2440
ggcggcccuaucgcgacg

SEQ ID NO: 1594867 - RNA, 22 nt, Pseudomonas putida KT2440
ggcggcccagccagucgcgcaa

SEQ ID NO: 1594868 - RNA, 23 nt, Pseudomonas putida KT2440
ggcggcccagccagucgcgcaac

SEQ ID NO: 1594869 - RNA, 17 nt, Pseudomonas putida KT2440
ggcgcuuugcacccgcg

SEQ ID NO: 1594870 - RNA, 18 nt, Pseudomonas putida KT2440
ggcgcuuugcacccgcgc

SEQ ID NO: 1594871 - RNA, 22 nt, Pseudomonas putida KT2440
ggcgcuuugcacccgcgcgcug

SEQ ID NO: 1594872 - RNA, 17 nt, Pseudomonas putida KT2440
ggcgcuuugcgcaaccg

SEQ ID NO: 1594873 - RNA, 15 nt, Pseudomonas putida KT2440
ggcgcuuucacuggc

SEQ ID NO: 1594874 - RNA, 13 nt, Pseudomonas putida KT2440
ggcggaucagcgc

SEQ ID NO: 1594875 - RNA, 21 nt, Pseudomonas putida KT2440
ggcgcuuggaaauguucaaca

SEQ ID NO: 1594876 - RNA, 21 nt, Pseudomonas putida KT2440
ggcggaucugacggcgcugcu

SEQ ID NO: 1594877 - RNA, 17 nt, Pseudomonas putida KT2440
ggcggauuugcccgcua

SEQ ID NO: 1594878 - RNA, 18 nt, Pseudomonas putida KT2440
ggcggauguucuugaccu

SEQ ID NO: 1594879 - RNA, 18 nt, Pseudomonas putida KT2440
ggcggauguuggccacga

SEQ ID NO: 1594880 - RNA, 16 nt, Pseudomonas putida KT2440
ggcgaguagaagcuug

SEQ ID NO: 1594881 - RNA, 13 nt, Pseudomonas putida KT2440
ggcgagggcuucg

SEQ ID NO: 1594882 - RNA, 11 nt, Pseudomonas putida KT2440
ggccuggccaa

SEQ ID NO: 1594883 - RNA, 14 nt, Pseudomonas putida KT2440
ggccuggaugcggu

SEQ ID NO: 1594884 - RNA, 18 nt, Pseudomonas putida KT2440
ggccuggaugcggucgcc

SEQ ID NO: 1594885 - RNA, 17 nt, Pseudomonas putida KT2440
ggccuggaugcguugcu

SEQ ID NO: 1594886 - RNA, 22 nt, Pseudomonas putida KT2440
ggccuggcgguaaacgugguca

SEQ ID NO: 1594887 - RNA, 11 nt, Pseudomonas putida KT2440
ggcgaucaggg

SEQ ID NO: 1594888 - RNA, 21 nt, Pseudomonas putida KT2440
ggcgauccggauggaucgccu

SEQ ID NO: 1594889 - RNA, 16 nt, Pseudomonas putida KT2440
ggcgaugaucgccugg

SEQ ID NO: 1594890 - RNA, 20 nt, Pseudomonas putida KT2440
ggcgaugcagggcugcgguc

SEQ ID NO: 1594891 - RNA, 23 nt, Pseudomonas putida KT2440
ggcgaucgccagguggaagcgcg

SEQ ID NO: 1594892 - RNA, 17 nt, Pseudomonas putida KT2440
ggcgaucuggucgaagc

SEQ ID NO: 1594893 - RNA, 18 nt, Pseudomonas putida KT2440
ggcgaucugaaucuucgg

SEQ ID NO: 1594894 - RNA, 18 nt, Pseudomonas putida KT2440
ggcgaugcgcacaccgcu

SEQ ID NO: 1594895 - RNA, 23 nt, Pseudomonas putida KT2440
ggcgauggcauccacacgcugcu

SEQ ID NO: 1594896 - RNA, 13 nt, Pseudomonas putida KT2440
ggcgccugcggca

SEQ ID NO: 1594897 - RNA, 13 nt, Pseudomonas putida KT2440
ggcgccgcgagua

SEQ ID NO: 1594898 - RNA, 17 nt, Pseudomonas putida KT2440
ggcgccgagccauagcg

SEQ ID NO: 1594899 - RNA, 15 nt, Pseudomonas putida KT2440
ggcgcaccagcggcu

SEQ ID NO: 1594900 - RNA, 12 nt, Pseudomonas putida KT2440
ggcgcaccacga

SEQ ID NO: 1594901 - RNA, 21 nt, Pseudomonas putida KT2440
ggcgcaccgagcgcucgcgaa

SEQ ID NO: 1594902 - RNA, 22 nt, Pseudomonas putida KT2440
ggcgcaccgagcgcucgcgaau

SEQ ID NO: 1594903 - RNA, 22 nt, Pseudomonas putida KT2440
ggcgcagcaucaucucugccga

SEQ ID NO: 1594904 - RNA, 23 nt, Pseudomonas putida KT2440
ggcgcagcauaugcuggucgccg

SEQ ID NO: 1594905 - RNA, 18 nt, Pseudomonas putida KT2440
ggcgcagcaaggucgccg

SEQ ID NO: 1594906 - RNA, 13 nt, Pseudomonas putida KT2440
ggcgcccagcaac

SEQ ID NO: 1594907 - RNA, 17 nt, Pseudomonas putida KT2440
ggcgcaugcauaagcca

SEQ ID NO: 1594908 - RNA, 19 nt, Pseudomonas putida KT2440
ggcgcaugacuuccaggua

SEQ ID NO: 1594909 - RNA, 22 nt, Pseudomonas putida KT2440
ggcgcauccucggugcgcggua

SEQ ID NO: 1594910 - RNA, 13 nt, Pseudomonas putida KT2440
ggcgcaucgcgag

SEQ ID NO: 1594911 - RNA, 18 nt, Pseudomonas putida KT2440
ggaugugguggaacagga

SEQ ID NO: 1594912 - RNA, 14 nt, Pseudomonas putida KT2440
ggauggucagcgcu

SEQ ID NO: 1594913 - RNA, 15 nt, Pseudomonas putida KT2440
ggaugccacgcugaa

SEQ ID NO: 1594914 - RNA, 20 nt, Pseudomonas putida KT2440
ggaugccacgcugaacacgc

SEQ ID NO: 1594915 - RNA, 14 nt, Pseudomonas putida KT2440
ggauggcaccggca

SEQ ID NO: 1594916 - RNA, 15 nt, Pseudomonas putida KT2440
ggauggcaccggcag

SEQ ID NO: 1594917 - RNA, 15 nt, Pseudomonas putida KT2440
ggauggccaugaucg

SEQ ID NO: 1594918 - RNA, 19 nt, Pseudomonas putida KT2440
ggaucggguuuacccgcga

SEQ ID NO: 1594919 - RNA, 20 nt, Pseudomonas putida KT2440
ggaucggguuuacccgcgaa

SEQ ID NO: 1594920 - RNA, 14 nt, Pseudomonas putida KT2440
ggaucggugccacc

SEQ ID NO: 1594921 - RNA, 23 nt, Pseudomonas putida KT2440
ggaucugacggcgcugcuggccu

SEQ ID NO: 1594922 - RNA, 22 nt, Pseudomonas putida KT2440
ggaugauccagcccaccacgaa

SEQ ID NO: 1594923 - RNA, 21 nt, Pseudomonas putida KT2440
ggaugacguccggcugcgggu

SEQ ID NO: 1594924 - RNA, 20 nt, Pseudomonas putida KT2440
ggaucgccgccgaugcgcuu

SEQ ID NO: 1594925 - RNA, 19 nt, Pseudomonas putida KT2440
ggaaaugaagacggugaga

SEQ ID NO: 1594926 - RNA, 18 nt, Pseudomonas putida KT2440
ggaaauguucacggcggc

SEQ ID NO: 1594927 - RNA, 15 nt, Pseudomonas putida KT2440
ggaaauuggccagca

SEQ ID NO: 1594928 - RNA, 18 nt, Pseudomonas putida KT2440
ggaaauuggccagcaggc

SEQ ID NO: 1594929 - RNA, 15 nt, Pseudomonas putida KT2440
ggaaauuggcgagca

SEQ ID NO: 1594930 - RNA, 20 nt, Pseudomonas putida KT2440
ggcacccaucacgacgcggg

SEQ ID NO: 1594931 - RNA, 16 nt, Pseudomonas putida KT2440
ggcaccccagccgcuc

SEQ ID NO: 1594932 - RNA, 21 nt, Pseudomonas putida KT2440
ggcaccccuuucuccagcaac

SEQ ID NO: 1594933 - RNA, 19 nt, Pseudomonas putida KT2440
ggcacccacagcgccugcu

SEQ ID NO: 1594934 - RNA, 16 nt, Pseudomonas putida KT2440
ggcacccagccagcga

SEQ ID NO: 1594935 - RNA, 21 nt, Pseudomonas putida KT2440
ggcaccacaagaacugcgacg

SEQ ID NO: 1594936 - RNA, 19 nt, Pseudomonas putida KT2440
ggcaccuaucgcugccgcc

SEQ ID NO: 1594937 - RNA, 16 nt, Pseudomonas putida KT2440
ggcaccgcacccggcg

SEQ ID NO: 1594938 - RNA, 16 nt, Pseudomonas putida KT2440
ggcacgaagcccaguu

SEQ ID NO: 1594939 - RNA, 16 nt, Pseudomonas putida KT2440
ggcacgaaacgccacg

SEQ ID NO: 1594940 - RNA, 16 nt, Pseudomonas putida KT2440
ggcacgcucgcgcagg

SEQ ID NO: 1594941 - RNA, 19 nt, Pseudomonas putida KT2440
ggcacgcucgcgcaggaac

SEQ ID NO: 1594942 - RNA, 19 nt, Pseudomonas putida KT2440
ggcacgcgggccguagugg

SEQ ID NO: 1594943 - RNA, 19 nt, Pseudomonas putida KT2440
ggcacgcguaccccuggcg

SEQ ID NO: 1594944 - RNA, 19 nt, Pseudomonas putida KT2440
ggcacgcgccagcagcgcg

SEQ ID NO: 1594945 - RNA, 13 nt, Pseudomonas putida KT2440
ggcacucggucgg

SEQ ID NO: 1594946 - RNA, 16 nt, Pseudomonas putida KT2440
ggcacucgaagcacuc

SEQ ID NO: 1594947 - RNA, 13 nt, Pseudomonas putida KT2440
ggcacuggccagc

SEQ ID NO: 1594948 - RNA, 23 nt, Pseudomonas putida KT2440
ggcacuggccagcggcgcggccu

SEQ ID NO: 1594949 - RNA, 17 nt, Pseudomonas putida KT2440
ggcacguuggugccggu

SEQ ID NO: 1594950 - RNA, 18 nt, Pseudomonas putida KT2440
ggcacggcaccagcacca

SEQ ID NO: 1594951 - RNA, 16 nt, Pseudomonas putida KT2440
ggcaaagaaacaccag

SEQ ID NO: 1594952 - RNA, 14 nt, Pseudomonas putida KT2440
ggcaaagaacauca

SEQ ID NO: 1594953 - RNA, 19 nt, Pseudomonas putida KT2440
ggcaacccuucggccagca

SEQ ID NO: 1594954 - RNA, 20 nt, Pseudomonas putida KT2440
ggcaaccgagaucucgguac

SEQ ID NO: 1594955 - RNA, 17 nt, Pseudomonas putida KT2440
ggauuguucccacaggg

SEQ ID NO: 1594956 - RNA, 13 nt, Pseudomonas putida KT2440
ggauuugccggug

SEQ ID NO: 1594957 - RNA, 22 nt, Pseudomonas putida KT2440
ggcaaaacucaccccguagcgc

SEQ ID NO: 1594958 - RNA, 14 nt, Pseudomonas putida KT2440
ggauuuucgcgcuc

SEQ ID NO: 1594959 - RNA, 14 nt, Pseudomonas putida KT2440
ggcaaacgcgguca

SEQ ID NO: 1594960 - RNA, 18 nt, Pseudomonas putida KT2440
ggcaaacccgcgccuaca

SEQ ID NO: 1594961 - RNA, 18 nt, Pseudomonas putida KT2440
ggcaaacuccacugugcc

SEQ ID NO: 1594962 - RNA, 20 nt, Pseudomonas putida KT2440
ggcaaacucgucgcuggucc

SEQ ID NO: 1594963 - RNA, 21 nt, Pseudomonas putida KT2440
ggcaaacagacggugcgccug

SEQ ID NO: 1594964 - RNA, 17 nt, Pseudomonas putida KT2440
ggcaaacagcaccagcc

SEQ ID NO: 1594965 - RNA, 17 nt, Pseudomonas putida KT2440
ggcaaucugcucgacga

SEQ ID NO: 1594966 - RNA, 18 nt, Pseudomonas putida KT2440
ggcaaucugcagcagcau

SEQ ID NO: 1594967 - RNA, 12 nt, Pseudomonas putida KT2440
ggcaaucggcag

SEQ ID NO: 1594968 - RNA, 18 nt, Pseudomonas putida KT2440
ggcaagcccgcucccaca

SEQ ID NO: 1594969 - RNA, 21 nt, Pseudomonas putida KT2440
ggcaagcccgcucccacagga

SEQ ID NO: 1594970 - RNA, 21 nt, Pseudomonas putida KT2440
ggcaagcccgcucccacaggg

SEQ ID NO: 1594971 - RNA, 19 nt, Pseudomonas putida KT2440
ggcaagcccgcuccuacag

SEQ ID NO: 1594972 - RNA, 21 nt, Pseudomonas putida KT2440
ggcaagcccgcuccuacaggu

SEQ ID NO: 1594973 - RNA, 18 nt, Pseudomonas putida KT2440
ggcaagcccgcuccuacg

SEQ ID NO: 1594974 - RNA, 12 nt, Pseudomonas putida KT2440
ggcacaggccag

SEQ ID NO: 1594975 - RNA, 14 nt, Pseudomonas putida KT2440
ggcacaggcccaaa

SEQ ID NO: 1594976 - RNA, 20 nt, Pseudomonas putida KT2440
ggcacaggcuuacaacugcu

SEQ ID NO: 1594977 - RNA, 18 nt, Pseudomonas putida KT2440
ggcaauguucgcugccag

SEQ ID NO: 1594978 - RNA, 23 nt, Pseudomonas putida KT2440
ggcacagaucaacgccgccagcg

SEQ ID NO: 1594979 - RNA, 15 nt, Pseudomonas putida KT2440
ggcaauguccagccc

SEQ ID NO: 1594980 - RNA, 20 nt, Pseudomonas putida KT2440
ggcaaugcgagacgccacca

SEQ ID NO: 1594981 - RNA, 15 nt, Pseudomonas putida KT2440
ggcaaugcgcgcgaa

SEQ ID NO: 1594982 - RNA, 23 nt, Pseudomonas putida KT2440
ggcaaugaucagcccuugccagu

SEQ ID NO: 1594983 - RNA, 17 nt, Pseudomonas putida KT2440
ggcaaugauccggucca

SEQ ID NO: 1594984 - RNA, 19 nt, Pseudomonas putida KT2440
ggcaaugcccauggccagg

SEQ ID NO: 1594985 - RNA, 15 nt, Pseudomonas putida KT2440
ggcaugagccuggcc

SEQ ID NO: 1594986 - RNA, 16 nt, Pseudomonas putida KT2440
ggcaugugcacuggca

SEQ ID NO: 1594987 - RNA, 19 nt, Pseudomonas putida KT2440
ggcauuuucgauacggccg

SEQ ID NO: 1594988 - RNA, 14 nt, Pseudomonas putida KT2440
ggcauuuccagcgu

SEQ ID NO: 1594989 - RNA, 20 nt, Pseudomonas putida KT2440
ggcauaccgcaacaccugcc

SEQ ID NO: 1594990 - RNA, 21 nt, Pseudomonas putida KT2440
ggcauacgaggccgucguagg

SEQ ID NO: 1594991 - RNA, 20 nt, Pseudomonas putida KT2440
ggcaguacauagaacagcau

SEQ ID NO: 1594992 - RNA, 18 nt, Pseudomonas putida KT2440
ggcauaacggcuggcgca

SEQ ID NO: 1594993 - RNA, 19 nt, Pseudomonas putida KT2440
ggcauaacggcuggcgcau

SEQ ID NO: 1594994 - RNA, 13 nt, Pseudomonas putida KT2440
ggcaggaacuggc

SEQ ID NO: 1594995 - RNA, 14 nt, Pseudomonas putida KT2440
ggcaggaacuggcu

SEQ ID NO: 1594996 - RNA, 20 nt, Pseudomonas putida KT2440
ggcaggaacuggcugccgcu

SEQ ID NO: 1594997 - RNA, 12 nt, Pseudomonas putida KT2440
ggcaggccagca

SEQ ID NO: 1594998 - RNA, 16 nt, Pseudomonas putida KT2440
ggcaggcccagguaac

SEQ ID NO: 1594999 - RNA, 19 nt, Pseudomonas putida KT2440
ggcaggccccugcaacagg

SEQ ID NO: 1595000 - RNA, 16 nt, Pseudomonas putida KT2440
ggcaggcgcagcugcc

SEQ ID NO: 1595001 - RNA, 15 nt, Pseudomonas putida KT2440
ggcagacuucgcugu

SEQ ID NO: 1595002 - RNA, 21 nt, Pseudomonas putida KT2440
ggcagacuaccaacaccggcg

SEQ ID NO: 1595003 - RNA, 14 nt, Pseudomonas putida KT2440
ggcagaccugcugg

SEQ ID NO: 1595004 - RNA, 13 nt, Pseudomonas putida KT2440
ggcagagcgccag

SEQ ID NO: 1595005 - RNA, 21 nt, Pseudomonas putida KT2440
ggcagaucgaaagacagcgcg

SEQ ID NO: 1595006 - RNA, 21 nt, Pseudomonas putida KT2440
ggcagcucgagcaugcggaua

SEQ ID NO: 1595007 - RNA, 14 nt, Pseudomonas putida KT2440
ggcagcuccagcca

SEQ ID NO: 1595008 - RNA, 20 nt, Pseudomonas putida KT2440
ggcagcggcgaacggucggu

SEQ ID NO: 1595009 - RNA, 19 nt, Pseudomonas putida KT2440
ggccagccgcgccaggucg

SEQ ID NO: 1595010 - RNA, 17 nt, Pseudomonas putida KT2440
ggccagcccauggcgcu

SEQ ID NO: 1595011 - RNA, 23 nt, Pseudomonas putida KT2440
ggccagcaggccauacagggccu

SEQ ID NO: 1595012 - RNA, 14 nt, Pseudomonas putida KT2440
ggccagcaggcccg

SEQ ID NO: 1595013 - RNA, 12 nt, Pseudomonas putida KT2440
ggccagagcgcg

SEQ ID NO: 1595014 - RNA, 23 nt, Pseudomonas putida KT2440
ggccagaaacggcggcagauaca

SEQ ID NO: 1595015 - RNA, 12 nt, Pseudomonas putida KT2440
ggccagcaagug

SEQ ID NO: 1595016 - RNA, 23 nt, Pseudomonas putida KT2440
ggccagcgucguguucgccuguc

SEQ ID NO: 1595017 - RNA, 15 nt, Pseudomonas putida KT2440
ggccagcuccuucgc

SEQ ID NO: 1595018 - RNA, 15 nt, Pseudomonas putida KT2440
ggccagcgccugcug

SEQ ID NO: 1595019 - RNA, 16 nt, Pseudomonas putida KT2440
ggccaauaccgcugca

SEQ ID NO: 1595020 - RNA, 17 nt, Pseudomonas putida KT2440
ggccaauaucuggugca

SEQ ID NO: 1595021 - RNA, 14 nt, Pseudomonas putida KT2440
ggccaauggcaggu

SEQ ID NO: 1595022 - RNA, 19 nt, Pseudomonas putida KT2440
ggccacauggaucagcuca

SEQ ID NO: 1595023 - RNA, 15 nt, Pseudomonas putida KT2440
ggccaacgacagguc

SEQ ID NO: 1595024 - RNA, 16 nt, Pseudomonas putida KT2440
ggccaaccagccggca

SEQ ID NO: 1595025 - RNA, 17 nt, Pseudomonas putida KT2440
ggccaagguugccacca

SEQ ID NO: 1595026 - RNA, 17 nt, Pseudomonas putida KT2440
ggccaaggucuccagca

SEQ ID NO: 1595027 - RNA, 23 nt, Pseudomonas putida KT2440
ggccaaggucaucgggaucagca

SEQ ID NO: 1595028 - RNA, 20 nt, Pseudomonas putida KT2440
ggccaacuccccacccaggu

SEQ ID NO: 1595029 - RNA, 18 nt, Pseudomonas putida KT2440
ggccaagccgcugccaca

SEQ ID NO: 1595030 - RNA, 15 nt, Pseudomonas putida KT2440
ggccacccuccgggu

SEQ ID NO: 1595031 - RNA, 20 nt, Pseudomonas putida KT2440
ggccacccggaccagcgccg

SEQ ID NO: 1595032 - RNA, 20 nt, Pseudomonas putida KT2440
ggccacgguguauccagccc

SEQ ID NO: 1595033 - RNA, 22 nt, Pseudomonas putida KT2440
ggccacgguguauccagcccgg

SEQ ID NO: 1595034 - RNA, 21 nt, Pseudomonas putida KT2440
ggccacgguagccagucugcu

SEQ ID NO: 1595035 - RNA, 15 nt, Pseudomonas putida KT2440
ggccacgcgcgccuu

SEQ ID NO: 1595036 - RNA, 22 nt, Pseudomonas putida KT2440
ggccgaugggcuguuccagcag

SEQ ID NO: 1595037 - RNA, 22 nt, Pseudomonas putida KT2440
ggccgauugccugggcgagcca

SEQ ID NO: 1595038 - RNA, 13 nt, Pseudomonas putida KT2440
ggccgaucacgaa

SEQ ID NO: 1595039 - RNA, 21 nt, Pseudomonas putida KT2440
ggccgaucaguacgaugcugc

SEQ ID NO: 1595040 - RNA, 22 nt, Pseudomonas putida KT2440
ggccgaucacucggcaggaaac

SEQ ID NO: 1595041 - RNA, 22 nt, Pseudomonas putida KT2440
ggccgagcugauccgccuggcc

SEQ ID NO: 1595042 - RNA, 13 nt, Pseudomonas putida KT2440
ggccgacuggcgc

SEQ ID NO: 1595043 - RNA, 20 nt, Pseudomonas putida KT2440
ggccgagcaggagcugaacu

SEQ ID NO: 1595044 - RNA, 23 nt, Pseudomonas putida KT2440
ggcccuuaaggucaaucagggau

SEQ ID NO: 1595045 - RNA, 13 nt, Pseudomonas putida KT2440
ggcccuucgcggg

SEQ ID NO: 1595046 - RNA, 14 nt, Pseudomonas putida KT2440
ggcccuucgcgggc

SEQ ID NO: 1595047 - RNA, 15 nt, Pseudomonas putida KT2440
ggcccuucgcgggca

SEQ ID NO: 1595048 - RNA, 21 nt, Pseudomonas putida KT2440
ggcccugugcuuugagcaggc

SEQ ID NO: 1595049 - RNA, 18 nt, Pseudomonas putida KT2440
ggcccuguagagcgccuu

SEQ ID NO: 1595050 - RNA, 15 nt, Pseudomonas putida KT2440
ggcccuucugcugcu

SEQ ID NO: 1595051 - RNA, 15 nt, Pseudomonas putida KT2440
ggcccuuucgcgggu

SEQ ID NO: 1595052 - RNA, 18 nt, Pseudomonas putida KT2440
ggccgaaaccgcccggga

SEQ ID NO: 1595053 - RNA, 14 nt, Pseudomonas putida KT2440
ggcccugccuacca

SEQ ID NO: 1595054 - RNA, 12 nt, Pseudomonas putida KT2440
ggcccuggagcg

SEQ ID NO: 1595055 - RNA, 15 nt, Pseudomonas putida KT2440
ggcccugaaggccgc

SEQ ID NO: 1595056 - RNA, 13 nt, Pseudomonas putida KT2440
ggcccugacgcgu

SEQ ID NO: 1595057 - RNA, 13 nt, Pseudomonas putida KT2440
ggcccugagccuu

SEQ ID NO: 1595058 - RNA, 14 nt, Pseudomonas putida KT2440
ggcccugagccuug

SEQ ID NO: 1595059 - RNA, 14 nt, Pseudomonas putida KT2440
ggcccgcgaugccg

SEQ ID NO: 1595060 - RNA, 15 nt, Pseudomonas putida KT2440
ggcccgccgccacca

SEQ ID NO: 1595061 - RNA, 16 nt, Pseudomonas putida KT2440
ggcccggcagguugau

SEQ ID NO: 1595062 - RNA, 22 nt, Pseudomonas putida KT2440
ggcccgcuauccucgaucgcca

SEQ ID NO: 1595063 - RNA, 17 nt, Pseudomonas putida KT2440
ggcccgugguuggagcg

SEQ ID NO: 1595064 - RNA, 17 nt, Pseudomonas putida KT2440
ggcccgugacgaaggcg

SEQ ID NO: 1595065 - RNA, 21 nt, Pseudomonas putida KT2440
ggcccuaucgcgacgcaaggc

SEQ ID NO: 1595066 - RNA, 17 nt, Pseudomonas putida KT2440
ggcccuauggggugagc

SEQ ID NO: 1595067 - RNA, 14 nt, Pseudomonas putida KT2440
ggcccggcuggcca

SEQ ID NO: 1595068 - RNA, 24 nt, Pseudomonas putida KT2440
ggcccgccaguaggcugcagccuu

SEQ ID NO: 1595069 - RNA, 23 nt, Pseudomonas putida KT2440
ggcccgccaccgccucgcccagg

SEQ ID NO: 1595070 - RNA, 18 nt, Pseudomonas putida KT2440
ggcccgaugaucaggccg

SEQ ID NO: 1595071 - RNA, 19 nt, Pseudomonas putida KT2440
ggcccgagcccccgcugcu

SEQ ID NO: 1595072 - RNA, 17 nt, Pseudomonas putida KT2440
ggccccgauacagcgcg

SEQ ID NO: 1595073 - RNA, 16 nt, Pseudomonas putida KT2440
ggccaggccccuuggc

SEQ ID NO: 1595074 - RNA, 13 nt, Pseudomonas putida KT2440
ggccccaggcggu

SEQ ID NO: 1595075 - RNA, 12 nt, Pseudomonas putida KT2440
ggccccagggau

SEQ ID NO: 1595076 - RNA, 16 nt, Pseudomonas putida KT2440
ggccccagggaucgau

SEQ ID NO: 1595077 - RNA, 20 nt, Pseudomonas putida KT2440
ggcccaugucgaucagcggc

SEQ ID NO: 1595078 - RNA, 14 nt, Pseudomonas putida KT2440
ggcccauuccgggu

SEQ ID NO: 1595079 - RNA, 21 nt, Pseudomonas putida KT2440
ggcccauuccgggucgccagu

SEQ ID NO: 1595080 - RNA, 16 nt, Pseudomonas putida KT2440
ggcccauucgcgggca

SEQ ID NO: 1595081 - RNA, 21 nt, Pseudomonas putida KT2440
ggccccaauugcuucaaccgu

SEQ ID NO: 1595082 - RNA, 15 nt, Pseudomonas putida KT2440
ggccccaccaggcac

SEQ ID NO: 1595083 - RNA, 14 nt, Pseudomonas putida KT2440
ggcccaugaucgcg

SEQ ID NO: 1595084 - RNA, 20 nt, Pseudomonas putida KT2440
ggccgggucacggcugaaga

SEQ ID NO: 1595085 - RNA, 16 nt, Pseudomonas putida KT2440
ggccgggucgaccugg

SEQ ID NO: 1595086 - RNA, 18 nt, Pseudomonas putida KT2440
ggccgucguguaggagcg

SEQ ID NO: 1595087 - RNA, 16 nt, Pseudomonas putida KT2440
ggccguggcaaggccc

SEQ ID NO: 1595088 - RNA, 18 nt, Pseudomonas putida KT2440
ggccguugaucagcgaca

SEQ ID NO: 1595089 - RNA, 15 nt, Pseudomonas putida KT2440
ggccguguucaggca

SEQ ID NO: 1595090 - RNA, 22 nt, Pseudomonas putida KT2440
ggccguugcuuucagcucuucg

SEQ ID NO: 1595091 - RNA, 23 nt, Pseudomonas putida KT2440
ggccguuucacgccucaugaucu

SEQ ID NO: 1595092 - RNA, 16 nt, Pseudomonas putida KT2440
ggccuccucgcgggca

SEQ ID NO: 1595093 - RNA, 20 nt, Pseudomonas putida KT2440
ggccugcaagccggcgaaca

SEQ ID NO: 1595094 - RNA, 18 nt, Pseudomonas putida KT2440
ggccugcacgaucgaccg

SEQ ID NO: 1595095 - RNA, 16 nt, Pseudomonas putida KT2440
ggccugauuggcaucg

SEQ ID NO: 1595096 - RNA, 16 nt, Pseudomonas putida KT2440
ggccugcggcagccag

SEQ ID NO: 1595097 - RNA, 12 nt, Pseudomonas putida KT2440
ggccugcccggu

SEQ ID NO: 1595098 - RNA, 22 nt, Pseudomonas putida KT2440
ggccugcacuaccucgcucagg

SEQ ID NO: 1595099 - RNA, 12 nt, Pseudomonas putida KT2440
ggccugcacugc

SEQ ID NO: 1595100 - RNA, 17 nt, Pseudomonas putida KT2440
ggccugcagccguugcu

SEQ ID NO: 1595101 - RNA, 20 nt, Pseudomonas putida KT2440
ggccugcauccacaccagcg

SEQ ID NO: 1595102 - RNA, 22 nt, Pseudomonas putida KT2440
ggccugcauccacaccagcggc

SEQ ID NO: 1595103 - RNA, 23 nt, Pseudomonas putida KT2440
ggccugcauccacaccagcggcg

SEQ ID NO: 1595104 - RNA, 19 nt, Pseudomonas putida KT2440
ggccgcuugcaaccgacgc

SEQ ID NO: 1595105 - RNA, 19 nt, Pseudomonas putida KT2440
ggccgcuuugugcugcgaa

SEQ ID NO: 1595106 - RNA, 22 nt, Pseudomonas putida KT2440
ggccggauagagcccggcgcag

SEQ ID NO: 1595107 - RNA, 21 nt, Pseudomonas putida KT2440
ggccggcacagacaccgcaaa

SEQ ID NO: 1595108 - RNA, 14 nt, Pseudomonas putida KT2440
ggccggcacaggaa

SEQ ID NO: 1595109 - RNA, 21 nt, Pseudomonas putida KT2440
ggccggcacgacuucgcacac

SEQ ID NO: 1595110 - RNA, 15 nt, Pseudomonas putida KT2440
ggccggcaccgacag

SEQ ID NO: 1595111 - RNA, 19 nt, Pseudomonas putida KT2440
ggccggcaccgacagcaac

SEQ ID NO: 1595112 - RNA, 16 nt, Pseudomonas putida KT2440
ggccggcacugaccac

SEQ ID NO: 1595113 - RNA, 13 nt, Pseudomonas putida KT2440
ggccggcagccag

SEQ ID NO: 1595114 - RNA, 23 nt, Pseudomonas putida KT2440
ggccggcaggcccggcccuuucg

SEQ ID NO: 1595115 - RNA, 15 nt, Pseudomonas putida KT2440
ggccgcaaggcggcc

SEQ ID NO: 1595116 - RNA, 22 nt, Pseudomonas putida KT2440
ggccgcaacacauuauccacca

SEQ ID NO: 1595117 - RNA, 14 nt, Pseudomonas putida KT2440
ggccgcaaagcggc

SEQ ID NO: 1595118 - RNA, 12 nt, Pseudomonas putida KT2440
ggccgccuugcg

SEQ ID NO: 1595119 - RNA, 17 nt, Pseudomonas putida KT2440
ggccgccucccaggacu

SEQ ID NO: 1595120 - RNA, 12 nt, Pseudomonas putida KT2440
gcuucaaggcca

SEQ ID NO: 1595121 - RNA, 18 nt, Pseudomonas putida KT2440
gcuucaaggccacgcggu

SEQ ID NO: 1595122 - RNA, 16 nt, Pseudomonas putida KT2440
gcuucaaggucgguga

SEQ ID NO: 1595123 - RNA, 20 nt, Pseudomonas putida KT2440
gcuucaaaauagucgaaggc

SEQ ID NO: 1595124 - RNA, 13 nt, Pseudomonas putida KT2440
gcuucaccgcgca

SEQ ID NO: 1595125 - RNA, 18 nt, Pseudomonas putida KT2440
gcuucacgucuggcacca

SEQ ID NO: 1595126 - RNA, 17 nt, Pseudomonas putida KT2440
gcuucagaucacccuug

SEQ ID NO: 1595127 - RNA, 20 nt, Pseudomonas putida KT2440
gcuuacccgcgaagaggccg

SEQ ID NO: 1595128 - RNA, 22 nt, Pseudomonas putida KT2440
gcuuaaucccgcaaguccgacu

SEQ ID NO: 1595129 - RNA, 22 nt, Pseudomonas putida KT2440
gcuguugcgcaccuugugcacg

SEQ ID NO: 1595130 - RNA, 19 nt, Pseudomonas putida KT2440
gcuguuggcacggcugaaa

SEQ ID NO: 1595131 - RNA, 20 nt, Pseudomonas putida KT2440
gcuguuguugccucaggugc

SEQ ID NO: 1595132 - RNA, 13 nt, Pseudomonas putida KT2440
gcuguugagcagc

SEQ ID NO: 1595133 - RNA, 20 nt, Pseudomonas putida KT2440
gcuguugagcagcagcccuu

SEQ ID NO: 1595134 - RNA, 18 nt, Pseudomonas putida KT2440
gcuguuccagcccggcaa

SEQ ID NO: 1595135 - RNA, 21 nt, Pseudomonas putida KT2440
gcuguuccauuucccuacagc

SEQ ID NO: 1595136 - RNA, 22 nt, Pseudomonas putida KT2440
gcuguuccggccgcuucgcgga

SEQ ID NO: 1595137 - RNA, 17 nt, Pseudomonas putida KT2440
gcuguuccucgccaugg

SEQ ID NO: 1595138 - RNA, 19 nt, Pseudomonas putida KT2440
gcugugcccugaucgccuc

SEQ ID NO: 1595139 - RNA, 24 nt, Pseudomonas putida KT2440
gcugugcacccgugccugccugca

SEQ ID NO: 1595140 - RNA, 17 nt, Pseudomonas putida KT2440
gcugugguucaccgugu

SEQ ID NO: 1595141 - RNA, 16 nt, Pseudomonas putida KT2440
gcugugcggcaaccgg

SEQ ID NO: 1595142 - RNA, 21 nt, Pseudomonas putida KT2440
gcugucggcgucggccaugcc

SEQ ID NO: 1595143 - RNA, 21 nt, Pseudomonas putida KT2440
gcugucguccagcucgcgcag

SEQ ID NO: 1595144 - RNA, 21 nt, Pseudomonas putida KT2440
gcugucgaucagacgcuccag

SEQ ID NO: 1595145 - RNA, 19 nt, Pseudomonas putida KT2440
gcugucgaugucuuucgcg

SEQ ID NO: 1595146 - RNA, 14 nt, Pseudomonas putida KT2440
gcuguacagcgcau

SEQ ID NO: 1595147 - RNA, 15 nt, Pseudomonas putida KT2440
gcuguacaggugcga

SEQ ID NO: 1595148 - RNA, 16 nt, Pseudomonas putida KT2440
gcuguacaccaggacu

SEQ ID NO: 1595149 - RNA, 19 nt, Pseudomonas putida KT2440
gcuguaccggccucuucgc

SEQ ID NO: 1595150 - RNA, 17 nt, Pseudomonas putida KT2440
gcuguaggggcgggccu

SEQ ID NO: 1595151 - RNA, 18 nt, Pseudomonas putida KT2440
gcuguagcccaccagguc

SEQ ID NO: 1595152 - RNA, 22 nt, Pseudomonas putida KT2440
gcugucgagcagguucaggcgc

SEQ ID NO: 1595153 - RNA, 24 nt, Pseudomonas putida KT2440
gcugucgagcagguucaggcgcag

SEQ ID NO: 1595154 - RNA, 23 nt, Pseudomonas putida KT2440
gcugucgaagcgcucccaggccu

SEQ ID NO: 1595155 - RNA, 22 nt, Pseudomonas putida KT2440
gcuguccggcgugaaauccuca

SEQ ID NO: 1595156 - RNA, 16 nt, Pseudomonas putida KT2440
gcuguccagcgcauca

SEQ ID NO: 1595157 - RNA, 18 nt, Pseudomonas putida KT2440
gcuguauguguguguccg

SEQ ID NO: 1595158 - RNA, 14 nt, Pseudomonas putida KT2440
gcugguggcaaugc

SEQ ID NO: 1595159 - RNA, 14 nt, Pseudomonas putida KT2440
gcugguggcggcau

SEQ ID NO: 1595160 - RNA, 19 nt, Pseudomonas putida KT2440
gcuggugguggcccugacc

SEQ ID NO: 1595161 - RNA, 15 nt, Pseudomonas putida KT2440
gcuggugggcgauga

SEQ ID NO: 1595162 - RNA, 17 nt, Pseudomonas putida KT2440
gcuggugggcgaugauc

SEQ ID NO: 1595163 - RNA, 21 nt, Pseudomonas putida KT2440
gcugguuuaucagcagcucga

SEQ ID NO: 1595164 - RNA, 15 nt, Pseudomonas putida KT2440
gcugguugaucaacu

SEQ ID NO: 1595165 - RNA, 18 nt, Pseudomonas putida KT2440
gcugguuaugagccuaca

SEQ ID NO: 1595166 - RNA, 15 nt, Pseudomonas putida KT2440
gcugguucugcugca

SEQ ID NO: 1595167 - RNA, 16 nt, Pseudomonas putida KT2440
gcugguucugcugcag

SEQ ID NO: 1595168 - RNA, 16 nt, Pseudomonas putida KT2440
gcuggucgaggcggcu

SEQ ID NO: 1595169 - RNA, 13 nt, Pseudomonas putida KT2440
gcuggucggcaau

SEQ ID NO: 1595170 - RNA, 20 nt, Pseudomonas putida KT2440
gcugggcgucaaccaauguc

SEQ ID NO: 1595171 - RNA, 15 nt, Pseudomonas putida KT2440
gcugggucagcgcug

SEQ ID NO: 1595172 - RNA, 14 nt, Pseudomonas putida KT2440
gcugguccucgacg

SEQ ID NO: 1595173 - RNA, 19 nt, Pseudomonas putida KT2440
gcugguccgggcccaugcc

SEQ ID NO: 1595174 - RNA, 18 nt, Pseudomonas putida KT2440
gcugguacaugccgccga

SEQ ID NO: 1595175 - RNA, 19 nt, Pseudomonas putida KT2440
gcugcucauacugcugacc

SEQ ID NO: 1595176 - RNA, 23 nt, Pseudomonas putida KT2440
gcugcucauacugcugacccgga

SEQ ID NO: 1595177 - RNA, 19 nt, Pseudomonas putida KT2440
gcugcuccaugaucucgcg

SEQ ID NO: 1595178 - RNA, 21 nt, Pseudomonas putida KT2440
gcugcuccaugaucucgcgcu

SEQ ID NO: 1595179 - RNA, 17 nt, Pseudomonas putida KT2440
gcugcucguacgaguug

SEQ ID NO: 1595180 - RNA, 15 nt, Pseudomonas putida KT2440
gcugcucugcaaugc

SEQ ID NO: 1595181 - RNA, 14 nt, Pseudomonas putida KT2440
gcugcucugccgcc

SEQ ID NO: 1595182 - RNA, 23 nt, Pseudomonas putida KT2440
gcuggcgucauccugcgcggcca

SEQ ID NO: 1595183 - RNA, 19 nt, Pseudomonas putida KT2440
gcuggcgucgaugaucacc

SEQ ID NO: 1595184 - RNA, 15 nt, Pseudomonas putida KT2440
gcuggcgguguagaa

SEQ ID NO: 1595185 - RNA, 24 nt, Pseudomonas putida KT2440
gcugggcgaacgccugcagggccu

SEQ ID NO: 1595186 - RNA, 17 nt, Pseudomonas putida KT2440
gcugggccccaggcggu

SEQ ID NO: 1595187 - RNA, 17 nt, Pseudomonas putida KT2440
gcugggcaugaucgcgc

SEQ ID NO: 1595188 - RNA, 17 nt, Pseudomonas putida KT2440
gcuggcugucgaaggcu

SEQ ID NO: 1595189 - RNA, 18 nt, Pseudomonas putida KT2440
gcugggaauccagugcag

SEQ ID NO: 1595190 - RNA, 23 nt, Pseudomonas putida KT2440
gcugggaauccagugcaggucua

SEQ ID NO: 1595191 - RNA, 13 nt, Pseudomonas putida KT2440
gcuggcucagcga

SEQ ID NO: 1595192 - RNA, 15 nt, Pseudomonas putida KT2440
gcuuccuugcgcacg

SEQ ID NO: 1595193 - RNA, 19 nt, Pseudomonas putida KT2440
gcuucgcccguguucgcgg

SEQ ID NO: 1595194 - RNA, 19 nt, Pseudomonas putida KT2440
gcuucgcccucguucgcgg

SEQ ID NO: 1595195 - RNA, 21 nt, Pseudomonas putida KT2440
gcuucgcccucguucgcgggc

SEQ ID NO: 1595196 - RNA, 17 nt, Pseudomonas putida KT2440
gcuucgcugccaggaag

SEQ ID NO: 1595197 - RNA, 16 nt, Pseudomonas putida KT2440
gcuuccacucggugca

SEQ ID NO: 1595198 - RNA, 13 nt, Pseudomonas putida KT2440
gcuucaugcacaa

SEQ ID NO: 1595199 - RNA, 20 nt, Pseudomonas putida KT2440
gcuucaugcugcugcagcac

SEQ ID NO: 1595200 - RNA, 16 nt, Pseudomonas putida KT2440
gcuuccaagugcugua

SEQ ID NO: 1595201 - RNA, 16 nt, Pseudomonas putida KT2440
gcuucagcgcgccauc

SEQ ID NO: 1595202 - RNA, 17 nt, Pseudomonas putida KT2440
gcuucagcgcgccaucu

SEQ ID NO: 1595203 - RNA, 17 nt, Pseudomonas putida KT2440
gcuucagcgaccgacac

SEQ ID NO: 1595204 - RNA, 21 nt, Pseudomonas putida KT2440
gcuucagccuuuuccagcucg

SEQ ID NO: 1595205 - RNA, 23 nt, Pseudomonas putida KT2440
gcuucagggucgggcacaggccc

SEQ ID NO: 1595206 - RNA, 12 nt, Pseudomonas putida KT2440
gcuucaggccgc

SEQ ID NO: 1595207 - RNA, 14 nt, Pseudomonas putida KT2440
gcuucaggccuucg

SEQ ID NO: 1595208 - RNA, 15 nt, Pseudomonas putida KT2440
gcuucaggccuucga

SEQ ID NO: 1595209 - RNA, 22 nt, Pseudomonas putida KT2440
gcuucccgguaacgggccagcc

SEQ ID NO: 1595210 - RNA, 18 nt, Pseudomonas putida KT2440
gcuuccgccaccacgaac

SEQ ID NO: 1595211 - RNA, 13 nt, Pseudomonas putida KT2440
gcuuccaggucgc

SEQ ID NO: 1595212 - RNA, 15 nt, Pseudomonas putida KT2440
gcuuccagcgauggc

SEQ ID NO: 1595213 - RNA, 17 nt, Pseudomonas putida KT2440
gcuugaagcugcgcucg

SEQ ID NO: 1595214 - RNA, 13 nt, Pseudomonas putida KT2440
gcuugaccauggc

SEQ ID NO: 1595215 - RNA, 13 nt, Pseudomonas putida KT2440
gcuugaacaacgg

SEQ ID NO: 1595216 - RNA, 21 nt, Pseudomonas putida KT2440
gcuugaacacauagaacaggu

SEQ ID NO: 1595217 - RNA, 14 nt, Pseudomonas putida KT2440
gcuucuucgcgggc

SEQ ID NO: 1595218 - RNA, 21 nt, Pseudomonas putida KT2440
gcuugaccuugucagcaacca

SEQ ID NO: 1595219 - RNA, 18 nt, Pseudomonas putida KT2440
gcuugagaccaggccugg

SEQ ID NO: 1595220 - RNA, 11 nt, Pseudomonas putida KT2440
gcuugagcagg

SEQ ID NO: 1595221 - RNA, 17 nt, Pseudomonas putida KT2440
gcuucguggaagacgaa

SEQ ID NO: 1595222 - RNA, 23 nt, Pseudomonas putida KT2440
gcuucugggcaaagaacggugcu

SEQ ID NO: 1595223 - RNA, 22 nt, Pseudomonas putida KT2440
gcuucugcugguccuugcacag

SEQ ID NO: 1595224 - RNA, 17 nt, Pseudomonas putida KT2440
gcuucugcuucagcucg

SEQ ID NO: 1595225 - RNA, 14 nt, Pseudomonas putida KT2440
gcuucuguaccgcc

SEQ ID NO: 1595226 - RNA, 13 nt, Pseudomonas putida KT2440
gcuugccgggugc

SEQ ID NO: 1595227 - RNA, 13 nt, Pseudomonas putida KT2440
gcuugccggcaau

SEQ ID NO: 1595228 - RNA, 13 nt, Pseudomonas putida KT2440
gcuugccgcuggc

SEQ ID NO: 1595229 - RNA, 24 nt, Pseudomonas putida KT2440
gcuugccgcuggcauccaccaggu

SEQ ID NO: 1595230 - RNA, 17 nt, Pseudomonas putida KT2440
gcuugccgaucagcgag

SEQ ID NO: 1595231 - RNA, 13 nt, Pseudomonas putida KT2440
gcuugcgcgaucc

SEQ ID NO: 1595232 - RNA, 16 nt, Pseudomonas putida KT2440
gcuugccuuccgggaa

SEQ ID NO: 1595233 - RNA, 14 nt, Pseudomonas putida KT2440
gcuugcacagguau

SEQ ID NO: 1595234 - RNA, 17 nt, Pseudomonas putida KT2440
gcuugcaaccgacgcga

SEQ ID NO: 1595235 - RNA, 23 nt, Pseudomonas putida KT2440
gcuugauauccagcaccggcgug

SEQ ID NO: 1595236 - RNA, 14 nt, Pseudomonas putida KT2440
gcuugccaccaucg

SEQ ID NO: 1595237 - RNA, 12 nt, Pseudomonas putida KT2440
gcuugcagcgcu

SEQ ID NO: 1595238 - RNA, 22 nt, Pseudomonas putida KT2440
gcuugcccgcgaagaggccggu

SEQ ID NO: 1595239 - RNA, 14 nt, Pseudomonas putida KT2440
gcuugccagcgucu

SEQ ID NO: 1595240 - RNA, 12 nt, Pseudomonas putida KT2440
gcuugcccauca

SEQ ID NO: 1595241 - RNA, 22 nt, Pseudomonas putida KT2440
gcuuggucagggcaaagcccag

SEQ ID NO: 1595242 - RNA, 16 nt, Pseudomonas putida KT2440
gcuuggcugccggccu

SEQ ID NO: 1595243 - RNA, 21 nt, Pseudomonas putida KT2440
gcuuggcggcccauucgcggg

SEQ ID NO: 1595244 - RNA, 12 nt, Pseudomonas putida KT2440
gcuugcgcggca

SEQ ID NO: 1595245 - RNA, 15 nt, Pseudomonas putida KT2440
gcuuggccaccacgu

SEQ ID NO: 1595246 - RNA, 21 nt, Pseudomonas putida KT2440
gcuuggagaagcgaucgaaag

SEQ ID NO: 1595247 - RNA, 14 nt, Pseudomonas putida KT2440
gcuuggcaccggca

SEQ ID NO: 1595248 - RNA, 19 nt, Pseudomonas putida KT2440
gcuuggcaccuaucgcugc

SEQ ID NO: 1595249 - RNA, 21 nt, Pseudomonas putida KT2440
gcuuuccagguccugcuccac

SEQ ID NO: 1595250 - RNA, 19 nt, Pseudomonas putida KT2440
gcuuucaguugagggugac

SEQ ID NO: 1595251 - RNA, 22 nt, Pseudomonas putida KT2440
gcuuuaucgaugaucucgaugu

SEQ ID NO: 1595252 - RNA, 21 nt, Pseudomonas putida KT2440
gcuugucuuccggcaggucgg

SEQ ID NO: 1595253 - RNA, 21 nt, Pseudomonas putida KT2440
gcuuguggucgacgucggcgu

SEQ ID NO: 1595254 - RNA, 19 nt, Pseudomonas putida KT2440
gcuuguccuugagcgccgc

SEQ ID NO: 1595255 - RNA, 13 nt, Pseudomonas putida KT2440
gcuuguagcgguc

SEQ ID NO: 1595256 - RNA, 15 nt, Pseudomonas putida KT2440
gcuuguagcggucga

SEQ ID NO: 1595257 - RNA, 18 nt, Pseudomonas putida KT2440
gcuuguagcucagguaga

SEQ ID NO: 1595258 - RNA, 15 nt, Pseudomonas putida KT2440
gcuuugaacagcucg

SEQ ID NO: 1595259 - RNA, 16 nt, Pseudomonas putida KT2440
gcuuugaacagcucga

SEQ ID NO: 1595260 - RNA, 20 nt, Pseudomonas putida KT2440
gcuuucucaagccugccaaa

SEQ ID NO: 1595261 - RNA, 17 nt, Pseudomonas putida KT2440
gcuuucggucagggcga

SEQ ID NO: 1595262 - RNA, 13 nt, Pseudomonas putida KT2440
gcuuucggcagug

SEQ ID NO: 1595263 - RNA, 21 nt, Pseudomonas putida KT2440
gcuuugccggccucuucgcgg

SEQ ID NO: 1595264 - RNA, 20 nt, Pseudomonas putida KT2440
gcuuugccgguguucgcggg

SEQ ID NO: 1595265 - RNA, 19 nt, Pseudomonas putida KT2440
gcuuugcagauuucguggg

SEQ ID NO: 1595266 - RNA, 13 nt, Pseudomonas putida KT2440
gcuuugcagccca

SEQ ID NO: 1595267 - RNA, 18 nt, Pseudomonas putida KT2440
gcuuugcagcccauucgc

SEQ ID NO: 1595268 - RNA, 21 nt, Pseudomonas putida KT2440
gcuuugcagcccauucgcggg

SEQ ID NO: 1595269 - RNA, 17 nt, Pseudomonas putida KT2440
gcuuugcagcccuucgc

SEQ ID NO: 1595270 - RNA, 20 nt, Pseudomonas putida KT2440
gcuuugcagcccuucgcagg

SEQ ID NO: 1595271 - RNA, 20 nt, Pseudomonas putida KT2440
gcuuugcagcccuucgccgg

SEQ ID NO: 1595272 - RNA, 19 nt, Pseudomonas putida KT2440
gcuuugccauucucgccgc

SEQ ID NO: 1595273 - RNA, 19 nt, Pseudomonas putida KT2440
gcuuuucaucuucaucgcg

SEQ ID NO: 1595274 - RNA, 18 nt, Pseudomonas putida KT2440
gcuuuucguuggccagcu

SEQ ID NO: 1595275 - RNA, 17 nt, Pseudomonas putida KT2440
gcuuuugaagucggcgu

SEQ ID NO: 1595276 - RNA, 14 nt, Pseudomonas putida KT2440
gcuuuucuucgcug

SEQ ID NO: 1595277 - RNA, 18 nt, Pseudomonas putida KT2440
gcuuuuggcugugcaccc

SEQ ID NO: 1595278 - RNA, 15 nt, Pseudomonas putida KT2440
gcuuuguuugcuggc

SEQ ID NO: 1595279 - RNA, 16 nt, Pseudomonas putida KT2440
gcuuuguuugcuggca

SEQ ID NO: 1595280 - RNA, 18 nt, Pseudomonas putida KT2440
gcuuuggcugcaggucgg

SEQ ID NO: 1595281 - RNA, 14 nt, Pseudomonas putida KT2440
gcuuuuuugugccu

SEQ ID NO: 1595282 - RNA, 14 nt, Pseudomonas putida KT2440
ggaaaucgccugcu

SEQ ID NO: 1595283 - RNA, 13 nt, Pseudomonas putida KT2440
gcugcuacgccgc

SEQ ID NO: 1595284 - RNA, 13 nt, Pseudomonas putida KT2440
gcugcucaccaug

SEQ ID NO: 1595285 - RNA, 22 nt, Pseudomonas putida KT2440
gcugcguuuaccggcaccgccu

SEQ ID NO: 1595286 - RNA, 17 nt, Pseudomonas putida KT2440
gcugcguaaggccggga

SEQ ID NO: 1595287 - RNA, 15 nt, Pseudomonas putida KT2440
gcugcgguagcgcag

SEQ ID NO: 1595288 - RNA, 18 nt, Pseudomonas putida KT2440
gcugcgguagcgcagccu

SEQ ID NO: 1595289 - RNA, 14 nt, Pseudomonas putida KT2440
gcugcgggugcccg

SEQ ID NO: 1595290 - RNA, 20 nt, Pseudomonas putida KT2440
gcugcgggugcccgggcuuu

SEQ ID NO: 1595291 - RNA, 23 nt, Pseudomonas putida KT2440
gcugcgcgcgagagcgacgcgcu

SEQ ID NO: 1595292 - RNA, 12 nt, Pseudomonas putida KT2440
gcugcgcggcag

SEQ ID NO: 1595293 - RNA, 21 nt, Pseudomonas putida KT2440
gcugcgcggcagcccuucgcg

SEQ ID NO: 1595294 - RNA, 12 nt, Pseudomonas putida KT2440
gcugcgcggguu

SEQ ID NO: 1595295 - RNA, 21 nt, Pseudomonas putida KT2440
gcugccggaacguuuccagca

SEQ ID NO: 1595296 - RNA, 14 nt, Pseudomonas putida KT2440
gcugccgcuucgcg

SEQ ID NO: 1595297 - RNA, 17 nt, Pseudomonas putida KT2440
gcugccggccagcgccu

SEQ ID NO: 1595298 - RNA, 18 nt, Pseudomonas putida KT2440
gcugcgccgcucugcccg

SEQ ID NO: 1595299 - RNA, 14 nt, Pseudomonas putida KT2440
gcugcgccucgcag

SEQ ID NO: 1595300 - RNA, 17 nt, Pseudomonas putida KT2440
gcugcgccucgcaggua

SEQ ID NO: 1595301 - RNA, 23 nt, Pseudomonas putida KT2440
gcugcgccgguguucgcgggcau

SEQ ID NO: 1595302 - RNA, 19 nt, Pseudomonas putida KT2440
gcugccaaaguccggcgaa

SEQ ID NO: 1595303 - RNA, 22 nt, Pseudomonas putida KT2440
gcugcauuggcggcaggcgcag

SEQ ID NO: 1595304 - RNA, 24 nt, Pseudomonas putida KT2440
gcugcauuggcggcaggcgcagcu

SEQ ID NO: 1595305 - RNA, 21 nt, Pseudomonas putida KT2440
gcugcccaaguacaccggcag

SEQ ID NO: 1595306 - RNA, 20 nt, Pseudomonas putida KT2440
gcugccacagguacugcgca

SEQ ID NO: 1595307 - RNA, 20 nt, Pseudomonas putida KT2440
gcugccacccacaggcacga

SEQ ID NO: 1595308 - RNA, 11 nt, Pseudomonas putida KT2440
gcugccgauca

SEQ ID NO: 1595309 - RNA, 13 nt, Pseudomonas putida KT2440
gcugccgaccugc

SEQ ID NO: 1595310 - RNA, 17 nt, Pseudomonas putida KT2440
gcugcccucgggcagcc

SEQ ID NO: 1595311 - RNA, 17 nt, Pseudomonas putida KT2440
gcugcccgugcugucgg

SEQ ID NO: 1595312 - RNA, 17 nt, Pseudomonas putida KT2440
gcugcccggugccgcgc

SEQ ID NO: 1595313 - RNA, 22 nt, Pseudomonas putida KT2440
gcugcccguccggcaugcgccg

SEQ ID NO: 1595314 - RNA, 16 nt, Pseudomonas putida KT2440
gcugcccaggugccag

SEQ ID NO: 1595315 - RNA, 19 nt, Pseudomonas putida KT2440
gcugcccaggugccaggcu

SEQ ID NO: 1595316 - RNA, 21 nt, Pseudomonas putida KT2440
gcugcccaggugccaggcuca

SEQ ID NO: 1595317 - RNA, 22 nt, Pseudomonas putida KT2440
gcugcagcagcuuccugugccg

SEQ ID NO: 1595318 - RNA, 17 nt, Pseudomonas putida KT2440
gcugcagcaggcuggcg

SEQ ID NO: 1595319 - RNA, 16 nt, Pseudomonas putida KT2440
gcugcagauugcauca

SEQ ID NO: 1595320 - RNA, 15 nt, Pseudomonas putida KT2440
gcugcagcacugccu

SEQ ID NO: 1595321 - RNA, 21 nt, Pseudomonas putida KT2440
gcugcaaucgagccgaacagc

SEQ ID NO: 1595322 - RNA, 18 nt, Pseudomonas putida KT2440
gcugcacugggcgauggc

SEQ ID NO: 1595323 - RNA, 19 nt, Pseudomonas putida KT2440
gcugcagaaccgccagcac

SEQ ID NO: 1595324 - RNA, 19 nt, Pseudomonas putida KT2440
gcugcagccaaccuucagg

SEQ ID NO: 1595325 - RNA, 14 nt, Pseudomonas putida KT2440
gcugcagcauggcg

SEQ ID NO: 1595326 - RNA, 18 nt, Pseudomonas putida KT2440
gcugcaagguccaggcgu

SEQ ID NO: 1595327 - RNA, 23 nt, Pseudomonas putida KT2440
gcugcaagguccaggcgugggua

SEQ ID NO: 1595328 - RNA, 18 nt, Pseudomonas putida KT2440
gcugcaagcgcaccugca

SEQ ID NO: 1595329 - RNA, 14 nt, Pseudomonas putida KT2440
gcugcacaggccag

SEQ ID NO: 1595330 - RNA, 19 nt, Pseudomonas putida KT2440
gcugaugaagccacgcucg

SEQ ID NO: 1595331 - RNA, 14 nt, Pseudomonas putida KT2440
gcugaucuucccgg

SEQ ID NO: 1595332 - RNA, 15 nt, Pseudomonas putida KT2440
gcugaucuucccggg

SEQ ID NO: 1595333 - RNA, 12 nt, Pseudomonas putida KT2440
gcugaugcccaa

SEQ ID NO: 1595334 - RNA, 21 nt, Pseudomonas putida KT2440
gcugcaacgaaaaaaagggca

SEQ ID NO: 1595335 - RNA, 20 nt, Pseudomonas putida KT2440
gcugaggaaguuguccgggu

SEQ ID NO: 1595336 - RNA, 21 nt, Pseudomonas putida KT2440
gcugauacgagucauccucac

SEQ ID NO: 1595337 - RNA, 18 nt, Pseudomonas putida KT2440
gcugaucgaaagcugcgc

SEQ ID NO: 1595338 - RNA, 12 nt, Pseudomonas putida KT2440
gcugaucaccag

SEQ ID NO: 1595339 - RNA, 16 nt, Pseudomonas putida KT2440
gcugaucagcuggucg

SEQ ID NO: 1595340 - RNA, 20 nt, Pseudomonas putida KT2440
gcugaucaggaacacuucgc

SEQ ID NO: 1595341 - RNA, 20 nt, Pseudomonas putida KT2440
gcugaucaucgacaggugcg

SEQ ID NO: 1595342 - RNA, 19 nt, Pseudomonas putida KT2440
gcugauccgccuggcccgu

SEQ ID NO: 1595343 - RNA, 12 nt, Pseudomonas putida KT2440
gcucucagccca

SEQ ID NO: 1595344 - RNA, 13 nt, Pseudomonas putida KT2440
gcucuccagcagg

SEQ ID NO: 1595345 - RNA, 18 nt, Pseudomonas putida KT2440
gcucuccagccgcugcug

SEQ ID NO: 1595346 - RNA, 20 nt, Pseudomonas putida KT2440
gcucuccagccgcugcugca

SEQ ID NO: 1595347 - RNA, 15 nt, Pseudomonas putida KT2440
gcucuccaggguucg

SEQ ID NO: 1595348 - RNA, 22 nt, Pseudomonas putida KT2440
gcucguugcugagcaagcgcgc

SEQ ID NO: 1595349 - RNA, 17 nt, Pseudomonas putida KT2440
gcucguuguccagcagc

SEQ ID NO: 1595350 - RNA, 18 nt, Pseudomonas putida KT2440
gcucguuguccagcagca

SEQ ID NO: 1595351 - RNA, 19 nt, Pseudomonas putida KT2440
gcucguuguccagcagcag

SEQ ID NO: 1595352 - RNA, 15 nt, Pseudomonas putida KT2440
gcucuaaaucgaccu

SEQ ID NO: 1595353 - RNA, 22 nt, Pseudomonas putida KT2440
gcucguugaacacauccucaaa

SEQ ID NO: 1595354 - RNA, 16 nt, Pseudomonas putida KT2440
gcugaagugccaaggc

SEQ ID NO: 1595355 - RNA, 15 nt, Pseudomonas putida KT2440
gcugaagucauacca

SEQ ID NO: 1595356 - RNA, 23 nt, Pseudomonas putida KT2440
gcucugcaggcacacccggaccc

SEQ ID NO: 1595357 - RNA, 15 nt, Pseudomonas putida KT2440
gcucugcaaugccgc

SEQ ID NO: 1595358 - RNA, 17 nt, Pseudomonas putida KT2440
gcucugcaaugccgcca

SEQ ID NO: 1595359 - RNA, 16 nt, Pseudomonas putida KT2440
gcugaaaccgcgaauc

SEQ ID NO: 1595360 - RNA, 22 nt, Pseudomonas putida KT2440
gcugaacacgcucaugaacagc

SEQ ID NO: 1595361 - RNA, 19 nt, Pseudomonas putida KT2440
gcugaaauggcggcccagc

SEQ ID NO: 1595362 - RNA, 17 nt, Pseudomonas putida KT2440
gcucgauggccaggaac

SEQ ID NO: 1595363 - RNA, 16 nt, Pseudomonas putida KT2440
gcucgaccaagccuga

SEQ ID NO: 1595364 - RNA, 18 nt, Pseudomonas putida KT2440
gcucgaccagaucagccg

SEQ ID NO: 1595365 - RNA, 18 nt, Pseudomonas putida KT2440
gcucgacauccagcgccg

SEQ ID NO: 1595366 - RNA, 18 nt, Pseudomonas putida KT2440
gcucgaaucaagccugcg

SEQ ID NO: 1595367 - RNA, 20 nt, Pseudomonas putida KT2440
gcuccggcguguccagcagg

SEQ ID NO: 1595368 - RNA, 23 nt, Pseudomonas putida KT2440
gcuccugcgccaccucggcgaaa

SEQ ID NO: 1595369 - RNA, 22 nt, Pseudomonas putida KT2440
gcuccgacaggcuguguggccg

SEQ ID NO: 1595370 - RNA, 21 nt, Pseudomonas putida KT2440
gcuccggaauccgcacacgcu

SEQ ID NO: 1595371 - RNA, 18 nt, Pseudomonas putida KT2440
gcucccggcauugcccaa

SEQ ID NO: 1595372 - RNA, 20 nt, Pseudomonas putida KT2440
gcucccucguaggagcgggu

SEQ ID NO: 1595373 - RNA, 20 nt, Pseudomonas putida KT2440
gcucgcuuuccuugcacgcg

SEQ ID NO: 1595374 - RNA, 18 nt, Pseudomonas putida KT2440
gcucggaaaggucggcgg

SEQ ID NO: 1595375 - RNA, 21 nt, Pseudomonas putida KT2440
gcucggacaaauccaggucgg

SEQ ID NO: 1595376 - RNA, 21 nt, Pseudomonas putida KT2440
gcucggccaccacccgcuggg

SEQ ID NO: 1595377 - RNA, 18 nt, Pseudomonas putida KT2440
gcucggccaccacuucug

SEQ ID NO: 1595378 - RNA, 19 nt, Pseudomonas putida KT2440
gcucggccgaugccaggua

SEQ ID NO: 1595379 - RNA, 15 nt, Pseudomonas putida KT2440
gcucgccaucgcccc

SEQ ID NO: 1595380 - RNA, 18 nt, Pseudomonas putida KT2440
gcucgcccagcagccaac

SEQ ID NO: 1595381 - RNA, 13 nt, Pseudomonas putida KT2440
gcucgcccgcgaa

SEQ ID NO: 1595382 - RNA, 16 nt, Pseudomonas putida KT2440
gcucgcccggcacggc

SEQ ID NO: 1595383 - RNA, 18 nt, Pseudomonas putida KT2440
gcucgccucacagcgccg

SEQ ID NO: 1595384 - RNA, 11 nt, Pseudomonas putida KT2440
gcucgccugcu

SEQ ID NO: 1595385 - RNA, 21 nt, Pseudomonas putida KT2440
gcucgcgauccaucuucaccu

SEQ ID NO: 1595386 - RNA, 21 nt, Pseudomonas putida KT2440
gcuccaccacagcugcgccag

SEQ ID NO: 1595387 - RNA, 12 nt, Pseudomonas putida KT2440
gcuccacugcaa

SEQ ID NO: 1595388 - RNA, 12 nt, Pseudomonas putida KT2440
gcuccaccugcu

SEQ ID NO: 1595389 - RNA, 18 nt, Pseudomonas putida KT2440
gcuccaccugcuccagca

SEQ ID NO: 1595390 - RNA, 17 nt, Pseudomonas putida KT2440
gcuccagcccagcgcca

SEQ ID NO: 1595391 - RNA, 18 nt, Pseudomonas putida KT2440
gcuccagcccagcgccag

SEQ ID NO: 1595392 - RNA, 16 nt, Pseudomonas putida KT2440
gcuccagcaacugcgc

SEQ ID NO: 1595393 - RNA, 21 nt, Pseudomonas putida KT2440
gcuccacacucgacgcugccg

SEQ ID NO: 1595394 - RNA, 13 nt, Pseudomonas putida KT2440
gcuccacaaucuc

SEQ ID NO: 1595395 - RNA, 18 nt, Pseudomonas putida KT2440
gcucaugcacucgccgau

SEQ ID NO: 1595396 - RNA, 17 nt, Pseudomonas putida KT2440
gcucaucuaccagcuug

SEQ ID NO: 1595397 - RNA, 17 nt, Pseudomonas putida KT2440
gcucauggucagccggc

SEQ ID NO: 1595398 - RNA, 18 nt, Pseudomonas putida KT2440
gcucaugcgccagggcug

SEQ ID NO: 1595399 - RNA, 12 nt, Pseudomonas putida KT2440
gcucaugcgggu

SEQ ID NO: 1595400 - RNA, 16 nt, Pseudomonas putida KT2440
gcuccagcguguucaa

SEQ ID NO: 1595401 - RNA, 17 nt, Pseudomonas putida KT2440
gcuccaggcggccagcc

SEQ ID NO: 1595402 - RNA, 17 nt, Pseudomonas putida KT2440
gcuccagggcaggcuga

SEQ ID NO: 1595403 - RNA, 23 nt, Pseudomonas putida KT2440
gcuccagguacucgcgacugaag

SEQ ID NO: 1595404 - RNA, 18 nt, Pseudomonas putida KT2440
gcuccaggugaaucagcg

SEQ ID NO: 1595405 - RNA, 20 nt, Pseudomonas putida KT2440
gcuccagucguggcgcuggc

SEQ ID NO: 1595406 - RNA, 12 nt, Pseudomonas putida KT2440
gcuccaggcaca

SEQ ID NO: 1595407 - RNA, 20 nt, Pseudomonas putida KT2440
gcuccaggcacaggcgcaca

SEQ ID NO: 1595408 - RNA, 14 nt, Pseudomonas putida KT2440
gcuccaggcgacca

SEQ ID NO: 1595409 - RNA, 22 nt, Pseudomonas putida KT2440
gcucccaccgguauagcgacag

SEQ ID NO: 1595410 - RNA, 18 nt, Pseudomonas putida KT2440
gcucccacagggaccgca

SEQ ID NO: 1595411 - RNA, 18 nt, Pseudomonas putida KT2440
gcuccaugggcaggccca

SEQ ID NO: 1595412 - RNA, 19 nt, Pseudomonas putida KT2440
gcucccccuccacccgguc

SEQ ID NO: 1595413 - RNA, 14 nt, Pseudomonas putida KT2440
gcucccgagccagg

SEQ ID NO: 1595414 - RNA, 20 nt, Pseudomonas putida KT2440
gcucccgcaggggcugcgca

SEQ ID NO: 1595415 - RNA, 23 nt, Pseudomonas putida KT2440
gcucauccacaccuucggcauga

SEQ ID NO: 1595416 - RNA, 15 nt, Pseudomonas putida KT2440
gcucaguucggguga

SEQ ID NO: 1595417 - RNA, 21 nt, Pseudomonas putida KT2440
gcucaguaauaggugcguggc

SEQ ID NO: 1595418 - RNA, 22 nt, Pseudomonas putida KT2440
gcucaggccuugccgcucacca

SEQ ID NO: 1595419 - RNA, 14 nt, Pseudomonas putida KT2440
gcucagcuggauag

SEQ ID NO: 1595420 - RNA, 21 nt, Pseudomonas putida KT2440
gcucaggccaugcugcgccag

SEQ ID NO: 1595421 - RNA, 21 nt, Pseudomonas putida KT2440
gcucaggaucacgucacccag

SEQ ID NO: 1595422 - RNA, 19 nt, Pseudomonas putida KT2440
gcucagcgugacgauggcc

SEQ ID NO: 1595423 - RNA, 13 nt, Pseudomonas putida KT2440
gcucagcuacgcu

SEQ ID NO: 1595424 - RNA, 20 nt, Pseudomonas putida KT2440
gcucagcguacgcaugguca

SEQ ID NO: 1595425 - RNA, 21 nt, Pseudomonas putida KT2440
gcucagccacgcuggcaccca

SEQ ID NO: 1595426 - RNA, 23 nt, Pseudomonas putida KT2440
gcucagcagguugaacagcagcg

SEQ ID NO: 1595427 - RNA, 23 nt, Pseudomonas putida KT2440
gcucagcacauucagcagcgccu

SEQ ID NO: 1595428 - RNA, 16 nt, Pseudomonas putida KT2440
gcguucaggcaggaac

SEQ ID NO: 1595429 - RNA, 16 nt, Pseudomonas putida KT2440
gcucagcaacugggca

SEQ ID NO: 1595430 - RNA, 18 nt, Pseudomonas putida KT2440
gcucagcaacugggcaau

SEQ ID NO: 1595431 - RNA, 14 nt, Pseudomonas putida KT2440
gcggucugcggcag

SEQ ID NO: 1595432 - RNA, 17 nt, Pseudomonas putida KT2440
gcggucggucagcaccu

SEQ ID NO: 1595433 - RNA, 22 nt, Pseudomonas putida KT2440
gcggucggucagcaccuggcag

SEQ ID NO: 1595434 - RNA, 22 nt, Pseudomonas putida KT2440
gcggucggugaaaccaccccgg

SEQ ID NO: 1595435 - RNA, 17 nt, Pseudomonas putida KT2440
gcggucgguggucagcu

SEQ ID NO: 1595436 - RNA, 20 nt, Pseudomonas putida KT2440
gcggucguuacccagguaga

SEQ ID NO: 1595437 - RNA, 12 nt, Pseudomonas putida KT2440
gcggucgccgug

SEQ ID NO: 1595438 - RNA, 18 nt, Pseudomonas putida KT2440
gcggucgcccauguugcg

SEQ ID NO: 1595439 - RNA, 17 nt, Pseudomonas putida KT2440
gcggucuuguaucccag

SEQ ID NO: 1595440 - RNA, 22 nt, Pseudomonas putida KT2440
gcggucuuguaucccaggcgcu

SEQ ID NO: 1595441 - RNA, 19 nt, Pseudomonas putida KT2440
gcggugaauagcaggccgc

SEQ ID NO: 1595442 - RNA, 21 nt, Pseudomonas putida KT2440
gcggugacccguguaggagcg

SEQ ID NO: 1595443 - RNA, 20 nt, Pseudomonas putida KT2440
gcggugagauguguccgcca

SEQ ID NO: 1595444 - RNA, 21 nt, Pseudomonas putida KT2440
gcggugauaugcguacccggc

SEQ ID NO: 1595445 - RNA, 16 nt, Pseudomonas putida KT2440
gcggugcagcaccucc

SEQ ID NO: 1595446 - RNA, 19 nt, Pseudomonas putida KT2440
gcggugcacggccugcauc

SEQ ID NO: 1595447 - RNA, 19 nt, Pseudomonas putida KT2440
gcgggcgcgcccgcgaaga

SEQ ID NO: 1595448 - RNA, 21 nt, Pseudomonas putida KT2440
gcgguaaagaacaugaucaag

SEQ ID NO: 1595449 - RNA, 16 nt, Pseudomonas putida KT2440
gcgguagggcguucag

SEQ ID NO: 1595450 - RNA, 19 nt, Pseudomonas putida KT2440
gcgguacaccgggaacagg

SEQ ID NO: 1595451 - RNA, 16 nt, Pseudomonas putida KT2440
gcggucaggccaagua

SEQ ID NO: 1595452 - RNA, 17 nt, Pseudomonas putida KT2440
gcggucagcgcugcggg

SEQ ID NO: 1595453 - RNA, 16 nt, Pseudomonas putida KT2440
gcggucagcgaauagu

SEQ ID NO: 1595454 - RNA, 23 nt, Pseudomonas putida KT2440
gcggucgccaaauucgaccagca

SEQ ID NO: 1595455 - RNA, 21 nt, Pseudomonas putida KT2440
gcgguccgcccuugccaccag

SEQ ID NO: 1595456 - RNA, 23 nt, Pseudomonas putida KT2440
gcgguggaguaccugugggagcg

SEQ ID NO: 1595457 - RNA, 16 nt, Pseudomonas putida KT2440
gcgguggcuggcaccg

SEQ ID NO: 1595458 - RNA, 18 nt, Pseudomonas putida KT2440
gcggugccuucaggcgcu

SEQ ID NO: 1595459 - RNA, 13 nt, Pseudomonas putida KT2440
gcggugcucaugc

SEQ ID NO: 1595460 - RNA, 14 nt, Pseudomonas putida KT2440
gcggugcggcgaca

SEQ ID NO: 1595461 - RNA, 20 nt, Pseudomonas putida KT2440
gcggugcggcgacagggcga

SEQ ID NO: 1595462 - RNA, 18 nt, Pseudomonas putida KT2440
gcggugugggcgaagucc

SEQ ID NO: 1595463 - RNA, 17 nt, Pseudomonas putida KT2440
gcgguuaagaaggcgaa

SEQ ID NO: 1595464 - RNA, 17 nt, Pseudomonas putida KT2440
gcgguuuucgcaacgcu

SEQ ID NO: 1595465 - RNA, 21 nt, Pseudomonas putida KT2440
gcgguuguagaucgccggcag

SEQ ID NO: 1595466 - RNA, 17 nt, Pseudomonas putida KT2440
gcgguucuucgccugca

SEQ ID NO: 1595467 - RNA, 20 nt, Pseudomonas putida KT2440
gcgguugaccgccgccacca

SEQ ID NO: 1595468 - RNA, 17 nt, Pseudomonas putida KT2440
gcgguucgaccaauggc

SEQ ID NO: 1595469 - RNA, 20 nt, Pseudomonas putida KT2440
gcgguugccaagcacggcgc

SEQ ID NO: 1595470 - RNA, 23 nt, Pseudomonas putida KT2440
gcgguugccaagcacggcgccga

SEQ ID NO: 1595471 - RNA, 19 nt, Pseudomonas putida KT2440
gcgguugcccguaggagcg

SEQ ID NO: 1595472 - RNA, 15 nt, Pseudomonas putida KT2440
gcguacgcaugguca

SEQ ID NO: 1595473 - RNA, 20 nt, Pseudomonas putida KT2440
gcguacccagcucgaucagc

SEQ ID NO: 1595474 - RNA, 13 nt, Pseudomonas putida KT2440
gcguaccggcaac

SEQ ID NO: 1595475 - RNA, 14 nt, Pseudomonas putida KT2440
gcguaccggcaacc

SEQ ID NO: 1595476 - RNA, 18 nt, Pseudomonas putida KT2440
gcguacacugcaggagcg

SEQ ID NO: 1595477 - RNA, 16 nt, Pseudomonas putida KT2440
gcguaaacccagguac

SEQ ID NO: 1595478 - RNA, 14 nt, Pseudomonas putida KT2440
gcguaaggccggga

SEQ ID NO: 1595479 - RNA, 15 nt, Pseudomonas putida KT2440
gcgucuggacccacg

SEQ ID NO: 1595480 - RNA, 15 nt, Pseudomonas putida KT2440
gcgucggucagcgag

SEQ ID NO: 1595481 - RNA, 16 nt, Pseudomonas putida KT2440
gcgucguacaggccua

SEQ ID NO: 1595482 - RNA, 19 nt, Pseudomonas putida KT2440
gcgugacgugcgcuccugg

SEQ ID NO: 1595483 - RNA, 19 nt, Pseudomonas putida KT2440
gcgugaaauccucaaccug

SEQ ID NO: 1595484 - RNA, 16 nt, Pseudomonas putida KT2440
gcguggcugcguucag

SEQ ID NO: 1595485 - RNA, 18 nt, Pseudomonas putida KT2440
gcguucaccggcaccugc

SEQ ID NO: 1595486 - RNA, 18 nt, Pseudomonas putida KT2440
gcguuauaccggcccuga

SEQ ID NO: 1595487 - RNA, 17 nt, Pseudomonas putida KT2440
gcguggcaccggcgaag

SEQ ID NO: 1595488 - RNA, 18 nt, Pseudomonas putida KT2440
gcguggcaccggcgaaga

SEQ ID NO: 1595489 - RNA, 14 nt, Pseudomonas putida KT2440
gcguggccagccca

SEQ ID NO: 1595490 - RNA, 15 nt, Pseudomonas putida KT2440
gcgugcuuccaccuc

SEQ ID NO: 1595491 - RNA, 16 nt, Pseudomonas putida KT2440
gcguggaacaacggcu

SEQ ID NO: 1595492 - RNA, 20 nt, Pseudomonas putida KT2440
gcgugcuugcaccgacaagc

SEQ ID NO: 1595493 - RNA, 19 nt, Pseudomonas putida KT2440
gcgucgccaaucucguugc

SEQ ID NO: 1595494 - RNA, 17 nt, Pseudomonas putida KT2440
gcgucagcguugcuggc

SEQ ID NO: 1595495 - RNA, 17 nt, Pseudomonas putida KT2440
gcgucagcucaagcgcu

SEQ ID NO: 1595496 - RNA, 15 nt, Pseudomonas putida KT2440
gcgucagcagggcca

SEQ ID NO: 1595497 - RNA, 18 nt, Pseudomonas putida KT2440
gcguccaggcccgccaga

SEQ ID NO: 1595498 - RNA, 17 nt, Pseudomonas putida KT2440
gcguccagggcagguca

SEQ ID NO: 1595499 - RNA, 16 nt, Pseudomonas putida KT2440
gcgucagggucucgcg

SEQ ID NO: 1595500 - RNA, 18 nt, Pseudomonas putida KT2440
gcgucccccgguaccagc

SEQ ID NO: 1595501 - RNA, 16 nt, Pseudomonas putida KT2440
gcguacugcauguacu

SEQ ID NO: 1595502 - RNA, 14 nt, Pseudomonas putida KT2440
gcguagcagguacg

SEQ ID NO: 1595503 - RNA, 22 nt, Pseudomonas putida KT2440
gcgucaacucaucacucuugcg

SEQ ID NO: 1595504 - RNA, 15 nt, Pseudomonas putida KT2440
gcgucacccgcgcca

SEQ ID NO: 1595505 - RNA, 15 nt, Pseudomonas putida KT2440
gcguagugcaggcgc

SEQ ID NO: 1595506 - RNA, 22 nt, Pseudomonas putida KT2440
gcgucaaccgaacccgcuggcg

SEQ ID NO: 1595507 - RNA, 20 nt, Pseudomonas putida KT2440
gcggcuccggcguguccagc

SEQ ID NO: 1595508 - RNA, 19 nt, Pseudomonas putida KT2440
gcggcucgucaaccacagc

SEQ ID NO: 1595509 - RNA, 15 nt, Pseudomonas putida KT2440
gcggcucuugcagcg

SEQ ID NO: 1595510 - RNA, 15 nt, Pseudomonas putida KT2440
gcggcucgcugcgcu

SEQ ID NO: 1595511 - RNA, 23 nt, Pseudomonas putida KT2440
gcggcguguaguagcuccagccc

SEQ ID NO: 1595512 - RNA, 21 nt, Pseudomonas putida KT2440
gcggcuccgaccgguggccug

SEQ ID NO: 1595513 - RNA, 18 nt, Pseudomonas putida KT2440
gcggcuccaccgaaauca

SEQ ID NO: 1595514 - RNA, 15 nt, Pseudomonas putida KT2440
gcggcugggugccau

SEQ ID NO: 1595515 - RNA, 18 nt, Pseudomonas putida KT2440
gcggcugggugccaucag

SEQ ID NO: 1595516 - RNA, 20 nt, Pseudomonas putida KT2440
gcggcugggccccaggcggu

SEQ ID NO: 1595517 - RNA, 20 nt, Pseudomonas putida KT2440
gcggcugguauugccuggcg

SEQ ID NO: 1595518 - RNA, 21 nt, Pseudomonas putida KT2440
gcggcugaccuguucgcgcaa

SEQ ID NO: 1595519 - RNA, 18 nt, Pseudomonas putida KT2440
gcggcugcgacggcgaau

SEQ ID NO: 1595520 - RNA, 13 nt, Pseudomonas putida KT2440
gcggcuucgaugc

SEQ ID NO: 1595521 - RNA, 20 nt, Pseudomonas putida KT2440
gcggcuucgaugcccggcag

SEQ ID NO: 1595522 - RNA, 22 nt, Pseudomonas putida KT2440
gcggcuucgaugcccggcaggu

SEQ ID NO: 1595523 - RNA, 13 nt, Pseudomonas putida KT2440
gcgggaagcccgu

SEQ ID NO: 1595524 - RNA, 17 nt, Pseudomonas putida KT2440
gcgggccugcuggcgaa

SEQ ID NO: 1595525 - RNA, 17 nt, Pseudomonas putida KT2440
gcgggccgccgaacagg

SEQ ID NO: 1595526 - RNA, 13 nt, Pseudomonas putida KT2440
gcgggcaugcccg

SEQ ID NO: 1595527 - RNA, 20 nt, Pseudomonas putida KT2440
gcgggcaugcccgcucccac

SEQ ID NO: 1595528 - RNA, 23 nt, Pseudomonas putida KT2440
gcgggccagcccauccagggcuu

SEQ ID NO: 1595529 - RNA, 19 nt, Pseudomonas putida KT2440
gcggcgcuggccgguggcc

SEQ ID NO: 1595530 - RNA, 13 nt, Pseudomonas putida KT2440
gcggcgccuucag

SEQ ID NO: 1595531 - RNA, 19 nt, Pseudomonas putida KT2440
aagcggucguuacccaggu

SEQ ID NO: 1595532 - RNA, 16 nt, Pseudomonas putida KT2440
gcggcgcccagcaaca

SEQ ID NO: 1595533 - RNA, 22 nt, Pseudomonas putida KT2440
gcggcgcccaguacuucgcgug

SEQ ID NO: 1595534 - RNA, 22 nt, Pseudomonas putida KT2440
gcggcguauacccggucagggu

SEQ ID NO: 1595535 - RNA, 17 nt, Pseudomonas putida KT2440
aagcuaacccggucucg

SEQ ID NO: 1595536 - RNA, 14 nt, Pseudomonas putida KT2440
gcggcgugcgcccg

SEQ ID NO: 1595537 - RNA, 15 nt, Pseudomonas putida KT2440
gcggcgucaccggcc

SEQ ID NO: 1595538 - RNA, 15 nt, Pseudomonas putida KT2440
gcggcgguggccgcg

SEQ ID NO: 1595539 - RNA, 19 nt, Pseudomonas putida KT2440
gcggccagcacgaacagca

SEQ ID NO: 1595540 - RNA, 13 nt, Pseudomonas putida KT2440
gcggccagcgccu

SEQ ID NO: 1595541 - RNA, 17 nt, Pseudomonas putida KT2440
gcggccagcgcaucggc

SEQ ID NO: 1595542 - RNA, 21 nt, Pseudomonas putida KT2440
gcggccagggcaucggacagg

SEQ ID NO: 1595543 - RNA, 18 nt, Pseudomonas putida KT2440
gcggccaggccggcgcag

SEQ ID NO: 1595544 - RNA, 17 nt, Pseudomonas putida KT2440
gcggccagcgccuggcg

SEQ ID NO: 1595545 - RNA, 14 nt, Pseudomonas putida KT2440
aagcgccccaggau

SEQ ID NO: 1595546 - RNA, 15 nt, Pseudomonas putida KT2440
gcggccaaggcgugg

SEQ ID NO: 1595547 - RNA, 14 nt, Pseudomonas putida KT2440
gcggccaaugcacg

SEQ ID NO: 1595548 - RNA, 17 nt, Pseudomonas putida KT2440
gcggccaaugcacgccu

SEQ ID NO: 1595549 - RNA, 15 nt, Pseudomonas putida KT2440
gcggccacagcgcca

SEQ ID NO: 1595550 - RNA, 22 nt, Pseudomonas putida KT2440
aagcgcgacuggugcucugcag

SEQ ID NO: 1595551 - RNA, 12 nt, Pseudomonas putida KT2440
gcggccagcacg

SEQ ID NO: 1595552 - RNA, 13 nt, Pseudomonas putida KT2440
gcggccaccgccu

SEQ ID NO: 1595553 - RNA, 13 nt, Pseudomonas putida KT2440
aagcgacagcggc

SEQ ID NO: 1595554 - RNA, 19 nt, Pseudomonas putida KT2440
aagcgagguaggccgucag

SEQ ID NO: 1595555 - RNA, 16 nt, Pseudomonas putida KT2440
gcggcagaacacaucg

SEQ ID NO: 1595556 - RNA, 17 nt, Pseudomonas putida KT2440
gcggcagaacacaucgg

SEQ ID NO: 1595557 - RNA, 15 nt, Pseudomonas putida KT2440
gcggcagacacaggc

SEQ ID NO: 1595558 - RNA, 15 nt, Pseudomonas putida KT2440
gcgcucgagcccgcc

SEQ ID NO: 1595559 - RNA, 23 nt, Pseudomonas putida KT2440
gcgcucgaucucacaggcgauga

SEQ ID NO: 1595560 - RNA, 13 nt, Pseudomonas putida KT2440
gcggcagccagca

SEQ ID NO: 1595561 - RNA, 19 nt, Pseudomonas putida KT2440
gcggcaguugccugccuug

SEQ ID NO: 1595562 - RNA, 18 nt, Pseudomonas putida KT2440
gcggcauagcucgagaaa

SEQ ID NO: 1595563 - RNA, 14 nt, Pseudomonas putida KT2440
gcggcaucagcuca

SEQ ID NO: 1595564 - RNA, 14 nt, Pseudomonas putida KT2440
gcggcauccaggcg

SEQ ID NO: 1595565 - RNA, 17 nt, Pseudomonas putida KT2440
aagcgcaaaaccaccag

SEQ ID NO: 1595566 - RNA, 18 nt, Pseudomonas putida KT2440
gcggccuugcccgcgaag

SEQ ID NO: 1595567 - RNA, 17 nt, Pseudomonas putida KT2440
gcggccuugugcggccc

SEQ ID NO: 1595568 - RNA, 15 nt, Pseudomonas putida KT2440
gcggccuucaagcuc

SEQ ID NO: 1595569 - RNA, 22 nt, Pseudomonas putida KT2440
gcggccuucaagcuccccagca

SEQ ID NO: 1595570 - RNA, 18 nt, Pseudomonas putida KT2440
gcggccuggcccggugca

SEQ ID NO: 1595571 - RNA, 18 nt, Pseudomonas putida KT2440
gcggccgaaggcgcuggc

SEQ ID NO: 1595572 - RNA, 21 nt, Pseudomonas putida KT2440
gcggccgaaggcgcuggcgag

SEQ ID NO: 1595573 - RNA, 16 nt, Pseudomonas putida KT2440
gcggcccuuggcagcg

SEQ ID NO: 1595574 - RNA, 15 nt, Pseudomonas putida KT2440
gcggcccucgguggc

SEQ ID NO: 1595575 - RNA, 17 nt, Pseudomonas putida KT2440
gcggcccuaucgcgacg

SEQ ID NO: 1595576 - RNA, 19 nt, Pseudomonas putida KT2440
gcggcccuaucgcgacgca

SEQ ID NO: 1595577 - RNA, 14 nt, Pseudomonas putida KT2440
gcggcccgccggca

SEQ ID NO: 1595578 - RNA, 15 nt, Pseudomonas putida KT2440
gcggcccgccggcaa

SEQ ID NO: 1595579 - RNA, 14 nt, Pseudomonas putida KT2440
gcggccccuggaac

SEQ ID NO: 1595580 - RNA, 15 nt, Pseudomonas putida KT2440
aagcggaucggccgg

SEQ ID NO: 1595581 - RNA, 23 nt, Pseudomonas putida KT2440
gcggccaugauuacgcugaaagg

SEQ ID NO: 1595582 - RNA, 17 nt, Pseudomonas putida KT2440
gcggcccaaucgccaca

SEQ ID NO: 1595583 - RNA, 15 nt, Pseudomonas putida KT2440
gcggcccauucgcgg

SEQ ID NO: 1595584 - RNA, 16 nt, Pseudomonas putida KT2440
gcggcccauucgcggg

SEQ ID NO: 1595585 - RNA, 22 nt, Pseudomonas putida KT2440
gcggccccggauucacggauca

SEQ ID NO: 1595586 - RNA, 22 nt, Pseudomonas putida KT2440
gccuuuuuuccaguuggcaggg

SEQ ID NO: 1595587 - RNA, 19 nt, Pseudomonas putida KT2440
gccuuuuuucgggcugcug

SEQ ID NO: 1595588 - RNA, 21 nt, Pseudomonas putida KT2440
gcgaaacgcggcaaccugcac

SEQ ID NO: 1595589 - RNA, 18 nt, Pseudomonas putida KT2440
gcgaaacccggcgcagcg

SEQ ID NO: 1595590 - RNA, 20 nt, Pseudomonas putida KT2440
gccuugugcggcccaaucgc

SEQ ID NO: 1595591 - RNA, 16 nt, Pseudomonas putida KT2440
gccuugugcugcgaag

SEQ ID NO: 1595592 - RNA, 23 nt, Pseudomonas putida KT2440
gccuugucucugaacacaugcca

SEQ ID NO: 1595593 - RNA, 15 nt, Pseudomonas putida KT2440
gccuugucuggcacc

SEQ ID NO: 1595594 - RNA, 17 nt, Pseudomonas putida KT2440
gccuugugggagcggga

SEQ ID NO: 1595595 - RNA, 15 nt, Pseudomonas putida KT2440
gccuuucgcgccagu

SEQ ID NO: 1595596 - RNA, 21 nt, Pseudomonas putida KT2440
gccuuguuuguacggcgcaau

SEQ ID NO: 1595597 - RNA, 17 nt, Pseudomonas putida KT2440
gccuuugaaaccggcaa

SEQ ID NO: 1595598 - RNA, 18 nt, Pseudomonas putida KT2440
gccuuugaaaccggcaaa

SEQ ID NO: 1595599 - RNA, 12 nt, Pseudomonas putida KT2440
gccuuuucgcgg

SEQ ID NO: 1595600 - RNA, 13 nt, Pseudomonas putida KT2440
gccuuugcgccuu

SEQ ID NO: 1595601 - RNA, 19 nt, Pseudomonas putida KT2440
gccuugauuaccagcgccc

SEQ ID NO: 1595602 - RNA, 15 nt, Pseudomonas putida KT2440
gccuugaucugcgcg

SEQ ID NO: 1595603 - RNA, 19 nt, Pseudomonas putida KT2440
gccuugcagcccuucgcgg

SEQ ID NO: 1595604 - RNA, 18 nt, Pseudomonas putida KT2440
gccuugcaggaagcggcg

SEQ ID NO: 1595605 - RNA, 14 nt, Pseudomonas putida KT2440
gccuugcgcugggc

SEQ ID NO: 1595606 - RNA, 15 nt, Pseudomonas putida KT2440
gccuugcgcugggca

SEQ ID NO: 1595607 - RNA, 22 nt, Pseudomonas putida KT2440
gccuugcccagcuccagcaccu

SEQ ID NO: 1595608 - RNA, 18 nt, Pseudomonas putida KT2440
gccuugccgcuggcgaug

SEQ ID NO: 1595609 - RNA, 16 nt, Pseudomonas putida KT2440
gccuugcgagccuggg

SEQ ID NO: 1595610 - RNA, 22 nt, Pseudomonas putida KT2440
gccuuggccaucacuucacggg

SEQ ID NO: 1595611 - RNA, 16 nt, Pseudomonas putida KT2440
gccuuggccgcuggcc

SEQ ID NO: 1595612 - RNA, 20 nt, Pseudomonas putida KT2440
gccuugcucguguuagcugg

SEQ ID NO: 1595613 - RNA, 19 nt, Pseudomonas putida KT2440
gccuuggcauagcgcucgc

SEQ ID NO: 1595614 - RNA, 15 nt, Pseudomonas putida KT2440
gccuugcuuggcagc

SEQ ID NO: 1595615 - RNA, 12 nt, Pseudomonas putida KT2440
gccuugcugauc

SEQ ID NO: 1595616 - RNA, 19 nt, Pseudomonas putida KT2440
gccuugucggcacgcgcca

SEQ ID NO: 1595617 - RNA, 19 nt, Pseudomonas putida KT2440
gccuugggcaacaccgcca

SEQ ID NO: 1595618 - RNA, 15 nt, Pseudomonas putida KT2440
gccuuggcuacgcaa

SEQ ID NO: 1595619 - RNA, 20 nt, Pseudomonas putida KT2440
gccugugucgaaccacugau

SEQ ID NO: 1595620 - RNA, 14 nt, Pseudomonas putida KT2440
gccugugcuggccu

SEQ ID NO: 1595621 - RNA, 19 nt, Pseudomonas putida KT2440
gccuguggggcaacugcgc

SEQ ID NO: 1595622 - RNA, 14 nt, Pseudomonas putida KT2440
gccuguggguaacc

SEQ ID NO: 1595623 - RNA, 17 nt, Pseudomonas putida KT2440
gccugccaaaucccuuu

SEQ ID NO: 1595624 - RNA, 18 nt, Pseudomonas putida KT2440
gccugcaugcucaucgcg

SEQ ID NO: 1595625 - RNA, 13 nt, Pseudomonas putida KT2440
gccugugccgaac

SEQ ID NO: 1595626 - RNA, 14 nt, Pseudomonas putida KT2440
gccugugccggccu

SEQ ID NO: 1595627 - RNA, 21 nt, Pseudomonas putida KT2440
gccugugccggccucuucgcg

SEQ ID NO: 1595628 - RNA, 21 nt, Pseudomonas putida KT2440
gccugucgucagcucaggccu

SEQ ID NO: 1595629 - RNA, 17 nt, Pseudomonas putida KT2440
gccugugagaucgagcg

SEQ ID NO: 1595630 - RNA, 21 nt, Pseudomonas putida KT2440
gccugugagaucgagcgccgc

SEQ ID NO: 1595631 - RNA, 18 nt, Pseudomonas putida KT2440
gccugugauuuacgcugg

SEQ ID NO: 1595632 - RNA, 22 nt, Pseudomonas putida KT2440
gccugaugccucaucaggccga

SEQ ID NO: 1595633 - RNA, 22 nt, Pseudomonas putida KT2440
gccugcacgaucgaccggguaa

SEQ ID NO: 1595634 - RNA, 14 nt, Pseudomonas putida KT2440
gccugcaggcugcc

SEQ ID NO: 1595635 - RNA, 15 nt, Pseudomonas putida KT2440
gccuugaagcgcggc

SEQ ID NO: 1595636 - RNA, 19 nt, Pseudomonas putida KT2440
gccuugaagcgcggcaugc

SEQ ID NO: 1595637 - RNA, 19 nt, Pseudomonas putida KT2440
gccuugaccagcaacggcc

SEQ ID NO: 1595638 - RNA, 18 nt, Pseudomonas putida KT2440
gccuugaccucgaccagg

SEQ ID NO: 1595639 - RNA, 19 nt, Pseudomonas putida KT2440
gccuugaggaccuugcggg

SEQ ID NO: 1595640 - RNA, 13 nt, Pseudomonas putida KT2440
gccuucucuuccg

SEQ ID NO: 1595641 - RNA, 22 nt, Pseudomonas putida KT2440
gccuucguaguaauggccgaug

SEQ ID NO: 1595642 - RNA, 17 nt, Pseudomonas putida KT2440
gccuucaucgcugcgau

SEQ ID NO: 1595643 - RNA, 13 nt, Pseudomonas putida KT2440
gccuucggugcug

SEQ ID NO: 1595644 - RNA, 16 nt, Pseudomonas putida KT2440
gccuucccgucgagcc

SEQ ID NO: 1595645 - RNA, 17 nt, Pseudomonas putida KT2440
gccuucaggcgcugguu

SEQ ID NO: 1595646 - RNA, 15 nt, Pseudomonas putida KT2440
gccuucagggccggu

SEQ ID NO: 1595647 - RNA, 22 nt, Pseudomonas putida KT2440
gccuucacacaggcugucggca

SEQ ID NO: 1595648 - RNA, 14 nt, Pseudomonas putida KT2440
gcgaacagcacugc

SEQ ID NO: 1595649 - RNA, 15 nt, Pseudomonas putida KT2440
gcgaacagcacugcc

SEQ ID NO: 1595650 - RNA, 18 nt, Pseudomonas putida KT2440
gcgaacaaggcucagcug

SEQ ID NO: 1595651 - RNA, 23 nt, Pseudomonas putida KT2440
gcgaacaccggcagagccggugc

SEQ ID NO: 1595652 - RNA, 13 nt, Pseudomonas putida KT2440
gcgaacaggcccu

SEQ ID NO: 1595653 - RNA, 19 nt, Pseudomonas putida KT2440
gcgaacaggcccugacagg

SEQ ID NO: 1595654 - RNA, 20 nt, Pseudomonas putida KT2440
gcgaacaggcccugacaggc

SEQ ID NO: 1595655 - RNA, 17 nt, Pseudomonas putida KT2440
gcgaaauggcgaaucag

SEQ ID NO: 1595656 - RNA, 13 nt, Pseudomonas putida KT2440
gcgaaagccagca

SEQ ID NO: 1595657 - RNA, 15 nt, Pseudomonas putida KT2440
gcgaaagccagcagu

SEQ ID NO: 1595658 - RNA, 22 nt, Pseudomonas putida KT2440
gcgaaagggccgcaaggccgcu

SEQ ID NO: 1595659 - RNA, 19 nt, Pseudomonas putida KT2440
gcgaaguuggucccugacu

SEQ ID NO: 1595660 - RNA, 20 nt, Pseudomonas putida KT2440
gcgaaguugaagcgccggua

SEQ ID NO: 1595661 - RNA, 16 nt, Pseudomonas putida KT2440
gcgaauacgguagcgg

SEQ ID NO: 1595662 - RNA, 11 nt, Pseudomonas putida KT2440
gcgaaucccgc

SEQ ID NO: 1595663 - RNA, 15 nt, Pseudomonas putida KT2440
gcgaaucagcgccuc

SEQ ID NO: 1595664 - RNA, 20 nt, Pseudomonas putida KT2440
gcgaaggucagagcaaccag

SEQ ID NO: 1595665 - RNA, 17 nt, Pseudomonas putida KT2440
gcgaaggggccggcaca

SEQ ID NO: 1595666 - RNA, 19 nt, Pseudomonas putida KT2440
gcgaagucacaccaucggc

SEQ ID NO: 1595667 - RNA, 21 nt, Pseudomonas putida KT2440
gcgaagucacaccaucggccg

SEQ ID NO: 1595668 - RNA, 16 nt, Pseudomonas putida KT2440
gcgaagucagguaggu

SEQ ID NO: 1595669 - RNA, 22 nt, Pseudomonas putida KT2440
gcgaagcccaguucgcgggcaa

SEQ ID NO: 1595670 - RNA, 14 nt, Pseudomonas putida KT2440
gcgaagcagccacc

SEQ ID NO: 1595671 - RNA, 15 nt, Pseudomonas putida KT2440
gcgaagcaagcgcau

SEQ ID NO: 1595672 - RNA, 16 nt, Pseudomonas putida KT2440
gcgaacuguacugacu

SEQ ID NO: 1595673 - RNA, 16 nt, Pseudomonas putida KT2440
gcgaagaggcccgaac

SEQ ID NO: 1595674 - RNA, 19 nt, Pseudomonas putida KT2440
gcgaagagguccugacagg

SEQ ID NO: 1595675 - RNA, 19 nt, Pseudomonas putida KT2440
gcgagcgguucagcgcacu

SEQ ID NO: 1595676 - RNA, 14 nt, Pseudomonas putida KT2440
gcgagcgucucgcc

SEQ ID NO: 1595677 - RNA, 12 nt, Pseudomonas putida KT2440
gcgagggcauca

SEQ ID NO: 1595678 - RNA, 20 nt, Pseudomonas putida KT2440
gcgagucgaucgacacaccg

SEQ ID NO: 1595679 - RNA, 20 nt, Pseudomonas putida KT2440
gcgaguagaagcuuggggcg

SEQ ID NO: 1595680 - RNA, 14 nt, Pseudomonas putida KT2440
gcgagugaugcggu

SEQ ID NO: 1595681 - RNA, 14 nt, Pseudomonas putida KT2440
gcgaguucgagucu

SEQ ID NO: 1595682 - RNA, 19 nt, Pseudomonas putida KT2440
gcgaguucaggcgcccugc

SEQ ID NO: 1595683 - RNA, 16 nt, Pseudomonas putida KT2440
gcgaguggucggcgua

SEQ ID NO: 1595684 - RNA, 14 nt, Pseudomonas putida KT2440
gcgacgcggcauug

SEQ ID NO: 1595685 - RNA, 14 nt, Pseudomonas putida KT2440
gcgacgcgcuaccu

SEQ ID NO: 1595686 - RNA, 20 nt, Pseudomonas putida KT2440
gcgacgcugccgcaccugcc

SEQ ID NO: 1595687 - RNA, 22 nt, Pseudomonas putida KT2440
gcgacgcugccgcaccugccug

SEQ ID NO: 1595688 - RNA, 19 nt, Pseudomonas putida KT2440
gcgacguagugacgcggau

SEQ ID NO: 1595689 - RNA, 19 nt, Pseudomonas putida KT2440
gcgacgggaagugcacugc

SEQ ID NO: 1595690 - RNA, 18 nt, Pseudomonas putida KT2440
gcgacugaauacagccaa

SEQ ID NO: 1595691 - RNA, 19 nt, Pseudomonas putida KT2440
gcgacaugaucagcggggu

SEQ ID NO: 1595692 - RNA, 22 nt, Pseudomonas putida KT2440
gcgacagcccauagcgccaucg

SEQ ID NO: 1595693 - RNA, 16 nt, Pseudomonas putida KT2440
gcgaccaaguuuucgc

SEQ ID NO: 1595694 - RNA, 15 nt, Pseudomonas putida KT2440
gcgacaugccggcca

SEQ ID NO: 1595695 - RNA, 16 nt, Pseudomonas putida KT2440
aagcccggcaccuggc

SEQ ID NO: 1595696 - RNA, 22 nt, Pseudomonas putida KT2440
aagccccgguucgcgagaaccg

SEQ ID NO: 1595697 - RNA, 18 nt, Pseudomonas putida KT2440
aagccccggcaucgcugc

SEQ ID NO: 1595698 - RNA, 15 nt, Pseudomonas putida KT2440
gcgacaaaggcgucg

SEQ ID NO: 1595699 - RNA, 17 nt, Pseudomonas putida KT2440
gcgacaaccgaaaaggc

SEQ ID NO: 1595700 - RNA, 19 nt, Pseudomonas putida KT2440
gcgacaaccgaaaaggcca

SEQ ID NO: 1595701 - RNA, 15 nt, Pseudomonas putida KT2440
gcgaaugcgcucauc

SEQ ID NO: 1595702 - RNA, 19 nt, Pseudomonas putida KT2440
gcgaaugagaggcggguca

SEQ ID NO: 1595703 - RNA, 12 nt, Pseudomonas putida KT2440
gcgaaugggccg

SEQ ID NO: 1595704 - RNA, 12 nt, Pseudomonas putida KT2440
gcgaaugggcug

SEQ ID NO: 1595705 - RNA, 17 nt, Pseudomonas putida KT2440
gcgaauggguggcggca

SEQ ID NO: 1595706 - RNA, 15 nt, Pseudomonas putida KT2440
gcgaccaucaccgcc

SEQ ID NO: 1595707 - RNA, 22 nt, Pseudomonas putida KT2440
gcgacgaaacccaguacggcgc

SEQ ID NO: 1595708 - RNA, 18 nt, Pseudomonas putida KT2440
gcgaccuggaucgcgccu

SEQ ID NO: 1595709 - RNA, 22 nt, Pseudomonas putida KT2440
gcgacgaucaucgcgccgacca

SEQ ID NO: 1595710 - RNA, 23 nt, Pseudomonas putida KT2440
gccgggguuuuuuauugccugcc

SEQ ID NO: 1595711 - RNA, 15 nt, Pseudomonas putida KT2440
gccgggucgaaggca

SEQ ID NO: 1595712 - RNA, 13 nt, Pseudomonas putida KT2440
gccgggugcaucg

SEQ ID NO: 1595713 - RNA, 16 nt, Pseudomonas putida KT2440
gccgguacagccuacc

SEQ ID NO: 1595714 - RNA, 17 nt, Pseudomonas putida KT2440
gccgguacagccuacca

SEQ ID NO: 1595715 - RNA, 21 nt, Pseudomonas putida KT2440
gccgguacagccuaccaacgc

SEQ ID NO: 1595716 - RNA, 16 nt, Pseudomonas putida KT2440
gccgguaccgccacca

SEQ ID NO: 1595717 - RNA, 18 nt, Pseudomonas putida KT2440
gccggucauccagcagcu

SEQ ID NO: 1595718 - RNA, 14 nt, Pseudomonas putida KT2440
gccgguacggccaa

SEQ ID NO: 1595719 - RNA, 17 nt, Pseudomonas putida KT2440
gccgguuaaaacccagg

SEQ ID NO: 1595720 - RNA, 18 nt, Pseudomonas putida KT2440
gccggucggggugcugcg

SEQ ID NO: 1595721 - RNA, 21 nt, Pseudomonas putida KT2440
gccggucggggugcugcgcac

SEQ ID NO: 1595722 - RNA, 14 nt, Pseudomonas putida KT2440
gccggucguuaccc

SEQ ID NO: 1595723 - RNA, 21 nt, Pseudomonas putida KT2440
gccggucguuacccaccagcu

SEQ ID NO: 1595724 - RNA, 16 nt, Pseudomonas putida KT2440
gccguaggagcgggcu

SEQ ID NO: 1595725 - RNA, 15 nt, Pseudomonas putida KT2440
gccguaggccaggua

SEQ ID NO: 1595726 - RNA, 22 nt, Pseudomonas putida KT2440
gccguaggccagguacaggcaa

SEQ ID NO: 1595727 - RNA, 21 nt, Pseudomonas putida KT2440
gccguaguaagccagcccugc

SEQ ID NO: 1595728 - RNA, 22 nt, Pseudomonas putida KT2440
gccguaguaagccagcccugcc

SEQ ID NO: 1595729 - RNA, 18 nt, Pseudomonas putida KT2440
gccguacaccaugcucag

SEQ ID NO: 1595730 - RNA, 23 nt, Pseudomonas putida KT2440
gccgguuuuuuuugauuguucau

SEQ ID NO: 1595731 - RNA, 15 nt, Pseudomonas putida KT2440
gccgguuucucgcag

SEQ ID NO: 1595732 - RNA, 21 nt, Pseudomonas putida KT2440
gccgguuucucgcagcagcac

SEQ ID NO: 1595733 - RNA, 21 nt, Pseudomonas putida KT2440
gccgguuggcguaaggaccau

SEQ ID NO: 1595734 - RNA, 12 nt, Pseudomonas putida KT2440
gccgguugcgca

SEQ ID NO: 1595735 - RNA, 15 nt, Pseudomonas putida KT2440
gccggcuaucggcca

SEQ ID NO: 1595736 - RNA, 15 nt, Pseudomonas putida KT2440
gccggcuuccagcga

SEQ ID NO: 1595737 - RNA, 13 nt, Pseudomonas putida KT2440
gccggcuugccuu

SEQ ID NO: 1595738 - RNA, 15 nt, Pseudomonas putida KT2440
gccggcuugccuuca

SEQ ID NO: 1595739 - RNA, 21 nt, Pseudomonas putida KT2440
gccggcuugccuucaagggca

SEQ ID NO: 1595740 - RNA, 23 nt, Pseudomonas putida KT2440
gccggcuuguucuguuucaccag

SEQ ID NO: 1595741 - RNA, 17 nt, Pseudomonas putida KT2440
gccgggcaucgaucacu

SEQ ID NO: 1595742 - RNA, 15 nt, Pseudomonas putida KT2440
gccgggccaccaccg

SEQ ID NO: 1595743 - RNA, 15 nt, Pseudomonas putida KT2440
gccgggcgcaccacg

SEQ ID NO: 1595744 - RNA, 18 nt, Pseudomonas putida KT2440
gccgggccuugaccagca

SEQ ID NO: 1595745 - RNA, 16 nt, Pseudomonas putida KT2440
gccgggccuuucaccg

SEQ ID NO: 1595746 - RNA, 20 nt, Pseudomonas putida KT2440
gccgggcucggccggggcaa

SEQ ID NO: 1595747 - RNA, 20 nt, Pseudomonas putida KT2440
gccuauucgcggguaaaccc

SEQ ID NO: 1595748 - RNA, 18 nt, Pseudomonas putida KT2440
gccuauccugugggagcg

SEQ ID NO: 1595749 - RNA, 22 nt, Pseudomonas putida KT2440
gccuaucucuuccagcgucucg

SEQ ID NO: 1595750 - RNA, 20 nt, Pseudomonas putida KT2440
gccuaugaaaccgagcgccg

SEQ ID NO: 1595751 - RNA, 17 nt, Pseudomonas putida KT2440
gccuaucagaucgagcg

SEQ ID NO: 1595752 - RNA, 21 nt, Pseudomonas putida KT2440
gccuaucagaucgagcgccca

SEQ ID NO: 1595753 - RNA, 21 nt, Pseudomonas putida KT2440
gccucaccgacccacaggcac

SEQ ID NO: 1595754 - RNA, 20 nt, Pseudomonas putida KT2440
gccucaaugggcuuccccag

SEQ ID NO: 1595755 - RNA, 20 nt, Pseudomonas putida KT2440
gccucaagccucgcgcaaca

SEQ ID NO: 1595756 - RNA, 18 nt, Pseudomonas putida KT2440
gccucaggccccaggcca

SEQ ID NO: 1595757 - RNA, 21 nt, Pseudomonas putida KT2440
gccucaggccccaggccaucc

SEQ ID NO: 1595758 - RNA, 15 nt, Pseudomonas putida KT2440
gccucagcgccaaua

SEQ ID NO: 1595759 - RNA, 16 nt, Pseudomonas putida KT2440
gccucaggugcacagg

SEQ ID NO: 1595760 - RNA, 23 nt, Pseudomonas putida KT2440
gccucauccucgcccaccagcug

SEQ ID NO: 1595761 - RNA, 22 nt, Pseudomonas putida KT2440
gccucauagcuuucaggcgcag

SEQ ID NO: 1595762 - RNA, 16 nt, Pseudomonas putida KT2440
gccucaugcagcaccu

SEQ ID NO: 1595763 - RNA, 17 nt, Pseudomonas putida KT2440
gccucccgcuacgagag

SEQ ID NO: 1595764 - RNA, 20 nt, Pseudomonas putida KT2440
gccuccagggcggccuuggc

SEQ ID NO: 1595765 - RNA, 13 nt, Pseudomonas putida KT2440
gccuccagguaau

SEQ ID NO: 1595766 - RNA, 18 nt, Pseudomonas putida KT2440
gccuccaggcguugcggg

SEQ ID NO: 1595767 - RNA, 22 nt, Pseudomonas putida KT2440
gccucccaggacuucagcaguu

SEQ ID NO: 1595768 - RNA, 15 nt, Pseudomonas putida KT2440
gccucccccagcgcg

SEQ ID NO: 1595769 - RNA, 17 nt, Pseudomonas putida KT2440
gccucccccagcgcggu

SEQ ID NO: 1595770 - RNA, 15 nt, Pseudomonas putida KT2440
gccuccauacgcugg

SEQ ID NO: 1595771 - RNA, 20 nt, Pseudomonas putida KT2440
aagccaagcgccgucgaacg

SEQ ID NO: 1595772 - RNA, 18 nt, Pseudomonas putida KT2440
aagccaccggacagaauc

SEQ ID NO: 1595773 - RNA, 21 nt, Pseudomonas putida KT2440
aagccacgcaccucggccaug

SEQ ID NO: 1595774 - RNA, 21 nt, Pseudomonas putida KT2440
gccucguuggcgaagucggcc

SEQ ID NO: 1595775 - RNA, 14 nt, Pseudomonas putida KT2440
gccucgugucgcga

SEQ ID NO: 1595776 - RNA, 16 nt, Pseudomonas putida KT2440
gccucgucggcgcggu

SEQ ID NO: 1595777 - RNA, 19 nt, Pseudomonas putida KT2440
gccucgucggugggcguca

SEQ ID NO: 1595778 - RNA, 13 nt, Pseudomonas putida KT2440
gccucgucgaugu

SEQ ID NO: 1595779 - RNA, 23 nt, Pseudomonas putida KT2440
gccucgguccaccccauguggcg

SEQ ID NO: 1595780 - RNA, 14 nt, Pseudomonas putida KT2440
gccucgguacccgc

SEQ ID NO: 1595781 - RNA, 19 nt, Pseudomonas putida KT2440
gccucgguacccuugggcg

SEQ ID NO: 1595782 - RNA, 16 nt, Pseudomonas putida KT2440
gccucgccauaagcug

SEQ ID NO: 1595783 - RNA, 16 nt, Pseudomonas putida KT2440
gccucgcccaggucaa

SEQ ID NO: 1595784 - RNA, 15 nt, Pseudomonas putida KT2440
gccucgcagguaauc

SEQ ID NO: 1595785 - RNA, 16 nt, Pseudomonas putida KT2440
gccugaucaaagucgc

SEQ ID NO: 1595786 - RNA, 17 nt, Pseudomonas putida KT2440
gccugaucaaagucgcc

SEQ ID NO: 1595787 - RNA, 13 nt, Pseudomonas putida KT2440
gccugaggcugcg

SEQ ID NO: 1595788 - RNA, 22 nt, Pseudomonas putida KT2440
gccugagccuuguucgcgcagg

SEQ ID NO: 1595789 - RNA, 20 nt, Pseudomonas putida KT2440
gccugaaacccauccacggc

SEQ ID NO: 1595790 - RNA, 17 nt, Pseudomonas putida KT2440
gccucuucgcagcacaa

SEQ ID NO: 1595791 - RNA, 12 nt, Pseudomonas putida KT2440
gccucuucgcgg

SEQ ID NO: 1595792 - RNA, 20 nt, Pseudomonas putida KT2440
gccucuucgcggguaaaccc

SEQ ID NO: 1595793 - RNA, 19 nt, Pseudomonas putida KT2440
gccucuucgcgggugaacc

SEQ ID NO: 1595794 - RNA, 18 nt, Pseudomonas putida KT2440
gccucuucggccagcaac

SEQ ID NO: 1595795 - RNA, 15 nt, Pseudomonas putida KT2440
gccucuguuugcugg

SEQ ID NO: 1595796 - RNA, 21 nt, Pseudomonas putida KT2440
gccucuucaggcaauggcgaa

SEQ ID NO: 1595797 - RNA, 16 nt, Pseudomonas putida KT2440
gccucugcugcggaua

SEQ ID NO: 1595798 - RNA, 16 nt, Pseudomonas putida KT2440
gccucuaccgcugcuc

SEQ ID NO: 1595799 - RNA, 19 nt, Pseudomonas putida KT2440
gccgucgcuggagcgggau

SEQ ID NO: 1595800 - RNA, 18 nt, Pseudomonas putida KT2440
gccgucgcgcccaccggu

SEQ ID NO: 1595801 - RNA, 16 nt, Pseudomonas putida KT2440
gccgucgccgcuucgg

SEQ ID NO: 1595802 - RNA, 16 nt, Pseudomonas putida KT2440
gccgucgauuacccag

SEQ ID NO: 1595803 - RNA, 13 nt, Pseudomonas putida KT2440
gccgucgaugccu

SEQ ID NO: 1595804 - RNA, 20 nt, Pseudomonas putida KT2440
gccgugaguggccucgaaca

SEQ ID NO: 1595805 - RNA, 13 nt, Pseudomonas putida KT2440
gccgugcagguca

SEQ ID NO: 1595806 - RNA, 22 nt, Pseudomonas putida KT2440
gccgugcaguucuaccguuggc

SEQ ID NO: 1595807 - RNA, 16 nt, Pseudomonas putida KT2440
gccgugcaggcggcga

SEQ ID NO: 1595808 - RNA, 12 nt, Pseudomonas putida KT2440
gccguggcaggc

SEQ ID NO: 1595809 - RNA, 20 nt, Pseudomonas putida KT2440
gccguguucaggcacgaucg

SEQ ID NO: 1595810 - RNA, 15 nt, Pseudomonas putida KT2440
gccguuguacaagcu

SEQ ID NO: 1595811 - RNA, 16 nt, Pseudomonas putida KT2440
gccguugucacgcgcc

SEQ ID NO: 1595812 - RNA, 19 nt, Pseudomonas putida KT2440
gccguugucacgcgccagg

SEQ ID NO: 1595813 - RNA, 18 nt, Pseudomonas putida KT2440
gccuaagguugcuccugc

SEQ ID NO: 1595814 - RNA, 20 nt, Pseudomonas putida KT2440
gccuacugcuggcgcgacca

SEQ ID NO: 1595815 - RNA, 17 nt, Pseudomonas putida KT2440
gccguuguucacgguca

SEQ ID NO: 1595816 - RNA, 22 nt, Pseudomonas putida KT2440
gccguuguucacggucaggccu

SEQ ID NO: 1595817 - RNA, 23 nt, Pseudomonas putida KT2440
gccguuguucggcaaaggccucu

SEQ ID NO: 1595818 - RNA, 13 nt, Pseudomonas putida KT2440
gcgcacaccgcug

SEQ ID NO: 1595819 - RNA, 22 nt, Pseudomonas putida KT2440
gcgcacaccgcugguggcgugg

SEQ ID NO: 1595820 - RNA, 15 nt, Pseudomonas putida KT2440
gcgauaucagcgcca

SEQ ID NO: 1595821 - RNA, 18 nt, Pseudomonas putida KT2440
gcgauaucagcgccagca

SEQ ID NO: 1595822 - RNA, 13 nt, Pseudomonas putida KT2440
gcgcacacuucgc

SEQ ID NO: 1595823 - RNA, 19 nt, Pseudomonas putida KT2440
gcgauagaacuccaccagc

SEQ ID NO: 1595824 - RNA, 20 nt, Pseudomonas putida KT2440
gcgauagauguccagcgucu

SEQ ID NO: 1595825 - RNA, 22 nt, Pseudomonas putida KT2440
gcgauagccuguggggcaacug

SEQ ID NO: 1595826 - RNA, 17 nt, Pseudomonas putida KT2440
gcgauagggaacagggc

SEQ ID NO: 1595827 - RNA, 16 nt, Pseudomonas putida KT2440
gcgcaccgugcaccag

SEQ ID NO: 1595828 - RNA, 14 nt, Pseudomonas putida KT2440
gcgcacgcugccca

SEQ ID NO: 1595829 - RNA, 15 nt, Pseudomonas putida KT2440
gcgcacgcugcccag

SEQ ID NO: 1595830 - RNA, 14 nt, Pseudomonas putida KT2440
gcgcacggccucca

SEQ ID NO: 1595831 - RNA, 17 nt, Pseudomonas putida KT2440
gcgcacggccuccacca

SEQ ID NO: 1595832 - RNA, 16 nt, Pseudomonas putida KT2440
gcgcacguagcgcccg

SEQ ID NO: 1595833 - RNA, 22 nt, Pseudomonas putida KT2440
gcgcacguagcgcccgucuggc

SEQ ID NO: 1595834 - RNA, 21 nt, Pseudomonas putida KT2440
gcgcacguacuccaccaaggc

SEQ ID NO: 1595835 - RNA, 13 nt, Pseudomonas putida KT2440
gcgcagaucccgc

SEQ ID NO: 1595836 - RNA, 12 nt, Pseudomonas putida KT2440
gcgcagauggug

SEQ ID NO: 1595837 - RNA, 16 nt, Pseudomonas putida KT2440
gcgcagauuccgcgau

SEQ ID NO: 1595838 - RNA, 22 nt, Pseudomonas putida KT2440
gcgcagcagcucccgagccagg

SEQ ID NO: 1595839 - RNA, 17 nt, Pseudomonas putida KT2440
gcgcagcagcaggcccg

SEQ ID NO: 1595840 - RNA, 23 nt, Pseudomonas putida KT2440
gcgcagcacaucacacagcggca

SEQ ID NO: 1595841 - RNA, 15 nt, Pseudomonas putida KT2440
gcgcagccaccagcu

SEQ ID NO: 1595842 - RNA, 17 nt, Pseudomonas putida KT2440
gcgcagccaaucggcgc

SEQ ID NO: 1595843 - RNA, 22 nt, Pseudomonas putida KT2440
gcgcagcaucuuccugccacuc

SEQ ID NO: 1595844 - RNA, 16 nt, Pseudomonas putida KT2440
gcgcagcccucccagg

SEQ ID NO: 1595845 - RNA, 20 nt, Pseudomonas putida KT2440
gcgcagcccugucacgacag

SEQ ID NO: 1595846 - RNA, 17 nt, Pseudomonas putida KT2440
gcgcagcgcaugcucgc

SEQ ID NO: 1595847 - RNA, 11 nt, Pseudomonas putida KT2440
gcgcagcgaac

SEQ ID NO: 1595848 - RNA, 16 nt, Pseudomonas putida KT2440
gcgcagguccaggcgc

SEQ ID NO: 1595849 - RNA, 15 nt, Pseudomonas putida KT2440
gcgcaguucguccag

SEQ ID NO: 1595850 - RNA, 20 nt, Pseudomonas putida KT2440
gcgcaugaaggacaucacca

SEQ ID NO: 1595851 - RNA, 17 nt, Pseudomonas putida KT2440
gcgcauguucaggucgu

SEQ ID NO: 1595852 - RNA, 21 nt, Pseudomonas putida KT2440
gcgccaaaaccuguuccagcc

SEQ ID NO: 1595853 - RNA, 19 nt, Pseudomonas putida KT2440
gcgcauuugcuccagggca

SEQ ID NO: 1595854 - RNA, 20 nt, Pseudomonas putida KT2440
gcgcauuuucaccgagcugc

SEQ ID NO: 1595855 - RNA, 20 nt, Pseudomonas putida KT2440
gcgcauuucguccaggcuca

SEQ ID NO: 1595856 - RNA, 23 nt, Pseudomonas putida KT2440
gcgcauuucguccaggcucagcu

SEQ ID NO: 1595857 - RNA, 14 nt, Pseudomonas putida KT2440
gcgccacccagaac

SEQ ID NO: 1595858 - RNA, 13 nt, Pseudomonas putida KT2440
gcgccaccggcag

SEQ ID NO: 1595859 - RNA, 17 nt, Pseudomonas putida KT2440
gcgcagcggcgucaccu

SEQ ID NO: 1595860 - RNA, 14 nt, Pseudomonas putida KT2440
gcgcaggccgacaa

SEQ ID NO: 1595861 - RNA, 15 nt, Pseudomonas putida KT2440
gcgcagcuuccacca

SEQ ID NO: 1595862 - RNA, 12 nt, Pseudomonas putida KT2440
gcgcaggaaccg

SEQ ID NO: 1595863 - RNA, 14 nt, Pseudomonas putida KT2440
gcgcagggcgcgaa

SEQ ID NO: 1595864 - RNA, 15 nt, Pseudomonas putida KT2440
gcgcagggcgcgaaa

SEQ ID NO: 1595865 - RNA, 18 nt, Pseudomonas putida KT2440
gcgcagggugccggccag

SEQ ID NO: 1595866 - RNA, 20 nt, Pseudomonas putida KT2440
gcgcaggguggcgcugacca

SEQ ID NO: 1595867 - RNA, 22 nt, Pseudomonas putida KT2440
gcgcagggugugcugcugccaa

SEQ ID NO: 1595868 - RNA, 15 nt, Pseudomonas putida KT2440
gcgcaggcgguuggc

SEQ ID NO: 1595869 - RNA, 16 nt, Pseudomonas putida KT2440
gcgcagggcaucgcgc

SEQ ID NO: 1595870 - RNA, 19 nt, Pseudomonas putida KT2440
gcgcaggcuuucggccacc

SEQ ID NO: 1595871 - RNA, 18 nt, Pseudomonas putida KT2440
gcgcaggcgccgccagcu

SEQ ID NO: 1595872 - RNA, 12 nt, Pseudomonas putida KT2440
gcgccgccuucg

SEQ ID NO: 1595873 - RNA, 15 nt, Pseudomonas putida KT2440
gcgccgccggcugaa

SEQ ID NO: 1595874 - RNA, 15 nt, Pseudomonas putida KT2440
gcgccgcauccagca

SEQ ID NO: 1595875 - RNA, 14 nt, Pseudomonas putida KT2440
gcgccgccaggcgg

SEQ ID NO: 1595876 - RNA, 12 nt, Pseudomonas putida KT2440
gcgccgccaugc

SEQ ID NO: 1595877 - RNA, 22 nt, Pseudomonas putida KT2440
gcgccgcccaauacgcaccgcu

SEQ ID NO: 1595878 - RNA, 15 nt, Pseudomonas putida KT2440
gcgccgcccagcucu

SEQ ID NO: 1595879 - RNA, 17 nt, Pseudomonas putida KT2440
gcgccgcccagcucuuu

SEQ ID NO: 1595880 - RNA, 13 nt, Pseudomonas putida KT2440
gcgccgccgcugc

SEQ ID NO: 1595881 - RNA, 20 nt, Pseudomonas putida KT2440
gcgccgccgcugcugcgccu

SEQ ID NO: 1595882 - RNA, 20 nt, Pseudomonas putida KT2440
gcgccgguguucgcgggcau

SEQ ID NO: 1595883 - RNA, 12 nt, Pseudomonas putida KT2440
gcgcccggcaaa

SEQ ID NO: 1595884 - RNA, 19 nt, Pseudomonas putida KT2440
gcgcccggcagaucgagcg

SEQ ID NO: 1595885 - RNA, 14 nt, Pseudomonas putida KT2440
gcgcccgcacagca

SEQ ID NO: 1595886 - RNA, 14 nt, Pseudomonas putida KT2440
gcgcccuucgcgga

SEQ ID NO: 1595887 - RNA, 15 nt, Pseudomonas putida KT2440
gcgcccuucgcggaa

SEQ ID NO: 1595888 - RNA, 20 nt, Pseudomonas putida KT2440
gcgcccuugcggaccaccug

SEQ ID NO: 1595889 - RNA, 13 nt, Pseudomonas putida KT2440
gcgcccggcgcag

SEQ ID NO: 1595890 - RNA, 14 nt, Pseudomonas putida KT2440
gcgcccggccaggu

SEQ ID NO: 1595891 - RNA, 16 nt, Pseudomonas putida KT2440
gcgcccggccagguca

SEQ ID NO: 1595892 - RNA, 21 nt, Pseudomonas putida KT2440
gcgcccugugggagcggccuu

SEQ ID NO: 1595893 - RNA, 19 nt, Pseudomonas putida KT2440
gcgccgaccaguaccacag

SEQ ID NO: 1595894 - RNA, 13 nt, Pseudomonas putida KT2440
gcgccgaucagcu

SEQ ID NO: 1595895 - RNA, 22 nt, Pseudomonas putida KT2440
gcgccacuucgugcaaggcgau

SEQ ID NO: 1595896 - RNA, 19 nt, Pseudomonas putida KT2440
gcgccagacgcgcgcuggc

SEQ ID NO: 1595897 - RNA, 19 nt, Pseudomonas putida KT2440
gcgccaguucgacgcugcu

SEQ ID NO: 1595898 - RNA, 15 nt, Pseudomonas putida KT2440
gcgccaucagcugcg

SEQ ID NO: 1595899 - RNA, 21 nt, Pseudomonas putida KT2440
gcgccaguuccacgaccguga

SEQ ID NO: 1595900 - RNA, 13 nt, Pseudomonas putida KT2440
gcgccaucggcac

SEQ ID NO: 1595901 - RNA, 16 nt, Pseudomonas putida KT2440
gcgcccaguagcgcca

SEQ ID NO: 1595902 - RNA, 13 nt, Pseudomonas putida KT2440
gcgccccgcucgc

SEQ ID NO: 1595903 - RNA, 15 nt, Pseudomonas putida KT2440
gcgccauuggccgcg

SEQ ID NO: 1595904 - RNA, 17 nt, Pseudomonas putida KT2440
gcgcccaaggucagcca

SEQ ID NO: 1595905 - RNA, 18 nt, Pseudomonas putida KT2440
gcgcccaaggucagccag

SEQ ID NO: 1595906 - RNA, 19 nt, Pseudomonas putida KT2440
gcgcgacaaucaggcguca

SEQ ID NO: 1595907 - RNA, 15 nt, Pseudomonas putida KT2440
gcgcgaauuuccggg

SEQ ID NO: 1595908 - RNA, 16 nt, Pseudomonas putida KT2440
gcgcgaauuuccgggu

SEQ ID NO: 1595909 - RNA, 22 nt, Pseudomonas putida KT2440
gcgcgaaguggauauccagcga

SEQ ID NO: 1595910 - RNA, 21 nt, Pseudomonas putida KT2440
gcgcgcccugcucauccagca

SEQ ID NO: 1595911 - RNA, 15 nt, Pseudomonas putida KT2440
gcgcgcccaucugca

SEQ ID NO: 1595912 - RNA, 15 nt, Pseudomonas putida KT2440
gcgcgccgccaggcg

SEQ ID NO: 1595913 - RNA, 18 nt, Pseudomonas putida KT2440
gcgcgccagggcaacggc

SEQ ID NO: 1595914 - RNA, 12 nt, Pseudomonas putida KT2440
gcgcgccagcag

SEQ ID NO: 1595915 - RNA, 17 nt, Pseudomonas putida KT2440
gcgcggaacgucguugc

SEQ ID NO: 1595916 - RNA, 16 nt, Pseudomonas putida KT2440
gcgcggaacacacgcu

SEQ ID NO: 1595917 - RNA, 12 nt, Pseudomonas putida KT2440
gcgcggcaaagg

SEQ ID NO: 1595918 - RNA, 22 nt, Pseudomonas putida KT2440
gcgcggcaaagguggcaccgcc

SEQ ID NO: 1595919 - RNA, 15 nt, Pseudomonas putida KT2440
gcgcgccggcgucga

SEQ ID NO: 1595920 - RNA, 15 nt, Pseudomonas putida KT2440
gcgcgcgcccaccgg

SEQ ID NO: 1595921 - RNA, 23 nt, Pseudomonas putida KT2440
gcgcgccugcaccugacgagcga

SEQ ID NO: 1595922 - RNA, 20 nt, Pseudomonas putida KT2440
gcgcgcgcauccacaggcgc

SEQ ID NO: 1595923 - RNA, 15 nt, Pseudomonas putida KT2440
gcgcgcgacagcacg

SEQ ID NO: 1595924 - RNA, 16 nt, Pseudomonas putida KT2440
gcgcgcgagagcgacg

SEQ ID NO: 1595925 - RNA, 15 nt, Pseudomonas putida KT2440
gcgcgcgaaggcccg

SEQ ID NO: 1595926 - RNA, 12 nt, Pseudomonas putida KT2440
gcgcgcgaauca

SEQ ID NO: 1595927 - RNA, 15 nt, Pseudomonas putida KT2440
gcgcuacggcgucga

SEQ ID NO: 1595928 - RNA, 20 nt, Pseudomonas putida KT2440
gcgcuaccccuguaggagcg

SEQ ID NO: 1595929 - RNA, 23 nt, Pseudomonas putida KT2440
gcgcuaaaggccgcuccugcaca

SEQ ID NO: 1595930 - RNA, 21 nt, Pseudomonas putida KT2440
gcgcucaagcgugacggccag

SEQ ID NO: 1595931 - RNA, 17 nt, Pseudomonas putida KT2440
gcgcucaaccgaccugc

SEQ ID NO: 1595932 - RNA, 22 nt, Pseudomonas putida KT2440
gcgcucaaccgaccugcaacgu

SEQ ID NO: 1595933 - RNA, 13 nt, Pseudomonas putida KT2440
gcgcuccugguca

SEQ ID NO: 1595934 - RNA, 20 nt, Pseudomonas putida KT2440
gcgcucgacauccagcgccg

SEQ ID NO: 1595935 - RNA, 23 nt, Pseudomonas putida KT2440
gcgcucgacauccagcgccgcca

SEQ ID NO: 1595936 - RNA, 13 nt, Pseudomonas putida KT2440
gcgcuccagcagg

SEQ ID NO: 1595937 - RNA, 13 nt, Pseudomonas putida KT2440
gcgcuccaacugg

SEQ ID NO: 1595938 - RNA, 21 nt, Pseudomonas putida KT2440
gcgcgugcggggcaucgccga

SEQ ID NO: 1595939 - RNA, 21 nt, Pseudomonas putida KT2440
gcgcguguagcccgcugaagg

SEQ ID NO: 1595940 - RNA, 18 nt, Pseudomonas putida KT2440
gcgcguccauggcgccga

SEQ ID NO: 1595941 - RNA, 21 nt, Pseudomonas putida KT2440
gcgcguccagcaacagcugcc

SEQ ID NO: 1595942 - RNA, 21 nt, Pseudomonas putida KT2440
gcgcgucucuuucaggcacag

SEQ ID NO: 1595943 - RNA, 23 nt, Pseudomonas putida KT2440
gcgcgucucuuucaggcacagca

SEQ ID NO: 1595944 - RNA, 17 nt, Pseudomonas putida KT2440
gcgcggcgcccagcaac

SEQ ID NO: 1595945 - RNA, 22 nt, Pseudomonas putida KT2440
gcgcgggcaauggccacacgcu

SEQ ID NO: 1595946 - RNA, 18 nt, Pseudomonas putida KT2440
gcgcguaguacuccagca

SEQ ID NO: 1595947 - RNA, 17 nt, Pseudomonas putida KT2440
gcgcgguuuuuucaugc

SEQ ID NO: 1595948 - RNA, 19 nt, Pseudomonas putida KT2440
gcgcgguuaagcgccacca

SEQ ID NO: 1595949 - RNA, 22 nt, Pseudomonas putida KT2440
gcgcgguuaagcgccaccaccg

SEQ ID NO: 1595950 - RNA, 19 nt, Pseudomonas putida KT2440
gcgcggugcggcguagacc

SEQ ID NO: 1595951 - RNA, 14 nt, Pseudomonas putida KT2440
gcgcgggcggcgcu

SEQ ID NO: 1595952 - RNA, 17 nt, Pseudomonas putida KT2440
gcgcggggugaucgccu

SEQ ID NO: 1595953 - RNA, 17 nt, Pseudomonas putida KT2440
gcgcgggucuuccacca

SEQ ID NO: 1595954 - RNA, 22 nt, Pseudomonas putida KT2440
gcgcgggucuuccaccaccucc

SEQ ID NO: 1595955 - RNA, 20 nt, Pseudomonas putida KT2440
gcgcggguuuacccgcgaag

SEQ ID NO: 1595956 - RNA, 20 nt, Pseudomonas putida KT2440
gcgcggguuuacccgcgaau

SEQ ID NO: 1595957 - RNA, 19 nt, Pseudomonas putida KT2440
gcgcgggugcgagaggcgc

SEQ ID NO: 1595958 - RNA, 20 nt, Pseudomonas putida KT2440
gaacaaccugaacaaggccu

SEQ ID NO: 1595959 - RNA, 17 nt, Pseudomonas putida KT2440
gaacaacaggucggcgc

SEQ ID NO: 1595960 - RNA, 16 nt, Pseudomonas putida KT2440
gaaauuggccagcagg

SEQ ID NO: 1595961 - RNA, 22 nt, Pseudomonas putida KT2440
gaacacauagucgauacccagg

SEQ ID NO: 1595962 - RNA, 15 nt, Pseudomonas putida KT2440
gaacacaucaccugc

SEQ ID NO: 1595963 - RNA, 20 nt, Pseudomonas putida KT2440
gaacaccugcgccccgguac

SEQ ID NO: 1595964 - RNA, 13 nt, Pseudomonas putida KT2440
gaacaagucgcgc

SEQ ID NO: 1595965 - RNA, 15 nt, Pseudomonas putida KT2440
gaacaagucgcgcac

SEQ ID NO: 1595966 - RNA, 16 nt, Pseudomonas putida KT2440
gaacaaggcucagcug

SEQ ID NO: 1595967 - RNA, 20 nt, Pseudomonas putida KT2440
gaaacccucacgcgccaggu

SEQ ID NO: 1595968 - RNA, 18 nt, Pseudomonas putida KT2440
gaaacccgcaucaucacg

SEQ ID NO: 1595969 - RNA, 20 nt, Pseudomonas putida KT2440
gaaaccgacuugauugccga

SEQ ID NO: 1595970 - RNA, 14 nt, Pseudomonas putida KT2440
gaaacccagggcag

SEQ ID NO: 1595971 - RNA, 15 nt, Pseudomonas putida KT2440
gaaacaucagccggu

SEQ ID NO: 1595972 - RNA, 14 nt, Pseudomonas putida KT2440
gaaaaugcccgcug

SEQ ID NO: 1595973 - RNA, 20 nt, Pseudomonas putida KT2440
gaaaaugcccccgccgaagc

SEQ ID NO: 1595974 - RNA, 12 nt, Pseudomonas putida KT2440
gaaaaucagcua

SEQ ID NO: 1595975 - RNA, 20 nt, Pseudomonas putida KT2440
aaccugugggagcgggcgug

SEQ ID NO: 1595976 - RNA, 22 nt, Pseudomonas putida KT2440
aaccugguuguagcccgggcag

SEQ ID NO: 1595977 - RNA, 17 nt, Pseudomonas putida KT2440
gaaaacugggcagcccu

SEQ ID NO: 1595978 - RNA, 15 nt, Pseudomonas putida KT2440
gaaaagcgagguacg

SEQ ID NO: 1595979 - RNA, 23 nt, Pseudomonas putida KT2440
gaaaaggccaaccacccgggcag

SEQ ID NO: 1595980 - RNA, 14 nt, Pseudomonas putida KT2440
gaaaaggcccugca

SEQ ID NO: 1595981 - RNA, 20 nt, Pseudomonas putida KT2440
aaccucggccgcauccugcg

SEQ ID NO: 1595982 - RNA, 12 nt, Pseudomonas putida KT2440
aaccucaccgcc

SEQ ID NO: 1595983 - RNA, 21 nt, Pseudomonas putida KT2440
aaccuccggcaucauccugcu

SEQ ID NO: 1595984 - RNA, 19 nt, Pseudomonas putida KT2440
gaacgacagcuuguugcca

SEQ ID NO: 1595985 - RNA, 19 nt, Pseudomonas putida KT2440
gaaccgagcggucgcaggu

SEQ ID NO: 1595986 - RNA, 20 nt, Pseudomonas putida KT2440
gaacccgcuccuacaacggc

SEQ ID NO: 1595987 - RNA, 15 nt, Pseudomonas putida KT2440
gaacccgcugccacc

SEQ ID NO: 1595988 - RNA, 18 nt, Pseudomonas putida KT2440
gaacccgcuggcgaucag

SEQ ID NO: 1595989 - RNA, 22 nt, Pseudomonas putida KT2440
gaaccccaguugaucaacccgu

SEQ ID NO: 1595990 - RNA, 13 nt, Pseudomonas putida KT2440
gaaccacaucacg

SEQ ID NO: 1595991 - RNA, 20 nt, Pseudomonas putida KT2440
gaaccacaucacgaucaugc

SEQ ID NO: 1595992 - RNA, 18 nt, Pseudomonas putida KT2440
gaacagcgugccaugcag

SEQ ID NO: 1595993 - RNA, 16 nt, Pseudomonas putida KT2440
gaacagcgccgcgauc

SEQ ID NO: 1595994 - RNA, 22 nt, Pseudomonas putida KT2440
gaacagccggcuaucggccagc

SEQ ID NO: 1595995 - RNA, 19 nt, Pseudomonas putida KT2440
gaaccaugcgccgcugcuc

SEQ ID NO: 1595996 - RNA, 19 nt, Pseudomonas putida KT2440
gaaccaggugcgguccggc

SEQ ID NO: 1595997 - RNA, 18 nt, Pseudomonas putida KT2440
gaaccccaccagcacugc

SEQ ID NO: 1595998 - RNA, 15 nt, Pseudomonas putida KT2440
gaacuccaacgccgg

SEQ ID NO: 1595999 - RNA, 18 nt, Pseudomonas putida KT2440
gaacuccuccagcucgcg

SEQ ID NO: 1596000 - RNA, 13 nt, Pseudomonas putida KT2440
gaacuccugcacc

SEQ ID NO: 1596001 - RNA, 17 nt, Pseudomonas putida KT2440
gaacguacuggccgcug

SEQ ID NO: 1596002 - RNA, 16 nt, Pseudomonas putida KT2440
gaacggugaacggcgg

SEQ ID NO: 1596003 - RNA, 20 nt, Pseudomonas putida KT2440
gaacgcugccuccacaccga

SEQ ID NO: 1596004 - RNA, 14 nt, Pseudomonas putida KT2440
gaacgcugccugca

SEQ ID NO: 1596005 - RNA, 21 nt, Pseudomonas putida KT2440
gaacgcgaguaacgcccuuca

SEQ ID NO: 1596006 - RNA, 22 nt, Pseudomonas putida KT2440
gaacgccuuguuccgcccagcu

SEQ ID NO: 1596007 - RNA, 22 nt, Pseudomonas putida KT2440
gaacgacuucggcaacagccgg

SEQ ID NO: 1596008 - RNA, 16 nt, Pseudomonas putida KT2440
gaacgaggcguuggcc

SEQ ID NO: 1596009 - RNA, 20 nt, Pseudomonas putida KT2440
gaaaaacagcaguuugcugc

SEQ ID NO: 1596010 - RNA, 17 nt, Pseudomonas putida KT2440
gaaaaagccccgccagu

SEQ ID NO: 1596011 - RNA, 21 nt, Pseudomonas putida KT2440
gaaaaagccccgccagugcaa

SEQ ID NO: 1596012 - RNA, 15 nt, Pseudomonas putida KT2440
gaaaaagccggcaac

SEQ ID NO: 1596013 - RNA, 16 nt, Pseudomonas putida KT2440
gaaaacuccugcuggu

SEQ ID NO: 1596014 - RNA, 16 nt, Pseudomonas putida KT2440
cuuuucggucaugccc

SEQ ID NO: 1596015 - RNA, 17 nt, Pseudomonas putida KT2440
cuuuuucauggcuugag

SEQ ID NO: 1596016 - RNA, 13 nt, Pseudomonas putida KT2440
cuuugagcaggcg

SEQ ID NO: 1596017 - RNA, 15 nt, Pseudomonas putida KT2440
cuuugagcaggcgcu

SEQ ID NO: 1596018 - RNA, 15 nt, Pseudomonas putida KT2440
cuuugcaagccuugu

SEQ ID NO: 1596019 - RNA, 23 nt, Pseudomonas putida KT2440
cuuugcagcccauucgcgggcaa

SEQ ID NO: 1596020 - RNA, 19 nt, Pseudomonas putida KT2440
cuuugcagcccuucgccgg

SEQ ID NO: 1596021 - RNA, 18 nt, Pseudomonas putida KT2440
cuuugccacucagcgggu

SEQ ID NO: 1596022 - RNA, 21 nt, Pseudomonas putida KT2440
cuuugccacucagcggguccu

SEQ ID NO: 1596023 - RNA, 21 nt, Pseudomonas putida KT2440
cuuugaaaccggcaaacgcgg

SEQ ID NO: 1596024 - RNA, 15 nt, Pseudomonas putida KT2440
cuuugcggacgaacu

SEQ ID NO: 1596025 - RNA, 14 nt, Pseudomonas putida KT2440
cuuugcugcagguc

SEQ ID NO: 1596026 - RNA, 12 nt, Pseudomonas putida KT2440
cuuugcgggcac

SEQ ID NO: 1596027 - RNA, 13 nt, Pseudomonas putida KT2440
cuuugcgggcaua

SEQ ID NO: 1596028 - RNA, 21 nt, Pseudomonas putida KT2440
cuuuggcaggaucgcaagcug

SEQ ID NO: 1596029 - RNA, 20 nt, Pseudomonas putida KT2440
cuuugguuggcuuguccagc

SEQ ID NO: 1596030 - RNA, 18 nt, Pseudomonas putida KT2440
cuuuccagguccugcucc

SEQ ID NO: 1596031 - RNA, 21 nt, Pseudomonas putida KT2440
cuuuccaccuggccacccggc

SEQ ID NO: 1596032 - RNA, 15 nt, Pseudomonas putida KT2440
cuuuccaaaccugcg

SEQ ID NO: 1596033 - RNA, 16 nt, Pseudomonas putida KT2440
cuuucgacaugcaguu

SEQ ID NO: 1596034 - RNA, 20 nt, Pseudomonas putida KT2440
cuuucgcggguaaacccgcu

SEQ ID NO: 1596035 - RNA, 18 nt, Pseudomonas putida KT2440
cuuucgagagccgggcaa

SEQ ID NO: 1596036 - RNA, 16 nt, Pseudomonas putida KT2440
cuuucgccgaucagcu

SEQ ID NO: 1596037 - RNA, 17 nt, Pseudomonas putida KT2440
cuuucugcuucgcugcc

SEQ ID NO: 1596038 - RNA, 13 nt, Pseudomonas putida KT2440
cuuggucagggca

SEQ ID NO: 1596039 - RNA, 16 nt, Pseudomonas putida KT2440
cuuggcgugcggcguc

SEQ ID NO: 1596040 - RNA, 19 nt, Pseudomonas putida KT2440
cuuggcaccuaucgcugcc

SEQ ID NO: 1596041 - RNA, 14 nt, Pseudomonas putida KT2440
cuuggcacgcuggc

SEQ ID NO: 1596042 - RNA, 15 nt, Pseudomonas putida KT2440
cuuggcagccucguc

SEQ ID NO: 1596043 - RNA, 20 nt, Pseudomonas putida KT2440
cuuggcagcggcuggcgcuc

SEQ ID NO: 1596044 - RNA, 22 nt, Pseudomonas putida KT2440
cuuggcauuggugccagcgcca

SEQ ID NO: 1596045 - RNA, 14 nt, Pseudomonas putida KT2440
cuuggccaaaccgg

SEQ ID NO: 1596046 - RNA, 17 nt, Pseudomonas putida KT2440
cuuggccaacugcagca

SEQ ID NO: 1596047 - RNA, 13 nt, Pseudomonas putida KT2440
cuuggcagugaug

SEQ ID NO: 1596048 - RNA, 23 nt, Pseudomonas putida KT2440
cuuggcggcccauucgcggguaa

SEQ ID NO: 1596049 - RNA, 16 nt, Pseudomonas putida KT2440
cuuggcguccacagcc

SEQ ID NO: 1596050 - RNA, 22 nt, Pseudomonas putida KT2440
cuuggcguccacagccaugccg

SEQ ID NO: 1596051 - RNA, 22 nt, Pseudomonas putida KT2440
cuugcuguagcccaccagguca

SEQ ID NO: 1596052 - RNA, 13 nt, Pseudomonas putida KT2440
cuugcuggccggu

SEQ ID NO: 1596053 - RNA, 13 nt, Pseudomonas putida KT2440
cuuggacgcuggc

SEQ ID NO: 1596054 - RNA, 18 nt, Pseudomonas putida KT2440
cuugcucugugcaugcgc

SEQ ID NO: 1596055 - RNA, 17 nt, Pseudomonas putida KT2440
cuugcugcaacagcucc

SEQ ID NO: 1596056 - RNA, 19 nt, Pseudomonas putida KT2440
cuugcguuucuucaucccu

SEQ ID NO: 1596057 - RNA, 15 nt, Pseudomonas putida KT2440
cuugcguucgccgcu

SEQ ID NO: 1596058 - RNA, 17 nt, Pseudomonas putida KT2440
cuugcuccaccaggcca

SEQ ID NO: 1596059 - RNA, 18 nt, Pseudomonas putida KT2440
cuugcggugcaugcgcac

SEQ ID NO: 1596060 - RNA, 14 nt, Pseudomonas putida KT2440
cuucgugcagguug

SEQ ID NO: 1596061 - RNA, 23 nt, Pseudomonas putida KT2440
cuucguugucgccuuucaggucg

SEQ ID NO: 1596062 - RNA, 17 nt, Pseudomonas putida KT2440
cuucgucgauguccagc

SEQ ID NO: 1596063 - RNA, 12 nt, Pseudomonas putida KT2440
cuucguccaggg

SEQ ID NO: 1596064 - RNA, 20 nt, Pseudomonas putida KT2440
cuucguccaggguggcguug

SEQ ID NO: 1596065 - RNA, 21 nt, Pseudomonas putida KT2440
cuucguccaggguggcguuga

SEQ ID NO: 1596066 - RNA, 23 nt, Pseudomonas putida KT2440
cuucgguggugaucaucagaccg

SEQ ID NO: 1596067 - RNA, 16 nt, Pseudomonas putida KT2440
cuucggugugcuccag

SEQ ID NO: 1596068 - RNA, 23 nt, Pseudomonas putida KT2440
cuucguaguaauggccgaugaac

SEQ ID NO: 1596069 - RNA, 21 nt, Pseudomonas putida KT2440
aaccguucacguucaacgccg

SEQ ID NO: 1596070 - RNA, 16 nt, Pseudomonas putida KT2440
cuuucaggugcuucgg

SEQ ID NO: 1596071 - RNA, 16 nt, Pseudomonas putida KT2440
cuuguaucccaggcgc

SEQ ID NO: 1596072 - RNA, 17 nt, Pseudomonas putida KT2440
cuuguaucccaggcgcu

SEQ ID NO: 1596073 - RNA, 14 nt, Pseudomonas putida KT2440
cuugucugacagca

SEQ ID NO: 1596074 - RNA, 17 nt, Pseudomonas putida KT2440
cuugucugacagcagga

SEQ ID NO: 1596075 - RNA, 18 nt, Pseudomonas putida KT2440
cuugucggcacgcgccag

SEQ ID NO: 1596076 - RNA, 18 nt, Pseudomonas putida KT2440
cuugucgguggugaucac

SEQ ID NO: 1596077 - RNA, 23 nt, Pseudomonas putida KT2440
cuuuacaacccagacucaaucag

SEQ ID NO: 1596078 - RNA, 12 nt, Pseudomonas putida KT2440
cuuuacggcuga

SEQ ID NO: 1596079 - RNA, 19 nt, Pseudomonas putida KT2440
cuuuagcuuauucgaugca

SEQ ID NO: 1596080 - RNA, 20 nt, Pseudomonas putida KT2440
cuuuagcaggcaagcccgcu

SEQ ID NO: 1596081 - RNA, 16 nt, Pseudomonas putida KT2440
cuuuacuggccaucca

SEQ ID NO: 1596082 - RNA, 19 nt, Pseudomonas putida KT2440
cuggcgcaucuuccagcac

SEQ ID NO: 1596083 - RNA, 12 nt, Pseudomonas putida KT2440
cuggcgccagcg

SEQ ID NO: 1596084 - RNA, 16 nt, Pseudomonas putida KT2440
cuggcgcaggccgcug

SEQ ID NO: 1596085 - RNA, 17 nt, Pseudomonas putida KT2440
cuggcgcaagccgugcc

SEQ ID NO: 1596086 - RNA, 14 nt, Pseudomonas putida KT2440
cuggcgcaccagcg

SEQ ID NO: 1596087 - RNA, 21 nt, Pseudomonas putida KT2440
cuggcgaugagguagaucaca

SEQ ID NO: 1596088 - RNA, 19 nt, Pseudomonas putida KT2440
cuggcgaucaggcaggcca

SEQ ID NO: 1596089 - RNA, 15 nt, Pseudomonas putida KT2440
cuggccucacaucgc

SEQ ID NO: 1596090 - RNA, 15 nt, Pseudomonas putida KT2440
cuggccugcaugcuc

SEQ ID NO: 1596091 - RNA, 17 nt, Pseudomonas putida KT2440
cuggccucuucgcgggu

SEQ ID NO: 1596092 - RNA, 19 nt, Pseudomonas putida KT2440
cuggccucuucgcggguaa

SEQ ID NO: 1596093 - RNA, 20 nt, Pseudomonas putida KT2440
cuggccgcguucgcccaggc

SEQ ID NO: 1596094 - RNA, 14 nt, Pseudomonas putida KT2440
cuggccuuccagcu

SEQ ID NO: 1596095 - RNA, 16 nt, Pseudomonas putida KT2440
cuggccuuggcgugca

SEQ ID NO: 1596096 - RNA, 20 nt, Pseudomonas putida KT2440
cuggccuuggcgugcacgcu

SEQ ID NO: 1596097 - RNA, 18 nt, Pseudomonas putida KT2440
cuggcgaaacaaucggug

SEQ ID NO: 1596098 - RNA, 20 nt, Pseudomonas putida KT2440
cuggcccuguacauccagcu

SEQ ID NO: 1596099 - RNA, 17 nt, Pseudomonas putida KT2440
cuggcccuuucgcgggu

SEQ ID NO: 1596100 - RNA, 19 nt, Pseudomonas putida KT2440
cuggcccuauggggugagc

SEQ ID NO: 1596101 - RNA, 14 nt, Pseudomonas putida KT2440
cuggcccggugcaa

SEQ ID NO: 1596102 - RNA, 17 nt, Pseudomonas putida KT2440
cuggcccgcuugcccga

SEQ ID NO: 1596103 - RNA, 19 nt, Pseudomonas putida KT2440
cuggccagcaagugccccu

SEQ ID NO: 1596104 - RNA, 13 nt, Pseudomonas putida KT2440
cuggccagcaggg

SEQ ID NO: 1596105 - RNA, 19 nt, Pseudomonas putida KT2440
cuggcaccggcgccaauca

SEQ ID NO: 1596106 - RNA, 18 nt, Pseudomonas putida KT2440
cuggcaccggcugcgccg

SEQ ID NO: 1596107 - RNA, 20 nt, Pseudomonas putida KT2440
cuggcacgccuucagcagcc

SEQ ID NO: 1596108 - RNA, 13 nt, Pseudomonas putida KT2440
cuggcacgugcag

SEQ ID NO: 1596109 - RNA, 15 nt, Pseudomonas putida KT2440
cuggcacugcccaag

SEQ ID NO: 1596110 - RNA, 12 nt, Pseudomonas putida KT2440
cuggcacugcgg

SEQ ID NO: 1596111 - RNA, 14 nt, Pseudomonas putida KT2440
cuggcacugcgggu

SEQ ID NO: 1596112 - RNA, 16 nt, Pseudomonas putida KT2440
cuggcacaggcuacgc

SEQ ID NO: 1596113 - RNA, 20 nt, Pseudomonas putida KT2440
cuggcaaucagcucuucgau

SEQ ID NO: 1596114 - RNA, 17 nt, Pseudomonas putida KT2440
cuggccaccagcauggc

SEQ ID NO: 1596115 - RNA, 20 nt, Pseudomonas putida KT2440
cuggccaccaugaacagcac

SEQ ID NO: 1596116 - RNA, 16 nt, Pseudomonas putida KT2440
cuggcacccgcaggac

SEQ ID NO: 1596117 - RNA, 19 nt, Pseudomonas putida KT2440
cuggccaagcggcucguca

SEQ ID NO: 1596118 - RNA, 19 nt, Pseudomonas putida KT2440
cuggccaaggucuccagca

SEQ ID NO: 1596119 - RNA, 13 nt, Pseudomonas putida KT2440
cuggccaccgcgc

SEQ ID NO: 1596120 - RNA, 19 nt, Pseudomonas putida KT2440
cugcccucgacaaucgcca

SEQ ID NO: 1596121 - RNA, 16 nt, Pseudomonas putida KT2440
cugcccguugcgcauc

SEQ ID NO: 1596122 - RNA, 17 nt, Pseudomonas putida KT2440
cugcccguugcgcauca

SEQ ID NO: 1596123 - RNA, 16 nt, Pseudomonas putida KT2440
cugcccgggcaaagca

SEQ ID NO: 1596124 - RNA, 21 nt, Pseudomonas putida KT2440
cugcccguccggcaugcgccg

SEQ ID NO: 1596125 - RNA, 13 nt, Pseudomonas putida KT2440
cugcccugcaugg

SEQ ID NO: 1596126 - RNA, 22 nt, Pseudomonas putida KT2440
cugcccugcauggcauucgcca

SEQ ID NO: 1596127 - RNA, 13 nt, Pseudomonas putida KT2440
cugcccucgggca

SEQ ID NO: 1596128 - RNA, 14 nt, Pseudomonas putida KT2440
cugcccucgggcag

SEQ ID NO: 1596129 - RNA, 19 nt, Pseudomonas putida KT2440
cugccgaccugcgccggga

SEQ ID NO: 1596130 - RNA, 16 nt, Pseudomonas putida KT2440
cuggaggaguccagcu

SEQ ID NO: 1596131 - RNA, 18 nt, Pseudomonas putida KT2440
cuggaggaguccagcugc

SEQ ID NO: 1596132 - RNA, 20 nt, Pseudomonas putida KT2440
cuggagaucuugucgaccug

SEQ ID NO: 1596133 - RNA, 16 nt, Pseudomonas putida KT2440
cuggagucguugcgcu

SEQ ID NO: 1596134 - RNA, 23 nt, Pseudomonas putida KT2440
cuggaucagugucugcgccugcu

SEQ ID NO: 1596135 - RNA, 20 nt, Pseudomonas putida KT2440
cuggaucacugccagcaccu

SEQ ID NO: 1596136 - RNA, 23 nt, Pseudomonas putida KT2440
cugggcgaugaucgccuggccgg

SEQ ID NO: 1596137 - RNA, 17 nt, Pseudomonas putida KT2440
cugggcgugaaagcagg

SEQ ID NO: 1596138 - RNA, 17 nt, Pseudomonas putida KT2440
cugggcgugacggcgau

SEQ ID NO: 1596139 - RNA, 20 nt, Pseudomonas putida KT2440
cugggcgugccaggcuuggc

SEQ ID NO: 1596140 - RNA, 21 nt, Pseudomonas putida KT2440
cugggcgugccaggcuuggcg

SEQ ID NO: 1596141 - RNA, 22 nt, Pseudomonas putida KT2440
cugggcgaucacauaaggcagc

SEQ ID NO: 1596142 - RNA, 12 nt, Pseudomonas putida KT2440
cugggccucauc

SEQ ID NO: 1596143 - RNA, 17 nt, Pseudomonas putida KT2440
cugggccucaucaucga

SEQ ID NO: 1596144 - RNA, 23 nt, Pseudomonas putida KT2440
cuggcugcugugguuuggcccgg

SEQ ID NO: 1596145 - RNA, 15 nt, Pseudomonas putida KT2440
cuggcugccgcgggu

SEQ ID NO: 1596146 - RNA, 17 nt, Pseudomonas putida KT2440
cuggcugugauacagca

SEQ ID NO: 1596147 - RNA, 12 nt, Pseudomonas putida KT2440
cuggcugggcuu

SEQ ID NO: 1596148 - RNA, 15 nt, Pseudomonas putida KT2440
cuggcugggcuucga

SEQ ID NO: 1596149 - RNA, 16 nt, Pseudomonas putida KT2440
cuggcugggcuucgac

SEQ ID NO: 1596150 - RNA, 17 nt, Pseudomonas putida KT2440
cuggcugggcuucgaca

SEQ ID NO: 1596151 - RNA, 20 nt, Pseudomonas putida KT2440
cugggaaaccgugucgggca

SEQ ID NO: 1596152 - RNA, 22 nt, Pseudomonas putida KT2440
cuggcuucaaguuuggcuuugc

SEQ ID NO: 1596153 - RNA, 15 nt, Pseudomonas putida KT2440
cugggcuuacggucu

SEQ ID NO: 1596154 - RNA, 18 nt, Pseudomonas putida KT2440
cugggcuucaugcugcug

SEQ ID NO: 1596155 - RNA, 21 nt, Pseudomonas putida KT2440
cugggcuucaugcugcugcag

SEQ ID NO: 1596156 - RNA, 17 nt, Pseudomonas putida KT2440
cugggcuucgacaaccg

SEQ ID NO: 1596157 - RNA, 21 nt, Pseudomonas putida KT2440
cugggcuucuucgugcgccuc

SEQ ID NO: 1596158 - RNA, 24 nt, Pseudomonas putida KT2440
cuggggauggcaccggcucugccg

SEQ ID NO: 1596159 - RNA, 20 nt, Pseudomonas putida KT2440
cugggcuuugggagcagugg

SEQ ID NO: 1596160 - RNA, 17 nt, Pseudomonas putida KT2440
cugggcgucaucacccg

SEQ ID NO: 1596161 - RNA, 20 nt, Pseudomonas putida KT2440
cugggcgucaucacccggga

SEQ ID NO: 1596162 - RNA, 23 nt, Pseudomonas putida KT2440
cugggcguucugacaacuaucga

SEQ ID NO: 1596163 - RNA, 23 nt, Pseudomonas putida KT2440
cugggcguuuccagguuccauag

SEQ ID NO: 1596164 - RNA, 14 nt, Pseudomonas putida KT2440
cugggucagcuccu

SEQ ID NO: 1596165 - RNA, 20 nt, Pseudomonas putida KT2440
cugggugaugcgcuugccag

SEQ ID NO: 1596166 - RNA, 20 nt, Pseudomonas putida KT2440
cuggucacccugacgcugca

SEQ ID NO: 1596167 - RNA, 20 nt, Pseudomonas putida KT2440
cugguauugccuggcgacac

SEQ ID NO: 1596168 - RNA, 20 nt, Pseudomonas putida KT2440
cugggugugcgccgucacca

SEQ ID NO: 1596169 - RNA, 18 nt, Pseudomonas putida KT2440
cugguaguucaucgccca

SEQ ID NO: 1596170 - RNA, 14 nt, Pseudomonas putida KT2440
cuggcgucgaugau

SEQ ID NO: 1596171 - RNA, 17 nt, Pseudomonas putida KT2440
cuggcgucgaugaucac

SEQ ID NO: 1596172 - RNA, 20 nt, Pseudomonas putida KT2440
cuggcgguguagaacggcag

SEQ ID NO: 1596173 - RNA, 14 nt, Pseudomonas putida KT2440
cuggcgguugacca

SEQ ID NO: 1596174 - RNA, 16 nt, Pseudomonas putida KT2440
cuggcgguugaccagg

SEQ ID NO: 1596175 - RNA, 19 nt, Pseudomonas putida KT2440
cuggcgguugaccagggcg

SEQ ID NO: 1596176 - RNA, 17 nt, Pseudomonas putida KT2440
cuggcgucauccugcgc

SEQ ID NO: 1596177 - RNA, 16 nt, Pseudomonas putida KT2440
cuggcucaucugccgg

SEQ ID NO: 1596178 - RNA, 14 nt, Pseudomonas putida KT2440
cuggcucaggcgcu

SEQ ID NO: 1596179 - RNA, 19 nt, Pseudomonas putida KT2440
cuggcugagguucagcgca

SEQ ID NO: 1596180 - RNA, 15 nt, Pseudomonas putida KT2440
cuggcugaucgcgcc

SEQ ID NO: 1596181 - RNA, 16 nt, Pseudomonas putida KT2440
cuggcugcaaggucca

SEQ ID NO: 1596182 - RNA, 19 nt, Pseudomonas putida KT2440
cuggcuacccgcucggccu

SEQ ID NO: 1596183 - RNA, 20 nt, Pseudomonas putida KT2440
cuggcuacccgcucggccuu

SEQ ID NO: 1596184 - RNA, 18 nt, Pseudomonas putida KT2440
cuggcgcgcugugcucag

SEQ ID NO: 1596185 - RNA, 20 nt, Pseudomonas putida KT2440
cuggcgcgcugugcucagca

SEQ ID NO: 1596186 - RNA, 15 nt, Pseudomonas putida KT2440
cuggcgggguggccg

SEQ ID NO: 1596187 - RNA, 19 nt, Pseudomonas putida KT2440
cuggcggguuuccucgguc

SEQ ID NO: 1596188 - RNA, 18 nt, Pseudomonas putida KT2440
cuggcggcccgccggcaa

SEQ ID NO: 1596189 - RNA, 20 nt, Pseudomonas putida KT2440
cuggcggcccgccggcaacu

SEQ ID NO: 1596190 - RNA, 17 nt, Pseudomonas putida KT2440
cuggcggcccugacgcg

SEQ ID NO: 1596191 - RNA, 17 nt, Pseudomonas putida KT2440
cuggcggcgaugugguu

SEQ ID NO: 1596192 - RNA, 14 nt, Pseudomonas putida KT2440
aaccggccaccgac

SEQ ID NO: 1596193 - RNA, 19 nt, Pseudomonas putida KT2440
aaccggccacgaaggccgg

SEQ ID NO: 1596194 - RNA, 18 nt, Pseudomonas putida KT2440
aaccggcgaucagggugu

SEQ ID NO: 1596195 - RNA, 19 nt, Pseudomonas putida KT2440
cuguguaggagcggguuca

SEQ ID NO: 1596196 - RNA, 23 nt, Pseudomonas putida KT2440
cugugggagcacaagcacgcgcu

SEQ ID NO: 1596197 - RNA, 16 nt, Pseudomonas putida KT2440
cugugggagcaggcau

SEQ ID NO: 1596198 - RNA, 14 nt, Pseudomonas putida KT2440
cugugggagcgggc

SEQ ID NO: 1596199 - RNA, 15 nt, Pseudomonas putida KT2440
cugugggagcgggca

SEQ ID NO: 1596200 - RNA, 16 nt, Pseudomonas putida KT2440
cugugggagcgggcau

SEQ ID NO: 1596201 - RNA, 16 nt, Pseudomonas putida KT2440
cugugggagcgggcgu

SEQ ID NO: 1596202 - RNA, 15 nt, Pseudomonas putida KT2440
cugugggagcgggcu

SEQ ID NO: 1596203 - RNA, 21 nt, Pseudomonas putida KT2440
cugugggagcgggcuugcccg

SEQ ID NO: 1596204 - RNA, 16 nt, Pseudomonas putida KT2440
cuguggcccaaggcga

SEQ ID NO: 1596205 - RNA, 16 nt, Pseudomonas putida KT2440
cuguggaagcgggcgu

SEQ ID NO: 1596206 - RNA, 20 nt, Pseudomonas putida KT2440
cuguggaagugggcuugccc

SEQ ID NO: 1596207 - RNA, 20 nt, Pseudomonas putida KT2440
cuguggcaauuggcggaagc

SEQ ID NO: 1596208 - RNA, 23 nt, Pseudomonas putida KT2440
cuguggcaauuggcggaagccuu

SEQ ID NO: 1596209 - RNA, 20 nt, Pseudomonas putida KT2440
cugugcuuugagcaggcgcu

SEQ ID NO: 1596210 - RNA, 16 nt, Pseudomonas putida KT2440
cuguuuuccauugcac

SEQ ID NO: 1596211 - RNA, 12 nt, Pseudomonas putida KT2440
cugucgcgccag

SEQ ID NO: 1596212 - RNA, 23 nt, Pseudomonas putida KT2440
cugucacgacaggggcgcagagc

SEQ ID NO: 1596213 - RNA, 14 nt, Pseudomonas putida KT2440
cugucggcgcggau

SEQ ID NO: 1596214 - RNA, 16 nt, Pseudomonas putida KT2440
cugucggcgucggcca

SEQ ID NO: 1596215 - RNA, 23 nt, Pseudomonas putida KT2440
cugugcacugcgaagcccaguuc

SEQ ID NO: 1596216 - RNA, 18 nt, Pseudomonas putida KT2440
cugucggguuggucgcca

SEQ ID NO: 1596217 - RNA, 18 nt, Pseudomonas putida KT2440
cugugcaggggagggcgu

SEQ ID NO: 1596218 - RNA, 15 nt, Pseudomonas putida KT2440
cugugccagcgaggc

SEQ ID NO: 1596219 - RNA, 18 nt, Pseudomonas putida KT2440
cugugcccugaucgccuc

SEQ ID NO: 1596220 - RNA, 19 nt, Pseudomonas putida KT2440
cugugcccugaucgccucc

SEQ ID NO: 1596221 - RNA, 23 nt, Pseudomonas putida KT2440
cugugcccugaucgccuccaggc

SEQ ID NO: 1596222 - RNA, 19 nt, Pseudomonas putida KT2440
cugugcggcguauacccgg

SEQ ID NO: 1596223 - RNA, 22 nt, Pseudomonas putida KT2440
cugugccgcuuuggcagcagcc

SEQ ID NO: 1596224 - RNA, 17 nt, Pseudomonas putida KT2440
cugugccggcagcgagc

SEQ ID NO: 1596225 - RNA, 21 nt, Pseudomonas putida KT2440
cugugccggcagcgagcgcug

SEQ ID NO: 1596226 - RNA, 22 nt, Pseudomonas putida KT2440
cugugccggccucuucgcgggc

SEQ ID NO: 1596227 - RNA, 22 nt, Pseudomonas putida KT2440
cugugccggccucuucgcgggu

SEQ ID NO: 1596228 - RNA, 19 nt, Pseudomonas putida KT2440
cuguacuggcccuuucgcg

SEQ ID NO: 1596229 - RNA, 14 nt, Pseudomonas putida KT2440
cuguagagcgccuu

SEQ ID NO: 1596230 - RNA, 15 nt, Pseudomonas putida KT2440
cuguaggagcggguu

SEQ ID NO: 1596231 - RNA, 22 nt, Pseudomonas putida KT2440
cuguaggaucggguuuacccgc

SEQ ID NO: 1596232 - RNA, 14 nt, Pseudomonas putida KT2440
cuguaggcaaacag

SEQ ID NO: 1596233 - RNA, 19 nt, Pseudomonas putida KT2440
cugucacccuugggcacca

SEQ ID NO: 1596234 - RNA, 17 nt, Pseudomonas putida KT2440
cugguccgaggucagca

SEQ ID NO: 1596235 - RNA, 20 nt, Pseudomonas putida KT2440
cugguccgaggucagcacca

SEQ ID NO: 1596236 - RNA, 17 nt, Pseudomonas putida KT2440
cuggucgaaggucaggc

SEQ ID NO: 1596237 - RNA, 13 nt, Pseudomonas putida KT2440
cuguaccgaccuc

SEQ ID NO: 1596238 - RNA, 14 nt, Pseudomonas putida KT2440
cuguaccgccguca

SEQ ID NO: 1596239 - RNA, 19 nt, Pseudomonas putida KT2440
cuguaccggccucuucgcg

SEQ ID NO: 1596240 - RNA, 18 nt, Pseudomonas putida KT2440
cuucagcucgaacccacu

SEQ ID NO: 1596241 - RNA, 22 nt, Pseudomonas putida KT2440
cuucagcggccgcgcaauugcc

SEQ ID NO: 1596242 - RNA, 13 nt, Pseudomonas putida KT2440
cuucagcgggucg

SEQ ID NO: 1596243 - RNA, 14 nt, Pseudomonas putida KT2440
cuucagcgcaucga

SEQ ID NO: 1596244 - RNA, 16 nt, Pseudomonas putida KT2440
cuucagccgucgccgc

SEQ ID NO: 1596245 - RNA, 16 nt, Pseudomonas putida KT2440
cuucaauagcggccaa

SEQ ID NO: 1596246 - RNA, 16 nt, Pseudomonas putida KT2440
cuucaaaucgcugcgc

SEQ ID NO: 1596247 - RNA, 20 nt, Pseudomonas putida KT2440
cuucaaaauagucgaaggcu

SEQ ID NO: 1596248 - RNA, 12 nt, Pseudomonas putida KT2440
cuucaaacccgg

SEQ ID NO: 1596249 - RNA, 17 nt, Pseudomonas putida KT2440
cuucaacgcggcuucga

SEQ ID NO: 1596250 - RNA, 17 nt, Pseudomonas putida KT2440
cuucagggucgggcaca

SEQ ID NO: 1596251 - RNA, 22 nt, Pseudomonas putida KT2440
cuucaggguuguggugagcccu

SEQ ID NO: 1596252 - RNA, 20 nt, Pseudomonas putida KT2440
cuucagguaauccaccagcc

SEQ ID NO: 1596253 - RNA, 14 nt, Pseudomonas putida KT2440
cuucagugcuucac

SEQ ID NO: 1596254 - RNA, 21 nt, Pseudomonas putida KT2440
cuuccagaccagacagcgcua

SEQ ID NO: 1596255 - RNA, 23 nt, Pseudomonas putida KT2440
cuuccagcccgccugcucaauca

SEQ ID NO: 1596256 - RNA, 14 nt, Pseudomonas putida KT2440
cuuccagccugcag

SEQ ID NO: 1596257 - RNA, 14 nt, Pseudomonas putida KT2440
cuuccagcggcaag

SEQ ID NO: 1596258 - RNA, 19 nt, Pseudomonas putida KT2440
cuuccacgcccaggcgcuu

SEQ ID NO: 1596259 - RNA, 22 nt, Pseudomonas putida KT2440
cuuccaccgguacauugcgcac

SEQ ID NO: 1596260 - RNA, 17 nt, Pseudomonas putida KT2440
cuucgcagcacaaggcu

SEQ ID NO: 1596261 - RNA, 14 nt, Pseudomonas putida KT2440
cuucgccagcgcca

SEQ ID NO: 1596262 - RNA, 15 nt, Pseudomonas putida KT2440
cuucgcccagugccu

SEQ ID NO: 1596263 - RNA, 17 nt, Pseudomonas putida KT2440
cuucgcccagugccuga

SEQ ID NO: 1596264 - RNA, 20 nt, Pseudomonas putida KT2440
cuucgccacgaacaggcgcu

SEQ ID NO: 1596265 - RNA, 20 nt, Pseudomonas putida KT2440
cuucgcccguguucgcgggc

SEQ ID NO: 1596266 - RNA, 21 nt, Pseudomonas putida KT2440
cuucgcccguguucgcgggca

SEQ ID NO: 1596267 - RNA, 21 nt, Pseudomonas putida KT2440
cuucgcccucguucgcgggca

SEQ ID NO: 1596268 - RNA, 14 nt, Pseudomonas putida KT2440
cuucgcccuucagc

SEQ ID NO: 1596269 - RNA, 12 nt, Pseudomonas putida KT2440
cuucgcgggcaa

SEQ ID NO: 1596270 - RNA, 20 nt, Pseudomonas putida KT2440
cuucgcgggcaagcccgcuc

SEQ ID NO: 1596271 - RNA, 12 nt, Pseudomonas putida KT2440
cuucgcgggcac

SEQ ID NO: 1596272 - RNA, 20 nt, Pseudomonas putida KT2440
cuucgcgggcacgcccgcuc

SEQ ID NO: 1596273 - RNA, 12 nt, Pseudomonas putida KT2440
cuucgcgggcau

SEQ ID NO: 1596274 - RNA, 13 nt, Pseudomonas putida KT2440
cuucgcgggcaug

SEQ ID NO: 1596275 - RNA, 12 nt, Pseudomonas putida KT2440
cuucgcggguaa

SEQ ID NO: 1596276 - RNA, 20 nt, Pseudomonas putida KT2440
cuucgcggguaaacccgcuc

SEQ ID NO: 1596277 - RNA, 20 nt, Pseudomonas putida KT2440
cuucgcggguaagcccgcuc

SEQ ID NO: 1596278 - RNA, 19 nt, Pseudomonas putida KT2440
cuucgcgggugaacccgcu

SEQ ID NO: 1596279 - RNA, 20 nt, Pseudomonas putida KT2440
cuucgcugucuuccagggca

SEQ ID NO: 1596280 - RNA, 23 nt, Pseudomonas putida KT2440
cuucgcucaggugcaccuccgcc

SEQ ID NO: 1596281 - RNA, 16 nt, Pseudomonas putida KT2440
cuucgcuuucaccuug

SEQ ID NO: 1596282 - RNA, 13 nt, Pseudomonas putida KT2440
cuucggucagcug

SEQ ID NO: 1596283 - RNA, 15 nt, Pseudomonas putida KT2440
cuucggucagcuggu

SEQ ID NO: 1596284 - RNA, 17 nt, Pseudomonas putida KT2440
cuuccugguuuucgcgg

SEQ ID NO: 1596285 - RNA, 18 nt, Pseudomonas putida KT2440
cuuccugguuuucgcggu

SEQ ID NO: 1596286 - RNA, 15 nt, Pseudomonas putida KT2440
cuuccggcugcagca

SEQ ID NO: 1596287 - RNA, 17 nt, Pseudomonas putida KT2440
cuucgaagaacacggcu

SEQ ID NO: 1596288 - RNA, 16 nt, Pseudomonas putida KT2440
cuucgaacacccgcuu

SEQ ID NO: 1596289 - RNA, 20 nt, Pseudomonas putida KT2440
cuucgaccagaacagcucga

SEQ ID NO: 1596290 - RNA, 23 nt, Pseudomonas putida KT2440
cuucgaccauuggacgauuguaa

SEQ ID NO: 1596291 - RNA, 22 nt, Pseudomonas putida KT2440
cuucgacacugaucucgcgcau

SEQ ID NO: 1596292 - RNA, 17 nt, Pseudomonas putida KT2440
cuuccgccaccacgaac

SEQ ID NO: 1596293 - RNA, 13 nt, Pseudomonas putida KT2440
cuuccgcaugcuu

SEQ ID NO: 1596294 - RNA, 19 nt, Pseudomonas putida KT2440
cuuccagcgucucgaugca

SEQ ID NO: 1596295 - RNA, 21 nt, Pseudomonas putida KT2440
cuuccagguaaugcgcaggcg

SEQ ID NO: 1596296 - RNA, 11 nt, Pseudomonas putida KT2440
cuuccaggucg

SEQ ID NO: 1596297 - RNA, 17 nt, Pseudomonas putida KT2440
cuuccaggcgacggaac

SEQ ID NO: 1596298 - RNA, 15 nt, Pseudomonas putida KT2440
gacgcggugcucgau

SEQ ID NO: 1596299 - RNA, 17 nt, Pseudomonas putida KT2440
gacgcggugcucgaugc

SEQ ID NO: 1596300 - RNA, 20 nt, Pseudomonas putida KT2440
gacgcgguggagggcaccgg

SEQ ID NO: 1596301 - RNA, 14 nt, Pseudomonas putida KT2440
gacgcgccgugcca

SEQ ID NO: 1596302 - RNA, 19 nt, Pseudomonas putida KT2440
gacgcggaccuugucgcca

SEQ ID NO: 1596303 - RNA, 14 nt, Pseudomonas putida KT2440
gacgcggagccggc

SEQ ID NO: 1596304 - RNA, 17 nt, Pseudomonas putida KT2440
gacgcgcgcagccuggc

SEQ ID NO: 1596305 - RNA, 17 nt, Pseudomonas putida KT2440
gacgcugccgcaccugc

SEQ ID NO: 1596306 - RNA, 12 nt, Pseudomonas putida KT2440
gacgcugccguc

SEQ ID NO: 1596307 - RNA, 23 nt, Pseudomonas putida KT2440
gacggccugcgcccgaucaccga

SEQ ID NO: 1596308 - RNA, 20 nt, Pseudomonas putida KT2440
aacgucggcagccaugcugu

SEQ ID NO: 1596309 - RNA, 18 nt, Pseudomonas putida KT2440
gacgguugacagcacggc

SEQ ID NO: 1596310 - RNA, 13 nt, Pseudomonas putida KT2440
gacggugcgcgcc

SEQ ID NO: 1596311 - RNA, 14 nt, Pseudomonas putida KT2440
gacggguuacccug

SEQ ID NO: 1596312 - RNA, 21 nt, Pseudomonas putida KT2440
gacgggugaccaggcccagca

SEQ ID NO: 1596313 - RNA, 19 nt, Pseudomonas putida KT2440
gacgggccucuucgcgggu

SEQ ID NO: 1596314 - RNA, 12 nt, Pseudomonas putida KT2440
gacgccgccauc

SEQ ID NO: 1596315 - RNA, 15 nt, Pseudomonas putida KT2440
gacgccgccagcgcu

SEQ ID NO: 1596316 - RNA, 21 nt, Pseudomonas putida KT2440
gacgccgccagcgcuccagca

SEQ ID NO: 1596317 - RNA, 16 nt, Pseudomonas putida KT2440
gacgauggccaccagc

SEQ ID NO: 1596318 - RNA, 15 nt, Pseudomonas putida KT2440
gacgauggacagccc

SEQ ID NO: 1596319 - RNA, 23 nt, Pseudomonas putida KT2440
gacgaugccguuuucgguaauca

SEQ ID NO: 1596320 - RNA, 21 nt, Pseudomonas putida KT2440
gacgaugcccgaucggguacu

SEQ ID NO: 1596321 - RNA, 18 nt, Pseudomonas putida KT2440
gacgccaccuucgccagg

SEQ ID NO: 1596322 - RNA, 17 nt, Pseudomonas putida KT2440
gacgccaccccggugca

SEQ ID NO: 1596323 - RNA, 12 nt, Pseudomonas putida KT2440
gacgcagcagcg

SEQ ID NO: 1596324 - RNA, 20 nt, Pseudomonas putida KT2440
gacgcagacaaaacgcugcg

SEQ ID NO: 1596325 - RNA, 20 nt, Pseudomonas putida KT2440
gaccuugggccggcgcaggu

SEQ ID NO: 1596326 - RNA, 17 nt, Pseudomonas putida KT2440
gaccugugggagcgggc

SEQ ID NO: 1596327 - RNA, 18 nt, Pseudomonas putida KT2440
gaccugugggagcgggca

SEQ ID NO: 1596328 - RNA, 21 nt, Pseudomonas putida KT2440
gaccugugggagcgggcaugc

SEQ ID NO: 1596329 - RNA, 16 nt, Pseudomonas putida KT2440
gaccugccagccuucg

SEQ ID NO: 1596330 - RNA, 16 nt, Pseudomonas putida KT2440
aacggcagcaggccaa

SEQ ID NO: 1596331 - RNA, 17 nt, Pseudomonas putida KT2440
aacggcagcgacagcug

SEQ ID NO: 1596332 - RNA, 15 nt, Pseudomonas putida KT2440
aacggcacucgaagc

SEQ ID NO: 1596333 - RNA, 17 nt, Pseudomonas putida KT2440
gacgaggccgagcgcga

SEQ ID NO: 1596334 - RNA, 12 nt, Pseudomonas putida KT2440
gacgaucgccgc

SEQ ID NO: 1596335 - RNA, 15 nt, Pseudomonas putida KT2440
gacgaucgccagccc

SEQ ID NO: 1596336 - RNA, 15 nt, Pseudomonas putida KT2440
gacacugaucucgcg

SEQ ID NO: 1596337 - RNA, 21 nt, Pseudomonas putida KT2440
gacacugccaucucgccaagc

SEQ ID NO: 1596338 - RNA, 13 nt, Pseudomonas putida KT2440
gacagcaggaaca

SEQ ID NO: 1596339 - RNA, 15 nt, Pseudomonas putida KT2440
gacagcaggaacagc

SEQ ID NO: 1596340 - RNA, 14 nt, Pseudomonas putida KT2440
gacagcgcuuccaa

SEQ ID NO: 1596341 - RNA, 18 nt, Pseudomonas putida KT2440
gacagcgcuuccaagugc

SEQ ID NO: 1596342 - RNA, 23 nt, Pseudomonas putida KT2440
gacagcuuguugccagcggcgau

SEQ ID NO: 1596343 - RNA, 14 nt, Pseudomonas putida KT2440
gacagcuugcccag

SEQ ID NO: 1596344 - RNA, 21 nt, Pseudomonas putida KT2440
gacauccacguccuggucacg

SEQ ID NO: 1596345 - RNA, 12 nt, Pseudomonas putida KT2440
gacacaggccgu

SEQ ID NO: 1596346 - RNA, 15 nt, Pseudomonas putida KT2440
gacacaggccgucgu

SEQ ID NO: 1596347 - RNA, 20 nt, Pseudomonas putida KT2440
gacaccagguucuguagcgc

SEQ ID NO: 1596348 - RNA, 20 nt, Pseudomonas putida KT2440
gacacuaggagugucagcgu

SEQ ID NO: 1596349 - RNA, 19 nt, Pseudomonas putida KT2440
gacacggcugccgacaggc

SEQ ID NO: 1596350 - RNA, 22 nt, Pseudomonas putida KT2440
gacacggacucauagcucagcu

SEQ ID NO: 1596351 - RNA, 21 nt, Pseudomonas putida KT2440
gaauaugcucuuuccaacgga

SEQ ID NO: 1596352 - RNA, 14 nt, Pseudomonas putida KT2440
gaaguguugccggu

SEQ ID NO: 1596353 - RNA, 20 nt, Pseudomonas putida KT2440
gaaguuguccgggucgccgu

SEQ ID NO: 1596354 - RNA, 14 nt, Pseudomonas putida KT2440
gaacugcagagccu

SEQ ID NO: 1596355 - RNA, 21 nt, Pseudomonas putida KT2440
gaacugcaacuugcccgcgua

SEQ ID NO: 1596356 - RNA, 17 nt, Pseudomonas putida KT2440
gaaguggagaucgucgu

SEQ ID NO: 1596357 - RNA, 15 nt, Pseudomonas putida KT2440
gaacuggcugccgcu

SEQ ID NO: 1596358 - RNA, 17 nt, Pseudomonas putida KT2440
gaacuggcugccgcuga

SEQ ID NO: 1596359 - RNA, 14 nt, Pseudomonas putida KT2440
gacaacagcaugcu

SEQ ID NO: 1596360 - RNA, 12 nt, Pseudomonas putida KT2440
gacaacccgcgc

SEQ ID NO: 1596361 - RNA, 21 nt, Pseudomonas putida KT2440
gacaagcgcauugaucgccgc

SEQ ID NO: 1596362 - RNA, 16 nt, Pseudomonas putida KT2440
gacaacuuggcaccga

SEQ ID NO: 1596363 - RNA, 18 nt, Pseudomonas putida KT2440
gaaugcgcccggccaggu

SEQ ID NO: 1596364 - RNA, 18 nt, Pseudomonas putida KT2440
gaaugcuguugugcgaua

SEQ ID NO: 1596365 - RNA, 22 nt, Pseudomonas putida KT2440
gaccaccgcaggugcaggcucg

SEQ ID NO: 1596366 - RNA, 17 nt, Pseudomonas putida KT2440
gaccacuuuuggcguga

SEQ ID NO: 1596367 - RNA, 21 nt, Pseudomonas putida KT2440
gaccagcaccagcgacugcaa

SEQ ID NO: 1596368 - RNA, 19 nt, Pseudomonas putida KT2440
aacgcccgaccuuggcgac

SEQ ID NO: 1596369 - RNA, 22 nt, Pseudomonas putida KT2440
aacgccccagcaguucgcgcac

SEQ ID NO: 1596370 - RNA, 23 nt, Pseudomonas putida KT2440
aacgccacgcccaacccagccag

SEQ ID NO: 1596371 - RNA, 16 nt, Pseudomonas putida KT2440
gaccagcggaucaccg

SEQ ID NO: 1596372 - RNA, 15 nt, Pseudomonas putida KT2440
gaccaggcccagcag

SEQ ID NO: 1596373 - RNA, 14 nt, Pseudomonas putida KT2440
gaccagggcgucga

SEQ ID NO: 1596374 - RNA, 15 nt, Pseudomonas putida KT2440
gaccagccgggcugc

SEQ ID NO: 1596375 - RNA, 12 nt, Pseudomonas putida KT2440
gaccagcgccgc

SEQ ID NO: 1596376 - RNA, 17 nt, Pseudomonas putida KT2440
gacccgcagcagguugc

SEQ ID NO: 1596377 - RNA, 14 nt, Pseudomonas putida KT2440
gaccauuuccgggu

SEQ ID NO: 1596378 - RNA, 15 nt, Pseudomonas putida KT2440
gaccauggcgaugaa

SEQ ID NO: 1596379 - RNA, 23 nt, Pseudomonas putida KT2440
gacccacaggcacaggcccagca

SEQ ID NO: 1596380 - RNA, 20 nt, Pseudomonas putida KT2440
gacccuguagccccgcuggu

SEQ ID NO: 1596381 - RNA, 15 nt, Pseudomonas putida KT2440
gacccugacucaugc

SEQ ID NO: 1596382 - RNA, 13 nt, Pseudomonas putida KT2440
gacccugcugcug

SEQ ID NO: 1596383 - RNA, 21 nt, Pseudomonas putida KT2440
aacgcgggcaauguccaggug

SEQ ID NO: 1596384 - RNA, 23 nt, Pseudomonas putida KT2440
aacgcggcuucgaugcccggcag

SEQ ID NO: 1596385 - RNA, 19 nt, Pseudomonas putida KT2440
gacccgcuggcgaccggcg

SEQ ID NO: 1596386 - RNA, 15 nt, Pseudomonas putida KT2440
gaccgaugccgccgu

SEQ ID NO: 1596387 - RNA, 23 nt, Pseudomonas putida KT2440
gaccgaugccgccguuguugacc

SEQ ID NO: 1596388 - RNA, 14 nt, Pseudomonas putida KT2440
gaccgccgccuggc

SEQ ID NO: 1596389 - RNA, 18 nt, Pseudomonas putida KT2440
gaccgauaaagagaagcu

SEQ ID NO: 1596390 - RNA, 22 nt, Pseudomonas putida KT2440
cucggacuucagcuucauggcg

SEQ ID NO: 1596391 - RNA, 17 nt, Pseudomonas putida KT2440
cucggaaaggucggcgg

SEQ ID NO: 1596392 - RNA, 19 nt, Pseudomonas putida KT2440
cucggacaaauccaggucg

SEQ ID NO: 1596393 - RNA, 17 nt, Pseudomonas putida KT2440
cucgcgggccuggagca

SEQ ID NO: 1596394 - RNA, 18 nt, Pseudomonas putida KT2440
cucggcaaucugcagcag

SEQ ID NO: 1596395 - RNA, 19 nt, Pseudomonas putida KT2440
cucggcaaucugcagcagc

SEQ ID NO: 1596396 - RNA, 13 nt, Pseudomonas putida KT2440
cucggccaggucg

SEQ ID NO: 1596397 - RNA, 17 nt, Pseudomonas putida KT2440
cucggccagugcgugca

SEQ ID NO: 1596398 - RNA, 13 nt, Pseudomonas putida KT2440
cucggccagcggc

SEQ ID NO: 1596399 - RNA, 17 nt, Pseudomonas putida KT2440
cucggcagugaacucca

SEQ ID NO: 1596400 - RNA, 23 nt, Pseudomonas putida KT2440
cucggcaauugcguucuugccug

SEQ ID NO: 1596401 - RNA, 13 nt, Pseudomonas putida KT2440
cucggcacugcac

SEQ ID NO: 1596402 - RNA, 15 nt, Pseudomonas putida KT2440
cucggccgaugccag

SEQ ID NO: 1596403 - RNA, 20 nt, Pseudomonas putida KT2440
cucggccucgguacccgcca

SEQ ID NO: 1596404 - RNA, 22 nt, Pseudomonas putida KT2440
cucggccucgguacccgccagc

SEQ ID NO: 1596405 - RNA, 23 nt, Pseudomonas putida KT2440
cucggccucgguacccgccagca

SEQ ID NO: 1596406 - RNA, 12 nt, Pseudomonas putida KT2440
cucggccucagc

SEQ ID NO: 1596407 - RNA, 16 nt, Pseudomonas putida KT2440
cucggcggugccugca

SEQ ID NO: 1596408 - RNA, 19 nt, Pseudomonas putida KT2440
cucggcggugccugcagcc

SEQ ID NO: 1596409 - RNA, 14 nt, Pseudomonas putida KT2440
cucggccuugccgu

SEQ ID NO: 1596410 - RNA, 17 nt, Pseudomonas putida KT2440
cucggccuugucuggca

SEQ ID NO: 1596411 - RNA, 20 nt, Pseudomonas putida KT2440
cucgccguacucggucuggu

SEQ ID NO: 1596412 - RNA, 12 nt, Pseudomonas putida KT2440
cucgccucagcg

SEQ ID NO: 1596413 - RNA, 16 nt, Pseudomonas putida KT2440
cucgccucagcgccaa

SEQ ID NO: 1596414 - RNA, 17 nt, Pseudomonas putida KT2440
cucgcgcauccagccag

SEQ ID NO: 1596415 - RNA, 14 nt, Pseudomonas putida KT2440
cucgcgcaugaucg

SEQ ID NO: 1596416 - RNA, 14 nt, Pseudomonas putida KT2440
cucgcgcaggcggu

SEQ ID NO: 1596417 - RNA, 18 nt, Pseudomonas putida KT2440
cucgcgcccacgcggguc

SEQ ID NO: 1596418 - RNA, 21 nt, Pseudomonas putida KT2440
cucgcgccgccgcugcugcgc

SEQ ID NO: 1596419 - RNA, 18 nt, Pseudomonas putida KT2440
cucgcgggcaaacccgcg

SEQ ID NO: 1596420 - RNA, 17 nt, Pseudomonas putida KT2440
cucgcagguauccgggu

SEQ ID NO: 1596421 - RNA, 20 nt, Pseudomonas putida KT2440
cucgcaggucuucucggcag

SEQ ID NO: 1596422 - RNA, 14 nt, Pseudomonas putida KT2440
cucgccccgcgcaa

SEQ ID NO: 1596423 - RNA, 23 nt, Pseudomonas putida KT2440
cucgccaaaccauggcgucaggc

SEQ ID NO: 1596424 - RNA, 16 nt, Pseudomonas putida KT2440
cucgcccgggucaggu

SEQ ID NO: 1596425 - RNA, 18 nt, Pseudomonas putida KT2440
cucgcccgggucaggucg

SEQ ID NO: 1596426 - RNA, 19 nt, Pseudomonas putida KT2440
cucgcccgguuuggccuga

SEQ ID NO: 1596427 - RNA, 17 nt, Pseudomonas putida KT2440
cucgccgcuguacacca

SEQ ID NO: 1596428 - RNA, 15 nt, Pseudomonas putida KT2440
cucgcagcagcaccg

SEQ ID NO: 1596429 - RNA, 17 nt, Pseudomonas putida KT2440
cucgaucucacaggcga

SEQ ID NO: 1596430 - RNA, 22 nt, Pseudomonas putida KT2440
cucgaucuuguuggucaggcca

SEQ ID NO: 1596431 - RNA, 20 nt, Pseudomonas putida KT2440
cucgaucgucgacaacgcac

SEQ ID NO: 1596432 - RNA, 13 nt, Pseudomonas putida KT2440
cucgaucggcacc

SEQ ID NO: 1596433 - RNA, 22 nt, Pseudomonas putida KT2440
cucgaucgccauguguacgccg

SEQ ID NO: 1596434 - RNA, 19 nt, Pseudomonas putida KT2440
cucgagcgcuuucagccgu

SEQ ID NO: 1596435 - RNA, 16 nt, Pseudomonas putida KT2440
cucgaggaagcggcca

SEQ ID NO: 1596436 - RNA, 17 nt, Pseudomonas putida KT2440
cucgaacggcgccagca

SEQ ID NO: 1596437 - RNA, 19 nt, Pseudomonas putida KT2440
cucgacaaaucccgcacaa

SEQ ID NO: 1596438 - RNA, 14 nt, Pseudomonas putida KT2440
cucgacccgcuggc

SEQ ID NO: 1596439 - RNA, 20 nt, Pseudomonas putida KT2440
cucgacccgcgucagcucaa

SEQ ID NO: 1596440 - RNA, 15 nt, Pseudomonas putida KT2440
cucgacccagccacc

SEQ ID NO: 1596441 - RNA, 19 nt, Pseudomonas putida KT2440
cucgacccccuugccagca

SEQ ID NO: 1596442 - RNA, 21 nt, Pseudomonas putida KT2440
cucgacccccuugccagcaug

SEQ ID NO: 1596443 - RNA, 22 nt, Pseudomonas putida KT2440
cucgacgccuuggcgcagcaag

SEQ ID NO: 1596444 - RNA, 13 nt, Pseudomonas putida KT2440
cucgaccgccgca

SEQ ID NO: 1596445 - RNA, 15 nt, Pseudomonas putida KT2440
cuccgcuuucagccg

SEQ ID NO: 1596446 - RNA, 20 nt, Pseudomonas putida KT2440
cucccaguacaugaucgggu

SEQ ID NO: 1596447 - RNA, 17 nt, Pseudomonas putida KT2440
cucccaggacuucagca

SEQ ID NO: 1596448 - RNA, 23 nt, Pseudomonas putida KT2440
cucccacagguucgguaaugccc

SEQ ID NO: 1596449 - RNA, 18 nt, Pseudomonas putida KT2440
cuccaugaaggccggcau

SEQ ID NO: 1596450 - RNA, 13 nt, Pseudomonas putida KT2440
cuccaucucgugg

SEQ ID NO: 1596451 - RNA, 14 nt, Pseudomonas putida KT2440
cuccaucgucugca

SEQ ID NO: 1596452 - RNA, 14 nt, Pseudomonas putida KT2440
cuccaucuccagcu

SEQ ID NO: 1596453 - RNA, 17 nt, Pseudomonas putida KT2440
cuccaucuccagcucaa

SEQ ID NO: 1596454 - RNA, 21 nt, Pseudomonas putida KT2440
cucccacagggaucgcgccag

SEQ ID NO: 1596455 - RNA, 20 nt, Pseudomonas putida KT2440
cucccacaggggccgcgcag

SEQ ID NO: 1596456 - RNA, 21 nt, Pseudomonas putida KT2440
cuccuugcgcaucaagcggcu

SEQ ID NO: 1596457 - RNA, 16 nt, Pseudomonas putida KT2440
cuccugguccugcgcg

SEQ ID NO: 1596458 - RNA, 21 nt, Pseudomonas putida KT2440
cuccuggucaucgaagccaag

SEQ ID NO: 1596459 - RNA, 17 nt, Pseudomonas putida KT2440
cuccugcugcugcauac

SEQ ID NO: 1596460 - RNA, 20 nt, Pseudomonas putida KT2440
cuccugcggaaaagcgaggu

SEQ ID NO: 1596461 - RNA, 20 nt, Pseudomonas putida KT2440
cuccgggcgcccuggcaugc

SEQ ID NO: 1596462 - RNA, 22 nt, Pseudomonas putida KT2440
cuccgguaacgguaauggccgg

SEQ ID NO: 1596463 - RNA, 23 nt, Pseudomonas putida KT2440
cuccgguaacgguaauggccggc

SEQ ID NO: 1596464 - RNA, 23 nt, Pseudomonas putida KT2440
cuccuccagccaacggucgauca

SEQ ID NO: 1596465 - RNA, 20 nt, Pseudomonas putida KT2440
cuccuacagggguagcguca

SEQ ID NO: 1596466 - RNA, 12 nt, Pseudomonas putida KT2440
cuccuacgggca

SEQ ID NO: 1596467 - RNA, 21 nt, Pseudomonas putida KT2440
cuccuacgggcgagcgcgcag

SEQ ID NO: 1596468 - RNA, 14 nt, Pseudomonas putida KT2440
cuagccaucgcacc

SEQ ID NO: 1596469 - RNA, 15 nt, Pseudomonas putida KT2440
cuagccgccugccgc

SEQ ID NO: 1596470 - RNA, 20 nt, Pseudomonas putida KT2440
cuaucagccgugaugagguu

SEQ ID NO: 1596471 - RNA, 12 nt, Pseudomonas putida KT2440
cguugccuucgc

SEQ ID NO: 1596472 - RNA, 17 nt, Pseudomonas putida KT2440
cguugcgaagcggccug

SEQ ID NO: 1596473 - RNA, 15 nt, Pseudomonas putida KT2440
cguugcgcaucaccu

SEQ ID NO: 1596474 - RNA, 23 nt, Pseudomonas putida KT2440
cuacuccgcgagcauucagcuca

SEQ ID NO: 1596475 - RNA, 16 nt, Pseudomonas putida KT2440
cuauccucgaucgcca

SEQ ID NO: 1596476 - RNA, 16 nt, Pseudomonas putida KT2440
cuaucucaggccaguu

SEQ ID NO: 1596477 - RNA, 22 nt, Pseudomonas putida KT2440
cuaucgcagagggccgcgcagg

SEQ ID NO: 1596478 - RNA, 23 nt, Pseudomonas putida KT2440
cuauccuucugccguuugcuggc

SEQ ID NO: 1596479 - RNA, 15 nt, Pseudomonas putida KT2440
cuauuaaccgcuugg

SEQ ID NO: 1596480 - RNA, 18 nt, Pseudomonas putida KT2440
cuaugccggucagcagca

SEQ ID NO: 1596481 - RNA, 21 nt, Pseudomonas putida KT2440
cucaaccggugcaacugccac

SEQ ID NO: 1596482 - RNA, 20 nt, Pseudomonas putida KT2440
cucaacgccagggcaaucgc

SEQ ID NO: 1596483 - RNA, 18 nt, Pseudomonas putida KT2440
cucaacuggcaggguucg

SEQ ID NO: 1596484 - RNA, 17 nt, Pseudomonas putida KT2440
cucaagcgccagggcau

SEQ ID NO: 1596485 - RNA, 17 nt, Pseudomonas putida KT2440
cucaagccgguuggcgu

SEQ ID NO: 1596486 - RNA, 17 nt, Pseudomonas putida KT2440
cucaagccucgcgcaac

SEQ ID NO: 1596487 - RNA, 17 nt, Pseudomonas putida KT2440
cucaagggauuggcaac

SEQ ID NO: 1596488 - RNA, 17 nt, Pseudomonas putida KT2440
cucaagggcgcugauca

SEQ ID NO: 1596489 - RNA, 18 nt, Pseudomonas putida KT2440
cucaaacccggcagccac

SEQ ID NO: 1596490 - RNA, 19 nt, Pseudomonas putida KT2440
cuccagaaaaucaggggua

SEQ ID NO: 1596491 - RNA, 20 nt, Pseudomonas putida KT2440
cuccaggcagccugccaggu

SEQ ID NO: 1596492 - RNA, 19 nt, Pseudomonas putida KT2440
cuccagcguuugcacggac

SEQ ID NO: 1596493 - RNA, 18 nt, Pseudomonas putida KT2440
cuccagcgucccggucaa

SEQ ID NO: 1596494 - RNA, 22 nt, Pseudomonas putida KT2440
cuccagcucgccauucucgauc

SEQ ID NO: 1596495 - RNA, 23 nt, Pseudomonas putida KT2440
cuccagcucgccauucucgauca

SEQ ID NO: 1596496 - RNA, 17 nt, Pseudomonas putida KT2440
cuccagcucgcgcgggu

SEQ ID NO: 1596497 - RNA, 14 nt, Pseudomonas putida KT2440
cuccagcuggccau

SEQ ID NO: 1596498 - RNA, 23 nt, Pseudomonas putida KT2440
cuccaucaccaaaggcccguggu

SEQ ID NO: 1596499 - RNA, 18 nt, Pseudomonas putida KT2440
cuccaguuguugggcagc

SEQ ID NO: 1596500 - RNA, 17 nt, Pseudomonas putida KT2440
cuccaguggugcaaggu

SEQ ID NO: 1596501 - RNA, 17 nt, Pseudomonas putida KT2440
cuccaggugcucgauga

SEQ ID NO: 1596502 - RNA, 19 nt, Pseudomonas putida KT2440
cuccacgacaaaucgacau

SEQ ID NO: 1596503 - RNA, 17 nt, Pseudomonas putida KT2440
cuccaccugcuccagca

SEQ ID NO: 1596504 - RNA, 21 nt, Pseudomonas putida KT2440
cuccaacucgcgcauccagcc

SEQ ID NO: 1596505 - RNA, 18 nt, Pseudomonas putida KT2440
cucaggcgggcagcgcaa

SEQ ID NO: 1596506 - RNA, 19 nt, Pseudomonas putida KT2440
cucaggccuucgccacugc

SEQ ID NO: 1596507 - RNA, 14 nt, Pseudomonas putida KT2440
cucaggccuugccg

SEQ ID NO: 1596508 - RNA, 14 nt, Pseudomonas putida KT2440
cucaggcaccagcg

SEQ ID NO: 1596509 - RNA, 23 nt, Pseudomonas putida KT2440
cucaggccaguuccucggccuga

SEQ ID NO: 1596510 - RNA, 12 nt, Pseudomonas putida KT2440
cucaggccaugc

SEQ ID NO: 1596511 - RNA, 16 nt, Pseudomonas putida KT2440
cucaggccccaggcca

SEQ ID NO: 1596512 - RNA, 19 nt, Pseudomonas putida KT2440
cucaggccccaggccaucc

SEQ ID NO: 1596513 - RNA, 19 nt, Pseudomonas putida KT2440
cucagcuacgcuggacuug

SEQ ID NO: 1596514 - RNA, 14 nt, Pseudomonas putida KT2440
cucagcuggccggc

SEQ ID NO: 1596515 - RNA, 14 nt, Pseudomonas putida KT2440
cucagcugggcguu

SEQ ID NO: 1596516 - RNA, 21 nt, Pseudomonas putida KT2440
cucagcuuacgccugaaccac

SEQ ID NO: 1596517 - RNA, 19 nt, Pseudomonas putida KT2440
cucauuuuguaaaaccgcg

SEQ ID NO: 1596518 - RNA, 17 nt, Pseudomonas putida KT2440
cuccaaagccagcgcua

SEQ ID NO: 1596519 - RNA, 23 nt, Pseudomonas putida KT2440
cucagaucagaacgaggcguugg

SEQ ID NO: 1596520 - RNA, 15 nt, Pseudomonas putida KT2440
cucagcaacugggca

SEQ ID NO: 1596521 - RNA, 20 nt, Pseudomonas putida KT2440
cucagcgugacgauggccac

SEQ ID NO: 1596522 - RNA, 22 nt, Pseudomonas putida KT2440
cucagcgugacgauggccacca

SEQ ID NO: 1596523 - RNA, 19 nt, Pseudomonas putida KT2440
cucagcucgucgagcauga

SEQ ID NO: 1596524 - RNA, 18 nt, Pseudomonas putida KT2440
cucagccacgcuggcacc

SEQ ID NO: 1596525 - RNA, 15 nt, Pseudomonas putida KT2440
cucagccaggcugag

SEQ ID NO: 1596526 - RNA, 13 nt, Pseudomonas putida KT2440
cucacugaacgca

SEQ ID NO: 1596527 - RNA, 19 nt, Pseudomonas putida KT2440
cucacuggcauccggcagc

SEQ ID NO: 1596528 - RNA, 23 nt, Pseudomonas putida KT2440
cucacuggcauccggcagcucac

SEQ ID NO: 1596529 - RNA, 14 nt, Pseudomonas putida KT2440
cucacgcauggccg

SEQ ID NO: 1596530 - RNA, 20 nt, Pseudomonas putida KT2440
cucacggccauccugcugua

SEQ ID NO: 1596531 - RNA, 15 nt, Pseudomonas putida KT2440
cucacgcgccagggu

SEQ ID NO: 1596532 - RNA, 18 nt, Pseudomonas putida KT2440
cucacguuugggcggcgu

SEQ ID NO: 1596533 - RNA, 13 nt, Pseudomonas putida KT2440
cucacgcacgauc

SEQ ID NO: 1596534 - RNA, 23 nt, Pseudomonas putida KT2440
cucaauuucuaaaagcuggcgcg

SEQ ID NO: 1596535 - RNA, 21 nt, Pseudomonas putida KT2440
cucaccgccggcucgucacug

SEQ ID NO: 1596536 - RNA, 15 nt, Pseudomonas putida KT2440
cucaccauguuccag

SEQ ID NO: 1596537 - RNA, 11 nt, Pseudomonas putida KT2440
cucacccgcuu

SEQ ID NO: 1596538 - RNA, 20 nt, Pseudomonas putida KT2440
cucaccccguagcgcuucag

SEQ ID NO: 1596539 - RNA, 16 nt, Pseudomonas putida KT2440
cucacagcacucguug

SEQ ID NO: 1596540 - RNA, 17 nt, Pseudomonas putida KT2440
cucacagggaccgugca

SEQ ID NO: 1596541 - RNA, 18 nt, Pseudomonas putida KT2440
cucacagcgccgcggcca

SEQ ID NO: 1596542 - RNA, 15 nt, Pseudomonas putida KT2440
cugagcgccauccac

SEQ ID NO: 1596543 - RNA, 13 nt, Pseudomonas putida KT2440
cugaggcugcgcc

SEQ ID NO: 1596544 - RNA, 17 nt, Pseudomonas putida KT2440
cugagccaggccgacaa

SEQ ID NO: 1596545 - RNA, 16 nt, Pseudomonas putida KT2440
cugagcccaaccucug

SEQ ID NO: 1596546 - RNA, 18 nt, Pseudomonas putida KT2440
cugagcagguuguccacc

SEQ ID NO: 1596547 - RNA, 21 nt, Pseudomonas putida KT2440
cugagcaccacauacggcgca

SEQ ID NO: 1596548 - RNA, 20 nt, Pseudomonas putida KT2440
cugaucacccgucugcagga

SEQ ID NO: 1596549 - RNA, 21 nt, Pseudomonas putida KT2440
cugaucaauccucugcccgca

SEQ ID NO: 1596550 - RNA, 19 nt, Pseudomonas putida KT2440
cugaucaaagucgccuaca

SEQ ID NO: 1596551 - RNA, 17 nt, Pseudomonas putida KT2440
cugaucacuugcucauc

SEQ ID NO: 1596552 - RNA, 17 nt, Pseudomonas putida KT2440
cugauagcgagccgcau

SEQ ID NO: 1596553 - RNA, 12 nt, Pseudomonas putida KT2440
cugauagcgcuu

SEQ ID NO: 1596554 - RNA, 13 nt, Pseudomonas putida KT2440
cugagucagcuug

SEQ ID NO: 1596555 - RNA, 21 nt, Pseudomonas putida KT2440
cugaggugcuuggggcugaac

SEQ ID NO: 1596556 - RNA, 18 nt, Pseudomonas putida KT2440
cugaccguuucauugccg

SEQ ID NO: 1596557 - RNA, 14 nt, Pseudomonas putida KT2440
cugacgcagugcag

SEQ ID NO: 1596558 - RNA, 17 nt, Pseudomonas putida KT2440
cugaccgggacgcaggc

SEQ ID NO: 1596559 - RNA, 14 nt, Pseudomonas putida KT2440
cugaccggucagcc

SEQ ID NO: 1596560 - RNA, 19 nt, Pseudomonas putida KT2440
cugaccgaugccgccguug

SEQ ID NO: 1596561 - RNA, 12 nt, Pseudomonas putida KT2440
cugaccggcacu

SEQ ID NO: 1596562 - RNA, 19 nt, Pseudomonas putida KT2440
cugacccgcgccucgaucc

SEQ ID NO: 1596563 - RNA, 20 nt, Pseudomonas putida KT2440
cugacuggcagcaaggccau

SEQ ID NO: 1596564 - RNA, 23 nt, Pseudomonas putida KT2440
cugagaaaaaggggugcaaagcg

SEQ ID NO: 1596565 - RNA, 15 nt, Pseudomonas putida KT2440
cugacgcgccgugcc

SEQ ID NO: 1596566 - RNA, 19 nt, Pseudomonas putida KT2440
cugacgguugaggcggucg

SEQ ID NO: 1596567 - RNA, 20 nt, Pseudomonas putida KT2440
cugacgggccucuucgcggg

SEQ ID NO: 1596568 - RNA, 21 nt, Pseudomonas putida KT2440
cugaaucagcaaaccgaccag

SEQ ID NO: 1596569 - RNA, 22 nt, Pseudomonas putida KT2440
cugaauggcuggugaagcccuu

SEQ ID NO: 1596570 - RNA, 18 nt, Pseudomonas putida KT2440
cugaaucuugcgcgccag

SEQ ID NO: 1596571 - RNA, 20 nt, Pseudomonas putida KT2440
cugaaucuugcgcgccagcg

SEQ ID NO: 1596572 - RNA, 23 nt, Pseudomonas putida KT2440
cugaaucuugcgcgccagcgcau

SEQ ID NO: 1596573 - RNA, 18 nt, Pseudomonas putida KT2440
cugacaaugcgacugagc

SEQ ID NO: 1596574 - RNA, 19 nt, Pseudomonas putida KT2440
cugacaccgcugccgggca

SEQ ID NO: 1596575 - RNA, 19 nt, Pseudomonas putida KT2440
cugacacauaggcagccac

SEQ ID NO: 1596576 - RNA, 16 nt, Pseudomonas putida KT2440
cugacacaucacgcac

SEQ ID NO: 1596577 - RNA, 22 nt, Pseudomonas putida KT2440
cugaccaucagccuguggguau

SEQ ID NO: 1596578 - RNA, 21 nt, Pseudomonas putida KT2440
cugaccaccguuacgccguug

SEQ ID NO: 1596579 - RNA, 16 nt, Pseudomonas putida KT2440
cugaccacgccgaagc

SEQ ID NO: 1596580 - RNA, 22 nt, Pseudomonas putida KT2440
cugacagcaugccccgggugca

SEQ ID NO: 1596581 - RNA, 21 nt, Pseudomonas putida KT2440
cugaagucauaccacacguug

SEQ ID NO: 1596582 - RNA, 16 nt, Pseudomonas putida KT2440
cugaagcucuccagca

SEQ ID NO: 1596583 - RNA, 20 nt, Pseudomonas putida KT2440
cugaagcucuccagcagguu

SEQ ID NO: 1596584 - RNA, 22 nt, Pseudomonas putida KT2440
cugaagccaguacgcgccugca

SEQ ID NO: 1596585 - RNA, 21 nt, Pseudomonas putida KT2440
cugaagcccuggaugacacgg

SEQ ID NO: 1596586 - RNA, 17 nt, Pseudomonas putida KT2440
cugaacgcugcgcgggu

SEQ ID NO: 1596587 - RNA, 15 nt, Pseudomonas putida KT2440
cugaagacgcuugcg

SEQ ID NO: 1596588 - RNA, 19 nt, Pseudomonas putida KT2440
cugaacuuggccuccagca

SEQ ID NO: 1596589 - RNA, 20 nt, Pseudomonas putida KT2440
cugaacggugaagucaacca

SEQ ID NO: 1596590 - RNA, 16 nt, Pseudomonas putida KT2440
cugaacuauccgacac

SEQ ID NO: 1596591 - RNA, 22 nt, Pseudomonas putida KT2440
cugaacuauccgacacagucgu

SEQ ID NO: 1596592 - RNA, 17 nt, Pseudomonas putida KT2440
cucugcuuccuugcgca

SEQ ID NO: 1596593 - RNA, 15 nt, Pseudomonas putida KT2440
cucugcggccuucaa

SEQ ID NO: 1596594 - RNA, 13 nt, Pseudomonas putida KT2440
cucugcgccugcg

SEQ ID NO: 1596595 - RNA, 16 nt, Pseudomonas putida KT2440
cucugccgccgcagca

SEQ ID NO: 1596596 - RNA, 13 nt, Pseudomonas putida KT2440
cucugcagcagcg

SEQ ID NO: 1596597 - RNA, 20 nt, Pseudomonas putida KT2440
cucuaugccaccuguugccg

SEQ ID NO: 1596598 - RNA, 15 nt, Pseudomonas putida KT2440
cucggcguagcaggu

SEQ ID NO: 1596599 - RNA, 16 nt, Pseudomonas putida KT2440
cucggcguacuccaga

SEQ ID NO: 1596600 - RNA, 13 nt, Pseudomonas putida KT2440
cucuucaccagcu

SEQ ID NO: 1596601 - RNA, 22 nt, Pseudomonas putida KT2440
cucuucaccugaccauuggcca

SEQ ID NO: 1596602 - RNA, 17 nt, Pseudomonas putida KT2440
cucuucaucccugaccg

SEQ ID NO: 1596603 - RNA, 15 nt, Pseudomonas putida KT2440
cucuggggagcggau

SEQ ID NO: 1596604 - RNA, 16 nt, Pseudomonas putida KT2440
cucuggguagccaccu

SEQ ID NO: 1596605 - RNA, 17 nt, Pseudomonas putida KT2440
cucuggcccgaacagca

SEQ ID NO: 1596606 - RNA, 23 nt, Pseudomonas putida KT2440
cucuguaucgaacaggcagacca

SEQ ID NO: 1596607 - RNA, 20 nt, Pseudomonas putida KT2440
cucuuucggcagcacccgcu

SEQ ID NO: 1596608 - RNA, 14 nt, Pseudomonas putida KT2440
cucuuccagcucgc

SEQ ID NO: 1596609 - RNA, 16 nt, Pseudomonas putida KT2440
cugaacagcgccuuga

SEQ ID NO: 1596610 - RNA, 16 nt, Pseudomonas putida KT2440
cugcccggccagcagg

SEQ ID NO: 1596611 - RNA, 17 nt, Pseudomonas putida KT2440
cugcccgccguccagca

SEQ ID NO: 1596612 - RNA, 12 nt, Pseudomonas putida KT2440
cugcccgagagc

SEQ ID NO: 1596613 - RNA, 20 nt, Pseudomonas putida KT2440
cugcccgccccccaccuggc

SEQ ID NO: 1596614 - RNA, 17 nt, Pseudomonas putida KT2440
cugccccucgaucaacg

SEQ ID NO: 1596615 - RNA, 14 nt, Pseudomonas putida KT2440
cugccccuggccca

SEQ ID NO: 1596616 - RNA, 14 nt, Pseudomonas putida KT2440
cugcccaccgauca

SEQ ID NO: 1596617 - RNA, 20 nt, Pseudomonas putida KT2440
cugccauuucuucagcagga

SEQ ID NO: 1596618 - RNA, 15 nt, Pseudomonas putida KT2440
cugccccagcgucac

SEQ ID NO: 1596619 - RNA, 24 nt, Pseudomonas putida KT2440
cugccacuggucgccucgacgcag

SEQ ID NO: 1596620 - RNA, 16 nt, Pseudomonas putida KT2440
cugccagcaccuggcg

SEQ ID NO: 1596621 - RNA, 19 nt, Pseudomonas putida KT2440
cugccagcgcgcugcgcaa

SEQ ID NO: 1596622 - RNA, 15 nt, Pseudomonas putida KT2440
cugccaggaagcucg

SEQ ID NO: 1596623 - RNA, 18 nt, Pseudomonas putida KT2440
cugccagcguuuccgggu

SEQ ID NO: 1596624 - RNA, 15 nt, Pseudomonas putida KT2440
cugccagcuccuggc

SEQ ID NO: 1596625 - RNA, 15 nt, Pseudomonas putida KT2440
cugccaggcaccaca

SEQ ID NO: 1596626 - RNA, 15 nt, Pseudomonas putida KT2440
cugccaggccaaaca

SEQ ID NO: 1596627 - RNA, 18 nt, Pseudomonas putida KT2440
cugccaggccgcacgcgc

SEQ ID NO: 1596628 - RNA, 20 nt, Pseudomonas putida KT2440
cugccaggccucaagccucg

SEQ ID NO: 1596629 - RNA, 16 nt, Pseudomonas putida KT2440
cugccaguucaugcag

SEQ ID NO: 1596630 - RNA, 19 nt, Pseudomonas putida KT2440
cugccagugggcacgguug

SEQ ID NO: 1596631 - RNA, 17 nt, Pseudomonas putida KT2440
cugccaguccuuggcca

SEQ ID NO: 1596632 - RNA, 16 nt, Pseudomonas putida KT2440
cugccaugcaggucga

SEQ ID NO: 1596633 - RNA, 18 nt, Pseudomonas putida KT2440
cugccaucucgccaagca

SEQ ID NO: 1596634 - RNA, 21 nt, Pseudomonas putida KT2440
cugccaguaaggcuugcucaa

SEQ ID NO: 1596635 - RNA, 13 nt, Pseudomonas putida KT2440
cugccauccaggu

SEQ ID NO: 1596636 - RNA, 13 nt, Pseudomonas putida KT2440
cugcaggcuggca

SEQ ID NO: 1596637 - RNA, 18 nt, Pseudomonas putida KT2440
cugcagggacugucggcu

SEQ ID NO: 1596638 - RNA, 13 nt, Pseudomonas putida KT2440
cugcagggcacgc

SEQ ID NO: 1596639 - RNA, 17 nt, Pseudomonas putida KT2440
cugcagggcacgccaau

SEQ ID NO: 1596640 - RNA, 20 nt, Pseudomonas putida KT2440
cugcaggcgcggugccggca

SEQ ID NO: 1596641 - RNA, 18 nt, Pseudomonas putida KT2440
cugcagguacagcagcug

SEQ ID NO: 1596642 - RNA, 18 nt, Pseudomonas putida KT2440
cugcaggucggccagcuc

SEQ ID NO: 1596643 - RNA, 23 nt, Pseudomonas putida KT2440
cugcagggcccagccaccgacga

SEQ ID NO: 1596644 - RNA, 17 nt, Pseudomonas putida KT2440
cugcagugccucgacca

SEQ ID NO: 1596645 - RNA, 13 nt, Pseudomonas putida KT2440
cugcagucagguu

SEQ ID NO: 1596646 - RNA, 21 nt, Pseudomonas putida KT2440
cugccacucguccgggcgcca

SEQ ID NO: 1596647 - RNA, 14 nt, Pseudomonas putida KT2440
cugccacgcaugcc

SEQ ID NO: 1596648 - RNA, 14 nt, Pseudomonas putida KT2440
cugccaaucaaccc

SEQ ID NO: 1596649 - RNA, 13 nt, Pseudomonas putida KT2440
cugccaaccggcu

SEQ ID NO: 1596650 - RNA, 17 nt, Pseudomonas putida KT2440
cugccaacgcaccgacc

SEQ ID NO: 1596651 - RNA, 18 nt, Pseudomonas putida KT2440
cugcaucgcugauccgcu

SEQ ID NO: 1596652 - RNA, 21 nt, Pseudomonas putida KT2440
cugcaugccaguagaagccca

SEQ ID NO: 1596653 - RNA, 12 nt, Pseudomonas putida KT2440
cugcauggccug

SEQ ID NO: 1596654 - RNA, 15 nt, Pseudomonas putida KT2440
cugaugcaccaggcc

SEQ ID NO: 1596655 - RNA, 18 nt, Pseudomonas putida KT2440
cugaugcagcagugccag

SEQ ID NO: 1596656 - RNA, 12 nt, Pseudomonas putida KT2440
cugaugcgccag

SEQ ID NO: 1596657 - RNA, 15 nt, Pseudomonas putida KT2440
cugaucgcuugcgcg

SEQ ID NO: 1596658 - RNA, 21 nt, Pseudomonas putida KT2440
cugauccucacgcacaaccgc

SEQ ID NO: 1596659 - RNA, 17 nt, Pseudomonas putida KT2440
cugaucgccgucgacca

SEQ ID NO: 1596660 - RNA, 22 nt, Pseudomonas putida KT2440
cugcaaagcgggcaacugcgcc

SEQ ID NO: 1596661 - RNA, 17 nt, Pseudomonas putida KT2440
cugcaacagcuccagca

SEQ ID NO: 1596662 - RNA, 14 nt, Pseudomonas putida KT2440
cugcaacaccucca

SEQ ID NO: 1596663 - RNA, 21 nt, Pseudomonas putida KT2440
cugcaaacgcaggugcgcacg

SEQ ID NO: 1596664 - RNA, 14 nt, Pseudomonas putida KT2440
cugcaaauacccca

SEQ ID NO: 1596665 - RNA, 21 nt, Pseudomonas putida KT2440
cugcaagguccaggcgugggu

SEQ ID NO: 1596666 - RNA, 23 nt, Pseudomonas putida KT2440
cugcaaggcaaugcccauggcca

SEQ ID NO: 1596667 - RNA, 19 nt, Pseudomonas putida KT2440
cugcaaggcagccccugca

SEQ ID NO: 1596668 - RNA, 16 nt, Pseudomonas putida KT2440
cugcaaggccagcgga

SEQ ID NO: 1596669 - RNA, 16 nt, Pseudomonas putida KT2440
cugcaacuccucgauc

SEQ ID NO: 1596670 - RNA, 17 nt, Pseudomonas putida KT2440
cugcaacuccucgauca

SEQ ID NO: 1596671 - RNA, 15 nt, Pseudomonas putida KT2440
cugcaccgaagcacc

SEQ ID NO: 1596672 - RNA, 21 nt, Pseudomonas putida KT2440
cugcacauacaaaaugugccg

SEQ ID NO: 1596673 - RNA, 15 nt, Pseudomonas putida KT2440
cugcaccacaugcac

SEQ ID NO: 1596674 - RNA, 18 nt, Pseudomonas putida KT2440
cugcaccaccugcuccug

SEQ ID NO: 1596675 - RNA, 18 nt, Pseudomonas putida KT2440
cugcaccacggcaguggc

SEQ ID NO: 1596676 - RNA, 14 nt, Pseudomonas putida KT2440
cugcacaucggcca

SEQ ID NO: 1596677 - RNA, 14 nt, Pseudomonas putida KT2440
cugcacaggccagc

SEQ ID NO: 1596678 - RNA, 21 nt, Pseudomonas putida KT2440
cugcacaggccagccccagcg

SEQ ID NO: 1596679 - RNA, 14 nt, Pseudomonas putida KT2440
cugcacagcgcgga

SEQ ID NO: 1596680 - RNA, 17 nt, Pseudomonas putida KT2440
cugcacacugcccagca

SEQ ID NO: 1596681 - RNA, 16 nt, Pseudomonas putida KT2440
cugcacacugcgcuug

SEQ ID NO: 1596682 - RNA, 13 nt, Pseudomonas putida KT2440
cugcaauugcacc

SEQ ID NO: 1596683 - RNA, 18 nt, Pseudomonas putida KT2440
cugcaauuucuugaggca

SEQ ID NO: 1596684 - RNA, 19 nt, Pseudomonas putida KT2440
cugcacggcaauugccacc

SEQ ID NO: 1596685 - RNA, 24 nt, Pseudomonas putida KT2440
cugcacggcaaaguccagcaucag

SEQ ID NO: 1596686 - RNA, 20 nt, Pseudomonas putida KT2440
cugcacgucauagcccgaaa

SEQ ID NO: 1596687 - RNA, 16 nt, Pseudomonas putida KT2440
cugcacuggcaugcgg

SEQ ID NO: 1596688 - RNA, 22 nt, Pseudomonas putida KT2440
cugcagagcgucaaccaggcgc

SEQ ID NO: 1596689 - RNA, 20 nt, Pseudomonas putida KT2440
cugcagagcucagcgugacg

SEQ ID NO: 1596690 - RNA, 16 nt, Pseudomonas putida KT2440
cugcagaucaccagcu

SEQ ID NO: 1596691 - RNA, 15 nt, Pseudomonas putida KT2440
cugcagacgccguca

SEQ ID NO: 1596692 - RNA, 14 nt, Pseudomonas putida KT2440
cugcagacaguggu

SEQ ID NO: 1596693 - RNA, 17 nt, Pseudomonas putida KT2440
cugcagaacauggccga

SEQ ID NO: 1596694 - RNA, 23 nt, Pseudomonas putida KT2440
cugcagcaccagcuuguugccgg

SEQ ID NO: 1596695 - RNA, 19 nt, Pseudomonas putida KT2440
cugcagcagcgcgccgaac

SEQ ID NO: 1596696 - RNA, 13 nt, Pseudomonas putida KT2440
cugcagcaggcug

SEQ ID NO: 1596697 - RNA, 23 nt, Pseudomonas putida KT2440
cugcagccauucauccucggccu

SEQ ID NO: 1596698 - RNA, 23 nt, Pseudomonas putida KT2440
cgugaagcgcacuuggccugcug

SEQ ID NO: 1596699 - RNA, 16 nt, Pseudomonas putida KT2440
cgugaagcaccgccac

SEQ ID NO: 1596700 - RNA, 17 nt, Pseudomonas putida KT2440
cgugaagcaccgccaca

SEQ ID NO: 1596701 - RNA, 13 nt, Pseudomonas putida KT2440
aaccgacccugcu

SEQ ID NO: 1596702 - RNA, 19 nt, Pseudomonas putida KT2440
aacccuucucuuccggcag

SEQ ID NO: 1596703 - RNA, 21 nt, Pseudomonas putida KT2440
aacccuucucuuccggcaggu

SEQ ID NO: 1596704 - RNA, 18 nt, Pseudomonas putida KT2440
aacccucacgcgccaggu

SEQ ID NO: 1596705 - RNA, 23 nt, Pseudomonas putida KT2440
cgucuucgccaggugcgcgucga

SEQ ID NO: 1596706 - RNA, 22 nt, Pseudomonas putida KT2440
cgugaaauccucaaccuggauu

SEQ ID NO: 1596707 - RNA, 19 nt, Pseudomonas putida KT2440
cgugaaccggcuguuggcc

SEQ ID NO: 1596708 - RNA, 22 nt, Pseudomonas putida KT2440
cgugaaaccgaaaaagccuaca

SEQ ID NO: 1596709 - RNA, 23 nt, Pseudomonas putida KT2440
cgugaaaccgaaaaagccuacac

SEQ ID NO: 1596710 - RNA, 22 nt, Pseudomonas putida KT2440
cgucuuuuccgugcaaccgcuc

SEQ ID NO: 1596711 - RNA, 19 nt, Pseudomonas putida KT2440
cgucgucgacaaaugccgg

SEQ ID NO: 1596712 - RNA, 18 nt, Pseudomonas putida KT2440
cgucggcaagcuugccag

SEQ ID NO: 1596713 - RNA, 12 nt, Pseudomonas putida KT2440
cgucggcagcca

SEQ ID NO: 1596714 - RNA, 22 nt, Pseudomonas putida KT2440
cgucugacuggcagcaaggcca

SEQ ID NO: 1596715 - RNA, 16 nt, Pseudomonas putida KT2440
cgucguucggcaucga

SEQ ID NO: 1596716 - RNA, 16 nt, Pseudomonas putida KT2440
cgugccgcaucagccg

SEQ ID NO: 1596717 - RNA, 14 nt, Pseudomonas putida KT2440
cgugccgcaugugc

SEQ ID NO: 1596718 - RNA, 18 nt, Pseudomonas putida KT2440
cgugccgcaugugccagg

SEQ ID NO: 1596719 - RNA, 18 nt, Pseudomonas putida KT2440
cgugcccggcaaucgcca

SEQ ID NO: 1596720 - RNA, 21 nt, Pseudomonas putida KT2440
cgugcccgcgaagagggcgac

SEQ ID NO: 1596721 - RNA, 19 nt, Pseudomonas putida KT2440
cgugcaucugcucccccag

SEQ ID NO: 1596722 - RNA, 16 nt, Pseudomonas putida KT2440
cgugccauccaccgcg

SEQ ID NO: 1596723 - RNA, 14 nt, Pseudomonas putida KT2440
cgugcccaccagcg

SEQ ID NO: 1596724 - RNA, 18 nt, Pseudomonas putida KT2440
cgugcccaccagcgcuuc

SEQ ID NO: 1596725 - RNA, 16 nt, Pseudomonas putida KT2440
cgugcaggcggcgaca

SEQ ID NO: 1596726 - RNA, 20 nt, Pseudomonas putida KT2440
cgugcacggccuugucagca

SEQ ID NO: 1596727 - RNA, 23 nt, Pseudomonas putida KT2440
cgugcacggccuugucagcagcu

SEQ ID NO: 1596728 - RNA, 17 nt, Pseudomonas putida KT2440
cgugcacccaaccugcc

SEQ ID NO: 1596729 - RNA, 19 nt, Pseudomonas putida KT2440
cgugcaccccauaacgccc

SEQ ID NO: 1596730 - RNA, 21 nt, Pseudomonas putida KT2440
cgugagggggcacgcggcgcu

SEQ ID NO: 1596731 - RNA, 12 nt, Pseudomonas putida KT2440
cgugagaccugc

SEQ ID NO: 1596732 - RNA, 20 nt, Pseudomonas putida KT2440
cgugagaccugcaaugccgc

SEQ ID NO: 1596733 - RNA, 21 nt, Pseudomonas putida KT2440
cgugacgugcgcuccugguca

SEQ ID NO: 1596734 - RNA, 15 nt, Pseudomonas putida KT2440
cgugacuaguggcca

SEQ ID NO: 1596735 - RNA, 22 nt, Pseudomonas putida KT2440
cgugacggauacaucgcauaca

SEQ ID NO: 1596736 - RNA, 18 nt, Pseudomonas putida KT2440
cgugauaucgggauaacc

SEQ ID NO: 1596737 - RNA, 14 nt, Pseudomonas putida KT2440
cgugaucaucagcg

SEQ ID NO: 1596738 - RNA, 15 nt, Pseudomonas putida KT2440
cgugaucauccccag

SEQ ID NO: 1596739 - RNA, 17 nt, Pseudomonas putida KT2440
cgugaucauccccagca

SEQ ID NO: 1596740 - RNA, 18 nt, Pseudomonas putida KT2440
cgugaucauccccagcau

SEQ ID NO: 1596741 - RNA, 19 nt, Pseudomonas putida KT2440
cgugaugguaucugccagc

SEQ ID NO: 1596742 - RNA, 20 nt, Pseudomonas putida KT2440
cgugaugguaucugccagca

SEQ ID NO: 1596743 - RNA, 12 nt, Pseudomonas putida KT2440
cgugcaccagca

SEQ ID NO: 1596744 - RNA, 21 nt, Pseudomonas putida KT2440
cgugcaaggaucaccaaggcu

SEQ ID NO: 1596745 - RNA, 15 nt, Pseudomonas putida KT2440
cgugcaagggauauc

SEQ ID NO: 1596746 - RNA, 19 nt, Pseudomonas putida KT2440
cgugauuugaacuugcgca

SEQ ID NO: 1596747 - RNA, 22 nt, Pseudomonas putida KT2440
cgugcaacgccgguagcugcgc

SEQ ID NO: 1596748 - RNA, 20 nt, Pseudomonas putida KT2440
cguugaccccgccgcuggcu

SEQ ID NO: 1596749 - RNA, 21 nt, Pseudomonas putida KT2440
cguugaugcgcuugaagugau

SEQ ID NO: 1596750 - RNA, 23 nt, Pseudomonas putida KT2440
cguucccgggcagguucgacucc

SEQ ID NO: 1596751 - RNA, 22 nt, Pseudomonas putida KT2440
cguucuuucucccaggccgaca

SEQ ID NO: 1596752 - RNA, 17 nt, Pseudomonas putida KT2440
cguucgggucaacucag

SEQ ID NO: 1596753 - RNA, 17 nt, Pseudomonas putida KT2440
cguucagcaagaccaga

SEQ ID NO: 1596754 - RNA, 14 nt, Pseudomonas putida KT2440
cguucacuguugcc

SEQ ID NO: 1596755 - RNA, 21 nt, Pseudomonas putida KT2440
cguucacuguugccgccacca

SEQ ID NO: 1596756 - RNA, 16 nt, Pseudomonas putida KT2440
cguucaacgccguacg

SEQ ID NO: 1596757 - RNA, 13 nt, Pseudomonas putida KT2440
cguucaccggcac

SEQ ID NO: 1596758 - RNA, 17 nt, Pseudomonas putida KT2440
cgugguucuugccgagc

SEQ ID NO: 1596759 - RNA, 19 nt, Pseudomonas putida KT2440
cgugguucuugccgagcag

SEQ ID NO: 1596760 - RNA, 18 nt, Pseudomonas putida KT2440
cgugguucaucaccagcc

SEQ ID NO: 1596761 - RNA, 18 nt, Pseudomonas putida KT2440
cguggugcgggccaccag

SEQ ID NO: 1596762 - RNA, 15 nt, Pseudomonas putida KT2440
cguguucccagcacc

SEQ ID NO: 1596763 - RNA, 17 nt, Pseudomonas putida KT2440
cguguucccagcacccc

SEQ ID NO: 1596764 - RNA, 19 nt, Pseudomonas putida KT2440
cguguucgcgaggaaaccc

SEQ ID NO: 1596765 - RNA, 23 nt, Pseudomonas putida KT2440
cguguucgcgaggaaacccgcgc

SEQ ID NO: 1596766 - RNA, 14 nt, Pseudomonas putida KT2440
cguguucaggcacg

SEQ ID NO: 1596767 - RNA, 13 nt, Pseudomonas putida KT2440
cguguuguucgcc

SEQ ID NO: 1596768 - RNA, 15 nt, Pseudomonas putida KT2440
cguguuguucgccaa

SEQ ID NO: 1596769 - RNA, 15 nt, Pseudomonas putida KT2440
cgugccggaacaacc

SEQ ID NO: 1596770 - RNA, 16 nt, Pseudomonas putida KT2440
cgugccuucaccagcu

SEQ ID NO: 1596771 - RNA, 13 nt, Pseudomonas putida KT2440
cgugccugcugcu

SEQ ID NO: 1596772 - RNA, 16 nt, Pseudomonas putida KT2440
cgugccucagccaggc

SEQ ID NO: 1596773 - RNA, 20 nt, Pseudomonas putida KT2440
cgugccuugccugggccggu

SEQ ID NO: 1596774 - RNA, 15 nt, Pseudomonas putida KT2440
cgugcgcgaucagcg

SEQ ID NO: 1596775 - RNA, 17 nt, Pseudomonas putida KT2440
cgugcgcgaucagcgca

SEQ ID NO: 1596776 - RNA, 18 nt, Pseudomonas putida KT2440
cgugcgccuaucaggccu

SEQ ID NO: 1596777 - RNA, 16 nt, Pseudomonas putida KT2440
cgugcgccucaugcag

SEQ ID NO: 1596778 - RNA, 20 nt, Pseudomonas putida KT2440
cgugcgccucaugcagcacc

SEQ ID NO: 1596779 - RNA, 21 nt, Pseudomonas putida KT2440
cgugcgccucaugcagcaccu

SEQ ID NO: 1596780 - RNA, 14 nt, Pseudomonas putida KT2440
cgugcgcccggcaa

SEQ ID NO: 1596781 - RNA, 21 nt, Pseudomonas putida KT2440
cguggcuguucgucggccuug

SEQ ID NO: 1596782 - RNA, 14 nt, Pseudomonas putida KT2440
cguggacagcagcu

SEQ ID NO: 1596783 - RNA, 19 nt, Pseudomonas putida KT2440
aaccgcgauaucagcgcca

SEQ ID NO: 1596784 - RNA, 19 nt, Pseudomonas putida KT2440
aaccgcgaagcaggcugcg

SEQ ID NO: 1596785 - RNA, 15 nt, Pseudomonas putida KT2440
cgucacccgcgccac

SEQ ID NO: 1596786 - RNA, 22 nt, Pseudomonas putida KT2440
cgucaccccucggcucacgccc

SEQ ID NO: 1596787 - RNA, 15 nt, Pseudomonas putida KT2440
aacccgcgccuacag

SEQ ID NO: 1596788 - RNA, 16 nt, Pseudomonas putida KT2440
aacccgcgccuacgac

SEQ ID NO: 1596789 - RNA, 15 nt, Pseudomonas putida KT2440
aacccgcuccuacac

SEQ ID NO: 1596790 - RNA, 23 nt, Pseudomonas putida KT2440
aacccgcugccacccacaggcac

SEQ ID NO: 1596791 - RNA, 15 nt, Pseudomonas putida KT2440
aacccggccagcagg

SEQ ID NO: 1596792 - RNA, 23 nt, Pseudomonas putida KT2440
cgucacaucgguuucgccggugu

SEQ ID NO: 1596793 - RNA, 22 nt, Pseudomonas putida KT2440
aacccgauuccuugcagcgccg

SEQ ID NO: 1596794 - RNA, 17 nt, Pseudomonas putida KT2440
cguauccuugcccacca

SEQ ID NO: 1596795 - RNA, 15 nt, Pseudomonas putida KT2440
cguaucaggcaucgc

SEQ ID NO: 1596796 - RNA, 20 nt, Pseudomonas putida KT2440
cguaggcacacccggccaag

SEQ ID NO: 1596797 - RNA, 21 nt, Pseudomonas putida KT2440
cguaggcacacccggccaagu

SEQ ID NO: 1596798 - RNA, 14 nt, Pseudomonas putida KT2440
cguagcgagcaccg

SEQ ID NO: 1596799 - RNA, 23 nt, Pseudomonas putida KT2440
cguagcccucgaugucuuccaga

SEQ ID NO: 1596800 - RNA, 19 nt, Pseudomonas putida KT2440
cguagcaggaucugcugca

SEQ ID NO: 1596801 - RNA, 13 nt, Pseudomonas putida KT2440
aaccccagccuuc

SEQ ID NO: 1596802 - RNA, 22 nt, Pseudomonas putida KT2440
aaccccagcgcguacagcgaca

SEQ ID NO: 1596803 - RNA, 22 nt, Pseudomonas putida KT2440
aaccccaccagcacugccuugc

SEQ ID NO: 1596804 - RNA, 19 nt, Pseudomonas putida KT2440
aaccccaucaccuuggccg

SEQ ID NO: 1596805 - RNA, 20 nt, Pseudomonas putida KT2440
aacccaguacggcgccacug

SEQ ID NO: 1596806 - RNA, 15 nt, Pseudomonas putida KT2440
aacccagccagcgac

SEQ ID NO: 1596807 - RNA, 15 nt, Pseudomonas putida KT2440
cguagccugaggggu

SEQ ID NO: 1596808 - RNA, 15 nt, Pseudomonas putida KT2440
cguagcgcuucagcu

SEQ ID NO: 1596809 - RNA, 14 nt, Pseudomonas putida KT2440
cguagcuguugcgc

SEQ ID NO: 1596810 - RNA, 14 nt, Pseudomonas putida KT2440
cguaggagcgggcu

SEQ ID NO: 1596811 - RNA, 19 nt, Pseudomonas putida KT2440
cguaggagcgggcuugccc

SEQ ID NO: 1596812 - RNA, 20 nt, Pseudomonas putida KT2440
cguaggccagguacaggcaa

SEQ ID NO: 1596813 - RNA, 14 nt, Pseudomonas putida KT2440
aaccccuccuucag

SEQ ID NO: 1596814 - RNA, 15 nt, Pseudomonas putida KT2440
cguacagcgacaugc

SEQ ID NO: 1596815 - RNA, 13 nt, Pseudomonas putida KT2440
cguacaucagccu

SEQ ID NO: 1596816 - RNA, 19 nt, Pseudomonas putida KT2440
cguaccagcagggccauca

SEQ ID NO: 1596817 - RNA, 18 nt, Pseudomonas putida KT2440
cguaccaguuccuugagc

SEQ ID NO: 1596818 - RNA, 12 nt, Pseudomonas putida KT2440
cguacccaggug

SEQ ID NO: 1596819 - RNA, 21 nt, Pseudomonas putida KT2440
cguacccaggugaugcaggca

SEQ ID NO: 1596820 - RNA, 15 nt, Pseudomonas putida KT2440
cguaaccgcccgcca

SEQ ID NO: 1596821 - RNA, 23 nt, Pseudomonas putida KT2440
cguacugcuucaucugcgccugu

SEQ ID NO: 1596822 - RNA, 15 nt, Pseudomonas putida KT2440
cguaccuggcugcug

SEQ ID NO: 1596823 - RNA, 14 nt, Pseudomonas putida KT2440
cggucgccgagccg

SEQ ID NO: 1596824 - RNA, 16 nt, Pseudomonas putida KT2440
cgguugcccgcugcau

SEQ ID NO: 1596825 - RNA, 20 nt, Pseudomonas putida KT2440
cgguucgcccccacgggcau

SEQ ID NO: 1596826 - RNA, 19 nt, Pseudomonas putida KT2440
cgguugcgcaaaucgccaa

SEQ ID NO: 1596827 - RNA, 23 nt, Pseudomonas putida KT2440
cgguuucucgcagcagcaccggc

SEQ ID NO: 1596828 - RNA, 18 nt, Pseudomonas putida KT2440
cgucgagccggguccacc

SEQ ID NO: 1596829 - RNA, 23 nt, Pseudomonas putida KT2440
cgucgagcaacuugcgcagcuug

SEQ ID NO: 1596830 - RNA, 20 nt, Pseudomonas putida KT2440
cgucgacucgaugccaucga

SEQ ID NO: 1596831 - RNA, 15 nt, Pseudomonas putida KT2440
cgucgagguacuuga

SEQ ID NO: 1596832 - RNA, 16 nt, Pseudomonas putida KT2440
cgucgaucugcaggug

SEQ ID NO: 1596833 - RNA, 18 nt, Pseudomonas putida KT2440
cgucgauguccagcgagg

SEQ ID NO: 1596834 - RNA, 18 nt, Pseudomonas putida KT2440
cgucgcgauugaucagcg

SEQ ID NO: 1596835 - RNA, 16 nt, Pseudomonas putida KT2440
cgucgcuggccagcuu

SEQ ID NO: 1596836 - RNA, 18 nt, Pseudomonas putida KT2440
cgucgaacgaguccgggc

SEQ ID NO: 1596837 - RNA, 20 nt, Pseudomonas putida KT2440
cgucgaccgccgccuggcuc

SEQ ID NO: 1596838 - RNA, 20 nt, Pseudomonas putida KT2440
cgucgacaccguugcagucg

SEQ ID NO: 1596839 - RNA, 24 nt, Pseudomonas putida KT2440
cguccucaugggugucggcauaca

SEQ ID NO: 1596840 - RNA, 14 nt, Pseudomonas putida KT2440
cguccggcaugcgc

SEQ ID NO: 1596841 - RNA, 13 nt, Pseudomonas putida KT2440
cguccggccagca

SEQ ID NO: 1596842 - RNA, 14 nt, Pseudomonas putida KT2440
cgucaccuugcuga

SEQ ID NO: 1596843 - RNA, 19 nt, Pseudomonas putida KT2440
cgucaugcucaugcgcggc

SEQ ID NO: 1596844 - RNA, 20 nt, Pseudomonas putida KT2440
cgucaucugcgcacggaagg

SEQ ID NO: 1596845 - RNA, 18 nt, Pseudomonas putida KT2440
cguccagcugagcgccau

SEQ ID NO: 1596846 - RNA, 16 nt, Pseudomonas putida KT2440
cguccagggcagguca

SEQ ID NO: 1596847 - RNA, 13 nt, Pseudomonas putida KT2440
gaugccccugcgc

SEQ ID NO: 1596848 - RNA, 16 nt, Pseudomonas putida KT2440
gaugccgccgcugcca

SEQ ID NO: 1596849 - RNA, 19 nt, Pseudomonas putida KT2440
gaugccgccgcugccagca

SEQ ID NO: 1596850 - RNA, 24 nt, Pseudomonas putida KT2440
gaugauauuugccacucaggcgca

SEQ ID NO: 1596851 - RNA, 13 nt, Pseudomonas putida KT2440
gaugaucagggac

SEQ ID NO: 1596852 - RNA, 13 nt, Pseudomonas putida KT2440
gaugauggcugcc

SEQ ID NO: 1596853 - RNA, 22 nt, Pseudomonas putida KT2440
aacuggcgcaucuuccagcaca

SEQ ID NO: 1596854 - RNA, 19 nt, Pseudomonas putida KT2440
aacugucguuuggcgcgau

SEQ ID NO: 1596855 - RNA, 21 nt, Pseudomonas putida KT2440
gaugcacagcucgcgcugcca

SEQ ID NO: 1596856 - RNA, 17 nt, Pseudomonas putida KT2440
gaucgccgccgagcuga

SEQ ID NO: 1596857 - RNA, 15 nt, Pseudomonas putida KT2440
gaucuucucggcgcg

SEQ ID NO: 1596858 - RNA, 18 nt, Pseudomonas putida KT2440
gaucugugggagcggccu

SEQ ID NO: 1596859 - RNA, 14 nt, Pseudomonas putida KT2440
gaucuugcuggccg

SEQ ID NO: 1596860 - RNA, 14 nt, Pseudomonas putida KT2440
gaucuuggccaggg

SEQ ID NO: 1596861 - RNA, 20 nt, Pseudomonas putida KT2440
gaucugaaaguucagcgccu

SEQ ID NO: 1596862 - RNA, 21 nt, Pseudomonas putida KT2440
gaucuggucgaagcucaggua

SEQ ID NO: 1596863 - RNA, 16 nt, Pseudomonas putida KT2440
gaucugccccucgauc

SEQ ID NO: 1596864 - RNA, 16 nt, Pseudomonas putida KT2440
gaucugccaggcacca

SEQ ID NO: 1596865 - RNA, 20 nt, Pseudomonas putida KT2440
gaugacuggccggagcugga

SEQ ID NO: 1596866 - RNA, 23 nt, Pseudomonas putida KT2440
gaugacuuucaugcccgcgucug

SEQ ID NO: 1596867 - RNA, 20 nt, Pseudomonas putida KT2440
gaugacccuuccagcccgcc

SEQ ID NO: 1596868 - RNA, 16 nt, Pseudomonas putida KT2440
gaugaaauccaccagc

SEQ ID NO: 1596869 - RNA, 15 nt, Pseudomonas putida KT2440
gaugaacucgucacc

SEQ ID NO: 1596870 - RNA, 19 nt, Pseudomonas putida KT2440
gaugaacgacagggucgcu

SEQ ID NO: 1596871 - RNA, 20 nt, Pseudomonas putida KT2440
gaugaauaaugcuccagcga

SEQ ID NO: 1596872 - RNA, 13 nt, Pseudomonas putida KT2440
gaugaaucgcgua

SEQ ID NO: 1596873 - RNA, 14 nt, Pseudomonas putida KT2440
gaugaagcaggccg

SEQ ID NO: 1596874 - RNA, 15 nt, Pseudomonas putida KT2440
aacuggccagcagcc

SEQ ID NO: 1596875 - RNA, 15 nt, Pseudomonas putida KT2440
aacugcugcccguug

SEQ ID NO: 1596876 - RNA, 14 nt, Pseudomonas putida KT2440
gauucaagcccggc

SEQ ID NO: 1596877 - RNA, 20 nt, Pseudomonas putida KT2440
gauuacccugcgccaggcau

SEQ ID NO: 1596878 - RNA, 22 nt, Pseudomonas putida KT2440
gauguucccauugagcuguuuc

SEQ ID NO: 1596879 - RNA, 23 nt, Pseudomonas putida KT2440
gauguugcccggcaugaucagcu

SEQ ID NO: 1596880 - RNA, 16 nt, Pseudomonas putida KT2440
gauguggcccgggaag

SEQ ID NO: 1596881 - RNA, 15 nt, Pseudomonas putida KT2440
gauugcccuguggcu

SEQ ID NO: 1596882 - RNA, 13 nt, Pseudomonas putida KT2440
gauugcgaguuga

SEQ ID NO: 1596883 - RNA, 22 nt, Pseudomonas putida KT2440
gauugccugaucaaagucgccu

SEQ ID NO: 1596884 - RNA, 17 nt, Pseudomonas putida KT2440
gauucgccaaggccucg

SEQ ID NO: 1596885 - RNA, 17 nt, Pseudomonas putida KT2440
gcaaacgcggucagcga

SEQ ID NO: 1596886 - RNA, 21 nt, Pseudomonas putida KT2440
gcaaacgcaggugcgcacgcu

SEQ ID NO: 1596887 - RNA, 18 nt, Pseudomonas putida KT2440
gcaaacucgucgcugguc

SEQ ID NO: 1596888 - RNA, 16 nt, Pseudomonas putida KT2440
gcaaagaaaaacccgg

SEQ ID NO: 1596889 - RNA, 21 nt, Pseudomonas putida KT2440
gcaaacuggcgcccggcaucg

SEQ ID NO: 1596890 - RNA, 23 nt, Pseudomonas putida KT2440
gcaaacuggcgcccggcaucgcu

SEQ ID NO: 1596891 - RNA, 14 nt, Pseudomonas putida KT2440
gcaaaccgaccagg

SEQ ID NO: 1596892 - RNA, 19 nt, Pseudomonas putida KT2440
gcaacagaaaaugcccgcu

SEQ ID NO: 1596893 - RNA, 13 nt, Pseudomonas putida KT2440
gcaacacuucagg

SEQ ID NO: 1596894 - RNA, 21 nt, Pseudomonas putida KT2440
gcaacagcaaggcaucggcgc

SEQ ID NO: 1596895 - RNA, 22 nt, Pseudomonas putida KT2440
gcaacagcucauccaggcugca

SEQ ID NO: 1596896 - RNA, 12 nt, Pseudomonas putida KT2440
gcaaaucgccgc

SEQ ID NO: 1596897 - RNA, 17 nt, Pseudomonas putida KT2440
gcaaaucgccaaucagg

SEQ ID NO: 1596898 - RNA, 15 nt, Pseudomonas putida KT2440
gcaaagaacaucacg

SEQ ID NO: 1596899 - RNA, 21 nt, Pseudomonas putida KT2440
gcaaagucuucagccaaggcg

SEQ ID NO: 1596900 - RNA, 11 nt, Pseudomonas putida KT2440
gauggccaaua

SEQ ID NO: 1596901 - RNA, 19 nt, Pseudomonas putida KT2440
gauggccaauaccgcugca

SEQ ID NO: 1596902 - RNA, 16 nt, Pseudomonas putida KT2440
gauggccaccagcacc

SEQ ID NO: 1596903 - RNA, 15 nt, Pseudomonas putida KT2440
gauggcaccgacuuc

SEQ ID NO: 1596904 - RNA, 16 nt, Pseudomonas putida KT2440
gaugcgccccccaggc

SEQ ID NO: 1596905 - RNA, 17 nt, Pseudomonas putida KT2440
gaugcgccuggcccgca

SEQ ID NO: 1596906 - RNA, 14 nt, Pseudomonas putida KT2440
gaugcgcgcugcaa

SEQ ID NO: 1596907 - RNA, 15 nt, Pseudomonas putida KT2440
gaugcgccaguacgc

SEQ ID NO: 1596908 - RNA, 13 nt, Pseudomonas putida KT2440
gaugcgcccuucg

SEQ ID NO: 1596909 - RNA, 13 nt, Pseudomonas putida KT2440
gaugcgcuggccc

SEQ ID NO: 1596910 - RNA, 15 nt, Pseudomonas putida KT2440
gauguagucgucgcu

SEQ ID NO: 1596911 - RNA, 16 nt, Pseudomonas putida KT2440
gauguacucaggggca

SEQ ID NO: 1596912 - RNA, 18 nt, Pseudomonas putida KT2440
gauguaggcagcugccuu

SEQ ID NO: 1596913 - RNA, 14 nt, Pseudomonas putida KT2440
gauggcugucugca

SEQ ID NO: 1596914 - RNA, 16 nt, Pseudomonas putida KT2440
gaucgaaaucagccuu

SEQ ID NO: 1596915 - RNA, 16 nt, Pseudomonas putida KT2440
gaucgagugcucgaac

SEQ ID NO: 1596916 - RNA, 21 nt, Pseudomonas putida KT2440
gauccugcagccgcaccugcc

SEQ ID NO: 1596917 - RNA, 19 nt, Pseudomonas putida KT2440
gauccucuucgaagacgcc

SEQ ID NO: 1596918 - RNA, 19 nt, Pseudomonas putida KT2440
gauccuguggaagcgggcg

SEQ ID NO: 1596919 - RNA, 22 nt, Pseudomonas putida KT2440
gaucccugugggagcgggcuug

SEQ ID NO: 1596920 - RNA, 14 nt, Pseudomonas putida KT2440
gaucagccacgggc

SEQ ID NO: 1596921 - RNA, 16 nt, Pseudomonas putida KT2440
gaucagccacgggcuu

SEQ ID NO: 1596922 - RNA, 20 nt, Pseudomonas putida KT2440
gaucagcggcacggccacca

SEQ ID NO: 1596923 - RNA, 23 nt, Pseudomonas putida KT2440
gaucagcuugccgaucagcgagu

SEQ ID NO: 1596924 - RNA, 22 nt, Pseudomonas putida KT2440
gaucagcuggucgaggcggcug

SEQ ID NO: 1596925 - RNA, 14 nt, Pseudomonas putida KT2440
gaucagcugccacu

SEQ ID NO: 1596926 - RNA, 17 nt, Pseudomonas putida KT2440
gaucagcucggcaacga

SEQ ID NO: 1596927 - RNA, 21 nt, Pseudomonas putida KT2440
gaucagcgguucgaccgacau

SEQ ID NO: 1596928 - RNA, 18 nt, Pseudomonas putida KT2440
gaucaugccgacggugcc

SEQ ID NO: 1596929 - RNA, 13 nt, Pseudomonas putida KT2440
gaucaggcaggcc

SEQ ID NO: 1596930 - RNA, 19 nt, Pseudomonas putida KT2440
gaucaggcaggccagcacg

SEQ ID NO: 1596931 - RNA, 18 nt, Pseudomonas putida KT2440
gaucaucagaccgccgau

SEQ ID NO: 1596932 - RNA, 16 nt, Pseudomonas putida KT2440
gaucaggaaggcacca

SEQ ID NO: 1596933 - RNA, 16 nt, Pseudomonas putida KT2440
gaguacgggcacaccu

SEQ ID NO: 1596934 - RNA, 16 nt, Pseudomonas putida KT2440
gaguaaccggcggcga

SEQ ID NO: 1596935 - RNA, 15 nt, Pseudomonas putida KT2440
gauaccccgcugccu

SEQ ID NO: 1596936 - RNA, 22 nt, Pseudomonas putida KT2440
gauacgcuucgaacacccgcuu

SEQ ID NO: 1596937 - RNA, 13 nt, Pseudomonas putida KT2440
gauaccgaacagc

SEQ ID NO: 1596938 - RNA, 15 nt, Pseudomonas putida KT2440
gauacucacccgcuu

SEQ ID NO: 1596939 - RNA, 14 nt, Pseudomonas putida KT2440
gauauugaccagcg

SEQ ID NO: 1596940 - RNA, 23 nt, Pseudomonas putida KT2440
gauagccuguggggcaacugcgc

SEQ ID NO: 1596941 - RNA, 15 nt, Pseudomonas putida KT2440
gauacuuggccauca

SEQ ID NO: 1596942 - RNA, 18 nt, Pseudomonas putida KT2440
gauagcggcagcgacgau

SEQ ID NO: 1596943 - RNA, 17 nt, Pseudomonas putida KT2440
gaucaccagguuguggc

SEQ ID NO: 1596944 - RNA, 17 nt, Pseudomonas putida KT2440
gaucaccuggucgaccg

SEQ ID NO: 1596945 - RNA, 19 nt, Pseudomonas putida KT2440
gaucaccugcggccuggcc

SEQ ID NO: 1596946 - RNA, 12 nt, Pseudomonas putida KT2440
gaucacgaacac

SEQ ID NO: 1596947 - RNA, 19 nt, Pseudomonas putida KT2440
gaucacgaacacaucaccu

SEQ ID NO: 1596948 - RNA, 14 nt, Pseudomonas putida KT2440
gaucagcagcaccg

SEQ ID NO: 1596949 - RNA, 15 nt, Pseudomonas putida KT2440
gaucagcagcaccga

SEQ ID NO: 1596950 - RNA, 17 nt, Pseudomonas putida KT2440
gaucaaacggucccgau

SEQ ID NO: 1596951 - RNA, 20 nt, Pseudomonas putida KT2440
gaucaaugggccgaucacga

SEQ ID NO: 1596952 - RNA, 20 nt, Pseudomonas putida KT2440
gaucaaugucggagcgggcu

SEQ ID NO: 1596953 - RNA, 15 nt, Pseudomonas putida KT2440
gagccggaucgacgc

SEQ ID NO: 1596954 - RNA, 16 nt, Pseudomonas putida KT2440
gagcgccauccaccug

SEQ ID NO: 1596955 - RNA, 18 nt, Pseudomonas putida KT2440
gagccugggucacggcau

SEQ ID NO: 1596956 - RNA, 15 nt, Pseudomonas putida KT2440
gagcgaaacccggcg

SEQ ID NO: 1596957 - RNA, 17 nt, Pseudomonas putida KT2440
gagcgcgugcggggcau

SEQ ID NO: 1596958 - RNA, 12 nt, Pseudomonas putida KT2440
gagcgccgcgau

SEQ ID NO: 1596959 - RNA, 17 nt, Pseudomonas putida KT2440
gagcgcggcgcccagca

SEQ ID NO: 1596960 - RNA, 13 nt, Pseudomonas putida KT2440
aacucgucgcugg

SEQ ID NO: 1596961 - RNA, 14 nt, Pseudomonas putida KT2440
aacucuuccccgcc

SEQ ID NO: 1596962 - RNA, 16 nt, Pseudomonas putida KT2440
aacucgaucggcaccc

SEQ ID NO: 1596963 - RNA, 20 nt, Pseudomonas putida KT2440
aacucgcccgguuuggccug

SEQ ID NO: 1596964 - RNA, 17 nt, Pseudomonas putida KT2440
gagcggccuugucgcga

SEQ ID NO: 1596965 - RNA, 14 nt, Pseudomonas putida KT2440
gagcggcucgcgcu

SEQ ID NO: 1596966 - RNA, 12 nt, Pseudomonas putida KT2440
aacugcccagga

SEQ ID NO: 1596967 - RNA, 21 nt, Pseudomonas putida KT2440
aacugccacgcccgcugcaug

SEQ ID NO: 1596968 - RNA, 14 nt, Pseudomonas putida KT2440
aacugccaggcugg

SEQ ID NO: 1596969 - RNA, 19 nt, Pseudomonas putida KT2440
gagcgggauuugccgucgc

SEQ ID NO: 1596970 - RNA, 20 nt, Pseudomonas putida KT2440
gagcgucaaccaggcgcagc

SEQ ID NO: 1596971 - RNA, 20 nt, Pseudomonas putida KT2440
gagcgggcgcgcccgcgaag

SEQ ID NO: 1596972 - RNA, 19 nt, Pseudomonas putida KT2440
gagcgggggcgcgucagcc

SEQ ID NO: 1596973 - RNA, 19 nt, Pseudomonas putida KT2440
gagcggguucacccgcgaa

SEQ ID NO: 1596974 - RNA, 20 nt, Pseudomonas putida KT2440
gagcggguucacccgcgaaa

SEQ ID NO: 1596975 - RNA, 20 nt, Pseudomonas putida KT2440
gagcggguucacccgcgaag

SEQ ID NO: 1596976 - RNA, 18 nt, Pseudomonas putida KT2440
gagcggguuuacccgcga

SEQ ID NO: 1596977 - RNA, 19 nt, Pseudomonas putida KT2440
gagcggguuuacccgcgaa

SEQ ID NO: 1596978 - RNA, 20 nt, Pseudomonas putida KT2440
gagcggguuuacccgcgaaa

SEQ ID NO: 1596979 - RNA, 20 nt, Pseudomonas putida KT2440
gagcggguuuacccgcgaac

SEQ ID NO: 1596980 - RNA, 20 nt, Pseudomonas putida KT2440
gagcggguuuacccgcgaau

SEQ ID NO: 1596981 - RNA, 19 nt, Pseudomonas putida KT2440
gagcgggcgugcccgcgaa

SEQ ID NO: 1596982 - RNA, 20 nt, Pseudomonas putida KT2440
gagcgggcgugcccgcgaag

SEQ ID NO: 1596983 - RNA, 20 nt, Pseudomonas putida KT2440
gagcgggcgugcccgcgaau

SEQ ID NO: 1596984 - RNA, 20 nt, Pseudomonas putida KT2440
gagcgggcgugccugcgaau

SEQ ID NO: 1596985 - RNA, 20 nt, Pseudomonas putida KT2440
gagcgggcuuacccgcgaag

SEQ ID NO: 1596986 - RNA, 20 nt, Pseudomonas putida KT2440
gagcgggcuugcccgcgaag

SEQ ID NO: 1596987 - RNA, 22 nt, Pseudomonas putida KT2440
gagcgggcuugcccgcgaagca

SEQ ID NO: 1596988 - RNA, 20 nt, Pseudomonas putida KT2440
gagcgggcuugcccgcgaau

SEQ ID NO: 1596989 - RNA, 23 nt, Pseudomonas putida KT2440
gagcuacagccccuuccccaggc

SEQ ID NO: 1596990 - RNA, 12 nt, Pseudomonas putida KT2440
gagcgugaagcg

SEQ ID NO: 1596991 - RNA, 23 nt, Pseudomonas putida KT2440
gagcguggcaaacccggccagca

SEQ ID NO: 1596992 - RNA, 19 nt, Pseudomonas putida KT2440
gagcugauucagcacaccg

SEQ ID NO: 1596993 - RNA, 20 nt, Pseudomonas putida KT2440
gagcugaugcucaagcgcca

SEQ ID NO: 1596994 - RNA, 18 nt, Pseudomonas putida KT2440
gagcuucgucggugcccu

SEQ ID NO: 1596995 - RNA, 14 nt, Pseudomonas putida KT2440
gagcugucgcgcca

SEQ ID NO: 1596996 - RNA, 17 nt, Pseudomonas putida KT2440
gagcuuggacaggcccc

SEQ ID NO: 1596997 - RNA, 14 nt, Pseudomonas putida KT2440
gaggaucagcgcag

SEQ ID NO: 1596998 - RNA, 14 nt, Pseudomonas putida KT2440
gagguugcgcucca

SEQ ID NO: 1596999 - RNA, 15 nt, Pseudomonas putida KT2440
gagguuugccaaggc

SEQ ID NO: 1597000 - RNA, 14 nt, Pseudomonas putida KT2440
gagguaagacaggc

SEQ ID NO: 1597001 - RNA, 23 nt, Pseudomonas putida KT2440
gagguacacccccagguuaucca

SEQ ID NO: 1597002 - RNA, 19 nt, Pseudomonas putida KT2440
gaggcugaucaggaacacu

SEQ ID NO: 1597003 - RNA, 18 nt, Pseudomonas putida KT2440
gagggucgugagccugca

SEQ ID NO: 1597004 - RNA, 19 nt, Pseudomonas putida KT2440
gagggugaggugcugcaga

SEQ ID NO: 1597005 - RNA, 21 nt, Pseudomonas putida KT2440
gagggucagcuggccuucgaa

SEQ ID NO: 1597006 - RNA, 19 nt, Pseudomonas putida KT2440
gagggaaaacucggucagg

SEQ ID NO: 1597007 - RNA, 19 nt, Pseudomonas putida KT2440
gaggcuguggcccaaggcg

SEQ ID NO: 1597008 - RNA, 21 nt, Pseudomonas putida KT2440
gcagggccggcccauucgcgg

SEQ ID NO: 1597009 - RNA, 15 nt, Pseudomonas putida KT2440
gcagggccucguuga

SEQ ID NO: 1597010 - RNA, 20 nt, Pseudomonas putida KT2440
gcagggccaucaucugcuga

SEQ ID NO: 1597011 - RNA, 17 nt, Pseudomonas putida KT2440
gcagggcccagccaccg

SEQ ID NO: 1597012 - RNA, 18 nt, Pseudomonas putida KT2440
gcagggcccagccaccga

SEQ ID NO: 1597013 - RNA, 22 nt, Pseudomonas putida KT2440
gcagggcccagccaccgacgaa

SEQ ID NO: 1597014 - RNA, 23 nt, Pseudomonas putida KT2440
gcagggcacgccaaucaccugca

SEQ ID NO: 1597015 - RNA, 21 nt, Pseudomonas putida KT2440
gcagggccaacgacacuccgg

SEQ ID NO: 1597016 - RNA, 15 nt, Pseudomonas putida KT2440
gcaggggacagccac

SEQ ID NO: 1597017 - RNA, 19 nt, Pseudomonas putida KT2440
gcagggcguugccgaucag

SEQ ID NO: 1597018 - RNA, 15 nt, Pseudomonas putida KT2440
gcagggugucgacga

SEQ ID NO: 1597019 - RNA, 19 nt, Pseudomonas putida KT2440
gcagguacacgggcaugcc

SEQ ID NO: 1597020 - RNA, 19 nt, Pseudomonas putida KT2440
gcaggguuuucagcgccgc

SEQ ID NO: 1597021 - RNA, 22 nt, Pseudomonas putida KT2440
gcaggguuuucagcgccgcaac

SEQ ID NO: 1597022 - RNA, 14 nt, Pseudomonas putida KT2440
gcagguaggcccag

SEQ ID NO: 1597023 - RNA, 14 nt, Pseudomonas putida KT2440
gcagguaccaguug

SEQ ID NO: 1597024 - RNA, 14 nt, Pseudomonas putida KT2440
gcaggucgacccgc

SEQ ID NO: 1597025 - RNA, 14 nt, Pseudomonas putida KT2440
gcaggucgaacagc

SEQ ID NO: 1597026 - RNA, 20 nt, Pseudomonas putida KT2440
gcaggucauuggcgccaucg

SEQ ID NO: 1597027 - RNA, 12 nt, Pseudomonas putida KT2440
gcaggucagcac

SEQ ID NO: 1597028 - RNA, 15 nt, Pseudomonas putida KT2440
gcaggucaggcccuu

SEQ ID NO: 1597029 - RNA, 15 nt, Pseudomonas putida KT2440
gcaggucaucgaaca

SEQ ID NO: 1597030 - RNA, 14 nt, Pseudomonas putida KT2440
gcagguccaggcgc

SEQ ID NO: 1597031 - RNA, 16 nt, Pseudomonas putida KT2440
gcaggucggccagcuc

SEQ ID NO: 1597032 - RNA, 14 nt, Pseudomonas putida KT2440
gcaggucgccaucc

SEQ ID NO: 1597033 - RNA, 19 nt, Pseudomonas putida KT2440
gcaggugggucacggucag

SEQ ID NO: 1597034 - RNA, 13 nt, Pseudomonas putida KT2440
gcaggugcaggcu

SEQ ID NO: 1597035 - RNA, 14 nt, Pseudomonas putida KT2440
gcaggugcagggug

SEQ ID NO: 1597036 - RNA, 18 nt, Pseudomonas putida KT2440
gcaggugcagguucgacc

SEQ ID NO: 1597037 - RNA, 18 nt, Pseudomonas putida KT2440
aagaagcuguagucacca

SEQ ID NO: 1597038 - RNA, 13 nt, Pseudomonas putida KT2440
gcaggucguugac

SEQ ID NO: 1597039 - RNA, 17 nt, Pseudomonas putida KT2440
gcaguaggugcaggcgu

SEQ ID NO: 1597040 - RNA, 18 nt, Pseudomonas putida KT2440
gcaguaccuguggcagcg

SEQ ID NO: 1597041 - RNA, 22 nt, Pseudomonas putida KT2440
gcaguagaaaguccaucugcuu

SEQ ID NO: 1597042 - RNA, 20 nt, Pseudomonas putida KT2440
gcaguacuuauaagcagcaa

SEQ ID NO: 1597043 - RNA, 19 nt, Pseudomonas putida KT2440
gcaguaccacacguugucc

SEQ ID NO: 1597044 - RNA, 22 nt, Pseudomonas putida KT2440
gcagguucgaccacugcaggug

SEQ ID NO: 1597045 - RNA, 15 nt, Pseudomonas putida KT2440
gcagguugcuggccu

SEQ ID NO: 1597046 - RNA, 15 nt, Pseudomonas putida KT2440
gcagguucaggcgca

SEQ ID NO: 1597047 - RNA, 18 nt, Pseudomonas putida KT2440
gcagguucaggcgcagca

SEQ ID NO: 1597048 - RNA, 18 nt, Pseudomonas putida KT2440
gcagguucagugaucaug

SEQ ID NO: 1597049 - RNA, 14 nt, Pseudomonas putida KT2440
gcagguucaacggc

SEQ ID NO: 1597050 - RNA, 15 nt, Pseudomonas putida KT2440
gcagguugaacaggu

SEQ ID NO: 1597051 - RNA, 23 nt, Pseudomonas putida KT2440
gcagguugaacagguugcugccg

SEQ ID NO: 1597052 - RNA, 15 nt, Pseudomonas putida KT2440
gcagguuggcgcgaa

SEQ ID NO: 1597053 - RNA, 17 nt, Pseudomonas putida KT2440
gcaggcgcaggugcagc

SEQ ID NO: 1597054 - RNA, 22 nt, Pseudomonas putida KT2440
gcaggcgcaggugcagccagcc

SEQ ID NO: 1597055 - RNA, 23 nt, Pseudomonas putida KT2440
gcaggcgcggcguggccucacgg

SEQ ID NO: 1597056 - RNA, 21 nt, Pseudomonas putida KT2440
gcaggcgacgagccaguucga

SEQ ID NO: 1597057 - RNA, 14 nt, Pseudomonas putida KT2440
gcaggcgcagggug

SEQ ID NO: 1597058 - RNA, 21 nt, Pseudomonas putida KT2440
gcaggcucugaaugucagcgc

SEQ ID NO: 1597059 - RNA, 17 nt, Pseudomonas putida KT2440
gcaggcucugcgccagc

SEQ ID NO: 1597060 - RNA, 14 nt, Pseudomonas putida KT2440
gcaggcugacccgc

SEQ ID NO: 1597061 - RNA, 17 nt, Pseudomonas putida KT2440
gcaggcucagggcagca

SEQ ID NO: 1597062 - RNA, 20 nt, Pseudomonas putida KT2440
gcaggcguucgucaagcucg

SEQ ID NO: 1597063 - RNA, 22 nt, Pseudomonas putida KT2440
gcaggcguaacucagcaacgcu

SEQ ID NO: 1597064 - RNA, 15 nt, Pseudomonas putida KT2440
gcaggcgguccagca

SEQ ID NO: 1597065 - RNA, 21 nt, Pseudomonas putida KT2440
gcaggcugcgugccugcugcu

SEQ ID NO: 1597066 - RNA, 19 nt, Pseudomonas putida KT2440
gcaggcuggcggccaaugc

SEQ ID NO: 1597067 - RNA, 22 nt, Pseudomonas putida KT2440
gcaggcugucgaacaggcugcc

SEQ ID NO: 1597068 - RNA, 23 nt, Pseudomonas putida KT2440
gcagggcaccaguugcaggucgg

SEQ ID NO: 1597069 - RNA, 20 nt, Pseudomonas putida KT2440
gcaggcuuucggccacccgg

SEQ ID NO: 1597070 - RNA, 21 nt, Pseudomonas putida KT2440
gcaggcuuucggccacccgga

SEQ ID NO: 1597071 - RNA, 20 nt, Pseudomonas putida KT2440
gcagggaagguggccggcaa

SEQ ID NO: 1597072 - RNA, 19 nt, Pseudomonas putida KT2440
gcaggccgccgacgaucag

SEQ ID NO: 1597073 - RNA, 15 nt, Pseudomonas putida KT2440
gcaggcccagcaggu

SEQ ID NO: 1597074 - RNA, 22 nt, Pseudomonas putida KT2440
gcaggccauacagggccuggcg

SEQ ID NO: 1597075 - RNA, 17 nt, Pseudomonas putida KT2440
gcaggccaccggcagca

SEQ ID NO: 1597076 - RNA, 17 nt, Pseudomonas putida KT2440
gcaggccaaugcagcuu

SEQ ID NO: 1597077 - RNA, 21 nt, Pseudomonas putida KT2440
gcaggccaaugcccaugccca

SEQ ID NO: 1597078 - RNA, 15 nt, Pseudomonas putida KT2440
gcaggcagcgauggc

SEQ ID NO: 1597079 - RNA, 19 nt, Pseudomonas putida KT2440
gcaggcaguucgagcgccu

SEQ ID NO: 1597080 - RNA, 22 nt, Pseudomonas putida KT2440
gcaggcaguucgagcgccugau

SEQ ID NO: 1597081 - RNA, 15 nt, Pseudomonas putida KT2440
gcaggcauacaggac

SEQ ID NO: 1597082 - RNA, 17 nt, Pseudomonas putida KT2440
gcaggaucuucaugcca

SEQ ID NO: 1597083 - RNA, 16 nt, Pseudomonas putida KT2440
gcaggauuugcccgca

SEQ ID NO: 1597084 - RNA, 17 nt, Pseudomonas putida KT2440
gcaggauuugcccgcaa

SEQ ID NO: 1597085 - RNA, 17 nt, Pseudomonas putida KT2440
gcaggcaaacgcgguca

SEQ ID NO: 1597086 - RNA, 21 nt, Pseudomonas putida KT2440
gcaggcaaacgcggucagcga

SEQ ID NO: 1597087 - RNA, 18 nt, Pseudomonas putida KT2440
gcaggcaaagaaugccgc

SEQ ID NO: 1597088 - RNA, 16 nt, Pseudomonas putida KT2440
gcagcaccgaggcgug

SEQ ID NO: 1597089 - RNA, 14 nt, Pseudomonas putida KT2440
gcagcaccgaucag

SEQ ID NO: 1597090 - RNA, 19 nt, Pseudomonas putida KT2440
gcagcaccgaucagcggcg

SEQ ID NO: 1597091 - RNA, 15 nt, Pseudomonas putida KT2440
gcagcaccgccacca

SEQ ID NO: 1597092 - RNA, 21 nt, Pseudomonas putida KT2440
gcagcaccgccaccaugcuca

SEQ ID NO: 1597093 - RNA, 14 nt, Pseudomonas putida KT2440
gcagccccggcaau

SEQ ID NO: 1597094 - RNA, 19 nt, Pseudomonas putida KT2440
gcagccccagcggcaaccu

SEQ ID NO: 1597095 - RNA, 22 nt, Pseudomonas putida KT2440
gcagccccaaccuuccagcaaa

SEQ ID NO: 1597096 - RNA, 14 nt, Pseudomonas putida KT2440
gcagccccaccucg

SEQ ID NO: 1597097 - RNA, 18 nt, Pseudomonas putida KT2440
gcagccccacgcccaggc

SEQ ID NO: 1597098 - RNA, 16 nt, Pseudomonas putida KT2440
gcagcaccgcugccag

SEQ ID NO: 1597099 - RNA, 14 nt, Pseudomonas putida KT2440
gcagccggcaccgc

SEQ ID NO: 1597100 - RNA, 16 nt, Pseudomonas putida KT2440
gcagccggcaccgcca

SEQ ID NO: 1597101 - RNA, 20 nt, Pseudomonas putida KT2440
gcagccggcaccgccauggu

SEQ ID NO: 1597102 - RNA, 19 nt, Pseudomonas putida KT2440
gcagccccugcacaucacg

SEQ ID NO: 1597103 - RNA, 14 nt, Pseudomonas putida KT2440
gcagcgaacgccgg

SEQ ID NO: 1597104 - RNA, 14 nt, Pseudomonas putida KT2440
gcagcgacgaccug

SEQ ID NO: 1597105 - RNA, 17 nt, Pseudomonas putida KT2440
gcagcgaucaguuccgc

SEQ ID NO: 1597106 - RNA, 23 nt, Pseudomonas putida KT2440
gcagcgaucccacggccgcgcag

SEQ ID NO: 1597107 - RNA, 18 nt, Pseudomonas putida KT2440
gcagcgcaaaaaacgccg

SEQ ID NO: 1597108 - RNA, 16 nt, Pseudomonas putida KT2440
gcagcgcauccaccuc

SEQ ID NO: 1597109 - RNA, 19 nt, Pseudomonas putida KT2440
gcagcgcaugcucgcgggc

SEQ ID NO: 1597110 - RNA, 13 nt, Pseudomonas putida KT2440
gcagcggcaaggu

SEQ ID NO: 1597111 - RNA, 20 nt, Pseudomonas putida KT2440
gcagcggcaagguagccugc

SEQ ID NO: 1597112 - RNA, 16 nt, Pseudomonas putida KT2440
gcagcgcuccgccaaa

SEQ ID NO: 1597113 - RNA, 19 nt, Pseudomonas putida KT2440
gcagcgcucgcugccgguc

SEQ ID NO: 1597114 - RNA, 17 nt, Pseudomonas putida KT2440
gcagcgcuucgaucagc

SEQ ID NO: 1597115 - RNA, 22 nt, Pseudomonas putida KT2440
gcagcgcuucgaucagcgccug

SEQ ID NO: 1597116 - RNA, 24 nt, Pseudomonas putida KT2440
gcagcgcuucgaucagcgccugcu

SEQ ID NO: 1597117 - RNA, 20 nt, Pseudomonas putida KT2440
gcagcgccgcauccagcacu

SEQ ID NO: 1597118 - RNA, 15 nt, Pseudomonas putida KT2440
gcagcgccgccaacu

SEQ ID NO: 1597119 - RNA, 13 nt, Pseudomonas putida KT2440
gcagcgcggcgau

SEQ ID NO: 1597120 - RNA, 16 nt, Pseudomonas putida KT2440
gcagcucuugucgaca

SEQ ID NO: 1597121 - RNA, 18 nt, Pseudomonas putida KT2440
gcagcuguugcuguuggc

SEQ ID NO: 1597122 - RNA, 21 nt, Pseudomonas putida KT2440
gcagcuguugcuguuggcgcg

SEQ ID NO: 1597123 - RNA, 22 nt, Pseudomonas putida KT2440
gcagcuguugcuguuggcgcga

SEQ ID NO: 1597124 - RNA, 23 nt, Pseudomonas putida KT2440
gcagcucuuuugccgggaagcgc

SEQ ID NO: 1597125 - RNA, 16 nt, Pseudomonas putida KT2440
gcagcugccggaacgu

SEQ ID NO: 1597126 - RNA, 18 nt, Pseudomonas putida KT2440
gcagcugcugaccucgac

SEQ ID NO: 1597127 - RNA, 18 nt, Pseudomonas putida KT2440
gcagcuucuucacaccgg

SEQ ID NO: 1597128 - RNA, 23 nt, Pseudomonas putida KT2440
gcagcuucuucacaccggccuug

SEQ ID NO: 1597129 - RNA, 21 nt, Pseudomonas putida KT2440
gcagcuucucgcggcgaaugc

SEQ ID NO: 1597130 - RNA, 21 nt, Pseudomonas putida KT2440
gcagcuucccggccuggcgca

SEQ ID NO: 1597131 - RNA, 20 nt, Pseudomonas putida KT2440
gcagcuuccgccaccacgaa

SEQ ID NO: 1597132 - RNA, 20 nt, Pseudomonas putida KT2440
gcagcuuauugcgcagggug

SEQ ID NO: 1597133 - RNA, 15 nt, Pseudomonas putida KT2440
gcagcuugcgcgccu

SEQ ID NO: 1597134 - RNA, 16 nt, Pseudomonas putida KT2440
gcagcuugaggcccau

SEQ ID NO: 1597135 - RNA, 20 nt, Pseudomonas putida KT2440
gcaggagcggguucacccgc

SEQ ID NO: 1597136 - RNA, 15 nt, Pseudomonas putida KT2440
gcaggaagcggcgcu

SEQ ID NO: 1597137 - RNA, 20 nt, Pseudomonas putida KT2440
gcaggaaccuccguugcugc

SEQ ID NO: 1597138 - RNA, 17 nt, Pseudomonas putida KT2440
gcaggaacagcggcagc

SEQ ID NO: 1597139 - RNA, 14 nt, Pseudomonas putida KT2440
gcagcuuuugcgca

SEQ ID NO: 1597140 - RNA, 17 nt, Pseudomonas putida KT2440
gcagcuuuugcgcagcg

SEQ ID NO: 1597141 - RNA, 14 nt, Pseudomonas putida KT2440
gcagcguggccuuc

SEQ ID NO: 1597142 - RNA, 22 nt, Pseudomonas putida KT2440
gcagcguaauagcuggugaacu

SEQ ID NO: 1597143 - RNA, 16 nt, Pseudomonas putida KT2440
gcagcguacccagcuc

SEQ ID NO: 1597144 - RNA, 17 nt, Pseudomonas putida KT2440
gcagcgggagucgaacc

SEQ ID NO: 1597145 - RNA, 22 nt, Pseudomonas putida KT2440
gcagcgggcacaggccgcgcau

SEQ ID NO: 1597146 - RNA, 10 nt, Pseudomonas putida KT2440
gcagcgggcu

SEQ ID NO: 1597147 - RNA, 20 nt, Pseudomonas putida KT2440
gcagcggggauucaacagcg

SEQ ID NO: 1597148 - RNA, 22 nt, Pseudomonas putida KT2440
gcagcggggauucaacagcgcg

SEQ ID NO: 1597149 - RNA, 22 nt, Pseudomonas putida KT2440
gcagcgggucgcacucggcaau

SEQ ID NO: 1597150 - RNA, 15 nt, Pseudomonas putida KT2440
gcagcucggugaaca

SEQ ID NO: 1597151 - RNA, 14 nt, Pseudomonas putida KT2440
gcagcucgagcaug

SEQ ID NO: 1597152 - RNA, 14 nt, Pseudomonas putida KT2440
gcagcuccagccag

SEQ ID NO: 1597153 - RNA, 13 nt, Pseudomonas putida KT2440
gcagcuccagcgu

SEQ ID NO: 1597154 - RNA, 17 nt, Pseudomonas putida KT2440
gcacucucccgcagccg

SEQ ID NO: 1597155 - RNA, 16 nt, Pseudomonas putida KT2440
gcacugaacagcgccu

SEQ ID NO: 1597156 - RNA, 18 nt, Pseudomonas putida KT2440
gcacucggucggcuggca

SEQ ID NO: 1597157 - RNA, 17 nt, Pseudomonas putida KT2440
gcacugccagcgccuca

SEQ ID NO: 1597158 - RNA, 14 nt, Pseudomonas putida KT2440
gcacugcaacaccg

SEQ ID NO: 1597159 - RNA, 16 nt, Pseudomonas putida KT2440
gcacugcaacaccggu

SEQ ID NO: 1597160 - RNA, 23 nt, Pseudomonas putida KT2440
gcacucaguuaaucagcaacgcc

SEQ ID NO: 1597161 - RNA, 18 nt, Pseudomonas putida KT2440
gcacuccccaucagcagc

SEQ ID NO: 1597162 - RNA, 22 nt, Pseudomonas putida KT2440
gcacuaccaggcccaacagcgc

SEQ ID NO: 1597163 - RNA, 22 nt, Pseudomonas putida KT2440
gcacuaccucgcucaggccaug

SEQ ID NO: 1597164 - RNA, 20 nt, Pseudomonas putida KT2440
gcacgugcccguagcggaua

SEQ ID NO: 1597165 - RNA, 17 nt, Pseudomonas putida KT2440
gcacuaagggcaggccu

SEQ ID NO: 1597166 - RNA, 12 nt, Pseudomonas putida KT2440
gcacuuccacac

SEQ ID NO: 1597167 - RNA, 22 nt, Pseudomonas putida KT2440
gcacuuccacuccagccgucga

SEQ ID NO: 1597168 - RNA, 14 nt, Pseudomonas putida KT2440
gcacuguugcuggc

SEQ ID NO: 1597169 - RNA, 17 nt, Pseudomonas putida KT2440
gcacuguuguccaaggg

SEQ ID NO: 1597170 - RNA, 14 nt, Pseudomonas putida KT2440
gcacugggcgaugg

SEQ ID NO: 1597171 - RNA, 14 nt, Pseudomonas putida KT2440
gcacuggcaggccu

SEQ ID NO: 1597172 - RNA, 14 nt, Pseudomonas putida KT2440
gcacugcugccgcc

SEQ ID NO: 1597173 - RNA, 18 nt, Pseudomonas putida KT2440
gcacuuggccugcugauu

SEQ ID NO: 1597174 - RNA, 21 nt, Pseudomonas putida KT2440
gcacuuguuccagccgcgcca

SEQ ID NO: 1597175 - RNA, 19 nt, Pseudomonas putida KT2440
gcacuugcgguguccauuc

SEQ ID NO: 1597176 - RNA, 18 nt, Pseudomonas putida KT2440
gcacuugggaucgaugca

SEQ ID NO: 1597177 - RNA, 14 nt, Pseudomonas putida KT2440
gcacuuucuugacc

SEQ ID NO: 1597178 - RNA, 21 nt, Pseudomonas putida KT2440
gcagaaagugcguuggcugcu

SEQ ID NO: 1597179 - RNA, 17 nt, Pseudomonas putida KT2440
gcagagcgccagcaucg

SEQ ID NO: 1597180 - RNA, 21 nt, Pseudomonas putida KT2440
gcagaggcuucuuugcaagcc

SEQ ID NO: 1597181 - RNA, 19 nt, Pseudomonas putida KT2440
gcagacaacgcggcggaua

SEQ ID NO: 1597182 - RNA, 22 nt, Pseudomonas putida KT2440
aacuugcgggucagcagcaccg

SEQ ID NO: 1597183 - RNA, 17 nt, Pseudomonas putida KT2440
gcagauaucuggacccc

SEQ ID NO: 1597184 - RNA, 15 nt, Pseudomonas putida KT2440
gcagauugcaucacu

SEQ ID NO: 1597185 - RNA, 13 nt, Pseudomonas putida KT2440
gcagcaacacgac

SEQ ID NO: 1597186 - RNA, 14 nt, Pseudomonas putida KT2440
gcagcaacacgacg

SEQ ID NO: 1597187 - RNA, 21 nt, Pseudomonas putida KT2440
gcagcaacaguuucuugccuu

SEQ ID NO: 1597188 - RNA, 13 nt, Pseudomonas putida KT2440
gcagcaagccugc

SEQ ID NO: 1597189 - RNA, 20 nt, Pseudomonas putida KT2440
gcagcaaguugaagaacagu

SEQ ID NO: 1597190 - RNA, 13 nt, Pseudomonas putida KT2440
gcagcacaaggcu

SEQ ID NO: 1597191 - RNA, 19 nt, Pseudomonas putida KT2440
gcagcaaucgccgccugga

SEQ ID NO: 1597192 - RNA, 13 nt, Pseudomonas putida KT2440
gcacgggucaccu

SEQ ID NO: 1597193 - RNA, 20 nt, Pseudomonas putida KT2440
gcacggguacccgcguuggc

SEQ ID NO: 1597194 - RNA, 17 nt, Pseudomonas putida KT2440
gcacggucuccggcgaa

SEQ ID NO: 1597195 - RNA, 20 nt, Pseudomonas putida KT2440
gcacguagucgucagggucu

SEQ ID NO: 1597196 - RNA, 20 nt, Pseudomonas putida KT2440
gcacguaguaauccggcaac

SEQ ID NO: 1597197 - RNA, 21 nt, Pseudomonas putida KT2440
gcacguaguaauccggcaacu

SEQ ID NO: 1597198 - RNA, 13 nt, Pseudomonas putida KT2440
gcacgucgcgauu

SEQ ID NO: 1597199 - RNA, 15 nt, Pseudomonas putida KT2440
gcacgucgcgauuga

SEQ ID NO: 1597200 - RNA, 18 nt, Pseudomonas putida KT2440
gcacgucgaugaaggcau

SEQ ID NO: 1597201 - RNA, 12 nt, Pseudomonas putida KT2440
gcacgucggcgc

SEQ ID NO: 1597202 - RNA, 15 nt, Pseudomonas putida KT2440
gcacgcugcccaggu

SEQ ID NO: 1597203 - RNA, 14 nt, Pseudomonas putida KT2440
gcacggcaaucagg

SEQ ID NO: 1597204 - RNA, 16 nt, Pseudomonas putida KT2440
gcacggcaauugccac

SEQ ID NO: 1597205 - RNA, 23 nt, Pseudomonas putida KT2440
gcacggcaauuucuaccggcaua

SEQ ID NO: 1597206 - RNA, 15 nt, Pseudomonas putida KT2440
gcacggcaccagcac

SEQ ID NO: 1597207 - RNA, 15 nt, Pseudomonas putida KT2440
gcacggcgccgaccg

SEQ ID NO: 1597208 - RNA, 20 nt, Pseudomonas putida KT2440
gcacggccuucccgccuggc

SEQ ID NO: 1597209 - RNA, 16 nt, Pseudomonas putida KT2440
gcacggccagcaccga

SEQ ID NO: 1597210 - RNA, 18 nt, Pseudomonas putida KT2440
gcacggcagcaaucgccg

SEQ ID NO: 1597211 - RNA, 17 nt, Pseudomonas putida KT2440
gcacgccaaucaccugc

SEQ ID NO: 1597212 - RNA, 16 nt, Pseudomonas putida KT2440
gcacgccagcaucacc

SEQ ID NO: 1597213 - RNA, 17 nt, Pseudomonas putida KT2440
gcacgcccaagccggcc

SEQ ID NO: 1597214 - RNA, 22 nt, Pseudomonas putida KT2440
gcacgaucucgucacugcgggu

SEQ ID NO: 1597215 - RNA, 20 nt, Pseudomonas putida KT2440
gcacgccgguaucacccagu

SEQ ID NO: 1597216 - RNA, 12 nt, Pseudomonas putida KT2440
gcacgcccgcuc

SEQ ID NO: 1597217 - RNA, 20 nt, Pseudomonas putida KT2440
gcacgcccgcucccacaggc

SEQ ID NO: 1597218 - RNA, 20 nt, Pseudomonas putida KT2440
gcacgcccgcucccacaggu

SEQ ID NO: 1597219 - RNA, 17 nt, Pseudomonas putida KT2440
gcacgccuucagcagcc

SEQ ID NO: 1597220 - RNA, 23 nt, Pseudomonas putida KT2440
gcacgccuucagcagccggucgu

SEQ ID NO: 1597221 - RNA, 16 nt, Pseudomonas putida KT2440
gcacgcgaucggcagc

SEQ ID NO: 1597222 - RNA, 15 nt, Pseudomonas putida KT2440
gcacgcgccagcagc

SEQ ID NO: 1597223 - RNA, 19 nt, Pseudomonas putida KT2440
gcacgcgccagcagcgcgu

SEQ ID NO: 1597224 - RNA, 14 nt, Pseudomonas putida KT2440
gcacgaucagcagc

SEQ ID NO: 1597225 - RNA, 18 nt, Pseudomonas putida KT2440
gcacgaucagcagcaaag

SEQ ID NO: 1597226 - RNA, 17 nt, Pseudomonas putida KT2440
gcacgaucagcgcggca

SEQ ID NO: 1597227 - RNA, 20 nt, Pseudomonas putida KT2440
gcacgaucagcgcggcaaag

SEQ ID NO: 1597228 - RNA, 14 nt, Pseudomonas putida KT2440
gcacgaagcccagu

SEQ ID NO: 1597229 - RNA, 21 nt, Pseudomonas putida KT2440
gcacgaagcccaguugcuggc

SEQ ID NO: 1597230 - RNA, 16 nt, Pseudomonas putida KT2440
gcacgaauacgcucga

SEQ ID NO: 1597231 - RNA, 21 nt, Pseudomonas putida KT2440
gcacgaauacgcucgaccaga

SEQ ID NO: 1597232 - RNA, 18 nt, Pseudomonas putida KT2440
gcacgaaggccagcaaag

SEQ ID NO: 1597233 - RNA, 19 nt, Pseudomonas putida KT2440
gcacgaaguaacggccacg

SEQ ID NO: 1597234 - RNA, 21 nt, Pseudomonas putida KT2440
gcacgaaguaacggccacggu

SEQ ID NO: 1597235 - RNA, 18 nt, Pseudomonas putida KT2440
gcaccggccaccaggcgc

SEQ ID NO: 1597236 - RNA, 22 nt, Pseudomonas putida KT2440
gcaccaugauguucugcuugag

SEQ ID NO: 1597237 - RNA, 15 nt, Pseudomonas putida KT2440
gcaccaggucgcggu

SEQ ID NO: 1597238 - RNA, 18 nt, Pseudomonas putida KT2440
gcaccagggcuggcagcg

SEQ ID NO: 1597239 - RNA, 21 nt, Pseudomonas putida KT2440
gcaccagggcuggcagcgggu

SEQ ID NO: 1597240 - RNA, 23 nt, Pseudomonas putida KT2440
gcaccagggcuggcagcggguag

SEQ ID NO: 1597241 - RNA, 22 nt, Pseudomonas putida KT2440
gcacccaauagcccaccgucag

SEQ ID NO: 1597242 - RNA, 12 nt, Pseudomonas putida KT2440
gcacccgcacau

SEQ ID NO: 1597243 - RNA, 19 nt, Pseudomonas putida KT2440
gcaccagcuugugccgcug

SEQ ID NO: 1597244 - RNA, 18 nt, Pseudomonas putida KT2440
gcaccagcuuguugccgg

SEQ ID NO: 1597245 - RNA, 18 nt, Pseudomonas putida KT2440
gcaccagcggcuuggcac

SEQ ID NO: 1597246 - RNA, 20 nt, Pseudomonas putida KT2440
gcaccagcgggcccagcagg

SEQ ID NO: 1597247 - RNA, 19 nt, Pseudomonas putida KT2440
gcaccagcgcgaucaccag

SEQ ID NO: 1597248 - RNA, 17 nt, Pseudomonas putida KT2440
gcaccgcuucacccucg

SEQ ID NO: 1597249 - RNA, 17 nt, Pseudomonas putida KT2440
gcaccgcuaccauggcc

SEQ ID NO: 1597250 - RNA, 18 nt, Pseudomonas putida KT2440
gcaccgcugccagcugcg

SEQ ID NO: 1597251 - RNA, 16 nt, Pseudomonas putida KT2440
gcaccgcuccgacaaa

SEQ ID NO: 1597252 - RNA, 23 nt, Pseudomonas putida KT2440
gcaccgcuccgacaaaugcacca

SEQ ID NO: 1597253 - RNA, 12 nt, Pseudomonas putida KT2440
gcaccggcaacc

SEQ ID NO: 1597254 - RNA, 22 nt, Pseudomonas putida KT2440
gcaccgaugcggugcagcaccu

SEQ ID NO: 1597255 - RNA, 12 nt, Pseudomonas putida KT2440
gcaccgaucacc

SEQ ID NO: 1597256 - RNA, 22 nt, Pseudomonas putida KT2440
gcaccgauucaaagccauaccg

SEQ ID NO: 1597257 - RNA, 19 nt, Pseudomonas putida KT2440
gcaccgccgcccacgccgg

SEQ ID NO: 1597258 - RNA, 17 nt, Pseudomonas putida KT2440
gcaccgagucgccuuca

SEQ ID NO: 1597259 - RNA, 21 nt, Pseudomonas putida KT2440
gcaccgagaugaucgcggcaa

SEQ ID NO: 1597260 - RNA, 23 nt, Pseudomonas putida KT2440
gcaccgagaugaucgcggcaauc

SEQ ID NO: 1597261 - RNA, 16 nt, Pseudomonas putida KT2440
gcacccggcuggucga

SEQ ID NO: 1597262 - RNA, 16 nt, Pseudomonas putida KT2440
gcacccggcggugacc

SEQ ID NO: 1597263 - RNA, 20 nt, Pseudomonas putida KT2440
gcaccacgggcggcucacag

SEQ ID NO: 1597264 - RNA, 14 nt, Pseudomonas putida KT2440
gcaccacgaucacg

SEQ ID NO: 1597265 - RNA, 16 nt, Pseudomonas putida KT2440
gcaccacggaaggcca

SEQ ID NO: 1597266 - RNA, 13 nt, Pseudomonas putida KT2440
gcaccacggcggc

SEQ ID NO: 1597267 - RNA, 22 nt, Pseudomonas putida KT2440
gcaccacccaccagcagugccc

SEQ ID NO: 1597268 - RNA, 18 nt, Pseudomonas putida KT2440
gcaccacccccagcgccu

SEQ ID NO: 1597269 - RNA, 23 nt, Pseudomonas putida KT2440
gcaccaaucgagauguaguccac

SEQ ID NO: 1597270 - RNA, 20 nt, Pseudomonas putida KT2440
gcaccaaugacuccgcccca

SEQ ID NO: 1597271 - RNA, 20 nt, Pseudomonas putida KT2440
gcaccacaagaacugcgacg

SEQ ID NO: 1597272 - RNA, 17 nt, Pseudomonas putida KT2440
gcaccacauacggcgca

SEQ ID NO: 1597273 - RNA, 19 nt, Pseudomonas putida KT2440
gcacaucacacagcggcag

SEQ ID NO: 1597274 - RNA, 16 nt, Pseudomonas putida KT2440
gcacaucccgucagcc

SEQ ID NO: 1597275 - RNA, 15 nt, Pseudomonas putida KT2440
gcacaucggccaccg

SEQ ID NO: 1597276 - RNA, 18 nt, Pseudomonas putida KT2440
gcacagugguguacagca

SEQ ID NO: 1597277 - RNA, 23 nt, Pseudomonas putida KT2440
gcacaucacguuuggcagugcca

SEQ ID NO: 1597278 - RNA, 13 nt, Pseudomonas putida KT2440
gcacacgaccuug

SEQ ID NO: 1597279 - RNA, 12 nt, Pseudomonas putida KT2440
gcacacgcucca

SEQ ID NO: 1597280 - RNA, 18 nt, Pseudomonas putida KT2440
gcacacgguaguccugcc

SEQ ID NO: 1597281 - RNA, 14 nt, Pseudomonas putida KT2440
gcacagcgcucgau

SEQ ID NO: 1597282 - RNA, 15 nt, Pseudomonas putida KT2440
gcacagcucgaugcc

SEQ ID NO: 1597283 - RNA, 15 nt, Pseudomonas putida KT2440
gcacaggccagccag

SEQ ID NO: 1597284 - RNA, 13 nt, Pseudomonas putida KT2440
gcacaggcccagc

SEQ ID NO: 1597285 - RNA, 17 nt, Pseudomonas putida KT2440
gcacaggcccagcauga

SEQ ID NO: 1597286 - RNA, 15 nt, Pseudomonas putida KT2440
gcacagggcgaugcc

SEQ ID NO: 1597287 - RNA, 17 nt, Pseudomonas putida KT2440
gcacaggccgccugacc

SEQ ID NO: 1597288 - RNA, 15 nt, Pseudomonas putida KT2440
gcacaggccgcgcau

SEQ ID NO: 1597289 - RNA, 19 nt, Pseudomonas putida KT2440
gcacaggccgcgcaugaug

SEQ ID NO: 1597290 - RNA, 15 nt, Pseudomonas putida KT2440
gcacagguccagccg

SEQ ID NO: 1597291 - RNA, 21 nt, Pseudomonas putida KT2440
gcacagggucaggucaaagcg

SEQ ID NO: 1597292 - RNA, 20 nt, Pseudomonas putida KT2440
gcaacaguuuucaaugcugc

SEQ ID NO: 1597293 - RNA, 19 nt, Pseudomonas putida KT2440
gcaacagggcgcuugcccg

SEQ ID NO: 1597294 - RNA, 21 nt, Pseudomonas putida KT2440
gcaacaucgaucuggugacug

SEQ ID NO: 1597295 - RNA, 22 nt, Pseudomonas putida KT2440
gcaauuucauccacauaggcca

SEQ ID NO: 1597296 - RNA, 13 nt, Pseudomonas putida KT2440
gcacaaucagcuc

SEQ ID NO: 1597297 - RNA, 14 nt, Pseudomonas putida KT2440
gccgaggcguuggc

SEQ ID NO: 1597298 - RNA, 21 nt, Pseudomonas putida KT2440
gccgagcgccgugcucggccu

SEQ ID NO: 1597299 - RNA, 18 nt, Pseudomonas putida KT2440
gccgaggacauaccacac

SEQ ID NO: 1597300 - RNA, 12 nt, Pseudomonas putida KT2440
gccgagggcaug

SEQ ID NO: 1597301 - RNA, 14 nt, Pseudomonas putida KT2440
gccgagggcauggg

SEQ ID NO: 1597302 - RNA, 16 nt, Pseudomonas putida KT2440
gccgagggcaugggcc

SEQ ID NO: 1597303 - RNA, 23 nt, Pseudomonas putida KT2440
gccgagggcaugggccacuucgc

SEQ ID NO: 1597304 - RNA, 19 nt, Pseudomonas putida KT2440
gccgaguaaccggcggcga

SEQ ID NO: 1597305 - RNA, 19 nt, Pseudomonas putida KT2440
gccgaucgaagcagcagcu

SEQ ID NO: 1597306 - RNA, 21 nt, Pseudomonas putida KT2440
gccgaugcccaccuuggcggu

SEQ ID NO: 1597307 - RNA, 14 nt, Pseudomonas putida KT2440
gccgaugccgucga

SEQ ID NO: 1597308 - RNA, 23 nt, Pseudomonas putida KT2440
gccgaugccgucgauuuugcagu

SEQ ID NO: 1597309 - RNA, 17 nt, Pseudomonas putida KT2440
gccgaucuucaggcuga

SEQ ID NO: 1597310 - RNA, 18 nt, Pseudomonas putida KT2440
gccgaugaagcaggccga

SEQ ID NO: 1597311 - RNA, 18 nt, Pseudomonas putida KT2440
gccgaugaccugcgucag

SEQ ID NO: 1597312 - RNA, 15 nt, Pseudomonas putida KT2440
gccgccacgaccacg

SEQ ID NO: 1597313 - RNA, 13 nt, Pseudomonas putida KT2440
gccgccacgaucg

SEQ ID NO: 1597314 - RNA, 13 nt, Pseudomonas putida KT2440
gccgccaccaucg

SEQ ID NO: 1597315 - RNA, 23 nt, Pseudomonas putida KT2440
gccgccaccaucgacucacgcuc

SEQ ID NO: 1597316 - RNA, 13 nt, Pseudomonas putida KT2440
gccgccaccagcg

SEQ ID NO: 1597317 - RNA, 22 nt, Pseudomonas putida KT2440
gccgcaucguuauccagcaccc

SEQ ID NO: 1597318 - RNA, 21 nt, Pseudomonas putida KT2440
gccgaugucggcgugcaccac

SEQ ID NO: 1597319 - RNA, 21 nt, Pseudomonas putida KT2440
aagcacgucgcgauugaucag

SEQ ID NO: 1597320 - RNA, 20 nt, Pseudomonas putida KT2440
aagcaccgccacaauccgcu

SEQ ID NO: 1597321 - RNA, 19 nt, Pseudomonas putida KT2440
gccgcaaccgggucggcgc

SEQ ID NO: 1597322 - RNA, 22 nt, Pseudomonas putida KT2440
aagcaacuguuggaauggcgca

SEQ ID NO: 1597323 - RNA, 23 nt, Pseudomonas putida KT2440
aagcaacuguuggaauggcgcac

SEQ ID NO: 1597324 - RNA, 12 nt, Pseudomonas putida KT2440
gccgcaccugcc

SEQ ID NO: 1597325 - RNA, 14 nt, Pseudomonas putida KT2440
gccgcaaggcggcc

SEQ ID NO: 1597326 - RNA, 16 nt, Pseudomonas putida KT2440
gccgcaacgcggcccu

SEQ ID NO: 1597327 - RNA, 20 nt, Pseudomonas putida KT2440
aagcagacagcugugcugcc

SEQ ID NO: 1597328 - RNA, 13 nt, Pseudomonas putida KT2440
gcccugcccucga

SEQ ID NO: 1597329 - RNA, 17 nt, Pseudomonas putida KT2440
gcccugccgaggccaug

SEQ ID NO: 1597330 - RNA, 13 nt, Pseudomonas putida KT2440
gcccugcgccugc

SEQ ID NO: 1597331 - RNA, 20 nt, Pseudomonas putida KT2440
gcccugcucuucgauccgcg

SEQ ID NO: 1597332 - RNA, 15 nt, Pseudomonas putida KT2440
gcccugcucacgcag

SEQ ID NO: 1597333 - RNA, 16 nt, Pseudomonas putida KT2440
gcccugcucgccaaau

SEQ ID NO: 1597334 - RNA, 14 nt, Pseudomonas putida KT2440
gcccugugggagcg

SEQ ID NO: 1597335 - RNA, 21 nt, Pseudomonas putida KT2440
gcccugugggagcgggcaugc

SEQ ID NO: 1597336 - RNA, 20 nt, Pseudomonas putida KT2440
gcccuguguaggagcggguu

SEQ ID NO: 1597337 - RNA, 18 nt, Pseudomonas putida KT2440
gcccuguuucuucaaggc

SEQ ID NO: 1597338 - RNA, 22 nt, Pseudomonas putida KT2440
gcccugugcuuugagcaggcgc

SEQ ID NO: 1597339 - RNA, 14 nt, Pseudomonas putida KT2440
gcccuucgcgggca

SEQ ID NO: 1597340 - RNA, 19 nt, Pseudomonas putida KT2440
gcccuucgcgggugaaccc

SEQ ID NO: 1597341 - RNA, 14 nt, Pseudomonas putida KT2440
gcccuucgcaggca

SEQ ID NO: 1597342 - RNA, 18 nt, Pseudomonas putida KT2440
gcccuucauacagcgccu

SEQ ID NO: 1597343 - RNA, 23 nt, Pseudomonas putida KT2440
gcccugggguuuuuuuggcuggu

SEQ ID NO: 1597344 - RNA, 13 nt, Pseudomonas putida KT2440
gcccuggcgacga

SEQ ID NO: 1597345 - RNA, 13 nt, Pseudomonas putida KT2440
gcccuggcaugcu

SEQ ID NO: 1597346 - RNA, 22 nt, Pseudomonas putida KT2440
gcccucuuccgcacgggucacc

SEQ ID NO: 1597347 - RNA, 24 nt, Pseudomonas putida KT2440
gcccucuugcugcaacagcuccag

SEQ ID NO: 1597348 - RNA, 20 nt, Pseudomonas putida KT2440
gcccucguucgcgggcacgc

SEQ ID NO: 1597349 - RNA, 18 nt, Pseudomonas putida KT2440
gcccugacgccagcgcug

SEQ ID NO: 1597350 - RNA, 14 nt, Pseudomonas putida KT2440
gcccugaucgccuc

SEQ ID NO: 1597351 - RNA, 23 nt, Pseudomonas putida KT2440
gcccugaucgccuccaggcguug

SEQ ID NO: 1597352 - RNA, 14 nt, Pseudomonas putida KT2440
gcccugaaggccgc

SEQ ID NO: 1597353 - RNA, 22 nt, Pseudomonas putida KT2440
gcccugacaggcgaucagucag

SEQ ID NO: 1597354 - RNA, 18 nt, Pseudomonas putida KT2440
gcccugagccaaggccgc

SEQ ID NO: 1597355 - RNA, 23 nt, Pseudomonas putida KT2440
gcccucgcggcggcuaagcgcca

SEQ ID NO: 1597356 - RNA, 22 nt, Pseudomonas putida KT2440
gcccucggccggggccaggcgc

SEQ ID NO: 1597357 - RNA, 18 nt, Pseudomonas putida KT2440
gcccuccuaucgcgacac

SEQ ID NO: 1597358 - RNA, 22 nt, Pseudomonas putida KT2440
gcccgcugcagucaaagccuuu

SEQ ID NO: 1597359 - RNA, 19 nt, Pseudomonas putida KT2440
gcccucgacaaucgccagg

SEQ ID NO: 1597360 - RNA, 20 nt, Pseudomonas putida KT2440
gcccucgacaaucgccaggu

SEQ ID NO: 1597361 - RNA, 21 nt, Pseudomonas putida KT2440
gcccucgacaaucgccaggua

SEQ ID NO: 1597362 - RNA, 23 nt, Pseudomonas putida KT2440
gcccucgacaaucgccagguaca

SEQ ID NO: 1597363 - RNA, 22 nt, Pseudomonas putida KT2440
gcccucgaugucuuccagacca

SEQ ID NO: 1597364 - RNA, 14 nt, Pseudomonas putida KT2440
gcccgcucucacag

SEQ ID NO: 1597365 - RNA, 16 nt, Pseudomonas putida KT2440
gcccgcucucacaggg

SEQ ID NO: 1597366 - RNA, 20 nt, Pseudomonas putida KT2440
gcccgcugaaacaucagccg

SEQ ID NO: 1597367 - RNA, 19 nt, Pseudomonas putida KT2440
gcccgcuccuacagguucu

SEQ ID NO: 1597368 - RNA, 19 nt, Pseudomonas putida KT2440
gcccgcucccacaggaauu

SEQ ID NO: 1597369 - RNA, 18 nt, Pseudomonas putida KT2440
gcccgcucccacagguaa

SEQ ID NO: 1597370 - RNA, 22 nt, Pseudomonas putida KT2440
gcccgcucccacagguaaugca

SEQ ID NO: 1597371 - RNA, 19 nt, Pseudomonas putida KT2440
gcccgcucccacagguacu

SEQ ID NO: 1597372 - RNA, 20 nt, Pseudomonas putida KT2440
gcccgcucccacagguacuc

SEQ ID NO: 1597373 - RNA, 20 nt, Pseudomonas putida KT2440
gcccgcucccacagguucgg

SEQ ID NO: 1597374 - RNA, 22 nt, Pseudomonas putida KT2440
gcccgcuccgacauugaucggc

SEQ ID NO: 1597375 - RNA, 23 nt, Pseudomonas putida KT2440
gccgacaucgaagcagugcugcc

SEQ ID NO: 1597376 - RNA, 17 nt, Pseudomonas putida KT2440
gccgacagccucaaggc

SEQ ID NO: 1597377 - RNA, 19 nt, Pseudomonas putida KT2440
gccgacagccucaaggccg

SEQ ID NO: 1597378 - RNA, 20 nt, Pseudomonas putida KT2440
gccgacagccucaaggccgg

SEQ ID NO: 1597379 - RNA, 16 nt, Pseudomonas putida KT2440
gccgacagcggcgaag

SEQ ID NO: 1597380 - RNA, 12 nt, Pseudomonas putida KT2440
gccgaccaggug

SEQ ID NO: 1597381 - RNA, 14 nt, Pseudomonas putida KT2440
gccgaccagguggu

SEQ ID NO: 1597382 - RNA, 18 nt, Pseudomonas putida KT2440
gccgaccaguaccacagc

SEQ ID NO: 1597383 - RNA, 19 nt, Pseudomonas putida KT2440
gccgacgaucaguaccggc

SEQ ID NO: 1597384 - RNA, 15 nt, Pseudomonas putida KT2440
gccgacgauaccgcc

SEQ ID NO: 1597385 - RNA, 21 nt, Pseudomonas putida KT2440
gccgaccuugggccggcgcag

SEQ ID NO: 1597386 - RNA, 20 nt, Pseudomonas putida KT2440
gccgaacuugccgaugaacg

SEQ ID NO: 1597387 - RNA, 22 nt, Pseudomonas putida KT2440
gccgaacucuggcaacagcuca

SEQ ID NO: 1597388 - RNA, 15 nt, Pseudomonas putida KT2440
gccgaaggcgcuggc

SEQ ID NO: 1597389 - RNA, 20 nt, Pseudomonas putida KT2440
gcccuugcugcagcaggcug

SEQ ID NO: 1597390 - RNA, 17 nt, Pseudomonas putida KT2440
gcccuuggcagcgcugc

SEQ ID NO: 1597391 - RNA, 21 nt, Pseudomonas putida KT2440
gcccuuggcagcgcugcaagc

SEQ ID NO: 1597392 - RNA, 16 nt, Pseudomonas putida KT2440
gcccuugucgaacagc

SEQ ID NO: 1597393 - RNA, 22 nt, Pseudomonas putida KT2440
gcccuugagcuucagcgcgcca

SEQ ID NO: 1597394 - RNA, 15 nt, Pseudomonas putida KT2440
gcccuucugaaaggc

SEQ ID NO: 1597395 - RNA, 16 nt, Pseudomonas putida KT2440
gccgaacagcaggcaa

SEQ ID NO: 1597396 - RNA, 14 nt, Pseudomonas putida KT2440
gcccuuucgcgggu

SEQ ID NO: 1597397 - RNA, 19 nt, Pseudomonas putida KT2440
gcccuuucgcggguaaacc

SEQ ID NO: 1597398 - RNA, 22 nt, Pseudomonas putida KT2440
gccgccuccaccgggauggcgg

SEQ ID NO: 1597399 - RNA, 16 nt, Pseudomonas putida KT2440
gccgccuccugcugcu

SEQ ID NO: 1597400 - RNA, 17 nt, Pseudomonas putida KT2440
gccgccuccugcugcug

SEQ ID NO: 1597401 - RNA, 20 nt, Pseudomonas putida KT2440
gccgccuccugcugcugcau

SEQ ID NO: 1597402 - RNA, 22 nt, Pseudomonas putida KT2440
gccgccugguugcguucgucga

SEQ ID NO: 1597403 - RNA, 23 nt, Pseudomonas putida KT2440
gccgccugguugcguucgucgau

SEQ ID NO: 1597404 - RNA, 24 nt, Pseudomonas putida KT2440
gccgccugguugcguucgucgaug

SEQ ID NO: 1597405 - RNA, 18 nt, Pseudomonas putida KT2440
gccgccugucgcgacggg

SEQ ID NO: 1597406 - RNA, 23 nt, Pseudomonas putida KT2440
gccgccuucggacucgacgucgu

SEQ ID NO: 1597407 - RNA, 17 nt, Pseudomonas putida KT2440
gccgccuucgccaaggu

SEQ ID NO: 1597408 - RNA, 22 nt, Pseudomonas putida KT2440
gccgccugggucaaccccaggu

SEQ ID NO: 1597409 - RNA, 14 nt, Pseudomonas putida KT2440
gccgcgaagcggcg

SEQ ID NO: 1597410 - RNA, 21 nt, Pseudomonas putida KT2440
gccgcgacuggaacgauaccg

SEQ ID NO: 1597411 - RNA, 15 nt, Pseudomonas putida KT2440
gccgcgccaggucgg

SEQ ID NO: 1597412 - RNA, 20 nt, Pseudomonas putida KT2440
gccgcgccaccgggcgcgau

SEQ ID NO: 1597413 - RNA, 18 nt, Pseudomonas putida KT2440
gccgcgccaccgaucucg

SEQ ID NO: 1597414 - RNA, 20 nt, Pseudomonas putida KT2440
gccgcgcaugcugugcccug

SEQ ID NO: 1597415 - RNA, 12 nt, Pseudomonas putida KT2440
gccgcgcagccc

SEQ ID NO: 1597416 - RNA, 13 nt, Pseudomonas putida KT2440
gccgcgcagccca

SEQ ID NO: 1597417 - RNA, 16 nt, Pseudomonas putida KT2440
gccgcgcagccuuuga

SEQ ID NO: 1597418 - RNA, 15 nt, Pseudomonas putida KT2440
gccgccagacaacug

SEQ ID NO: 1597419 - RNA, 22 nt, Pseudomonas putida KT2440
gccgccagacaacuggccaggg

SEQ ID NO: 1597420 - RNA, 21 nt, Pseudomonas putida KT2440
gccgccacuaccguauucgcg

SEQ ID NO: 1597421 - RNA, 18 nt, Pseudomonas putida KT2440
gccgccgagugcgcggaa

SEQ ID NO: 1597422 - RNA, 15 nt, Pseudomonas putida KT2440
gccgccgaggcaccg

SEQ ID NO: 1597423 - RNA, 13 nt, Pseudomonas putida KT2440
gccgccgauaccg

SEQ ID NO: 1597424 - RNA, 16 nt, Pseudomonas putida KT2440
gccgccgauagcagca

SEQ ID NO: 1597425 - RNA, 19 nt, Pseudomonas putida KT2440
gccgccgauagcagcaccg

SEQ ID NO: 1597426 - RNA, 17 nt, Pseudomonas putida KT2440
gccgccgcugcgaggau

SEQ ID NO: 1597427 - RNA, 14 nt, Pseudomonas putida KT2440
gccgccgcugacca

SEQ ID NO: 1597428 - RNA, 14 nt, Pseudomonas putida KT2440
gccgccgcugccag

SEQ ID NO: 1597429 - RNA, 13 nt, Pseudomonas putida KT2440
gccgccggcaacu

SEQ ID NO: 1597430 - RNA, 16 nt, Pseudomonas putida KT2440
gccgccggcaacuggc

SEQ ID NO: 1597431 - RNA, 21 nt, Pseudomonas putida KT2440
gccgccguucaggcgccugcc

SEQ ID NO: 1597432 - RNA, 21 nt, Pseudomonas putida KT2440
gccgccgguuucucgcagcag

SEQ ID NO: 1597433 - RNA, 19 nt, Pseudomonas putida KT2440
gccgcgcgcccgcugaccg

SEQ ID NO: 1597434 - RNA, 20 nt, Pseudomonas putida KT2440
gccgcgcgcccgcugaccgg

SEQ ID NO: 1597435 - RNA, 20 nt, Pseudomonas putida KT2440
gccgcgcccucuuccgcacg

SEQ ID NO: 1597436 - RNA, 15 nt, Pseudomonas putida KT2440
gccgcgcugacgcag

SEQ ID NO: 1597437 - RNA, 20 nt, Pseudomonas putida KT2440
gccgcgcugacgcagggccu

SEQ ID NO: 1597438 - RNA, 19 nt, Pseudomonas putida KT2440
gccgcgcugauaucgauac

SEQ ID NO: 1597439 - RNA, 15 nt, Pseudomonas putida KT2440
gccgcgcucgguuga

SEQ ID NO: 1597440 - RNA, 13 nt, Pseudomonas putida KT2440
gccgcggcaccca

SEQ ID NO: 1597441 - RNA, 17 nt, Pseudomonas putida KT2440
gccgcggauguggugga

SEQ ID NO: 1597442 - RNA, 14 nt, Pseudomonas putida KT2440
gccgcucgauaugc

SEQ ID NO: 1597443 - RNA, 20 nt, Pseudomonas putida KT2440
gccgcucgauaugccgccgu

SEQ ID NO: 1597444 - RNA, 21 nt, Pseudomonas putida KT2440
gccgcucgagaaacgccagcu

SEQ ID NO: 1597445 - RNA, 18 nt, Pseudomonas putida KT2440
gccgcucugcggcccauu

SEQ ID NO: 1597446 - RNA, 23 nt, Pseudomonas putida KT2440
gccgcuccugcggucagccugcg

SEQ ID NO: 1597447 - RNA, 18 nt, Pseudomonas putida KT2440
gccgcucccacagguaau

SEQ ID NO: 1597448 - RNA, 20 nt, Pseudomonas putida KT2440
gccgcucccacagguaauac

SEQ ID NO: 1597449 - RNA, 19 nt, Pseudomonas putida KT2440
gccgcuaggcggccccauu

SEQ ID NO: 1597450 - RNA, 19 nt, Pseudomonas putida KT2440
gccgcguucgcccaggcgc

SEQ ID NO: 1597451 - RNA, 16 nt, Pseudomonas putida KT2440
gccgcguugcggcccu

SEQ ID NO: 1597452 - RNA, 19 nt, Pseudomonas putida KT2440
gccgcgggcgucgcgauca

SEQ ID NO: 1597453 - RNA, 16 nt, Pseudomonas putida KT2440
gccgcggguaccaccu

SEQ ID NO: 1597454 - RNA, 18 nt, Pseudomonas putida KT2440
gccgcgguagugcggccg

SEQ ID NO: 1597455 - RNA, 21 nt, Pseudomonas putida KT2440
gccgcgguagugcggccgggu

SEQ ID NO: 1597456 - RNA, 13 nt, Pseudomonas putida KT2440
gccccugcggcug

SEQ ID NO: 1597457 - RNA, 22 nt, Pseudomonas putida KT2440
gccccugcaacagggcgcuugc

SEQ ID NO: 1597458 - RNA, 15 nt, Pseudomonas putida KT2440
gccccugugggagcg

SEQ ID NO: 1597459 - RNA, 15 nt, Pseudomonas putida KT2440
gccccuguaggaucg

SEQ ID NO: 1597460 - RNA, 19 nt, Pseudomonas putida KT2440
gccccuguaggaucggguu

SEQ ID NO: 1597461 - RNA, 16 nt, Pseudomonas putida KT2440
gccccucgaucaacgu

SEQ ID NO: 1597462 - RNA, 15 nt, Pseudomonas putida KT2440
gccccugcgccgcca

SEQ ID NO: 1597463 - RNA, 23 nt, Pseudomonas putida KT2440
gccccugccagcaccagcgcgau

SEQ ID NO: 1597464 - RNA, 12 nt, Pseudomonas putida KT2440
gcccgaucgccu

SEQ ID NO: 1597465 - RNA, 13 nt, Pseudomonas putida KT2440
gcccgaucagcca

SEQ ID NO: 1597466 - RNA, 18 nt, Pseudomonas putida KT2440
gcccgaucaccgacgugu

SEQ ID NO: 1597467 - RNA, 15 nt, Pseudomonas putida KT2440
gcccgauggccuuga

SEQ ID NO: 1597468 - RNA, 15 nt, Pseudomonas putida KT2440
gcccgaugggcgucg

SEQ ID NO: 1597469 - RNA, 18 nt, Pseudomonas putida KT2440
gcccgcaacaccaggaca

SEQ ID NO: 1597470 - RNA, 19 nt, Pseudomonas putida KT2440
gcccgcaacauaaggugca

SEQ ID NO: 1597471 - RNA, 23 nt, Pseudomonas putida KT2440
gcccgcaaccgaugaacccgcga

SEQ ID NO: 1597472 - RNA, 15 nt, Pseudomonas putida KT2440
gcccgcaagggucug

SEQ ID NO: 1597473 - RNA, 23 nt, Pseudomonas putida KT2440
gcccgcacagcacguucagcggg

SEQ ID NO: 1597474 - RNA, 16 nt, Pseudomonas putida KT2440
gcccgcagcgcuucga

SEQ ID NO: 1597475 - RNA, 18 nt, Pseudomonas putida KT2440
gcccgcagcuucaacucc

SEQ ID NO: 1597476 - RNA, 22 nt, Pseudomonas putida KT2440
gcccgcagcuucaacuccacca

SEQ ID NO: 1597477 - RNA, 11 nt, Pseudomonas putida KT2440
gcccgcaucgu

SEQ ID NO: 1597478 - RNA, 23 nt, Pseudomonas putida KT2440
gcccgcaguacuuauaagcagca

SEQ ID NO: 1597479 - RNA, 14 nt, Pseudomonas putida KT2440
gcccgccaugcaac

SEQ ID NO: 1597480 - RNA, 22 nt, Pseudomonas putida KT2440
gcccgcccacgccgcugguaca

SEQ ID NO: 1597481 - RNA, 15 nt, Pseudomonas putida KT2440
gcccgccaggcgcaa

SEQ ID NO: 1597482 - RNA, 22 nt, Pseudomonas putida KT2440
gcccgccaggcgcaagccuucg

SEQ ID NO: 1597483 - RNA, 17 nt, Pseudomonas putida KT2440
gcccgcggcccacagug

SEQ ID NO: 1597484 - RNA, 12 nt, Pseudomonas putida KT2440
gcccgcggcuca

SEQ ID NO: 1597485 - RNA, 18 nt, Pseudomonas putida KT2440
gcccgcgugcgcccagau

SEQ ID NO: 1597486 - RNA, 18 nt, Pseudomonas putida KT2440
gcccgcgucugccgcagc

SEQ ID NO: 1597487 - RNA, 21 nt, Pseudomonas putida KT2440
gcccgcgucugccgcagcccc

SEQ ID NO: 1597488 - RNA, 17 nt, Pseudomonas putida KT2440
gcccgcuaagaggucgg

SEQ ID NO: 1597489 - RNA, 18 nt, Pseudomonas putida KT2440
gcccgcgugcuucaagcc

SEQ ID NO: 1597490 - RNA, 18 nt, Pseudomonas putida KT2440
gcccgcguucaugccggc

SEQ ID NO: 1597491 - RNA, 15 nt, Pseudomonas putida KT2440
gcccgcgaggaggcc

SEQ ID NO: 1597492 - RNA, 23 nt, Pseudomonas putida KT2440
gcccgcgaggaggccggggaugc

SEQ ID NO: 1597493 - RNA, 14 nt, Pseudomonas putida KT2440
gcccgcgaaucgcc

SEQ ID NO: 1597494 - RNA, 15 nt, Pseudomonas putida KT2440
gcccgcgaaugggcc

SEQ ID NO: 1597495 - RNA, 14 nt, Pseudomonas putida KT2440
gcccgcgaagaggc

SEQ ID NO: 1597496 - RNA, 21 nt, Pseudomonas putida KT2440
gcccgcgaagaggccggcacu

SEQ ID NO: 1597497 - RNA, 23 nt, Pseudomonas putida KT2440
gcccgcgaagaggccggcacugg

SEQ ID NO: 1597498 - RNA, 21 nt, Pseudomonas putida KT2440
gcccgcgaagggccgcgaagc

SEQ ID NO: 1597499 - RNA, 19 nt, Pseudomonas putida KT2440
gcccgcgaagggcucaaca

SEQ ID NO: 1597500 - RNA, 18 nt, Pseudomonas putida KT2440
gcccgcgaacacgggcga

SEQ ID NO: 1597501 - RNA, 12 nt, Pseudomonas putida KT2440
gcccgcgaaaug

SEQ ID NO: 1597502 - RNA, 18 nt, Pseudomonas putida KT2440
gcccgcgcaaaucgccgc

SEQ ID NO: 1597503 - RNA, 15 nt, Pseudomonas putida KT2440
gcccgcccagcuggc

SEQ ID NO: 1597504 - RNA, 21 nt, Pseudomonas putida KT2440
gcccgccccccaccuggcccu

SEQ ID NO: 1597505 - RNA, 13 nt, Pseudomonas putida KT2440
gcccccgccgaag

SEQ ID NO: 1597506 - RNA, 14 nt, Pseudomonas putida KT2440
gccccccagccagc

SEQ ID NO: 1597507 - RNA, 15 nt, Pseudomonas putida KT2440
gccccccagccagca

SEQ ID NO: 1597508 - RNA, 23 nt, Pseudomonas putida KT2440
gccccccaggcggugaguguucu

SEQ ID NO: 1597509 - RNA, 20 nt, Pseudomonas putida KT2440
gccccccuguaggagcgggu

SEQ ID NO: 1597510 - RNA, 16 nt, Pseudomonas putida KT2440
aagacgaagcgcuugg

SEQ ID NO: 1597511 - RNA, 19 nt, Pseudomonas putida KT2440
gccccucgaccacgcacag

SEQ ID NO: 1597512 - RNA, 14 nt, Pseudomonas putida KT2440
gccccuacgcuggu

SEQ ID NO: 1597513 - RNA, 14 nt, Pseudomonas putida KT2440
gccccuaccgccaa

SEQ ID NO: 1597514 - RNA, 16 nt, Pseudomonas putida KT2440
gccccguccacagcga

SEQ ID NO: 1597515 - RNA, 19 nt, Pseudomonas putida KT2440
gccccgugcccgaucaccg

SEQ ID NO: 1597516 - RNA, 14 nt, Pseudomonas putida KT2440
gccccgggugcagc

SEQ ID NO: 1597517 - RNA, 19 nt, Pseudomonas putida KT2440
gccccgguacgacgcacca

SEQ ID NO: 1597518 - RNA, 16 nt, Pseudomonas putida KT2440
gccccgguccagcaca

SEQ ID NO: 1597519 - RNA, 21 nt, Pseudomonas putida KT2440
gccccggcuaucucaggccag

SEQ ID NO: 1597520 - RNA, 18 nt, Pseudomonas putida KT2440
gccccgggcaggccaugc

SEQ ID NO: 1597521 - RNA, 21 nt, Pseudomonas putida KT2440
gccccggcgccgccaggcagc

SEQ ID NO: 1597522 - RNA, 18 nt, Pseudomonas putida KT2440
gcccauccaacgcaucca

SEQ ID NO: 1597523 - RNA, 14 nt, Pseudomonas putida KT2440
gcccaucagcgccg

SEQ ID NO: 1597524 - RNA, 20 nt, Pseudomonas putida KT2440
gcccaucaggaacagcucga

SEQ ID NO: 1597525 - RNA, 14 nt, Pseudomonas putida KT2440
gcccaucaccggca

SEQ ID NO: 1597526 - RNA, 14 nt, Pseudomonas putida KT2440
gcccauagcgccau

SEQ ID NO: 1597527 - RNA, 21 nt, Pseudomonas putida KT2440
gcccauaaaagccucagcgcc

SEQ ID NO: 1597528 - RNA, 23 nt, Pseudomonas putida KT2440
gcccauaaaagccucagcgcccg

SEQ ID NO: 1597529 - RNA, 14 nt, Pseudomonas putida KT2440
gccccaccaggcac

SEQ ID NO: 1597530 - RNA, 14 nt, Pseudomonas putida KT2440
gccccaauggcgaa

SEQ ID NO: 1597531 - RNA, 22 nt, Pseudomonas putida KT2440
gccccacaauaagaugcggcgc

SEQ ID NO: 1597532 - RNA, 19 nt, Pseudomonas putida KT2440
gcccaucgcauaugcccca

SEQ ID NO: 1597533 - RNA, 16 nt, Pseudomonas putida KT2440
gcccaucucaggccca

SEQ ID NO: 1597534 - RNA, 19 nt, Pseudomonas putida KT2440
gccccacucgcgcagcaca

SEQ ID NO: 1597535 - RNA, 14 nt, Pseudomonas putida KT2440
gccccacucggcgc

SEQ ID NO: 1597536 - RNA, 16 nt, Pseudomonas putida KT2440
gccccacuuccagcga

SEQ ID NO: 1597537 - RNA, 21 nt, Pseudomonas putida KT2440
gccccagcgccuuggccugcu

SEQ ID NO: 1597538 - RNA, 19 nt, Pseudomonas putida KT2440
gccccagggaucgaugccc

SEQ ID NO: 1597539 - RNA, 21 nt, Pseudomonas putida KT2440
gccccagggaucgaugcccug

SEQ ID NO: 1597540 - RNA, 15 nt, Pseudomonas putida KT2440
gccccagggcccuca

SEQ ID NO: 1597541 - RNA, 15 nt, Pseudomonas putida KT2440
gccccaggcggugca

SEQ ID NO: 1597542 - RNA, 22 nt, Pseudomonas putida KT2440
gccccagcaucaacgcugccau

SEQ ID NO: 1597543 - RNA, 17 nt, Pseudomonas putida KT2440
gccccagcgucacccgu

SEQ ID NO: 1597544 - RNA, 19 nt, Pseudomonas putida KT2440
gccccagcgcgccagcagg

SEQ ID NO: 1597545 - RNA, 17 nt, Pseudomonas putida KT2440
gccccagcggcagcagc

SEQ ID NO: 1597546 - RNA, 17 nt, Pseudomonas putida KT2440
gcccagcgccaccggca

SEQ ID NO: 1597547 - RNA, 19 nt, Pseudomonas putida KT2440
gcccagcgccaccggcagc

SEQ ID NO: 1597548 - RNA, 22 nt, Pseudomonas putida KT2440
gcccagcgccaccggcagcaag

SEQ ID NO: 1597549 - RNA, 21 nt, Pseudomonas putida KT2440
gcccagcccggacugcaccag

SEQ ID NO: 1597550 - RNA, 20 nt, Pseudomonas putida KT2440
gcccagccaucgagcaccgg

SEQ ID NO: 1597551 - RNA, 15 nt, Pseudomonas putida KT2440
gcccaggaucacugg

SEQ ID NO: 1597552 - RNA, 17 nt, Pseudomonas putida KT2440
gcccagcuucuccagca

SEQ ID NO: 1597553 - RNA, 20 nt, Pseudomonas putida KT2440
gcccagcuucuccagcaagc

SEQ ID NO: 1597554 - RNA, 22 nt, Pseudomonas putida KT2440
gcccagcucgcuggccaccagc

SEQ ID NO: 1597555 - RNA, 19 nt, Pseudomonas putida KT2440
gcccagcuggagacgaaca

SEQ ID NO: 1597556 - RNA, 21 nt, Pseudomonas putida KT2440
gcccagcugaagugccaaggc

SEQ ID NO: 1597557 - RNA, 22 nt, Pseudomonas putida KT2440
gcccagcugaagugccaaggcu

SEQ ID NO: 1597558 - RNA, 16 nt, Pseudomonas putida KT2440
gcccagcagcaacgca

SEQ ID NO: 1597559 - RNA, 17 nt, Pseudomonas putida KT2440
gcccagccaacccucga

SEQ ID NO: 1597560 - RNA, 22 nt, Pseudomonas putida KT2440
gcccagccaacccucgaccucg

SEQ ID NO: 1597561 - RNA, 19 nt, Pseudomonas putida KT2440
gcccagcagguacaccgcc

SEQ ID NO: 1597562 - RNA, 21 nt, Pseudomonas putida KT2440
gcccagcagguagacgaugcc

SEQ ID NO: 1597563 - RNA, 16 nt, Pseudomonas putida KT2440
gcccagaucagcagca

SEQ ID NO: 1597564 - RNA, 18 nt, Pseudomonas putida KT2440
gcccagaucagcagcacc

SEQ ID NO: 1597565 - RNA, 19 nt, Pseudomonas putida KT2440
gcccagaucagcagcaccg

SEQ ID NO: 1597566 - RNA, 22 nt, Pseudomonas putida KT2440
gcccagauagccauugcggcug

SEQ ID NO: 1597567 - RNA, 15 nt, Pseudomonas putida KT2440
gcccacucaauacuc

SEQ ID NO: 1597568 - RNA, 19 nt, Pseudomonas putida KT2440
gcccacuucugcggccagg

SEQ ID NO: 1597569 - RNA, 19 nt, Pseudomonas putida KT2440
gcccacggcgauggucugc

SEQ ID NO: 1597570 - RNA, 15 nt, Pseudomonas putida KT2440
gcccacgccggcaac

SEQ ID NO: 1597571 - RNA, 14 nt, Pseudomonas putida KT2440
gcccacgccuucca

SEQ ID NO: 1597572 - RNA, 21 nt, Pseudomonas putida KT2440
gcccacgcucuguaucgaaca

SEQ ID NO: 1597573 - RNA, 22 nt, Pseudomonas putida KT2440
gcccaccuuggcggugaucgag

SEQ ID NO: 1597574 - RNA, 19 nt, Pseudomonas putida KT2440
gcccacgaucucacgcgcc

SEQ ID NO: 1597575 - RNA, 23 nt, Pseudomonas putida KT2440
gcccacgaucucacgcgccacau

SEQ ID NO: 1597576 - RNA, 14 nt, Pseudomonas putida KT2440
gcccaccuucacgc

SEQ ID NO: 1597577 - RNA, 18 nt, Pseudomonas putida KT2440
gcccaccuucacgccauu

SEQ ID NO: 1597578 - RNA, 14 nt, Pseudomonas putida KT2440
gccauuucuucagc

SEQ ID NO: 1597579 - RNA, 17 nt, Pseudomonas putida KT2440
gccauugcaccacgcca

SEQ ID NO: 1597580 - RNA, 20 nt, Pseudomonas putida KT2440
gccauugaggaaguagaaca

SEQ ID NO: 1597581 - RNA, 20 nt, Pseudomonas putida KT2440
gccauugaggcuguggccca

SEQ ID NO: 1597582 - RNA, 22 nt, Pseudomonas putida KT2440
gccauucguccgaccaacggua

SEQ ID NO: 1597583 - RNA, 14 nt, Pseudomonas putida KT2440
gccauucaucaucg

SEQ ID NO: 1597584 - RNA, 16 nt, Pseudomonas putida KT2440
gccauuccggcugcag

SEQ ID NO: 1597585 - RNA, 15 nt, Pseudomonas putida KT2440
gccauugacccgcuu

SEQ ID NO: 1597586 - RNA, 18 nt, Pseudomonas putida KT2440
gccauugacccgcuugca

SEQ ID NO: 1597587 - RNA, 18 nt, Pseudomonas putida KT2440
gccauugacuaccaggua

SEQ ID NO: 1597588 - RNA, 17 nt, Pseudomonas putida KT2440
gccauucgcgggcaugc

SEQ ID NO: 1597589 - RNA, 14 nt, Pseudomonas putida KT2440
gccaugugcuggcg

SEQ ID NO: 1597590 - RNA, 22 nt, Pseudomonas putida KT2440
gccaugugcacacgcaacugau

SEQ ID NO: 1597591 - RNA, 14 nt, Pseudomonas putida KT2440
gccauguugcgcag

SEQ ID NO: 1597592 - RNA, 16 nt, Pseudomonas putida KT2440
gccauguugcgcagca

SEQ ID NO: 1597593 - RNA, 15 nt, Pseudomonas putida KT2440
gccaugaucagcgcc

SEQ ID NO: 1597594 - RNA, 14 nt, Pseudomonas putida KT2440
gccaugaucgccgc

SEQ ID NO: 1597595 - RNA, 13 nt, Pseudomonas putida KT2440
gccagucgcgcaa

SEQ ID NO: 1597596 - RNA, 18 nt, Pseudomonas putida KT2440
gccagucgcgcaacugcc

SEQ ID NO: 1597597 - RNA, 21 nt, Pseudomonas putida KT2440
gccagucgcgcaacugcccag

SEQ ID NO: 1597598 - RNA, 14 nt, Pseudomonas putida KT2440
gccaugcgcaggca

SEQ ID NO: 1597599 - RNA, 13 nt, Pseudomonas putida KT2440
gccaugcgcugca

SEQ ID NO: 1597600 - RNA, 14 nt, Pseudomonas putida KT2440
gccaugcgcugcag

SEQ ID NO: 1597601 - RNA, 18 nt, Pseudomonas putida KT2440
gccaugcugcgccaggau

SEQ ID NO: 1597602 - RNA, 15 nt, Pseudomonas putida KT2440
gcccaccgacagccc

SEQ ID NO: 1597603 - RNA, 21 nt, Pseudomonas putida KT2440
gcccaccagcugcaccaccug

SEQ ID NO: 1597604 - RNA, 15 nt, Pseudomonas putida KT2440
gcccaccagucugcu

SEQ ID NO: 1597605 - RNA, 20 nt, Pseudomonas putida KT2440
gcccaccacgaacgccccca

SEQ ID NO: 1597606 - RNA, 13 nt, Pseudomonas putida KT2440
gcccaccaccagc

SEQ ID NO: 1597607 - RNA, 19 nt, Pseudomonas putida KT2440
gcccaacauaucgcgaaac

SEQ ID NO: 1597608 - RNA, 14 nt, Pseudomonas putida KT2440
gcccaacccagcca

SEQ ID NO: 1597609 - RNA, 13 nt, Pseudomonas putida KT2440
gcccaaacagcau

SEQ ID NO: 1597610 - RNA, 13 nt, Pseudomonas putida KT2440
gcccaacagcgcg

SEQ ID NO: 1597611 - RNA, 19 nt, Pseudomonas putida KT2440
gcccaauacccaacagcau

SEQ ID NO: 1597612 - RNA, 17 nt, Pseudomonas putida KT2440
gcccaagccauccacca

SEQ ID NO: 1597613 - RNA, 21 nt, Pseudomonas putida KT2440
gcccaaggccugcaccauuug

SEQ ID NO: 1597614 - RNA, 17 nt, Pseudomonas putida KT2440
gcccacacggcaagcca

SEQ ID NO: 1597615 - RNA, 13 nt, Pseudomonas putida KT2440
gccacccgcucug

SEQ ID NO: 1597616 - RNA, 16 nt, Pseudomonas putida KT2440
gccacccggaccagcg

SEQ ID NO: 1597617 - RNA, 14 nt, Pseudomonas putida KT2440
gccacccgacgcca

SEQ ID NO: 1597618 - RNA, 14 nt, Pseudomonas putida KT2440
gccacccucgcacc

SEQ ID NO: 1597619 - RNA, 15 nt, Pseudomonas putida KT2440
gccacccucgcacca

SEQ ID NO: 1597620 - RNA, 13 nt, Pseudomonas putida KT2440
gccaccgaaggcg

SEQ ID NO: 1597621 - RNA, 18 nt, Pseudomonas putida KT2440
gccaccgacuccggcaag

SEQ ID NO: 1597622 - RNA, 16 nt, Pseudomonas putida KT2440
gccaccgccucggcua

SEQ ID NO: 1597623 - RNA, 12 nt, Pseudomonas putida KT2440
gccaccgccacu

SEQ ID NO: 1597624 - RNA, 12 nt, Pseudomonas putida KT2440
gccaccggcagc

SEQ ID NO: 1597625 - RNA, 16 nt, Pseudomonas putida KT2440
gccaccggcagcaccu

SEQ ID NO: 1597626 - RNA, 18 nt, Pseudomonas putida KT2440
gccaccggcagcaccugc

SEQ ID NO: 1597627 - RNA, 22 nt, Pseudomonas putida KT2440
gccaccggacagaaucgcgguc

SEQ ID NO: 1597628 - RNA, 16 nt, Pseudomonas putida KT2440
gccaccggcgcugcgu

SEQ ID NO: 1597629 - RNA, 16 nt, Pseudomonas putida KT2440
gccaccucgcuaccca

SEQ ID NO: 1597630 - RNA, 21 nt, Pseudomonas putida KT2440
gccaccuggccuuccagcugc

SEQ ID NO: 1597631 - RNA, 16 nt, Pseudomonas putida KT2440
gccacgccgccuucgg

SEQ ID NO: 1597632 - RNA, 22 nt, Pseudomonas putida KT2440
gccacgccugcagucgaucccg

SEQ ID NO: 1597633 - RNA, 19 nt, Pseudomonas putida KT2440
gccacgccggucgggcacu

SEQ ID NO: 1597634 - RNA, 16 nt, Pseudomonas putida KT2440
gccacgcuggcaccca

SEQ ID NO: 1597635 - RNA, 20 nt, Pseudomonas putida KT2440
gccacgcucgugcaggcugu

SEQ ID NO: 1597636 - RNA, 22 nt, Pseudomonas putida KT2440
gccacgcucaaccccaucaccu

SEQ ID NO: 1597637 - RNA, 18 nt, Pseudomonas putida KT2440
gccacggaacaucgaggc

SEQ ID NO: 1597638 - RNA, 21 nt, Pseudomonas putida KT2440
gccacggugucggacagguug

SEQ ID NO: 1597639 - RNA, 19 nt, Pseudomonas putida KT2440
gccacguccgaugccguag

SEQ ID NO: 1597640 - RNA, 19 nt, Pseudomonas putida KT2440
gccacgucgccagcggcaa

SEQ ID NO: 1597641 - RNA, 19 nt, Pseudomonas putida KT2440
gccacuccgccucguuggc

SEQ ID NO: 1597642 - RNA, 23 nt, Pseudomonas putida KT2440
gccacucagcggguccucgaaac

SEQ ID NO: 1597643 - RNA, 16 nt, Pseudomonas putida KT2440
gccacuggccagcaga

SEQ ID NO: 1597644 - RNA, 20 nt, Pseudomonas putida KT2440
gccacugguaguucaucgcc

SEQ ID NO: 1597645 - RNA, 21 nt, Pseudomonas putida KT2440
gccacuggucgccucgacgca

SEQ ID NO: 1597646 - RNA, 16 nt, Pseudomonas putida KT2440
gccacguuugagcagu

SEQ ID NO: 1597647 - RNA, 20 nt, Pseudomonas putida KT2440
gccaccaguuccaccggcaa

SEQ ID NO: 1597648 - RNA, 21 nt, Pseudomonas putida KT2440
gccaccaguuccaccggcaag

SEQ ID NO: 1597649 - RNA, 22 nt, Pseudomonas putida KT2440
gccaccaguuccaccggcaagc

SEQ ID NO: 1597650 - RNA, 16 nt, Pseudomonas putida KT2440
gccaccaugaacagca

SEQ ID NO: 1597651 - RNA, 19 nt, Pseudomonas putida KT2440
gccaccaugcucggccagc

SEQ ID NO: 1597652 - RNA, 14 nt, Pseudomonas putida KT2440
gccacccaggcccu

SEQ ID NO: 1597653 - RNA, 13 nt, Pseudomonas putida KT2440
gccacccacaggc

SEQ ID NO: 1597654 - RNA, 19 nt, Pseudomonas putida KT2440
gccaccccaggccacuggu

SEQ ID NO: 1597655 - RNA, 13 nt, Pseudomonas putida KT2440
gccaccagcgccg

SEQ ID NO: 1597656 - RNA, 17 nt, Pseudomonas putida KT2440
gccaccaggcgcggcag

SEQ ID NO: 1597657 - RNA, 12 nt, Pseudomonas putida KT2440
gccaccaggccu

SEQ ID NO: 1597658 - RNA, 13 nt, Pseudomonas putida KT2440
gccacagcugcug

SEQ ID NO: 1597659 - RNA, 13 nt, Pseudomonas putida KT2440
gccaccaagcccu

SEQ ID NO: 1597660 - RNA, 21 nt, Pseudomonas putida KT2440
gccaccaauacccgcaacgau

SEQ ID NO: 1597661 - RNA, 15 nt, Pseudomonas putida KT2440
gccaccaccagcaac

SEQ ID NO: 1597662 - RNA, 17 nt, Pseudomonas putida KT2440
gccaccaccaugcgaug

SEQ ID NO: 1597663 - RNA, 19 nt, Pseudomonas putida KT2440
gccaccacccggggcagca

SEQ ID NO: 1597664 - RNA, 22 nt, Pseudomonas putida KT2440
gccaccacccggggcagcauca

SEQ ID NO: 1597665 - RNA, 14 nt, Pseudomonas putida KT2440
gccaccaccgcuga

SEQ ID NO: 1597666 - RNA, 20 nt, Pseudomonas putida KT2440
gccaccacgucacgcaccau

SEQ ID NO: 1597667 - RNA, 22 nt, Pseudomonas putida KT2440
gccaccacgguacuuggcgcug

SEQ ID NO: 1597668 - RNA, 20 nt, Pseudomonas putida KT2440
gccaauggcgaugaacacgc

SEQ ID NO: 1597669 - RNA, 17 nt, Pseudomonas putida KT2440
gccaaugguauugcccg

SEQ ID NO: 1597670 - RNA, 14 nt, Pseudomonas putida KT2440
gccaauuucaacgc

SEQ ID NO: 1597671 - RNA, 18 nt, Pseudomonas putida KT2440
gccaauugcgccagccgc

SEQ ID NO: 1597672 - RNA, 22 nt, Pseudomonas putida KT2440
gccaauuuccauaccaauggca

SEQ ID NO: 1597673 - RNA, 21 nt, Pseudomonas putida KT2440
gccaauuugccagcgugaacc

SEQ ID NO: 1597674 - RNA, 21 nt, Pseudomonas putida KT2440
gccacaacccuugcagcgccu

SEQ ID NO: 1597675 - RNA, 14 nt, Pseudomonas putida KT2440
gccacagccgaggg

SEQ ID NO: 1597676 - RNA, 19 nt, Pseudomonas putida KT2440
gccacagccgagggcaugg

SEQ ID NO: 1597677 - RNA, 22 nt, Pseudomonas putida KT2440
gccacagccgagggcaugggcc

SEQ ID NO: 1597678 - RNA, 16 nt, Pseudomonas putida KT2440
gccaagguugccacca

SEQ ID NO: 1597679 - RNA, 19 nt, Pseudomonas putida KT2440
gccaagguugccaccagca

SEQ ID NO: 1597680 - RNA, 17 nt, Pseudomonas putida KT2440
gccaaguacggccagca

SEQ ID NO: 1597681 - RNA, 17 nt, Pseudomonas putida KT2440
gccaagcacggcgccga

SEQ ID NO: 1597682 - RNA, 16 nt, Pseudomonas putida KT2440
gccaaggucagcaagc

SEQ ID NO: 1597683 - RNA, 19 nt, Pseudomonas putida KT2440
gccaaggucaucgggauca

SEQ ID NO: 1597684 - RNA, 21 nt, Pseudomonas putida KT2440
gccaaggucaucgggaucagc

SEQ ID NO: 1597685 - RNA, 19 nt, Pseudomonas putida KT2440
gccaaggucuccagcaccg

SEQ ID NO: 1597686 - RNA, 16 nt, Pseudomonas putida KT2440
gccaaguguuugaagc

SEQ ID NO: 1597687 - RNA, 22 nt, Pseudomonas putida KT2440
gccaauaacaaguucaagguca

SEQ ID NO: 1597688 - RNA, 12 nt, Pseudomonas putida KT2440
gccaaugcucag

SEQ ID NO: 1597689 - RNA, 13 nt, Pseudomonas putida KT2440
gccaaugcugaug

SEQ ID NO: 1597690 - RNA, 19 nt, Pseudomonas putida KT2440
gccaauaacucgcagcgca

SEQ ID NO: 1597691 - RNA, 22 nt, Pseudomonas putida KT2440
gcaguccugcaacucggccuug

SEQ ID NO: 1597692 - RNA, 23 nt, Pseudomonas putida KT2440
gcagucagggucucggccaaucg

SEQ ID NO: 1597693 - RNA, 14 nt, Pseudomonas putida KT2440
gcagucccgccaua

SEQ ID NO: 1597694 - RNA, 23 nt, Pseudomonas putida KT2440
gcagucguuguccaggugguagu

SEQ ID NO: 1597695 - RNA, 17 nt, Pseudomonas putida KT2440
gccaagauccgcggcau

SEQ ID NO: 1597696 - RNA, 16 nt, Pseudomonas putida KT2440
gcagucuugcugauca

SEQ ID NO: 1597697 - RNA, 19 nt, Pseudomonas putida KT2440
gccaacuccuugcgcauca

SEQ ID NO: 1597698 - RNA, 17 nt, Pseudomonas putida KT2440
gccaacuccccacccag

SEQ ID NO: 1597699 - RNA, 22 nt, Pseudomonas putida KT2440
gccaacuccccacccaggugau

SEQ ID NO: 1597700 - RNA, 21 nt, Pseudomonas putida KT2440
gccagcggcucgaccaagccu

SEQ ID NO: 1597701 - RNA, 16 nt, Pseudomonas putida KT2440
gccagcguggccgcca

SEQ ID NO: 1597702 - RNA, 21 nt, Pseudomonas putida KT2440
gccagcguggccgccaacagc

SEQ ID NO: 1597703 - RNA, 14 nt, Pseudomonas putida KT2440
gccagcguguucca

SEQ ID NO: 1597704 - RNA, 18 nt, Pseudomonas putida KT2440
gccagcucggcaguggcg

SEQ ID NO: 1597705 - RNA, 17 nt, Pseudomonas putida KT2440
gccagcuccuggcucag

SEQ ID NO: 1597706 - RNA, 16 nt, Pseudomonas putida KT2440
gccaggaacagcgcca

SEQ ID NO: 1597707 - RNA, 17 nt, Pseudomonas putida KT2440
gccagcuucgacgaaga

SEQ ID NO: 1597708 - RNA, 23 nt, Pseudomonas putida KT2440
gccagcugcgcugccugcuggcg

SEQ ID NO: 1597709 - RNA, 19 nt, Pseudomonas putida KT2440
gccagguccgagugcucga

SEQ ID NO: 1597710 - RNA, 19 nt, Pseudomonas putida KT2440
gccagguccaggcugcgcg

SEQ ID NO: 1597711 - RNA, 14 nt, Pseudomonas putida KT2440
gccagguauggcca

SEQ ID NO: 1597712 - RNA, 21 nt, Pseudomonas putida KT2440
gccagguucggaucagcaaug

SEQ ID NO: 1597713 - RNA, 21 nt, Pseudomonas putida KT2440
gccagguuuuugaugucgccg

SEQ ID NO: 1597714 - RNA, 23 nt, Pseudomonas putida KT2440
gccagguuuuugaugucgccgua

SEQ ID NO: 1597715 - RNA, 19 nt, Pseudomonas putida KT2440
gccagguuguucaguggcg

SEQ ID NO: 1597716 - RNA, 23 nt, Pseudomonas putida KT2440
gccaguaaggcuugcucaaggug

SEQ ID NO: 1597717 - RNA, 15 nt, Pseudomonas putida KT2440
gccagucgcacaggu

SEQ ID NO: 1597718 - RNA, 19 nt, Pseudomonas putida KT2440
gccagucgcacagguccag

SEQ ID NO: 1597719 - RNA, 17 nt, Pseudomonas putida KT2440
gccaguccuuggccaau

SEQ ID NO: 1597720 - RNA, 21 nt, Pseudomonas putida KT2440
gccaggcuuggcgugcggcgu

SEQ ID NO: 1597721 - RNA, 15 nt, Pseudomonas putida KT2440
gccaggccggcgcag

SEQ ID NO: 1597722 - RNA, 18 nt, Pseudomonas putida KT2440
gccaggccgauggcgaug

SEQ ID NO: 1597723 - RNA, 15 nt, Pseudomonas putida KT2440
gccagggcaacggca

SEQ ID NO: 1597724 - RNA, 13 nt, Pseudomonas putida KT2440
gccagggcaagca

SEQ ID NO: 1597725 - RNA, 16 nt, Pseudomonas putida KT2440
gccaggguacgauagg

SEQ ID NO: 1597726 - RNA, 22 nt, Pseudomonas putida KT2440
gccaggguacgauagggcggug

SEQ ID NO: 1597727 - RNA, 22 nt, Pseudomonas putida KT2440
gccaggguaccgccguccacca

SEQ ID NO: 1597728 - RNA, 13 nt, Pseudomonas putida KT2440
gccagcggcgaug

SEQ ID NO: 1597729 - RNA, 18 nt, Pseudomonas putida KT2440
gccagcggcgaugcucag

SEQ ID NO: 1597730 - RNA, 18 nt, Pseudomonas putida KT2440
gccagcgcgcugagcagg

SEQ ID NO: 1597731 - RNA, 18 nt, Pseudomonas putida KT2440
gccagcgccuggcgcagu

SEQ ID NO: 1597732 - RNA, 17 nt, Pseudomonas putida KT2440
gccagcgccugcugcca

SEQ ID NO: 1597733 - RNA, 21 nt, Pseudomonas putida KT2440
gccagccuccggcccaucccg

SEQ ID NO: 1597734 - RNA, 21 nt, Pseudomonas putida KT2440
gccagccucuucuucaaggcu

SEQ ID NO: 1597735 - RNA, 23 nt, Pseudomonas putida KT2440
gccagccguuguuugucaccccg

SEQ ID NO: 1597736 - RNA, 18 nt, Pseudomonas putida KT2440
gccagccguugcgccgcu

SEQ ID NO: 1597737 - RNA, 15 nt, Pseudomonas putida KT2440
gccagcgacagcauc

SEQ ID NO: 1597738 - RNA, 19 nt, Pseudomonas putida KT2440
gccagcccugccgaggcca

SEQ ID NO: 1597739 - RNA, 22 nt, Pseudomonas putida KT2440
gccagcauggccggauagagcc

SEQ ID NO: 1597740 - RNA, 12 nt, Pseudomonas putida KT2440
gccagccgaggg

SEQ ID NO: 1597741 - RNA, 23 nt, Pseudomonas putida KT2440
gccagccguugauccaggcuugg

SEQ ID NO: 1597742 - RNA, 17 nt, Pseudomonas putida KT2440
gccagccgccgccgagu

SEQ ID NO: 1597743 - RNA, 15 nt, Pseudomonas putida KT2440
gccagccgcgccagg

SEQ ID NO: 1597744 - RNA, 16 nt, Pseudomonas putida KT2440
gccagccgcgccaggu

SEQ ID NO: 1597745 - RNA, 17 nt, Pseudomonas putida KT2440
gccagccgcgccagguc

SEQ ID NO: 1597746 - RNA, 13 nt, Pseudomonas putida KT2440
gccagcaagcggg

SEQ ID NO: 1597747 - RNA, 19 nt, Pseudomonas putida KT2440
gccagcaccaucaggcaca

SEQ ID NO: 1597748 - RNA, 19 nt, Pseudomonas putida KT2440
gccagcaaacccucggccu

SEQ ID NO: 1597749 - RNA, 13 nt, Pseudomonas putida KT2440
gccacuucgcgag

SEQ ID NO: 1597750 - RNA, 19 nt, Pseudomonas putida KT2440
gccagcaaaugcccacugc

SEQ ID NO: 1597751 - RNA, 15 nt, Pseudomonas putida KT2440
gccagcaacaagcug

SEQ ID NO: 1597752 - RNA, 17 nt, Pseudomonas putida KT2440
gccagcaacuggugaau

SEQ ID NO: 1597753 - RNA, 22 nt, Pseudomonas putida KT2440
gccagcaacuggugaaucagcc

SEQ ID NO: 1597754 - RNA, 15 nt, Pseudomonas putida KT2440
gccagcaucacgccg

SEQ ID NO: 1597755 - RNA, 22 nt, Pseudomonas putida KT2440
gccagcaucacgccgcgcuggc

SEQ ID NO: 1597756 - RNA, 20 nt, Pseudomonas putida KT2440
gccagcagggcaggggacag

SEQ ID NO: 1597757 - RNA, 18 nt, Pseudomonas putida KT2440
gccagcagggccgcccuu

SEQ ID NO: 1597758 - RNA, 16 nt, Pseudomonas putida KT2440
gccagcaggccgccga

SEQ ID NO: 1597759 - RNA, 20 nt, Pseudomonas putida KT2440
gccagcaugcuaauugcccg

SEQ ID NO: 1597760 - RNA, 22 nt, Pseudomonas putida KT2440
gccagcaugcuaauugcccgag

SEQ ID NO: 1597761 - RNA, 21 nt, Pseudomonas putida KT2440
gccagcaaggcaauaccgaug

SEQ ID NO: 1597762 - RNA, 20 nt, Pseudomonas putida KT2440
gccagcacuacgccggccaa

SEQ ID NO: 1597763 - RNA, 22 nt, Pseudomonas putida KT2440
gccagcacuacgccggccaagg

SEQ ID NO: 1597764 - RNA, 22 nt, Pseudomonas putida KT2440
gccagcagauggcucaucgccg

SEQ ID NO: 1597765 - RNA, 23 nt, Pseudomonas putida KT2440
gccagcagauggcucaucgccgu

SEQ ID NO: 1597766 - RNA, 12 nt, Pseudomonas putida KT2440
gccagcaggccg

SEQ ID NO: 1597767 - RNA, 19 nt, Pseudomonas putida KT2440
gccagcaggccaccggcag

SEQ ID NO: 1597768 - RNA, 13 nt, Pseudomonas putida KT2440
gccagcaggcccg

SEQ ID NO: 1597769 - RNA, 12 nt, Pseudomonas putida KT2440
acugcgcgaucg

SEQ ID NO: 1597770 - RNA, 15 nt, Pseudomonas putida KT2440
acugcgcgcaaaggc

SEQ ID NO: 1597771 - RNA, 15 nt, Pseudomonas putida KT2440
acugcgccugggaaa

SEQ ID NO: 1597772 - RNA, 21 nt, Pseudomonas putida KT2440
acugcgcuacgacccaccgac

SEQ ID NO: 1597773 - RNA, 17 nt, Pseudomonas putida KT2440
acugcggacagcaaggc

SEQ ID NO: 1597774 - RNA, 21 nt, Pseudomonas putida KT2440
acugcguauuuuugcgccagg

SEQ ID NO: 1597775 - RNA, 14 nt, Pseudomonas putida KT2440
acuggccgacauca

SEQ ID NO: 1597776 - RNA, 20 nt, Pseudomonas putida KT2440
acuggcgcgaugcgguugca

SEQ ID NO: 1597777 - RNA, 20 nt, Pseudomonas putida KT2440
acuggcgcaggccgcuggcc

SEQ ID NO: 1597778 - RNA, 16 nt, Pseudomonas putida KT2440
acugggugcacagguu

SEQ ID NO: 1597779 - RNA, 18 nt, Pseudomonas putida KT2440
acuggccaauugcgccau

SEQ ID NO: 1597780 - RNA, 21 nt, Pseudomonas putida KT2440
acuggccggucuguucggcaa

SEQ ID NO: 1597781 - RNA, 17 nt, Pseudomonas putida KT2440
acuggcgcaccagcggc

SEQ ID NO: 1597782 - RNA, 15 nt, Pseudomonas putida KT2440
acuggcgcagcaggu

SEQ ID NO: 1597783 - RNA, 18 nt, Pseudomonas putida KT2440
acuggccggagcuggagc

SEQ ID NO: 1597784 - RNA, 20 nt, Pseudomonas putida KT2440
acuggucgccucgacgcaga

SEQ ID NO: 1597785 - RNA, 20 nt, Pseudomonas putida KT2440
acugucguuuggcgcgauca

SEQ ID NO: 1597786 - RNA, 17 nt, Pseudomonas putida KT2440
acuguggucauccaggc

SEQ ID NO: 1597787 - RNA, 18 nt, Pseudomonas putida KT2440
acuguuugagccggcgcu

SEQ ID NO: 1597788 - RNA, 17 nt, Pseudomonas putida KT2440
acuguuggaauggcgca

SEQ ID NO: 1597789 - RNA, 15 nt, Pseudomonas putida KT2440
acuguugcagcgcca

SEQ ID NO: 1597790 - RNA, 23 nt, Pseudomonas putida KT2440
acugaauggccuuggccaucacu

SEQ ID NO: 1597791 - RNA, 18 nt, Pseudomonas putida KT2440
acugagucggccucgaua

SEQ ID NO: 1597792 - RNA, 14 nt, Pseudomonas putida KT2440
acugaacagcgccu

SEQ ID NO: 1597793 - RNA, 13 nt, Pseudomonas putida KT2440
acucuugcgccag

SEQ ID NO: 1597794 - RNA, 18 nt, Pseudomonas putida KT2440
acugccaucucgccaagc

SEQ ID NO: 1597795 - RNA, 20 nt, Pseudomonas putida KT2440
acugccagcacgaucauggg

SEQ ID NO: 1597796 - RNA, 14 nt, Pseudomonas putida KT2440
acugccaaugcuca

SEQ ID NO: 1597797 - RNA, 21 nt, Pseudomonas putida KT2440
acugccaaugcucaguggacc

SEQ ID NO: 1597798 - RNA, 18 nt, Pseudomonas putida KT2440
acugcagaacauggccga

SEQ ID NO: 1597799 - RNA, 17 nt, Pseudomonas putida KT2440
acugcaagcaaacgcca

SEQ ID NO: 1597800 - RNA, 19 nt, Pseudomonas putida KT2440
acugcaagcaaacgccaga

SEQ ID NO: 1597801 - RNA, 23 nt, Pseudomonas putida KT2440
acugcaagcgaugcacgccagca

SEQ ID NO: 1597802 - RNA, 16 nt, Pseudomonas putida KT2440
acugcacccgccagcc

SEQ ID NO: 1597803 - RNA, 16 nt, Pseudomonas putida KT2440
acugcacgcuucgauc

SEQ ID NO: 1597804 - RNA, 13 nt, Pseudomonas putida KT2440
acugcacugccag

SEQ ID NO: 1597805 - RNA, 15 nt, Pseudomonas putida KT2440
acugcaccucccgcc

SEQ ID NO: 1597806 - RNA, 14 nt, Pseudomonas putida KT2440
acugaugcccaugc

SEQ ID NO: 1597807 - RNA, 19 nt, Pseudomonas putida KT2440
acugcaacaccggucaggu

SEQ ID NO: 1597808 - RNA, 21 nt, Pseudomonas putida KT2440
agaauccguuccuucgaccag

SEQ ID NO: 1597809 - RNA, 16 nt, Pseudomonas putida KT2440
agaaugugcucggccu

SEQ ID NO: 1597810 - RNA, 19 nt, Pseudomonas putida KT2440
agaagguaucggccauggc

SEQ ID NO: 1597811 - RNA, 23 nt, Pseudomonas putida KT2440
agaaggcugcccucgggcagccu

SEQ ID NO: 1597812 - RNA, 20 nt, Pseudomonas putida KT2440
agaacggcagcaggccaaug

SEQ ID NO: 1597813 - RNA, 12 nt, Pseudomonas putida KT2440
agaaccugggac

SEQ ID NO: 1597814 - RNA, 18 nt, Pseudomonas putida KT2440
agaacagcgaagccagca

SEQ ID NO: 1597815 - RNA, 17 nt, Pseudomonas putida KT2440
agaacaucacgaaggug

SEQ ID NO: 1597816 - RNA, 15 nt, Pseudomonas putida KT2440
agaacaccugcagcg

SEQ ID NO: 1597817 - RNA, 21 nt, Pseudomonas putida KT2440
agaacaaccggggcuccggcg

SEQ ID NO: 1597818 - RNA, 13 nt, Pseudomonas putida KT2440
agaaaagccgcug

SEQ ID NO: 1597819 - RNA, 19 nt, Pseudomonas putida KT2440
acuuccaguccgccucguc

SEQ ID NO: 1597820 - RNA, 22 nt, Pseudomonas putida KT2440
acuuccagcgacaucggaacga

SEQ ID NO: 1597821 - RNA, 21 nt, Pseudomonas putida KT2440
acuuuugcuggcuguaccggc

SEQ ID NO: 1597822 - RNA, 17 nt, Pseudomonas putida KT2440
acuuugucgaugccugc

SEQ ID NO: 1597823 - RNA, 11 nt, Pseudomonas putida KT2440
agauacccgcc

SEQ ID NO: 1597824 - RNA, 18 nt, Pseudomonas putida KT2440
agaucaggucgccaggcu

SEQ ID NO: 1597825 - RNA, 14 nt, Pseudomonas putida KT2440
agaggcagcgaaag

SEQ ID NO: 1597826 - RNA, 18 nt, Pseudomonas putida KT2440
agaggccggcacaggaag

SEQ ID NO: 1597827 - RNA, 17 nt, Pseudomonas putida KT2440
agaguccgaagcgaaca

SEQ ID NO: 1597828 - RNA, 23 nt, Pseudomonas putida KT2440
agaucggugcguaggagcggguc

SEQ ID NO: 1597829 - RNA, 22 nt, Pseudomonas putida KT2440
agauccugcagccgcaccugcc

SEQ ID NO: 1597830 - RNA, 18 nt, Pseudomonas putida KT2440
agaugccgccgcugccag

SEQ ID NO: 1597831 - RNA, 21 nt, Pseudomonas putida KT2440
agagcggccccaagcuucacc

SEQ ID NO: 1597832 - RNA, 17 nt, Pseudomonas putida KT2440
agacucaaucaggcagc

SEQ ID NO: 1597833 - RNA, 12 nt, Pseudomonas putida KT2440
agaccagcagca

SEQ ID NO: 1597834 - RNA, 14 nt, Pseudomonas putida KT2440
agaccaccucaucc

SEQ ID NO: 1597835 - RNA, 18 nt, Pseudomonas putida KT2440
agacauugagcaagggcc

SEQ ID NO: 1597836 - RNA, 14 nt, Pseudomonas putida KT2440
agacacgagcggcc

SEQ ID NO: 1597837 - RNA, 16 nt, Pseudomonas putida KT2440
agaccgccgcccaggu

SEQ ID NO: 1597838 - RNA, 18 nt, Pseudomonas putida KT2440
agaccugcaaugccgcug

SEQ ID NO: 1597839 - RNA, 18 nt, Pseudomonas putida KT2440
agacgcaggcaaacgcgg

SEQ ID NO: 1597840 - RNA, 17 nt, Pseudomonas putida KT2440
agacgcaaaaaacccgg

SEQ ID NO: 1597841 - RNA, 19 nt, Pseudomonas putida KT2440
agaccugugggagcgggca

SEQ ID NO: 1597842 - RNA, 16 nt, Pseudomonas putida KT2440
agaccuggaggucaug

SEQ ID NO: 1597843 - RNA, 17 nt, Pseudomonas putida KT2440
agaccuuucccaugacg

SEQ ID NO: 1597844 - RNA, 13 nt, Pseudomonas putida KT2440
agacgaagccgaa

SEQ ID NO: 1597845 - RNA, 14 nt, Pseudomonas putida KT2440
agaccuugcgcacg

SEQ ID NO: 1597846 - RNA, 18 nt, Pseudomonas putida KT2440
agaccuugcgcacggccu

SEQ ID NO: 1597847 - RNA, 17 nt, Pseudomonas putida KT2440
acggcaagccacgccag

SEQ ID NO: 1597848 - RNA, 21 nt, Pseudomonas putida KT2440
acggcaauggcccgcuccagu

SEQ ID NO: 1597849 - RNA, 13 nt, Pseudomonas putida KT2440
acggcaauucgcc

SEQ ID NO: 1597850 - RNA, 20 nt, Pseudomonas putida KT2440
acggcaauugccaccggcgc

SEQ ID NO: 1597851 - RNA, 18 nt, Pseudomonas putida KT2440
acggcaccuuugcaggug

SEQ ID NO: 1597852 - RNA, 12 nt, Pseudomonas putida KT2440
acggaucgccag

SEQ ID NO: 1597853 - RNA, 23 nt, Pseudomonas putida KT2440
acggaucagccgcgggcgucgcg

SEQ ID NO: 1597854 - RNA, 12 nt, Pseudomonas putida KT2440
acggaucaccug

SEQ ID NO: 1597855 - RNA, 15 nt, Pseudomonas putida KT2440
acggauacaccagaa

SEQ ID NO: 1597856 - RNA, 22 nt, Pseudomonas putida KT2440
acggauggcagcgaucaguucc

SEQ ID NO: 1597857 - RNA, 16 nt, Pseudomonas putida KT2440
acggcaacgccagcaa

SEQ ID NO: 1597858 - RNA, 17 nt, Pseudomonas putida KT2440
acggcauuuccagcguc

SEQ ID NO: 1597859 - RNA, 20 nt, Pseudomonas putida KT2440
acggcauuuccagcgucagu

SEQ ID NO: 1597860 - RNA, 18 nt, Pseudomonas putida KT2440
acggcauggccgaagcgg

SEQ ID NO: 1597861 - RNA, 19 nt, Pseudomonas putida KT2440
acggccacgguagccaguc

SEQ ID NO: 1597862 - RNA, 17 nt, Pseudomonas putida KT2440
acggccaauggccggga

SEQ ID NO: 1597863 - RNA, 21 nt, Pseudomonas putida KT2440
acggcagccguucccgggcag

SEQ ID NO: 1597864 - RNA, 17 nt, Pseudomonas putida KT2440
acggcagcaaucgccgc

SEQ ID NO: 1597865 - RNA, 13 nt, Pseudomonas putida KT2440
acggcaucacgcu

SEQ ID NO: 1597866 - RNA, 19 nt, Pseudomonas putida KT2440
acggcagugcacccgcgag

SEQ ID NO: 1597867 - RNA, 18 nt, Pseudomonas putida KT2440
acgcugccuccacaccga

SEQ ID NO: 1597868 - RNA, 13 nt, Pseudomonas putida KT2440
acgcuggcaccca

SEQ ID NO: 1597869 - RNA, 18 nt, Pseudomonas putida KT2440
acgcuggcacccacgcgc

SEQ ID NO: 1597870 - RNA, 20 nt, Pseudomonas putida KT2440
acgcuuccuuguccgccaag

SEQ ID NO: 1597871 - RNA, 13 nt, Pseudomonas putida KT2440
acgcuucgaacac

SEQ ID NO: 1597872 - RNA, 12 nt, Pseudomonas putida KT2440
acgcuuggccag

SEQ ID NO: 1597873 - RNA, 22 nt, Pseudomonas putida KT2440
acgcuugccaaggcuagccacg

SEQ ID NO: 1597874 - RNA, 17 nt, Pseudomonas putida KT2440
acggaaggucuucagcu

SEQ ID NO: 1597875 - RNA, 17 nt, Pseudomonas putida KT2440
acggacgucgcgcuggc

SEQ ID NO: 1597876 - RNA, 19 nt, Pseudomonas putida KT2440
acgcgacagggcgcccguu

SEQ ID NO: 1597877 - RNA, 19 nt, Pseudomonas putida KT2440
acgcgaccucagccguggu

SEQ ID NO: 1597878 - RNA, 22 nt, Pseudomonas putida KT2440
acgcgcucacgcuugccaaggc

SEQ ID NO: 1597879 - RNA, 23 nt, Pseudomonas putida KT2440
acgccuuggccuggcgagucagg

SEQ ID NO: 1597880 - RNA, 17 nt, Pseudomonas putida KT2440
acgccuuggucgaaccg

SEQ ID NO: 1597881 - RNA, 20 nt, Pseudomonas putida KT2440
acgcgaaucgccagggcuca

SEQ ID NO: 1597882 - RNA, 20 nt, Pseudomonas putida KT2440
aaacagcaguuugcugcgcu

SEQ ID NO: 1597883 - RNA, 18 nt, Pseudomonas putida KT2440
acgcggggcagcgcacgu

SEQ ID NO: 1597884 - RNA, 22 nt, Pseudomonas putida KT2440
acgcucgcgcaggaaccgcguc

SEQ ID NO: 1597885 - RNA, 21 nt, Pseudomonas putida KT2440
acgcuccuucgccacgaacag

SEQ ID NO: 1597886 - RNA, 22 nt, Pseudomonas putida KT2440
acgucgcgauugaucagcgccu

SEQ ID NO: 1597887 - RNA, 16 nt, Pseudomonas putida KT2440
acgucgcgcuggccgc

SEQ ID NO: 1597888 - RNA, 15 nt, Pseudomonas putida KT2440
acguauccgccgcaa

SEQ ID NO: 1597889 - RNA, 22 nt, Pseudomonas putida KT2440
acguauccgccgcaaugucagc

SEQ ID NO: 1597890 - RNA, 16 nt, Pseudomonas putida KT2440
acgucguacucggccg

SEQ ID NO: 1597891 - RNA, 21 nt, Pseudomonas putida KT2440
acguagcgcccgucuggcugc

SEQ ID NO: 1597892 - RNA, 22 nt, Pseudomonas putida KT2440
acguaguccuugugcaguucgc

SEQ ID NO: 1597893 - RNA, 15 nt, Pseudomonas putida KT2440
acguggacagcagcu

SEQ ID NO: 1597894 - RNA, 16 nt, Pseudomonas putida KT2440
acgucguugaaggcgu

SEQ ID NO: 1597895 - RNA, 17 nt, Pseudomonas putida KT2440
acgucguugcaguucac

SEQ ID NO: 1597896 - RNA, 16 nt, Pseudomonas putida KT2440
acgucucgaacggcgc

SEQ ID NO: 1597897 - RNA, 20 nt, Pseudomonas putida KT2440
acgucucgaacggcgccagc

SEQ ID NO: 1597898 - RNA, 16 nt, Pseudomonas putida KT2440
acgugcaacgucgcgu

SEQ ID NO: 1597899 - RNA, 17 nt, Pseudomonas putida KT2440
acgugcaaggaucacca

SEQ ID NO: 1597900 - RNA, 14 nt, Pseudomonas putida KT2440
acgugauugacccg

SEQ ID NO: 1597901 - RNA, 15 nt, Pseudomonas putida KT2440
acgugcacggccuug

SEQ ID NO: 1597902 - RNA, 15 nt, Pseudomonas putida KT2440
acgugcaccggccuu

SEQ ID NO: 1597903 - RNA, 16 nt, Pseudomonas putida KT2440
acguuuaccugcagcu

SEQ ID NO: 1597904 - RNA, 15 nt, Pseudomonas putida KT2440
acguuuccagcaacc

SEQ ID NO: 1597905 - RNA, 15 nt, Pseudomonas putida KT2440
acguugguagcggug

SEQ ID NO: 1597906 - RNA, 19 nt, Pseudomonas putida KT2440
acguuggccgccagcggca

SEQ ID NO: 1597907 - RNA, 12 nt, Pseudomonas putida KT2440
acguuaccaggc

SEQ ID NO: 1597908 - RNA, 14 nt, Pseudomonas putida KT2440
acuagcggugcaga

SEQ ID NO: 1597909 - RNA, 22 nt, Pseudomonas putida KT2440
acuacgccggccaaggucagca

SEQ ID NO: 1597910 - RNA, 20 nt, Pseudomonas putida KT2440
acuacgcgccagcauggacc

SEQ ID NO: 1597911 - RNA, 17 nt, Pseudomonas putida KT2440
acggcggcgaucagcgc

SEQ ID NO: 1597912 - RNA, 14 nt, Pseudomonas putida KT2440
acggccagccguug

SEQ ID NO: 1597913 - RNA, 13 nt, Pseudomonas putida KT2440
acggccaucagca

SEQ ID NO: 1597914 - RNA, 16 nt, Pseudomonas putida KT2440
acggccaucagcaagc

SEQ ID NO: 1597915 - RNA, 22 nt, Pseudomonas putida KT2440
acggcggcagauacaaccccag

SEQ ID NO: 1597916 - RNA, 22 nt, Pseudomonas putida KT2440
acggcggguggaaauuggccag

SEQ ID NO: 1597917 - RNA, 21 nt, Pseudomonas putida KT2440
acggcggugauaugcguaccc

SEQ ID NO: 1597918 - RNA, 18 nt, Pseudomonas putida KT2440
acgggcaaacaggcugau

SEQ ID NO: 1597919 - RNA, 20 nt, Pseudomonas putida KT2440
acgggcgcgacuugauccag

SEQ ID NO: 1597920 - RNA, 19 nt, Pseudomonas putida KT2440
acgguggcugccacgggca

SEQ ID NO: 1597921 - RNA, 19 nt, Pseudomonas putida KT2440
acgggucaccacgggaaug

SEQ ID NO: 1597922 - RNA, 18 nt, Pseudomonas putida KT2440
acgggucaugccaccgcc

SEQ ID NO: 1597923 - RNA, 15 nt, Pseudomonas putida KT2440
acgguagcggcagca

SEQ ID NO: 1597924 - RNA, 17 nt, Pseudomonas putida KT2440
acgguaguggcggcaac

SEQ ID NO: 1597925 - RNA, 15 nt, Pseudomonas putida KT2440
acgguauaggccccg

SEQ ID NO: 1597926 - RNA, 20 nt, Pseudomonas putida KT2440
acccgcgccuacgacggccu

SEQ ID NO: 1597927 - RNA, 13 nt, Pseudomonas putida KT2440
acccgcgccucga

SEQ ID NO: 1597928 - RNA, 13 nt, Pseudomonas putida KT2440
acccgcgcguugc

SEQ ID NO: 1597929 - RNA, 16 nt, Pseudomonas putida KT2440
acccgcgcguugcgga

SEQ ID NO: 1597930 - RNA, 18 nt, Pseudomonas putida KT2440
acccgcgaaagggccagu

SEQ ID NO: 1597931 - RNA, 16 nt, Pseudomonas putida KT2440
acccgcgaaagggccg

SEQ ID NO: 1597932 - RNA, 19 nt, Pseudomonas putida KT2440
acccgcgaagaagacaccg

SEQ ID NO: 1597933 - RNA, 20 nt, Pseudomonas putida KT2440
acccgcgaagaagacaccgc

SEQ ID NO: 1597934 - RNA, 14 nt, Pseudomonas putida KT2440
acccgcgaagaagc

SEQ ID NO: 1597935 - RNA, 18 nt, Pseudomonas putida KT2440
acccgcgaagaagccacc

SEQ ID NO: 1597936 - RNA, 20 nt, Pseudomonas putida KT2440
acccgcgaagaagccaccgc

SEQ ID NO: 1597937 - RNA, 17 nt, Pseudomonas putida KT2440
acccgcgaagaggccag

SEQ ID NO: 1597938 - RNA, 17 nt, Pseudomonas putida KT2440
acccgcgaagaggcccg

SEQ ID NO: 1597939 - RNA, 17 nt, Pseudomonas putida KT2440
acccgcgaagaggccgg

SEQ ID NO: 1597940 - RNA, 20 nt, Pseudomonas putida KT2440
acccgcgaagaggccggcaa

SEQ ID NO: 1597941 - RNA, 23 nt, Pseudomonas putida KT2440
acccgcgaagaggccggcaaagc

SEQ ID NO: 1597942 - RNA, 20 nt, Pseudomonas putida KT2440
acccgcgaagaggccggcac

SEQ ID NO: 1597943 - RNA, 19 nt, Pseudomonas putida KT2440
acccgcgaagaggccggua

SEQ ID NO: 1597944 - RNA, 20 nt, Pseudomonas putida KT2440
acccgcgaagcaggcgacgc

SEQ ID NO: 1597945 - RNA, 22 nt, Pseudomonas putida KT2440
acccgcucuguuuucaaggcgu

SEQ ID NO: 1597946 - RNA, 13 nt, Pseudomonas putida KT2440
acccgcgugugcu

SEQ ID NO: 1597947 - RNA, 14 nt, Pseudomonas putida KT2440
acccgcucaaagcg

SEQ ID NO: 1597948 - RNA, 19 nt, Pseudomonas putida KT2440
acccgcuccuacaaagcgg

SEQ ID NO: 1597949 - RNA, 21 nt, Pseudomonas putida KT2440
acccgcuccuacaggcgaccg

SEQ ID NO: 1597950 - RNA, 20 nt, Pseudomonas putida KT2440
acccgcuccuaccacguaca

SEQ ID NO: 1597951 - RNA, 21 nt, Pseudomonas putida KT2440
acccgcuccuacgacggccug

SEQ ID NO: 1597952 - RNA, 21 nt, Pseudomonas putida KT2440
acccgcuccuacuacggccug

SEQ ID NO: 1597953 - RNA, 18 nt, Pseudomonas putida KT2440
acccgcgucucgccgcug

SEQ ID NO: 1597954 - RNA, 17 nt, Pseudomonas putida KT2440
acccgcuacaccggccu

SEQ ID NO: 1597955 - RNA, 20 nt, Pseudomonas putida KT2440
acccgcuacaccggccugga

SEQ ID NO: 1597956 - RNA, 11 nt, Pseudomonas putida KT2440
acccgccagca

SEQ ID NO: 1597957 - RNA, 17 nt, Pseudomonas putida KT2440
acccgccccacgcccga

SEQ ID NO: 1597958 - RNA, 17 nt, Pseudomonas putida KT2440
acccgcaucaucacgcg

SEQ ID NO: 1597959 - RNA, 18 nt, Pseudomonas putida KT2440
acccgcaucaucacgcgc

SEQ ID NO: 1597960 - RNA, 20 nt, Pseudomonas putida KT2440
acccgcaucaucacgcgcaa

SEQ ID NO: 1597961 - RNA, 23 nt, Pseudomonas putida KT2440
acccgcccaauuuggccagcuuc

SEQ ID NO: 1597962 - RNA, 18 nt, Pseudomonas putida KT2440
acccgauuccuugcagcg

SEQ ID NO: 1597963 - RNA, 20 nt, Pseudomonas putida KT2440
acccgcaauacauccgcguc

SEQ ID NO: 1597964 - RNA, 16 nt, Pseudomonas putida KT2440
accccgacgccggccu

SEQ ID NO: 1597965 - RNA, 18 nt, Pseudomonas putida KT2440
accccccagcagcgggca

SEQ ID NO: 1597966 - RNA, 20 nt, Pseudomonas putida KT2440
acccccgaaucagugcaccg

SEQ ID NO: 1597967 - RNA, 19 nt, Pseudomonas putida KT2440
acccccgccgccagggcaa

SEQ ID NO: 1597968 - RNA, 22 nt, Pseudomonas putida KT2440
acccccgaucuauucgacccgc

SEQ ID NO: 1597969 - RNA, 18 nt, Pseudomonas putida KT2440
accccaaaccgcucgaag

SEQ ID NO: 1597970 - RNA, 19 nt, Pseudomonas putida KT2440
acccagcguauagccaccg

SEQ ID NO: 1597971 - RNA, 17 nt, Pseudomonas putida KT2440
acccaugccacccauau

SEQ ID NO: 1597972 - RNA, 21 nt, Pseudomonas putida KT2440
acccaucggcgcgaaggucac

SEQ ID NO: 1597973 - RNA, 16 nt, Pseudomonas putida KT2440
acccagcucgccaaca

SEQ ID NO: 1597974 - RNA, 16 nt, Pseudomonas putida KT2440
acccagccacccggcg

SEQ ID NO: 1597975 - RNA, 21 nt, Pseudomonas putida KT2440
accaugcgcggguccgauccg

SEQ ID NO: 1597976 - RNA, 14 nt, Pseudomonas putida KT2440
accaugcuggccaa

SEQ ID NO: 1597977 - RNA, 14 nt, Pseudomonas putida KT2440
accauucaaugcgu

SEQ ID NO: 1597978 - RNA, 17 nt, Pseudomonas putida KT2440
accaguuccaccggcaa

SEQ ID NO: 1597979 - RNA, 17 nt, Pseudomonas putida KT2440
accaguuccagggcggc

SEQ ID NO: 1597980 - RNA, 14 nt, Pseudomonas putida KT2440
accaugcucaccgc

SEQ ID NO: 1597981 - RNA, 16 nt, Pseudomonas putida KT2440
accaugcucggccagc

SEQ ID NO: 1597982 - RNA, 19 nt, Pseudomonas putida KT2440
accaugaacucuuccccgc

SEQ ID NO: 1597983 - RNA, 16 nt, Pseudomonas putida KT2440
accaucggcuccagcg

SEQ ID NO: 1597984 - RNA, 19 nt, Pseudomonas putida KT2440
accaucggccggcucgaac

SEQ ID NO: 1597985 - RNA, 15 nt, Pseudomonas putida KT2440
accaucgccggcacg

SEQ ID NO: 1597986 - RNA, 14 nt, Pseudomonas putida KT2440
accaucgaccuggc

SEQ ID NO: 1597987 - RNA, 18 nt, Pseudomonas putida KT2440
accaucgaccuggcccga

SEQ ID NO: 1597988 - RNA, 14 nt, Pseudomonas putida KT2440
accaucaccgccag

SEQ ID NO: 1597989 - RNA, 16 nt, Pseudomonas putida KT2440
accaucaccgccagca

SEQ ID NO: 1597990 - RNA, 17 nt, Pseudomonas putida KT2440
accaucaccgccagcau

SEQ ID NO: 1597991 - RNA, 22 nt, Pseudomonas putida KT2440
accaucaauacgcuggaucacc

SEQ ID NO: 1597992 - RNA, 13 nt, Pseudomonas putida KT2440
accauccaucacc

SEQ ID NO: 1597993 - RNA, 18 nt, Pseudomonas putida KT2440
accaucagagcgccagca

SEQ ID NO: 1597994 - RNA, 20 nt, Pseudomonas putida KT2440
accagguaaaugguccccgc

SEQ ID NO: 1597995 - RNA, 15 nt, Pseudomonas putida KT2440
accaggucgccagca

SEQ ID NO: 1597996 - RNA, 18 nt, Pseudomonas putida KT2440
accaggucgccagcacca

SEQ ID NO: 1597997 - RNA, 23 nt, Pseudomonas putida KT2440
accagggccuuggccuggggcuu

SEQ ID NO: 1597998 - RNA, 21 nt, Pseudomonas putida KT2440
accaggucgguagggaucacc

SEQ ID NO: 1597999 - RNA, 15 nt, Pseudomonas putida KT2440
accaggucgcggugc

SEQ ID NO: 1598000 - RNA, 21 nt, Pseudomonas putida KT2440
accaguaguucucgacagcca

SEQ ID NO: 1598001 - RNA, 23 nt, Pseudomonas putida KT2440
accaguacgaacuacgcgccagc

SEQ ID NO: 1598002 - RNA, 18 nt, Pseudomonas putida KT2440
acaguucgaaaaccugcu

SEQ ID NO: 1598003 - RNA, 22 nt, Pseudomonas putida KT2440
accaggccguugaucagcgaca

SEQ ID NO: 1598004 - RNA, 20 nt, Pseudomonas putida KT2440
accaggccuuugacuucguc

SEQ ID NO: 1598005 - RNA, 21 nt, Pseudomonas putida KT2440
accaggcuggccaccaccauc

SEQ ID NO: 1598006 - RNA, 19 nt, Pseudomonas putida KT2440
accagggacgaacccuuga

SEQ ID NO: 1598007 - RNA, 18 nt, Pseudomonas putida KT2440
accaggccgaucaccagc

SEQ ID NO: 1598008 - RNA, 20 nt, Pseudomonas putida KT2440
accaggccgaucaccagcac

SEQ ID NO: 1598009 - RNA, 17 nt, Pseudomonas putida KT2440
accgaaggccgccggca

SEQ ID NO: 1598010 - RNA, 14 nt, Pseudomonas putida KT2440
acccgcuugccacg

SEQ ID NO: 1598011 - RNA, 14 nt, Pseudomonas putida KT2440
acccggaccagcgc

SEQ ID NO: 1598012 - RNA, 13 nt, Pseudomonas putida KT2440
acccgcugggcuu

SEQ ID NO: 1598013 - RNA, 13 nt, Pseudomonas putida KT2440
acccgcuggccgg

SEQ ID NO: 1598014 - RNA, 15 nt, Pseudomonas putida KT2440
acccgcuggcgaccg

SEQ ID NO: 1598015 - RNA, 18 nt, Pseudomonas putida KT2440
acccgcuggcgaccggcg

SEQ ID NO: 1598016 - RNA, 19 nt, Pseudomonas putida KT2440
acccgcuggcgaccggcgu

SEQ ID NO: 1598017 - RNA, 18 nt, Pseudomonas putida KT2440
acccgcuggcgaucaggc

SEQ ID NO: 1598018 - RNA, 18 nt, Pseudomonas putida KT2440
accgacgcauucgcgggu

SEQ ID NO: 1598019 - RNA, 15 nt, Pseudomonas putida KT2440
accgacgccgaucaa

SEQ ID NO: 1598020 - RNA, 19 nt, Pseudomonas putida KT2440
accgagcggucgcagguuc

SEQ ID NO: 1598021 - RNA, 16 nt, Pseudomonas putida KT2440
accgaccgugcauaca

SEQ ID NO: 1598022 - RNA, 20 nt, Pseudomonas putida KT2440
accgaccgugcauacacccg

SEQ ID NO: 1598023 - RNA, 19 nt, Pseudomonas putida KT2440
accgaccucuuagcgggca

SEQ ID NO: 1598024 - RNA, 16 nt, Pseudomonas putida KT2440
accgaccugcaacguc

SEQ ID NO: 1598025 - RNA, 18 nt, Pseudomonas putida KT2440
accgagguaccaccggag

SEQ ID NO: 1598026 - RNA, 17 nt, Pseudomonas putida KT2440
accgagugcccgcgcag

SEQ ID NO: 1598027 - RNA, 19 nt, Pseudomonas putida KT2440
accgcaaaucacugacccg

SEQ ID NO: 1598028 - RNA, 21 nt, Pseudomonas putida KT2440
accgcaacuggcccgcgccag

SEQ ID NO: 1598029 - RNA, 14 nt, Pseudomonas putida KT2440
accgcaagcugcac

SEQ ID NO: 1598030 - RNA, 17 nt, Pseudomonas putida KT2440
accgcacccggcgguga

SEQ ID NO: 1598031 - RNA, 23 nt, Pseudomonas putida KT2440
accgcacuccccaucagcagcug

SEQ ID NO: 1598032 - RNA, 20 nt, Pseudomonas putida KT2440
accgcacuuacuaucacgcc

SEQ ID NO: 1598033 - RNA, 16 nt, Pseudomonas putida KT2440
accgcacagcaucacc

SEQ ID NO: 1598034 - RNA, 16 nt, Pseudomonas putida KT2440
accgcacccgcaagcg

SEQ ID NO: 1598035 - RNA, 24 nt, Pseudomonas putida KT2440
accgcacccgcaagcgccgaugcu

SEQ ID NO: 1598036 - RNA, 16 nt, Pseudomonas putida KT2440
accgauucgcgcaggu

SEQ ID NO: 1598037 - RNA, 16 nt, Pseudomonas putida KT2440
accgaugcggugcagc

SEQ ID NO: 1598038 - RNA, 23 nt, Pseudomonas putida KT2440
accgaucucgccagccugcagcg

SEQ ID NO: 1598039 - RNA, 12 nt, Pseudomonas putida KT2440
accgcaucucca

SEQ ID NO: 1598040 - RNA, 21 nt, Pseudomonas putida KT2440
accgccagccaaccgcgugcu

SEQ ID NO: 1598041 - RNA, 15 nt, Pseudomonas putida KT2440
accgccagcgggcug

SEQ ID NO: 1598042 - RNA, 14 nt, Pseudomonas putida KT2440
accgccagcggcaa

SEQ ID NO: 1598043 - RNA, 16 nt, Pseudomonas putida KT2440
accgccagcggcaagc

SEQ ID NO: 1598044 - RNA, 15 nt, Pseudomonas putida KT2440
accgcaggucacugc

SEQ ID NO: 1598045 - RNA, 23 nt, Pseudomonas putida KT2440
accgcagaucggugcguaggagc

SEQ ID NO: 1598046 - RNA, 22 nt, Pseudomonas putida KT2440
accgcauccgcaccccaaggcu

SEQ ID NO: 1598047 - RNA, 23 nt, Pseudomonas putida KT2440
accgccuccacggucagcaucca

SEQ ID NO: 1598048 - RNA, 20 nt, Pseudomonas putida KT2440
accgccuaugaaaccgagcg

SEQ ID NO: 1598049 - RNA, 20 nt, Pseudomonas putida KT2440
accgccgcgccucgcggugc

SEQ ID NO: 1598050 - RNA, 15 nt, Pseudomonas putida KT2440
accgcgcaccuccug

SEQ ID NO: 1598051 - RNA, 21 nt, Pseudomonas putida KT2440
accgcgauaucagcgccagca

SEQ ID NO: 1598052 - RNA, 13 nt, Pseudomonas putida KT2440
accgccucgaucg

SEQ ID NO: 1598053 - RNA, 15 nt, Pseudomonas putida KT2440
accgccucuaccacg

SEQ ID NO: 1598054 - RNA, 12 nt, Pseudomonas putida KT2440
accgccucggua

SEQ ID NO: 1598055 - RNA, 18 nt, Pseudomonas putida KT2440
accgccucgaucgucgac

SEQ ID NO: 1598056 - RNA, 15 nt, Pseudomonas putida KT2440
accgcgucgccaauc

SEQ ID NO: 1598057 - RNA, 19 nt, Pseudomonas putida KT2440
accgcggugcugaccaccg

SEQ ID NO: 1598058 - RNA, 15 nt, Pseudomonas putida KT2440
accgcucugcgccac

SEQ ID NO: 1598059 - RNA, 16 nt, Pseudomonas putida KT2440
accgcgcugguaagcc

SEQ ID NO: 1598060 - RNA, 21 nt, Pseudomonas putida KT2440
accgcugccauagcgcugcac

SEQ ID NO: 1598061 - RNA, 17 nt, Pseudomonas putida KT2440
accgcugccgaucagca

SEQ ID NO: 1598062 - RNA, 18 nt, Pseudomonas putida KT2440
accgcuguacaggugcga

SEQ ID NO: 1598063 - RNA, 20 nt, Pseudomonas putida KT2440
accggaguccccaccggcac

SEQ ID NO: 1598064 - RNA, 13 nt, Pseudomonas putida KT2440
accgcuucaccgc

SEQ ID NO: 1598065 - RNA, 19 nt, Pseudomonas putida KT2440
accgcuugcacagguaucg

SEQ ID NO: 1598066 - RNA, 12 nt, Pseudomonas putida KT2440
accgcuugcgca

SEQ ID NO: 1598067 - RNA, 20 nt, Pseudomonas putida KT2440
accggugccccgguccagca

SEQ ID NO: 1598068 - RNA, 14 nt, Pseudomonas putida KT2440
accgguugcaggcg

SEQ ID NO: 1598069 - RNA, 17 nt, Pseudomonas putida KT2440
accgguugcaggcgagc

SEQ ID NO: 1598070 - RNA, 13 nt, Pseudomonas putida KT2440
accgguauaacgc

SEQ ID NO: 1598071 - RNA, 15 nt, Pseudomonas putida KT2440
accgguauagcgaca

SEQ ID NO: 1598072 - RNA, 20 nt, Pseudomonas putida KT2440
accggguucuugaagaagcu

SEQ ID NO: 1598073 - RNA, 21 nt, Pseudomonas putida KT2440
accggucauacauccagcuuc

SEQ ID NO: 1598074 - RNA, 16 nt, Pseudomonas putida KT2440
accggucggccaucga

SEQ ID NO: 1598075 - RNA, 18 nt, Pseudomonas putida KT2440
accggucggccaucgacg

SEQ ID NO: 1598076 - RNA, 14 nt, Pseudomonas putida KT2440
accgggcgcgauug

SEQ ID NO: 1598077 - RNA, 18 nt, Pseudomonas putida KT2440
accggcaccggcgaacag

SEQ ID NO: 1598078 - RNA, 21 nt, Pseudomonas putida KT2440
accggcaccggcgaacagcaa

SEQ ID NO: 1598079 - RNA, 21 nt, Pseudomonas putida KT2440
accggcaccgggaugcucugc

SEQ ID NO: 1598080 - RNA, 14 nt, Pseudomonas putida KT2440
accggcaaucgaca

SEQ ID NO: 1598081 - RNA, 15 nt, Pseudomonas putida KT2440
accggcaagcccaug

SEQ ID NO: 1598082 - RNA, 23 nt, Pseudomonas putida KT2440
accggcaagcccauggcuggcag

SEQ ID NO: 1598083 - RNA, 13 nt, Pseudomonas putida KT2440
accggcaccgccu

SEQ ID NO: 1598084 - RNA, 22 nt, Pseudomonas putida KT2440
accggcaccgccucuaccacgc

SEQ ID NO: 1598085 - RNA, 18 nt, Pseudomonas putida KT2440
accggcacaagcgucccu

SEQ ID NO: 1598086 - RNA, 13 nt, Pseudomonas putida KT2440
accgggcgggugc

SEQ ID NO: 1598087 - RNA, 17 nt, Pseudomonas putida KT2440
accgucgaugucggcgu

SEQ ID NO: 1598088 - RNA, 19 nt, Pseudomonas putida KT2440
accgucgaugucggcgugg

SEQ ID NO: 1598089 - RNA, 17 nt, Pseudomonas putida KT2440
accgguuugaagccaua

SEQ ID NO: 1598090 - RNA, 17 nt, Pseudomonas putida KT2440
accucgaugcccuccag

SEQ ID NO: 1598091 - RNA, 22 nt, Pseudomonas putida KT2440
accucgaucucgaagcugccac

SEQ ID NO: 1598092 - RNA, 16 nt, Pseudomonas putida KT2440
accucgaacuugcccg

SEQ ID NO: 1598093 - RNA, 15 nt, Pseudomonas putida KT2440
accucggcgaucagc

SEQ ID NO: 1598094 - RNA, 14 nt, Pseudomonas putida KT2440
accucggccagguc

SEQ ID NO: 1598095 - RNA, 15 nt, Pseudomonas putida KT2440
accugaacaaggccu

SEQ ID NO: 1598096 - RNA, 16 nt, Pseudomonas putida KT2440
accugaugcaccaggc

SEQ ID NO: 1598097 - RNA, 19 nt, Pseudomonas putida KT2440
accucgucaugcagcgcca

SEQ ID NO: 1598098 - RNA, 16 nt, Pseudomonas putida KT2440
accucgggcuuggcac

SEQ ID NO: 1598099 - RNA, 22 nt, Pseudomonas putida KT2440
accucaggccugcacugcaccc

SEQ ID NO: 1598100 - RNA, 15 nt, Pseudomonas putida KT2440
accucaccgccggcu

SEQ ID NO: 1598101 - RNA, 17 nt, Pseudomonas putida KT2440
accuaucgcugccgccu

SEQ ID NO: 1598102 - RNA, 19 nt, Pseudomonas putida KT2440
accuccaguugccaguguu

SEQ ID NO: 1598103 - RNA, 21 nt, Pseudomonas putida KT2440
accuccguugcugcggggugc

SEQ ID NO: 1598104 - RNA, 17 nt, Pseudomonas putida KT2440
accuccaccccgcaggc

SEQ ID NO: 1598105 - RNA, 22 nt, Pseudomonas putida KT2440
accgugcccgcccacgccgcug

SEQ ID NO: 1598106 - RNA, 15 nt, Pseudomonas putida KT2440
accgugcaccagcac

SEQ ID NO: 1598107 - RNA, 11 nt, Pseudomonas putida KT2440
accgugcugca

SEQ ID NO: 1598108 - RNA, 23 nt, Pseudomonas putida KT2440
accguggcgaucccuguaggagc

SEQ ID NO: 1598109 - RNA, 19 nt, Pseudomonas putida KT2440
accguucacguucaacgcc

SEQ ID NO: 1598110 - RNA, 18 nt, Pseudomonas putida KT2440
accguguugcagcggguu

SEQ ID NO: 1598111 - RNA, 20 nt, Pseudomonas putida KT2440
accugauguccaaauugggc

SEQ ID NO: 1598112 - RNA, 19 nt, Pseudomonas putida KT2440
accugcagcucagccagca

SEQ ID NO: 1598113 - RNA, 17 nt, Pseudomonas putida KT2440
accugcaggcgcggugc

SEQ ID NO: 1598114 - RNA, 17 nt, Pseudomonas putida KT2440
accugcagggucaggcg

SEQ ID NO: 1598115 - RNA, 21 nt, Pseudomonas putida KT2440
accugcagguaaugcgccgca

SEQ ID NO: 1598116 - RNA, 15 nt, Pseudomonas putida KT2440
accuugccaucgacc

SEQ ID NO: 1598117 - RNA, 16 nt, Pseudomonas putida KT2440
accugccaacgcaccg

SEQ ID NO: 1598118 - RNA, 22 nt, Pseudomonas putida KT2440
accugccaacgcaccgaccacg

SEQ ID NO: 1598119 - RNA, 15 nt, Pseudomonas putida KT2440
accuuguuacccgca

SEQ ID NO: 1598120 - RNA, 16 nt, Pseudomonas putida KT2440
accuugggccggcgca

SEQ ID NO: 1598121 - RNA, 14 nt, Pseudomonas putida KT2440
accuugggcgagga

SEQ ID NO: 1598122 - RNA, 19 nt, Pseudomonas putida KT2440
accuuggugccaaccuuga

SEQ ID NO: 1598123 - RNA, 22 nt, Pseudomonas putida KT2440
accuugcggguuucgucgauca

SEQ ID NO: 1598124 - RNA, 17 nt, Pseudomonas putida KT2440
accuugcuccaccaggc

SEQ ID NO: 1598125 - RNA, 16 nt, Pseudomonas putida KT2440
accuuggacgcuggca

SEQ ID NO: 1598126 - RNA, 17 nt, Pseudomonas putida KT2440
acgaacaguggcccgau

SEQ ID NO: 1598127 - RNA, 14 nt, Pseudomonas putida KT2440
acgaacaggcgcuu

SEQ ID NO: 1598128 - RNA, 15 nt, Pseudomonas putida KT2440
acgaaacgccaggca

SEQ ID NO: 1598129 - RNA, 17 nt, Pseudomonas putida KT2440
accuuugcggcacaucu

SEQ ID NO: 1598130 - RNA, 17 nt, Pseudomonas putida KT2440
acgaccucggccagguc

SEQ ID NO: 1598131 - RNA, 19 nt, Pseudomonas putida KT2440
acgacgauggccaccagca

SEQ ID NO: 1598132 - RNA, 23 nt, Pseudomonas putida KT2440
acgaccggcucaacagcaggugc

SEQ ID NO: 1598133 - RNA, 19 nt, Pseudomonas putida KT2440
acgacaggggcgcagagcg

SEQ ID NO: 1598134 - RNA, 16 nt, Pseudomonas putida KT2440
acgaauggguggcagc

SEQ ID NO: 1598135 - RNA, 14 nt, Pseudomonas putida KT2440
acgaaucugcagug

SEQ ID NO: 1598136 - RNA, 21 nt, Pseudomonas putida KT2440
acgacaagguagcggccagcc

SEQ ID NO: 1598137 - RNA, 20 nt, Pseudomonas putida KT2440
acgaauaucgccgaacgggc

SEQ ID NO: 1598138 - RNA, 20 nt, Pseudomonas putida KT2440
acgcaaccucguugcuggug

SEQ ID NO: 1598139 - RNA, 13 nt, Pseudomonas putida KT2440
acgcaacuccacg

SEQ ID NO: 1598140 - RNA, 18 nt, Pseudomonas putida KT2440
acgcaccagggcuggcag

SEQ ID NO: 1598141 - RNA, 19 nt, Pseudomonas putida KT2440
acgcaccagggcuggcagc

SEQ ID NO: 1598142 - RNA, 23 nt, Pseudomonas putida KT2440
acgcaccagggcuggcagcgggu

SEQ ID NO: 1598143 - RNA, 21 nt, Pseudomonas putida KT2440
acgcacagugguguacagcaa

SEQ ID NO: 1598144 - RNA, 16 nt, Pseudomonas putida KT2440
acgcaccgaucugcgg

SEQ ID NO: 1598145 - RNA, 23 nt, Pseudomonas putida KT2440
acgcacgugggucgggaacagcu

SEQ ID NO: 1598146 - RNA, 13 nt, Pseudomonas putida KT2440
acgaucgccagcc

SEQ ID NO: 1598147 - RNA, 20 nt, Pseudomonas putida KT2440
acgacugccgcccugguccg

SEQ ID NO: 1598148 - RNA, 19 nt, Pseudomonas putida KT2440
acgacuuauccgcuggcuu

SEQ ID NO: 1598149 - RNA, 17 nt, Pseudomonas putida KT2440
aaacaaugcacagcgcu

SEQ ID NO: 1598150 - RNA, 16 nt, Pseudomonas putida KT2440
aagaccgccgcccagg

SEQ ID NO: 1598151 - RNA, 12 nt, Pseudomonas putida KT2440
aagaaugccgcc

SEQ ID NO: 1598152 - RNA, 15 nt, Pseudomonas putida KT2440
aacugcuccaggcag

SEQ ID NO: 1598153 - RNA, 16 nt, Pseudomonas putida KT2440
aacugcucgcugccac

SEQ ID NO: 1598154 - RNA, 16 nt, Pseudomonas putida KT2440
aacuggcaucggucac

SEQ ID NO: 1598155 - RNA, 14 nt, Pseudomonas putida KT2440
aacuggccagcagc

SEQ ID NO: 1598156 - RNA, 15 nt, Pseudomonas putida KT2440
aacuggccaggguac

SEQ ID NO: 1598157 - RNA, 13 nt, Pseudomonas putida KT2440
aacuggcccaccc

SEQ ID NO: 1598158 - RNA, 21 nt, Pseudomonas putida KT2440
aacuggcucaugcgccagggc

SEQ ID NO: 1598159 - RNA, 19 nt, Pseudomonas putida KT2440
aacugugggagcaggcaug

SEQ ID NO: 1598160 - RNA, 15 nt, Pseudomonas putida KT2440
aacuucacuucgguu

SEQ ID NO: 1598161 - RNA, 14 nt, Pseudomonas putida KT2440
aacuuacuucggcg

SEQ ID NO: 1598162 - RNA, 14 nt, Pseudomonas putida KT2440
aacuucgccgaggc

SEQ ID NO: 1598163 - RNA, 19 nt, Pseudomonas putida KT2440
aacugaugaccggccuggu

SEQ ID NO: 1598164 - RNA, 21 nt, Pseudomonas putida KT2440
aacugcgggcugaggaaguug

SEQ ID NO: 1598165 - RNA, 16 nt, Pseudomonas putida KT2440
aacucuccuugcguug

SEQ ID NO: 1598166 - RNA, 14 nt, Pseudomonas putida KT2440
aacggccgucaccu

SEQ ID NO: 1598167 - RNA, 20 nt, Pseudomonas putida KT2440
aacgaggccgccauuaccgg

SEQ ID NO: 1598168 - RNA, 21 nt, Pseudomonas putida KT2440
aacgccccacccgcucaaagc

SEQ ID NO: 1598169 - RNA, 13 nt, Pseudomonas putida KT2440
aacgccccagcag

SEQ ID NO: 1598170 - RNA, 17 nt, Pseudomonas putida KT2440
aacgccccccggcucca

SEQ ID NO: 1598171 - RNA, 23 nt, Pseudomonas putida KT2440
aacgccagggcaaucgccaaggu

SEQ ID NO: 1598172 - RNA, 18 nt, Pseudomonas putida KT2440
aacgccagcuguucgguc

SEQ ID NO: 1598173 - RNA, 16 nt, Pseudomonas putida KT2440
aacgccuucaggcgaa

SEQ ID NO: 1598174 - RNA, 15 nt, Pseudomonas putida KT2440
aacgcggaucgugac

SEQ ID NO: 1598175 - RNA, 13 nt, Pseudomonas putida KT2440
aacgcggucagca

SEQ ID NO: 1598176 - RNA, 16 nt, Pseudomonas putida KT2440
aaccggugcaacugcc

SEQ ID NO: 1598177 - RNA, 17 nt, Pseudomonas putida KT2440
aaccguuggucagcgac

SEQ ID NO: 1598178 - RNA, 14 nt, Pseudomonas putida KT2440
aaccucaacgccau

SEQ ID NO: 1598179 - RNA, 20 nt, Pseudomonas putida KT2440
aaccggcuuguagccggcag

SEQ ID NO: 1598180 - RNA, 14 nt, Pseudomonas putida KT2440
aaccggcgcuggcc

SEQ ID NO: 1598181 - RNA, 16 nt, Pseudomonas putida KT2440
aaccgcuguacaggug

SEQ ID NO: 1598182 - RNA, 22 nt, Pseudomonas putida KT2440
aacacggcuucgcagacgucuu

SEQ ID NO: 1598183 - RNA, 16 nt, Pseudomonas putida KT2440
aagucggguuuaccug

SEQ ID NO: 1598184 - RNA, 13 nt, Pseudomonas putida KT2440
aaggugcccugcu

SEQ ID NO: 1598185 - RNA, 23 nt, Pseudomonas putida KT2440
aagguggcauuggcgugcucgcg

SEQ ID NO: 1598186 - RNA, 20 nt, Pseudomonas putida KT2440
aagugccgccucguugcgaa

SEQ ID NO: 1598187 - RNA, 12 nt, Pseudomonas putida KT2440
aaguggccaagc

SEQ ID NO: 1598188 - RNA, 19 nt, Pseudomonas putida KT2440
aaguggauauccagcgagg

SEQ ID NO: 1598189 - RNA, 20 nt, Pseudomonas putida KT2440
aagugcuguaugauucgccu

SEQ ID NO: 1598190 - RNA, 17 nt, Pseudomonas putida KT2440
aagacgaaguacggcuu

SEQ ID NO: 1598191 - RNA, 18 nt, Pseudomonas putida KT2440
aagacuccgcuucaucag

SEQ ID NO: 1598192 - RNA, 14 nt, Pseudomonas putida KT2440
aagccaacugcucu

SEQ ID NO: 1598193 - RNA, 19 nt, Pseudomonas putida KT2440
aagagaagcugcagcuuca

SEQ ID NO: 1598194 - RNA, 13 nt, Pseudomonas putida KT2440
aagccacgccaga

SEQ ID NO: 1598195 - RNA, 17 nt, Pseudomonas putida KT2440
aagccagcagccugugc

SEQ ID NO: 1598196 - RNA, 14 nt, Pseudomonas putida KT2440
aagccagcccugcc

SEQ ID NO: 1598197 - RNA, 16 nt, Pseudomonas putida KT2440
aagccaguacgcaggc

SEQ ID NO: 1598198 - RNA, 15 nt, Pseudomonas putida KT2440
aagccauaucccgcc

SEQ ID NO: 1598199 - RNA, 16 nt, Pseudomonas putida KT2440
aagccgcugccacagg

SEQ ID NO: 1598200 - RNA, 13 nt, Pseudomonas putida KT2440
aagccgccacaug

SEQ ID NO: 1598201 - RNA, 10 nt, Pseudomonas putida KT2440
aagcccugcc

SEQ ID NO: 1598202 - RNA, 19 nt, Pseudomonas putida KT2440
aagccaugaucagcgccug

SEQ ID NO: 1598203 - RNA, 20 nt, Pseudomonas putida KT2440
aagccuaaucgggcagaugc

SEQ ID NO: 1598204 - RNA, 18 nt, Pseudomonas putida KT2440
aagccucagcgcccgcug

SEQ ID NO: 1598205 - RNA, 21 nt, Pseudomonas putida KT2440
aagccggcgcucagcgggcgu

SEQ ID NO: 1598206 - RNA, 19 nt, Pseudomonas putida KT2440
aagcgcauugaucgccgcc

SEQ ID NO: 1598207 - RNA, 16 nt, Pseudomonas putida KT2440
aagcgccaauuggcgg

SEQ ID NO: 1598208 - RNA, 19 nt, Pseudomonas putida KT2440
aagcggccuuuucgcgcua

SEQ ID NO: 1598209 - RNA, 16 nt, Pseudomonas putida KT2440
aagcgguugcccgcug

SEQ ID NO: 1598210 - RNA, 19 nt, Pseudomonas putida KT2440
aaggccaccacgguacuug

SEQ ID NO: 1598211 - RNA, 19 nt, Pseudomonas putida KT2440
aaggccagccgagccaagc

SEQ ID NO: 1598212 - RNA, 13 nt, Pseudomonas putida KT2440
aaggccagcgccu

SEQ ID NO: 1598213 - RNA, 19 nt, Pseudomonas putida KT2440
aaggcaaagaagucgccac

SEQ ID NO: 1598214 - RNA, 20 nt, Pseudomonas putida KT2440
aaggcauccacaccguacug

SEQ ID NO: 1598215 - RNA, 22 nt, Pseudomonas putida KT2440
aaggcauccacaccguacugcu

SEQ ID NO: 1598216 - RNA, 19 nt, Pseudomonas putida KT2440
aaggccggcagccagggcc

SEQ ID NO: 1598217 - RNA, 19 nt, Pseudomonas putida KT2440
aaggccgccggcaacuggc

SEQ ID NO: 1598218 - RNA, 18 nt, Pseudomonas putida KT2440
aagguagugcaccaacgc

SEQ ID NO: 1598219 - RNA, 20 nt, Pseudomonas putida KT2440
aagguagugcaccaacgccg

SEQ ID NO: 1598220 - RNA, 23 nt, Pseudomonas putida KT2440
aaggucacgcccaucaggaacag

SEQ ID NO: 1598221 - RNA, 14 nt, Pseudomonas putida KT2440
aaggcuugcccuca

SEQ ID NO: 1598222 - RNA, 17 nt, Pseudomonas putida KT2440
aaggcugacgccaguug

SEQ ID NO: 1598223 - RNA, 15 nt, Pseudomonas putida KT2440
aaggcuggucgcugc

SEQ ID NO: 1598224 - RNA, 21 nt, Pseudomonas putida KT2440
aaggcugcccucgggcagccu

SEQ ID NO: 1598225 - RNA, 13 nt, Pseudomonas putida KT2440
acagacgggucgg

SEQ ID NO: 1598226 - RNA, 19 nt, Pseudomonas putida KT2440
acagaugcugcugcagugc

SEQ ID NO: 1598227 - RNA, 16 nt, Pseudomonas putida KT2440
acagauacuggcgcug

SEQ ID NO: 1598228 - RNA, 19 nt, Pseudomonas putida KT2440
acagcaccgccauggccag

SEQ ID NO: 1598229 - RNA, 12 nt, Pseudomonas putida KT2440
acagcaccaugc

SEQ ID NO: 1598230 - RNA, 14 nt, Pseudomonas putida KT2440
acagcaccaugcgc

SEQ ID NO: 1598231 - RNA, 15 nt, Pseudomonas putida KT2440
acagcaaccgcguga

SEQ ID NO: 1598232 - RNA, 20 nt, Pseudomonas putida KT2440
acagcaacaccguagcgagc

SEQ ID NO: 1598233 - RNA, 18 nt, Pseudomonas putida KT2440
acacugucccgaucaggu

SEQ ID NO: 1598234 - RNA, 16 nt, Pseudomonas putida KT2440
acacugucccggcaca

SEQ ID NO: 1598235 - RNA, 15 nt, Pseudomonas putida KT2440
acagaacaccaccag

SEQ ID NO: 1598236 - RNA, 18 nt, Pseudomonas putida KT2440
acacuucaggcugcgccg

SEQ ID NO: 1598237 - RNA, 22 nt, Pseudomonas putida KT2440
acacuugguccagggccauggc

SEQ ID NO: 1598238 - RNA, 17 nt, Pseudomonas putida KT2440
acacgucauacagcccg

SEQ ID NO: 1598239 - RNA, 20 nt, Pseudomonas putida KT2440
acacguccagccccgcaccg

SEQ ID NO: 1598240 - RNA, 14 nt, Pseudomonas putida KT2440
acacuccccucgac

SEQ ID NO: 1598241 - RNA, 18 nt, Pseudomonas putida KT2440
acacucgccaggaucggc

SEQ ID NO: 1598242 - RNA, 15 nt, Pseudomonas putida KT2440
acacugaucucgcgc

SEQ ID NO: 1598243 - RNA, 22 nt, Pseudomonas putida KT2440
acagcagcugcauuggcggcag

SEQ ID NO: 1598244 - RNA, 15 nt, Pseudomonas putida KT2440
acagcaggaacagcg

SEQ ID NO: 1598245 - RNA, 21 nt, Pseudomonas putida KT2440
acagcaggaacagcggcagca

SEQ ID NO: 1598246 - RNA, 13 nt, Pseudomonas putida KT2440
acagcagcgccgc

SEQ ID NO: 1598247 - RNA, 16 nt, Pseudomonas putida KT2440
acagcaucagccaugg

SEQ ID NO: 1598248 - RNA, 22 nt, Pseudomonas putida KT2440
acagcaucaaucgcuccaggcg

SEQ ID NO: 1598249 - RNA, 15 nt, Pseudomonas putida KT2440
acagccucaaggccg

SEQ ID NO: 1598250 - RNA, 18 nt, Pseudomonas putida KT2440
acagccuaccaacgcagc

SEQ ID NO: 1598251 - RNA, 17 nt, Pseudomonas putida KT2440
acagcgcauaggccaag

SEQ ID NO: 1598252 - RNA, 17 nt, Pseudomonas putida KT2440
acagcgcacucucccgc

SEQ ID NO: 1598253 - RNA, 20 nt, Pseudomonas putida KT2440
acagcgagcagccuggcauu

SEQ ID NO: 1598254 - RNA, 21 nt, Pseudomonas putida KT2440
acagcggcgaaggauggaccg

SEQ ID NO: 1598255 - RNA, 16 nt, Pseudomonas putida KT2440
acagcguccaguucaa

SEQ ID NO: 1598256 - RNA, 20 nt, Pseudomonas putida KT2440
acagcugaucgccgucgacc

SEQ ID NO: 1598257 - RNA, 17 nt, Pseudomonas putida KT2440
acagcugcacaucucca

SEQ ID NO: 1598258 - RNA, 21 nt, Pseudomonas putida KT2440
acaggagucuacggaccuccg

SEQ ID NO: 1598259 - RNA, 15 nt, Pseudomonas putida KT2440
acaggaccaggccga

SEQ ID NO: 1598260 - RNA, 17 nt, Pseudomonas putida KT2440
acaggaaugucaccgcg

SEQ ID NO: 1598261 - RNA, 21 nt, Pseudomonas putida KT2440
acagcugugugucgucacggc

SEQ ID NO: 1598262 - RNA, 17 nt, Pseudomonas putida KT2440
acagguuuagcgcuggc

SEQ ID NO: 1598263 - RNA, 15 nt, Pseudomonas putida KT2440
acagguucggcucac

SEQ ID NO: 1598264 - RNA, 15 nt, Pseudomonas putida KT2440
acagguucucggcac

SEQ ID NO: 1598265 - RNA, 15 nt, Pseudomonas putida KT2440
acagguugcggccau

SEQ ID NO: 1598266 - RNA, 22 nt, Pseudomonas putida KT2440
acaggugcgcgcgcgacagcac

SEQ ID NO: 1598267 - RNA, 19 nt, Pseudomonas putida KT2440
acaggugauagacguggcu

SEQ ID NO: 1598268 - RNA, 19 nt, Pseudomonas putida KT2440
acaggucguaaucgcccgc

SEQ ID NO: 1598269 - RNA, 17 nt, Pseudomonas putida KT2440
acagguaguuggccggg

SEQ ID NO: 1598270 - RNA, 21 nt, Pseudomonas putida KT2440
acaggcuaaagugccuugauc

SEQ ID NO: 1598271 - RNA, 18 nt, Pseudomonas putida KT2440
acaggcgcuugaagaagc

SEQ ID NO: 1598272 - RNA, 21 nt, Pseudomonas putida KT2440
acaccguagcgagcaccggca

SEQ ID NO: 1598273 - RNA, 20 nt, Pseudomonas putida KT2440
acaccggguguuggacacag

SEQ ID NO: 1598274 - RNA, 19 nt, Pseudomonas putida KT2440
acacgacgauggccaccag

SEQ ID NO: 1598275 - RNA, 17 nt, Pseudomonas putida KT2440
acacgaacaucagcagg

SEQ ID NO: 1598276 - RNA, 13 nt, Pseudomonas putida KT2440
acacgggcgaagc

SEQ ID NO: 1598277 - RNA, 16 nt, Pseudomonas putida KT2440
acacgcucaugaacag

SEQ ID NO: 1598278 - RNA, 21 nt, Pseudomonas putida KT2440
acacgcucaugaacagcgccc

SEQ ID NO: 1598279 - RNA, 15 nt, Pseudomonas putida KT2440
acacgccgucgaccu

SEQ ID NO: 1598280 - RNA, 18 nt, Pseudomonas putida KT2440
acacgcccgcgugcuuca

SEQ ID NO: 1598281 - RNA, 20 nt, Pseudomonas putida KT2440
acacgcccgugcucacgcac

SEQ ID NO: 1598282 - RNA, 13 nt, Pseudomonas putida KT2440
aaaaguuggccau

SEQ ID NO: 1598283 - RNA, 21 nt, Pseudomonas putida KT2440
aaaaguuggcugaccggcacg

SEQ ID NO: 1598284 - RNA, 21 nt, Pseudomonas putida KT2440
acaccaguucgccaucgcgca

SEQ ID NO: 1598285 - RNA, 12 nt, Pseudomonas putida KT2440
acaccagcagcc

SEQ ID NO: 1598286 - RNA, 18 nt, Pseudomonas putida KT2440
acaccagcaacaucggug

SEQ ID NO: 1598287 - RNA, 18 nt, Pseudomonas putida KT2440
acacaucgguacgccgca

SEQ ID NO: 1598288 - RNA, 15 nt, Pseudomonas putida KT2440
acacauccagcgccg

SEQ ID NO: 1598289 - RNA, 15 nt, Pseudomonas putida KT2440
acacagucuucggag

SEQ ID NO: 1598290 - RNA, 22 nt, Pseudomonas putida KT2440
acaccaccgcgaaacacagcag

SEQ ID NO: 1598291 - RNA, 12 nt, Pseudomonas putida KT2440
acaccacgccaa

SEQ ID NO: 1598292 - RNA, 15 nt, Pseudomonas putida KT2440
acaccagacucagcg

SEQ ID NO: 1598293 - RNA, 22 nt, Pseudomonas putida KT2440
acaccgggaacaggugcgcgcg

SEQ ID NO: 1598294 - RNA, 12 nt, Pseudomonas putida KT2440
acacccgcucgg

SEQ ID NO: 1598295 - RNA, 19 nt, Pseudomonas putida KT2440
acaccccgauucacagcag

SEQ ID NO: 1598296 - RNA, 21 nt, Pseudomonas putida KT2440
aauggcgguuuugagacgcau

SEQ ID NO: 1598297 - RNA, 21 nt, Pseudomonas putida KT2440
aaugggucaggaugccgugcg

SEQ ID NO: 1598298 - RNA, 15 nt, Pseudomonas putida KT2440
aaugcggugugcugc

SEQ ID NO: 1598299 - RNA, 18 nt, Pseudomonas putida KT2440
aaugcuccggcgacagcu

SEQ ID NO: 1598300 - RNA, 22 nt, Pseudomonas putida KT2440
aauggcgaugaacacgccgucg

SEQ ID NO: 1598301 - RNA, 14 nt, Pseudomonas putida KT2440
aaugcugccaugca

SEQ ID NO: 1598302 - RNA, 17 nt, Pseudomonas putida KT2440
aaugcugccuuuuccug

SEQ ID NO: 1598303 - RNA, 16 nt, Pseudomonas putida KT2440
aaugcccauggccagg

SEQ ID NO: 1598304 - RNA, 18 nt, Pseudomonas putida KT2440
acaaugcacagcgcucga

SEQ ID NO: 1598305 - RNA, 17 nt, Pseudomonas putida KT2440
acacaccggguguugga

SEQ ID NO: 1598306 - RNA, 18 nt, Pseudomonas putida KT2440
acacagaugccgccgcug

SEQ ID NO: 1598307 - RNA, 20 nt, Pseudomonas putida KT2440
acacaaggccgcucccacag

SEQ ID NO: 1598308 - RNA, 19 nt, Pseudomonas putida KT2440
acacaaggccgcucccacg

SEQ ID NO: 1598309 - RNA, 23 nt, Pseudomonas putida KT2440
acaaguuucaaaaacggugcaga

SEQ ID NO: 1598310 - RNA, 14 nt, Pseudomonas putida KT2440
acaagccacgcacc

SEQ ID NO: 1598311 - RNA, 15 nt, Pseudomonas putida KT2440
acaagccacgcaccu

SEQ ID NO: 1598312 - RNA, 20 nt, Pseudomonas putida KT2440
acaagcgucccugcccgauc

SEQ ID NO: 1598313 - RNA, 22 nt, Pseudomonas putida KT2440
acaagcgcaggcgguuggccau

SEQ ID NO: 1598314 - RNA, 21 nt, Pseudomonas putida KT2440
acaaggcaaaggucugcugcg

SEQ ID NO: 1598315 - RNA, 18 nt, Pseudomonas putida KT2440
acaagcgcauugaucgcc

SEQ ID NO: 1598316 - RNA, 18 nt, Pseudomonas putida KT2440
acaaggccacuggcgucg

SEQ ID NO: 1598317 - RNA, 16 nt, Pseudomonas putida KT2440
acaacgcagccggcac

SEQ ID NO: 1598318 - RNA, 22 nt, Pseudomonas putida KT2440
acaacgcccgccgucaucgaac

SEQ ID NO: 1598319 - RNA, 15 nt, Pseudomonas putida KT2440
acaacgaugugcgag

SEQ ID NO: 1598320 - RNA, 16 nt, Pseudomonas putida KT2440
acaacgcgccaccgcc

SEQ ID NO: 1598321 - RNA, 14 nt, Pseudomonas putida KT2440
acaacuaucgagca

SEQ ID NO: 1598322 - RNA, 20 nt, Pseudomonas putida KT2440
acaaccccaaccucaacgcc

SEQ ID NO: 1598323 - RNA, 19 nt, Pseudomonas putida KT2440
acaaccccugcaaggccag

SEQ ID NO: 1598324 - RNA, 14 nt, Pseudomonas putida KT2440
acaacaggucggcg

SEQ ID NO: 1598325 - RNA, 20 nt, Pseudomonas putida KT2440
aauuucuuucagcucggcac

SEQ ID NO: 1598326 - RNA, 17 nt, Pseudomonas putida KT2440
acaaagccccggcagcg

SEQ ID NO: 1598327 - RNA, 20 nt, Pseudomonas putida KT2440
acaaaguugccgaugaugcg

SEQ ID NO: 1598328 - RNA, 16 nt, Pseudomonas putida KT2440
aaauccgcgccgauca

SEQ ID NO: 1598329 - RNA, 17 nt, Pseudomonas putida KT2440
aaaugcagaugcgcgau

SEQ ID NO: 1598330 - RNA, 13 nt, Pseudomonas putida KT2440
aacaccaucuuca

SEQ ID NO: 1598331 - RNA, 20 nt, Pseudomonas putida KT2440
aacacccugcaccacggcag

SEQ ID NO: 1598332 - RNA, 11 nt, Pseudomonas putida KT2440
aacacauccag

SEQ ID NO: 1598333 - RNA, 17 nt, Pseudomonas putida KT2440
aacacagcaggccaagg

SEQ ID NO: 1598334 - RNA, 17 nt, Pseudomonas putida KT2440
aaaagggucuugcucgc

SEQ ID NO: 1598335 - RNA, 15 nt, Pseudomonas putida KT2440
aacaaaucggccuug

SEQ ID NO: 1598336 - RNA, 21 nt, Pseudomonas putida KT2440
aaauguccauugagcacucaa

SEQ ID NO: 1598337 - RNA, 23 nt, Pseudomonas putida KT2440
aaaacggaaauaccggggcaccu

SEQ ID NO: 1598338 - RNA, 13 nt, Pseudomonas putida KT2440
aaaacucugcagg

SEQ ID NO: 1598339 - RNA, 16 nt, Pseudomonas putida KT2440
aaaacggugcagaccu

SEQ ID NO: 1598340 - RNA, 19 nt, Pseudomonas putida KT2440
aaaccggguaggccccagg

SEQ ID NO: 1598341 - RNA, 23 nt, Pseudomonas putida KT2440
aaaccggcaccggcgaacagcaa

SEQ ID NO: 1598342 - RNA, 22 nt, Pseudomonas putida KT2440
aaaccugccggugcgcgggcgu

SEQ ID NO: 1598343 - RNA, 20 nt, Pseudomonas putida KT2440
aaaccgcucgaacaagcgcg

SEQ ID NO: 1598344 - RNA, 12 nt, Pseudomonas putida KT2440
aaaccgccagcc

SEQ ID NO: 1598345 - RNA, 12 nt, Pseudomonas putida KT2440
aaacccaggcaa

SEQ ID NO: 1598346 - RNA, 20 nt, Pseudomonas putida KT2440
aaacccgccccuauacacau

SEQ ID NO: 1598347 - RNA, 18 nt, Pseudomonas putida KT2440
aaaccaaacgcccgcgca

SEQ ID NO: 1598348 - RNA, 23 nt, Pseudomonas putida KT2440
aaagcccuugucgaacagcugau

SEQ ID NO: 1598349 - RNA, 10 nt, Pseudomonas putida KT2440
aaagcggccc

SEQ ID NO: 1598350 - RNA, 13 nt, Pseudomonas putida KT2440
aaagcgagcaugg

SEQ ID NO: 1598351 - RNA, 24 nt, Pseudomonas putida KT2440
aaagcaggauggugacugccagca

SEQ ID NO: 1598352 - RNA, 22 nt, Pseudomonas putida KT2440
aaagagcaacgguuuaccgccg

SEQ ID NO: 1598353 - RNA, 22 nt, Pseudomonas putida KT2440
aaacggaccgcauaguggguau

SEQ ID NO: 1598354 - RNA, 14 nt, Pseudomonas putida KT2440
aaacgccgggcacu

SEQ ID NO: 1598355 - RNA, 20 nt, Pseudomonas putida KT2440
aaaagaaaaagggcaucuca

SEQ ID NO: 1598356 - RNA, 12 nt, Pseudomonas putida KT2440
aaaaggcccgaa

SEQ ID NO: 1598357 - RNA, 20 nt, Pseudomonas putida KT2440
uuuuucauucagcuuuggcu

SEQ ID NO: 1598358 - RNA, 11 nt, Pseudomonas putida KT2440
uuuucaucaaa

SEQ ID NO: 1598359 - RNA, 19 nt, Pseudomonas putida KT2440
uuuaccugcagcucagcca

SEQ ID NO: 1598360 - RNA, 21 nt, Pseudomonas putida KT2440
uuuaccgguugcaggcgagcu

SEQ ID NO: 1598361 - RNA, 12 nt, Pseudomonas putida KT2440
uuuucaccuucg

SEQ ID NO: 1598362 - RNA, 21 nt, Pseudomonas putida KT2440
uuuucaccuccaguugccagu

SEQ ID NO: 1598363 - RNA, 14 nt, Pseudomonas putida KT2440
uuuugaauuuuuua

SEQ ID NO: 1598364 - RNA, 22 nt, Pseudomonas putida KT2440
uuuucuuuacaacccagacuca

SEQ ID NO: 1598365 - RNA, 23 nt, Pseudomonas putida KT2440
uuuugcgcagcggcgucaccuuc

SEQ ID NO: 1598366 - RNA, 14 nt, Pseudomonas putida KT2440
uuuuggauuuuuug

SEQ ID NO: 1598367 - RNA, 16 nt, Pseudomonas putida KT2440
uuuuguucuccagcau

SEQ ID NO: 1598368 - RNA, 13 nt, Pseudomonas putida KT2440
uuuuguccauucu

SEQ ID NO: 1598369 - RNA, 13 nt, Pseudomonas putida KT2440
uuuugugccugug

SEQ ID NO: 1598370 - RNA, 22 nt, Pseudomonas putida KT2440
uucgucgaccgccgccuggcuc

SEQ ID NO: 1598371 - RNA, 18 nt, Pseudomonas putida KT2440
uucgucggccuuguucaa

SEQ ID NO: 1598372 - RNA, 21 nt, Pseudomonas putida KT2440
uucgucggugcccuucacugg

SEQ ID NO: 1598373 - RNA, 22 nt, Pseudomonas putida KT2440
uucggcagcacccgcuuggcca

SEQ ID NO: 1598374 - RNA, 17 nt, Pseudomonas putida KT2440
uucggcaugcacggcag

SEQ ID NO: 1598375 - RNA, 12 nt, Pseudomonas putida KT2440
uucggccagcag

SEQ ID NO: 1598376 - RNA, 21 nt, Pseudomonas putida KT2440
uucggcaaggcgaccugccag

SEQ ID NO: 1598377 - RNA, 12 nt, Pseudomonas putida KT2440
uucguccaggcu

SEQ ID NO: 1598378 - RNA, 13 nt, Pseudomonas putida KT2440
uucguccaggcuc

SEQ ID NO: 1598379 - RNA, 21 nt, Pseudomonas putida KT2440
uucguccaggcucagcucguc

SEQ ID NO: 1598380 - RNA, 13 nt, Pseudomonas putida KT2440
uucguccaggcuu

SEQ ID NO: 1598381 - RNA, 14 nt, Pseudomonas putida KT2440
uucggugugcucca

SEQ ID NO: 1598382 - RNA, 21 nt, Pseudomonas putida KT2440
uucuccuuggacagcaauucc

SEQ ID NO: 1598383 - RNA, 18 nt, Pseudomonas putida KT2440
uucuccugugccggccuc

SEQ ID NO: 1598384 - RNA, 20 nt, Pseudomonas putida KT2440
uucuugaagcguucagucag

SEQ ID NO: 1598385 - RNA, 20 nt, Pseudomonas putida KT2440
uucuucauauccgcuuugcu

SEQ ID NO: 1598386 - RNA, 20 nt, Pseudomonas putida KT2440
uucucgucuggcgcggcaca

SEQ ID NO: 1598387 - RNA, 17 nt, Pseudomonas putida KT2440
uucucgguauccggcuc

SEQ ID NO: 1598388 - RNA, 13 nt, Pseudomonas putida KT2440
uucucggcugccu

SEQ ID NO: 1598389 - RNA, 19 nt, Pseudomonas putida KT2440
uucucgcucagguaggcag

SEQ ID NO: 1598390 - RNA, 14 nt, Pseudomonas putida KT2440
uucucgcagcagca

SEQ ID NO: 1598391 - RNA, 15 nt, Pseudomonas putida KT2440
uucucgcagcagcac

SEQ ID NO: 1598392 - RNA, 16 nt, Pseudomonas putida KT2440
uucucgagcggccuga

SEQ ID NO: 1598393 - RNA, 19 nt, Pseudomonas putida KT2440
uucucgagcugaugcucaa

SEQ ID NO: 1598394 - RNA, 14 nt, Pseudomonas putida KT2440
uucugcuugaggcc

SEQ ID NO: 1598395 - RNA, 16 nt, Pseudomonas putida KT2440
uucuggauaugcucca

SEQ ID NO: 1598396 - RNA, 22 nt, Pseudomonas putida KT2440
uucuggcuggagccguccagga

SEQ ID NO: 1598397 - RNA, 17 nt, Pseudomonas putida KT2440
uugcagccccagccuca

SEQ ID NO: 1598398 - RNA, 21 nt, Pseudomonas putida KT2440
uugcagccccagccucagcug

SEQ ID NO: 1598399 - RNA, 19 nt, Pseudomonas putida KT2440
uugaugacuuuggcgucgg

SEQ ID NO: 1598400 - RNA, 15 nt, Pseudomonas putida KT2440
uugaugaaauccacc

SEQ ID NO: 1598401 - RNA, 16 nt, Pseudomonas putida KT2440
uugagccgccaacccg

SEQ ID NO: 1598402 - RNA, 20 nt, Pseudomonas putida KT2440
uugagcaggucgaacagccc

SEQ ID NO: 1598403 - RNA, 17 nt, Pseudomonas putida KT2440
uugaucgcuugucucca

SEQ ID NO: 1598404 - RNA, 12 nt, Pseudomonas putida KT2440
uucuugaaauua

SEQ ID NO: 1598405 - RNA, 16 nt, Pseudomonas putida KT2440
uucuugccgagcagcg

SEQ ID NO: 1598406 - RNA, 23 nt, Pseudomonas putida KT2440
uucuuugaaaguggccaagccac

SEQ ID NO: 1598407 - RNA, 18 nt, Pseudomonas putida KT2440
uugaaaaaaggcccuucg

SEQ ID NO: 1598408 - RNA, 18 nt, Pseudomonas putida KT2440
uugaaacggucagcggca

SEQ ID NO: 1598409 - RNA, 18 nt, Pseudomonas putida KT2440
uugaacagguugcugccg

SEQ ID NO: 1598410 - RNA, 17 nt, Pseudomonas putida KT2440
uugaacgacaaccccca

SEQ ID NO: 1598411 - RNA, 14 nt, Pseudomonas putida KT2440
uugaagaacagugu

SEQ ID NO: 1598412 - RNA, 15 nt, Pseudomonas putida KT2440
uuguucaccacaccc

SEQ ID NO: 1598413 - RNA, 20 nt, Pseudomonas putida KT2440
uuguuucgggccagucccuc

SEQ ID NO: 1598414 - RNA, 13 nt, Pseudomonas putida KT2440
uuguugccagcgg

SEQ ID NO: 1598415 - RNA, 13 nt, Pseudomonas putida KT2440
uuguggucuuccu

SEQ ID NO: 1598416 - RNA, 17 nt, Pseudomonas putida KT2440
uugucgcccgcccagcc

SEQ ID NO: 1598417 - RNA, 13 nt, Pseudomonas putida KT2440
uugucugacagca

SEQ ID NO: 1598418 - RNA, 21 nt, Pseudomonas putida KT2440
uugugaaacaccacacuagcc

SEQ ID NO: 1598419 - RNA, 20 nt, Pseudomonas putida KT2440
uugucuuccaguuccaucca

SEQ ID NO: 1598420 - RNA, 23 nt, Pseudomonas putida KT2440
uuguccuggaucagccgcgccau

SEQ ID NO: 1598421 - RNA, 14 nt, Pseudomonas putida KT2440
uugucaaaugcccc

SEQ ID NO: 1598422 - RNA, 17 nt, Pseudomonas putida KT2440
uuguagcccaccaccuu

SEQ ID NO: 1598423 - RNA, 23 nt, Pseudomonas putida KT2440
uuguagcucagguagaccugcgu

SEQ ID NO: 1598424 - RNA, 22 nt, Pseudomonas putida KT2440
uuguaguucuuggucagcauca

SEQ ID NO: 1598425 - RNA, 17 nt, Pseudomonas putida KT2440
uuguauuggccaagaau

SEQ ID NO: 1598426 - RNA, 13 nt, Pseudomonas putida KT2440
uugguuuuuucac

SEQ ID NO: 1598427 - RNA, 11 nt, Pseudomonas putida KT2440
uuuaaaccuuc

SEQ ID NO: 1598428 - RNA, 19 nt, Pseudomonas putida KT2440
uuggucuguacaaaagauc

SEQ ID NO: 1598429 - RNA, 16 nt, Pseudomonas putida KT2440
uugguuugacgcugcu

SEQ ID NO: 1598430 - RNA, 18 nt, Pseudomonas putida KT2440
uuggugaugcuggcuuca

SEQ ID NO: 1598431 - RNA, 15 nt, Pseudomonas putida KT2440
uuggugaaagcgcaa

SEQ ID NO: 1598432 - RNA, 12 nt, Pseudomonas putida KT2440
uuggccgggccu

SEQ ID NO: 1598433 - RNA, 14 nt, Pseudomonas putida KT2440
uuggccgggccuuu

SEQ ID NO: 1598434 - RNA, 14 nt, Pseudomonas putida KT2440
uuggccuucccuuc

SEQ ID NO: 1598435 - RNA, 20 nt, Pseudomonas putida KT2440
uuggcucuguggauuucaau

SEQ ID NO: 1598436 - RNA, 21 nt, Pseudomonas putida KT2440
uuggcccgacaaagaagcgcc

SEQ ID NO: 1598437 - RNA, 17 nt, Pseudomonas putida KT2440
uuggccgacuggcgcac

SEQ ID NO: 1598438 - RNA, 22 nt, Pseudomonas putida KT2440
uuggccgcgcgcccaucugcac

SEQ ID NO: 1598439 - RNA, 15 nt, Pseudomonas putida KT2440
uuggccgcuggcccu

SEQ ID NO: 1598440 - RNA, 19 nt, Pseudomonas putida KT2440
uuggccgcuggcccuucgc

SEQ ID NO: 1598441 - RNA, 17 nt, Pseudomonas putida KT2440
uugggguuuggugguug

SEQ ID NO: 1598442 - RNA, 22 nt, Pseudomonas putida KT2440
uuggcuggugaaggcaggucag

SEQ ID NO: 1598443 - RNA, 13 nt, Pseudomonas putida KT2440
uuggcugugagau

SEQ ID NO: 1598444 - RNA, 18 nt, Pseudomonas putida KT2440
uugcuggcgacgcugccc

SEQ ID NO: 1598445 - RNA, 13 nt, Pseudomonas putida KT2440
uugcugcucugca

SEQ ID NO: 1598446 - RNA, 12 nt, Pseudomonas putida KT2440
uuggaaaaugau

SEQ ID NO: 1598447 - RNA, 14 nt, Pseudomonas putida KT2440
uuggaaaauguuac

SEQ ID NO: 1598448 - RNA, 21 nt, Pseudomonas putida KT2440
uuggaaaauguuacccaagca

SEQ ID NO: 1598449 - RNA, 19 nt, Pseudomonas putida KT2440
uuggaaauguucaacagcc

SEQ ID NO: 1598450 - RNA, 14 nt, Pseudomonas putida KT2440
uugcuugcagcgcu

SEQ ID NO: 1598451 - RNA, 15 nt, Pseudomonas putida KT2440
uugcuucuugaagcg

SEQ ID NO: 1598452 - RNA, 16 nt, Pseudomonas putida KT2440
uuggcaacaauguacc

SEQ ID NO: 1598453 - RNA, 18 nt, Pseudomonas putida KT2440
uuggcaccggcagcagca

SEQ ID NO: 1598454 - RNA, 19 nt, Pseudomonas putida KT2440
uuggcaccggcagcagcaa

SEQ ID NO: 1598455 - RNA, 14 nt, Pseudomonas putida KT2440
uuggcaccuaucgc

SEQ ID NO: 1598456 - RNA, 17 nt, Pseudomonas putida KT2440
uuggcacguugcugccu

SEQ ID NO: 1598457 - RNA, 18 nt, Pseudomonas putida KT2440
uuggcacguugcugccug

SEQ ID NO: 1598458 - RNA, 14 nt, Pseudomonas putida KT2440
uuggcaaucaaggu

SEQ ID NO: 1598459 - RNA, 22 nt, Pseudomonas putida KT2440
uuggauacugcccgucaguuug

SEQ ID NO: 1598460 - RNA, 16 nt, Pseudomonas putida KT2440
uugccagggugccaga

SEQ ID NO: 1598461 - RNA, 20 nt, Pseudomonas putida KT2440
uugccagcgucuuuggccug

SEQ ID NO: 1598462 - RNA, 17 nt, Pseudomonas putida KT2440
uugccagcguguuccau

SEQ ID NO: 1598463 - RNA, 13 nt, Pseudomonas putida KT2440
uugccagccgccc

SEQ ID NO: 1598464 - RNA, 14 nt, Pseudomonas putida KT2440
uugcaggccagcgu

SEQ ID NO: 1598465 - RNA, 16 nt, Pseudomonas putida KT2440
uugcagucaccuggcc

SEQ ID NO: 1598466 - RNA, 18 nt, Pseudomonas putida KT2440
uugcagugccugugagau

SEQ ID NO: 1598467 - RNA, 16 nt, Pseudomonas putida KT2440
uugcccaacucugccg

SEQ ID NO: 1598468 - RNA, 16 nt, Pseudomonas putida KT2440
uugccauucuugucca

SEQ ID NO: 1598469 - RNA, 21 nt, Pseudomonas putida KT2440
uugccgggagcggguuuucuc

SEQ ID NO: 1598470 - RNA, 21 nt, Pseudomonas putida KT2440
uugccggggcugcuuugcagc

SEQ ID NO: 1598471 - RNA, 22 nt, Pseudomonas putida KT2440
uugccggucacuggcgacagcc

SEQ ID NO: 1598472 - RNA, 18 nt, Pseudomonas putida KT2440
uugccgugcccaccagcg

SEQ ID NO: 1598473 - RNA, 17 nt, Pseudomonas putida KT2440
uugccucaggugcacag

SEQ ID NO: 1598474 - RNA, 20 nt, Pseudomonas putida KT2440
uugccucaggugcacagggc

SEQ ID NO: 1598475 - RNA, 17 nt, Pseudomonas putida KT2440
uugcgggcuuucugguu

SEQ ID NO: 1598476 - RNA, 13 nt, Pseudomonas putida KT2440
uugcgguccugca

SEQ ID NO: 1598477 - RNA, 22 nt, Pseudomonas putida KT2440
uugcggguguggccacacugcu

SEQ ID NO: 1598478 - RNA, 15 nt, Pseudomonas putida KT2440
uugcucggcaccacc

SEQ ID NO: 1598479 - RNA, 16 nt, Pseudomonas putida KT2440
uugcuccgcgaggcuc

SEQ ID NO: 1598480 - RNA, 16 nt, Pseudomonas putida KT2440
uugcgauccgccccau

SEQ ID NO: 1598481 - RNA, 19 nt, Pseudomonas putida KT2440
uugcgcagguacacgggca

SEQ ID NO: 1598482 - RNA, 17 nt, Pseudomonas putida KT2440
uugcgcaucaacguucc

SEQ ID NO: 1598483 - RNA, 14 nt, Pseudomonas putida KT2440
uugcgcaucaccuc

SEQ ID NO: 1598484 - RNA, 17 nt, Pseudomonas putida KT2440
uugccugcaaucagcuc

SEQ ID NO: 1598485 - RNA, 15 nt, Pseudomonas putida KT2440
uugccugccagaauc

SEQ ID NO: 1598486 - RNA, 22 nt, Pseudomonas putida KT2440
uugccugccagaaucuggggcc

SEQ ID NO: 1598487 - RNA, 19 nt, Pseudomonas putida KT2440
uugccuggcuuuccagguc

SEQ ID NO: 1598488 - RNA, 13 nt, Pseudomonas putida KT2440
uugcggcccuucg

SEQ ID NO: 1598489 - RNA, 17 nt, Pseudomonas putida KT2440
uugcggaucacuuccau

SEQ ID NO: 1598490 - RNA, 15 nt, Pseudomonas putida KT2440
uugcgcaaggggucg

SEQ ID NO: 1598491 - RNA, 15 nt, Pseudomonas putida KT2440
uuccucgacccagcc

SEQ ID NO: 1598492 - RNA, 18 nt, Pseudomonas putida KT2440
uuccgggcaaugcaggca

SEQ ID NO: 1598493 - RNA, 16 nt, Pseudomonas putida KT2440
uuccggguccagugcc

SEQ ID NO: 1598494 - RNA, 16 nt, Pseudomonas putida KT2440
uuccgugcaaccgcuc

SEQ ID NO: 1598495 - RNA, 14 nt, Pseudomonas putida KT2440
uuccugaagugaau

SEQ ID NO: 1598496 - RNA, 16 nt, Pseudomonas putida KT2440
uuccugagcggugaaa

SEQ ID NO: 1598497 - RNA, 23 nt, Pseudomonas putida KT2440
uuccugugccgcuuuggcagcag

SEQ ID NO: 1598498 - RNA, 14 nt, Pseudomonas putida KT2440
uuccuggcuggcag

SEQ ID NO: 1598499 - RNA, 22 nt, Pseudomonas putida KT2440
uuccuggaugacgauaugcccg

SEQ ID NO: 1598500 - RNA, 23 nt, Pseudomonas putida KT2440
uuccuggcggaacgacagcuugu

SEQ ID NO: 1598501 - RNA, 17 nt, Pseudomonas putida KT2440
uuccugggaagcugcag

SEQ ID NO: 1598502 - RNA, 13 nt, Pseudomonas putida KT2440
uuccuuggucagg

SEQ ID NO: 1598503 - RNA, 22 nt, Pseudomonas putida KT2440
uuccuuguaggccauuucccaa

SEQ ID NO: 1598504 - RNA, 21 nt, Pseudomonas putida KT2440
uuccuugucagucucuuucaa

SEQ ID NO: 1598505 - RNA, 15 nt, Pseudomonas putida KT2440
uuccuugcagcgccg

SEQ ID NO: 1598506 - RNA, 16 nt, Pseudomonas putida KT2440
uucgaaaaccugcuga

SEQ ID NO: 1598507 - RNA, 18 nt, Pseudomonas putida KT2440
uucgaaaaccugcugaca

SEQ ID NO: 1598508 - RNA, 15 nt, Pseudomonas putida KT2440
uucgaaaccacccug

SEQ ID NO: 1598509 - RNA, 14 nt, Pseudomonas putida KT2440
uucgaauccugcug

SEQ ID NO: 1598510 - RNA, 18 nt, Pseudomonas putida KT2440
uucgaaucgcucaugccc

SEQ ID NO: 1598511 - RNA, 20 nt, Pseudomonas putida KT2440
uucgacaugcaguugagccc

SEQ ID NO: 1598512 - RNA, 13 nt, Pseudomonas putida KT2440
uucgagccaccgg

SEQ ID NO: 1598513 - RNA, 15 nt, Pseudomonas putida KT2440
uucgagacuuuagcu

SEQ ID NO: 1598514 - RNA, 21 nt, Pseudomonas putida KT2440
uucgacgcugcugucggucag

SEQ ID NO: 1598515 - RNA, 23 nt, Pseudomonas putida KT2440
uucgagagccgggcaaugauccg

SEQ ID NO: 1598516 - RNA, 12 nt, Pseudomonas putida KT2440
uucgacugccgc

SEQ ID NO: 1598517 - RNA, 16 nt, Pseudomonas putida KT2440
uucgcaacgcuuggca

SEQ ID NO: 1598518 - RNA, 18 nt, Pseudomonas putida KT2440
uucgaguuuggccagccg

SEQ ID NO: 1598519 - RNA, 18 nt, Pseudomonas putida KT2440
uucgcgcccgcagugcac

SEQ ID NO: 1598520 - RNA, 15 nt, Pseudomonas putida KT2440
uucgcgggcaagccc

SEQ ID NO: 1598521 - RNA, 15 nt, Pseudomonas putida KT2440
uucgcgggcaugccc

SEQ ID NO: 1598522 - RNA, 16 nt, Pseudomonas putida KT2440
uucgcggccaagccgc

SEQ ID NO: 1598523 - RNA, 19 nt, Pseudomonas putida KT2440
uucgcggguaaacccccuc

SEQ ID NO: 1598524 - RNA, 21 nt, Pseudomonas putida KT2440
uucgcugcgcaucacccgccc

SEQ ID NO: 1598525 - RNA, 17 nt, Pseudomonas putida KT2440
uucgcugcgucaggcca

SEQ ID NO: 1598526 - RNA, 11 nt, Pseudomonas putida KT2440
uucgcuggggc

SEQ ID NO: 1598527 - RNA, 19 nt, Pseudomonas putida KT2440
uucgcuuucaccuugcugg

SEQ ID NO: 1598528 - RNA, 19 nt, Pseudomonas putida KT2440
uucgccgcgcuguggcgcc

SEQ ID NO: 1598529 - RNA, 20 nt, Pseudomonas putida KT2440
uucgccguacuggcugcacu

SEQ ID NO: 1598530 - RNA, 13 nt, Pseudomonas putida KT2440
uucgcccaggcgc

SEQ ID NO: 1598531 - RNA, 16 nt, Pseudomonas putida KT2440
uucgccaucgcccguc

SEQ ID NO: 1598532 - RNA, 19 nt, Pseudomonas putida KT2440
uucgccaucgcccgucagc

SEQ ID NO: 1598533 - RNA, 14 nt, Pseudomonas putida KT2440
uucgccagcgccac

SEQ ID NO: 1598534 - RNA, 12 nt, Pseudomonas putida KT2440
uucgccacaaaa

SEQ ID NO: 1598535 - RNA, 13 nt, Pseudomonas putida KT2440
uuccgccgucacc

SEQ ID NO: 1598536 - RNA, 20 nt, Pseudomonas putida KT2440
uuccgccgcuuuguuugcug

SEQ ID NO: 1598537 - RNA, 20 nt, Pseudomonas putida KT2440
uuccgcuggggauggcaccg

SEQ ID NO: 1598538 - RNA, 16 nt, Pseudomonas putida KT2440
uuccgcguccuugacg

SEQ ID NO: 1598539 - RNA, 15 nt, Pseudomonas putida KT2440
uucccggugcuggcu

SEQ ID NO: 1598540 - RNA, 14 nt, Pseudomonas putida KT2440
uucccucugccugc

SEQ ID NO: 1598541 - RNA, 15 nt, Pseudomonas putida KT2440
uucccucugccugcc

SEQ ID NO: 1598542 - RNA, 12 nt, Pseudomonas putida KT2440
uuccccuuggcg

SEQ ID NO: 1598543 - RNA, 13 nt, Pseudomonas putida KT2440
uuccccgaccaaa

SEQ ID NO: 1598544 - RNA, 19 nt, Pseudomonas putida KT2440
uuccccgcccaagcggcag

SEQ ID NO: 1598545 - RNA, 20 nt, Pseudomonas putida KT2440
uuccccaggccgcccaccca

SEQ ID NO: 1598546 - RNA, 22 nt, Pseudomonas putida KT2440
uuccccaggccgcccacccacc

SEQ ID NO: 1598547 - RNA, 15 nt, Pseudomonas putida KT2440
uuccccagcaagucc

SEQ ID NO: 1598548 - RNA, 23 nt, Pseudomonas putida KT2440
uuccaugccccucaaugcugccu

SEQ ID NO: 1598549 - RNA, 16 nt, Pseudomonas putida KT2440
uuccauuucacuggcu

SEQ ID NO: 1598550 - RNA, 18 nt, Pseudomonas putida KT2440
uucccaauccucagcgcg

SEQ ID NO: 1598551 - RNA, 16 nt, Pseudomonas putida KT2440
uuccagcuucugcugg

SEQ ID NO: 1598552 - RNA, 15 nt, Pseudomonas putida KT2440
uuccagcagcgacac

SEQ ID NO: 1598553 - RNA, 19 nt, Pseudomonas putida KT2440
uuccagcagcgacacugac

SEQ ID NO: 1598554 - RNA, 23 nt, Pseudomonas putida KT2440
uuccagaaucugcacacugcgcu

SEQ ID NO: 1598555 - RNA, 15 nt, Pseudomonas putida KT2440
uuccagucggccuga

SEQ ID NO: 1598556 - RNA, 22 nt, Pseudomonas putida KT2440
uuccagucggccugaugccuca

SEQ ID NO: 1598557 - RNA, 19 nt, Pseudomonas putida KT2440
uuccagugccgccaccugg

SEQ ID NO: 1598558 - RNA, 17 nt, Pseudomonas putida KT2440
uuccaguuggcagggca

SEQ ID NO: 1598559 - RNA, 16 nt, Pseudomonas putida KT2440
uuccaguuggccggca

SEQ ID NO: 1598560 - RNA, 21 nt, Pseudomonas putida KT2440
uuccaguuggccggcauggcg

SEQ ID NO: 1598561 - RNA, 13 nt, Pseudomonas putida KT2440
uuccauagugugc

SEQ ID NO: 1598562 - RNA, 17 nt, Pseudomonas putida KT2440
uuccauagugugcucac

SEQ ID NO: 1598563 - RNA, 22 nt, Pseudomonas putida KT2440
uuccauagugugcucacgguga

SEQ ID NO: 1598564 - RNA, 19 nt, Pseudomonas putida KT2440
uuccaccccggcagugccu

SEQ ID NO: 1598565 - RNA, 14 nt, Pseudomonas putida KT2440
uuccaccugcgccu

SEQ ID NO: 1598566 - RNA, 14 nt, Pseudomonas putida KT2440
uuccaccggcuugc

SEQ ID NO: 1598567 - RNA, 16 nt, Pseudomonas putida KT2440
uuccaccggcuugccc

SEQ ID NO: 1598568 - RNA, 14 nt, Pseudomonas putida KT2440
uuccacacccagcg

SEQ ID NO: 1598569 - RNA, 20 nt, Pseudomonas putida KT2440
uuccacacggcgguucugcg

SEQ ID NO: 1598570 - RNA, 19 nt, Pseudomonas putida KT2440
uuccacagguaccaggcug

SEQ ID NO: 1598571 - RNA, 17 nt, Pseudomonas putida KT2440
uuccaccacauccucuu

SEQ ID NO: 1598572 - RNA, 14 nt, Pseudomonas putida KT2440
uuccaaguuggcuc

SEQ ID NO: 1598573 - RNA, 22 nt, Pseudomonas putida KT2440
uucacgucuggcaccaguucca

SEQ ID NO: 1598574 - RNA, 14 nt, Pseudomonas putida KT2440
uucacuuccacacg

SEQ ID NO: 1598575 - RNA, 22 nt, Pseudomonas putida KT2440
uucacuguggucauccaggcug

SEQ ID NO: 1598576 - RNA, 12 nt, Pseudomonas putida KT2440
uucacucaacca

SEQ ID NO: 1598577 - RNA, 13 nt, Pseudomonas putida KT2440
uucaccccguggc

SEQ ID NO: 1598578 - RNA, 14 nt, Pseudomonas putida KT2440
uucaccguugccgc

SEQ ID NO: 1598579 - RNA, 20 nt, Pseudomonas putida KT2440
uucaccgcgcaccuccugcg

SEQ ID NO: 1598580 - RNA, 22 nt, Pseudomonas putida KT2440
uucaccguacccaggugaugca

SEQ ID NO: 1598581 - RNA, 15 nt, Pseudomonas putida KT2440
uucacgcaagcgccu

SEQ ID NO: 1598582 - RNA, 14 nt, Pseudomonas putida KT2440
uucacgcaggcgca

SEQ ID NO: 1598583 - RNA, 10 nt, Pseudomonas putida KT2440
uucagcagcc

SEQ ID NO: 1598584 - RNA, 21 nt, Pseudomonas putida KT2440
uucagcagcgaagggcucaac

SEQ ID NO: 1598585 - RNA, 13 nt, Pseudomonas putida KT2440
uucagcagcgccu

SEQ ID NO: 1598586 - RNA, 15 nt, Pseudomonas putida KT2440
uucagcacaccgcuc

SEQ ID NO: 1598587 - RNA, 19 nt, Pseudomonas putida KT2440
uucagccaccgcacucugc

SEQ ID NO: 1598588 - RNA, 14 nt, Pseudomonas putida KT2440
uucagccaaggcgc

SEQ ID NO: 1598589 - RNA, 17 nt, Pseudomonas putida KT2440
uucagcaagaccagaaa

SEQ ID NO: 1598590 - RNA, 18 nt, Pseudomonas putida KT2440
uucagaucacccuuggcc

SEQ ID NO: 1598591 - RNA, 14 nt, Pseudomonas putida KT2440
uucacagcaaaaaa

SEQ ID NO: 1598592 - RNA, 19 nt, Pseudomonas putida KT2440
uucacagcagaucacaaag

SEQ ID NO: 1598593 - RNA, 15 nt, Pseudomonas putida KT2440
uucacaucgcccuuc

SEQ ID NO: 1598594 - RNA, 23 nt, Pseudomonas putida KT2440
uucacacaggcugucggcaugca

SEQ ID NO: 1598595 - RNA, 20 nt, Pseudomonas putida KT2440
uucaaugccagcaguucgca

SEQ ID NO: 1598596 - RNA, 12 nt, Pseudomonas putida KT2440
uucaaugaguua

SEQ ID NO: 1598597 - RNA, 17 nt, Pseudomonas putida KT2440
uucaaggccgccaccuc

SEQ ID NO: 1598598 - RNA, 10 nt, Pseudomonas putida KT2440
uucaaggcgc

SEQ ID NO: 1598599 - RNA, 20 nt, Pseudomonas putida KT2440
uucaaggcguaccugccccc

SEQ ID NO: 1598600 - RNA, 18 nt, Pseudomonas putida KT2440
uucauuaccauccaucac

SEQ ID NO: 1598601 - RNA, 17 nt, Pseudomonas putida KT2440
uucauugccaacagcag

SEQ ID NO: 1598602 - RNA, 16 nt, Pseudomonas putida KT2440
uucauucagcuuuggc

SEQ ID NO: 1598603 - RNA, 14 nt, Pseudomonas putida KT2440
uucaucacccaguu

SEQ ID NO: 1598604 - RNA, 19 nt, Pseudomonas putida KT2440
uucaucgcugacuuccagc

SEQ ID NO: 1598605 - RNA, 20 nt, Pseudomonas putida KT2440
uucaucgcugacuuccagca

SEQ ID NO: 1598606 - RNA, 13 nt, Pseudomonas putida KT2440
uucaucugucagc

SEQ ID NO: 1598607 - RNA, 23 nt, Pseudomonas putida KT2440
uucagugccugggucagcuccuc

SEQ ID NO: 1598608 - RNA, 12 nt, Pseudomonas putida KT2440
uucauaccccuc

SEQ ID NO: 1598609 - RNA, 18 nt, Pseudomonas putida KT2440
uucagcucggccacccgc

SEQ ID NO: 1598610 - RNA, 20 nt, Pseudomonas putida KT2440
uucagcccuugcugcagcag

SEQ ID NO: 1598611 - RNA, 21 nt, Pseudomonas putida KT2440
uucagcgcccgcaacagaucc

SEQ ID NO: 1598612 - RNA, 18 nt, Pseudomonas putida KT2440
uucagcgccucuuugccc

SEQ ID NO: 1598613 - RNA, 21 nt, Pseudomonas putida KT2440
uucagggccgguuaaaaccca

SEQ ID NO: 1598614 - RNA, 21 nt, Pseudomonas putida KT2440
uucagggucgggcacaggccc

SEQ ID NO: 1598615 - RNA, 14 nt, Pseudomonas putida KT2440
uucaggcacagcac

SEQ ID NO: 1598616 - RNA, 19 nt, Pseudomonas putida KT2440
uucagguaauccaccagcc

SEQ ID NO: 1598617 - RNA, 11 nt, Pseudomonas putida KT2440
uucaggucauu

SEQ ID NO: 1598618 - RNA, 17 nt, Pseudomonas putida KT2440
uucaggucgaugauggc

SEQ ID NO: 1598619 - RNA, 24 nt, Pseudomonas putida KT2440
uucaggugcuucggcucuucgccu

SEQ ID NO: 1598620 - RNA, 12 nt, Pseudomonas putida KT2440
uggcugcacugg

SEQ ID NO: 1598621 - RNA, 15 nt, Pseudomonas putida KT2440
uggcugccagcgcgc

SEQ ID NO: 1598622 - RNA, 13 nt, Pseudomonas putida KT2440
uggcugccggccu

SEQ ID NO: 1598623 - RNA, 17 nt, Pseudomonas putida KT2440
uggcuguucgucggccu

SEQ ID NO: 1598624 - RNA, 14 nt, Pseudomonas putida KT2440
uggcuggucuccag

SEQ ID NO: 1598625 - RNA, 12 nt, Pseudomonas putida KT2440
uggcuggugaag

SEQ ID NO: 1598626 - RNA, 16 nt, Pseudomonas putida KT2440
uggcuggugaaggcag

SEQ ID NO: 1598627 - RNA, 23 nt, Pseudomonas putida KT2440
uggcuggugaaggcaggucagcg

SEQ ID NO: 1598628 - RNA, 16 nt, Pseudomonas putida KT2440
uggcugcguucaggca

SEQ ID NO: 1598629 - RNA, 18 nt, Pseudomonas putida KT2440
uggcugcguucaggcagg

SEQ ID NO: 1598630 - RNA, 12 nt, Pseudomonas putida KT2440
uggcuggcagca

SEQ ID NO: 1598631 - RNA, 14 nt, Pseudomonas putida KT2440
uggcuggcagcacg

SEQ ID NO: 1598632 - RNA, 18 nt, Pseudomonas putida KT2440
ugggaagcugcagcagcu

SEQ ID NO: 1598633 - RNA, 23 nt, Pseudomonas putida KT2440
uggcuucccgguaacgggccagc

SEQ ID NO: 1598634 - RNA, 23 nt, Pseudomonas putida KT2440
uggcuuguccuuguugaccccgg

SEQ ID NO: 1598635 - RNA, 19 nt, Pseudomonas putida KT2440
uggcuugucuuccggcagg

SEQ ID NO: 1598636 - RNA, 23 nt, Pseudomonas putida KT2440
uggcuuggcccaguucuccggca

SEQ ID NO: 1598637 - RNA, 22 nt, Pseudomonas putida KT2440
uggcuucgguggugaucaucag

SEQ ID NO: 1598638 - RNA, 13 nt, Pseudomonas putida KT2440
uggcuuacaucau

SEQ ID NO: 1598639 - RNA, 18 nt, Pseudomonas putida KT2440
uggcuuagcgcgggccuu

SEQ ID NO: 1598640 - RNA, 18 nt, Pseudomonas putida KT2440
uggcuuacaacaggaaca

SEQ ID NO: 1598641 - RNA, 13 nt, Pseudomonas putida KT2440
ugggagcggccuu

SEQ ID NO: 1598642 - RNA, 17 nt, Pseudomonas putida KT2440
ugggagcgggcaugccc

SEQ ID NO: 1598643 - RNA, 21 nt, Pseudomonas putida KT2440
ugggagcgggcgcgcccgcga

SEQ ID NO: 1598644 - RNA, 15 nt, Pseudomonas putida KT2440
ugggagcgggcuugc

SEQ ID NO: 1598645 - RNA, 19 nt, Pseudomonas putida KT2440
ugggagcgggucagccugc

SEQ ID NO: 1598646 - RNA, 20 nt, Pseudomonas putida KT2440
ugggacugcguugcaguccu

SEQ ID NO: 1598647 - RNA, 22 nt, Pseudomonas putida KT2440
ugggccaggguaccgccgucca

SEQ ID NO: 1598648 - RNA, 23 nt, Pseudomonas putida KT2440
ugggccccaggcggugcacggcc

SEQ ID NO: 1598649 - RNA, 18 nt, Pseudomonas putida KT2440
ugggcgcagugccgugag

SEQ ID NO: 1598650 - RNA, 14 nt, Pseudomonas putida KT2440
uggggacggcagcc

SEQ ID NO: 1598651 - RNA, 14 nt, Pseudomonas putida KT2440
uggggcugccuugc

SEQ ID NO: 1598652 - RNA, 13 nt, Pseudomonas putida KT2440
ugggcuucgagca

SEQ ID NO: 1598653 - RNA, 15 nt, Pseudomonas putida KT2440
ugggcuucaugcugc

SEQ ID NO: 1598654 - RNA, 16 nt, Pseudomonas putida KT2440
ugggcuucaugcugcu

SEQ ID NO: 1598655 - RNA, 13 nt, Pseudomonas putida KT2440
ugggcgugccagg

SEQ ID NO: 1598656 - RNA, 20 nt, Pseudomonas putida KT2440
ugggcuuuucguuggccagc

SEQ ID NO: 1598657 - RNA, 15 nt, Pseudomonas putida KT2440
ugggcuuggcagcac

SEQ ID NO: 1598658 - RNA, 18 nt, Pseudomonas putida KT2440
uggcgucggucagcgagu

SEQ ID NO: 1598659 - RNA, 19 nt, Pseudomonas putida KT2440
uggcgugacggauacaucg

SEQ ID NO: 1598660 - RNA, 14 nt, Pseudomonas putida KT2440
uggcgugcaccugu

SEQ ID NO: 1598661 - RNA, 22 nt, Pseudomonas putida KT2440
uggcgugcacgcuugagcgcgc

SEQ ID NO: 1598662 - RNA, 22 nt, Pseudomonas putida KT2440
uggcgucgacucgaugccaucg

SEQ ID NO: 1598663 - RNA, 13 nt, Pseudomonas putida KT2440
uggcgucaggcgu

SEQ ID NO: 1598664 - RNA, 14 nt, Pseudomonas putida KT2440
uggcguccagcagu

SEQ ID NO: 1598665 - RNA, 16 nt, Pseudomonas putida KT2440
uggcguuguccagcag

SEQ ID NO: 1598666 - RNA, 14 nt, Pseudomonas putida KT2440
uggcguugagccgc

SEQ ID NO: 1598667 - RNA, 15 nt, Pseudomonas putida KT2440
uggcucaguggcugc

SEQ ID NO: 1598668 - RNA, 23 nt, Pseudomonas putida KT2440
uggcucgacacgcuugcgaagga

SEQ ID NO: 1598669 - RNA, 15 nt, Pseudomonas putida KT2440
uggcucgcugcccca

SEQ ID NO: 1598670 - RNA, 20 nt, Pseudomonas putida KT2440
uggcucugcagcguauucag

SEQ ID NO: 1598671 - RNA, 16 nt, Pseudomonas putida KT2440
uggcucuucaacacca

SEQ ID NO: 1598672 - RNA, 16 nt, Pseudomonas putida KT2440
uggcuauccuucugcc

SEQ ID NO: 1598673 - RNA, 14 nt, Pseudomonas putida KT2440
uggcucacaucauc

SEQ ID NO: 1598674 - RNA, 12 nt, Pseudomonas putida KT2440
uggcgcuggauc

SEQ ID NO: 1598675 - RNA, 14 nt, Pseudomonas putida KT2440
uggcgcuccuccag

SEQ ID NO: 1598676 - RNA, 20 nt, Pseudomonas putida KT2440
uggcgcgaccaucaccgcca

SEQ ID NO: 1598677 - RNA, 14 nt, Pseudomonas putida KT2440
uggcggugagaugu

SEQ ID NO: 1598678 - RNA, 17 nt, Pseudomonas putida KT2440
uggcgguugaccagggc

SEQ ID NO: 1598679 - RNA, 18 nt, Pseudomonas putida KT2440
uggcggcgccuucagguu

SEQ ID NO: 1598680 - RNA, 21 nt, Pseudomonas putida KT2440
uggcgguaaacguggucagcc

SEQ ID NO: 1598681 - RNA, 16 nt, Pseudomonas putida KT2440
uggcggcugagccggc

SEQ ID NO: 1598682 - RNA, 20 nt, Pseudomonas putida KT2440
ugguuaaaagccaacugcuc

SEQ ID NO: 1598683 - RNA, 22 nt, Pseudomonas putida KT2440
ugguuaacaugcuggccauccc

SEQ ID NO: 1598684 - RNA, 20 nt, Pseudomonas putida KT2440
ugguucaucgacuugcgucc

SEQ ID NO: 1598685 - RNA, 20 nt, Pseudomonas putida KT2440
ugguucauugccaacagcag

SEQ ID NO: 1598686 - RNA, 15 nt, Pseudomonas putida KT2440
ugguugcccaugcac

SEQ ID NO: 1598687 - RNA, 22 nt, Pseudomonas putida KT2440
ugguugcccaugcacagcgagc

SEQ ID NO: 1598688 - RNA, 21 nt, Pseudomonas putida KT2440
ugguugaucaacugugccugg

SEQ ID NO: 1598689 - RNA, 16 nt, Pseudomonas putida KT2440
ugguucugaaaccagu

SEQ ID NO: 1598690 - RNA, 12 nt, Pseudomonas putida KT2440
ugguucuugccg

SEQ ID NO: 1598691 - RNA, 12 nt, Pseudomonas putida KT2440
ugguuguagccc

SEQ ID NO: 1598692 - RNA, 16 nt, Pseudomonas putida KT2440
ugguuguagcccgggc

SEQ ID NO: 1598693 - RNA, 16 nt, Pseudomonas putida KT2440
ugguugugcuggcccu

SEQ ID NO: 1598694 - RNA, 22 nt, Pseudomonas putida KT2440
ugguuugccgugcccaccagcg

SEQ ID NO: 1598695 - RNA, 21 nt, Pseudomonas putida KT2440
ugguuuguggguacugcuuca

SEQ ID NO: 1598696 - RNA, 21 nt, Pseudomonas putida KT2440
uguacaccccgaccaaggcca

SEQ ID NO: 1598697 - RNA, 20 nt, Pseudomonas putida KT2440
ugggguccuguuugccgagg

SEQ ID NO: 1598698 - RNA, 15 nt, Pseudomonas putida KT2440
uggggugagcggcuu

SEQ ID NO: 1598699 - RNA, 15 nt, Pseudomonas putida KT2440
ugggggugaagcccu

SEQ ID NO: 1598700 - RNA, 20 nt, Pseudomonas putida KT2440
uggggucugcccggccagca

SEQ ID NO: 1598701 - RNA, 16 nt, Pseudomonas putida KT2440
ugggguuggacccagg

SEQ ID NO: 1598702 - RNA, 20 nt, Pseudomonas putida KT2440
ugguaacgggcaaaguccau

SEQ ID NO: 1598703 - RNA, 14 nt, Pseudomonas putida KT2440
ugguccagccacaa

SEQ ID NO: 1598704 - RNA, 19 nt, Pseudomonas putida KT2440
ugguccagcuucaccucau

SEQ ID NO: 1598705 - RNA, 20 nt, Pseudomonas putida KT2440
ugguccacgguucuggcagc

SEQ ID NO: 1598706 - RNA, 21 nt, Pseudomonas putida KT2440
uggucaugccauccucggcca

SEQ ID NO: 1598707 - RNA, 23 nt, Pseudomonas putida KT2440
uggucaugccauccucggccagg

SEQ ID NO: 1598708 - RNA, 21 nt, Pseudomonas putida KT2440
uggucacccugacgcugcacu

SEQ ID NO: 1598709 - RNA, 16 nt, Pseudomonas putida KT2440
ugguagggaaauccuc

SEQ ID NO: 1598710 - RNA, 18 nt, Pseudomonas putida KT2440
ugguagugauaaugggca

SEQ ID NO: 1598711 - RNA, 17 nt, Pseudomonas putida KT2440
ugguauugcgcgucucu

SEQ ID NO: 1598712 - RNA, 23 nt, Pseudomonas putida KT2440
uggucaacagcccggugaaguca

SEQ ID NO: 1598713 - RNA, 19 nt, Pseudomonas putida KT2440
ugguauugggcuugaacga

SEQ ID NO: 1598714 - RNA, 14 nt, Pseudomonas putida KT2440
ugguggucggcagc

SEQ ID NO: 1598715 - RNA, 20 nt, Pseudomonas putida KT2440
ugguguaauccaucaccaca

SEQ ID NO: 1598716 - RNA, 15 nt, Pseudomonas putida KT2440
ugguggugcugggca

SEQ ID NO: 1598717 - RNA, 20 nt, Pseudomonas putida KT2440
uggugcugguggccacgccg

SEQ ID NO: 1598718 - RNA, 15 nt, Pseudomonas putida KT2440
uggugcucaugaucc

SEQ ID NO: 1598719 - RNA, 16 nt, Pseudomonas putida KT2440
uggugccaucaccgcc

SEQ ID NO: 1598720 - RNA, 13 nt, Pseudomonas putida KT2440
uggugcccgccag

SEQ ID NO: 1598721 - RNA, 21 nt, Pseudomonas putida KT2440
uggugcagguugauccagccc

SEQ ID NO: 1598722 - RNA, 18 nt, Pseudomonas putida KT2440
uggugcaccagcuugugc

SEQ ID NO: 1598723 - RNA, 19 nt, Pseudomonas putida KT2440
uggugcgccuccagcagcg

SEQ ID NO: 1598724 - RNA, 19 nt, Pseudomonas putida KT2440
uggugccggucggcgucca

SEQ ID NO: 1598725 - RNA, 15 nt, Pseudomonas putida KT2440
uggucuucaaggcca

SEQ ID NO: 1598726 - RNA, 19 nt, Pseudomonas putida KT2440
uggugaaagucgaccagca

SEQ ID NO: 1598727 - RNA, 19 nt, Pseudomonas putida KT2440
uggugaacuuaugguuguc

SEQ ID NO: 1598728 - RNA, 21 nt, Pseudomonas putida KT2440
uggucgccggaaacacuagcg

SEQ ID NO: 1598729 - RNA, 16 nt, Pseudomonas putida KT2440
uggucgccgccaccca

SEQ ID NO: 1598730 - RNA, 18 nt, Pseudomonas putida KT2440
uggucccccacuucugcc

SEQ ID NO: 1598731 - RNA, 18 nt, Pseudomonas putida KT2440
uggucgcgggccagccca

SEQ ID NO: 1598732 - RNA, 15 nt, Pseudomonas putida KT2440
uggucggcagggccg

SEQ ID NO: 1598733 - RNA, 18 nt, Pseudomonas putida KT2440
uguucgauuucaccggcu

SEQ ID NO: 1598734 - RNA, 13 nt, Pseudomonas putida KT2440
uguugaccucugg

SEQ ID NO: 1598735 - RNA, 21 nt, Pseudomonas putida KT2440
uguugaccccgggcacaugca

SEQ ID NO: 1598736 - RNA, 13 nt, Pseudomonas putida KT2440
uguugagcaacag

SEQ ID NO: 1598737 - RNA, 15 nt, Pseudomonas putida KT2440
uguugagcagcagcc

SEQ ID NO: 1598738 - RNA, 22 nt, Pseudomonas putida KT2440
uguugaacaugcggaagcaacc

SEQ ID NO: 1598739 - RNA, 18 nt, Pseudomonas putida KT2440
uguucaacgcaaugggca

SEQ ID NO: 1598740 - RNA, 22 nt, Pseudomonas putida KT2440
uguuagaaaacugggcagcccu

SEQ ID NO: 1598741 - RNA, 15 nt, Pseudomonas putida KT2440
uguuaccggccuggc

SEQ ID NO: 1598742 - RNA, 23 nt, Pseudomonas putida KT2440
uguguacgggacaaggcauuuuc

SEQ ID NO: 1598743 - RNA, 19 nt, Pseudomonas putida KT2440
uguggcagcggcuuggccg

SEQ ID NO: 1598744 - RNA, 14 nt, Pseudomonas putida KT2440
uguggcagcucugc

SEQ ID NO: 1598745 - RNA, 20 nt, Pseudomonas putida KT2440
uguggauaacuuacaucugc

SEQ ID NO: 1598746 - RNA, 18 nt, Pseudomonas putida KT2440
ugugccgagugccaacaa

SEQ ID NO: 1598747 - RNA, 19 nt, Pseudomonas putida KT2440
ugugcccugaucgccucca

SEQ ID NO: 1598748 - RNA, 23 nt, Pseudomonas putida KT2440
ugugcucggccugggcagguuca

SEQ ID NO: 1598749 - RNA, 15 nt, Pseudomonas putida KT2440
ugugcugcguuguug

SEQ ID NO: 1598750 - RNA, 19 nt, Pseudomonas putida KT2440
ugugcaaagaacacuuccg

SEQ ID NO: 1598751 - RNA, 22 nt, Pseudomonas putida KT2440
ugugaugcagccagccucuucu

SEQ ID NO: 1598752 - RNA, 14 nt, Pseudomonas putida KT2440
ugugaaacaccaca

SEQ ID NO: 1598753 - RNA, 21 nt, Pseudomonas putida KT2440
ugucuguacaguggcacuggc

SEQ ID NO: 1598754 - RNA, 16 nt, Pseudomonas putida KT2440
ugucugcgccugcugg

SEQ ID NO: 1598755 - RNA, 15 nt, Pseudomonas putida KT2440
ugucuuccggcauga

SEQ ID NO: 1598756 - RNA, 20 nt, Pseudomonas putida KT2440
ugucuuccggcaugaacaca

SEQ ID NO: 1598757 - RNA, 12 nt, Pseudomonas putida KT2440
ugucuccuuagu

SEQ ID NO: 1598758 - RNA, 14 nt, Pseudomonas putida KT2440
ugucugacagcagg

SEQ ID NO: 1598759 - RNA, 19 nt, Pseudomonas putida KT2440
ugucuccgaacgccuuggc

SEQ ID NO: 1598760 - RNA, 14 nt, Pseudomonas putida KT2440
ugucggccagggcc

SEQ ID NO: 1598761 - RNA, 15 nt, Pseudomonas putida KT2440
ugucggcagccaggg

SEQ ID NO: 1598762 - RNA, 19 nt, Pseudomonas putida KT2440
ugucgcuggguacuggcuu

SEQ ID NO: 1598763 - RNA, 21 nt, Pseudomonas putida KT2440
ugucgguaaacaauucccagc

SEQ ID NO: 1598764 - RNA, 17 nt, Pseudomonas putida KT2440
ugucgguggcggccagc

SEQ ID NO: 1598765 - RNA, 14 nt, Pseudomonas putida KT2440
ugucgcccgccucg

SEQ ID NO: 1598766 - RNA, 15 nt, Pseudomonas putida KT2440
ugucgaucagcggcu

SEQ ID NO: 1598767 - RNA, 18 nt, Pseudomonas putida KT2440
ugucgacguacagcagcu

SEQ ID NO: 1598768 - RNA, 22 nt, Pseudomonas putida KT2440
ugucgacgaugcuuuugauggu

SEQ ID NO: 1598769 - RNA, 23 nt, Pseudomonas putida KT2440
ugucgacgaugcuuuugaugguc

SEQ ID NO: 1598770 - RNA, 20 nt, Pseudomonas putida KT2440
ugucgagguugcgcuccauc

SEQ ID NO: 1598771 - RNA, 17 nt, Pseudomonas putida KT2440
ugucgacagugaauucc

SEQ ID NO: 1598772 - RNA, 21 nt, Pseudomonas putida KT2440
ugucgaagcgcaccucggcca

SEQ ID NO: 1598773 - RNA, 14 nt, Pseudomonas putida KT2440
ugucgaaccacuga

SEQ ID NO: 1598774 - RNA, 20 nt, Pseudomonas putida KT2440
ugucgaaccccugauguggc

SEQ ID NO: 1598775 - RNA, 16 nt, Pseudomonas putida KT2440
uguccuuggcccagcc

SEQ ID NO: 1598776 - RNA, 23 nt, Pseudomonas putida KT2440
uguccuggguuacggcggccugc

SEQ ID NO: 1598777 - RNA, 23 nt, Pseudomonas putida KT2440
uguccuguuuguuuuuacucuuu

SEQ ID NO: 1598778 - RNA, 11 nt, Pseudomonas putida KT2440
uguccugcugc

SEQ ID NO: 1598779 - RNA, 23 nt, Pseudomonas putida KT2440
uguccucaaucacauccacagcc

SEQ ID NO: 1598780 - RNA, 17 nt, Pseudomonas putida KT2440
uguccucggcguucagc

SEQ ID NO: 1598781 - RNA, 19 nt, Pseudomonas putida KT2440
uguccggcgugaaauccuc

SEQ ID NO: 1598782 - RNA, 11 nt, Pseudomonas putida KT2440
ugucccggcac

SEQ ID NO: 1598783 - RNA, 17 nt, Pseudomonas putida KT2440
ugucccggcacaaccga

SEQ ID NO: 1598784 - RNA, 15 nt, Pseudomonas putida KT2440
ugucccggccagggc

SEQ ID NO: 1598785 - RNA, 14 nt, Pseudomonas putida KT2440
uguccaugaaggug

SEQ ID NO: 1598786 - RNA, 17 nt, Pseudomonas putida KT2440
uguccaccccacccucg

SEQ ID NO: 1598787 - RNA, 20 nt, Pseudomonas putida KT2440
uguccagcaagggccugugc

SEQ ID NO: 1598788 - RNA, 21 nt, Pseudomonas putida KT2440
uguccagcaagggccugugcc

SEQ ID NO: 1598789 - RNA, 13 nt, Pseudomonas putida KT2440
uguccagcagcag

SEQ ID NO: 1598790 - RNA, 22 nt, Pseudomonas putida KT2440
uguccagcccgauuucgugcac

SEQ ID NO: 1598791 - RNA, 15 nt, Pseudomonas putida KT2440
uguccauccaugcaa

SEQ ID NO: 1598792 - RNA, 16 nt, Pseudomonas putida KT2440
uguccaaauugggcug

SEQ ID NO: 1598793 - RNA, 13 nt, Pseudomonas putida KT2440
uguccacaaacuc

SEQ ID NO: 1598794 - RNA, 22 nt, Pseudomonas putida KT2440
uguccacaccaaagucagccag

SEQ ID NO: 1598795 - RNA, 14 nt, Pseudomonas putida KT2440
ugucaucugaggcc

SEQ ID NO: 1598796 - RNA, 21 nt, Pseudomonas putida KT2440
ugucauccugcguggcgguga

SEQ ID NO: 1598797 - RNA, 23 nt, Pseudomonas putida KT2440
uguaugcgugaucuuuacuuucu

SEQ ID NO: 1598798 - RNA, 18 nt, Pseudomonas putida KT2440
uguauuuagucagggugu

SEQ ID NO: 1598799 - RNA, 18 nt, Pseudomonas putida KT2440
ugucaguucugcucagcu

SEQ ID NO: 1598800 - RNA, 21 nt, Pseudomonas putida KT2440
uuauccgcgaguaaagccagc

SEQ ID NO: 1598801 - RNA, 21 nt, Pseudomonas putida KT2440
uuauccgcuggcuuguccuug

SEQ ID NO: 1598802 - RNA, 11 nt, Pseudomonas putida KT2440
uuauccagcac

SEQ ID NO: 1598803 - RNA, 14 nt, Pseudomonas putida KT2440
uuauggaugccaau

SEQ ID NO: 1598804 - RNA, 22 nt, Pseudomonas putida KT2440
uuaugggcagcaccgcguauca

SEQ ID NO: 1598805 - RNA, 23 nt, Pseudomonas putida KT2440
uuaucuccaagccgcuucacugu

SEQ ID NO: 1598806 - RNA, 16 nt, Pseudomonas putida KT2440
uuauccuucaggcgcu

SEQ ID NO: 1598807 - RNA, 13 nt, Pseudomonas putida KT2440
uucaacccuaccc

SEQ ID NO: 1598808 - RNA, 23 nt, Pseudomonas putida KT2440
uucaaccgcacccgcaagcgccg

SEQ ID NO: 1598809 - RNA, 20 nt, Pseudomonas putida KT2440
uucaacgccguacggcccau

SEQ ID NO: 1598810 - RNA, 19 nt, Pseudomonas putida KT2440
uucaacucggacaaccaag

SEQ ID NO: 1598811 - RNA, 19 nt, Pseudomonas putida KT2440
uucaacagcuucuugcacc

SEQ ID NO: 1598812 - RNA, 15 nt, Pseudomonas putida KT2440
uucaaauguccauug

SEQ ID NO: 1598813 - RNA, 22 nt, Pseudomonas putida KT2440
uucaaagccauaccgcauccca

SEQ ID NO: 1598814 - RNA, 19 nt, Pseudomonas putida KT2440
uucaaagccugcuccagca

SEQ ID NO: 1598815 - RNA, 22 nt, Pseudomonas putida KT2440
uucaaagccugcuccagcaccc

SEQ ID NO: 1598816 - RNA, 16 nt, Pseudomonas putida KT2440
uucaaaaaaaagggca

SEQ ID NO: 1598817 - RNA, 20 nt, Pseudomonas putida KT2440
uuauuucucuuccuggcugg

SEQ ID NO: 1598818 - RNA, 15 nt, Pseudomonas putida KT2440
uuauuugugaaacac

SEQ ID NO: 1598819 - RNA, 21 nt, Pseudomonas putida KT2440
uuaaccugcggcuguccagca

SEQ ID NO: 1598820 - RNA, 14 nt, Pseudomonas putida KT2440
uuaagcggucucgg

SEQ ID NO: 1598821 - RNA, 19 nt, Pseudomonas putida KT2440
uguugccugcgauuuaugc

SEQ ID NO: 1598822 - RNA, 14 nt, Pseudomonas putida KT2440
uuaaaccuucaaca

SEQ ID NO: 1598823 - RNA, 16 nt, Pseudomonas putida KT2440
uuacccaccagcucca

SEQ ID NO: 1598824 - RNA, 13 nt, Pseudomonas putida KT2440
uuacuguuugagc

SEQ ID NO: 1598825 - RNA, 18 nt, Pseudomonas putida KT2440
uuacugguggacacugcc

SEQ ID NO: 1598826 - RNA, 22 nt, Pseudomonas putida KT2440
uuacucuuuugcauaucuacuc

SEQ ID NO: 1598827 - RNA, 14 nt, Pseudomonas putida KT2440
uuacaagggccugu

SEQ ID NO: 1598828 - RNA, 20 nt, Pseudomonas putida KT2440
uuacagaugucuggcaucaa

SEQ ID NO: 1598829 - RNA, 17 nt, Pseudomonas putida KT2440
ugccgcuucgcggaacu

SEQ ID NO: 1598830 - RNA, 16 nt, Pseudomonas putida KT2440
ugccggaagaucaggc

SEQ ID NO: 1598831 - RNA, 14 nt, Pseudomonas putida KT2440
ugccggccaaucga

SEQ ID NO: 1598832 - RNA, 15 nt, Pseudomonas putida KT2440
ugccggccagcgccu

SEQ ID NO: 1598833 - RNA, 16 nt, Pseudomonas putida KT2440
ugccggccagcggcau

SEQ ID NO: 1598834 - RNA, 13 nt, Pseudomonas putida KT2440
ugccggcagcucg

SEQ ID NO: 1598835 - RNA, 15 nt, Pseudomonas putida KT2440
ugccggcccaaggca

SEQ ID NO: 1598836 - RNA, 21 nt, Pseudomonas putida KT2440
ugccggcccaaggcaccaacu

SEQ ID NO: 1598837 - RNA, 19 nt, Pseudomonas putida KT2440
ugccggccgcuucauauca

SEQ ID NO: 1598838 - RNA, 21 nt, Pseudomonas putida KT2440
ugccgggcuuuuuugugccuc

SEQ ID NO: 1598839 - RNA, 13 nt, Pseudomonas putida KT2440
ugccgggccaggg

SEQ ID NO: 1598840 - RNA, 14 nt, Pseudomonas putida KT2440
ugccggguaguucu

SEQ ID NO: 1598841 - RNA, 22 nt, Pseudomonas putida KT2440
ugccgggucaaggccagcgccu

SEQ ID NO: 1598842 - RNA, 14 nt, Pseudomonas putida KT2440
ugccgggucggccu

SEQ ID NO: 1598843 - RNA, 17 nt, Pseudomonas putida KT2440
ugccggggcaugcgcag

SEQ ID NO: 1598844 - RNA, 23 nt, Pseudomonas putida KT2440
ugccggcgaauccagccggcccg

SEQ ID NO: 1598845 - RNA, 13 nt, Pseudomonas putida KT2440
ugccgcgcgcccg

SEQ ID NO: 1598846 - RNA, 15 nt, Pseudomonas putida KT2440
ugccgccuucuccag

SEQ ID NO: 1598847 - RNA, 19 nt, Pseudomonas putida KT2440
ugccgccugggucaggcgu

SEQ ID NO: 1598848 - RNA, 12 nt, Pseudomonas putida KT2440
ugccgccugugu

SEQ ID NO: 1598849 - RNA, 14 nt, Pseudomonas putida KT2440
ugccgcucaucgag

SEQ ID NO: 1598850 - RNA, 15 nt, Pseudomonas putida KT2440
ugccgcggguggcuu

SEQ ID NO: 1598851 - RNA, 17 nt, Pseudomonas putida KT2440
ugccuggaauuccugcc

SEQ ID NO: 1598852 - RNA, 12 nt, Pseudomonas putida KT2440
ugccugcugcuc

SEQ ID NO: 1598853 - RNA, 13 nt, Pseudomonas putida KT2440
ugccucugcugcg

SEQ ID NO: 1598854 - RNA, 14 nt, Pseudomonas putida KT2440
ugccugggucagcu

SEQ ID NO: 1598855 - RNA, 21 nt, Pseudomonas putida KT2440
ugccugggugguaucugccga

SEQ ID NO: 1598856 - RNA, 18 nt, Pseudomonas putida KT2440
ugccuggcccucugcgug

SEQ ID NO: 1598857 - RNA, 24 nt, Pseudomonas putida KT2440
ugccugggccggugggcaacagcu

SEQ ID NO: 1598858 - RNA, 16 nt, Pseudomonas putida KT2440
ugccucgcccagguca

SEQ ID NO: 1598859 - RNA, 23 nt, Pseudomonas putida KT2440
ugccguuuuuuuugcccgugacu

SEQ ID NO: 1598860 - RNA, 13 nt, Pseudomonas putida KT2440
ugccgguagugau

SEQ ID NO: 1598861 - RNA, 17 nt, Pseudomonas putida KT2440
ugccgguuugcggccuu

SEQ ID NO: 1598862 - RNA, 18 nt, Pseudomonas putida KT2440
ugccgguuuuugccgcga

SEQ ID NO: 1598863 - RNA, 16 nt, Pseudomonas putida KT2440
ugccgugguucaucac

SEQ ID NO: 1598864 - RNA, 16 nt, Pseudomonas putida KT2440
ugccgugcaggucagc

SEQ ID NO: 1598865 - RNA, 17 nt, Pseudomonas putida KT2440
ugccgugcaggucagcg

SEQ ID NO: 1598866 - RNA, 20 nt, Pseudomonas putida KT2440
ugccgugaucgccgggcgca

SEQ ID NO: 1598867 - RNA, 15 nt, Pseudomonas putida KT2440
ugccguggcaggcag

SEQ ID NO: 1598868 - RNA, 15 nt, Pseudomonas putida KT2440
ugccgugcucgucca

SEQ ID NO: 1598869 - RNA, 23 nt, Pseudomonas putida KT2440
ugccguuccucaagcggccucga

SEQ ID NO: 1598870 - RNA, 21 nt, Pseudomonas putida KT2440
ugccccagcaucaacgcugcc

SEQ ID NO: 1598871 - RNA, 21 nt, Pseudomonas putida KT2440
ugcccccagccggucauccag

SEQ ID NO: 1598872 - RNA, 20 nt, Pseudomonas putida KT2440
ugccccccggugccggccaa

SEQ ID NO: 1598873 - RNA, 14 nt, Pseudomonas putida KT2440
ugcccccgccgaag

SEQ ID NO: 1598874 - RNA, 14 nt, Pseudomonas putida KT2440
ugccauuucuucag

SEQ ID NO: 1598875 - RNA, 19 nt, Pseudomonas putida KT2440
ugccauuucuucagcagga

SEQ ID NO: 1598876 - RNA, 22 nt, Pseudomonas putida KT2440
ugccauugcaccacccccagcg

SEQ ID NO: 1598877 - RNA, 17 nt, Pseudomonas putida KT2440
ugcccgcuguugagcag

SEQ ID NO: 1598878 - RNA, 18 nt, Pseudomonas putida KT2440
ugcccgcuguugagcagc

SEQ ID NO: 1598879 - RNA, 18 nt, Pseudomonas putida KT2440
ugcccgcucccacagguu

SEQ ID NO: 1598880 - RNA, 16 nt, Pseudomonas putida KT2440
ugcccgcucucacagg

SEQ ID NO: 1598881 - RNA, 20 nt, Pseudomonas putida KT2440
ugcccgcucucacagggacc

SEQ ID NO: 1598882 - RNA, 19 nt, Pseudomonas putida KT2440
ugcccggcaaucgccaggc

SEQ ID NO: 1598883 - RNA, 18 nt, Pseudomonas putida KT2440
ugcccgcgaagggccgca

SEQ ID NO: 1598884 - RNA, 19 nt, Pseudomonas putida KT2440
ugcccgcgaagggccgcca

SEQ ID NO: 1598885 - RNA, 21 nt, Pseudomonas putida KT2440
ugcccgcgaagggccgcgaag

SEQ ID NO: 1598886 - RNA, 15 nt, Pseudomonas putida KT2440
ugcccgcgaguccuc

SEQ ID NO: 1598887 - RNA, 21 nt, Pseudomonas putida KT2440
ugcccgcggcucacccaccag

SEQ ID NO: 1598888 - RNA, 20 nt, Pseudomonas putida KT2440
ugcccgacaagccacgcacc

SEQ ID NO: 1598889 - RNA, 14 nt, Pseudomonas putida KT2440
ugcccgacaccuca

SEQ ID NO: 1598890 - RNA, 17 nt, Pseudomonas putida KT2440
ugcccucggccggggcc

SEQ ID NO: 1598891 - RNA, 22 nt, Pseudomonas putida KT2440
ugcccucggccaccuggccuuc

SEQ ID NO: 1598892 - RNA, 17 nt, Pseudomonas putida KT2440
ugcccugaucgccucca

SEQ ID NO: 1598893 - RNA, 23 nt, Pseudomonas putida KT2440
ugccgcaccagguccaccagcag

SEQ ID NO: 1598894 - RNA, 16 nt, Pseudomonas putida KT2440
ugccgaggacauacca

SEQ ID NO: 1598895 - RNA, 16 nt, Pseudomonas putida KT2440
ugccgagguucuucca

SEQ ID NO: 1598896 - RNA, 17 nt, Pseudomonas putida KT2440
ugccgaucaccgugccc

SEQ ID NO: 1598897 - RNA, 20 nt, Pseudomonas putida KT2440
ugccgaucagcacgccgccg

SEQ ID NO: 1598898 - RNA, 18 nt, Pseudomonas putida KT2440
ugccgcaucagccggcuu

SEQ ID NO: 1598899 - RNA, 16 nt, Pseudomonas putida KT2440
ugccgcagccccgcca

SEQ ID NO: 1598900 - RNA, 21 nt, Pseudomonas putida KT2440
ugccgccaacuguuucugcuc

SEQ ID NO: 1598901 - RNA, 15 nt, Pseudomonas putida KT2440
ugccgccccgugccc

SEQ ID NO: 1598902 - RNA, 13 nt, Pseudomonas putida KT2440
ugccgccccucca

SEQ ID NO: 1598903 - RNA, 18 nt, Pseudomonas putida KT2440
ugccgccccuccacccac

SEQ ID NO: 1598904 - RNA, 18 nt, Pseudomonas putida KT2440
ugccgccguucaggcgcc

SEQ ID NO: 1598905 - RNA, 21 nt, Pseudomonas putida KT2440
ugccgccgguguaccauccag

SEQ ID NO: 1598906 - RNA, 19 nt, Pseudomonas putida KT2440
ugccacguuuucgcggccc

SEQ ID NO: 1598907 - RNA, 23 nt, Pseudomonas putida KT2440
ugccagaugaaguagaacuggcg

SEQ ID NO: 1598908 - RNA, 22 nt, Pseudomonas putida KT2440
ugccagcccggcggccagcacg

SEQ ID NO: 1598909 - RNA, 17 nt, Pseudomonas putida KT2440
ugccagccgcaaccggg

SEQ ID NO: 1598910 - RNA, 18 nt, Pseudomonas putida KT2440
ugccagcgaggcaaucag

SEQ ID NO: 1598911 - RNA, 15 nt, Pseudomonas putida KT2440
ugccagcgccucacc

SEQ ID NO: 1598912 - RNA, 17 nt, Pseudomonas putida KT2440
ugccagcgcgcugcgca

SEQ ID NO: 1598913 - RNA, 13 nt, Pseudomonas putida KT2440
ugccaucuccaau

SEQ ID NO: 1598914 - RNA, 17 nt, Pseudomonas putida KT2440
ugccaucucgccaagca

SEQ ID NO: 1598915 - RNA, 22 nt, Pseudomonas putida KT2440
ugccaucgauauggaucccacg

SEQ ID NO: 1598916 - RNA, 19 nt, Pseudomonas putida KT2440
ugccauccucggccaggcc

SEQ ID NO: 1598917 - RNA, 21 nt, Pseudomonas putida KT2440
ugccauccucggccaggccca

SEQ ID NO: 1598918 - RNA, 14 nt, Pseudomonas putida KT2440
ugccauccaccgcg

SEQ ID NO: 1598919 - RNA, 16 nt, Pseudomonas putida KT2440
ugccagggugccagac

SEQ ID NO: 1598920 - RNA, 17 nt, Pseudomonas putida KT2440
ugccagggugccagacc

SEQ ID NO: 1598921 - RNA, 18 nt, Pseudomonas putida KT2440
ugccagggugccagacca

SEQ ID NO: 1598922 - RNA, 20 nt, Pseudomonas putida KT2440
ugccagguccgagugcucga

SEQ ID NO: 1598923 - RNA, 23 nt, Pseudomonas putida KT2440
ugccaguaaggcuugcucaaggu

SEQ ID NO: 1598924 - RNA, 21 nt, Pseudomonas putida KT2440
ugccacgcccgcugcaugcuc

SEQ ID NO: 1598925 - RNA, 17 nt, Pseudomonas putida KT2440
ugccacggccuucuuca

SEQ ID NO: 1598926 - RNA, 16 nt, Pseudomonas putida KT2440
ugccacgcugaacacg

SEQ ID NO: 1598927 - RNA, 15 nt, Pseudomonas putida KT2440
ugccaccuucagcgg

SEQ ID NO: 1598928 - RNA, 14 nt, Pseudomonas putida KT2440
ugccaccuuccagg

SEQ ID NO: 1598929 - RNA, 22 nt, Pseudomonas putida KT2440
ugccaauuuccauaccaauggc

SEQ ID NO: 1598930 - RNA, 22 nt, Pseudomonas putida KT2440
ugccaaaucccuuugcccgcca

SEQ ID NO: 1598931 - RNA, 17 nt, Pseudomonas putida KT2440
ugccaaugcucagugga

SEQ ID NO: 1598932 - RNA, 21 nt, Pseudomonas putida KT2440
ugccaacagcaguugcugcug

SEQ ID NO: 1598933 - RNA, 15 nt, Pseudomonas putida KT2440
ugccaacaggcagca

SEQ ID NO: 1598934 - RNA, 16 nt, Pseudomonas putida KT2440
ugccaacaggcagcau

SEQ ID NO: 1598935 - RNA, 14 nt, Pseudomonas putida KT2440
ugcauugcagcccc

SEQ ID NO: 1598936 - RNA, 22 nt, Pseudomonas putida KT2440
ugcauugcgcgucacugcaccu

SEQ ID NO: 1598937 - RNA, 19 nt, Pseudomonas putida KT2440
ugccaaagaaggacucggc

SEQ ID NO: 1598938 - RNA, 19 nt, Pseudomonas putida KT2440
ugcauuucgucgagcucga

SEQ ID NO: 1598939 - RNA, 17 nt, Pseudomonas putida KT2440
ugcauaugcagggccuu

SEQ ID NO: 1598940 - RNA, 23 nt, Pseudomonas putida KT2440
ugcauaggugucgaacaccaccg

SEQ ID NO: 1598941 - RNA, 22 nt, Pseudomonas putida KT2440
ugcauaaucguucugcuugucc

SEQ ID NO: 1598942 - RNA, 15 nt, Pseudomonas putida KT2440
ugcauacgcaccaac

SEQ ID NO: 1598943 - RNA, 16 nt, Pseudomonas putida KT2440
ugcaguuguccaggcu

SEQ ID NO: 1598944 - RNA, 18 nt, Pseudomonas putida KT2440
ugcaguucuaccagcagc

SEQ ID NO: 1598945 - RNA, 15 nt, Pseudomonas putida KT2440
ugcaguucuuccagc

SEQ ID NO: 1598946 - RNA, 22 nt, Pseudomonas putida KT2440
ugcaguucuugauccaguagcc

SEQ ID NO: 1598947 - RNA, 20 nt, Pseudomonas putida KT2440
ugcagugccucacgcaugcc

SEQ ID NO: 1598948 - RNA, 19 nt, Pseudomonas putida KT2440
ugcagugguugugcuggcc

SEQ ID NO: 1598949 - RNA, 17 nt, Pseudomonas putida KT2440
ugcacucccgcugcugc

SEQ ID NO: 1598950 - RNA, 18 nt, Pseudomonas putida KT2440
ugcacucccgcugcugcg

SEQ ID NO: 1598951 - RNA, 17 nt, Pseudomonas putida KT2440
ugcacuaagggcaggcc

SEQ ID NO: 1598952 - RNA, 15 nt, Pseudomonas putida KT2440
ugcacugccuggcuc

SEQ ID NO: 1598953 - RNA, 18 nt, Pseudomonas putida KT2440
ugcacugccuggcucagg

SEQ ID NO: 1598954 - RNA, 14 nt, Pseudomonas putida KT2440
ugcauguccaguca

SEQ ID NO: 1598955 - RNA, 17 nt, Pseudomonas putida KT2440
ugcauguccugaagcag

SEQ ID NO: 1598956 - RNA, 15 nt, Pseudomonas putida KT2440
ugcaugcaagcagcc

SEQ ID NO: 1598957 - RNA, 20 nt, Pseudomonas putida KT2440
ugcaucggugguuggacaca

SEQ ID NO: 1598958 - RNA, 15 nt, Pseudomonas putida KT2440
ugcaucgucacaucc

SEQ ID NO: 1598959 - RNA, 17 nt, Pseudomonas putida KT2440
ugcaucugcucccccag

SEQ ID NO: 1598960 - RNA, 19 nt, Pseudomonas putida KT2440
ugcauccacaccagcggcg

SEQ ID NO: 1598961 - RNA, 17 nt, Pseudomonas putida KT2440
ugcauccacccacuugg

SEQ ID NO: 1598962 - RNA, 15 nt, Pseudomonas putida KT2440
ugcauccaacgcugc

SEQ ID NO: 1598963 - RNA, 15 nt, Pseudomonas putida KT2440
ugcauccugcacugc

SEQ ID NO: 1598964 - RNA, 16 nt, Pseudomonas putida KT2440
ugcauccugcacugca

SEQ ID NO: 1598965 - RNA, 13 nt, Pseudomonas putida KT2440
ugcgcucaaccag

SEQ ID NO: 1598966 - RNA, 17 nt, Pseudomonas putida KT2440
ugcggacagcaaggcau

SEQ ID NO: 1598967 - RNA, 18 nt, Pseudomonas putida KT2440
ugcggaacguuuccaggc

SEQ ID NO: 1598968 - RNA, 15 nt, Pseudomonas putida KT2440
ugcggauacagcgcc

SEQ ID NO: 1598969 - RNA, 17 nt, Pseudomonas putida KT2440
ugcggauacagcgccca

SEQ ID NO: 1598970 - RNA, 20 nt, Pseudomonas putida KT2440
ugcggaccaccugggccagu

SEQ ID NO: 1598971 - RNA, 18 nt, Pseudomonas putida KT2440
ugcggaucacuuccaugg

SEQ ID NO: 1598972 - RNA, 19 nt, Pseudomonas putida KT2440
ugcggaucaucuccaugaa

SEQ ID NO: 1598973 - RNA, 15 nt, Pseudomonas putida KT2440
ugcggaucgccgccg

SEQ ID NO: 1598974 - RNA, 14 nt, Pseudomonas putida KT2440
ugcggcaggugggu

SEQ ID NO: 1598975 - RNA, 14 nt, Pseudomonas putida KT2440
ugcggccuggcccg

SEQ ID NO: 1598976 - RNA, 16 nt, Pseudomonas putida KT2440
ugcggcgaaagccagc

SEQ ID NO: 1598977 - RNA, 15 nt, Pseudomonas putida KT2440
ugcggcccuugcuca

SEQ ID NO: 1598978 - RNA, 22 nt, Pseudomonas putida KT2440
ugcggcccuuggcagcgcugca

SEQ ID NO: 1598979 - RNA, 13 nt, Pseudomonas putida KT2440
ugcggccaaugca

SEQ ID NO: 1598980 - RNA, 13 nt, Pseudomonas putida KT2440
ugcggccacagcc

SEQ ID NO: 1598981 - RNA, 14 nt, Pseudomonas putida KT2440
ugcggccaccgccu

SEQ ID NO: 1598982 - RNA, 18 nt, Pseudomonas putida KT2440
ugcggcccaaucgccaca

SEQ ID NO: 1598983 - RNA, 19 nt, Pseudomonas putida KT2440
ugcgucucuuccuccaucu

SEQ ID NO: 1598984 - RNA, 16 nt, Pseudomonas putida KT2440
ugcgugaacacugcca

SEQ ID NO: 1598985 - RNA, 19 nt, Pseudomonas putida KT2440
ugcguucuugccugucccc

SEQ ID NO: 1598986 - RNA, 14 nt, Pseudomonas putida KT2440
ugcguugccuguga

SEQ ID NO: 1598987 - RNA, 12 nt, Pseudomonas putida KT2440
ugcguugcaaca

SEQ ID NO: 1598988 - RNA, 21 nt, Pseudomonas putida KT2440
ugcgugccucagccaggcuga

SEQ ID NO: 1598989 - RNA, 20 nt, Pseudomonas putida KT2440
ugcgugccuugccugggccg

SEQ ID NO: 1598990 - RNA, 15 nt, Pseudomonas putida KT2440
ugcggugcucaugca

SEQ ID NO: 1598991 - RNA, 19 nt, Pseudomonas putida KT2440
ugcggugggcacacaccgg

SEQ ID NO: 1598992 - RNA, 14 nt, Pseudomonas putida KT2440
ugcggcgcgggcgc

SEQ ID NO: 1598993 - RNA, 17 nt, Pseudomonas putida KT2440
ugcgggcgucuuccagg

SEQ ID NO: 1598994 - RNA, 20 nt, Pseudomonas putida KT2440
ugcgggcgucuuccaggugg

SEQ ID NO: 1598995 - RNA, 18 nt, Pseudomonas putida KT2440
ugcgggcugaggaaguug

SEQ ID NO: 1598996 - RNA, 15 nt, Pseudomonas putida KT2440
ugcgggcuuucuggu

SEQ ID NO: 1598997 - RNA, 13 nt, Pseudomonas putida KT2440
ugcgcgcaacagu

SEQ ID NO: 1598998 - RNA, 16 nt, Pseudomonas putida KT2440
ugcgcgccgccaggcg

SEQ ID NO: 1598999 - RNA, 17 nt, Pseudomonas putida KT2440
ugcgcgcgggcucugug

SEQ ID NO: 1599000 - RNA, 17 nt, Pseudomonas putida KT2440
ugcgcguauccuugccc

SEQ ID NO: 1599001 - RNA, 13 nt, Pseudomonas putida KT2440
ugcgcgguaaacg

SEQ ID NO: 1599002 - RNA, 19 nt, Pseudomonas putida KT2440
ugcgcgguaaacgggaagu

SEQ ID NO: 1599003 - RNA, 13 nt, Pseudomonas putida KT2440
ugcgcggcucgcu

SEQ ID NO: 1599004 - RNA, 17 nt, Pseudomonas putida KT2440
ugcgccugcugguacag

SEQ ID NO: 1599005 - RNA, 21 nt, Pseudomonas putida KT2440
ugcgccugcugguacagccgg

SEQ ID NO: 1599006 - RNA, 15 nt, Pseudomonas putida KT2440
ugcgccugaacagca

SEQ ID NO: 1599007 - RNA, 21 nt, Pseudomonas putida KT2440
ugcgccugaacagcaucagcc

SEQ ID NO: 1599008 - RNA, 18 nt, Pseudomonas putida KT2440
ugcgccugcaaacgcagg

SEQ ID NO: 1599009 - RNA, 22 nt, Pseudomonas putida KT2440
ugcgccugcaguucgcugcgca

SEQ ID NO: 1599010 - RNA, 23 nt, Pseudomonas putida KT2440
ugcgccugcaguucgcugcgcaa

SEQ ID NO: 1599011 - RNA, 14 nt, Pseudomonas putida KT2440
ugcgccucaugcag

SEQ ID NO: 1599012 - RNA, 15 nt, Pseudomonas putida KT2440
ugcgccucaugcagc

SEQ ID NO: 1599013 - RNA, 13 nt, Pseudomonas putida KT2440
ugcgccuccagca

SEQ ID NO: 1599014 - RNA, 14 nt, Pseudomonas putida KT2440
ugcgccuccagcag

SEQ ID NO: 1599015 - RNA, 15 nt, Pseudomonas putida KT2440
ugcgccguggccgcc

SEQ ID NO: 1599016 - RNA, 23 nt, Pseudomonas putida KT2440
ugcgccugggaaaccgugucggg

SEQ ID NO: 1599017 - RNA, 18 nt, Pseudomonas putida KT2440
ugcgccuugcuuggcagc

SEQ ID NO: 1599018 - RNA, 20 nt, Pseudomonas putida KT2440
ugcgcgaaguggauauccag

SEQ ID NO: 1599019 - RNA, 17 nt, Pseudomonas putida KT2440
ugcgcccgcacagcacg

SEQ ID NO: 1599020 - RNA, 18 nt, Pseudomonas putida KT2440
ugcgcccgcacagcacgu

SEQ ID NO: 1599021 - RNA, 23 nt, Pseudomonas putida KT2440
ugcgccccccauagcaggaacac

SEQ ID NO: 1599022 - RNA, 20 nt, Pseudomonas putida KT2440
ugcgccccguccacagcgau

SEQ ID NO: 1599023 - RNA, 15 nt, Pseudomonas putida KT2440
ugcgccccucaucaa

SEQ ID NO: 1599024 - RNA, 15 nt, Pseudomonas putida KT2440
ugcgccccacuucca

SEQ ID NO: 1599025 - RNA, 18 nt, Pseudomonas putida KT2440
ugcgccgcucgcccagca

SEQ ID NO: 1599026 - RNA, 21 nt, Pseudomonas putida KT2440
ugcgccgcucgcccagcagcc

SEQ ID NO: 1599027 - RNA, 17 nt, Pseudomonas putida KT2440
ugcgcccuucgcggaag

SEQ ID NO: 1599028 - RNA, 14 nt, Pseudomonas putida KT2440
ugcgcccugcugcc

SEQ ID NO: 1599029 - RNA, 15 nt, Pseudomonas putida KT2440
ugcgcccuggcggcc

SEQ ID NO: 1599030 - RNA, 20 nt, Pseudomonas putida KT2440
ugccuuccaaccagccagcc

SEQ ID NO: 1599031 - RNA, 23 nt, Pseudomonas putida KT2440
ugccuggugguuuugcguggccu

SEQ ID NO: 1599032 - RNA, 15 nt, Pseudomonas putida KT2440
ugccugucaguuccu

SEQ ID NO: 1599033 - RNA, 18 nt, Pseudomonas putida KT2440
ugccuuccugcaccuugu

SEQ ID NO: 1599034 - RNA, 19 nt, Pseudomonas putida KT2440
ugccuuccucggccaugcg

SEQ ID NO: 1599035 - RNA, 22 nt, Pseudomonas putida KT2440
ugccuucuucgauguacggcag

SEQ ID NO: 1599036 - RNA, 17 nt, Pseudomonas putida KT2440
ugccuucgcgaccgcca

SEQ ID NO: 1599037 - RNA, 21 nt, Pseudomonas putida KT2440
ugcgccaguacgccagcagcg

SEQ ID NO: 1599038 - RNA, 19 nt, Pseudomonas putida KT2440
ugcgccaggcaucccauuc

SEQ ID NO: 1599039 - RNA, 22 nt, Pseudomonas putida KT2440
ugcgccaguggcacccacagcg

SEQ ID NO: 1599040 - RNA, 15 nt, Pseudomonas putida KT2440
ugcuugaggccgcca

SEQ ID NO: 1599041 - RNA, 23 nt, Pseudomonas putida KT2440
ugcuuuuccugcgggucauccuc

SEQ ID NO: 1599042 - RNA, 14 nt, Pseudomonas putida KT2440
ugcuucaaucaacc

SEQ ID NO: 1599043 - RNA, 19 nt, Pseudomonas putida KT2440
ugcuucaaucaaccagcgg

SEQ ID NO: 1599044 - RNA, 15 nt, Pseudomonas putida KT2440
ugcuucauagccauc

SEQ ID NO: 1599045 - RNA, 22 nt, Pseudomonas putida KT2440
ugcuucauagccaucuacuccu

SEQ ID NO: 1599046 - RNA, 15 nt, Pseudomonas putida KT2440
ugcuucaccuugccu

SEQ ID NO: 1599047 - RNA, 18 nt, Pseudomonas putida KT2440
ugcugugguuuggcccgg

SEQ ID NO: 1599048 - RNA, 18 nt, Pseudomonas putida KT2440
ugcuguugcugcaguuca

SEQ ID NO: 1599049 - RNA, 14 nt, Pseudomonas putida KT2440
ugcuguuggcgcga

SEQ ID NO: 1599050 - RNA, 15 nt, Pseudomonas putida KT2440
ugcugggcaagggcc

SEQ ID NO: 1599051 - RNA, 18 nt, Pseudomonas putida KT2440
ugcugguuuggcagcacc

SEQ ID NO: 1599052 - RNA, 19 nt, Pseudomonas putida KT2440
ugcuguagcccaccagguc

SEQ ID NO: 1599053 - RNA, 20 nt, Pseudomonas putida KT2440
ugcugccgaccugcgccggg

SEQ ID NO: 1599054 - RNA, 21 nt, Pseudomonas putida KT2440
ugcugccgcccucuugcugca

SEQ ID NO: 1599055 - RNA, 20 nt, Pseudomonas putida KT2440
ugcugccuccgccaagcacg

SEQ ID NO: 1599056 - RNA, 18 nt, Pseudomonas putida KT2440
ugcugccuuuuccugcug

SEQ ID NO: 1599057 - RNA, 15 nt, Pseudomonas putida KT2440
ugcugccugugccgg

SEQ ID NO: 1599058 - RNA, 16 nt, Pseudomonas putida KT2440
ugcugccuucucugug

SEQ ID NO: 1599059 - RNA, 13 nt, Pseudomonas putida KT2440
ugcugcucugcaa

SEQ ID NO: 1599060 - RNA, 14 nt, Pseudomonas putida KT2440
ugcugcucugccgc

SEQ ID NO: 1599061 - RNA, 22 nt, Pseudomonas putida KT2440
ugcugcuggccgccagacaacu

SEQ ID NO: 1599062 - RNA, 16 nt, Pseudomonas putida KT2440
ugcuggcggcugagcc

SEQ ID NO: 1599063 - RNA, 21 nt, Pseudomonas putida KT2440
ugcuggcggcugagccggcug

SEQ ID NO: 1599064 - RNA, 20 nt, Pseudomonas putida KT2440
ugcucggugcugcugccauc

SEQ ID NO: 1599065 - RNA, 22 nt, Pseudomonas putida KT2440
ugcucgccaucgccccgcgccg

SEQ ID NO: 1599066 - RNA, 15 nt, Pseudomonas putida KT2440
ugcucgggguuggug

SEQ ID NO: 1599067 - RNA, 12 nt, Pseudomonas putida KT2440
ugcucgccggcc

SEQ ID NO: 1599068 - RNA, 22 nt, Pseudomonas putida KT2440
ugcucgaucagguugagcaccg

SEQ ID NO: 1599069 - RNA, 14 nt, Pseudomonas putida KT2440
ugcucgaggaagcu

SEQ ID NO: 1599070 - RNA, 24 nt, Pseudomonas putida KT2440
ugcuccuugagguagucgauccag

SEQ ID NO: 1599071 - RNA, 17 nt, Pseudomonas putida KT2440
ugcuccacccgugcagg

SEQ ID NO: 1599072 - RNA, 22 nt, Pseudomonas putida KT2440
ugcucccgcaggggcugcgcaa

SEQ ID NO: 1599073 - RNA, 14 nt, Pseudomonas putida KT2440
ugcuccaccaggcc

SEQ ID NO: 1599074 - RNA, 15 nt, Pseudomonas putida KT2440
ugcuccaaccccagc

SEQ ID NO: 1599075 - RNA, 17 nt, Pseudomonas putida KT2440
ugcuccaaccccagcgc

SEQ ID NO: 1599076 - RNA, 14 nt, Pseudomonas putida KT2440
ugcuccggccggcc

SEQ ID NO: 1599077 - RNA, 12 nt, Pseudomonas putida KT2440
ugcucaccagcu

SEQ ID NO: 1599078 - RNA, 18 nt, Pseudomonas putida KT2440
ugcucaugggucaacagg

SEQ ID NO: 1599079 - RNA, 18 nt, Pseudomonas putida KT2440
ugcucaugauccagucag

SEQ ID NO: 1599080 - RNA, 19 nt, Pseudomonas putida KT2440
ugcucaucggcggcuucca

SEQ ID NO: 1599081 - RNA, 15 nt, Pseudomonas putida KT2440
ugcucauccagcaaa

SEQ ID NO: 1599082 - RNA, 16 nt, Pseudomonas putida KT2440
ugcguuucuucauccc

SEQ ID NO: 1599083 - RNA, 18 nt, Pseudomonas putida KT2440
ugcucaacuucccucugc

SEQ ID NO: 1599084 - RNA, 19 nt, Pseudomonas putida KT2440
ugcucaacuucccucugcc

SEQ ID NO: 1599085 - RNA, 20 nt, Pseudomonas putida KT2440
ugcucaacuucccucugccu

SEQ ID NO: 1599086 - RNA, 22 nt, Pseudomonas putida KT2440
ugcucaacuucccucugccugc

SEQ ID NO: 1599087 - RNA, 17 nt, Pseudomonas putida KT2440
ugcucaagcgccagggc

SEQ ID NO: 1599088 - RNA, 18 nt, Pseudomonas putida KT2440
ugcucaagcgccagggca

SEQ ID NO: 1599089 - RNA, 18 nt, Pseudomonas putida KT2440
ugcucaaucaaccagccc

SEQ ID NO: 1599090 - RNA, 18 nt, Pseudomonas putida KT2440
ugcugcccguugcgcauc

SEQ ID NO: 1599091 - RNA, 23 nt, Pseudomonas putida KT2440
ugcugcccguugcgcaucaccuc

SEQ ID NO: 1599092 - RNA, 21 nt, Pseudomonas putida KT2440
ugcugccauccuugaagaaca

SEQ ID NO: 1599093 - RNA, 18 nt, Pseudomonas putida KT2440
ugcugcagcacugccugc

SEQ ID NO: 1599094 - RNA, 15 nt, Pseudomonas putida KT2440
ugcugcagguucuga

SEQ ID NO: 1599095 - RNA, 13 nt, Pseudomonas putida KT2440
ugcugcagggcac

SEQ ID NO: 1599096 - RNA, 22 nt, Pseudomonas putida KT2440
ugcugcagggcacgccaaucac

SEQ ID NO: 1599097 - RNA, 18 nt, Pseudomonas putida KT2440
ugcugcagggcccagcca

SEQ ID NO: 1599098 - RNA, 21 nt, Pseudomonas putida KT2440
ugcugcagggcccagccaccg

SEQ ID NO: 1599099 - RNA, 19 nt, Pseudomonas putida KT2440
ugcugcaacagcucaucca

SEQ ID NO: 1599100 - RNA, 14 nt, Pseudomonas putida KT2440
ugcucgucaccauc

SEQ ID NO: 1599101 - RNA, 16 nt, Pseudomonas putida KT2440
ugcugagcaagcgcgc

SEQ ID NO: 1599102 - RNA, 15 nt, Pseudomonas putida KT2440
ugcugagucagcuug

SEQ ID NO: 1599103 - RNA, 17 nt, Pseudomonas putida KT2440
ugcugagucagcuugug

SEQ ID NO: 1599104 - RNA, 22 nt, Pseudomonas putida KT2440
ugaaguugcggcauagcucgag

SEQ ID NO: 1599105 - RNA, 15 nt, Pseudomonas putida KT2440
ugaaguugcaggcau

SEQ ID NO: 1599106 - RNA, 15 nt, Pseudomonas putida KT2440
ugaagugccaaggcu

SEQ ID NO: 1599107 - RNA, 17 nt, Pseudomonas putida KT2440
ugaagugccaaggcuuu

SEQ ID NO: 1599108 - RNA, 20 nt, Pseudomonas putida KT2440
ugaaguacucggcacgcgcc

SEQ ID NO: 1599109 - RNA, 14 nt, Pseudomonas putida KT2440
ugaaguauaaaggu

SEQ ID NO: 1599110 - RNA, 14 nt, Pseudomonas putida KT2440
ugaagucaaccaac

SEQ ID NO: 1599111 - RNA, 14 nt, Pseudomonas putida KT2440
ugaauaaccugguu

SEQ ID NO: 1599112 - RNA, 19 nt, Pseudomonas putida KT2440
ugaaucagcggcaggcugg

SEQ ID NO: 1599113 - RNA, 20 nt, Pseudomonas putida KT2440
ugaaucagcggcaggcuggc

SEQ ID NO: 1599114 - RNA, 19 nt, Pseudomonas putida KT2440
ugaaugccgccauccucgg

SEQ ID NO: 1599115 - RNA, 15 nt, Pseudomonas putida KT2440
ugaaucccugagcca

SEQ ID NO: 1599116 - RNA, 15 nt, Pseudomonas putida KT2440
ugaagaguggaucgu

SEQ ID NO: 1599117 - RNA, 21 nt, Pseudomonas putida KT2440
ugaagccaguacgcgccugca

SEQ ID NO: 1599118 - RNA, 17 nt, Pseudomonas putida KT2440
ugaagccaugggcagag

SEQ ID NO: 1599119 - RNA, 19 nt, Pseudomonas putida KT2440
ugaagcgcgggucuuccac

SEQ ID NO: 1599120 - RNA, 15 nt, Pseudomonas putida KT2440
ugaagcgagguggcu

SEQ ID NO: 1599121 - RNA, 19 nt, Pseudomonas putida KT2440
ugaaggcgaaugagaggcg

SEQ ID NO: 1599122 - RNA, 12 nt, Pseudomonas putida KT2440
ugaaggcccagc

SEQ ID NO: 1599123 - RNA, 17 nt, Pseudomonas putida KT2440
ugaagcuuccaguuggc

SEQ ID NO: 1599124 - RNA, 19 nt, Pseudomonas putida KT2440
ugaaggaauuaccaggcgc

SEQ ID NO: 1599125 - RNA, 23 nt, Pseudomonas putida KT2440
ugaaggccagugcgaucugagua

SEQ ID NO: 1599126 - RNA, 16 nt, Pseudomonas putida KT2440
ugaagcgguugaccgc

SEQ ID NO: 1599127 - RNA, 12 nt, Pseudomonas putida KT2440
ugaagcucucca

SEQ ID NO: 1599128 - RNA, 12 nt, Pseudomonas putida KT2440
ugaagcggccua

SEQ ID NO: 1599129 - RNA, 11 nt, Pseudomonas putida KT2440
ugaagaagccc

SEQ ID NO: 1599130 - RNA, 21 nt, Pseudomonas putida KT2440
ugaagaagcuaccccacaacc

SEQ ID NO: 1599131 - RNA, 13 nt, Pseudomonas putida KT2440
ugaagaagcuccc

SEQ ID NO: 1599132 - RNA, 14 nt, Pseudomonas putida KT2440
ugaagaagcucccg

SEQ ID NO: 1599133 - RNA, 18 nt, Pseudomonas putida KT2440
ugaagaacaccugcagcg

SEQ ID NO: 1599134 - RNA, 13 nt, Pseudomonas putida KT2440
ugaacuuggccuc

SEQ ID NO: 1599135 - RNA, 18 nt, Pseudomonas putida KT2440
ugaacuuggccuccagca

SEQ ID NO: 1599136 - RNA, 22 nt, Pseudomonas putida KT2440
ugaacuuguacagcgugcgcuc

SEQ ID NO: 1599137 - RNA, 20 nt, Pseudomonas putida KT2440
ugaagacgcucgacagcaac

SEQ ID NO: 1599138 - RNA, 12 nt, Pseudomonas putida KT2440
ugaacugcucuc

SEQ ID NO: 1599139 - RNA, 17 nt, Pseudomonas putida KT2440
ugacgcgccaggucuuc

SEQ ID NO: 1599140 - RNA, 22 nt, Pseudomonas putida KT2440
ugacgcggauccgugcaccgcu

SEQ ID NO: 1599141 - RNA, 18 nt, Pseudomonas putida KT2440
ugacgaccucggccaggu

SEQ ID NO: 1599142 - RNA, 15 nt, Pseudomonas putida KT2440
ugacgcaagcgcgcc

SEQ ID NO: 1599143 - RNA, 19 nt, Pseudomonas putida KT2440
ugacgcaagcgcgccgcca

SEQ ID NO: 1599144 - RNA, 17 nt, Pseudomonas putida KT2440
ugaccuggaucgccagg

SEQ ID NO: 1599145 - RNA, 14 nt, Pseudomonas putida KT2440
ugaccuucaaccac

SEQ ID NO: 1599146 - RNA, 14 nt, Pseudomonas putida KT2440
ugaccgccccgccc

SEQ ID NO: 1599147 - RNA, 12 nt, Pseudomonas putida KT2440
ugaccgccgcca

SEQ ID NO: 1599148 - RNA, 13 nt, Pseudomonas putida KT2440
ugaccuuggcugg

SEQ ID NO: 1599149 - RNA, 18 nt, Pseudomonas putida KT2440
ugacaaugcgacugagca

SEQ ID NO: 1599150 - RNA, 15 nt, Pseudomonas putida KT2440
ugaccaacaggcugg

SEQ ID NO: 1599151 - RNA, 16 nt, Pseudomonas putida KT2440
ugaccagcccgcugca

SEQ ID NO: 1599152 - RNA, 16 nt, Pseudomonas putida KT2440
ugaccagcggcagcaa

SEQ ID NO: 1599153 - RNA, 17 nt, Pseudomonas putida KT2440
ugaccaggcccagcagg

SEQ ID NO: 1599154 - RNA, 14 nt, Pseudomonas putida KT2440
ugacccgcuugcag

SEQ ID NO: 1599155 - RNA, 11 nt, Pseudomonas putida KT2440
ugaccgcccag

SEQ ID NO: 1599156 - RNA, 17 nt, Pseudomonas putida KT2440
ugaccgcccagcgucgu

SEQ ID NO: 1599157 - RNA, 18 nt, Pseudomonas putida KT2440
ugaccgagguaccaccgg

SEQ ID NO: 1599158 - RNA, 16 nt, Pseudomonas putida KT2440
ugagacuagcaguccc

SEQ ID NO: 1599159 - RNA, 21 nt, Pseudomonas putida KT2440
ugagaccguagggggccgcuu

SEQ ID NO: 1599160 - RNA, 16 nt, Pseudomonas putida KT2440
ugagacuuagucucga

SEQ ID NO: 1599161 - RNA, 20 nt, Pseudomonas putida KT2440
ugagcacacgguaguccugc

SEQ ID NO: 1599162 - RNA, 16 nt, Pseudomonas putida KT2440
ugagcaagcgcgcgcc

SEQ ID NO: 1599163 - RNA, 19 nt, Pseudomonas putida KT2440
ugacuuccagcuugccguc

SEQ ID NO: 1599164 - RNA, 14 nt, Pseudomonas putida KT2440
ugacuauuucuagu

SEQ ID NO: 1599165 - RNA, 22 nt, Pseudomonas putida KT2440
ugacguugcaggauuugcccgc

SEQ ID NO: 1599166 - RNA, 19 nt, Pseudomonas putida KT2440
ugacggugcgcgccagcgg

SEQ ID NO: 1599167 - RNA, 16 nt, Pseudomonas putida KT2440
ugcaacagcucaucca

SEQ ID NO: 1599168 - RNA, 17 nt, Pseudomonas putida KT2440
ugcaacagcucauccag

SEQ ID NO: 1599169 - RNA, 15 nt, Pseudomonas putida KT2440
ugcaacgcagcgcgu

SEQ ID NO: 1599170 - RNA, 20 nt, Pseudomonas putida KT2440
ugcaacccgucagugcucgg

SEQ ID NO: 1599171 - RNA, 16 nt, Pseudomonas putida KT2440
ugcaacccggccuugg

SEQ ID NO: 1599172 - RNA, 22 nt, Pseudomonas putida KT2440
ugcaacccggccuuggccgcug

SEQ ID NO: 1599173 - RNA, 13 nt, Pseudomonas putida KT2440
ugcaaccaggcgc

SEQ ID NO: 1599174 - RNA, 22 nt, Pseudomonas putida KT2440
ugcaacggcacacgcaccaccc

SEQ ID NO: 1599175 - RNA, 16 nt, Pseudomonas putida KT2440
ugcaacuggcgcaggc

SEQ ID NO: 1599176 - RNA, 14 nt, Pseudomonas putida KT2440
ugcaacugccacgc

SEQ ID NO: 1599177 - RNA, 15 nt, Pseudomonas putida KT2440
ugcaccgaagcacca

SEQ ID NO: 1599178 - RNA, 19 nt, Pseudomonas putida KT2440
ugcaccgaagcaccacugg

SEQ ID NO: 1599179 - RNA, 19 nt, Pseudomonas putida KT2440
ugcacccgugccugccugc

SEQ ID NO: 1599180 - RNA, 17 nt, Pseudomonas putida KT2440
ugcacccucuuccuugu

SEQ ID NO: 1599181 - RNA, 17 nt, Pseudomonas putida KT2440
ugcaccccgauccauuu

SEQ ID NO: 1599182 - RNA, 14 nt, Pseudomonas putida KT2440
ugcacccgcgcgcu

SEQ ID NO: 1599183 - RNA, 19 nt, Pseudomonas putida KT2440
ugcacccaucggcgcgaag

SEQ ID NO: 1599184 - RNA, 17 nt, Pseudomonas putida KT2440
ugcaccaugaauucccu

SEQ ID NO: 1599185 - RNA, 16 nt, Pseudomonas putida KT2440
ugcaccaugauguucu

SEQ ID NO: 1599186 - RNA, 16 nt, Pseudomonas putida KT2440
ugcaccaguuccuggc

SEQ ID NO: 1599187 - RNA, 19 nt, Pseudomonas putida KT2440
ugcaccaguuccuggcgcu

SEQ ID NO: 1599188 - RNA, 20 nt, Pseudomonas putida KT2440
ugcaccaguuccuggcgcuc

SEQ ID NO: 1599189 - RNA, 22 nt, Pseudomonas putida KT2440
ugcaccaguuccuggcgcuccu

SEQ ID NO: 1599190 - RNA, 13 nt, Pseudomonas putida KT2440
ugcaccagcacca

SEQ ID NO: 1599191 - RNA, 13 nt, Pseudomonas putida KT2440
ugcaccaccugcu

SEQ ID NO: 1599192 - RNA, 14 nt, Pseudomonas putida KT2440
ugcaccacaugcac

SEQ ID NO: 1599193 - RNA, 17 nt, Pseudomonas putida KT2440
ugcaccacccccagcgc

SEQ ID NO: 1599194 - RNA, 22 nt, Pseudomonas putida KT2440
ugcaccacccccagcgccucca

SEQ ID NO: 1599195 - RNA, 22 nt, Pseudomonas putida KT2440
ugcaauucgugaaccaagcaaa

SEQ ID NO: 1599196 - RNA, 19 nt, Pseudomonas putida KT2440
ugcacggcaaaguccagca

SEQ ID NO: 1599197 - RNA, 20 nt, Pseudomonas putida KT2440
ugcacgcuuucgccgaucag

SEQ ID NO: 1599198 - RNA, 23 nt, Pseudomonas putida KT2440
ugcaccugguaggucacuucagu

SEQ ID NO: 1599199 - RNA, 18 nt, Pseudomonas putida KT2440
ugcaccgguucgccccca

SEQ ID NO: 1599200 - RNA, 19 nt, Pseudomonas putida KT2440
ugcaccucccgccacggcc

SEQ ID NO: 1599201 - RNA, 16 nt, Pseudomonas putida KT2440
ugcaccgcagccccag

SEQ ID NO: 1599202 - RNA, 21 nt, Pseudomonas putida KT2440
ugcaccgcuccgacaaaugca

SEQ ID NO: 1599203 - RNA, 14 nt, Pseudomonas putida KT2440
ugaugcgccgcucg

SEQ ID NO: 1599204 - RNA, 23 nt, Pseudomonas putida KT2440
ugaugcgcaccggaguccccacc

SEQ ID NO: 1599205 - RNA, 18 nt, Pseudomonas putida KT2440
ugauuacccugcgccagg

SEQ ID NO: 1599206 - RNA, 20 nt, Pseudomonas putida KT2440
ugauucagcacaccgcucaa

SEQ ID NO: 1599207 - RNA, 13 nt, Pseudomonas putida KT2440
ugcaaacacccag

SEQ ID NO: 1599208 - RNA, 17 nt, Pseudomonas putida KT2440
ugaucuguccuccugcc

SEQ ID NO: 1599209 - RNA, 21 nt, Pseudomonas putida KT2440
ugaucugcgcgcucacugcau

SEQ ID NO: 1599210 - RNA, 16 nt, Pseudomonas putida KT2440
ugaucauguccuugcu

SEQ ID NO: 1599211 - RNA, 14 nt, Pseudomonas putida KT2440
ugaucaucagaccg

SEQ ID NO: 1599212 - RNA, 18 nt, Pseudomonas putida KT2440
ugaugccggaguggaaga

SEQ ID NO: 1599213 - RNA, 20 nt, Pseudomonas putida KT2440
ugaugauaccgaacagcacc

SEQ ID NO: 1599214 - RNA, 21 nt, Pseudomonas putida KT2440
ugaucuugguggucagccagg

SEQ ID NO: 1599215 - RNA, 18 nt, Pseudomonas putida KT2440
ugaugaaacuuuucauug

SEQ ID NO: 1599216 - RNA, 13 nt, Pseudomonas putida KT2440
ugauaggacugcu

SEQ ID NO: 1599217 - RNA, 13 nt, Pseudomonas putida KT2440
ugaucaauccucu

SEQ ID NO: 1599218 - RNA, 22 nt, Pseudomonas putida KT2440
ugaucaacaaaccgacccugcu

SEQ ID NO: 1599219 - RNA, 14 nt, Pseudomonas putida KT2440
ugagcaucggcguu

SEQ ID NO: 1599220 - RNA, 18 nt, Pseudomonas putida KT2440
ugagcauggcaaacagca

SEQ ID NO: 1599221 - RNA, 21 nt, Pseudomonas putida KT2440
ugagcauggcaaacagcacca

SEQ ID NO: 1599222 - RNA, 22 nt, Pseudomonas putida KT2440
ugagcauggcaaacagcaccag

SEQ ID NO: 1599223 - RNA, 18 nt, Pseudomonas putida KT2440
ugagucaggcgcccugcc

SEQ ID NO: 1599224 - RNA, 14 nt, Pseudomonas putida KT2440
ugagccaaggccgc

SEQ ID NO: 1599225 - RNA, 21 nt, Pseudomonas putida KT2440
ugauacacccgcuccaacaaa

SEQ ID NO: 1599226 - RNA, 13 nt, Pseudomonas putida KT2440
ugauaacgaaucu

SEQ ID NO: 1599227 - RNA, 20 nt, Pseudomonas putida KT2440
ucgccauggccgaucuucag

SEQ ID NO: 1599228 - RNA, 16 nt, Pseudomonas putida KT2440
ucgccauucaccagcu

SEQ ID NO: 1599229 - RNA, 19 nt, Pseudomonas putida KT2440
ucgccauucaccagcuuca

SEQ ID NO: 1599230 - RNA, 22 nt, Pseudomonas putida KT2440
ucgccacacaagccccccugua

SEQ ID NO: 1599231 - RNA, 16 nt, Pseudomonas putida KT2440
ucgccacaccacagcu

SEQ ID NO: 1599232 - RNA, 18 nt, Pseudomonas putida KT2440
ucgccacaccacagcugc

SEQ ID NO: 1599233 - RNA, 21 nt, Pseudomonas putida KT2440
ucgccaaggccucgaacagca

SEQ ID NO: 1599234 - RNA, 16 nt, Pseudomonas putida KT2440
ucgccaagguccagcc

SEQ ID NO: 1599235 - RNA, 19 nt, Pseudomonas putida KT2440
ucgccaagguccagccacg

SEQ ID NO: 1599236 - RNA, 14 nt, Pseudomonas putida KT2440
ucgccaaccccacg

SEQ ID NO: 1599237 - RNA, 19 nt, Pseudomonas putida KT2440
ucgcauaugccccaggcau

SEQ ID NO: 1599238 - RNA, 18 nt, Pseudomonas putida KT2440
ucgcagguaaucggccug

SEQ ID NO: 1599239 - RNA, 16 nt, Pseudomonas putida KT2440
ucgcccaccagcugca

SEQ ID NO: 1599240 - RNA, 20 nt, Pseudomonas putida KT2440
ucgccccaggagggcuggug

SEQ ID NO: 1599241 - RNA, 14 nt, Pseudomonas putida KT2440
ucgcccccgcugca

SEQ ID NO: 1599242 - RNA, 21 nt, Pseudomonas putida KT2440
ucgccccgcggucuggcacag

SEQ ID NO: 1599243 - RNA, 18 nt, Pseudomonas putida KT2440
ucgcccaguuccaugucg

SEQ ID NO: 1599244 - RNA, 14 nt, Pseudomonas putida KT2440
ucgcccgcugcuuc

SEQ ID NO: 1599245 - RNA, 14 nt, Pseudomonas putida KT2440
ucgcccgcccagcc

SEQ ID NO: 1599246 - RNA, 18 nt, Pseudomonas putida KT2440
ucgccgugcagcaccgcu

SEQ ID NO: 1599247 - RNA, 16 nt, Pseudomonas putida KT2440
ucgccgucgaccaggc

SEQ ID NO: 1599248 - RNA, 13 nt, Pseudomonas putida KT2440
ucgccgucagccu

SEQ ID NO: 1599249 - RNA, 15 nt, Pseudomonas putida KT2440
ucgccgucagccuuu

SEQ ID NO: 1599250 - RNA, 15 nt, Pseudomonas putida KT2440
ucgccguacuggcug

SEQ ID NO: 1599251 - RNA, 17 nt, Pseudomonas putida KT2440
ucgccguacuggcugca

SEQ ID NO: 1599252 - RNA, 13 nt, Pseudomonas putida KT2440
ucgccuggccggc

SEQ ID NO: 1599253 - RNA, 20 nt, Pseudomonas putida KT2440
ucgccugcuuggcaccuauc

SEQ ID NO: 1599254 - RNA, 17 nt, Pseudomonas putida KT2440
ucgccuguaccggccuu

SEQ ID NO: 1599255 - RNA, 18 nt, Pseudomonas putida KT2440
ucgcccuuuuuuuauucc

SEQ ID NO: 1599256 - RNA, 14 nt, Pseudomonas putida KT2440
ucgccgaaccccac

SEQ ID NO: 1599257 - RNA, 14 nt, Pseudomonas putida KT2440
ucgcccugcgccug

SEQ ID NO: 1599258 - RNA, 19 nt, Pseudomonas putida KT2440
ucgccgaucagcuggguga

SEQ ID NO: 1599259 - RNA, 23 nt, Pseudomonas putida KT2440
ucgccgagccgauaugcgggguc

SEQ ID NO: 1599260 - RNA, 20 nt, Pseudomonas putida KT2440
ucgccgcuguacaccaggac

SEQ ID NO: 1599261 - RNA, 19 nt, Pseudomonas putida KT2440
ucgccgcggguaccaccug

SEQ ID NO: 1599262 - RNA, 22 nt, Pseudomonas putida KT2440
ucgccgcgcuguggcgcccggc

SEQ ID NO: 1599263 - RNA, 23 nt, Pseudomonas putida KT2440
ucgccgccaugguuuugggcacg

SEQ ID NO: 1599264 - RNA, 15 nt, Pseudomonas putida KT2440
ucgaugaaggcugcu

SEQ ID NO: 1599265 - RNA, 22 nt, Pseudomonas putida KT2440
ucgaucuggaucacugccagca

SEQ ID NO: 1599266 - RNA, 16 nt, Pseudomonas putida KT2440
ucgaucuggaugaagu

SEQ ID NO: 1599267 - RNA, 21 nt, Pseudomonas putida KT2440
ucgaucucggccagcaggcca

SEQ ID NO: 1599268 - RNA, 14 nt, Pseudomonas putida KT2440
ucgaucugccugcc

SEQ ID NO: 1599269 - RNA, 16 nt, Pseudomonas putida KT2440
ucgaucugccugccuc

SEQ ID NO: 1599270 - RNA, 21 nt, Pseudomonas putida KT2440
ucgaucugcucgcccaccgac

SEQ ID NO: 1599271 - RNA, 14 nt, Pseudomonas putida KT2440
ucgcacgcaugucc

SEQ ID NO: 1599272 - RNA, 20 nt, Pseudomonas putida KT2440
ucgcaccacguccggccagc

SEQ ID NO: 1599273 - RNA, 21 nt, Pseudomonas putida KT2440
ucgcacagguccagccgccau

SEQ ID NO: 1599274 - RNA, 22 nt, Pseudomonas putida KT2440
ucgaucacacccucugccaucu

SEQ ID NO: 1599275 - RNA, 19 nt, Pseudomonas putida KT2440
ucgaucaacgugguaaugc

SEQ ID NO: 1599276 - RNA, 17 nt, Pseudomonas putida KT2440
ucgauaucggcgcggcc

SEQ ID NO: 1599277 - RNA, 19 nt, Pseudomonas putida KT2440
ucgacgccgugguagcacc

SEQ ID NO: 1599278 - RNA, 14 nt, Pseudomonas putida KT2440
ucgacgcggaccuu

SEQ ID NO: 1599279 - RNA, 19 nt, Pseudomonas putida KT2440
ucgacgcgcgcagccuggc

SEQ ID NO: 1599280 - RNA, 15 nt, Pseudomonas putida KT2440
ucgacgcuuccuugu

SEQ ID NO: 1599281 - RNA, 16 nt, Pseudomonas putida KT2440
ucgagggcuucuucuu

SEQ ID NO: 1599282 - RNA, 19 nt, Pseudomonas putida KT2440
ucgaggauuuucaccuucg

SEQ ID NO: 1599283 - RNA, 17 nt, Pseudomonas putida KT2440
ucgaggaucagcgcaga

SEQ ID NO: 1599284 - RNA, 16 nt, Pseudomonas putida KT2440
uccuuguaggccauuu

SEQ ID NO: 1599285 - RNA, 22 nt, Pseudomonas putida KT2440
uccuuguaggccauuucccaaa

SEQ ID NO: 1599286 - RNA, 20 nt, Pseudomonas putida KT2440
uccuuguugaccccgggcac

SEQ ID NO: 1599287 - RNA, 21 nt, Pseudomonas putida KT2440
uccuuggcgaaggcugccugg

SEQ ID NO: 1599288 - RNA, 19 nt, Pseudomonas putida KT2440
uccuuggggauguugcggc

SEQ ID NO: 1599289 - RNA, 19 nt, Pseudomonas putida KT2440
uccuuggacagcaauucca

SEQ ID NO: 1599290 - RNA, 20 nt, Pseudomonas putida KT2440
uccuuggacagcaauuccaa

SEQ ID NO: 1599291 - RNA, 19 nt, Pseudomonas putida KT2440
ucgaaaggcgacuccugaa

SEQ ID NO: 1599292 - RNA, 18 nt, Pseudomonas putida KT2440
ucgaaacgccgggucagc

SEQ ID NO: 1599293 - RNA, 13 nt, Pseudomonas putida KT2440
ucgaaaccaucaa

SEQ ID NO: 1599294 - RNA, 15 nt, Pseudomonas putida KT2440
ucgaaaccaucaauc

SEQ ID NO: 1599295 - RNA, 18 nt, Pseudomonas putida KT2440
ucgaaaccaucaaucaac

SEQ ID NO: 1599296 - RNA, 18 nt, Pseudomonas putida KT2440
ucgaccggcaggcgcuuc

SEQ ID NO: 1599297 - RNA, 22 nt, Pseudomonas putida KT2440
ucgaccucgauuuccaccggcu

SEQ ID NO: 1599298 - RNA, 13 nt, Pseudomonas putida KT2440
ucgacccgcugcc

SEQ ID NO: 1599299 - RNA, 13 nt, Pseudomonas putida KT2440
ucgaccgccgccu

SEQ ID NO: 1599300 - RNA, 19 nt, Pseudomonas putida KT2440
ucgaccgcgaccaugguga

SEQ ID NO: 1599301 - RNA, 23 nt, Pseudomonas putida KT2440
ucgacaaucggcucaacagccac

SEQ ID NO: 1599302 - RNA, 16 nt, Pseudomonas putida KT2440
ucgacaaccccagccc

SEQ ID NO: 1599303 - RNA, 18 nt, Pseudomonas putida KT2440
ucgacaacccgcgcugcc

SEQ ID NO: 1599304 - RNA, 22 nt, Pseudomonas putida KT2440
ucgaacagcuugccauccuuga

SEQ ID NO: 1599305 - RNA, 19 nt, Pseudomonas putida KT2440
ucgaacagcucuuccaguu

SEQ ID NO: 1599306 - RNA, 14 nt, Pseudomonas putida KT2440
ucgaacaacugucc

SEQ ID NO: 1599307 - RNA, 22 nt, Pseudomonas putida KT2440
ucgaacaacuguccugugcgca

SEQ ID NO: 1599308 - RNA, 17 nt, Pseudomonas putida KT2440
ucgaacaauucuuccag

SEQ ID NO: 1599309 - RNA, 20 nt, Pseudomonas putida KT2440
ucgaaggucaggcgcgugcc

SEQ ID NO: 1599310 - RNA, 19 nt, Pseudomonas putida KT2440
ucgaacgcugccugcaggc

SEQ ID NO: 1599311 - RNA, 14 nt, Pseudomonas putida KT2440
ucgaacgcugugcc

SEQ ID NO: 1599312 - RNA, 18 nt, Pseudomonas putida KT2440
ucgaacuucacuucgguu

SEQ ID NO: 1599313 - RNA, 21 nt, Pseudomonas putida KT2440
uccuggcacucucgcggugcc

SEQ ID NO: 1599314 - RNA, 10 nt, Pseudomonas putida KT2440
uccugcucuc

SEQ ID NO: 1599315 - RNA, 14 nt, Pseudomonas putida KT2440
uccugcagcaggcc

SEQ ID NO: 1599316 - RNA, 18 nt, Pseudomonas putida KT2440
uccugcaccugguugcca

SEQ ID NO: 1599317 - RNA, 17 nt, Pseudomonas putida KT2440
uccugcaccuuguuacc

SEQ ID NO: 1599318 - RNA, 14 nt, Pseudomonas putida KT2440
uccugcagcaccag

SEQ ID NO: 1599319 - RNA, 15 nt, Pseudomonas putida KT2440
uccugcagcaccagc

SEQ ID NO: 1599320 - RNA, 16 nt, Pseudomonas putida KT2440
uccugcagcaccagcu

SEQ ID NO: 1599321 - RNA, 15 nt, Pseudomonas putida KT2440
uccugcacugcaaca

SEQ ID NO: 1599322 - RNA, 18 nt, Pseudomonas putida KT2440
ucagcgaugccuuuguac

SEQ ID NO: 1599323 - RNA, 22 nt, Pseudomonas putida KT2440
ucagcgagcgggugccgcagca

SEQ ID NO: 1599324 - RNA, 17 nt, Pseudomonas putida KT2440
uccugcgugcugugcac

SEQ ID NO: 1599325 - RNA, 20 nt, Pseudomonas putida KT2440
uccugcggcagauccugcag

SEQ ID NO: 1599326 - RNA, 13 nt, Pseudomonas putida KT2440
uccugcagggaac

SEQ ID NO: 1599327 - RNA, 19 nt, Pseudomonas putida KT2440
uccuugccguccaggucca

SEQ ID NO: 1599328 - RNA, 21 nt, Pseudomonas putida KT2440
uccuugcccucgcccacucac

SEQ ID NO: 1599329 - RNA, 16 nt, Pseudomonas putida KT2440
uccuugcccaccagga

SEQ ID NO: 1599330 - RNA, 14 nt, Pseudomonas putida KT2440
uccuugcagggcac

SEQ ID NO: 1599331 - RNA, 17 nt, Pseudomonas putida KT2440
uccuugaagaacaccug

SEQ ID NO: 1599332 - RNA, 22 nt, Pseudomonas putida KT2440
uccuucugcgucgacucuuccc

SEQ ID NO: 1599333 - RNA, 21 nt, Pseudomonas putida KT2440
uccuucgaccagaacagcucg

SEQ ID NO: 1599334 - RNA, 22 nt, Pseudomonas putida KT2440
ucguuccagugaagcuuccagu

SEQ ID NO: 1599335 - RNA, 13 nt, Pseudomonas putida KT2440
ucguucaugcccu

SEQ ID NO: 1599336 - RNA, 17 nt, Pseudomonas putida KT2440
ucguucuugaagaugac

SEQ ID NO: 1599337 - RNA, 21 nt, Pseudomonas putida KT2440
ucguugguggugcgcccggcg

SEQ ID NO: 1599338 - RNA, 18 nt, Pseudomonas putida KT2440
ucgugaucauccccagca

SEQ ID NO: 1599339 - RNA, 22 nt, Pseudomonas putida KT2440
ucguucaacaccuucucggccu

SEQ ID NO: 1599340 - RNA, 14 nt, Pseudomonas putida KT2440
ucguuauccagcac

SEQ ID NO: 1599341 - RNA, 22 nt, Pseudomonas putida KT2440
ucguuauccugcagcaccagcu

SEQ ID NO: 1599342 - RNA, 14 nt, Pseudomonas putida KT2440
ucuaaaucgaccug

SEQ ID NO: 1599343 - RNA, 21 nt, Pseudomonas putida KT2440
ucguccccgcgcuuugugcac

SEQ ID NO: 1599344 - RNA, 13 nt, Pseudomonas putida KT2440
ucguccaggcuca

SEQ ID NO: 1599345 - RNA, 20 nt, Pseudomonas putida KT2440
ucguccacgcgcaggccacg

SEQ ID NO: 1599346 - RNA, 22 nt, Pseudomonas putida KT2440
ucguaccgcauuguccucguca

SEQ ID NO: 1599347 - RNA, 19 nt, Pseudomonas putida KT2440
ucguacgcgggcagacuuc

SEQ ID NO: 1599348 - RNA, 17 nt, Pseudomonas putida KT2440
ucggucagccagaugcg

SEQ ID NO: 1599349 - RNA, 16 nt, Pseudomonas putida KT2440
ucgguacccgccagca

SEQ ID NO: 1599350 - RNA, 19 nt, Pseudomonas putida KT2440
ucgguaaagcgcgccucca

SEQ ID NO: 1599351 - RNA, 20 nt, Pseudomonas putida KT2440
ucggugacgaucaccagggc

SEQ ID NO: 1599352 - RNA, 15 nt, Pseudomonas putida KT2440
ucggugaugaucagg

SEQ ID NO: 1599353 - RNA, 13 nt, Pseudomonas putida KT2440
ucggugcgcugcu

SEQ ID NO: 1599354 - RNA, 14 nt, Pseudomonas putida KT2440
ucgguggucagcuc

SEQ ID NO: 1599355 - RNA, 12 nt, Pseudomonas putida KT2440
ucggugguugga

SEQ ID NO: 1599356 - RNA, 16 nt, Pseudomonas putida KT2440
ucggugcucaggcuca

SEQ ID NO: 1599357 - RNA, 15 nt, Pseudomonas putida KT2440
ucggugcugcugcca

SEQ ID NO: 1599358 - RNA, 22 nt, Pseudomonas putida KT2440
ucgguguaggguucgauccacu

SEQ ID NO: 1599359 - RNA, 11 nt, Pseudomonas putida KT2440
ucgggcugcug

SEQ ID NO: 1599360 - RNA, 21 nt, Pseudomonas putida KT2440
ucggggaauggcccagccagc

SEQ ID NO: 1599361 - RNA, 22 nt, Pseudomonas putida KT2440
ucgggcgguugggcaagugcgu

SEQ ID NO: 1599362 - RNA, 16 nt, Pseudomonas putida KT2440
ucggggguucgaaucc

SEQ ID NO: 1599363 - RNA, 16 nt, Pseudomonas putida KT2440
ucggggcugcuuugca

SEQ ID NO: 1599364 - RNA, 22 nt, Pseudomonas putida KT2440
ucggggucgcgaguucgagucu

SEQ ID NO: 1599365 - RNA, 19 nt, Pseudomonas putida KT2440
ucgggucaacucaggcuga

SEQ ID NO: 1599366 - RNA, 14 nt, Pseudomonas putida KT2440
ucgggucauccccg

SEQ ID NO: 1599367 - RNA, 18 nt, Pseudomonas putida KT2440
ucggguacuccaccacca

SEQ ID NO: 1599368 - RNA, 21 nt, Pseudomonas putida KT2440
ucggguaggucaccaucagcc

SEQ ID NO: 1599369 - RNA, 14 nt, Pseudomonas putida KT2440
ucgggugaggauga

SEQ ID NO: 1599370 - RNA, 24 nt, Pseudomonas putida KT2440
ucgggugaaaaggcccucagaguu

SEQ ID NO: 1599371 - RNA, 20 nt, Pseudomonas putida KT2440
ucgggaauuguacgaccccc

SEQ ID NO: 1599372 - RNA, 14 nt, Pseudomonas putida KT2440
ucgggaacagcucu

SEQ ID NO: 1599373 - RNA, 20 nt, Pseudomonas putida KT2440
ucgggcacgaucagcagcaa

SEQ ID NO: 1599374 - RNA, 21 nt, Pseudomonas putida KT2440
ucgggccagucccuccugugc

SEQ ID NO: 1599375 - RNA, 21 nt, Pseudomonas putida KT2440
ucgggcaaggccagugccgca

SEQ ID NO: 1599376 - RNA, 13 nt, Pseudomonas putida KT2440
ucgggcaaggcga

SEQ ID NO: 1599377 - RNA, 18 nt, Pseudomonas putida KT2440
ucggcggccccggcgccg

SEQ ID NO: 1599378 - RNA, 20 nt, Pseudomonas putida KT2440
ucggcgcgaaggucacgccc

SEQ ID NO: 1599379 - RNA, 15 nt, Pseudomonas putida KT2440
ucggcgcgugccgca

SEQ ID NO: 1599380 - RNA, 21 nt, Pseudomonas putida KT2440
ucggcgauauggcuccaccac

SEQ ID NO: 1599381 - RNA, 22 nt, Pseudomonas putida KT2440
ucggcgauagguuugcguugcc

SEQ ID NO: 1599382 - RNA, 20 nt, Pseudomonas putida KT2440
ucggcgcacccggcuggucg

SEQ ID NO: 1599383 - RNA, 18 nt, Pseudomonas putida KT2440
ucggcguauggcuucacg

SEQ ID NO: 1599384 - RNA, 20 nt, Pseudomonas putida KT2440
ucggcgucaacgguaacguu

SEQ ID NO: 1599385 - RNA, 14 nt, Pseudomonas putida KT2440
ucggcgugcggcug

SEQ ID NO: 1599386 - RNA, 23 nt, Pseudomonas putida KT2440
ucggcgguugcaccguggcagca

SEQ ID NO: 1599387 - RNA, 15 nt, Pseudomonas putida KT2440
ucggcucuccuuuuu

SEQ ID NO: 1599388 - RNA, 19 nt, Pseudomonas putida KT2440
ucggcuugaaaucauccau

SEQ ID NO: 1599389 - RNA, 15 nt, Pseudomonas putida KT2440
ucgcuuuugcuugca

SEQ ID NO: 1599390 - RNA, 17 nt, Pseudomonas putida KT2440
ucggagcgggcuugccc

SEQ ID NO: 1599391 - RNA, 13 nt, Pseudomonas putida KT2440
ucgcgcagcagcu

SEQ ID NO: 1599392 - RNA, 22 nt, Pseudomonas putida KT2440
ucgcgcaggaaccgcgucacau

SEQ ID NO: 1599393 - RNA, 23 nt, Pseudomonas putida KT2440
ucgcgcagggcgcgaaaagccug

SEQ ID NO: 1599394 - RNA, 19 nt, Pseudomonas putida KT2440
ucgcugcgcaucacccgcc

SEQ ID NO: 1599395 - RNA, 13 nt, Pseudomonas putida KT2440
ucgcugcugugcg

SEQ ID NO: 1599396 - RNA, 18 nt, Pseudomonas putida KT2440
ucgcuguaaccugguugu

SEQ ID NO: 1599397 - RNA, 16 nt, Pseudomonas putida KT2440
ucgcuguugcgcaccu

SEQ ID NO: 1599398 - RNA, 14 nt, Pseudomonas putida KT2440
ucggccgcauccau

SEQ ID NO: 1599399 - RNA, 16 nt, Pseudomonas putida KT2440
ucggccgcauccugcg

SEQ ID NO: 1599400 - RNA, 19 nt, Pseudomonas putida KT2440
ucggccggcggauagcccc

SEQ ID NO: 1599401 - RNA, 14 nt, Pseudomonas putida KT2440
ucggccugcgcucc

SEQ ID NO: 1599402 - RNA, 18 nt, Pseudomonas putida KT2440
ucggccugcgcuccagca

SEQ ID NO: 1599403 - RNA, 21 nt, Pseudomonas putida KT2440
ucggccugcgcuccagcagcu

SEQ ID NO: 1599404 - RNA, 22 nt, Pseudomonas putida KT2440
ucggccugcucgcuggcuuguu

SEQ ID NO: 1599405 - RNA, 13 nt, Pseudomonas putida KT2440
ucggccuuguccg

SEQ ID NO: 1599406 - RNA, 15 nt, Pseudomonas putida KT2440
ucggccuuguucaac

SEQ ID NO: 1599407 - RNA, 17 nt, Pseudomonas putida KT2440
ucggcgaaggcuggccu

SEQ ID NO: 1599408 - RNA, 18 nt, Pseudomonas putida KT2440
ucggccagugcgugcagu

SEQ ID NO: 1599409 - RNA, 16 nt, Pseudomonas putida KT2440
ucggccagcucgccaa

SEQ ID NO: 1599410 - RNA, 20 nt, Pseudomonas putida KT2440
ucggccagcucggcaguggc

SEQ ID NO: 1599411 - RNA, 13 nt, Pseudomonas putida KT2440
ucggccagcugcg

SEQ ID NO: 1599412 - RNA, 22 nt, Pseudomonas putida KT2440
ucggccagcugcgcacgcagga

SEQ ID NO: 1599413 - RNA, 19 nt, Pseudomonas putida KT2440
ucggccagccgccgccgag

SEQ ID NO: 1599414 - RNA, 22 nt, Pseudomonas putida KT2440
ucggccagcaguucgucgagca

SEQ ID NO: 1599415 - RNA, 14 nt, Pseudomonas putida KT2440
ucggcccacugcac

SEQ ID NO: 1599416 - RNA, 17 nt, Pseudomonas putida KT2440
ucggccauuugcucgac

SEQ ID NO: 1599417 - RNA, 16 nt, Pseudomonas putida KT2440
ucggccaucuuuggca

SEQ ID NO: 1599418 - RNA, 16 nt, Pseudomonas putida KT2440
ucggccaugccacccc

SEQ ID NO: 1599419 - RNA, 21 nt, Pseudomonas putida KT2440
ucggaugccacgcugaacacg

SEQ ID NO: 1599420 - RNA, 19 nt, Pseudomonas putida KT2440
ucggcaacauucaccagcc

SEQ ID NO: 1599421 - RNA, 22 nt, Pseudomonas putida KT2440
ucggcaaacagguucucggcac

SEQ ID NO: 1599422 - RNA, 13 nt, Pseudomonas putida KT2440
ucggccaccgccg

SEQ ID NO: 1599423 - RNA, 13 nt, Pseudomonas putida KT2440
ugaaaaacaacaa

SEQ ID NO: 1599424 - RNA, 20 nt, Pseudomonas putida KT2440
ucuuugaacgagguuuugca

SEQ ID NO: 1599425 - RNA, 21 nt, Pseudomonas putida KT2440
ucuuugagggucagcuggccu

SEQ ID NO: 1599426 - RNA, 20 nt, Pseudomonas putida KT2440
ucuuucagcucaaucagcca

SEQ ID NO: 1599427 - RNA, 21 nt, Pseudomonas putida KT2440
ucuuucagcucaaucagccaa

SEQ ID NO: 1599428 - RNA, 16 nt, Pseudomonas putida KT2440
ucuuucggcagcaccc

SEQ ID NO: 1599429 - RNA, 23 nt, Pseudomonas putida KT2440
ucuuucgcguacugcauguacuc

SEQ ID NO: 1599430 - RNA, 12 nt, Pseudomonas putida KT2440
ucuuucucccag

SEQ ID NO: 1599431 - RNA, 21 nt, Pseudomonas putida KT2440
ucuuccauuugcgcuggcugc

SEQ ID NO: 1599432 - RNA, 12 nt, Pseudomonas putida KT2440
ucuucccaccac

SEQ ID NO: 1599433 - RNA, 19 nt, Pseudomonas putida KT2440
ucuucccaccaccagcgcc

SEQ ID NO: 1599434 - RNA, 21 nt, Pseudomonas putida KT2440
ucuuccaguuccauccagucc

SEQ ID NO: 1599435 - RNA, 13 nt, Pseudomonas putida KT2440
ucuuccagcucgc

SEQ ID NO: 1599436 - RNA, 19 nt, Pseudomonas putida KT2440
ucuuccagcucgcuuuccu

SEQ ID NO: 1599437 - RNA, 20 nt, Pseudomonas putida KT2440
ucuuccagcucgcuuuccuu

SEQ ID NO: 1599438 - RNA, 13 nt, Pseudomonas putida KT2440
ucuuccagcucuu

SEQ ID NO: 1599439 - RNA, 21 nt, Pseudomonas putida KT2440
ucuugcuggccgguggcuucg

SEQ ID NO: 1599440 - RNA, 21 nt, Pseudomonas putida KT2440
ucuucccccgggcuuggugau

SEQ ID NO: 1599441 - RNA, 15 nt, Pseudomonas putida KT2440
ucuuccccgcccaag

SEQ ID NO: 1599442 - RNA, 23 nt, Pseudomonas putida KT2440
ucuuccccgcccaagcggcagaa

SEQ ID NO: 1599443 - RNA, 14 nt, Pseudomonas putida KT2440
ucuuggcggcuggg

SEQ ID NO: 1599444 - RNA, 21 nt, Pseudomonas putida KT2440
ucuuguguuuugccuccagcu

SEQ ID NO: 1599445 - RNA, 17 nt, Pseudomonas putida KT2440
ugaaaugguugaagauc

SEQ ID NO: 1599446 - RNA, 21 nt, Pseudomonas putida KT2440
ugaaaugguugaagaucaggu

SEQ ID NO: 1599447 - RNA, 19 nt, Pseudomonas putida KT2440
ugaaauggcggcccagcca

SEQ ID NO: 1599448 - RNA, 13 nt, Pseudomonas putida KT2440
ugaaauucaccug

SEQ ID NO: 1599449 - RNA, 18 nt, Pseudomonas putida KT2440
ugaaauuuuugaaauuuu

SEQ ID NO: 1599450 - RNA, 21 nt, Pseudomonas putida KT2440
ugaacagcagcgccgccaggc

SEQ ID NO: 1599451 - RNA, 20 nt, Pseudomonas putida KT2440
ugaacagcgcugcgaggccc

SEQ ID NO: 1599452 - RNA, 21 nt, Pseudomonas putida KT2440
ugaacagguugcgcgccgcca

SEQ ID NO: 1599453 - RNA, 20 nt, Pseudomonas putida KT2440
ugaacacgcccgcgugcuuc

SEQ ID NO: 1599454 - RNA, 16 nt, Pseudomonas putida KT2440
ugaacacgccgucgac

SEQ ID NO: 1599455 - RNA, 18 nt, Pseudomonas putida KT2440
ugaacacgcucaugaaca

SEQ ID NO: 1599456 - RNA, 19 nt, Pseudomonas putida KT2440
ugaacaccugccagccccg

SEQ ID NO: 1599457 - RNA, 13 nt, Pseudomonas putida KT2440
ugaacacaugcca

SEQ ID NO: 1599458 - RNA, 17 nt, Pseudomonas putida KT2440
ugaacaacggcgcuguc

SEQ ID NO: 1599459 - RNA, 18 nt, Pseudomonas putida KT2440
ugaacaaggccuggccca

SEQ ID NO: 1599460 - RNA, 16 nt, Pseudomonas putida KT2440
ugaacgcagcuuccgc

SEQ ID NO: 1599461 - RNA, 18 nt, Pseudomonas putida KT2440
ugaacgaugcccgggccu

SEQ ID NO: 1599462 - RNA, 13 nt, Pseudomonas putida KT2440
ugaacgaggacug

SEQ ID NO: 1599463 - RNA, 19 nt, Pseudomonas putida KT2440
ugaacccgugcaucugcuc

SEQ ID NO: 1599464 - RNA, 16 nt, Pseudomonas putida KT2440
ugaacccgcuccuaca

SEQ ID NO: 1599465 - RNA, 20 nt, Pseudomonas putida KT2440
ugaacccgcuccuacacagg

SEQ ID NO: 1599466 - RNA, 19 nt, Pseudomonas putida KT2440
ugaaccaugcgccgcugcu

SEQ ID NO: 1599467 - RNA, 22 nt, Pseudomonas putida KT2440
ugaaaacauugcuaauuucagg

SEQ ID NO: 1599468 - RNA, 15 nt, Pseudomonas putida KT2440
ugaaacaucagccgg

SEQ ID NO: 1599469 - RNA, 20 nt, Pseudomonas putida KT2440
ugaaagcguauugccagaag

SEQ ID NO: 1599470 - RNA, 15 nt, Pseudomonas putida KT2440
ugaaagcaggauggu

SEQ ID NO: 1599471 - RNA, 19 nt, Pseudomonas putida KT2440
ugaaagucgaccagcagcu

SEQ ID NO: 1599472 - RNA, 20 nt, Pseudomonas putida KT2440
ugaaacgaguggaucaaccg

SEQ ID NO: 1599473 - RNA, 15 nt, Pseudomonas putida KT2440
ugaaacuuuucauug

SEQ ID NO: 1599474 - RNA, 19 nt, Pseudomonas putida KT2440
ucuucaucccuguacagau

SEQ ID NO: 1599475 - RNA, 17 nt, Pseudomonas putida KT2440
ucuuccacgcccaggcg

SEQ ID NO: 1599476 - RNA, 23 nt, Pseudomonas putida KT2440
ucuucagccaccgcacucugcug

SEQ ID NO: 1599477 - RNA, 22 nt, Pseudomonas putida KT2440
ucuucacaccggccuuggccag

SEQ ID NO: 1599478 - RNA, 13 nt, Pseudomonas putida KT2440
ucuuaugccuggg

SEQ ID NO: 1599479 - RNA, 13 nt, Pseudomonas putida KT2440
ucuguguucuuca

SEQ ID NO: 1599480 - RNA, 20 nt, Pseudomonas putida KT2440
ucugcucgccaucuggcguu

SEQ ID NO: 1599481 - RNA, 14 nt, Pseudomonas putida KT2440
ucugcguggcaguu

SEQ ID NO: 1599482 - RNA, 21 nt, Pseudomonas putida KT2440
ucugcugcggauacagcgccc

SEQ ID NO: 1599483 - RNA, 17 nt, Pseudomonas putida KT2440
ucugcuggauacccagc

SEQ ID NO: 1599484 - RNA, 13 nt, Pseudomonas putida KT2440
ucugcagcagcau

SEQ ID NO: 1599485 - RNA, 16 nt, Pseudomonas putida KT2440
ucugcagccaccacgu

SEQ ID NO: 1599486 - RNA, 12 nt, Pseudomonas putida KT2440
ucugcagccuga

SEQ ID NO: 1599487 - RNA, 23 nt, Pseudomonas putida KT2440
ucugcagccugacgcgccgccaa

SEQ ID NO: 1599488 - RNA, 15 nt, Pseudomonas putida KT2440
ucugcagcaccgacu

SEQ ID NO: 1599489 - RNA, 17 nt, Pseudomonas putida KT2440
ucugcacagcgcggaac

SEQ ID NO: 1599490 - RNA, 15 nt, Pseudomonas putida KT2440
ucugcaagcgcagcc

SEQ ID NO: 1599491 - RNA, 15 nt, Pseudomonas putida KT2440
ucugcaaugccgcca

SEQ ID NO: 1599492 - RNA, 14 nt, Pseudomonas putida KT2440
ucugcacucccgcu

SEQ ID NO: 1599493 - RNA, 18 nt, Pseudomonas putida KT2440
ucugcacucccgcugcug

SEQ ID NO: 1599494 - RNA, 14 nt, Pseudomonas putida KT2440
ucugcaccuugccc

SEQ ID NO: 1599495 - RNA, 14 nt, Pseudomonas putida KT2440
ucugcacgcgugcc

SEQ ID NO: 1599496 - RNA, 21 nt, Pseudomonas putida KT2440
ucugcacgcgugccugguugc

SEQ ID NO: 1599497 - RNA, 13 nt, Pseudomonas putida KT2440
ucuggcgcguguc

SEQ ID NO: 1599498 - RNA, 18 nt, Pseudomonas putida KT2440
ucuggcugaggaacaacu

SEQ ID NO: 1599499 - RNA, 20 nt, Pseudomonas putida KT2440
ucuggcugcaagguccaggc

SEQ ID NO: 1599500 - RNA, 19 nt, Pseudomonas putida KT2440
ucugguugccgccagcccc

SEQ ID NO: 1599501 - RNA, 17 nt, Pseudomonas putida KT2440
ucugguugcuggcgcca

SEQ ID NO: 1599502 - RNA, 20 nt, Pseudomonas putida KT2440
ucugguugcuggcgccagcg

SEQ ID NO: 1599503 - RNA, 22 nt, Pseudomonas putida KT2440
ucugguuacccaacagaccacc

SEQ ID NO: 1599504 - RNA, 20 nt, Pseudomonas putida KT2440
ucuguccagauuacaaaagc

SEQ ID NO: 1599505 - RNA, 16 nt, Pseudomonas putida KT2440
ucuguccccccagggc

SEQ ID NO: 1599506 - RNA, 13 nt, Pseudomonas putida KT2440
ucuguacaguggc

SEQ ID NO: 1599507 - RNA, 20 nt, Pseudomonas putida KT2440
ucuguaagugaugaucacau

SEQ ID NO: 1599508 - RNA, 15 nt, Pseudomonas putida KT2440
ucuccagcuccuggc

SEQ ID NO: 1599509 - RNA, 17 nt, Pseudomonas putida KT2440
ucuccagcucgccauuc

SEQ ID NO: 1599510 - RNA, 22 nt, Pseudomonas putida KT2440
ucuccagcaacaacgccuuggc

SEQ ID NO: 1599511 - RNA, 14 nt, Pseudomonas putida KT2440
ucuccagcagugcc

SEQ ID NO: 1599512 - RNA, 23 nt, Pseudomonas putida KT2440
ucuccaggugcaccaacacuucc

SEQ ID NO: 1599513 - RNA, 20 nt, Pseudomonas putida KT2440
ucuccagguucucgcuccag

SEQ ID NO: 1599514 - RNA, 19 nt, Pseudomonas putida KT2440
ucuccagcaccgccccggc

SEQ ID NO: 1599515 - RNA, 16 nt, Pseudomonas putida KT2440
ucuccagccgcugcug

SEQ ID NO: 1599516 - RNA, 16 nt, Pseudomonas putida KT2440
ucuccagcgaugaccc

SEQ ID NO: 1599517 - RNA, 14 nt, Pseudomonas putida KT2440
ucuccucggccagc

SEQ ID NO: 1599518 - RNA, 17 nt, Pseudomonas putida KT2440
ucuccgggcgcccuggc

SEQ ID NO: 1599519 - RNA, 21 nt, Pseudomonas putida KT2440
ucuccgggaagguuuccagcc

SEQ ID NO: 1599520 - RNA, 18 nt, Pseudomonas putida KT2440
ucuccggcgaaauaccca

SEQ ID NO: 1599521 - RNA, 12 nt, Pseudomonas putida KT2440
ucuccccuuccc

SEQ ID NO: 1599522 - RNA, 14 nt, Pseudomonas putida KT2440
ucucgcugucgucc

SEQ ID NO: 1599523 - RNA, 19 nt, Pseudomonas putida KT2440
ucucgcugucguccagcuc

SEQ ID NO: 1599524 - RNA, 21 nt, Pseudomonas putida KT2440
ucucgcacuugaucuugcgcc

SEQ ID NO: 1599525 - RNA, 24 nt, Pseudomonas putida KT2440
ucucgcacuugaucuugcgcccca

SEQ ID NO: 1599526 - RNA, 12 nt, Pseudomonas putida KT2440
ucucggccggag

SEQ ID NO: 1599527 - RNA, 15 nt, Pseudomonas putida KT2440
ucucuacgcccaugg

SEQ ID NO: 1599528 - RNA, 18 nt, Pseudomonas putida KT2440
ucucuucggccaguuuca

SEQ ID NO: 1599529 - RNA, 13 nt, Pseudomonas putida KT2440
ucucuuccggcag

SEQ ID NO: 1599530 - RNA, 17 nt, Pseudomonas putida KT2440
ucucugccgagaggauc

SEQ ID NO: 1599531 - RNA, 20 nt, Pseudomonas putida KT2440
ucugcaacuccucgaucacc

SEQ ID NO: 1599532 - RNA, 15 nt, Pseudomonas putida KT2440
ucugcaacagcucca

SEQ ID NO: 1599533 - RNA, 13 nt, Pseudomonas putida KT2440
ucugagccagccg

SEQ ID NO: 1599534 - RNA, 14 nt, Pseudomonas putida KT2440
gguguucgcgggcg

SEQ ID NO: 1599535 - RNA, 16 nt, Pseudomonas putida KT2440
gguguucgcgggcgcg

SEQ ID NO: 1599536 - RNA, 18 nt, Pseudomonas putida KT2440
ggugucaccgcgagcagc

SEQ ID NO: 1599537 - RNA, 12 nt, Pseudomonas putida KT2440
gguguggcagcu

SEQ ID NO: 1599538 - RNA, 16 nt, Pseudomonas putida KT2440
gguguggcagcucugc

SEQ ID NO: 1599539 - RNA, 14 nt, Pseudomonas putida KT2440
ggugugguagcugu

SEQ ID NO: 1599540 - RNA, 13 nt, Pseudomonas putida KT2440
gguguagcgcagu

SEQ ID NO: 1599541 - RNA, 18 nt, Pseudomonas putida KT2440
gguguagaacggcagcag

SEQ ID NO: 1599542 - RNA, 14 nt, Pseudomonas putida KT2440
gguggccugagccg

SEQ ID NO: 1599543 - RNA, 14 nt, Pseudomonas putida KT2440
ggugguuuugcgug

SEQ ID NO: 1599544 - RNA, 19 nt, Pseudomonas putida KT2440
ggugguuuauccggcacag

SEQ ID NO: 1599545 - RNA, 19 nt, Pseudomonas putida KT2440
ggugguaauuggccggcag

SEQ ID NO: 1599546 - RNA, 15 nt, Pseudomonas putida KT2440
ggugcuggcucgcug

SEQ ID NO: 1599547 - RNA, 16 nt, Pseudomonas putida KT2440
ggugcccacugcagcc

SEQ ID NO: 1599548 - RNA, 18 nt, Pseudomonas putida KT2440
ggugccauccaccgcgcc

SEQ ID NO: 1599549 - RNA, 18 nt, Pseudomonas putida KT2440
gguggccgcgcgggugcg

SEQ ID NO: 1599550 - RNA, 14 nt, Pseudomonas putida KT2440
gguggccggcacug

SEQ ID NO: 1599551 - RNA, 21 nt, Pseudomonas putida KT2440
gguggcccugaccgcggugcu

SEQ ID NO: 1599552 - RNA, 15 nt, Pseudomonas putida KT2440
gguggcagaacaucg

SEQ ID NO: 1599553 - RNA, 14 nt, Pseudomonas putida KT2440
gguggcaugcucca

SEQ ID NO: 1599554 - RNA, 16 nt, Pseudomonas putida KT2440
gguuauacgccgccga

SEQ ID NO: 1599555 - RNA, 19 nt, Pseudomonas putida KT2440
gguuacggcggccugcugc

SEQ ID NO: 1599556 - RNA, 13 nt, Pseudomonas putida KT2440
gguguuggcggug

SEQ ID NO: 1599557 - RNA, 18 nt, Pseudomonas putida KT2440
gguucagguacagcagcu

SEQ ID NO: 1599558 - RNA, 16 nt, Pseudomonas putida KT2440
gguucaagggcagggu

SEQ ID NO: 1599559 - RNA, 23 nt, Pseudomonas putida KT2440
gguucacccgcgaagcaggcgac

SEQ ID NO: 1599560 - RNA, 13 nt, Pseudomonas putida KT2440
gguuccagcgcac

SEQ ID NO: 1599561 - RNA, 20 nt, Pseudomonas putida KT2440
gguucgaaucgcucaugccc

SEQ ID NO: 1599562 - RNA, 12 nt, Pseudomonas putida KT2440
gguucgauccac

SEQ ID NO: 1599563 - RNA, 14 nt, Pseudomonas putida KT2440
gguucgacugccgc

SEQ ID NO: 1599564 - RNA, 17 nt, Pseudomonas putida KT2440
gguuguggcuuggccca

SEQ ID NO: 1599565 - RNA, 17 nt, Pseudomonas putida KT2440
gguugccgccagccccg

SEQ ID NO: 1599566 - RNA, 22 nt, Pseudomonas putida KT2440
gguugcucaggcgcuccagcag

SEQ ID NO: 1599567 - RNA, 21 nt, Pseudomonas putida KT2440
gguuggcaaacucgucgcugg

SEQ ID NO: 1599568 - RNA, 23 nt, Pseudomonas putida KT2440
gguugagcacacgguaguccugc

SEQ ID NO: 1599569 - RNA, 18 nt, Pseudomonas putida KT2440
gguugcaauaccgugcuu

SEQ ID NO: 1599570 - RNA, 19 nt, Pseudomonas putida KT2440
gguugaccacgaugcccau

SEQ ID NO: 1599571 - RNA, 19 nt, Pseudomonas putida KT2440
gguucuccugugccggccu

SEQ ID NO: 1599572 - RNA, 13 nt, Pseudomonas putida KT2440
gguucguccccuu

SEQ ID NO: 1599573 - RNA, 21 nt, Pseudomonas putida KT2440
gguucgucucgcugucgucga

SEQ ID NO: 1599574 - RNA, 15 nt, Pseudomonas putida KT2440
gguucugccggggca

SEQ ID NO: 1599575 - RNA, 19 nt, Pseudomonas putida KT2440
gguucuugccgagcagcgc

SEQ ID NO: 1599576 - RNA, 21 nt, Pseudomonas putida KT2440
gguucgcccgguuccagcgca

SEQ ID NO: 1599577 - RNA, 15 nt, Pseudomonas putida KT2440
gguuuuggcaggccg

SEQ ID NO: 1599578 - RNA, 20 nt, Pseudomonas putida KT2440
gguuuuuuauugccugccag

SEQ ID NO: 1599579 - RNA, 16 nt, Pseudomonas putida KT2440
guaaaaaucaugcagu

SEQ ID NO: 1599580 - RNA, 17 nt, Pseudomonas putida KT2440
guaaaaaucaugcaguu

SEQ ID NO: 1599581 - RNA, 17 nt, Pseudomonas putida KT2440
gguuucccgaugaagaa

SEQ ID NO: 1599582 - RNA, 14 nt, Pseudomonas putida KT2440
gguuugaagcccgg

SEQ ID NO: 1599583 - RNA, 13 nt, Pseudomonas putida KT2440
gguuugacgcugc

SEQ ID NO: 1599584 - RNA, 18 nt, Pseudomonas putida KT2440
gguuuggcagcaccgggc

SEQ ID NO: 1599585 - RNA, 19 nt, Pseudomonas putida KT2440
gguuuguggguacugcuuc

SEQ ID NO: 1599586 - RNA, 23 nt, Pseudomonas putida KT2440
gguccggcaucacuacccaggcc

SEQ ID NO: 1599587 - RNA, 19 nt, Pseudomonas putida KT2440
gguccucgaaacgcaggcu

SEQ ID NO: 1599588 - RNA, 15 nt, Pseudomonas putida KT2440
gguccugcaauugca

SEQ ID NO: 1599589 - RNA, 12 nt, Pseudomonas putida KT2440
ggucgcggcggc

SEQ ID NO: 1599590 - RNA, 21 nt, Pseudomonas putida KT2440
ggucgcugccgugcaggucag

SEQ ID NO: 1599591 - RNA, 13 nt, Pseudomonas putida KT2440
ggucggcggggcc

SEQ ID NO: 1599592 - RNA, 17 nt, Pseudomonas putida KT2440
ggucgggaacagcucug

SEQ ID NO: 1599593 - RNA, 19 nt, Pseudomonas putida KT2440
ggucgggaauugcagcccg

SEQ ID NO: 1599594 - RNA, 18 nt, Pseudomonas putida KT2440
ggucgcguucuuucuccc

SEQ ID NO: 1599595 - RNA, 17 nt, Pseudomonas putida KT2440
ggucgcgucgcccagac

SEQ ID NO: 1599596 - RNA, 21 nt, Pseudomonas putida KT2440
ggucggugauauagcaccggu

SEQ ID NO: 1599597 - RNA, 22 nt, Pseudomonas putida KT2440
ggucgggucgcugccgugcagg

SEQ ID NO: 1599598 - RNA, 21 nt, Pseudomonas putida KT2440
ggucucgaucuaugcccggcu

SEQ ID NO: 1599599 - RNA, 14 nt, Pseudomonas putida KT2440
ggucuccgugcuca

SEQ ID NO: 1599600 - RNA, 16 nt, Pseudomonas putida KT2440
ggucucgaacgcugug

SEQ ID NO: 1599601 - RNA, 19 nt, Pseudomonas putida KT2440
ggucucgaacgcugugccg

SEQ ID NO: 1599602 - RNA, 22 nt, Pseudomonas putida KT2440
ggucucccagcgcuguccccca

SEQ ID NO: 1599603 - RNA, 17 nt, Pseudomonas putida KT2440
ggugaccagcggcagca

SEQ ID NO: 1599604 - RNA, 18 nt, Pseudomonas putida KT2440
ggugaccagcggcagcaa

SEQ ID NO: 1599605 - RNA, 15 nt, Pseudomonas putida KT2440
ggucugcugcggccg

SEQ ID NO: 1599606 - RNA, 17 nt, Pseudomonas putida KT2440
ggucugcccggccagca

SEQ ID NO: 1599607 - RNA, 16 nt, Pseudomonas putida KT2440
ggugacaacgcccgcc

SEQ ID NO: 1599608 - RNA, 15 nt, Pseudomonas putida KT2440
ggugaaucagcccca

SEQ ID NO: 1599609 - RNA, 18 nt, Pseudomonas putida KT2440
ggugaaucagcggcaggc

SEQ ID NO: 1599610 - RNA, 15 nt, Pseudomonas putida KT2440
ggugccauagcacca

SEQ ID NO: 1599611 - RNA, 18 nt, Pseudomonas putida KT2440
ggugccaucaccgcccgc

SEQ ID NO: 1599612 - RNA, 20 nt, Pseudomonas putida KT2440
ggugccaucaccgcccgcgc

SEQ ID NO: 1599613 - RNA, 11 nt, Pseudomonas putida KT2440
ggugccaggcu

SEQ ID NO: 1599614 - RNA, 15 nt, Pseudomonas putida KT2440
ggugccaggcucagg

SEQ ID NO: 1599615 - RNA, 17 nt, Pseudomonas putida KT2440
ggugccaggcucaggcc

SEQ ID NO: 1599616 - RNA, 15 nt, Pseudomonas putida KT2440
ggugccaacaggcag

SEQ ID NO: 1599617 - RNA, 16 nt, Pseudomonas putida KT2440
ggugccaacaggcagc

SEQ ID NO: 1599618 - RNA, 17 nt, Pseudomonas putida KT2440
ggugccaacaggcagca

SEQ ID NO: 1599619 - RNA, 18 nt, Pseudomonas putida KT2440
ggugccaacaggcagcau

SEQ ID NO: 1599620 - RNA, 23 nt, Pseudomonas putida KT2440
ggugcagguugauccagcccuuc

SEQ ID NO: 1599621 - RNA, 18 nt, Pseudomonas putida KT2440
ggugcaaaaccugccggu

SEQ ID NO: 1599622 - RNA, 14 nt, Pseudomonas putida KT2440
ggucauacauccag

SEQ ID NO: 1599623 - RNA, 19 nt, Pseudomonas putida KT2440
ggucaucagauggcccggu

SEQ ID NO: 1599624 - RNA, 22 nt, Pseudomonas putida KT2440
ggucaugccauccucggccagg

SEQ ID NO: 1599625 - RNA, 15 nt, Pseudomonas putida KT2440
ggucauccaggaaaa

SEQ ID NO: 1599626 - RNA, 13 nt, Pseudomonas putida KT2440
ggucacucccggg

SEQ ID NO: 1599627 - RNA, 16 nt, Pseudomonas putida KT2440
ggucacuucagugcug

SEQ ID NO: 1599628 - RNA, 17 nt, Pseudomonas putida KT2440
ggucacugcgcggccgg

SEQ ID NO: 1599629 - RNA, 17 nt, Pseudomonas putida KT2440
ggucagcaagccgccga

SEQ ID NO: 1599630 - RNA, 15 nt, Pseudomonas putida KT2440
ggucagcaguggcuc

SEQ ID NO: 1599631 - RNA, 16 nt, Pseudomonas putida KT2440
ggucaguucagccagg

SEQ ID NO: 1599632 - RNA, 20 nt, Pseudomonas putida KT2440
ggucagcagcaccgccacca

SEQ ID NO: 1599633 - RNA, 17 nt, Pseudomonas putida KT2440
ggucagcaccagcucau

SEQ ID NO: 1599634 - RNA, 23 nt, Pseudomonas putida KT2440
gguccauccccgcacgcgguggg

SEQ ID NO: 1599635 - RNA, 24 nt, Pseudomonas putida KT2440
gguccccauagcuuuccagcaugu

SEQ ID NO: 1599636 - RNA, 20 nt, Pseudomonas putida KT2440
ggucccaauaauaaaaaaag

SEQ ID NO: 1599637 - RNA, 18 nt, Pseudomonas putida KT2440
gguccauguaggagcggg

SEQ ID NO: 1599638 - RNA, 14 nt, Pseudomonas putida KT2440
ggucccgcccucca

SEQ ID NO: 1599639 - RNA, 12 nt, Pseudomonas putida KT2440
gguccaggcaca

SEQ ID NO: 1599640 - RNA, 14 nt, Pseudomonas putida KT2440
gguccaggccagcu

SEQ ID NO: 1599641 - RNA, 15 nt, Pseudomonas putida KT2440
gguccaggccagcuu

SEQ ID NO: 1599642 - RNA, 12 nt, Pseudomonas putida KT2440
gguccagcucug

SEQ ID NO: 1599643 - RNA, 15 nt, Pseudomonas putida KT2440
gguccacccacccuc

SEQ ID NO: 1599644 - RNA, 21 nt, Pseudomonas putida KT2440
gguccaccgccagugcgguga

SEQ ID NO: 1599645 - RNA, 22 nt, Pseudomonas putida KT2440
ggucauggcgcgccaugccccu

SEQ ID NO: 1599646 - RNA, 23 nt, Pseudomonas putida KT2440
ggguguugcuugucccaggccau

SEQ ID NO: 1599647 - RNA, 20 nt, Pseudomonas putida KT2440
ggguguuggacacaggccgu

SEQ ID NO: 1599648 - RNA, 21 nt, Pseudomonas putida KT2440
ggguggucgcugcggcacacc

SEQ ID NO: 1599649 - RNA, 22 nt, Pseudomonas putida KT2440
gguauaggccccgaaugcacgg

SEQ ID NO: 1599650 - RNA, 23 nt, Pseudomonas putida KT2440
gguauagguccagcucuggucac

SEQ ID NO: 1599651 - RNA, 17 nt, Pseudomonas putida KT2440
gguagcgucgcgcgccc

SEQ ID NO: 1599652 - RNA, 22 nt, Pseudomonas putida KT2440
gguagcgucaacugccaggcug

SEQ ID NO: 1599653 - RNA, 12 nt, Pseudomonas putida KT2440
gguagcggcggc

SEQ ID NO: 1599654 - RNA, 15 nt, Pseudomonas putida KT2440
gguagcggcugggcg

SEQ ID NO: 1599655 - RNA, 12 nt, Pseudomonas putida KT2440
gguagcggggcc

SEQ ID NO: 1599656 - RNA, 14 nt, Pseudomonas putida KT2440
gguagcggcagcaa

SEQ ID NO: 1599657 - RNA, 14 nt, Pseudomonas putida KT2440
gguagcggccagcc

SEQ ID NO: 1599658 - RNA, 16 nt, Pseudomonas putida KT2440
gguagccuuccagcuc

SEQ ID NO: 1599659 - RNA, 23 nt, Pseudomonas putida KT2440
gguagccacgugaauaugcucuu

SEQ ID NO: 1599660 - RNA, 15 nt, Pseudomonas putida KT2440
ggucacguagaacag

SEQ ID NO: 1599661 - RNA, 18 nt, Pseudomonas putida KT2440
ggucaauuggagcggccu

SEQ ID NO: 1599662 - RNA, 22 nt, Pseudomonas putida KT2440
ggucaaucugugaggccagcgg

SEQ ID NO: 1599663 - RNA, 21 nt, Pseudomonas putida KT2440
ggucaacggcaacgccagcaa

SEQ ID NO: 1599664 - RNA, 22 nt, Pseudomonas putida KT2440
ggucaagcucguccugcagggc

SEQ ID NO: 1599665 - RNA, 16 nt, Pseudomonas putida KT2440
ggucaaggccagcgcc

SEQ ID NO: 1599666 - RNA, 21 nt, Pseudomonas putida KT2440
ggucaagacgaagcgcuuggu

SEQ ID NO: 1599667 - RNA, 14 nt, Pseudomonas putida KT2440
ggggccggcacagg

SEQ ID NO: 1599668 - RNA, 14 nt, Pseudomonas putida KT2440
ggggcccggacagg

SEQ ID NO: 1599669 - RNA, 16 nt, Pseudomonas putida KT2440
ggggccaaguggcugg

SEQ ID NO: 1599670 - RNA, 24 nt, Pseudomonas putida KT2440
ggggcaaacuucucgaugaagucg

SEQ ID NO: 1599671 - RNA, 15 nt, Pseudomonas putida KT2440
ggggcaacugcgcga

SEQ ID NO: 1599672 - RNA, 13 nt, Pseudomonas putida KT2440
ggggaucuugcug

SEQ ID NO: 1599673 - RNA, 20 nt, Pseudomonas putida KT2440
ggggaucuugcuggccggug

SEQ ID NO: 1599674 - RNA, 23 nt, Pseudomonas putida KT2440
gggcuugcccgcgaaugggcugc

SEQ ID NO: 1599675 - RNA, 24 nt, Pseudomonas putida KT2440
gggcuucaugcacaacgcgcgggc

SEQ ID NO: 1599676 - RNA, 21 nt, Pseudomonas putida KT2440
gggcuucaugcugcugcagca

SEQ ID NO: 1599677 - RNA, 17 nt, Pseudomonas putida KT2440
gggcuguuccagcagcg

SEQ ID NO: 1599678 - RNA, 20 nt, Pseudomonas putida KT2440
gggcggaucugagcagcaga

SEQ ID NO: 1599679 - RNA, 22 nt, Pseudomonas putida KT2440
gggcggaucugagcagcagaga

SEQ ID NO: 1599680 - RNA, 17 nt, Pseudomonas putida KT2440
gggcgcuuugcaccccu

SEQ ID NO: 1599681 - RNA, 22 nt, Pseudomonas putida KT2440
gggcgcuggaagugcugagagg

SEQ ID NO: 1599682 - RNA, 14 nt, Pseudomonas putida KT2440
gggccgugcaggcg

SEQ ID NO: 1599683 - RNA, 15 nt, Pseudomonas putida KT2440
gggccgugcaggcgg

SEQ ID NO: 1599684 - RNA, 20 nt, Pseudomonas putida KT2440
gggcuacaugaaccacacac

SEQ ID NO: 1599685 - RNA, 14 nt, Pseudomonas putida KT2440
gggcuagaugcugg

SEQ ID NO: 1599686 - RNA, 18 nt, Pseudomonas putida KT2440
gggcucaacgccagggca

SEQ ID NO: 1599687 - RNA, 12 nt, Pseudomonas putida KT2440
gggcucagccgc

SEQ ID NO: 1599688 - RNA, 17 nt, Pseudomonas putida KT2440
gggcucuucgcggguga

SEQ ID NO: 1599689 - RNA, 18 nt, Pseudomonas putida KT2440
gggcggguugcacagggu

SEQ ID NO: 1599690 - RNA, 21 nt, Pseudomonas putida KT2440
gggcguuuuuugugccuggcg

SEQ ID NO: 1599691 - RNA, 21 nt, Pseudomonas putida KT2440
gggcggcgugaccagcccggc

SEQ ID NO: 1599692 - RNA, 13 nt, Pseudomonas putida KT2440
ggggugguuggca

SEQ ID NO: 1599693 - RNA, 15 nt, Pseudomonas putida KT2440
ggguacagucuccua

SEQ ID NO: 1599694 - RNA, 20 nt, Pseudomonas putida KT2440
gggucagcgcugacucagcg

SEQ ID NO: 1599695 - RNA, 17 nt, Pseudomonas putida KT2440
gggucagcagcaccgcc

SEQ ID NO: 1599696 - RNA, 17 nt, Pseudomonas putida KT2440
gggucagcuccucugcc

SEQ ID NO: 1599697 - RNA, 15 nt, Pseudomonas putida KT2440
gggugcaucggcacc

SEQ ID NO: 1599698 - RNA, 21 nt, Pseudomonas putida KT2440
gggugccgcggauguggugga

SEQ ID NO: 1599699 - RNA, 17 nt, Pseudomonas putida KT2440
ggguggcgcggugcggc

SEQ ID NO: 1599700 - RNA, 19 nt, Pseudomonas putida KT2440
gggugccggccagcggcau

SEQ ID NO: 1599701 - RNA, 15 nt, Pseudomonas putida KT2440
gggugauugcaguca

SEQ ID NO: 1599702 - RNA, 17 nt, Pseudomonas putida KT2440
gggugaugcgcuugcca

SEQ ID NO: 1599703 - RNA, 16 nt, Pseudomonas putida KT2440
gggucggcgccaggcc

SEQ ID NO: 1599704 - RNA, 13 nt, Pseudomonas putida KT2440
gggucggccugcu

SEQ ID NO: 1599705 - RNA, 17 nt, Pseudomonas putida KT2440
gggucggcgggcggauc

SEQ ID NO: 1599706 - RNA, 12 nt, Pseudomonas putida KT2440
ggggcgcccggc

SEQ ID NO: 1599707 - RNA, 16 nt, Pseudomonas putida KT2440
ggggcgugcucggcau

SEQ ID NO: 1599708 - RNA, 19 nt, Pseudomonas putida KT2440
ggggcugcaaggcagcccc

SEQ ID NO: 1599709 - RNA, 20 nt, Pseudomonas putida KT2440
ggggcugcauugcagcccca

SEQ ID NO: 1599710 - RNA, 22 nt, Pseudomonas putida KT2440
ggggcugcuuugcagcccuucg

SEQ ID NO: 1599711 - RNA, 22 nt, Pseudomonas putida KT2440
ggggcugccuugcagccccugc

SEQ ID NO: 1599712 - RNA, 19 nt, Pseudomonas putida KT2440
ggggcugcugcgcagcccc

SEQ ID NO: 1599713 - RNA, 15 nt, Pseudomonas putida KT2440
ggggcucagcccgcc

SEQ ID NO: 1599714 - RNA, 14 nt, Pseudomonas putida KT2440
gggggagcgggcga

SEQ ID NO: 1599715 - RNA, 18 nt, Pseudomonas putida KT2440
ggggucuuuucgccacug

SEQ ID NO: 1599716 - RNA, 20 nt, Pseudomonas putida KT2440
ggggucugcccggccagcag

SEQ ID NO: 1599717 - RNA, 16 nt, Pseudomonas putida KT2440
ggggugauugcaguca

SEQ ID NO: 1599718 - RNA, 16 nt, Pseudomonas putida KT2440
ggggugcugagcuuga

SEQ ID NO: 1599719 - RNA, 18 nt, Pseudomonas putida KT2440
ggggugccuucgagcaug

SEQ ID NO: 1599720 - RNA, 16 nt, Pseudomonas putida KT2440
gggggauuugaggaag

SEQ ID NO: 1599721 - RNA, 17 nt, Pseudomonas putida KT2440
gggauguugugggcaau

SEQ ID NO: 1599722 - RNA, 14 nt, Pseudomonas putida KT2440
gggauuuggggcgc

SEQ ID NO: 1599723 - RNA, 20 nt, Pseudomonas putida KT2440
gggauuuggggcgcccggca

SEQ ID NO: 1599724 - RNA, 19 nt, Pseudomonas putida KT2440
gggagaguccugcgcgcuu

SEQ ID NO: 1599725 - RNA, 20 nt, Pseudomonas putida KT2440
gggagcaggcaugcccgcuc

SEQ ID NO: 1599726 - RNA, 16 nt, Pseudomonas putida KT2440
gggaucagcacgccca

SEQ ID NO: 1599727 - RNA, 17 nt, Pseudomonas putida KT2440
gggaucagcacgcccau

SEQ ID NO: 1599728 - RNA, 19 nt, Pseudomonas putida KT2440
gggaucaccgcaagcugca

SEQ ID NO: 1599729 - RNA, 18 nt, Pseudomonas putida KT2440
gggaucaccgccagcagc

SEQ ID NO: 1599730 - RNA, 21 nt, Pseudomonas putida KT2440
gggaucaccucguaaggccug

SEQ ID NO: 1599731 - RNA, 23 nt, Pseudomonas putida KT2440
gggaucaccucguaaggccugag

SEQ ID NO: 1599732 - RNA, 21 nt, Pseudomonas putida KT2440
gggcacuggcugauagccgcc

SEQ ID NO: 1599733 - RNA, 12 nt, Pseudomonas putida KT2440
gggcagaugagg

SEQ ID NO: 1599734 - RNA, 23 nt, Pseudomonas putida KT2440
gggcagcaucaccacgcccuggc

SEQ ID NO: 1599735 - RNA, 15 nt, Pseudomonas putida KT2440
gggcaaacuggcgcc

SEQ ID NO: 1599736 - RNA, 21 nt, Pseudomonas putida KT2440
gggcaaaaucgaccagggccu

SEQ ID NO: 1599737 - RNA, 12 nt, Pseudomonas putida KT2440
gggcaaccuggg

SEQ ID NO: 1599738 - RNA, 15 nt, Pseudomonas putida KT2440
gggcaaccugggugu

SEQ ID NO: 1599739 - RNA, 16 nt, Pseudomonas putida KT2440
gggcaaugaguccggu

SEQ ID NO: 1599740 - RNA, 14 nt, Pseudomonas putida KT2440
gggcacgggcagcg

SEQ ID NO: 1599741 - RNA, 12 nt, Pseudomonas putida KT2440
gggcaaggcugg

SEQ ID NO: 1599742 - RNA, 14 nt, Pseudomonas putida KT2440
gggcaagcccgcuc

SEQ ID NO: 1599743 - RNA, 20 nt, Pseudomonas putida KT2440
gggcaagcccgcucccacag

SEQ ID NO: 1599744 - RNA, 20 nt, Pseudomonas putida KT2440
gggcaagggccugcaggcag

SEQ ID NO: 1599745 - RNA, 21 nt, Pseudomonas putida KT2440
gggccgcaaagcggccccagu

SEQ ID NO: 1599746 - RNA, 21 nt, Pseudomonas putida KT2440
gggccgcaacgcggccccggc

SEQ ID NO: 1599747 - RNA, 18 nt, Pseudomonas putida KT2440
gggccgcaacgcggcccu

SEQ ID NO: 1599748 - RNA, 12 nt, Pseudomonas putida KT2440
gggccgcgcagc

SEQ ID NO: 1599749 - RNA, 13 nt, Pseudomonas putida KT2440
gggccgcgcaggc

SEQ ID NO: 1599750 - RNA, 15 nt, Pseudomonas putida KT2440
gggccgcgcaggcgg

SEQ ID NO: 1599751 - RNA, 16 nt, Pseudomonas putida KT2440
gggccgcgacgcggcc

SEQ ID NO: 1599752 - RNA, 17 nt, Pseudomonas putida KT2440
gggccaguccaggccaa

SEQ ID NO: 1599753 - RNA, 13 nt, Pseudomonas putida KT2440
gggcccagccacc

SEQ ID NO: 1599754 - RNA, 13 nt, Pseudomonas putida KT2440
gggcccuguggga

SEQ ID NO: 1599755 - RNA, 22 nt, Pseudomonas putida KT2440
ggcuucuucgugcgccucaugc

SEQ ID NO: 1599756 - RNA, 20 nt, Pseudomonas putida KT2440
ggcuucuugacgggugacca

SEQ ID NO: 1599757 - RNA, 23 nt, Pseudomonas putida KT2440
ggcuugagcuuagcgcgcacggu

SEQ ID NO: 1599758 - RNA, 19 nt, Pseudomonas putida KT2440
ggcuuuccagguccugcuc

SEQ ID NO: 1599759 - RNA, 15 nt, Pseudomonas putida KT2440
ggcuuuccaccuggc

SEQ ID NO: 1599760 - RNA, 16 nt, Pseudomonas putida KT2440
ggcuugcgcugaagga

SEQ ID NO: 1599761 - RNA, 20 nt, Pseudomonas putida KT2440
ggcuucagaagccuuggccu

SEQ ID NO: 1599762 - RNA, 24 nt, Pseudomonas putida KT2440
ggcuucagaagccuuggccuuggc

SEQ ID NO: 1599763 - RNA, 22 nt, Pseudomonas putida KT2440
ggcuucaaguuuggcuuugccc

SEQ ID NO: 1599764 - RNA, 17 nt, Pseudomonas putida KT2440
ggcuucaaacagcucac

SEQ ID NO: 1599765 - RNA, 16 nt, Pseudomonas putida KT2440
ggcuuacuuggucacc

SEQ ID NO: 1599766 - RNA, 16 nt, Pseudomonas putida KT2440
ggcuucaugcugcugc

SEQ ID NO: 1599767 - RNA, 23 nt, Pseudomonas putida KT2440
ggccgcagccucuucggccagca

SEQ ID NO: 1599768 - RNA, 16 nt, Pseudomonas putida KT2440
ggccgcagagcggccc

SEQ ID NO: 1599769 - RNA, 21 nt, Pseudomonas putida KT2440
ggccgcagagcggcccugagc

SEQ ID NO: 1599770 - RNA, 13 nt, Pseudomonas putida KT2440
ggccgcacccagc

SEQ ID NO: 1599771 - RNA, 22 nt, Pseudomonas putida KT2440
ggccgccauugaugccgaaggc

SEQ ID NO: 1599772 - RNA, 16 nt, Pseudomonas putida KT2440
ggccgcccacccacca

SEQ ID NO: 1599773 - RNA, 14 nt, Pseudomonas putida KT2440
ggccgccaggaugg

SEQ ID NO: 1599774 - RNA, 13 nt, Pseudomonas putida KT2440
ggccgccagcggc

SEQ ID NO: 1599775 - RNA, 14 nt, Pseudomonas putida KT2440
ggcuguccagcaag

SEQ ID NO: 1599776 - RNA, 17 nt, Pseudomonas putida KT2440
ggcuguccagcaagggc

SEQ ID NO: 1599777 - RNA, 18 nt, Pseudomonas putida KT2440
ggcugucgaaggcuugca

SEQ ID NO: 1599778 - RNA, 14 nt, Pseudomonas putida KT2440
ggcugucgagcagg

SEQ ID NO: 1599779 - RNA, 22 nt, Pseudomonas putida KT2440
gggaaguggugguagaaggucg

SEQ ID NO: 1599780 - RNA, 19 nt, Pseudomonas putida KT2440
ggcuuucggcgcacccggc

SEQ ID NO: 1599781 - RNA, 13 nt, Pseudomonas putida KT2440
ggcuuugauacug

SEQ ID NO: 1599782 - RNA, 19 nt, Pseudomonas putida KT2440
ggcuuuguuguuugggccu

SEQ ID NO: 1599783 - RNA, 19 nt, Pseudomonas putida KT2440
ggcuuuucguuggccagcu

SEQ ID NO: 1599784 - RNA, 21 nt, Pseudomonas putida KT2440
ggcuuuucguuggccagcuug

SEQ ID NO: 1599785 - RNA, 18 nt, Pseudomonas putida KT2440
gggacgaucugcagcacc

SEQ ID NO: 1599786 - RNA, 18 nt, Pseudomonas putida KT2440
gggacagccacaugccag

SEQ ID NO: 1599787 - RNA, 23 nt, Pseudomonas putida KT2440
gggaauggcccagccagcguggg

SEQ ID NO: 1599788 - RNA, 18 nt, Pseudomonas putida KT2440
gucuagagaucugcaggg

SEQ ID NO: 1599789 - RNA, 17 nt, Pseudomonas putida KT2440
gucuacaaaacuuccag

SEQ ID NO: 1599790 - RNA, 14 nt, Pseudomonas putida KT2440
gucuccgggcgccc

SEQ ID NO: 1599791 - RNA, 18 nt, Pseudomonas putida KT2440
gucucccagcgcuguccc

SEQ ID NO: 1599792 - RNA, 23 nt, Pseudomonas putida KT2440
gucucccagcgcugucccccagc

SEQ ID NO: 1599793 - RNA, 19 nt, Pseudomonas putida KT2440
gucuauggaugccagcggu

SEQ ID NO: 1599794 - RNA, 15 nt, Pseudomonas putida KT2440
gucgguagagcaaau

SEQ ID NO: 1599795 - RNA, 22 nt, Pseudomonas putida KT2440
gucggucgcccccaugaugacc

SEQ ID NO: 1599796 - RNA, 21 nt, Pseudomonas putida KT2440
gucggucagguagccuuccag

SEQ ID NO: 1599797 - RNA, 20 nt, Pseudomonas putida KT2440
gucguccacgcgcaggccac

SEQ ID NO: 1599798 - RNA, 14 nt, Pseudomonas putida KT2440
gucguccagcucgc

SEQ ID NO: 1599799 - RNA, 15 nt, Pseudomonas putida KT2440
gucguccgcaguccc

SEQ ID NO: 1599800 - RNA, 18 nt, Pseudomonas putida KT2440
gucgugcucacgccccuu

SEQ ID NO: 1599801 - RNA, 16 nt, Pseudomonas putida KT2440
gucgugcugccggucg

SEQ ID NO: 1599802 - RNA, 14 nt, Pseudomonas putida KT2440
gucguggcgaacac

SEQ ID NO: 1599803 - RNA, 18 nt, Pseudomonas putida KT2440
gucgugccggaacaaccc

SEQ ID NO: 1599804 - RNA, 13 nt, Pseudomonas putida KT2440
gucgggcacaggc

SEQ ID NO: 1599805 - RNA, 17 nt, Pseudomonas putida KT2440
gucgggaauugcagccc

SEQ ID NO: 1599806 - RNA, 23 nt, Pseudomonas putida KT2440
gucggcguuaccccguugcgcag

SEQ ID NO: 1599807 - RNA, 13 nt, Pseudomonas putida KT2440
gucgggcuggcug

SEQ ID NO: 1599808 - RNA, 14 nt, Pseudomonas putida KT2440
gucgggcuggcugc

SEQ ID NO: 1599809 - RNA, 14 nt, Pseudomonas putida KT2440
gucggggccggaga

SEQ ID NO: 1599810 - RNA, 15 nt, Pseudomonas putida KT2440
gucggggccggagaa

SEQ ID NO: 1599811 - RNA, 18 nt, Pseudomonas putida KT2440
gucggggugaggggauuc

SEQ ID NO: 1599812 - RNA, 19 nt, Pseudomonas putida KT2440
gucggccagaucggccagc

SEQ ID NO: 1599813 - RNA, 16 nt, Pseudomonas putida KT2440
gucggccaccuggucg

SEQ ID NO: 1599814 - RNA, 24 nt, Pseudomonas putida KT2440
gucggccugggucagcugguucug

SEQ ID NO: 1599815 - RNA, 20 nt, Pseudomonas putida KT2440
gucggccugcccgguacgca

SEQ ID NO: 1599816 - RNA, 23 nt, Pseudomonas putida KT2440
gucggccugcacuaccucgcuca

SEQ ID NO: 1599817 - RNA, 16 nt, Pseudomonas putida KT2440
gucggcguccacugca

SEQ ID NO: 1599818 - RNA, 15 nt, Pseudomonas putida KT2440
gucggcguccuucag

SEQ ID NO: 1599819 - RNA, 22 nt, Pseudomonas putida KT2440
gucggcguagccguuugaagcc

SEQ ID NO: 1599820 - RNA, 18 nt, Pseudomonas putida KT2440
gucggcgcgcgcauccac

SEQ ID NO: 1599821 - RNA, 14 nt, Pseudomonas putida KT2440
gucggcgccaggcc

SEQ ID NO: 1599822 - RNA, 14 nt, Pseudomonas putida KT2440
gucgcucuucaacc

SEQ ID NO: 1599823 - RNA, 16 nt, Pseudomonas putida KT2440
gucggcacgagcaugc

SEQ ID NO: 1599824 - RNA, 19 nt, Pseudomonas putida KT2440
gucggcacgcgccagcagc

SEQ ID NO: 1599825 - RNA, 14 nt, Pseudomonas putida KT2440
gucggcacgguguc

SEQ ID NO: 1599826 - RNA, 12 nt, Pseudomonas putida KT2440
gucggcaugcac

SEQ ID NO: 1599827 - RNA, 22 nt, Pseudomonas putida KT2440
gucggcaugcacuuccaggaag

SEQ ID NO: 1599828 - RNA, 15 nt, Pseudomonas putida KT2440
gucggcagagcgcca

SEQ ID NO: 1599829 - RNA, 23 nt, Pseudomonas putida KT2440
gucgcgagccucuguuugcuggu

SEQ ID NO: 1599830 - RNA, 17 nt, Pseudomonas putida KT2440
gucgcgcagauggcaga

SEQ ID NO: 1599831 - RNA, 12 nt, Pseudomonas putida KT2440
gucgcgcagggc

SEQ ID NO: 1599832 - RNA, 14 nt, Pseudomonas putida KT2440
gucgcgcagggccu

SEQ ID NO: 1599833 - RNA, 15 nt, Pseudomonas putida KT2440
gucgaugaucgccgc

SEQ ID NO: 1599834 - RNA, 18 nt, Pseudomonas putida KT2440
gucgaugaucgccgccgc

SEQ ID NO: 1599835 - RNA, 17 nt, Pseudomonas putida KT2440
gucgaugcggccacagc

SEQ ID NO: 1599836 - RNA, 15 nt, Pseudomonas putida KT2440
gucgaugauggcugc

SEQ ID NO: 1599837 - RNA, 12 nt, Pseudomonas putida KT2440
guccgugagaaa

SEQ ID NO: 1599838 - RNA, 17 nt, Pseudomonas putida KT2440
guccgcugccuuccaac

SEQ ID NO: 1599839 - RNA, 15 nt, Pseudomonas putida KT2440
guccgagcggagcug

SEQ ID NO: 1599840 - RNA, 20 nt, Pseudomonas putida KT2440
gucccugacucgaccgccgc

SEQ ID NO: 1599841 - RNA, 24 nt, Pseudomonas putida KT2440
gucccugacucgaccgccgcacag

SEQ ID NO: 1599842 - RNA, 24 nt, Pseudomonas putida KT2440
guccgacaaugccagcaaaugccc

SEQ ID NO: 1599843 - RNA, 14 nt, Pseudomonas putida KT2440
gucccggccagggc

SEQ ID NO: 1599844 - RNA, 16 nt, Pseudomonas putida KT2440
guccuugcuggccacc

SEQ ID NO: 1599845 - RNA, 15 nt, Pseudomonas putida KT2440
guccucgaacucaug

SEQ ID NO: 1599846 - RNA, 18 nt, Pseudomonas putida KT2440
guccucgaacucaugcuc

SEQ ID NO: 1599847 - RNA, 16 nt, Pseudomonas putida KT2440
gucgaaccgcaacugg

SEQ ID NO: 1599848 - RNA, 17 nt, Pseudomonas putida KT2440
gucgaaccgcaacuggc

SEQ ID NO: 1599849 - RNA, 12 nt, Pseudomonas putida KT2440
gucgaaccugcc

SEQ ID NO: 1599850 - RNA, 22 nt, Pseudomonas putida KT2440
gucgaaccccugauguggcugc

SEQ ID NO: 1599851 - RNA, 21 nt, Pseudomonas putida KT2440
gucgaagcgcucccaggccuc

SEQ ID NO: 1599852 - RNA, 12 nt, Pseudomonas putida KT2440
gucgaagcccgc

SEQ ID NO: 1599853 - RNA, 14 nt, Pseudomonas putida KT2440
gucgaagcccgcgg

SEQ ID NO: 1599854 - RNA, 17 nt, Pseudomonas putida KT2440
gucgaaggucaggcgcg

SEQ ID NO: 1599855 - RNA, 19 nt, Pseudomonas putida KT2440
gucgagcaccacggcggcg

SEQ ID NO: 1599856 - RNA, 15 nt, Pseudomonas putida KT2440
gucgacgaucgccgc

SEQ ID NO: 1599857 - RNA, 13 nt, Pseudomonas putida KT2440
gucgaccaaaaau

SEQ ID NO: 1599858 - RNA, 19 nt, Pseudomonas putida KT2440
gucgaccaaaaaucuuaac

SEQ ID NO: 1599859 - RNA, 14 nt, Pseudomonas putida KT2440
gucgacaccaggau

SEQ ID NO: 1599860 - RNA, 19 nt, Pseudomonas putida KT2440
gucgaaugcgugcaacgcc

SEQ ID NO: 1599861 - RNA, 15 nt, Pseudomonas putida KT2440
guccaggauacccau

SEQ ID NO: 1599862 - RNA, 17 nt, Pseudomonas putida KT2440
guccaggcaaucacuga

SEQ ID NO: 1599863 - RNA, 22 nt, Pseudomonas putida KT2440
guccaggaacgcugccuccaca

SEQ ID NO: 1599864 - RNA, 22 nt, Pseudomonas putida KT2440
guccagcgucugcuugcccaga

SEQ ID NO: 1599865 - RNA, 11 nt, Pseudomonas putida KT2440
guccagcuccg

SEQ ID NO: 1599866 - RNA, 21 nt, Pseudomonas putida KT2440
guccagcguucggccagcacu

SEQ ID NO: 1599867 - RNA, 16 nt, Pseudomonas putida KT2440
guccaguuccggcagg

SEQ ID NO: 1599868 - RNA, 19 nt, Pseudomonas putida KT2440
guccaguuggcggcgcagc

SEQ ID NO: 1599869 - RNA, 21 nt, Pseudomonas putida KT2440
guccagguuuggguuggcuuu

SEQ ID NO: 1599870 - RNA, 20 nt, Pseudomonas putida KT2440
guccagguaguacggcaggc

SEQ ID NO: 1599871 - RNA, 23 nt, Pseudomonas putida KT2440
guccagguaguacggcaggcgaa

SEQ ID NO: 1599872 - RNA, 16 nt, Pseudomonas putida KT2440
guccaggguggcguug

SEQ ID NO: 1599873 - RNA, 13 nt, Pseudomonas putida KT2440
guccaggcucagc

SEQ ID NO: 1599874 - RNA, 20 nt, Pseudomonas putida KT2440
guccaggcccgccagagcau

SEQ ID NO: 1599875 - RNA, 20 nt, Pseudomonas putida KT2440
guccagacgccgcagugaca

SEQ ID NO: 1599876 - RNA, 14 nt, Pseudomonas putida KT2440
guccagagggccug

SEQ ID NO: 1599877 - RNA, 20 nt, Pseudomonas putida KT2440
guccacugcacccgugcagg

SEQ ID NO: 1599878 - RNA, 15 nt, Pseudomonas putida KT2440
guccagcacacugag

SEQ ID NO: 1599879 - RNA, 13 nt, Pseudomonas putida KT2440
guccagcagcagc

SEQ ID NO: 1599880 - RNA, 21 nt, Pseudomonas putida KT2440
guccagcaagggccugugccg

SEQ ID NO: 1599881 - RNA, 20 nt, Pseudomonas putida KT2440
guccagcaacagcugccggg

SEQ ID NO: 1599882 - RNA, 15 nt, Pseudomonas putida KT2440
guccagcaagcucau

SEQ ID NO: 1599883 - RNA, 21 nt, Pseudomonas putida KT2440
guccagcaagcucaucaccag

SEQ ID NO: 1599884 - RNA, 18 nt, Pseudomonas putida KT2440
guccagcaggccauauug

SEQ ID NO: 1599885 - RNA, 15 nt, Pseudomonas putida KT2440
guccacucaccggca

SEQ ID NO: 1599886 - RNA, 17 nt, Pseudomonas putida KT2440
guccaccucugcggccu

SEQ ID NO: 1599887 - RNA, 15 nt, Pseudomonas putida KT2440
guccacgcgcaggcc

SEQ ID NO: 1599888 - RNA, 22 nt, Pseudomonas putida KT2440
guccaccaucuccagcucgccg

SEQ ID NO: 1599889 - RNA, 19 nt, Pseudomonas putida KT2440
gucaucacccgggaacagc

SEQ ID NO: 1599890 - RNA, 21 nt, Pseudomonas putida KT2440
gucaucaauauccagccuucc

SEQ ID NO: 1599891 - RNA, 22 nt, Pseudomonas putida KT2440
gucaucaccacccccagcgacc

SEQ ID NO: 1599892 - RNA, 20 nt, Pseudomonas putida KT2440
gucaucaccacuucacugac

SEQ ID NO: 1599893 - RNA, 22 nt, Pseudomonas putida KT2440
gucauccgccaacaccaccucc

SEQ ID NO: 1599894 - RNA, 15 nt, Pseudomonas putida KT2440
gucauccucaccggc

SEQ ID NO: 1599895 - RNA, 20 nt, Pseudomonas putida KT2440
gucaucgaacaguuugcuuu

SEQ ID NO: 1599896 - RNA, 19 nt, Pseudomonas putida KT2440
guccacaccaaagucagcc

SEQ ID NO: 1599897 - RNA, 16 nt, Pseudomonas putida KT2440
gucaugucggcagcca

SEQ ID NO: 1599898 - RNA, 17 nt, Pseudomonas putida KT2440
gucaugggucacucccg

SEQ ID NO: 1599899 - RNA, 17 nt, Pseudomonas putida KT2440
gucaugcgggaagccau

SEQ ID NO: 1599900 - RNA, 13 nt, Pseudomonas putida KT2440
guauuggccaaga

SEQ ID NO: 1599901 - RNA, 22 nt, Pseudomonas putida KT2440
guauucgcuaaccucugcaugc

SEQ ID NO: 1599902 - RNA, 16 nt, Pseudomonas putida KT2440
gucaccuuguccagca

SEQ ID NO: 1599903 - RNA, 19 nt, Pseudomonas putida KT2440
gucaccuuuuccacuugca

SEQ ID NO: 1599904 - RNA, 18 nt, Pseudomonas putida KT2440
gucaccgucaccuugcug

SEQ ID NO: 1599905 - RNA, 19 nt, Pseudomonas putida KT2440
gucaccaucggugcggccc

SEQ ID NO: 1599906 - RNA, 17 nt, Pseudomonas putida KT2440
gucaccacgcccgccgg

SEQ ID NO: 1599907 - RNA, 15 nt, Pseudomonas putida KT2440
gucaauaccggugcc

SEQ ID NO: 1599908 - RNA, 15 nt, Pseudomonas putida KT2440
gucaaacagccgccc

SEQ ID NO: 1599909 - RNA, 20 nt, Pseudomonas putida KT2440
gucaaguacuugcaggugca

SEQ ID NO: 1599910 - RNA, 16 nt, Pseudomonas putida KT2440
guauggccgagcagga

SEQ ID NO: 1599911 - RNA, 13 nt, Pseudomonas putida KT2440
guaugauuucagg

SEQ ID NO: 1599912 - RNA, 15 nt, Pseudomonas putida KT2440
guauggcuucacggc

SEQ ID NO: 1599913 - RNA, 14 nt, Pseudomonas putida KT2440
guauuaauuugaac

SEQ ID NO: 1599914 - RNA, 22 nt, Pseudomonas putida KT2440
guauccccgaguauccccacca

SEQ ID NO: 1599915 - RNA, 13 nt, Pseudomonas putida KT2440
guaucccaggcgc

SEQ ID NO: 1599916 - RNA, 14 nt, Pseudomonas putida KT2440
guauccaucaccau

SEQ ID NO: 1599917 - RNA, 21 nt, Pseudomonas putida KT2440
guaucacgcuccugcaugccu

SEQ ID NO: 1599918 - RNA, 23 nt, Pseudomonas putida KT2440
guagcugucacccuuggucagga

SEQ ID NO: 1599919 - RNA, 23 nt, Pseudomonas putida KT2440
guagcugucggucagccagaugc

SEQ ID NO: 1599920 - RNA, 17 nt, Pseudomonas putida KT2440
guaggacaucuggucag

SEQ ID NO: 1599921 - RNA, 20 nt, Pseudomonas putida KT2440
guaggaacgcuaaguaguug

SEQ ID NO: 1599922 - RNA, 16 nt, Pseudomonas putida KT2440
guaggaucaaguaccc

SEQ ID NO: 1599923 - RNA, 21 nt, Pseudomonas putida KT2440
guauaggccccgaaugcacgg

SEQ ID NO: 1599924 - RNA, 16 nt, Pseudomonas putida KT2440
guagcggucaugcagc

SEQ ID NO: 1599925 - RNA, 14 nt, Pseudomonas putida KT2440
guagcccaccaccu

SEQ ID NO: 1599926 - RNA, 22 nt, Pseudomonas putida KT2440
guagccaccugauguacaagga

SEQ ID NO: 1599927 - RNA, 15 nt, Pseudomonas putida KT2440
guagccacgcugcca

SEQ ID NO: 1599928 - RNA, 20 nt, Pseudomonas putida KT2440
guagcagguacgcgcaggca

SEQ ID NO: 1599929 - RNA, 17 nt, Pseudomonas putida KT2440
guagcaggaucugcugc

SEQ ID NO: 1599930 - RNA, 21 nt, Pseudomonas putida KT2440
guagcacgggcgcugaagcca

SEQ ID NO: 1599931 - RNA, 22 nt, Pseudomonas putida KT2440
guagcacgggcgcugaagccag

SEQ ID NO: 1599932 - RNA, 17 nt, Pseudomonas putida KT2440
guagcacaagggccagg

SEQ ID NO: 1599933 - RNA, 19 nt, Pseudomonas putida KT2440
guagacaugaggcccuccc

SEQ ID NO: 1599934 - RNA, 14 nt, Pseudomonas putida KT2440
guagaacaaccggg

SEQ ID NO: 1599935 - RNA, 19 nt, Pseudomonas putida KT2440
guagaacggcagcaggcca

SEQ ID NO: 1599936 - RNA, 21 nt, Pseudomonas putida KT2440
guacauccagcuccagcacca

SEQ ID NO: 1599937 - RNA, 15 nt, Pseudomonas putida KT2440
guaccuggccgugcc

SEQ ID NO: 1599938 - RNA, 18 nt, Pseudomonas putida KT2440
guaccuucuggcuggagc

SEQ ID NO: 1599939 - RNA, 14 nt, Pseudomonas putida KT2440
guaccugccccccc

SEQ ID NO: 1599940 - RNA, 12 nt, Pseudomonas putida KT2440
guacgaagccau

SEQ ID NO: 1599941 - RNA, 14 nt, Pseudomonas putida KT2440
guacgaagcucugg

SEQ ID NO: 1599942 - RNA, 18 nt, Pseudomonas putida KT2440
guacgcaaucgcucaggg

SEQ ID NO: 1599943 - RNA, 12 nt, Pseudomonas putida KT2440
guacgcaggcau

SEQ ID NO: 1599944 - RNA, 16 nt, Pseudomonas putida KT2440
guacuuggcgccgccc

SEQ ID NO: 1599945 - RNA, 12 nt, Pseudomonas putida KT2440
guacuugcugca

SEQ ID NO: 1599946 - RNA, 15 nt, Pseudomonas putida KT2440
guacucugucacccg

SEQ ID NO: 1599947 - RNA, 22 nt, Pseudomonas putida KT2440
guacucugucacccgcugcacg

SEQ ID NO: 1599948 - RNA, 16 nt, Pseudomonas putida KT2440
guacgccagcagcgca

SEQ ID NO: 1599949 - RNA, 14 nt, Pseudomonas putida KT2440
guacucgaacagcu

SEQ ID NO: 1599950 - RNA, 18 nt, Pseudomonas putida KT2440
guacucgcaagcuccagg

SEQ ID NO: 1599951 - RNA, 12 nt, Pseudomonas putida KT2440
guacagccagca

SEQ ID NO: 1599952 - RNA, 14 nt, Pseudomonas putida KT2440
guacagcacccagg

SEQ ID NO: 1599953 - RNA, 14 nt, Pseudomonas putida KT2440
guacaggcugccgc

SEQ ID NO: 1599954 - RNA, 18 nt, Pseudomonas putida KT2440
guacagccuaccaacgca

SEQ ID NO: 1599955 - RNA, 23 nt, Pseudomonas putida KT2440
guacagccuaccaacgcagcaug

SEQ ID NO: 1599956 - RNA, 19 nt, Pseudomonas putida KT2440
guacagcgacaugccggcc

SEQ ID NO: 1599957 - RNA, 18 nt, Pseudomonas putida KT2440
guacagcucacgcagcca

SEQ ID NO: 1599958 - RNA, 22 nt, Pseudomonas putida KT2440
guacagcucacgcagccaguuc

SEQ ID NO: 1599959 - RNA, 14 nt, Pseudomonas putida KT2440
guacaggcaaagaa

SEQ ID NO: 1599960 - RNA, 18 nt, Pseudomonas putida KT2440
guacaggcaauacaaggc

SEQ ID NO: 1599961 - RNA, 16 nt, Pseudomonas putida KT2440
guacaacaacaaaaaa

SEQ ID NO: 1599962 - RNA, 19 nt, Pseudomonas putida KT2440
guacaacaacaaaaaaaac

SEQ ID NO: 1599963 - RNA, 23 nt, Pseudomonas putida KT2440
guacacagcccaaggcuggccag

SEQ ID NO: 1599964 - RNA, 13 nt, Pseudomonas putida KT2440
guacaaugcacuu

SEQ ID NO: 1599965 - RNA, 17 nt, Pseudomonas putida KT2440
guaauacgcugugcucu

SEQ ID NO: 1599966 - RNA, 15 nt, Pseudomonas putida KT2440
guaauacugcuucca

SEQ ID NO: 1599967 - RNA, 18 nt, Pseudomonas putida KT2440
guaauccucguccagcuc

SEQ ID NO: 1599968 - RNA, 17 nt, Pseudomonas putida KT2440
guaaucaguaccaggcc

SEQ ID NO: 1599969 - RNA, 13 nt, Pseudomonas putida KT2440
guggcccucagcc

SEQ ID NO: 1599970 - RNA, 21 nt, Pseudomonas putida KT2440
guggcccugaccgcggugcug

SEQ ID NO: 1599971 - RNA, 14 nt, Pseudomonas putida KT2440
guggccugagccgg

SEQ ID NO: 1599972 - RNA, 19 nt, Pseudomonas putida KT2440
guggccggcaacggccacg

SEQ ID NO: 1599973 - RNA, 14 nt, Pseudomonas putida KT2440
guggcguggcugcg

SEQ ID NO: 1599974 - RNA, 20 nt, Pseudomonas putida KT2440
guggucuucaaggccaccac

SEQ ID NO: 1599975 - RNA, 22 nt, Pseudomonas putida KT2440
gugguccagcguucggccagca

SEQ ID NO: 1599976 - RNA, 19 nt, Pseudomonas putida KT2440
gugggcgucaaacagccgc

SEQ ID NO: 1599977 - RNA, 22 nt, Pseudomonas putida KT2440
guggucgaauagcgcgagcugg

SEQ ID NO: 1599978 - RNA, 13 nt, Pseudomonas putida KT2440
gugggagcggggg

SEQ ID NO: 1599979 - RNA, 20 nt, Pseudomonas putida KT2440
gugcgccaccgacuccggca

SEQ ID NO: 1599980 - RNA, 15 nt, Pseudomonas putida KT2440
guggaagcgcgcauc

SEQ ID NO: 1599981 - RNA, 20 nt, Pseudomonas putida KT2440
guggaacaggauggcaaagc

SEQ ID NO: 1599982 - RNA, 22 nt, Pseudomonas putida KT2440
guggaaauuggccagcaggccc

SEQ ID NO: 1599983 - RNA, 18 nt, Pseudomonas putida KT2440
guggaagugcuucaccuu

SEQ ID NO: 1599984 - RNA, 15 nt, Pseudomonas putida KT2440
guggaaucggcucca

SEQ ID NO: 1599985 - RNA, 23 nt, Pseudomonas putida KT2440
guggaaaucgccugcuuggccga

SEQ ID NO: 1599986 - RNA, 12 nt, Pseudomonas putida KT2440
guggaccagagc

SEQ ID NO: 1599987 - RNA, 20 nt, Pseudomonas putida KT2440
guggcaccgccgcccacgcc

SEQ ID NO: 1599988 - RNA, 19 nt, Pseudomonas putida KT2440
guggcacccacagcgccug

SEQ ID NO: 1599989 - RNA, 22 nt, Pseudomonas putida KT2440
guggcacccacagcgccugcug

SEQ ID NO: 1599990 - RNA, 12 nt, Pseudomonas putida KT2440
guggcagaacau

SEQ ID NO: 1599991 - RNA, 16 nt, Pseudomonas putida KT2440
guggcagaacucccau

SEQ ID NO: 1599992 - RNA, 13 nt, Pseudomonas putida KT2440
guggcagcccccc

SEQ ID NO: 1599993 - RNA, 17 nt, Pseudomonas putida KT2440
guguucccagcacccca

SEQ ID NO: 1599994 - RNA, 16 nt, Pseudomonas putida KT2440
guguucgcgaacugca

SEQ ID NO: 1599995 - RNA, 15 nt, Pseudomonas putida KT2440
guguuacgccaggcg

SEQ ID NO: 1599996 - RNA, 15 nt, Pseudomonas putida KT2440
guguuagcgcggacc

SEQ ID NO: 1599997 - RNA, 14 nt, Pseudomonas putida KT2440
guguccgccgccgu

SEQ ID NO: 1599998 - RNA, 14 nt, Pseudomonas putida KT2440
gugucccggccagg

SEQ ID NO: 1599999 - RNA, 14 nt, Pseudomonas putida KT2440
gugugcuccagcuc

SEQ ID NO: 1600000 - RNA, 20 nt, Pseudomonas putida KT2440
guguagcccgcugaagguca

SEQ ID NO: 1600001 - RNA, 22 nt, Pseudomonas putida KT2440
guguagccgcuuucggucaggg

SEQ ID NO: 1600002 - RNA, 18 nt, Pseudomonas putida KT2440
guguagcgcaguccggua

SEQ ID NO: 1600003 - RNA, 13 nt, Pseudomonas putida KT2440
guguaggaucugc

SEQ ID NO: 1600004 - RNA, 15 nt, Pseudomonas putida KT2440
guguagucgguggug

SEQ ID NO: 1600005 - RNA, 15 nt, Pseudomonas putida KT2440
guguauccaccccca

SEQ ID NO: 1600006 - RNA, 13 nt, Pseudomonas putida KT2440
guguauccauacu

SEQ ID NO: 1600007 - RNA, 15 nt, Pseudomonas putida KT2440
gugucaguugcucgc

SEQ ID NO: 1600008 - RNA, 13 nt, Pseudomonas putida KT2440
guguccacccccg

SEQ ID NO: 1600009 - RNA, 17 nt, Pseudomonas putida KT2440
gugucagcguacacugc

SEQ ID NO: 1600010 - RNA, 21 nt, Pseudomonas putida KT2440
gugucacauugguguggguga

SEQ ID NO: 1600011 - RNA, 16 nt, Pseudomonas putida KT2440
guucgaauccugcuga

SEQ ID NO: 1600012 - RNA, 12 nt, Pseudomonas putida KT2440
guucgacgcugc

SEQ ID NO: 1600013 - RNA, 13 nt, Pseudomonas putida KT2440
guucgaccacugc

SEQ ID NO: 1600014 - RNA, 17 nt, Pseudomonas putida KT2440
guucgaccacugcaggu

SEQ ID NO: 1600015 - RNA, 17 nt, Pseudomonas putida KT2440
guucgacugccgcucau

SEQ ID NO: 1600016 - RNA, 14 nt, Pseudomonas putida KT2440
guucgacucccgcu

SEQ ID NO: 1600017 - RNA, 13 nt, Pseudomonas putida KT2440
guuccuucagcag

SEQ ID NO: 1600018 - RNA, 14 nt, Pseudomonas putida KT2440
guuccggcaaacca

SEQ ID NO: 1600019 - RNA, 18 nt, Pseudomonas putida KT2440
guucggcguaacgguccu

SEQ ID NO: 1600020 - RNA, 16 nt, Pseudomonas putida KT2440
guucggugcucaggcu

SEQ ID NO: 1600021 - RNA, 20 nt, Pseudomonas putida KT2440
guucguacagguugcggcca

SEQ ID NO: 1600022 - RNA, 18 nt, Pseudomonas putida KT2440
guucggguucagcuucuc

SEQ ID NO: 1600023 - RNA, 15 nt, Pseudomonas putida KT2440
guucucgacagccac

SEQ ID NO: 1600024 - RNA, 17 nt, Pseudomonas putida KT2440
guucucgacagccaccu

SEQ ID NO: 1600025 - RNA, 14 nt, Pseudomonas putida KT2440
guucucgccgccgc

SEQ ID NO: 1600026 - RNA, 15 nt, Pseudomonas putida KT2440
guucugccggggcau

SEQ ID NO: 1600027 - RNA, 16 nt, Pseudomonas putida KT2440
guucugaaucuggcuc

SEQ ID NO: 1600028 - RNA, 13 nt, Pseudomonas putida KT2440
guucucuucacuc

SEQ ID NO: 1600029 - RNA, 20 nt, Pseudomonas putida KT2440
guucacccgcgaaagggcca

SEQ ID NO: 1600030 - RNA, 15 nt, Pseudomonas putida KT2440
guucacgcaggcgca

SEQ ID NO: 1600031 - RNA, 14 nt, Pseudomonas putida KT2440
guucacggucaggc

SEQ ID NO: 1600032 - RNA, 19 nt, Pseudomonas putida KT2440
guucaugcccaccgcugca

SEQ ID NO: 1600033 - RNA, 13 nt, Pseudomonas putida KT2440
guucaugcccuuc

SEQ ID NO: 1600034 - RNA, 23 nt, Pseudomonas putida KT2440
guucaucuucuugcaguucuuga

SEQ ID NO: 1600035 - RNA, 18 nt, Pseudomonas putida KT2440
guucaucggcaaacacau

SEQ ID NO: 1600036 - RNA, 21 nt, Pseudomonas putida KT2440
guuccagcguagccguccuuu

SEQ ID NO: 1600037 - RNA, 20 nt, Pseudomonas putida KT2440
guuccagccgcgccacuccc

SEQ ID NO: 1600038 - RNA, 17 nt, Pseudomonas putida KT2440
guuccauuucccuacag

SEQ ID NO: 1600039 - RNA, 16 nt, Pseudomonas putida KT2440
guuccgcccagcucug

SEQ ID NO: 1600040 - RNA, 23 nt, Pseudomonas putida KT2440
guuccgcaaauucucgagcugau

SEQ ID NO: 1600041 - RNA, 15 nt, Pseudomonas putida KT2440
guuacccaucugcuc

SEQ ID NO: 1600042 - RNA, 15 nt, Pseudomonas putida KT2440
guuacccaccagcuc

SEQ ID NO: 1600043 - RNA, 15 nt, Pseudomonas putida KT2440
guuacccagguagau

SEQ ID NO: 1600044 - RNA, 16 nt, Pseudomonas putida KT2440
guuauccugcagcacc

SEQ ID NO: 1600045 - RNA, 16 nt, Pseudomonas putida KT2440
guuauccagcugcaac

SEQ ID NO: 1600046 - RNA, 18 nt, Pseudomonas putida KT2440
guuauccagcugcaacag

SEQ ID NO: 1600047 - RNA, 17 nt, Pseudomonas putida KT2440
guuauccaggcuggcgc

SEQ ID NO: 1600048 - RNA, 12 nt, Pseudomonas putida KT2440
guuauccaggua

SEQ ID NO: 1600049 - RNA, 20 nt, Pseudomonas putida KT2440
guuauuuuuuaacaaggcac

SEQ ID NO: 1600050 - RNA, 21 nt, Pseudomonas putida KT2440
guuauuuuuuaacaaggcacg

SEQ ID NO: 1600051 - RNA, 18 nt, Pseudomonas putida KT2440
guuauuugugaaacacca

SEQ ID NO: 1600052 - RNA, 14 nt, Pseudomonas putida KT2440
guucaacagccgcg

SEQ ID NO: 1600053 - RNA, 16 nt, Pseudomonas putida KT2440
guucaacuucgguggc

SEQ ID NO: 1600054 - RNA, 13 nt, Pseudomonas putida KT2440
guucaagggcagg

SEQ ID NO: 1600055 - RNA, 15 nt, Pseudomonas putida KT2440
guucaaggucaucgc

SEQ ID NO: 1600056 - RNA, 15 nt, Pseudomonas putida KT2440
gugcacugccuggcu

SEQ ID NO: 1600057 - RNA, 22 nt, Pseudomonas putida KT2440
gugcacugcgaagcccaguucg

SEQ ID NO: 1600058 - RNA, 13 nt, Pseudomonas putida KT2440
gugcaccuccgcc

SEQ ID NO: 1600059 - RNA, 20 nt, Pseudomonas putida KT2440
gugcaccgcucagugccggg

SEQ ID NO: 1600060 - RNA, 15 nt, Pseudomonas putida KT2440
gugcacccacuggcc

SEQ ID NO: 1600061 - RNA, 15 nt, Pseudomonas putida KT2440
gugcaaacacccagc

SEQ ID NO: 1600062 - RNA, 19 nt, Pseudomonas putida KT2440
gugcaucaagucgcccagu

SEQ ID NO: 1600063 - RNA, 17 nt, Pseudomonas putida KT2440
gugcauccaacgcugcc

SEQ ID NO: 1600064 - RNA, 15 nt, Pseudomonas putida KT2440
gugcaugcgcacggu

SEQ ID NO: 1600065 - RNA, 20 nt, Pseudomonas putida KT2440
gugcagggaagggcaaugau

SEQ ID NO: 1600066 - RNA, 21 nt, Pseudomonas putida KT2440
gugcaggggucugugcagcga

SEQ ID NO: 1600067 - RNA, 15 nt, Pseudomonas putida KT2440
gugcagguucgacca

SEQ ID NO: 1600068 - RNA, 18 nt, Pseudomonas putida KT2440
gugcaggugcacuguugc

SEQ ID NO: 1600069 - RNA, 19 nt, Pseudomonas putida KT2440
gugcagguggauguugaug

SEQ ID NO: 1600070 - RNA, 22 nt, Pseudomonas putida KT2440
gugcaggcgcaggcucuccacg

SEQ ID NO: 1600071 - RNA, 15 nt, Pseudomonas putida KT2440
gugcagcugaugagg

SEQ ID NO: 1600072 - RNA, 22 nt, Pseudomonas putida KT2440
gugccggccaaucgaucugcuc

SEQ ID NO: 1600073 - RNA, 12 nt, Pseudomonas putida KT2440
gugccggccucu

SEQ ID NO: 1600074 - RNA, 22 nt, Pseudomonas putida KT2440
gugccggccucuucgcggccuu

SEQ ID NO: 1600075 - RNA, 14 nt, Pseudomonas putida KT2440
gugccgcaucagcc

SEQ ID NO: 1600076 - RNA, 16 nt, Pseudomonas putida KT2440
gugccgcaucagccgg

SEQ ID NO: 1600077 - RNA, 21 nt, Pseudomonas putida KT2440
gugccgcaucagccggcuucc

SEQ ID NO: 1600078 - RNA, 17 nt, Pseudomonas putida KT2440
gugccgcaugugccagg

SEQ ID NO: 1600079 - RNA, 21 nt, Pseudomonas putida KT2440
gugccgcaagcagucccagca

SEQ ID NO: 1600080 - RNA, 15 nt, Pseudomonas putida KT2440
gugccgagugccaac

SEQ ID NO: 1600081 - RNA, 18 nt, Pseudomonas putida KT2440
gugccgagugccaacaau

SEQ ID NO: 1600082 - RNA, 14 nt, Pseudomonas putida KT2440
gugccgaggacaac

SEQ ID NO: 1600083 - RNA, 17 nt, Pseudomonas putida KT2440
gugccauccaccgcgcc

SEQ ID NO: 1600084 - RNA, 17 nt, Pseudomonas putida KT2440
gugcauguagccaauca

SEQ ID NO: 1600085 - RNA, 22 nt, Pseudomonas putida KT2440
gugccaucgccucggcacugca

SEQ ID NO: 1600086 - RNA, 17 nt, Pseudomonas putida KT2440
gugcccacugcagccau

SEQ ID NO: 1600087 - RNA, 20 nt, Pseudomonas putida KT2440
gugcccacugcagccauuca

SEQ ID NO: 1600088 - RNA, 17 nt, Pseudomonas putida KT2440
gugccgucagaaagaau

SEQ ID NO: 1600089 - RNA, 20 nt, Pseudomonas putida KT2440
gugccguacauagcaggauc

SEQ ID NO: 1600090 - RNA, 13 nt, Pseudomonas putida KT2440
gugccgguggggu

SEQ ID NO: 1600091 - RNA, 15 nt, Pseudomonas putida KT2440
gugccgguggggugu

SEQ ID NO: 1600092 - RNA, 13 nt, Pseudomonas putida KT2440
gugccgugcaggg

SEQ ID NO: 1600093 - RNA, 16 nt, Pseudomonas putida KT2440
gugccggucacuggca

SEQ ID NO: 1600094 - RNA, 17 nt, Pseudomonas putida KT2440
gugccggguccaguucc

SEQ ID NO: 1600095 - RNA, 14 nt, Pseudomonas putida KT2440
gugccugcagcccg

SEQ ID NO: 1600096 - RNA, 23 nt, Pseudomonas putida KT2440
gugccugguugcccaugcacagc

SEQ ID NO: 1600097 - RNA, 15 nt, Pseudomonas putida KT2440
gugccugcugcucgc

SEQ ID NO: 1600098 - RNA, 15 nt, Pseudomonas putida KT2440
gugaccagcggcagc

SEQ ID NO: 1600099 - RNA, 18 nt, Pseudomonas putida KT2440
gugaccaggcccagcagg

SEQ ID NO: 1600100 - RNA, 19 nt, Pseudomonas putida KT2440
gugacgaucaccagggcau

SEQ ID NO: 1600101 - RNA, 16 nt, Pseudomonas putida KT2440
gugacgcggagccggc

SEQ ID NO: 1600102 - RNA, 13 nt, Pseudomonas putida KT2440
gugacuagaggau

SEQ ID NO: 1600103 - RNA, 13 nt, Pseudomonas putida KT2440
gugacugaugaug

SEQ ID NO: 1600104 - RNA, 12 nt, Pseudomonas putida KT2440
gugagaccugca

SEQ ID NO: 1600105 - RNA, 17 nt, Pseudomonas putida KT2440
gugaucagcaaugccag

SEQ ID NO: 1600106 - RNA, 14 nt, Pseudomonas putida KT2440
gugaucgcaucauc

SEQ ID NO: 1600107 - RNA, 19 nt, Pseudomonas putida KT2440
gugaucgacagguucgaau

SEQ ID NO: 1600108 - RNA, 23 nt, Pseudomonas putida KT2440
gugaucaacaaaccgacccugcu

SEQ ID NO: 1600109 - RNA, 11 nt, Pseudomonas putida KT2440
gugagcccugu

SEQ ID NO: 1600110 - RNA, 19 nt, Pseudomonas putida KT2440
gugagggggcacgcggcgc

SEQ ID NO: 1600111 - RNA, 19 nt, Pseudomonas putida KT2440
gugaggcauggaagggcgg

SEQ ID NO: 1600112 - RNA, 18 nt, Pseudomonas putida KT2440
gugaagcggacagcuauc

SEQ ID NO: 1600113 - RNA, 19 nt, Pseudomonas putida KT2440
gugaagcccuucgaugcuc

SEQ ID NO: 1600114 - RNA, 19 nt, Pseudomonas putida KT2440
gugaagucaaccaacuccu

SEQ ID NO: 1600115 - RNA, 21 nt, Pseudomonas putida KT2440
gugaauagcaggccgcauuuc

SEQ ID NO: 1600116 - RNA, 17 nt, Pseudomonas putida KT2440
gugaauuccuugcagcu

SEQ ID NO: 1600117 - RNA, 17 nt, Pseudomonas putida KT2440
gugaauuccuugcuggu

SEQ ID NO: 1600118 - RNA, 18 nt, Pseudomonas putida KT2440
gugaaucagcggcaggcu

SEQ ID NO: 1600119 - RNA, 12 nt, Pseudomonas putida KT2440
gugaaccgcgcc

SEQ ID NO: 1600120 - RNA, 22 nt, Pseudomonas putida KT2440
gugaaccccaccccagcguucc

SEQ ID NO: 1600121 - RNA, 16 nt, Pseudomonas putida KT2440
gucuuuuccccuuaua

SEQ ID NO: 1600122 - RNA, 14 nt, Pseudomonas putida KT2440
gucuucccauccac

SEQ ID NO: 1600123 - RNA, 22 nt, Pseudomonas putida KT2440
gucuucgcucacaaagcccuug

SEQ ID NO: 1600124 - RNA, 15 nt, Pseudomonas putida KT2440
gucuuggccgcaaug

SEQ ID NO: 1600125 - RNA, 12 nt, Pseudomonas putida KT2440
gucuucaaggcc

SEQ ID NO: 1600126 - RNA, 17 nt, Pseudomonas putida KT2440
gucuucagccaaggcgc

SEQ ID NO: 1600127 - RNA, 20 nt, Pseudomonas putida KT2440
gucuucaaucgucaugaucg

SEQ ID NO: 1600128 - RNA, 22 nt, Pseudomonas putida KT2440
gucuggcgcaggaagucuuccu

SEQ ID NO: 1600129 - RNA, 14 nt, Pseudomonas putida KT2440
gucuggcaucaaug

SEQ ID NO: 1600130 - RNA, 16 nt, Pseudomonas putida KT2440
gucugcuuugcagccc

SEQ ID NO: 1600131 - RNA, 19 nt, Pseudomonas putida KT2440
gucugcuuugcagcccuuc

SEQ ID NO: 1600132 - RNA, 14 nt, Pseudomonas putida KT2440
gucugcugcggccg

SEQ ID NO: 1600133 - RNA, 14 nt, Pseudomonas putida KT2440
gucuggcggcccug

SEQ ID NO: 1600134 - RNA, 13 nt, Pseudomonas putida KT2440
gucuguaagucgu

SEQ ID NO: 1600135 - RNA, 15 nt, Pseudomonas putida KT2440
gucugguuaccagag

SEQ ID NO: 1600136 - RNA, 15 nt, Pseudomonas putida KT2440
gucucgaacggcgcc

SEQ ID NO: 1600137 - RNA, 16 nt, Pseudomonas putida KT2440
gucucgaaccaguucg

SEQ ID NO: 1600138 - RNA, 17 nt, Pseudomonas putida KT2440
gucuccgugcucaggcg

SEQ ID NO: 1600139 - RNA, 17 nt, Pseudomonas putida KT2440
gucucgccaaacugcug

SEQ ID NO: 1600140 - RNA, 16 nt, Pseudomonas putida KT2440
gucucgcggcuggugu

SEQ ID NO: 1600141 - RNA, 14 nt, Pseudomonas putida KT2440
gucucguacgggug

SEQ ID NO: 1600142 - RNA, 18 nt, Pseudomonas putida KT2440
gucucugaacacaugcca

SEQ ID NO: 1600143 - RNA, 12 nt, Pseudomonas putida KT2440
gucugcaucauu

SEQ ID NO: 1600144 - RNA, 23 nt, Pseudomonas putida KT2440
gucucuuucaacagcuggcuggu

SEQ ID NO: 1600145 - RNA, 13 nt, Pseudomonas putida KT2440
gucugacagcagg

SEQ ID NO: 1600146 - RNA, 17 nt, Pseudomonas putida KT2440
gucugacagcaggaaca

SEQ ID NO: 1600147 - RNA, 18 nt, Pseudomonas putida KT2440
gucugacagcaggaacag

SEQ ID NO: 1600148 - RNA, 19 nt, Pseudomonas putida KT2440
gucugacagcaggaacagc

SEQ ID NO: 1600149 - RNA, 14 nt, Pseudomonas putida KT2440
gucugcgccugcug

SEQ ID NO: 1600150 - RNA, 17 nt, Pseudomonas putida KT2440
gucugccgcuucgucca

SEQ ID NO: 1600151 - RNA, 16 nt, Pseudomonas putida KT2440
gucugcccggccagca

SEQ ID NO: 1600152 - RNA, 18 nt, Pseudomonas putida KT2440
gucugcccggccagcagg

SEQ ID NO: 1600153 - RNA, 15 nt, Pseudomonas putida KT2440
gucugccgaagaacg

SEQ ID NO: 1600154 - RNA, 18 nt, Pseudomonas putida KT2440
gucugccgguaccacugc

SEQ ID NO: 1600155 - RNA, 19 nt, Pseudomonas putida KT2440
gucugccaguucaugcagc

SEQ ID NO: 1600156 - RNA, 17 nt, Pseudomonas putida KT2440
uaaaugguccccgcuuc

SEQ ID NO: 1600157 - RNA, 22 nt, Pseudomonas putida KT2440
uaaagguugacgcccucucgaa

SEQ ID NO: 1600158 - RNA, 16 nt, Pseudomonas putida KT2440
uaaagccagcagccug

SEQ ID NO: 1600159 - RNA, 19 nt, Pseudomonas putida KT2440
uaaagccagcagccugugc

SEQ ID NO: 1600160 - RNA, 22 nt, Pseudomonas putida KT2440
uaaaccagcagcgccugcagcg

SEQ ID NO: 1600161 - RNA, 22 nt, Pseudomonas putida KT2440
uaaacgugagacuuagucucga

SEQ ID NO: 1600162 - RNA, 18 nt, Pseudomonas putida KT2440
uaaacguggucagccacg

SEQ ID NO: 1600163 - RNA, 11 nt, Pseudomonas putida KT2440
uaaaccuucaa

SEQ ID NO: 1600164 - RNA, 22 nt, Pseudomonas putida KT2440
uaaacgaccggcuugucuucca

SEQ ID NO: 1600165 - RNA, 18 nt, Pseudomonas putida KT2440
uaaaccugccugauugcc

SEQ ID NO: 1600166 - RNA, 22 nt, Pseudomonas putida KT2440
uaacgacccggaaaauggucgg

SEQ ID NO: 1600167 - RNA, 18 nt, Pseudomonas putida KT2440
uaacgagccuuggccagc

SEQ ID NO: 1600168 - RNA, 20 nt, Pseudomonas putida KT2440
uaacgagccuuggccagcgu

SEQ ID NO: 1600169 - RNA, 14 nt, Pseudomonas putida KT2440
uaacgcuuggccag

SEQ ID NO: 1600170 - RNA, 22 nt, Pseudomonas putida KT2440
uaacgcuuggccagacucagcu

SEQ ID NO: 1600171 - RNA, 13 nt, Pseudomonas putida KT2440
uaacaugcuggcc

SEQ ID NO: 1600172 - RNA, 18 nt, Pseudomonas putida KT2440
uaaccauguugaaaauag

SEQ ID NO: 1600173 - RNA, 19 nt, Pseudomonas putida KT2440
guuuucuguugccuuacau

SEQ ID NO: 1600174 - RNA, 11 nt, Pseudomonas putida KT2440
guuuugcagcg

SEQ ID NO: 1600175 - RNA, 23 nt, Pseudomonas putida KT2440
uaaaaaaaccggccacgaaggcc

SEQ ID NO: 1600176 - RNA, 22 nt, Pseudomonas putida KT2440
guuuuuuggaggguuuuccuag

SEQ ID NO: 1600177 - RNA, 15 nt, Pseudomonas putida KT2440
uaaaagccaacugcu

SEQ ID NO: 1600178 - RNA, 12 nt, Pseudomonas putida KT2440
uaaaaacaacag

SEQ ID NO: 1600179 - RNA, 13 nt, Pseudomonas putida KT2440
uaaaacagccuug

SEQ ID NO: 1600180 - RNA, 13 nt, Pseudomonas putida KT2440
guuuuccauugca

SEQ ID NO: 1600181 - RNA, 12 nt, Pseudomonas putida KT2440
guuuucgcugau

SEQ ID NO: 1600182 - RNA, 22 nt, Pseudomonas putida KT2440
guuuucauaccgagaaugaaac

SEQ ID NO: 1600183 - RNA, 13 nt, Pseudomonas putida KT2440
guuugguuuuuuc

SEQ ID NO: 1600184 - RNA, 15 nt, Pseudomonas putida KT2440
guuugguuuuuucac

SEQ ID NO: 1600185 - RNA, 15 nt, Pseudomonas putida KT2440
guuucuugccuucca

SEQ ID NO: 1600186 - RNA, 20 nt, Pseudomonas putida KT2440
guuugcgaagguaaccuggu

SEQ ID NO: 1600187 - RNA, 18 nt, Pseudomonas putida KT2440
guuugcgagcgcgggcag

SEQ ID NO: 1600188 - RNA, 20 nt, Pseudomonas putida KT2440
guuugcaaggcugcuucaau

SEQ ID NO: 1600189 - RNA, 23 nt, Pseudomonas putida KT2440
guugucaggcacuaagcgaaaca

SEQ ID NO: 1600190 - RNA, 18 nt, Pseudomonas putida KT2440
guuguccaccccacccuc

SEQ ID NO: 1600191 - RNA, 13 nt, Pseudomonas putida KT2440
guugucgcugggu

SEQ ID NO: 1600192 - RNA, 17 nt, Pseudomonas putida KT2440
guucuuaucuggggugg

SEQ ID NO: 1600193 - RNA, 16 nt, Pseudomonas putida KT2440
guucugcuugaggccc

SEQ ID NO: 1600194 - RNA, 14 nt, Pseudomonas putida KT2440
guuguggugagccc

SEQ ID NO: 1600195 - RNA, 14 nt, Pseudomonas putida KT2440
guuguucagcagcg

SEQ ID NO: 1600196 - RNA, 21 nt, Pseudomonas putida KT2440
guuucaccugaccaucagccu

SEQ ID NO: 1600197 - RNA, 20 nt, Pseudomonas putida KT2440
guuucacccuugggcucagc

SEQ ID NO: 1600198 - RNA, 17 nt, Pseudomonas putida KT2440
guuuccagcccuuccac

SEQ ID NO: 1600199 - RNA, 19 nt, Pseudomonas putida KT2440
guuucggguaggucaccau

SEQ ID NO: 1600200 - RNA, 16 nt, Pseudomonas putida KT2440
guuucagccuuggccg

SEQ ID NO: 1600201 - RNA, 22 nt, Pseudomonas putida KT2440
guuucagcagcguugcauucca

SEQ ID NO: 1600202 - RNA, 21 nt, Pseudomonas putida KT2440
uauuuuccugaguuagacauu

SEQ ID NO: 1600203 - RNA, 20 nt, Pseudomonas putida KT2440
ucaaauacucagaccaacaa

SEQ ID NO: 1600204 - RNA, 23 nt, Pseudomonas putida KT2440
ucaaauagaccucgagaauccgu

SEQ ID NO: 1600205 - RNA, 19 nt, Pseudomonas putida KT2440
ucaaccaggcgcagcagcu

SEQ ID NO: 1600206 - RNA, 14 nt, Pseudomonas putida KT2440
ucaaccagccgccu

SEQ ID NO: 1600207 - RNA, 23 nt, Pseudomonas putida KT2440
ucaaccccaggugcugaugccca

SEQ ID NO: 1600208 - RNA, 13 nt, Pseudomonas putida KT2440
ucaaccccaucac

SEQ ID NO: 1600209 - RNA, 13 nt, Pseudomonas putida KT2440
ucaaccaacuccu

SEQ ID NO: 1600210 - RNA, 14 nt, Pseudomonas putida KT2440
ucaaccacagcccg

SEQ ID NO: 1600211 - RNA, 15 nt, Pseudomonas putida KT2440
ucaaccaccgcucaa

SEQ ID NO: 1600212 - RNA, 14 nt, Pseudomonas putida KT2440
ucaacacugucccg

SEQ ID NO: 1600213 - RNA, 12 nt, Pseudomonas putida KT2440
ucaacaccaacu

SEQ ID NO: 1600214 - RNA, 15 nt, Pseudomonas putida KT2440
ucaacaccagacuca

SEQ ID NO: 1600215 - RNA, 19 nt, Pseudomonas putida KT2440
ucaacaggcuggccgacgu

SEQ ID NO: 1600216 - RNA, 14 nt, Pseudomonas putida KT2440
ucaacagcuggcug

SEQ ID NO: 1600217 - RNA, 20 nt, Pseudomonas putida KT2440
ucaacagccgcggcacccaa

SEQ ID NO: 1600218 - RNA, 22 nt, Pseudomonas putida KT2440
ucaacagcgcgacgcagcagcg

SEQ ID NO: 1600219 - RNA, 16 nt, Pseudomonas putida KT2440
ucaacagccacgcccg

SEQ ID NO: 1600220 - RNA, 12 nt, Pseudomonas putida KT2440
ucaaaugccccc

SEQ ID NO: 1600221 - RNA, 17 nt, Pseudomonas putida KT2440
ucaacuccauggccagg

SEQ ID NO: 1600222 - RNA, 15 nt, Pseudomonas putida KT2440
ucaacucggcaguga

SEQ ID NO: 1600223 - RNA, 17 nt, Pseudomonas putida KT2440
ucaacucggcagugaac

SEQ ID NO: 1600224 - RNA, 22 nt, Pseudomonas putida KT2440
ucaacuggcaggguucgcuguc

SEQ ID NO: 1600225 - RNA, 17 nt, Pseudomonas putida KT2440
ucaacguucauccccuc

SEQ ID NO: 1600226 - RNA, 17 nt, Pseudomonas putida KT2440
ucaacguucccaauguc

SEQ ID NO: 1600227 - RNA, 19 nt, Pseudomonas putida KT2440
ucaaccgugguucuugccg

SEQ ID NO: 1600228 - RNA, 22 nt, Pseudomonas putida KT2440
ucaaccgccuccacggucagca

SEQ ID NO: 1600229 - RNA, 15 nt, Pseudomonas putida KT2440
ucaaccgcacccgca

SEQ ID NO: 1600230 - RNA, 19 nt, Pseudomonas putida KT2440
ucaacgccaucaggcagcu

SEQ ID NO: 1600231 - RNA, 18 nt, Pseudomonas putida KT2440
ucaacgccgccagcggcu

SEQ ID NO: 1600232 - RNA, 14 nt, Pseudomonas putida KT2440
ucaagaaauugcag

SEQ ID NO: 1600233 - RNA, 21 nt, Pseudomonas putida KT2440
ucaagaaaucgggucaucccc

SEQ ID NO: 1600234 - RNA, 16 nt, Pseudomonas putida KT2440
ucaacuucccucugcc

SEQ ID NO: 1600235 - RNA, 22 nt, Pseudomonas putida KT2440
ucaacuucccucugccugccca

SEQ ID NO: 1600236 - RNA, 19 nt, Pseudomonas putida KT2440
uauuuagucaggguguccg

SEQ ID NO: 1600237 - RNA, 14 nt, Pseudomonas putida KT2440
uauuucaaagaucu

SEQ ID NO: 1600238 - RNA, 21 nt, Pseudomonas putida KT2440
uauuucaaagaucucgggugc

SEQ ID NO: 1600239 - RNA, 18 nt, Pseudomonas putida KT2440
uauucgcuaaccucugca

SEQ ID NO: 1600240 - RNA, 20 nt, Pseudomonas putida KT2440
uauucuucuggcuuucuggc

SEQ ID NO: 1600241 - RNA, 18 nt, Pseudomonas putida KT2440
uauucagugcgcagguac

SEQ ID NO: 1600242 - RNA, 22 nt, Pseudomonas putida KT2440
ucacacagcggcagacacaggc

SEQ ID NO: 1600243 - RNA, 20 nt, Pseudomonas putida KT2440
ucacaacgcgcaucccuugu

SEQ ID NO: 1600244 - RNA, 12 nt, Pseudomonas putida KT2440
ucacaccggccg

SEQ ID NO: 1600245 - RNA, 19 nt, Pseudomonas putida KT2440
ucacaccggccuuggccag

SEQ ID NO: 1600246 - RNA, 14 nt, Pseudomonas putida KT2440
ucacacucgccagg

SEQ ID NO: 1600247 - RNA, 22 nt, Pseudomonas putida KT2440
ucacacucgcccccaucgcagg

SEQ ID NO: 1600248 - RNA, 16 nt, Pseudomonas putida KT2440
ucacagcgccgcggcc

SEQ ID NO: 1600249 - RNA, 18 nt, Pseudomonas putida KT2440
ucacauaaggcagcagcu

SEQ ID NO: 1600250 - RNA, 20 nt, Pseudomonas putida KT2440
ucacaugcgccacacccgcu

SEQ ID NO: 1600251 - RNA, 23 nt, Pseudomonas putida KT2440
ucacauccaccgcucgcgccgcc

SEQ ID NO: 1600252 - RNA, 21 nt, Pseudomonas putida KT2440
ucacauccuuggucauggcac

SEQ ID NO: 1600253 - RNA, 16 nt, Pseudomonas putida KT2440
ucacaucaacuguuca

SEQ ID NO: 1600254 - RNA, 13 nt, Pseudomonas putida KT2440
ucacauccacagc

SEQ ID NO: 1600255 - RNA, 18 nt, Pseudomonas putida KT2440
ucaccacaaaaccuucca

SEQ ID NO: 1600256 - RNA, 21 nt, Pseudomonas putida KT2440
ucaccaguauugcgucaggcu

SEQ ID NO: 1600257 - RNA, 12 nt, Pseudomonas putida KT2440
ucaccagggcau

SEQ ID NO: 1600258 - RNA, 12 nt, Pseudomonas putida KT2440
ucaccagcagcu

SEQ ID NO: 1600259 - RNA, 14 nt, Pseudomonas putida KT2440
ucaccagcagcuuc

SEQ ID NO: 1600260 - RNA, 12 nt, Pseudomonas putida KT2440
ucaccagccagg

SEQ ID NO: 1600261 - RNA, 14 nt, Pseudomonas putida KT2440
ucaccagccaggca

SEQ ID NO: 1600262 - RNA, 16 nt, Pseudomonas putida KT2440
ucaccagccaggcaca

SEQ ID NO: 1600263 - RNA, 12 nt, Pseudomonas putida KT2440
ucaccagccccu

SEQ ID NO: 1600264 - RNA, 20 nt, Pseudomonas putida KT2440
ucaccagccccucaggcaca

SEQ ID NO: 1600265 - RNA, 19 nt, Pseudomonas putida KT2440
ucaccaccgucgaagcccg

SEQ ID NO: 1600266 - RNA, 15 nt, Pseudomonas putida KT2440
ucaccaccaggugcu

SEQ ID NO: 1600267 - RNA, 11 nt, Pseudomonas putida KT2440
ucaccaccauc

SEQ ID NO: 1600268 - RNA, 12 nt, Pseudomonas putida KT2440
ucacccagcacu

SEQ ID NO: 1600269 - RNA, 12 nt, Pseudomonas putida KT2440
ucacccagcgcu

SEQ ID NO: 1600270 - RNA, 20 nt, Pseudomonas putida KT2440
ucacccaggugcaacccggc

SEQ ID NO: 1600271 - RNA, 13 nt, Pseudomonas putida KT2440
ucacccagucacc

SEQ ID NO: 1600272 - RNA, 15 nt, Pseudomonas putida KT2440
ucacccagucaccuu

SEQ ID NO: 1600273 - RNA, 16 nt, Pseudomonas putida KT2440
ucacccagucaccuug

SEQ ID NO: 1600274 - RNA, 22 nt, Pseudomonas putida KT2440
ucacccaccagccaaacccggc

SEQ ID NO: 1600275 - RNA, 14 nt, Pseudomonas putida KT2440
ucaccaugggccug

SEQ ID NO: 1600276 - RNA, 16 nt, Pseudomonas putida KT2440
ucaccaugggccugga

SEQ ID NO: 1600277 - RNA, 19 nt, Pseudomonas putida KT2440
ucaccaucagccgcgggcu

SEQ ID NO: 1600278 - RNA, 13 nt, Pseudomonas putida KT2440
ucaccaucaagcc

SEQ ID NO: 1600279 - RNA, 20 nt, Pseudomonas putida KT2440
ucaccggcgaguccugccuu

SEQ ID NO: 1600280 - RNA, 15 nt, Pseudomonas putida KT2440
ucaccgcccgcgccg

SEQ ID NO: 1600281 - RNA, 13 nt, Pseudomonas putida KT2440
ucaccgccccagc

SEQ ID NO: 1600282 - RNA, 12 nt, Pseudomonas putida KT2440
ucaccgccgccc

SEQ ID NO: 1600283 - RNA, 18 nt, Pseudomonas putida KT2440
ucaccggcaaagcugauc

SEQ ID NO: 1600284 - RNA, 15 nt, Pseudomonas putida KT2440
ucaccggcaccugcu

SEQ ID NO: 1600285 - RNA, 21 nt, Pseudomonas putida KT2440
ucaccgcgucgauacgcugcu

SEQ ID NO: 1600286 - RNA, 17 nt, Pseudomonas putida KT2440
ucaccgcgcccaagguc

SEQ ID NO: 1600287 - RNA, 14 nt, Pseudomonas putida KT2440
ucaccgacccacag

SEQ ID NO: 1600288 - RNA, 22 nt, Pseudomonas putida KT2440
ucacccuggucacgcaguucgu

SEQ ID NO: 1600289 - RNA, 15 nt, Pseudomonas putida KT2440
ucacccuuggccacc

SEQ ID NO: 1600290 - RNA, 21 nt, Pseudomonas putida KT2440
ucacccuuggcgcaagcgcuc

SEQ ID NO: 1600291 - RNA, 12 nt, Pseudomonas putida KT2440
ucacccuugggc

SEQ ID NO: 1600292 - RNA, 21 nt, Pseudomonas putida KT2440
ucaccgagcugcccaaguaca

SEQ ID NO: 1600293 - RNA, 21 nt, Pseudomonas putida KT2440
ucaccgagugcccgcgcagga

SEQ ID NO: 1600294 - RNA, 18 nt, Pseudomonas putida KT2440
ucaccgcaagcugcaccg

SEQ ID NO: 1600295 - RNA, 22 nt, Pseudomonas putida KT2440
ucaccgcagcccagcgccgccg

SEQ ID NO: 1600296 - RNA, 23 nt, Pseudomonas putida KT2440
ucacccgcgaaugcuacagaagc

SEQ ID NO: 1600297 - RNA, 16 nt, Pseudomonas putida KT2440
ucacccgcuugccacg

SEQ ID NO: 1600298 - RNA, 19 nt, Pseudomonas putida KT2440
ucacccucgcgcagcaucu

SEQ ID NO: 1600299 - RNA, 17 nt, Pseudomonas putida KT2440
ucacccgcaccucacaa

SEQ ID NO: 1600300 - RNA, 16 nt, Pseudomonas putida KT2440
ucaccccguggccccg

SEQ ID NO: 1600301 - RNA, 17 nt, Pseudomonas putida KT2440
ucaccccguucgcccug

SEQ ID NO: 1600302 - RNA, 15 nt, Pseudomonas putida KT2440
ucaccccguacaccc

SEQ ID NO: 1600303 - RNA, 17 nt, Pseudomonas putida KT2440
ucaccccguagcgcuuc

SEQ ID NO: 1600304 - RNA, 15 nt, Pseudomonas putida KT2440
ucaccccgccccugc

SEQ ID NO: 1600305 - RNA, 16 nt, Pseudomonas putida KT2440
ucaccccgccccugcu

SEQ ID NO: 1600306 - RNA, 15 nt, Pseudomonas putida KT2440
ucaaugcugccuccg

SEQ ID NO: 1600307 - RNA, 19 nt, Pseudomonas putida KT2440
ucaaugucgagcaugauca

SEQ ID NO: 1600308 - RNA, 15 nt, Pseudomonas putida KT2440
ucaaggccagcgccu

SEQ ID NO: 1600309 - RNA, 12 nt, Pseudomonas putida KT2440
ucaaggucacgg

SEQ ID NO: 1600310 - RNA, 19 nt, Pseudomonas putida KT2440
ucaagccugcgcaggcgcc

SEQ ID NO: 1600311 - RNA, 17 nt, Pseudomonas putida KT2440
ucaagcgccagggcauc

SEQ ID NO: 1600312 - RNA, 12 nt, Pseudomonas putida KT2440
ucaagcuggaug

SEQ ID NO: 1600313 - RNA, 13 nt, Pseudomonas putida KT2440
ucaagcucuuccu

SEQ ID NO: 1600314 - RNA, 17 nt, Pseudomonas putida KT2440
ucaagcuccccagcaac

SEQ ID NO: 1600315 - RNA, 21 nt, Pseudomonas putida KT2440
ucaagcuccccagcaacggau

SEQ ID NO: 1600316 - RNA, 22 nt, Pseudomonas putida KT2440
ucaagcucgaagcgcucaugca

SEQ ID NO: 1600317 - RNA, 18 nt, Pseudomonas putida KT2440
ucaaucacauccacagcc

SEQ ID NO: 1600318 - RNA, 22 nt, Pseudomonas putida KT2440
ucaaucaaccagcccgccgcca

SEQ ID NO: 1600319 - RNA, 22 nt, Pseudomonas putida KT2440
ucacugcagaucaccagcucgc

SEQ ID NO: 1600320 - RNA, 17 nt, Pseudomonas putida KT2440
ucacugcaccucccgcc

SEQ ID NO: 1600321 - RNA, 22 nt, Pseudomonas putida KT2440
ucacugacaaagccugcaccca

SEQ ID NO: 1600322 - RNA, 14 nt, Pseudomonas putida KT2440
ucacugaacgcaau

SEQ ID NO: 1600323 - RNA, 15 nt, Pseudomonas putida KT2440
ucacuggcugcugcg

SEQ ID NO: 1600324 - RNA, 19 nt, Pseudomonas putida KT2440
ucacuggccagcagggccg

SEQ ID NO: 1600325 - RNA, 13 nt, Pseudomonas putida KT2440
ucacuuccaggcc

SEQ ID NO: 1600326 - RNA, 13 nt, Pseudomonas putida KT2440
ucacuucauccag

SEQ ID NO: 1600327 - RNA, 17 nt, Pseudomonas putida KT2440
ucacuucauccagccgg

SEQ ID NO: 1600328 - RNA, 17 nt, Pseudomonas putida KT2440
ucacuucuuucagcuca

SEQ ID NO: 1600329 - RNA, 14 nt, Pseudomonas putida KT2440
ucacuuucugcgcu

SEQ ID NO: 1600330 - RNA, 18 nt, Pseudomonas putida KT2440
ucacuuucuugaaauuaa

SEQ ID NO: 1600331 - RNA, 18 nt, Pseudomonas putida KT2440
ucacuccugguuggccag

SEQ ID NO: 1600332 - RNA, 19 nt, Pseudomonas putida KT2440
ucacucugccgccccucca

SEQ ID NO: 1600333 - RNA, 15 nt, Pseudomonas putida KT2440
ucacuacaugcggcc

SEQ ID NO: 1600334 - RNA, 19 nt, Pseudomonas putida KT2440
ucacguagaacaggccugc

SEQ ID NO: 1600335 - RNA, 16 nt, Pseudomonas putida KT2440
ucacguccagccacuu

SEQ ID NO: 1600336 - RNA, 21 nt, Pseudomonas putida KT2440
ucacgucuggcaccaguucca

SEQ ID NO: 1600337 - RNA, 17 nt, Pseudomonas putida KT2440
ucacguuguagcccacc

SEQ ID NO: 1600338 - RNA, 19 nt, Pseudomonas putida KT2440
ucacguuguagcccaccac

SEQ ID NO: 1600339 - RNA, 13 nt, Pseudomonas putida KT2440
ucacguuugcaaa

SEQ ID NO: 1600340 - RNA, 22 nt, Pseudomonas putida KT2440
ucaccuugcuggaacugcugca

SEQ ID NO: 1600341 - RNA, 12 nt, Pseudomonas putida KT2440
ucaccuuggccg

SEQ ID NO: 1600342 - RNA, 15 nt, Pseudomonas putida KT2440
ucacgaacaccagcc

SEQ ID NO: 1600343 - RNA, 18 nt, Pseudomonas putida KT2440
ucacgaacaccagcccca

SEQ ID NO: 1600344 - RNA, 22 nt, Pseudomonas putida KT2440
ucacgaaccugugaagccaggg

SEQ ID NO: 1600345 - RNA, 13 nt, Pseudomonas putida KT2440
ucaccugcggccu

SEQ ID NO: 1600346 - RNA, 13 nt, Pseudomonas putida KT2440
ucaccuggccgug

SEQ ID NO: 1600347 - RNA, 15 nt, Pseudomonas putida KT2440
ucaccugguuugagg

SEQ ID NO: 1600348 - RNA, 19 nt, Pseudomonas putida KT2440
ucaccucgguaaaggugcc

SEQ ID NO: 1600349 - RNA, 23 nt, Pseudomonas putida KT2440
ucacgcaacucuaccucacugac

SEQ ID NO: 1600350 - RNA, 17 nt, Pseudomonas putida KT2440
ucacgcaagcggcccug

SEQ ID NO: 1600351 - RNA, 12 nt, Pseudomonas putida KT2440
ucacgcagggcc

SEQ ID NO: 1600352 - RNA, 22 nt, Pseudomonas putida KT2440
ucacgcagagcauggucaugcc

SEQ ID NO: 1600353 - RNA, 20 nt, Pseudomonas putida KT2440
ucacgccccuuggcacggcc

SEQ ID NO: 1600354 - RNA, 16 nt, Pseudomonas putida KT2440
ucacgcccgggccagg

SEQ ID NO: 1600355 - RNA, 17 nt, Pseudomonas putida KT2440
ucacgcccgggccaggc

SEQ ID NO: 1600356 - RNA, 18 nt, Pseudomonas putida KT2440
ucacgcccaucaggaaca

SEQ ID NO: 1600357 - RNA, 21 nt, Pseudomonas putida KT2440
ucacgcccaucaggaacagcu

SEQ ID NO: 1600358 - RNA, 17 nt, Pseudomonas putida KT2440
ucacgccauccccccag

SEQ ID NO: 1600359 - RNA, 15 nt, Pseudomonas putida KT2440
ucacgcaucugcgcu

SEQ ID NO: 1600360 - RNA, 16 nt, Pseudomonas putida KT2440
ucacgguuucacccuu

SEQ ID NO: 1600361 - RNA, 19 nt, Pseudomonas putida KT2440
ucacggguauagccaugca

SEQ ID NO: 1600362 - RNA, 16 nt, Pseudomonas putida KT2440
ucacggccauccugcu

SEQ ID NO: 1600363 - RNA, 22 nt, Pseudomonas putida KT2440
ucacggcgcaggccgacaacag

SEQ ID NO: 1600364 - RNA, 17 nt, Pseudomonas putida KT2440
ucacgcgccacauagcu

SEQ ID NO: 1600365 - RNA, 22 nt, Pseudomonas putida KT2440
ucacgcucguuguccagcagca

SEQ ID NO: 1600366 - RNA, 13 nt, Pseudomonas putida KT2440
ucacgcucaugcu

SEQ ID NO: 1600367 - RNA, 19 nt, Pseudomonas putida KT2440
ucagacgcggaacuggcug

SEQ ID NO: 1600368 - RNA, 22 nt, Pseudomonas putida KT2440
ucagaccuccgucugcucugcc

SEQ ID NO: 1600369 - RNA, 14 nt, Pseudomonas putida KT2440
ucagacuccuuuga

SEQ ID NO: 1600370 - RNA, 23 nt, Pseudomonas putida KT2440
ucagagcgguagggcguucagca

SEQ ID NO: 1600371 - RNA, 12 nt, Pseudomonas putida KT2440
ucagagcgccag

SEQ ID NO: 1600372 - RNA, 19 nt, Pseudomonas putida KT2440
ucagagcgccagcaagcgc

SEQ ID NO: 1600373 - RNA, 15 nt, Pseudomonas putida KT2440
ucagacuuuccugaa

SEQ ID NO: 1600374 - RNA, 17 nt, Pseudomonas putida KT2440
ucagacuuugcggacga

SEQ ID NO: 1600375 - RNA, 15 nt, Pseudomonas putida KT2440
ucagauacugcaccc

SEQ ID NO: 1600376 - RNA, 16 nt, Pseudomonas putida KT2440
ucagauuacgcgucau

SEQ ID NO: 1600377 - RNA, 20 nt, Pseudomonas putida KT2440
ucagcaaaccgaccaggcag

SEQ ID NO: 1600378 - RNA, 18 nt, Pseudomonas putida KT2440
ucagaucacccuuggcca

SEQ ID NO: 1600379 - RNA, 14 nt, Pseudomonas putida KT2440
ucagccaggguuuc

SEQ ID NO: 1600380 - RNA, 23 nt, Pseudomonas putida KT2440
ucagccagccuucgccaacugca

SEQ ID NO: 1600381 - RNA, 17 nt, Pseudomonas putida KT2440
ucagccagacgaccagc

SEQ ID NO: 1600382 - RNA, 20 nt, Pseudomonas putida KT2440
ucagccacgcuggcacccac

SEQ ID NO: 1600383 - RNA, 20 nt, Pseudomonas putida KT2440
ucagccaccgcacucugcug

SEQ ID NO: 1600384 - RNA, 22 nt, Pseudomonas putida KT2440
ucagccaccgcacucugcugcu

SEQ ID NO: 1600385 - RNA, 22 nt, Pseudomonas putida KT2440
ucagccaugggcaggucgaccc

SEQ ID NO: 1600386 - RNA, 22 nt, Pseudomonas putida KT2440
ucagccagugcugccugcugca

SEQ ID NO: 1600387 - RNA, 14 nt, Pseudomonas putida KT2440
ucagccacauugau

SEQ ID NO: 1600388 - RNA, 18 nt, Pseudomonas putida KT2440
ucagccaaccgccccacc

SEQ ID NO: 1600389 - RNA, 20 nt, Pseudomonas putida KT2440
ucagccaaccgccccaccca

SEQ ID NO: 1600390 - RNA, 15 nt, Pseudomonas putida KT2440
ucagccaaaucagcu

SEQ ID NO: 1600391 - RNA, 20 nt, Pseudomonas putida KT2440
ucagccaaggcgcauccucg

SEQ ID NO: 1600392 - RNA, 14 nt, Pseudomonas putida KT2440
ucagcaugcccagc

SEQ ID NO: 1600393 - RNA, 15 nt, Pseudomonas putida KT2440
ucagcaucagugcag

SEQ ID NO: 1600394 - RNA, 13 nt, Pseudomonas putida KT2440
ucagccucgguca

SEQ ID NO: 1600395 - RNA, 18 nt, Pseudomonas putida KT2440
ucagccguuggagcagcc

SEQ ID NO: 1600396 - RNA, 11 nt, Pseudomonas putida KT2440
ucagccuucag

SEQ ID NO: 1600397 - RNA, 12 nt, Pseudomonas putida KT2440
ucagccuucaga

SEQ ID NO: 1600398 - RNA, 20 nt, Pseudomonas putida KT2440
ucagccuucagugcuucaca

SEQ ID NO: 1600399 - RNA, 16 nt, Pseudomonas putida KT2440
ucagccuuuuccagcu

SEQ ID NO: 1600400 - RNA, 20 nt, Pseudomonas putida KT2440
ucagcccugagggcucaucc

SEQ ID NO: 1600401 - RNA, 15 nt, Pseudomonas putida KT2440
ucagccgauacgcug

SEQ ID NO: 1600402 - RNA, 18 nt, Pseudomonas putida KT2440
ucagccgcugcgccugcc

SEQ ID NO: 1600403 - RNA, 17 nt, Pseudomonas putida KT2440
ucagcccuugcucggcc

SEQ ID NO: 1600404 - RNA, 15 nt, Pseudomonas putida KT2440
ucagcccuugcugca

SEQ ID NO: 1600405 - RNA, 18 nt, Pseudomonas putida KT2440
ucagcccuugcugcagca

SEQ ID NO: 1600406 - RNA, 22 nt, Pseudomonas putida KT2440
ucagcccuugcugcagcaggcu

SEQ ID NO: 1600407 - RNA, 22 nt, Pseudomonas putida KT2440
ucagcccauuucaccugcucug

SEQ ID NO: 1600408 - RNA, 19 nt, Pseudomonas putida KT2440
ucagcaccagcucauccau

SEQ ID NO: 1600409 - RNA, 20 nt, Pseudomonas putida KT2440
ucagcacaccgcucaaccuu

SEQ ID NO: 1600410 - RNA, 21 nt, Pseudomonas putida KT2440
ucagcaccugggcgucaucac

SEQ ID NO: 1600411 - RNA, 22 nt, Pseudomonas putida KT2440
ucagcaaccucgagguacgagu

SEQ ID NO: 1600412 - RNA, 21 nt, Pseudomonas putida KT2440
ucagcaagaccagaaacccag

SEQ ID NO: 1600413 - RNA, 19 nt, Pseudomonas putida KT2440
ucagcaacccggccaggcc

SEQ ID NO: 1600414 - RNA, 20 nt, Pseudomonas putida KT2440
ucagcaaccacgcuuggcuc

SEQ ID NO: 1600415 - RNA, 20 nt, Pseudomonas putida KT2440
ucagcagcuucagccagggc

SEQ ID NO: 1600416 - RNA, 21 nt, Pseudomonas putida KT2440
ucagcagguugaacagcagcg

SEQ ID NO: 1600417 - RNA, 15 nt, Pseudomonas putida KT2440
ucagcaguggcucca

SEQ ID NO: 1600418 - RNA, 23 nt, Pseudomonas putida KT2440
uagauguccagcgucugcuugcc

SEQ ID NO: 1600419 - RNA, 16 nt, Pseudomonas putida KT2440
uagcccaccaccuucu

SEQ ID NO: 1600420 - RNA, 23 nt, Pseudomonas putida KT2440
uagcccaccaccuucucacugau

SEQ ID NO: 1600421 - RNA, 21 nt, Pseudomonas putida KT2440
uagcagguaaacccgcgccug

SEQ ID NO: 1600422 - RNA, 22 nt, Pseudomonas putida KT2440
uagcagguacgcgcaggcagcu

SEQ ID NO: 1600423 - RNA, 14 nt, Pseudomonas putida KT2440
uagcagcgcuaugc

SEQ ID NO: 1600424 - RNA, 21 nt, Pseudomonas putida KT2440
uagcugggcccgcccagcugg

SEQ ID NO: 1600425 - RNA, 17 nt, Pseudomonas putida KT2440
uaggcccagcccagccc

SEQ ID NO: 1600426 - RNA, 19 nt, Pseudomonas putida KT2440
uaggcgggagagcagggcu

SEQ ID NO: 1600427 - RNA, 18 nt, Pseudomonas putida KT2440
uaggcgucuuccacgccc

SEQ ID NO: 1600428 - RNA, 23 nt, Pseudomonas putida KT2440
uaggcacucggucggcuggcacu

SEQ ID NO: 1600429 - RNA, 21 nt, Pseudomonas putida KT2440
uagcgcccgggcaucaucaaa

SEQ ID NO: 1600430 - RNA, 12 nt, Pseudomonas putida KT2440
uagcccugcccu

SEQ ID NO: 1600431 - RNA, 18 nt, Pseudomonas putida KT2440
uagcgcagccuugucucu

SEQ ID NO: 1600432 - RNA, 18 nt, Pseudomonas putida KT2440
uagcgguacagcacccag

SEQ ID NO: 1600433 - RNA, 12 nt, Pseudomonas putida KT2440
uagcggcugggc

SEQ ID NO: 1600434 - RNA, 14 nt, Pseudomonas putida KT2440
uagcgcuuucuggu

SEQ ID NO: 1600435 - RNA, 13 nt, Pseudomonas putida KT2440
uaguccugcagcg

SEQ ID NO: 1600436 - RNA, 14 nt, Pseudomonas putida KT2440
uagucaucuguaag

SEQ ID NO: 1600437 - RNA, 15 nt, Pseudomonas putida KT2440
uaguccagcaacucc

SEQ ID NO: 1600438 - RNA, 16 nt, Pseudomonas putida KT2440
uaguccagcaacuccc

SEQ ID NO: 1600439 - RNA, 16 nt, Pseudomonas putida KT2440
uaguacuccagcagcg

SEQ ID NO: 1600440 - RNA, 15 nt, Pseudomonas putida KT2440
uaguagcuccagccc

SEQ ID NO: 1600441 - RNA, 13 nt, Pseudomonas putida KT2440
uagugcaccaacg

SEQ ID NO: 1600442 - RNA, 17 nt, Pseudomonas putida KT2440
uaguucuggcugccuuc

SEQ ID NO: 1600443 - RNA, 16 nt, Pseudomonas putida KT2440
uaguucaucuucuugc

SEQ ID NO: 1600444 - RNA, 15 nt, Pseudomonas putida KT2440
uaguugaccagcacc

SEQ ID NO: 1600445 - RNA, 17 nt, Pseudomonas putida KT2440
uaguugaccagcaccag

SEQ ID NO: 1600446 - RNA, 20 nt, Pseudomonas putida KT2440
uaguugaccgugaucaucag

SEQ ID NO: 1600447 - RNA, 17 nt, Pseudomonas putida KT2440
uaucucaggccaguucc

SEQ ID NO: 1600448 - RNA, 18 nt, Pseudomonas putida KT2440
uauccgcuuugcuugagu

SEQ ID NO: 1600449 - RNA, 21 nt, Pseudomonas putida KT2440
uaucacgcuccugcaugccuu

SEQ ID NO: 1600450 - RNA, 20 nt, Pseudomonas putida KT2440
uauagucagaaaguuugguu

SEQ ID NO: 1600451 - RNA, 21 nt, Pseudomonas putida KT2440
uaugccggccccguauaccca

SEQ ID NO: 1600452 - RNA, 17 nt, Pseudomonas putida KT2440
uaugccggucagcagca

SEQ ID NO: 1600453 - RNA, 21 nt, Pseudomonas putida KT2440
uaugccgccguucaggcgccu

SEQ ID NO: 1600454 - RNA, 16 nt, Pseudomonas putida KT2440
uaugccaccuguugcc

SEQ ID NO: 1600455 - RNA, 17 nt, Pseudomonas putida KT2440
uaugcgugcauguccug

SEQ ID NO: 1600456 - RNA, 18 nt, Pseudomonas putida KT2440
uauggcgcuuucacuggc

SEQ ID NO: 1600457 - RNA, 16 nt, Pseudomonas putida KT2440
uauggccgagcaggag

SEQ ID NO: 1600458 - RNA, 18 nt, Pseudomonas putida KT2440
uauggccgagcaggagcu

SEQ ID NO: 1600459 - RNA, 21 nt, Pseudomonas putida KT2440
uaugggcuucggaacuaaacc

SEQ ID NO: 1600460 - RNA, 21 nt, Pseudomonas putida KT2440
uaugguugucgaacagcaucc

SEQ ID NO: 1600461 - RNA, 23 nt, Pseudomonas putida KT2440
uaucugccgaugcgcgugcauuu

SEQ ID NO: 1600462 - RNA, 18 nt, Pseudomonas putida KT2440
uaugauucgccucccgcu

SEQ ID NO: 1600463 - RNA, 21 nt, Pseudomonas putida KT2440
uacuggcuucgaugaaggcug

SEQ ID NO: 1600464 - RNA, 23 nt, Pseudomonas putida KT2440
uacuggccaauugcgccaucaga

SEQ ID NO: 1600465 - RNA, 15 nt, Pseudomonas putida KT2440
uacugcuucaugaag

SEQ ID NO: 1600466 - RNA, 16 nt, Pseudomonas putida KT2440
uacuuauaagcagcaa

SEQ ID NO: 1600467 - RNA, 22 nt, Pseudomonas putida KT2440
uacuuggcgccgcccuggaugc

SEQ ID NO: 1600468 - RNA, 18 nt, Pseudomonas putida KT2440
uacuugugugccugcucc

SEQ ID NO: 1600469 - RNA, 22 nt, Pseudomonas putida KT2440
uacugcuucaugaagucagcca

SEQ ID NO: 1600470 - RNA, 12 nt, Pseudomonas putida KT2440
uacugcuuccag

SEQ ID NO: 1600471 - RNA, 16 nt, Pseudomonas putida KT2440
uacugcugggucagca

SEQ ID NO: 1600472 - RNA, 21 nt, Pseudomonas putida KT2440
uacugcgccggccaaguggcc

SEQ ID NO: 1600473 - RNA, 13 nt, Pseudomonas putida KT2440
uacuccagcagcg

SEQ ID NO: 1600474 - RNA, 13 nt, Pseudomonas putida KT2440
uacuccacuucca

SEQ ID NO: 1600475 - RNA, 22 nt, Pseudomonas putida KT2440
uacucggcuacgaaccgagcgg

SEQ ID NO: 1600476 - RNA, 21 nt, Pseudomonas putida KT2440
uacuccugcaccaugauguuc

SEQ ID NO: 1600477 - RNA, 15 nt, Pseudomonas putida KT2440
uacucacccgcuugc

SEQ ID NO: 1600478 - RNA, 17 nt, Pseudomonas putida KT2440
uacucacccgcuugcca

SEQ ID NO: 1600479 - RNA, 23 nt, Pseudomonas putida KT2440
uaccccuccggccccggugcauc

SEQ ID NO: 1600480 - RNA, 15 nt, Pseudomonas putida KT2440
uaccccccugcacca

SEQ ID NO: 1600481 - RNA, 13 nt, Pseudomonas putida KT2440
uacccaauaaaaa

SEQ ID NO: 1600482 - RNA, 14 nt, Pseudomonas putida KT2440
uacccaccagcucc

SEQ ID NO: 1600483 - RNA, 17 nt, Pseudomonas putida KT2440
uaccccaggcaaaaaaa

SEQ ID NO: 1600484 - RNA, 12 nt, Pseudomonas putida KT2440
uacccuuccugg

SEQ ID NO: 1600485 - RNA, 18 nt, Pseudomonas putida KT2440
uacccuuugccauccacc

SEQ ID NO: 1600486 - RNA, 21 nt, Pseudomonas putida KT2440
uaccgccaguagcaaucaggu

SEQ ID NO: 1600487 - RNA, 17 nt, Pseudomonas putida KT2440
uaccgcaucccaaugug

SEQ ID NO: 1600488 - RNA, 21 nt, Pseudomonas putida KT2440
uaccgauugccucaggcccca

SEQ ID NO: 1600489 - RNA, 20 nt, Pseudomonas putida KT2440
uaccgcaacaccugccgcag

SEQ ID NO: 1600490 - RNA, 20 nt, Pseudomonas putida KT2440
uaccggugccccgguccagc

SEQ ID NO: 1600491 - RNA, 17 nt, Pseudomonas putida KT2440
uaccgggcggccaccgg

SEQ ID NO: 1600492 - RNA, 23 nt, Pseudomonas putida KT2440
uaccgggcggccaccggccacgc

SEQ ID NO: 1600493 - RNA, 19 nt, Pseudomonas putida KT2440
uaccacuuccaacacccgg

SEQ ID NO: 1600494 - RNA, 15 nt, Pseudomonas putida KT2440
uaccaccugggcgcu

SEQ ID NO: 1600495 - RNA, 15 nt, Pseudomonas putida KT2440
uaccaggcccaacag

SEQ ID NO: 1600496 - RNA, 19 nt, Pseudomonas putida KT2440
uaccaggccuuucugcucg

SEQ ID NO: 1600497 - RNA, 15 nt, Pseudomonas putida KT2440
uacccaacagaccac

SEQ ID NO: 1600498 - RNA, 14 nt, Pseudomonas putida KT2440
uaccauuuuccuuu

SEQ ID NO: 1600499 - RNA, 20 nt, Pseudomonas putida KT2440
uacgggcuugugcaucagcg

SEQ ID NO: 1600500 - RNA, 12 nt, Pseudomonas putida KT2440
uacggcuugccg

SEQ ID NO: 1600501 - RNA, 15 nt, Pseudomonas putida KT2440
uacgucaaguaggca

SEQ ID NO: 1600502 - RNA, 18 nt, Pseudomonas putida KT2440
uacggcggccugcugccg

SEQ ID NO: 1600503 - RNA, 12 nt, Pseudomonas putida KT2440
uacggcccaugu

SEQ ID NO: 1600504 - RNA, 22 nt, Pseudomonas putida KT2440
uacggccguggucgccuucacu

SEQ ID NO: 1600505 - RNA, 16 nt, Pseudomonas putida KT2440
uacggcagaacggcuu

SEQ ID NO: 1600506 - RNA, 17 nt, Pseudomonas putida KT2440
uacggccaguuguccgg

SEQ ID NO: 1600507 - RNA, 14 nt, Pseudomonas putida KT2440
uacgcagcacccgg

SEQ ID NO: 1600508 - RNA, 20 nt, Pseudomonas putida KT2440
uacgcacaggcgcagcagcu

SEQ ID NO: 1600509 - RNA, 18 nt, Pseudomonas putida KT2440
uacgcacauagcccugcu

SEQ ID NO: 1600510 - RNA, 17 nt, Pseudomonas putida KT2440
uacgcaccaacuggucg

SEQ ID NO: 1600511 - RNA, 18 nt, Pseudomonas putida KT2440
uacggaaucugcaccgcc

SEQ ID NO: 1600512 - RNA, 21 nt, Pseudomonas putida KT2440
uacgcgccugcaccuggcuga

SEQ ID NO: 1600513 - RNA, 20 nt, Pseudomonas putida KT2440
uacgcggcagcagcagcccc

SEQ ID NO: 1600514 - RNA, 18 nt, Pseudomonas putida KT2440
uaccuaggguucaaaucc

SEQ ID NO: 1600515 - RNA, 12 nt, Pseudomonas putida KT2440
uacgaagccaug

SEQ ID NO: 1600516 - RNA, 13 nt, Pseudomonas putida KT2440
uacagguugcggc

SEQ ID NO: 1600517 - RNA, 19 nt, Pseudomonas putida KT2440
uacagcucccgcgcaugcu

SEQ ID NO: 1600518 - RNA, 14 nt, Pseudomonas putida KT2440
uacagcucgaucuc

SEQ ID NO: 1600519 - RNA, 17 nt, Pseudomonas putida KT2440
uacagcugcucaccaug

SEQ ID NO: 1600520 - RNA, 23 nt, Pseudomonas putida KT2440
uacagcugcucaccauguuccag

SEQ ID NO: 1600521 - RNA, 14 nt, Pseudomonas putida KT2440
uacagccagaaagc

SEQ ID NO: 1600522 - RNA, 16 nt, Pseudomonas putida KT2440
uacagcagcucacuga

SEQ ID NO: 1600523 - RNA, 20 nt, Pseudomonas putida KT2440
uacagcaccccguccagccc

SEQ ID NO: 1600524 - RNA, 23 nt, Pseudomonas putida KT2440
uacacccccagguuauccacagg

SEQ ID NO: 1600525 - RNA, 22 nt, Pseudomonas putida KT2440
uacaccaccgguaggacaaaaa

SEQ ID NO: 1600526 - RNA, 16 nt, Pseudomonas putida KT2440
uacaagaucaagcccc

SEQ ID NO: 1600527 - RNA, 17 nt, Pseudomonas putida KT2440
uacaagggccugugccg

SEQ ID NO: 1600528 - RNA, 21 nt, Pseudomonas putida KT2440
uacaagggccugugccgggcc

SEQ ID NO: 1600529 - RNA, 15 nt, Pseudomonas putida KT2440
uacaaggcucaacua

SEQ ID NO: 1600530 - RNA, 14 nt, Pseudomonas putida KT2440
uacaagggugaagu

SEQ ID NO: 1600531 - RNA, 12 nt, Pseudomonas putida KT2440
uacaacugccac

SEQ ID NO: 1600532 - RNA, 18 nt, Pseudomonas putida KT2440
uacaacugcuccaggcag

SEQ ID NO: 1600533 - RNA, 18 nt, Pseudomonas putida KT2440
uacaaacggcuuggcugc

SEQ ID NO: 1600534 - RNA, 15 nt, Pseudomonas putida KT2440
uaaucagcaacgccc

SEQ ID NO: 1600535 - RNA, 14 nt, Pseudomonas putida KT2440
uaauagucacucag

SEQ ID NO: 1600536 - RNA, 12 nt, Pseudomonas putida KT2440
uaauggccggcu

SEQ ID NO: 1600537 - RNA, 20 nt, Pseudomonas putida KT2440
uaaugggcaauguccagccc

SEQ ID NO: 1600538 - RNA, 15 nt, Pseudomonas putida KT2440
uaaucgacaaagcuc

SEQ ID NO: 1600539 - RNA, 19 nt, Pseudomonas putida KT2440
ggcaugcacuuccaggaag

SEQ ID NO: 1600540 - RNA, 20 nt, Pseudomonas putida KT2440
ggcaugcacuuccaggaagg

SEQ ID NO: 1600541 - RNA, 17 nt, Pseudomonas putida KT2440
ggcaugcagcggccagu

SEQ ID NO: 1600542 - RNA, 14 nt, Pseudomonas putida KT2440
ggcaugccagcagc

SEQ ID NO: 1600543 - RNA, 17 nt, Pseudomonas putida KT2440
ggcaugccagcagcugg

SEQ ID NO: 1600544 - RNA, 23 nt, Pseudomonas putida KT2440
ggcaugccauugcaccaccccca

SEQ ID NO: 1600545 - RNA, 22 nt, Pseudomonas putida KT2440
ggcaugcccaguucgcgugcca

SEQ ID NO: 1600546 - RNA, 14 nt, Pseudomonas putida KT2440
ggcaucggcgccuu

SEQ ID NO: 1600547 - RNA, 16 nt, Pseudomonas putida KT2440
ggcaucgccuccagcg

SEQ ID NO: 1600548 - RNA, 18 nt, Pseudomonas putida KT2440
ggcaucgccaacagaggc

SEQ ID NO: 1600549 - RNA, 20 nt, Pseudomonas putida KT2440
ggcaucgccaacagaggccu

SEQ ID NO: 1600550 - RNA, 24 nt, Pseudomonas putida KT2440
ggcaugcuccaugguagauaagag

SEQ ID NO: 1600551 - RNA, 16 nt, Pseudomonas putida KT2440
ggcaugcgucuggcgg

SEQ ID NO: 1600552 - RNA, 20 nt, Pseudomonas putida KT2440
ggcagucacccaccggcucc

SEQ ID NO: 1600553 - RNA, 18 nt, Pseudomonas putida KT2440
ggcaggcucagggcagca

SEQ ID NO: 1600554 - RNA, 22 nt, Pseudomonas putida KT2440
ggcaguagaaaguccaucugcu

SEQ ID NO: 1600555 - RNA, 23 nt, Pseudomonas putida KT2440
ggcagucuucaagcucgaagcgc

SEQ ID NO: 1600556 - RNA, 11 nt, Pseudomonas putida KT2440
ggcagugaacu

SEQ ID NO: 1600557 - RNA, 17 nt, Pseudomonas putida KT2440
ggcauacaggaccaggc

SEQ ID NO: 1600558 - RNA, 18 nt, Pseudomonas putida KT2440
ggcauaccaucuucugca

SEQ ID NO: 1600559 - RNA, 22 nt, Pseudomonas putida KT2440
ggcauagauggcugucugcagc

SEQ ID NO: 1600560 - RNA, 15 nt, Pseudomonas putida KT2440
ggcauagcgcucgcg

SEQ ID NO: 1600561 - RNA, 20 nt, Pseudomonas putida KT2440
ggcauauccggccuuuucau

SEQ ID NO: 1600562 - RNA, 16 nt, Pseudomonas putida KT2440
ggcauaguccaggaag

SEQ ID NO: 1600563 - RNA, 18 nt, Pseudomonas putida KT2440
ggcagcgaucagcgcaga

SEQ ID NO: 1600564 - RNA, 18 nt, Pseudomonas putida KT2440
ggcagcgcaaucaccgcc

SEQ ID NO: 1600565 - RNA, 12 nt, Pseudomonas putida KT2440
ggcagcggcugg

SEQ ID NO: 1600566 - RNA, 20 nt, Pseudomonas putida KT2440
ggcagcgcgggcagaugagg

SEQ ID NO: 1600567 - RNA, 22 nt, Pseudomonas putida KT2440
ggcagcgggagucgaaccugcc

SEQ ID NO: 1600568 - RNA, 13 nt, Pseudomonas putida KT2440
ggcagcgggcucg

SEQ ID NO: 1600569 - RNA, 16 nt, Pseudomonas putida KT2440
ggcagcgggcucgccc

SEQ ID NO: 1600570 - RNA, 12 nt, Pseudomonas putida KT2440
ggcagcgggcug

SEQ ID NO: 1600571 - RNA, 13 nt, Pseudomonas putida KT2440
ggcaggccagcac

SEQ ID NO: 1600572 - RNA, 14 nt, Pseudomonas putida KT2440
ggcaggccagcacg

SEQ ID NO: 1600573 - RNA, 17 nt, Pseudomonas putida KT2440
ggcaggccuuguuccac

SEQ ID NO: 1600574 - RNA, 16 nt, Pseudomonas putida KT2440
ggcaggaaacaccagg

SEQ ID NO: 1600575 - RNA, 18 nt, Pseudomonas putida KT2440
ggcaggaaacaccagggu

SEQ ID NO: 1600576 - RNA, 13 nt, Pseudomonas putida KT2440
ggcagcugcugac

SEQ ID NO: 1600577 - RNA, 15 nt, Pseudomonas putida KT2440
ggcagccgcguccuu

SEQ ID NO: 1600578 - RNA, 15 nt, Pseudomonas putida KT2440
ggcagccccaaccuu

SEQ ID NO: 1600579 - RNA, 18 nt, Pseudomonas putida KT2440
ggcagcccccccagcaac

SEQ ID NO: 1600580 - RNA, 13 nt, Pseudomonas putida KT2440
ggcagccaccgcc

SEQ ID NO: 1600581 - RNA, 20 nt, Pseudomonas putida KT2440
ggcagccaccucgacccccu

SEQ ID NO: 1600582 - RNA, 20 nt, Pseudomonas putida KT2440
ggcagcaggccaaugcccau

SEQ ID NO: 1600583 - RNA, 20 nt, Pseudomonas putida KT2440
ggcagcaugaacagcgcugc

SEQ ID NO: 1600584 - RNA, 16 nt, Pseudomonas putida KT2440
ggcagcagugcaccca

SEQ ID NO: 1600585 - RNA, 20 nt, Pseudomonas putida KT2440
ggcagcaccgcugccagcug

SEQ ID NO: 1600586 - RNA, 20 nt, Pseudomonas putida KT2440
ggcacuccagcgaguggcca

SEQ ID NO: 1600587 - RNA, 20 nt, Pseudomonas putida KT2440
ggcacuaccaggcccaacag

SEQ ID NO: 1600588 - RNA, 14 nt, Pseudomonas putida KT2440
ggcacucgaagcac

SEQ ID NO: 1600589 - RNA, 22 nt, Pseudomonas putida KT2440
ggcagaccugcuggcacugcgg

SEQ ID NO: 1600590 - RNA, 22 nt, Pseudomonas putida KT2440
ggcagaauuucaggcugggugg

SEQ ID NO: 1600591 - RNA, 16 nt, Pseudomonas putida KT2440
ggcagaucgaaagaca

SEQ ID NO: 1600592 - RNA, 19 nt, Pseudomonas putida KT2440
ggcagaucgagcgccgccc

SEQ ID NO: 1600593 - RNA, 13 nt, Pseudomonas putida KT2440
ggcagaucacgca

SEQ ID NO: 1600594 - RNA, 17 nt, Pseudomonas putida KT2440
ggcagagcgccagcauc

SEQ ID NO: 1600595 - RNA, 13 nt, Pseudomonas putida KT2440
ggcagaugcgucu

SEQ ID NO: 1600596 - RNA, 22 nt, Pseudomonas putida KT2440
ggcagcaacacgacgauggcca

SEQ ID NO: 1600597 - RNA, 17 nt, Pseudomonas putida KT2440
ggcagcaaggcauccag

SEQ ID NO: 1600598 - RNA, 20 nt, Pseudomonas putida KT2440
ggcagcaaguugaagaacag

SEQ ID NO: 1600599 - RNA, 21 nt, Pseudomonas putida KT2440
ggcacgcccggcaccugccgg

SEQ ID NO: 1600600 - RNA, 16 nt, Pseudomonas putida KT2440
ggcacgacugaacacc

SEQ ID NO: 1600601 - RNA, 19 nt, Pseudomonas putida KT2440
ggcacgacugaacaccugc

SEQ ID NO: 1600602 - RNA, 20 nt, Pseudomonas putida KT2440
ggcacgacugaacaccugcc

SEQ ID NO: 1600603 - RNA, 19 nt, Pseudomonas putida KT2440
ggcacgauccugugggagc

SEQ ID NO: 1600604 - RNA, 15 nt, Pseudomonas putida KT2440
ggcacgcccagcaac

SEQ ID NO: 1600605 - RNA, 15 nt, Pseudomonas putida KT2440
ggcaccgcacccggc

SEQ ID NO: 1600606 - RNA, 13 nt, Pseudomonas putida KT2440
ggcaccgccgccc

SEQ ID NO: 1600607 - RNA, 13 nt, Pseudomonas putida KT2440
ggcacaggcccag

SEQ ID NO: 1600608 - RNA, 17 nt, Pseudomonas putida KT2440
ggcacaggcccagcaac

SEQ ID NO: 1600609 - RNA, 20 nt, Pseudomonas putida KT2440
ggcacaggcccagcaacagc

SEQ ID NO: 1600610 - RNA, 20 nt, Pseudomonas putida KT2440
ggcacaggcuacgcagcacc

SEQ ID NO: 1600611 - RNA, 13 nt, Pseudomonas putida KT2440
ggcacaucaccag

SEQ ID NO: 1600612 - RNA, 19 nt, Pseudomonas putida KT2440
ggcaccaacugcacccgcc

SEQ ID NO: 1600613 - RNA, 18 nt, Pseudomonas putida KT2440
ggcaccagcaccagcucc

SEQ ID NO: 1600614 - RNA, 17 nt, Pseudomonas putida KT2440
ggcacaggccagccagg

SEQ ID NO: 1600615 - RNA, 18 nt, Pseudomonas putida KT2440
ggcacaggccagccaggu

SEQ ID NO: 1600616 - RNA, 13 nt, Pseudomonas putida KT2440
ggcacagcccagc

SEQ ID NO: 1600617 - RNA, 22 nt, Pseudomonas putida KT2440
ggcacagaucaacgccgccagc

SEQ ID NO: 1600618 - RNA, 13 nt, Pseudomonas putida KT2440
ggcaaacuccacu

SEQ ID NO: 1600619 - RNA, 15 nt, Pseudomonas putida KT2440
ggcaaagaaacacca

SEQ ID NO: 1600620 - RNA, 18 nt, Pseudomonas putida KT2440
ggcaaagaaacaccaggc

SEQ ID NO: 1600621 - RNA, 20 nt, Pseudomonas putida KT2440
ggcaaagaacggugcugccg

SEQ ID NO: 1600622 - RNA, 22 nt, Pseudomonas putida KT2440
ggcaaacgaaaucugccugcug

SEQ ID NO: 1600623 - RNA, 21 nt, Pseudomonas putida KT2440
ggcaaacccgcgccuacaggc

SEQ ID NO: 1600624 - RNA, 19 nt, Pseudomonas putida KT2440
ggcaaacccggccagcagg

SEQ ID NO: 1600625 - RNA, 20 nt, Pseudomonas putida KT2440
ggcaaacccggccagcaggu

SEQ ID NO: 1600626 - RNA, 14 nt, Pseudomonas putida KT2440
ggcaaacacaucca

SEQ ID NO: 1600627 - RNA, 23 nt, Pseudomonas putida KT2440
ggcaaacaccuugccccgcaggc

SEQ ID NO: 1600628 - RNA, 15 nt, Pseudomonas putida KT2440
ggcccugaaggccgc

SEQ ID NO: 1600629 - RNA, 21 nt, Pseudomonas putida KT2440
ggcccugaaggccgcuccugc

SEQ ID NO: 1600630 - RNA, 19 nt, Pseudomonas putida KT2440
ggcccugacaggcgaucag

SEQ ID NO: 1600631 - RNA, 22 nt, Pseudomonas putida KT2440
ggcccugacgccagcgcugggc

SEQ ID NO: 1600632 - RNA, 17 nt, Pseudomonas putida KT2440
ggcccugcucacgcagc

SEQ ID NO: 1600633 - RNA, 21 nt, Pseudomonas putida KT2440
ggccgaacaccgccagcccgc

SEQ ID NO: 1600634 - RNA, 22 nt, Pseudomonas putida KT2440
ggccgacaaaacugagcaagaa

SEQ ID NO: 1600635 - RNA, 21 nt, Pseudomonas putida KT2440
ggccgacacaccaauggccau

SEQ ID NO: 1600636 - RNA, 16 nt, Pseudomonas putida KT2440
ggccgcaacgcggccc

SEQ ID NO: 1600637 - RNA, 20 nt, Pseudomonas putida KT2440
ggccgcaacgcggcccuggg

SEQ ID NO: 1600638 - RNA, 16 nt, Pseudomonas putida KT2440
ggccgcaaggcggccc

SEQ ID NO: 1600639 - RNA, 15 nt, Pseudomonas putida KT2440
ggccgaugggcaggc

SEQ ID NO: 1600640 - RNA, 17 nt, Pseudomonas putida KT2440
ggccgaugggcaggcca

SEQ ID NO: 1600641 - RNA, 23 nt, Pseudomonas putida KT2440
ggccgauuuggcccgcugcgccg

SEQ ID NO: 1600642 - RNA, 17 nt, Pseudomonas putida KT2440
ggccgaucuucaggcug

SEQ ID NO: 1600643 - RNA, 18 nt, Pseudomonas putida KT2440
ggccgaucuucaggcuga

SEQ ID NO: 1600644 - RNA, 18 nt, Pseudomonas putida KT2440
ggccgaguaaccggcggc

SEQ ID NO: 1600645 - RNA, 15 nt, Pseudomonas putida KT2440
ggccccggccaggcc

SEQ ID NO: 1600646 - RNA, 14 nt, Pseudomonas putida KT2440
ggccccggccccag

SEQ ID NO: 1600647 - RNA, 21 nt, Pseudomonas putida KT2440
ggccccagggaucgaugcccu

SEQ ID NO: 1600648 - RNA, 17 nt, Pseudomonas putida KT2440
ggccccagggggcagcu

SEQ ID NO: 1600649 - RNA, 12 nt, Pseudomonas putida KT2440
ggcccccacgcc

SEQ ID NO: 1600650 - RNA, 17 nt, Pseudomonas putida KT2440
ggccccccagccagcag

SEQ ID NO: 1600651 - RNA, 18 nt, Pseudomonas putida KT2440
ggccccccagccagcaga

SEQ ID NO: 1600652 - RNA, 19 nt, Pseudomonas putida KT2440
ggccccccagccagcagau

SEQ ID NO: 1600653 - RNA, 15 nt, Pseudomonas putida KT2440
ggcccgcaagggucu

SEQ ID NO: 1600654 - RNA, 20 nt, Pseudomonas putida KT2440
ggcccgaugaucaggccgcu

SEQ ID NO: 1600655 - RNA, 22 nt, Pseudomonas putida KT2440
ggcccgaugggcgucgccugca

SEQ ID NO: 1600656 - RNA, 21 nt, Pseudomonas putida KT2440
ggccccggcgccgccaggcag

SEQ ID NO: 1600657 - RNA, 12 nt, Pseudomonas putida KT2440
ggcccagccgcg

SEQ ID NO: 1600658 - RNA, 21 nt, Pseudomonas putida KT2440
ggcccagcaggugcccaagcg

SEQ ID NO: 1600659 - RNA, 17 nt, Pseudomonas putida KT2440
ggcccagcccaguagau

SEQ ID NO: 1600660 - RNA, 21 nt, Pseudomonas putida KT2440
ggcccagccccgagcaaagcc

SEQ ID NO: 1600661 - RNA, 21 nt, Pseudomonas putida KT2440
ggcccagccaggcacuggcca

SEQ ID NO: 1600662 - RNA, 22 nt, Pseudomonas putida KT2440
ggcccagccaucgagcaccggc

SEQ ID NO: 1600663 - RNA, 16 nt, Pseudomonas putida KT2440
ggcccacggcguccag

SEQ ID NO: 1600664 - RNA, 18 nt, Pseudomonas putida KT2440
ggcccacggcguccaggc

SEQ ID NO: 1600665 - RNA, 23 nt, Pseudomonas putida KT2440
ggcccaucgcauaugccccaggc

SEQ ID NO: 1600666 - RNA, 23 nt, Pseudomonas putida KT2440
ggccccacaauaagaugcggcgc

SEQ ID NO: 1600667 - RNA, 15 nt, Pseudomonas putida KT2440
ggccccaccaggcac

SEQ ID NO: 1600668 - RNA, 11 nt, Pseudomonas putida KT2440
ggcccaguucg

SEQ ID NO: 1600669 - RNA, 17 nt, Pseudomonas putida KT2440
ggcccagcuacgcgagc

SEQ ID NO: 1600670 - RNA, 19 nt, Pseudomonas putida KT2440
ggccaggguacgauagggc

SEQ ID NO: 1600671 - RNA, 12 nt, Pseudomonas putida KT2440
ggccaggccccu

SEQ ID NO: 1600672 - RNA, 14 nt, Pseudomonas putida KT2440
ggccaggcccacca

SEQ ID NO: 1600673 - RNA, 23 nt, Pseudomonas putida KT2440
ggccagcuugacggugcgcgcca

SEQ ID NO: 1600674 - RNA, 16 nt, Pseudomonas putida KT2440
ggccagcugcugcggc

SEQ ID NO: 1600675 - RNA, 20 nt, Pseudomonas putida KT2440
ggccagcgcgcugagcaggu

SEQ ID NO: 1600676 - RNA, 13 nt, Pseudomonas putida KT2440
ggccagccccagc

SEQ ID NO: 1600677 - RNA, 21 nt, Pseudomonas putida KT2440
ggccagcgccugcaggcccag

SEQ ID NO: 1600678 - RNA, 16 nt, Pseudomonas putida KT2440
ggccagcgccugcugc

SEQ ID NO: 1600679 - RNA, 16 nt, Pseudomonas putida KT2440
ggccaguuugugcucg

SEQ ID NO: 1600680 - RNA, 20 nt, Pseudomonas putida KT2440
ggccaucagcaagccgccga

SEQ ID NO: 1600681 - RNA, 17 nt, Pseudomonas putida KT2440
ggccaucacuuccggcu

SEQ ID NO: 1600682 - RNA, 19 nt, Pseudomonas putida KT2440
ggccaucaauaccggcaug

SEQ ID NO: 1600683 - RNA, 18 nt, Pseudomonas putida KT2440
ggccauauugcugagcca

SEQ ID NO: 1600684 - RNA, 18 nt, Pseudomonas putida KT2440
ggccaugcccaccgcauu

SEQ ID NO: 1600685 - RNA, 15 nt, Pseudomonas putida KT2440
ggccauuuccggccc

SEQ ID NO: 1600686 - RNA, 13 nt, Pseudomonas putida KT2440
ggccauguccggg

SEQ ID NO: 1600687 - RNA, 13 nt, Pseudomonas putida KT2440
ggccaugugcucg

SEQ ID NO: 1600688 - RNA, 18 nt, Pseudomonas putida KT2440
ggccacccggaccagcgc

SEQ ID NO: 1600689 - RNA, 22 nt, Pseudomonas putida KT2440
ggccaccgccucggcuacgccg

SEQ ID NO: 1600690 - RNA, 14 nt, Pseudomonas putida KT2440
ggccacgcccaacc

SEQ ID NO: 1600691 - RNA, 23 nt, Pseudomonas putida KT2440
ggccacgcccaaccccagcgcgu

SEQ ID NO: 1600692 - RNA, 14 nt, Pseudomonas putida KT2440
ggccaccggcagca

SEQ ID NO: 1600693 - RNA, 16 nt, Pseudomonas putida KT2440
ggccaccggcagcacc

SEQ ID NO: 1600694 - RNA, 17 nt, Pseudomonas putida KT2440
ggccaccacccgcuggg

SEQ ID NO: 1600695 - RNA, 14 nt, Pseudomonas putida KT2440
ggccaccagcaccu

SEQ ID NO: 1600696 - RNA, 15 nt, Pseudomonas putida KT2440
ggccaccagcaccug

SEQ ID NO: 1600697 - RNA, 12 nt, Pseudomonas putida KT2440
ggccaccagcac

SEQ ID NO: 1600698 - RNA, 14 nt, Pseudomonas putida KT2440
ggccaccagggugg

SEQ ID NO: 1600699 - RNA, 18 nt, Pseudomonas putida KT2440
ggccaccaugaacagcac

SEQ ID NO: 1600700 - RNA, 19 nt, Pseudomonas putida KT2440
ggccaccauguacugcaga

SEQ ID NO: 1600701 - RNA, 20 nt, Pseudomonas putida KT2440
ggccaccauguacugcagac

SEQ ID NO: 1600702 - RNA, 22 nt, Pseudomonas putida KT2440
ggcaugucgaugcggugcucau

SEQ ID NO: 1600703 - RNA, 20 nt, Pseudomonas putida KT2440
ggcauguucaucaccggcca

SEQ ID NO: 1600704 - RNA, 13 nt, Pseudomonas putida KT2440
ggccaccacuucu

SEQ ID NO: 1600705 - RNA, 19 nt, Pseudomonas putida KT2440
ggccaccacuucuggcugg

SEQ ID NO: 1600706 - RNA, 13 nt, Pseudomonas putida KT2440
ggccagcaggccc

SEQ ID NO: 1600707 - RNA, 16 nt, Pseudomonas putida KT2440
ggccagcaggcccggc

SEQ ID NO: 1600708 - RNA, 13 nt, Pseudomonas putida KT2440
ggccagcaacagg

SEQ ID NO: 1600709 - RNA, 18 nt, Pseudomonas putida KT2440
ggccagcacaaccacugc

SEQ ID NO: 1600710 - RNA, 19 nt, Pseudomonas putida KT2440
ggccagcacaaccacugca

SEQ ID NO: 1600711 - RNA, 19 nt, Pseudomonas putida KT2440
ggccagccagguauggcca

SEQ ID NO: 1600712 - RNA, 22 nt, Pseudomonas putida KT2440
ggccagcaggucagcacgcgcu

SEQ ID NO: 1600713 - RNA, 14 nt, Pseudomonas putida KT2440
ggccagccagcagc

SEQ ID NO: 1600714 - RNA, 14 nt, Pseudomonas putida KT2440
ggccacggccgagu

SEQ ID NO: 1600715 - RNA, 14 nt, Pseudomonas putida KT2440
ggccacgccgccuu

SEQ ID NO: 1600716 - RNA, 14 nt, Pseudomonas putida KT2440
ggccacgcugcggc

SEQ ID NO: 1600717 - RNA, 13 nt, Pseudomonas putida KT2440
ggccacgguccag

SEQ ID NO: 1600718 - RNA, 17 nt, Pseudomonas putida KT2440
ggccagaucggccagcu

SEQ ID NO: 1600719 - RNA, 14 nt, Pseudomonas putida KT2440
ggcaaaagaaaaag

SEQ ID NO: 1600720 - RNA, 21 nt, Pseudomonas putida KT2440
ggcaaaaucgaccagggccuu

SEQ ID NO: 1600721 - RNA, 17 nt, Pseudomonas putida KT2440
ggauugaaacugccccu

SEQ ID NO: 1600722 - RNA, 17 nt, Pseudomonas putida KT2440
ggaugcugaagcucucc

SEQ ID NO: 1600723 - RNA, 22 nt, Pseudomonas putida KT2440
ggaugcugaagcucuccagcag

SEQ ID NO: 1600724 - RNA, 18 nt, Pseudomonas putida KT2440
ggaucgggcacaacucca

SEQ ID NO: 1600725 - RNA, 16 nt, Pseudomonas putida KT2440
ggaucgucuggcacug

SEQ ID NO: 1600726 - RNA, 22 nt, Pseudomonas putida KT2440
ggaucgugacggucugccggca

SEQ ID NO: 1600727 - RNA, 12 nt, Pseudomonas putida KT2440
ggaucuucucuu

SEQ ID NO: 1600728 - RNA, 19 nt, Pseudomonas putida KT2440
ggaucuuguauuggccaag

SEQ ID NO: 1600729 - RNA, 16 nt, Pseudomonas putida KT2440
ggaugagaaagcccgc

SEQ ID NO: 1600730 - RNA, 20 nt, Pseudomonas putida KT2440
ggaugcgguugaccacgaug

SEQ ID NO: 1600731 - RNA, 13 nt, Pseudomonas putida KT2440
ggaugcuccccuu

SEQ ID NO: 1600732 - RNA, 21 nt, Pseudomonas putida KT2440
ggaugcgcuucauccagcggg

SEQ ID NO: 1600733 - RNA, 15 nt, Pseudomonas putida KT2440
ggaucauuugaaaga

SEQ ID NO: 1600734 - RNA, 22 nt, Pseudomonas putida KT2440
ggaucaugguguucaugcccac

SEQ ID NO: 1600735 - RNA, 12 nt, Pseudomonas putida KT2440
ggaucgccagga

SEQ ID NO: 1600736 - RNA, 13 nt, Pseudomonas putida KT2440
ggaucgcucucgc

SEQ ID NO: 1600737 - RNA, 23 nt, Pseudomonas putida KT2440
ggaucgcgccuucauaggcggcc

SEQ ID NO: 1600738 - RNA, 22 nt, Pseudomonas putida KT2440
ggaucgcgccuucgcuggcgac

SEQ ID NO: 1600739 - RNA, 15 nt, Pseudomonas putida KT2440
ggaucgcgcaagccu

SEQ ID NO: 1600740 - RNA, 14 nt, Pseudomonas putida KT2440
ggauaucaaagcgg

SEQ ID NO: 1600741 - RNA, 21 nt, Pseudomonas putida KT2440
ggauauaagccgccccacccu

SEQ ID NO: 1600742 - RNA, 18 nt, Pseudomonas putida KT2440
ggaucagggucagggcca

SEQ ID NO: 1600743 - RNA, 14 nt, Pseudomonas putida KT2440
ggaucagccgcgcc

SEQ ID NO: 1600744 - RNA, 14 nt, Pseudomonas putida KT2440
ggaucagcucggca

SEQ ID NO: 1600745 - RNA, 22 nt, Pseudomonas putida KT2440
ggaucaggaacaaucuucuuca

SEQ ID NO: 1600746 - RNA, 13 nt, Pseudomonas putida KT2440
ggagguagccacc

SEQ ID NO: 1600747 - RNA, 14 nt, Pseudomonas putida KT2440
ggagcguugcaggc

SEQ ID NO: 1600748 - RNA, 22 nt, Pseudomonas putida KT2440
ggagcuccccucagacagagcu

SEQ ID NO: 1600749 - RNA, 17 nt, Pseudomonas putida KT2440
ggagcguccgagcggag

SEQ ID NO: 1600750 - RNA, 17 nt, Pseudomonas putida KT2440
ggagagguacaccccca

SEQ ID NO: 1600751 - RNA, 22 nt, Pseudomonas putida KT2440
ggagagcgauuccaagugccuc

SEQ ID NO: 1600752 - RNA, 19 nt, Pseudomonas putida KT2440
ggagagccccaccaggaag

SEQ ID NO: 1600753 - RNA, 17 nt, Pseudomonas putida KT2440
ggacuccggccggggcu

SEQ ID NO: 1600754 - RNA, 22 nt, Pseudomonas putida KT2440
ggagaagcgaucgaaaggcgac

SEQ ID NO: 1600755 - RNA, 20 nt, Pseudomonas putida KT2440
ggacucacccgcaccucaca

SEQ ID NO: 1600756 - RNA, 13 nt, Pseudomonas putida KT2440
ggagaccuuuccc

SEQ ID NO: 1600757 - RNA, 17 nt, Pseudomonas putida KT2440
ggacaucaccaggccgg

SEQ ID NO: 1600758 - RNA, 11 nt, Pseudomonas putida KT2440
ggacaggcgcu

SEQ ID NO: 1600759 - RNA, 13 nt, Pseudomonas putida KT2440
ggacaggggaugc

SEQ ID NO: 1600760 - RNA, 19 nt, Pseudomonas putida KT2440
ggacagguagaucugcucu

SEQ ID NO: 1600761 - RNA, 20 nt, Pseudomonas putida KT2440
ggacagggucagcggggugu

SEQ ID NO: 1600762 - RNA, 17 nt, Pseudomonas putida KT2440
ggacgcuggcagcuugg

SEQ ID NO: 1600763 - RNA, 17 nt, Pseudomonas putida KT2440
ggaaugugucagggcug

SEQ ID NO: 1600764 - RNA, 20 nt, Pseudomonas putida KT2440
ggaauguuaccggccuggca

SEQ ID NO: 1600765 - RNA, 22 nt, Pseudomonas putida KT2440
ggaauuucggcguugaccgagg

SEQ ID NO: 1600766 - RNA, 14 nt, Pseudomonas putida KT2440
ggaauuucugcacc

SEQ ID NO: 1600767 - RNA, 14 nt, Pseudomonas putida KT2440
ggaauuugccggga

SEQ ID NO: 1600768 - RNA, 20 nt, Pseudomonas putida KT2440
ggaaggcuacauccaggcug

SEQ ID NO: 1600769 - RNA, 19 nt, Pseudomonas putida KT2440
ggaaggcgucacgcagggc

SEQ ID NO: 1600770 - RNA, 15 nt, Pseudomonas putida KT2440
ggaauccagugcagg

SEQ ID NO: 1600771 - RNA, 22 nt, Pseudomonas putida KT2440
ggaacucgcccgguuuggccug

SEQ ID NO: 1600772 - RNA, 23 nt, Pseudomonas putida KT2440
ggaacuccugcugcagcuccgga

SEQ ID NO: 1600773 - RNA, 17 nt, Pseudomonas putida KT2440
ggaacguuuccagcaac

SEQ ID NO: 1600774 - RNA, 22 nt, Pseudomonas putida KT2440
ggaacuggcugaccagugucug

SEQ ID NO: 1600775 - RNA, 20 nt, Pseudomonas putida KT2440
ggaacuugucgacgaugcuu

SEQ ID NO: 1600776 - RNA, 17 nt, Pseudomonas putida KT2440
ggaacgucguugcaguu

SEQ ID NO: 1600777 - RNA, 20 nt, Pseudomonas putida KT2440
ggaagaucacgucggccugc

SEQ ID NO: 1600778 - RNA, 17 nt, Pseudomonas putida KT2440
ggaagauugaaggggca

SEQ ID NO: 1600779 - RNA, 15 nt, Pseudomonas putida KT2440
ggaagcuucucgagc

SEQ ID NO: 1600780 - RNA, 15 nt, Pseudomonas putida KT2440
ggaagccugcauccc

SEQ ID NO: 1600781 - RNA, 12 nt, Pseudomonas putida KT2440
ggaacaaccuga

SEQ ID NO: 1600782 - RNA, 20 nt, Pseudomonas putida KT2440
ggaacaacggcucacugcuc

SEQ ID NO: 1600783 - RNA, 12 nt, Pseudomonas putida KT2440
ggaaauuggcca

SEQ ID NO: 1600784 - RNA, 17 nt, Pseudomonas putida KT2440
ggaaauuggccagcagg

SEQ ID NO: 1600785 - RNA, 17 nt, Pseudomonas putida KT2440
ggaaaucgccugcuugg

SEQ ID NO: 1600786 - RNA, 22 nt, Pseudomonas putida KT2440
ggaacgaaaaacuccuugagau

SEQ ID NO: 1600787 - RNA, 18 nt, Pseudomonas putida KT2440
ggaaccuccguugcugcg

SEQ ID NO: 1600788 - RNA, 19 nt, Pseudomonas putida KT2440
ggaaccgaauaaccgcugu

SEQ ID NO: 1600789 - RNA, 21 nt, Pseudomonas putida KT2440
ggaacagccgcgcaugcugug

SEQ ID NO: 1600790 - RNA, 17 nt, Pseudomonas putida KT2440
ggaacagcggcagcaac

SEQ ID NO: 1600791 - RNA, 22 nt, Pseudomonas putida KT2440
ggaacagcucuggcagcagugc

SEQ ID NO: 1600792 - RNA, 21 nt, Pseudomonas putida KT2440
ggaaaccuccggcaucauccu

SEQ ID NO: 1600793 - RNA, 20 nt, Pseudomonas putida KT2440
gcuuugcagauuucgugggu

SEQ ID NO: 1600794 - RNA, 14 nt, Pseudomonas putida KT2440
gcuuugcagcccau

SEQ ID NO: 1600795 - RNA, 22 nt, Pseudomonas putida KT2440
gcuuugcacccgcgcgcugaag

SEQ ID NO: 1600796 - RNA, 16 nt, Pseudomonas putida KT2440
gcuuucugcugugucg

SEQ ID NO: 1600797 - RNA, 21 nt, Pseudomonas putida KT2440
gcuuucuggaggaguccagcu

SEQ ID NO: 1600798 - RNA, 16 nt, Pseudomonas putida KT2440
gcuuucggcaguguaa

SEQ ID NO: 1600799 - RNA, 18 nt, Pseudomonas putida KT2440
gcuuucgaucgagccacu

SEQ ID NO: 1600800 - RNA, 22 nt, Pseudomonas putida KT2440
gcuuuccaccuggccacccggc

SEQ ID NO: 1600801 - RNA, 23 nt, Pseudomonas putida KT2440
gcuuuccaccuggccacccggcu

SEQ ID NO: 1600802 - RNA, 16 nt, Pseudomonas putida KT2440
gcuuuccaaaccugcg

SEQ ID NO: 1600803 - RNA, 18 nt, Pseudomonas putida KT2440
gcuuucaguugaggguga

SEQ ID NO: 1600804 - RNA, 15 nt, Pseudomonas putida KT2440
gcuuucagccgagcc

SEQ ID NO: 1600805 - RNA, 18 nt, Pseudomonas putida KT2440
gcuuucaggcgcagcaca

SEQ ID NO: 1600806 - RNA, 12 nt, Pseudomonas putida KT2440
gcuuuccagguc

SEQ ID NO: 1600807 - RNA, 18 nt, Pseudomonas putida KT2440
gcuuuccagguccugcuc

SEQ ID NO: 1600808 - RNA, 16 nt, Pseudomonas putida KT2440
gcuuucacuucaucca

SEQ ID NO: 1600809 - RNA, 22 nt, Pseudomonas putida KT2440
gcuuugggagcaguggugcuca

SEQ ID NO: 1600810 - RNA, 22 nt, Pseudomonas putida KT2440
gcuuuggggggcgacagacagg

SEQ ID NO: 1600811 - RNA, 21 nt, Pseudomonas putida KT2440
gcuuuggccguagccaggcau

SEQ ID NO: 1600812 - RNA, 20 nt, Pseudomonas putida KT2440
gcuuuguauggccgagcagg

SEQ ID NO: 1600813 - RNA, 22 nt, Pseudomonas putida KT2440
gcuuuguauggccgagcaggag

SEQ ID NO: 1600814 - RNA, 13 nt, Pseudomonas putida KT2440
gcuuugcgggcac

SEQ ID NO: 1600815 - RNA, 20 nt, Pseudomonas putida KT2440
gcuuugcgggcacgggcagc

SEQ ID NO: 1600816 - RNA, 16 nt, Pseudomonas putida KT2440
gcuuugcggccccuuc

SEQ ID NO: 1600817 - RNA, 15 nt, Pseudomonas putida KT2440
gcuuuuaugauccug

SEQ ID NO: 1600818 - RNA, 18 nt, Pseudomonas putida KT2440
gcuuuuccagcaaagucu

SEQ ID NO: 1600819 - RNA, 22 nt, Pseudomonas putida KT2440
gcuuuuccagcaaagucuucag

SEQ ID NO: 1600820 - RNA, 21 nt, Pseudomonas putida KT2440
gcuuuucaccuccaguugcca

SEQ ID NO: 1600821 - RNA, 22 nt, Pseudomonas putida KT2440
gcuuuucaccuccaguugccag

SEQ ID NO: 1600822 - RNA, 18 nt, Pseudomonas putida KT2440
gcuuugugugcccaccag

SEQ ID NO: 1600823 - RNA, 20 nt, Pseudomonas putida KT2440
gcuuuuugauuguggagcug

SEQ ID NO: 1600824 - RNA, 17 nt, Pseudomonas putida KT2440
gcuuuuucauggcuuga

SEQ ID NO: 1600825 - RNA, 22 nt, Pseudomonas putida KT2440
gcuuguucuguuucaccagcag

SEQ ID NO: 1600826 - RNA, 23 nt, Pseudomonas putida KT2440
gcuuggccgacuggcgcaccagc

SEQ ID NO: 1600827 - RNA, 14 nt, Pseudomonas putida KT2440
gcuuggggccgcuc

SEQ ID NO: 1600828 - RNA, 15 nt, Pseudomonas putida KT2440
gcuuggucucguugc

SEQ ID NO: 1600829 - RNA, 19 nt, Pseudomonas putida KT2440
gcuugucaugccuuggcua

SEQ ID NO: 1600830 - RNA, 14 nt, Pseudomonas putida KT2440
gcuuguccaucccc

SEQ ID NO: 1600831 - RNA, 14 nt, Pseudomonas putida KT2440
gcuuguuauggcac

SEQ ID NO: 1600832 - RNA, 15 nt, Pseudomonas putida KT2440
gcuugugcaucagcg

SEQ ID NO: 1600833 - RNA, 18 nt, Pseudomonas putida KT2440
gcuugucuuccaguucca

SEQ ID NO: 1600834 - RNA, 13 nt, Pseudomonas putida KT2440
gcuugcucaggcu

SEQ ID NO: 1600835 - RNA, 16 nt, Pseudomonas putida KT2440
gcuugcgguccugcac

SEQ ID NO: 1600836 - RNA, 18 nt, Pseudomonas putida KT2440
gcuugcgguccugcacca

SEQ ID NO: 1600837 - RNA, 20 nt, Pseudomonas putida KT2440
gcuuggccagaaacggcggc

SEQ ID NO: 1600838 - RNA, 13 nt, Pseudomonas putida KT2440
gcuuggccaccac

SEQ ID NO: 1600839 - RNA, 16 nt, Pseudomonas putida KT2440
gcuuggcacgcuggcu

SEQ ID NO: 1600840 - RNA, 23 nt, Pseudomonas putida KT2440
gcuuggcagcaccgcugccagcu

SEQ ID NO: 1600841 - RNA, 15 nt, Pseudomonas putida KT2440
gcuuggcagcggcug

SEQ ID NO: 1600842 - RNA, 16 nt, Pseudomonas putida KT2440
gcuuggcagcggcugg

SEQ ID NO: 1600843 - RNA, 13 nt, Pseudomonas putida KT2440
gcuugcgcugaag

SEQ ID NO: 1600844 - RNA, 14 nt, Pseudomonas putida KT2440
gcuugcggaacagg

SEQ ID NO: 1600845 - RNA, 18 nt, Pseudomonas putida KT2440
gcuugcgcauggccgcca

SEQ ID NO: 1600846 - RNA, 19 nt, Pseudomonas putida KT2440
gcuugcccggcuccaggua

SEQ ID NO: 1600847 - RNA, 22 nt, Pseudomonas putida KT2440
gcuugcccgaggaacggcuggc

SEQ ID NO: 1600848 - RNA, 17 nt, Pseudomonas putida KT2440
gcuugcccgccuuggca

SEQ ID NO: 1600849 - RNA, 22 nt, Pseudomonas putida KT2440
gcuugcccgcgaagaggccagc

SEQ ID NO: 1600850 - RNA, 15 nt, Pseudomonas putida KT2440
gcuugccggcaauac

SEQ ID NO: 1600851 - RNA, 14 nt, Pseudomonas putida KT2440
gcuugccgcgugcg

SEQ ID NO: 1600852 - RNA, 21 nt, Pseudomonas putida KT2440
gcuugccgcuggcauccacca

SEQ ID NO: 1600853 - RNA, 17 nt, Pseudomonas putida KT2440
gcuugcaguuguccagg

SEQ ID NO: 1600854 - RNA, 15 nt, Pseudomonas putida KT2440
gcuugcaucaaauuu

SEQ ID NO: 1600855 - RNA, 14 nt, Pseudomonas putida KT2440
gcuugccaccaucg

SEQ ID NO: 1600856 - RNA, 22 nt, Pseudomonas putida KT2440
gcuugccaccaucgaccuggcc

SEQ ID NO: 1600857 - RNA, 20 nt, Pseudomonas putida KT2440
gcuugagugguuuucuuccc

SEQ ID NO: 1600858 - RNA, 18 nt, Pseudomonas putida KT2440
gcuugaucaggcccggcu

SEQ ID NO: 1600859 - RNA, 14 nt, Pseudomonas putida KT2440
gcuugaucugguca

SEQ ID NO: 1600860 - RNA, 21 nt, Pseudomonas putida KT2440
gcuugaugcugucgaagcgcu

SEQ ID NO: 1600861 - RNA, 21 nt, Pseudomonas putida KT2440
gcuugacgaucuucugcacgc

SEQ ID NO: 1600862 - RNA, 19 nt, Pseudomonas putida KT2440
gcuugagcgcgccgccuuc

SEQ ID NO: 1600863 - RNA, 18 nt, Pseudomonas putida KT2440
gcuugagccuugugcugu

SEQ ID NO: 1600864 - RNA, 19 nt, Pseudomonas putida KT2440
gcuugagccuugugcugug

SEQ ID NO: 1600865 - RNA, 22 nt, Pseudomonas putida KT2440
gcuugagaccaggccuggaugc

SEQ ID NO: 1600866 - RNA, 17 nt, Pseudomonas putida KT2440
gcuuccaguuggccggc

SEQ ID NO: 1600867 - RNA, 22 nt, Pseudomonas putida KT2440
gcuucccccaaucuccagcccg

SEQ ID NO: 1600868 - RNA, 20 nt, Pseudomonas putida KT2440
gcuucccgguaacgggccag

SEQ ID NO: 1600869 - RNA, 13 nt, Pseudomonas putida KT2440
gcuuccugcuggc

SEQ ID NO: 1600870 - RNA, 18 nt, Pseudomonas putida KT2440
gcuuccuggccuuccuug

SEQ ID NO: 1600871 - RNA, 13 nt, Pseudomonas putida KT2440
gcuuccucuucaa

SEQ ID NO: 1600872 - RNA, 18 nt, Pseudomonas putida KT2440
gcuuccucuucaaggccc

SEQ ID NO: 1600873 - RNA, 19 nt, Pseudomonas putida KT2440
gcuucgcgcauuucgucca

SEQ ID NO: 1600874 - RNA, 23 nt, Pseudomonas putida KT2440
gcuucgcgggcacgcccgcuccc

SEQ ID NO: 1600875 - RNA, 15 nt, Pseudomonas putida KT2440
gcuucgccagcgcca

SEQ ID NO: 1600876 - RNA, 16 nt, Pseudomonas putida KT2440
gcuucgccgcgcugug

SEQ ID NO: 1600877 - RNA, 23 nt, Pseudomonas putida KT2440
gcuucgcccucguucgcgggcac

SEQ ID NO: 1600878 - RNA, 12 nt, Pseudomonas putida KT2440
gcuuccuugucc

SEQ ID NO: 1600879 - RNA, 16 nt, Pseudomonas putida KT2440
gcuucgaugcccggca

SEQ ID NO: 1600880 - RNA, 22 nt, Pseudomonas putida KT2440
gcuucgcagacgucuuccaugc

SEQ ID NO: 1600881 - RNA, 16 nt, Pseudomonas putida KT2440
gcuucgggaauaccag

SEQ ID NO: 1600882 - RNA, 20 nt, Pseudomonas putida KT2440
gcuucgggaauaccaggccc

SEQ ID NO: 1600883 - RNA, 20 nt, Pseudomonas putida KT2440
gcuucggugugcuccagcuc

SEQ ID NO: 1600884 - RNA, 22 nt, Pseudomonas putida KT2440
gcuucggugugcuccagcucca

SEQ ID NO: 1600885 - RNA, 13 nt, Pseudomonas putida KT2440
gcuucggcaugca

SEQ ID NO: 1600886 - RNA, 23 nt, Pseudomonas putida KT2440
gcuucggccacgguguauccagc

SEQ ID NO: 1600887 - RNA, 15 nt, Pseudomonas putida KT2440
gcuucggcgcgggca

SEQ ID NO: 1600888 - RNA, 19 nt, Pseudomonas putida KT2440
gcuucggcgggguuuuuuc

SEQ ID NO: 1600889 - RNA, 18 nt, Pseudomonas putida KT2440
gcuucgcggaucaacccg

SEQ ID NO: 1600890 - RNA, 19 nt, Pseudomonas putida KT2440
gcuucucgcgcuuggccag

SEQ ID NO: 1600891 - RNA, 22 nt, Pseudomonas putida KT2440
gcuucugagccagccgcggcag

SEQ ID NO: 1600892 - RNA, 13 nt, Pseudomonas putida KT2440
gcuucugcuucag

SEQ ID NO: 1600893 - RNA, 15 nt, Pseudomonas putida KT2440
gcuucugcuucagcu

SEQ ID NO: 1600894 - RNA, 14 nt, Pseudomonas putida KT2440
gcuucugcacuccc

SEQ ID NO: 1600895 - RNA, 21 nt, Pseudomonas putida KT2440
gcuucugcagauccuugauca

SEQ ID NO: 1600896 - RNA, 19 nt, Pseudomonas putida KT2440
gcuucuccagcaagcgcuc

SEQ ID NO: 1600897 - RNA, 12 nt, Pseudomonas putida KT2440
gcuucucacgca

SEQ ID NO: 1600898 - RNA, 14 nt, Pseudomonas putida KT2440
gcuucguccaggua

SEQ ID NO: 1600899 - RNA, 12 nt, Pseudomonas putida KT2440
gcuucugguugu

SEQ ID NO: 1600900 - RNA, 18 nt, Pseudomonas putida KT2440
gcuucuucacaccggccu

SEQ ID NO: 1600901 - RNA, 15 nt, Pseudomonas putida KT2440
gcuugaagcggccua

SEQ ID NO: 1600902 - RNA, 16 nt, Pseudomonas putida KT2440
gcuugaagcugcgcuc

SEQ ID NO: 1600903 - RNA, 22 nt, Pseudomonas putida KT2440
gcuugaacccgugcaucugcuc

SEQ ID NO: 1600904 - RNA, 14 nt, Pseudomonas putida KT2440
gcuugaccauggcg

SEQ ID NO: 1600905 - RNA, 12 nt, Pseudomonas putida KT2440
gcuugacccccu

SEQ ID NO: 1600906 - RNA, 19 nt, Pseudomonas putida KT2440
gcuugacgaucgccagccc

SEQ ID NO: 1600907 - RNA, 22 nt, Pseudomonas putida KT2440
gcuugacgaucgccagccccag

SEQ ID NO: 1600908 - RNA, 18 nt, Pseudomonas putida KT2440
gcuuauugcgcagggugg

SEQ ID NO: 1600909 - RNA, 19 nt, Pseudomonas putida KT2440
gcuucaacgcgacgguuga

SEQ ID NO: 1600910 - RNA, 21 nt, Pseudomonas putida KT2440
gcuucagaucacccuuggcca

SEQ ID NO: 1600911 - RNA, 18 nt, Pseudomonas putida KT2440
gcuucacgggucaugcca

SEQ ID NO: 1600912 - RNA, 18 nt, Pseudomonas putida KT2440
gcuucaccgcgcaccucc

SEQ ID NO: 1600913 - RNA, 20 nt, Pseudomonas putida KT2440
gcuucaccgcgcaccuccug

SEQ ID NO: 1600914 - RNA, 19 nt, Pseudomonas putida KT2440
gcuucagccuuuuccagcu

SEQ ID NO: 1600915 - RNA, 15 nt, Pseudomonas putida KT2440
gcuucaggccgccuu

SEQ ID NO: 1600916 - RNA, 16 nt, Pseudomonas putida KT2440
gcuuccaccauucccu

SEQ ID NO: 1600917 - RNA, 20 nt, Pseudomonas putida KT2440
gcuuccaccauucccugcac

SEQ ID NO: 1600918 - RNA, 21 nt, Pseudomonas putida KT2440
gcuuccaccauucccugcaca

SEQ ID NO: 1600919 - RNA, 20 nt, Pseudomonas putida KT2440
gcuuccaccucgggcuuggc

SEQ ID NO: 1600920 - RNA, 16 nt, Pseudomonas putida KT2440
gcuucaugcugcugca

SEQ ID NO: 1600921 - RNA, 18 nt, Pseudomonas putida KT2440
gcuucaugcugcugcagc

SEQ ID NO: 1600922 - RNA, 21 nt, Pseudomonas putida KT2440
gcuucaucgcugacuuccagc

SEQ ID NO: 1600923 - RNA, 22 nt, Pseudomonas putida KT2440
gcuucaucgcugacuuccagca

SEQ ID NO: 1600924 - RNA, 15 nt, Pseudomonas putida KT2440
gcuucaucggcuggc

SEQ ID NO: 1600925 - RNA, 15 nt, Pseudomonas putida KT2440
gcuucauggcgccga

SEQ ID NO: 1600926 - RNA, 22 nt, Pseudomonas putida KT2440
gcuuacccgcgaagaggccggc

SEQ ID NO: 1600927 - RNA, 15 nt, Pseudomonas putida KT2440
gcuuaucggcugacc

SEQ ID NO: 1600928 - RNA, 17 nt, Pseudomonas putida KT2440
gcuuauucuucuggcuu

SEQ ID NO: 1600929 - RNA, 14 nt, Pseudomonas putida KT2440
gcuuacuuggucac

SEQ ID NO: 1600930 - RNA, 15 nt, Pseudomonas putida KT2440
gcuggccaaggccuc

SEQ ID NO: 1600931 - RNA, 14 nt, Pseudomonas putida KT2440
gcuggccaaggucu

SEQ ID NO: 1600932 - RNA, 18 nt, Pseudomonas putida KT2440
gcuggccaaggucuccag

SEQ ID NO: 1600933 - RNA, 23 nt, Pseudomonas putida KT2440
gcuggccaaucuccacccgccgu

SEQ ID NO: 1600934 - RNA, 23 nt, Pseudomonas putida KT2440
gcuggccaauuucuacccgccgu

SEQ ID NO: 1600935 - RNA, 22 nt, Pseudomonas putida KT2440
gcuggcauucaacgcccgccgu

SEQ ID NO: 1600936 - RNA, 18 nt, Pseudomonas putida KT2440
gcuggcagcuugcccugc

SEQ ID NO: 1600937 - RNA, 17 nt, Pseudomonas putida KT2440
gcuggccaucccgcugu

SEQ ID NO: 1600938 - RNA, 20 nt, Pseudomonas putida KT2440
gcuggccauuucgcggcgca

SEQ ID NO: 1600939 - RNA, 13 nt, Pseudomonas putida KT2440
gcuggccaggaug

SEQ ID NO: 1600940 - RNA, 22 nt, Pseudomonas putida KT2440
gcuggccugcagccguugcugg

SEQ ID NO: 1600941 - RNA, 21 nt, Pseudomonas putida KT2440
gcuggccuuggacaccaggcu

SEQ ID NO: 1600942 - RNA, 14 nt, Pseudomonas putida KT2440
gcuggccgugguga

SEQ ID NO: 1600943 - RNA, 14 nt, Pseudomonas putida KT2440
gcuggccguccagc

SEQ ID NO: 1600944 - RNA, 19 nt, Pseudomonas putida KT2440
gcuggccguccagcugagc

SEQ ID NO: 1600945 - RNA, 22 nt, Pseudomonas putida KT2440
gcuggccguccagcugagcgcc

SEQ ID NO: 1600946 - RNA, 14 nt, Pseudomonas putida KT2440
gcuggccgguggcu

SEQ ID NO: 1600947 - RNA, 14 nt, Pseudomonas putida KT2440
gcuggccgcaccca

SEQ ID NO: 1600948 - RNA, 23 nt, Pseudomonas putida KT2440
gcuggccgccacggugccgaaca

SEQ ID NO: 1600949 - RNA, 19 nt, Pseudomonas putida KT2440
gcuggccgcccgcccgcgu

SEQ ID NO: 1600950 - RNA, 16 nt, Pseudomonas putida KT2440
gcuggcgguuugcucc

SEQ ID NO: 1600951 - RNA, 17 nt, Pseudomonas putida KT2440
gcuggcggcugagccgg

SEQ ID NO: 1600952 - RNA, 18 nt, Pseudomonas putida KT2440
gcuggcgggcaaacuggc

SEQ ID NO: 1600953 - RNA, 20 nt, Pseudomonas putida KT2440
gcuggcgcucaauggcaccg

SEQ ID NO: 1600954 - RNA, 21 nt, Pseudomonas putida KT2440
gcuggcgcucaauggcaccgu

SEQ ID NO: 1600955 - RNA, 12 nt, Pseudomonas putida KT2440
gcuggcgcgcug

SEQ ID NO: 1600956 - RNA, 14 nt, Pseudomonas putida KT2440
gcuggcgcgcggcc

SEQ ID NO: 1600957 - RNA, 17 nt, Pseudomonas putida KT2440
gcuggcgacgaagcugc

SEQ ID NO: 1600958 - RNA, 18 nt, Pseudomonas putida KT2440
gcuggcgaucaggcaggc

SEQ ID NO: 1600959 - RNA, 22 nt, Pseudomonas putida KT2440
gcuggcgaucaggcaggccagc

SEQ ID NO: 1600960 - RNA, 21 nt, Pseudomonas putida KT2440
gcuggcgaugaagacgcucga

SEQ ID NO: 1600961 - RNA, 17 nt, Pseudomonas putida KT2440
gcuggucgaggcggcug

SEQ ID NO: 1600962 - RNA, 22 nt, Pseudomonas putida KT2440
gcuggucggcuauggcgcggug

SEQ ID NO: 1600963 - RNA, 13 nt, Pseudomonas putida KT2440
gcuggggccgcaa

SEQ ID NO: 1600964 - RNA, 19 nt, Pseudomonas putida KT2440
gcuggggccgcaaagcggc

SEQ ID NO: 1600965 - RNA, 18 nt, Pseudomonas putida KT2440
gcugguacuccacuucca

SEQ ID NO: 1600966 - RNA, 19 nt, Pseudomonas putida KT2440
gcugguagaaccacuccag

SEQ ID NO: 1600967 - RNA, 21 nt, Pseudomonas putida KT2440
gcugguagaaccacuccaggg

SEQ ID NO: 1600968 - RNA, 15 nt, Pseudomonas putida KT2440
gcugguacagcagga

SEQ ID NO: 1600969 - RNA, 16 nt, Pseudomonas putida KT2440
gcugguacagggucag

SEQ ID NO: 1600970 - RNA, 18 nt, Pseudomonas putida KT2440
gcugggugccaucagggc

SEQ ID NO: 1600971 - RNA, 23 nt, Pseudomonas putida KT2440
gcugggugcgcgggucauccagg

SEQ ID NO: 1600972 - RNA, 20 nt, Pseudomonas putida KT2440
gcuggguaccgugcugcagg

SEQ ID NO: 1600973 - RNA, 20 nt, Pseudomonas putida KT2440
gcugggcgaacgccugcagg

SEQ ID NO: 1600974 - RNA, 19 nt, Pseudomonas putida KT2440
gcugggcccgcccagcugg

SEQ ID NO: 1600975 - RNA, 23 nt, Pseudomonas putida KT2440
gcugggcgaugaucgccuggccg

SEQ ID NO: 1600976 - RNA, 22 nt, Pseudomonas putida KT2440
gcuggggauuuggggcgcccgg

SEQ ID NO: 1600977 - RNA, 20 nt, Pseudomonas putida KT2440
gcugggcuucgacaaccggg

SEQ ID NO: 1600978 - RNA, 17 nt, Pseudomonas putida KT2440
gcugggcgugccaggcu

SEQ ID NO: 1600979 - RNA, 17 nt, Pseudomonas putida KT2440
gcuggcuggucuccagc

SEQ ID NO: 1600980 - RNA, 17 nt, Pseudomonas putida KT2440
gcugggaauccagugca

SEQ ID NO: 1600981 - RNA, 17 nt, Pseudomonas putida KT2440
gcugggagagcgccugc

SEQ ID NO: 1600982 - RNA, 22 nt, Pseudomonas putida KT2440
gcuggcuuacaucaugccgccc

SEQ ID NO: 1600983 - RNA, 13 nt, Pseudomonas putida KT2440
gcugugcacugcg

SEQ ID NO: 1600984 - RNA, 14 nt, Pseudomonas putida KT2440
gcugugcagcgcuc

SEQ ID NO: 1600985 - RNA, 20 nt, Pseudomonas putida KT2440
gcugugcaacagcgccuggc

SEQ ID NO: 1600986 - RNA, 14 nt, Pseudomonas putida KT2440
gcugucgucaagcu

SEQ ID NO: 1600987 - RNA, 18 nt, Pseudomonas putida KT2440
gcugucuuccagggcaau

SEQ ID NO: 1600988 - RNA, 21 nt, Pseudomonas putida KT2440
gcugugcucagcacauucagc

SEQ ID NO: 1600989 - RNA, 14 nt, Pseudomonas putida KT2440
gcugugcucuggcu

SEQ ID NO: 1600990 - RNA, 14 nt, Pseudomonas putida KT2440
gcugugcggcuggc

SEQ ID NO: 1600991 - RNA, 14 nt, Pseudomonas putida KT2440
gcuguugcgcuggg

SEQ ID NO: 1600992 - RNA, 18 nt, Pseudomonas putida KT2440
gcuguuccucgccauggc

SEQ ID NO: 1600993 - RNA, 21 nt, Pseudomonas putida KT2440
gcuguuccucgccauggccga

SEQ ID NO: 1600994 - RNA, 15 nt, Pseudomonas putida KT2440
gcuguucgcagcaca

SEQ ID NO: 1600995 - RNA, 12 nt, Pseudomonas putida KT2440
gcuguuccagcc

SEQ ID NO: 1600996 - RNA, 20 nt, Pseudomonas putida KT2440
gcuguuaccagagagcugag

SEQ ID NO: 1600997 - RNA, 23 nt, Pseudomonas putida KT2440
gcuguuguugccucaggugcaca

SEQ ID NO: 1600998 - RNA, 21 nt, Pseudomonas putida KT2440
gcuguuggcgcgacauguuca

SEQ ID NO: 1600999 - RNA, 22 nt, Pseudomonas putida KT2440
gcugguucauugccaacagcag

SEQ ID NO: 1601000 - RNA, 21 nt, Pseudomonas putida KT2440
gcugguucgauuccagcaggg

SEQ ID NO: 1601001 - RNA, 14 nt, Pseudomonas putida KT2440
gcuguacaacgcag

SEQ ID NO: 1601002 - RNA, 19 nt, Pseudomonas putida KT2440
gcuguacaacgcagccggc

SEQ ID NO: 1601003 - RNA, 22 nt, Pseudomonas putida KT2440
gcuguacaacgcagccggcacc

SEQ ID NO: 1601004 - RNA, 17 nt, Pseudomonas putida KT2440
gcuguacgcuggccaag

SEQ ID NO: 1601005 - RNA, 13 nt, Pseudomonas putida KT2440
gcuguaccggccu

SEQ ID NO: 1601006 - RNA, 13 nt, Pseudomonas putida KT2440
gcuguaaccuggu

SEQ ID NO: 1601007 - RNA, 14 nt, Pseudomonas putida KT2440
gcuguaaccugguu

SEQ ID NO: 1601008 - RNA, 18 nt, Pseudomonas putida KT2440
gcugguuuaucagcagcu

SEQ ID NO: 1601009 - RNA, 22 nt, Pseudomonas putida KT2440
gcugucgcuacgcgccauccgc

SEQ ID NO: 1601010 - RNA, 23 nt, Pseudomonas putida KT2440
gcuguccugauguucggugcuca

SEQ ID NO: 1601011 - RNA, 13 nt, Pseudomonas putida KT2440
gcugucccaugcu

SEQ ID NO: 1601012 - RNA, 14 nt, Pseudomonas putida KT2440
gcugucacccuugg

SEQ ID NO: 1601013 - RNA, 21 nt, Pseudomonas putida KT2440
gcuguaggggcgggccugcug

SEQ ID NO: 1601014 - RNA, 15 nt, Pseudomonas putida KT2440
gcugcgugccuugcc

SEQ ID NO: 1601015 - RNA, 18 nt, Pseudomonas putida KT2440
gcugcguggcauccuuua

SEQ ID NO: 1601016 - RNA, 19 nt, Pseudomonas putida KT2440
gcugcgguuugcucugaca

SEQ ID NO: 1601017 - RNA, 16 nt, Pseudomonas putida KT2440
gcugcguacgcucugg

SEQ ID NO: 1601018 - RNA, 18 nt, Pseudomonas putida KT2440
gcugcgucagcauccaac

SEQ ID NO: 1601019 - RNA, 21 nt, Pseudomonas putida KT2440
gcugcgucagcauccaacccu

SEQ ID NO: 1601020 - RNA, 23 nt, Pseudomonas putida KT2440
gcugcgucagcauccaacccugc

SEQ ID NO: 1601021 - RNA, 16 nt, Pseudomonas putida KT2440
gcugcggggcagcccc

SEQ ID NO: 1601022 - RNA, 20 nt, Pseudomonas putida KT2440
gcugcggucaucaccacccc

SEQ ID NO: 1601023 - RNA, 14 nt, Pseudomonas putida KT2440
gcugcggucggguc

SEQ ID NO: 1601024 - RNA, 14 nt, Pseudomonas putida KT2440
gcugcucgcccgcc

SEQ ID NO: 1601025 - RNA, 15 nt, Pseudomonas putida KT2440
gcugcuccaugaucu

SEQ ID NO: 1601026 - RNA, 21 nt, Pseudomonas putida KT2440
gcugcuccccaaccaccuccc

SEQ ID NO: 1601027 - RNA, 18 nt, Pseudomonas putida KT2440
gcugcgcgccauggcgac

SEQ ID NO: 1601028 - RNA, 15 nt, Pseudomonas putida KT2440
gcugcgcggcagccc

SEQ ID NO: 1601029 - RNA, 15 nt, Pseudomonas putida KT2440
gcugcgccgcucugc

SEQ ID NO: 1601030 - RNA, 16 nt, Pseudomonas putida KT2440
gcugcgccgcucugcc

SEQ ID NO: 1601031 - RNA, 17 nt, Pseudomonas putida KT2440
gcugcgccugccgggcc

SEQ ID NO: 1601032 - RNA, 19 nt, Pseudomonas putida KT2440
gcugcgcaucacccgcccc

SEQ ID NO: 1601033 - RNA, 23 nt, Pseudomonas putida KT2440
gcugcgcaucaggcugcgcccgc

SEQ ID NO: 1601034 - RNA, 17 nt, Pseudomonas putida KT2440
gcugcgcaugaaacucg

SEQ ID NO: 1601035 - RNA, 14 nt, Pseudomonas putida KT2440
gcugcgcccgccuu

SEQ ID NO: 1601036 - RNA, 14 nt, Pseudomonas putida KT2440
gcugcgcacguagc

SEQ ID NO: 1601037 - RNA, 14 nt, Pseudomonas putida KT2440
gcugcgcacgcagg

SEQ ID NO: 1601038 - RNA, 13 nt, Pseudomonas putida KT2440
gcugcgcagcccc

SEQ ID NO: 1601039 - RNA, 13 nt, Pseudomonas putida KT2440
gcugcgcagcccu

SEQ ID NO: 1601040 - RNA, 15 nt, Pseudomonas putida KT2440
gcugcgcagcccugu

SEQ ID NO: 1601041 - RNA, 15 nt, Pseudomonas putida KT2440
gcugcgcggccccug

SEQ ID NO: 1601042 - RNA, 14 nt, Pseudomonas putida KT2440
gcugcgcugccugc

SEQ ID NO: 1601043 - RNA, 20 nt, Pseudomonas putida KT2440
gcugcgcucgauccugugga

SEQ ID NO: 1601044 - RNA, 14 nt, Pseudomonas putida KT2440
gcugcggccaccgc

SEQ ID NO: 1601045 - RNA, 21 nt, Pseudomonas putida KT2440
gcugcggcagguaggcccagc

SEQ ID NO: 1601046 - RNA, 17 nt, Pseudomonas putida KT2440
gcugcggggugcucugc

SEQ ID NO: 1601047 - RNA, 17 nt, Pseudomonas putida KT2440
gcugcggguaaugccac

SEQ ID NO: 1601048 - RNA, 23 nt, Pseudomonas putida KT2440
gcugcgggcguuguguugcuggg

SEQ ID NO: 1601049 - RNA, 13 nt, Pseudomonas putida KT2440
gcugcggcugcuc

SEQ ID NO: 1601050 - RNA, 15 nt, Pseudomonas putida KT2440
gcuggcaaugcaacu

SEQ ID NO: 1601051 - RNA, 19 nt, Pseudomonas putida KT2440
gcuggcacugcccaagcca

SEQ ID NO: 1601052 - RNA, 19 nt, Pseudomonas putida KT2440
gcuggacccaaucgcugug

SEQ ID NO: 1601053 - RNA, 20 nt, Pseudomonas putida KT2440
gcuggacuaacaggugcuca

SEQ ID NO: 1601054 - RNA, 22 nt, Pseudomonas putida KT2440
gcuggagcuauuuggcuccaac

SEQ ID NO: 1601055 - RNA, 12 nt, Pseudomonas putida KT2440
gcuggauaccca

SEQ ID NO: 1601056 - RNA, 15 nt, Pseudomonas putida KT2440
gcuggauacccagcg

SEQ ID NO: 1601057 - RNA, 15 nt, Pseudomonas putida KT2440
gcugcuuugcagccc

SEQ ID NO: 1601058 - RNA, 20 nt, Pseudomonas putida KT2440
gcuggaagugcugagagggu

SEQ ID NO: 1601059 - RNA, 20 nt, Pseudomonas putida KT2440
gcugcuggauugccugauca

SEQ ID NO: 1601060 - RNA, 18 nt, Pseudomonas putida KT2440
gcugcuggccgccagaca

SEQ ID NO: 1601061 - RNA, 15 nt, Pseudomonas putida KT2440
gcugcugcagggccc

SEQ ID NO: 1601062 - RNA, 19 nt, Pseudomonas putida KT2440
gcugcugcagggcccagcc

SEQ ID NO: 1601063 - RNA, 18 nt, Pseudomonas putida KT2440
gcugcugcagcacugccu

SEQ ID NO: 1601064 - RNA, 14 nt, Pseudomonas putida KT2440
gcugcuggccuugc

SEQ ID NO: 1601065 - RNA, 12 nt, Pseudomonas putida KT2440
gcugcuuaccag

SEQ ID NO: 1601066 - RNA, 21 nt, Pseudomonas putida KT2440
gcugcuuccggcugguacucc

SEQ ID NO: 1601067 - RNA, 17 nt, Pseudomonas putida KT2440
gcugcugugcggcuggc

SEQ ID NO: 1601068 - RNA, 22 nt, Pseudomonas putida KT2440
gcugcuguccagacgccgcagu

SEQ ID NO: 1601069 - RNA, 15 nt, Pseudomonas putida KT2440
gcugcauugcagccc

SEQ ID NO: 1601070 - RNA, 16 nt, Pseudomonas putida KT2440
gcugcauugcagcccc

SEQ ID NO: 1601071 - RNA, 21 nt, Pseudomonas putida KT2440
gcugcauuggcggcaggcgca

SEQ ID NO: 1601072 - RNA, 14 nt, Pseudomonas putida KT2440
gcugccaaccggcu

SEQ ID NO: 1601073 - RNA, 20 nt, Pseudomonas putida KT2440
gcugccaaaccgccccacca

SEQ ID NO: 1601074 - RNA, 18 nt, Pseudomonas putida KT2440
gcugccagcugcgcugcc

SEQ ID NO: 1601075 - RNA, 16 nt, Pseudomonas putida KT2440
gcugccacucuucacc

SEQ ID NO: 1601076 - RNA, 18 nt, Pseudomonas putida KT2440
gcugccacucuucaccau

SEQ ID NO: 1601077 - RNA, 12 nt, Pseudomonas putida KT2440
gcugccacugcg

SEQ ID NO: 1601078 - RNA, 18 nt, Pseudomonas putida KT2440
gcugccaccuuccagguc

SEQ ID NO: 1601079 - RNA, 16 nt, Pseudomonas putida KT2440
gcugcagcacugccug

SEQ ID NO: 1601080 - RNA, 18 nt, Pseudomonas putida KT2440
gcugcagcacugccugca

SEQ ID NO: 1601081 - RNA, 22 nt, Pseudomonas putida KT2440
gcugcagcuccuuguagauauu

SEQ ID NO: 1601082 - RNA, 17 nt, Pseudomonas putida KT2440
gcugcagggcccagcca

SEQ ID NO: 1601083 - RNA, 21 nt, Pseudomonas putida KT2440
gcugcagggcacgccaaucac

SEQ ID NO: 1601084 - RNA, 17 nt, Pseudomonas putida KT2440
gcugcaggucggccagc

SEQ ID NO: 1601085 - RNA, 20 nt, Pseudomonas putida KT2440
gcugcaguucuuccagcggc

SEQ ID NO: 1601086 - RNA, 21 nt, Pseudomonas putida KT2440
gcugcagguucugaaucuggc

SEQ ID NO: 1601087 - RNA, 22 nt, Pseudomonas putida KT2440
gcugcacgucgcgcagggccuu

SEQ ID NO: 1601088 - RNA, 19 nt, Pseudomonas putida KT2440
gcugcagaaccgccagcac

SEQ ID NO: 1601089 - RNA, 20 nt, Pseudomonas putida KT2440
gcugcagaaccgccagcacc

SEQ ID NO: 1601090 - RNA, 14 nt, Pseudomonas putida KT2440
gcugcagacccgcg

SEQ ID NO: 1601091 - RNA, 13 nt, Pseudomonas putida KT2440
gcugcacuuccac

SEQ ID NO: 1601092 - RNA, 18 nt, Pseudomonas putida KT2440
gcugcacuuccacacccg

SEQ ID NO: 1601093 - RNA, 19 nt, Pseudomonas putida KT2440
gcugcacuucgauacccag

SEQ ID NO: 1601094 - RNA, 17 nt, Pseudomonas putida KT2440
gcugcaccgaccgugca

SEQ ID NO: 1601095 - RNA, 17 nt, Pseudomonas putida KT2440
gcugcaccgccaccccg

SEQ ID NO: 1601096 - RNA, 14 nt, Pseudomonas putida KT2440
gcugcacaggccag

SEQ ID NO: 1601097 - RNA, 22 nt, Pseudomonas putida KT2440
gcugcaaucgagccgaacagca

SEQ ID NO: 1601098 - RNA, 13 nt, Pseudomonas putida KT2440
gcugcaaggcagc

SEQ ID NO: 1601099 - RNA, 19 nt, Pseudomonas putida KT2440
gcugcaaggcagccccugc

SEQ ID NO: 1601100 - RNA, 17 nt, Pseudomonas putida KT2440
gcugcaagcgcaccugc

SEQ ID NO: 1601101 - RNA, 15 nt, Pseudomonas putida KT2440
gcugcaaagcagccc

SEQ ID NO: 1601102 - RNA, 16 nt, Pseudomonas putida KT2440
gcugcaaagcagcccc

SEQ ID NO: 1601103 - RNA, 21 nt, Pseudomonas putida KT2440
gcugcaaagcagccccaaaag

SEQ ID NO: 1601104 - RNA, 12 nt, Pseudomonas putida KT2440
gcugcaacagcg

SEQ ID NO: 1601105 - RNA, 20 nt, Pseudomonas putida KT2440
gcugccauuucuucagcagg

SEQ ID NO: 1601106 - RNA, 21 nt, Pseudomonas putida KT2440
gcugccauuucuucagcagga

SEQ ID NO: 1601107 - RNA, 23 nt, Pseudomonas putida KT2440
gcugccauuucuucagcaggaag

SEQ ID NO: 1601108 - RNA, 14 nt, Pseudomonas putida KT2440
gcugccauccuuga

SEQ ID NO: 1601109 - RNA, 17 nt, Pseudomonas putida KT2440
gcugccaugcaaggcaa

SEQ ID NO: 1601110 - RNA, 13 nt, Pseudomonas putida KT2440
gcugccaggccgc

SEQ ID NO: 1601111 - RNA, 17 nt, Pseudomonas putida KT2440
gcugccauagcgcugca

SEQ ID NO: 1601112 - RNA, 20 nt, Pseudomonas putida KT2440
gcugccauagcgcugcaccg

SEQ ID NO: 1601113 - RNA, 23 nt, Pseudomonas putida KT2440
gcugcccagcgaauagcaacaca

SEQ ID NO: 1601114 - RNA, 17 nt, Pseudomonas putida KT2440
gcugcccaggugccagg

SEQ ID NO: 1601115 - RNA, 19 nt, Pseudomonas putida KT2440
gcugcccaacgccugaagc

SEQ ID NO: 1601116 - RNA, 14 nt, Pseudomonas putida KT2440
gcugccccaacugc

SEQ ID NO: 1601117 - RNA, 20 nt, Pseudomonas putida KT2440
gcugccccaacugcauccgc

SEQ ID NO: 1601118 - RNA, 21 nt, Pseudomonas putida KT2440
gcugccccaagugccagaacc

SEQ ID NO: 1601119 - RNA, 13 nt, Pseudomonas putida KT2440
gcugcccucgggc

SEQ ID NO: 1601120 - RNA, 16 nt, Pseudomonas putida KT2440
gcugcccucgggcagc

SEQ ID NO: 1601121 - RNA, 22 nt, Pseudomonas putida KT2440
gcugcccguccggcaugcgccg

SEQ ID NO: 1601122 - RNA, 14 nt, Pseudomonas putida KT2440
gcugccgaucagca

SEQ ID NO: 1601123 - RNA, 23 nt, Pseudomonas putida KT2440
gcugccgaucagcacgccgccga

SEQ ID NO: 1601124 - RNA, 14 nt, Pseudomonas putida KT2440
gcugccgcaccugc

SEQ ID NO: 1601125 - RNA, 17 nt, Pseudomonas putida KT2440
gcugccgccaaccagcu

SEQ ID NO: 1601126 - RNA, 18 nt, Pseudomonas putida KT2440
gcugccgcccucuugcug

SEQ ID NO: 1601127 - RNA, 20 nt, Pseudomonas putida KT2440
gcugccgcccucuugcugca

SEQ ID NO: 1601128 - RNA, 13 nt, Pseudomonas putida KT2440
gcugccuucucug

SEQ ID NO: 1601129 - RNA, 21 nt, Pseudomonas putida KT2440
gcugccuucucuguguucuuc

SEQ ID NO: 1601130 - RNA, 13 nt, Pseudomonas putida KT2440
gcugccugugccg

SEQ ID NO: 1601131 - RNA, 23 nt, Pseudomonas putida KT2440
gcugccuggcccgcuacgacccu

SEQ ID NO: 1601132 - RNA, 22 nt, Pseudomonas putida KT2440
gcugccuccacaccgacaucca

SEQ ID NO: 1601133 - RNA, 20 nt, Pseudomonas putida KT2440
gcugcgauagaacuccacca

SEQ ID NO: 1601134 - RNA, 23 nt, Pseudomonas putida KT2440
gcugcgauagaacuccaccagcc

SEQ ID NO: 1601135 - RNA, 20 nt, Pseudomonas putida KT2440
gcugcgaaacgaaacccugc

SEQ ID NO: 1601136 - RNA, 19 nt, Pseudomonas putida KT2440
gcugcgaaugggcugcaaa

SEQ ID NO: 1601137 - RNA, 22 nt, Pseudomonas putida KT2440
gcugccuugcccagcuccagca

SEQ ID NO: 1601138 - RNA, 23 nt, Pseudomonas putida KT2440
gcugccggaacguuuccagcaac

SEQ ID NO: 1601139 - RNA, 22 nt, Pseudomonas putida KT2440
gcugccgccgaacauggugcuu

SEQ ID NO: 1601140 - RNA, 21 nt, Pseudomonas putida KT2440
gcugccggcguggcgagcuga

SEQ ID NO: 1601141 - RNA, 15 nt, Pseudomonas putida KT2440
gcugccggaccugcc

SEQ ID NO: 1601142 - RNA, 14 nt, Pseudomonas putida KT2440
gcugccggccagcg

SEQ ID NO: 1601143 - RNA, 18 nt, Pseudomonas putida KT2440
gcgcaucacccgccccuc

SEQ ID NO: 1601144 - RNA, 15 nt, Pseudomonas putida KT2440
gcgcaucagccgcgc

SEQ ID NO: 1601145 - RNA, 20 nt, Pseudomonas putida KT2440
gcgcaucccuuguaggagcu

SEQ ID NO: 1601146 - RNA, 14 nt, Pseudomonas putida KT2440
gcgcauccagcagg

SEQ ID NO: 1601147 - RNA, 16 nt, Pseudomonas putida KT2440
gcgcauaggcaaugau

SEQ ID NO: 1601148 - RNA, 18 nt, Pseudomonas putida KT2440
gcgcaguucguccaggcu

SEQ ID NO: 1601149 - RNA, 15 nt, Pseudomonas putida KT2440
gcgcaguaacaggcg

SEQ ID NO: 1601150 - RNA, 17 nt, Pseudomonas putida KT2440
gcgcaguacaggcugcc

SEQ ID NO: 1601151 - RNA, 22 nt, Pseudomonas putida KT2440
gcgcagucaccacacggcagcc

SEQ ID NO: 1601152 - RNA, 23 nt, Pseudomonas putida KT2440
gcgcagguacgccaugugcgccc

SEQ ID NO: 1601153 - RNA, 17 nt, Pseudomonas putida KT2440
gcgcaggugcagccagc

SEQ ID NO: 1601154 - RNA, 22 nt, Pseudomonas putida KT2440
gcgcagccggccuugcuccagu

SEQ ID NO: 1601155 - RNA, 18 nt, Pseudomonas putida KT2440
gcgcagcgacgaccugca

SEQ ID NO: 1601156 - RNA, 15 nt, Pseudomonas putida KT2440
gcgcagcgcacggcu

SEQ ID NO: 1601157 - RNA, 17 nt, Pseudomonas putida KT2440
gcgcagcgcacggcugu

SEQ ID NO: 1601158 - RNA, 18 nt, Pseudomonas putida KT2440
gcgcagcgcacuuccaca

SEQ ID NO: 1601159 - RNA, 15 nt, Pseudomonas putida KT2440
gcgcagguaggggug

SEQ ID NO: 1601160 - RNA, 12 nt, Pseudomonas putida KT2440
gcgcaggggucu

SEQ ID NO: 1601161 - RNA, 20 nt, Pseudomonas putida KT2440
gcgcagggugucgguggcgg

SEQ ID NO: 1601162 - RNA, 21 nt, Pseudomonas putida KT2440
gcgcaggcugucgaacaggcu

SEQ ID NO: 1601163 - RNA, 12 nt, Pseudomonas putida KT2440
gcgcagggcgcg

SEQ ID NO: 1601164 - RNA, 14 nt, Pseudomonas putida KT2440
gcgcaccgagcgcu

SEQ ID NO: 1601165 - RNA, 17 nt, Pseudomonas putida KT2440
gcgcaccaaggcggcau

SEQ ID NO: 1601166 - RNA, 14 nt, Pseudomonas putida KT2440
gcgcaccaucggcu

SEQ ID NO: 1601167 - RNA, 20 nt, Pseudomonas putida KT2440
gcgcaccaucggcuccagcg

SEQ ID NO: 1601168 - RNA, 13 nt, Pseudomonas putida KT2440
gcgcagagcgccc

SEQ ID NO: 1601169 - RNA, 15 nt, Pseudomonas putida KT2440
gcgcagagcgccccg

SEQ ID NO: 1601170 - RNA, 17 nt, Pseudomonas putida KT2440
gcgcagagcgccccggc

SEQ ID NO: 1601171 - RNA, 15 nt, Pseudomonas putida KT2440
gcgcacgaauacgcu

SEQ ID NO: 1601172 - RNA, 16 nt, Pseudomonas putida KT2440
gcgcacucucccgcag

SEQ ID NO: 1601173 - RNA, 18 nt, Pseudomonas putida KT2440
gcgcacucucccgcagcc

SEQ ID NO: 1601174 - RNA, 22 nt, Pseudomonas putida KT2440
gcgcaccucggccagugcgccc

SEQ ID NO: 1601175 - RNA, 17 nt, Pseudomonas putida KT2440
gcgcaacucagcgcagc

SEQ ID NO: 1601176 - RNA, 17 nt, Pseudomonas putida KT2440
gcgcaagccgugccugg

SEQ ID NO: 1601177 - RNA, 14 nt, Pseudomonas putida KT2440
gcgcaagccgcugu

SEQ ID NO: 1601178 - RNA, 18 nt, Pseudomonas putida KT2440
gcgcaagccgcugucggu

SEQ ID NO: 1601179 - RNA, 16 nt, Pseudomonas putida KT2440
gcgcaaggggucgcgg

SEQ ID NO: 1601180 - RNA, 19 nt, Pseudomonas putida KT2440
gcgcaaggggucgcggccu

SEQ ID NO: 1601181 - RNA, 14 nt, Pseudomonas putida KT2440
gcgcaaggccgcgg

SEQ ID NO: 1601182 - RNA, 14 nt, Pseudomonas putida KT2440
gcgcaaggcauuca

SEQ ID NO: 1601183 - RNA, 20 nt, Pseudomonas putida KT2440
gcgcaaggcauucagcucgg

SEQ ID NO: 1601184 - RNA, 21 nt, Pseudomonas putida KT2440
gcgcaaggcauucagcucggc

SEQ ID NO: 1601185 - RNA, 19 nt, Pseudomonas putida KT2440
gcgcacagcugccggccag

SEQ ID NO: 1601186 - RNA, 16 nt, Pseudomonas putida KT2440
gcgcacaccgcuggug

SEQ ID NO: 1601187 - RNA, 23 nt, Pseudomonas putida KT2440
gcgcaccacaucauccaugaagc

SEQ ID NO: 1601188 - RNA, 20 nt, Pseudomonas putida KT2440
gcgccaggaguucugcacag

SEQ ID NO: 1601189 - RNA, 21 nt, Pseudomonas putida KT2440
gcgccaggaguucugcacagc

SEQ ID NO: 1601190 - RNA, 15 nt, Pseudomonas putida KT2440
gcgccaggaucaacu

SEQ ID NO: 1601191 - RNA, 16 nt, Pseudomonas putida KT2440
gcgccaggaucgagac

SEQ ID NO: 1601192 - RNA, 19 nt, Pseudomonas putida KT2440
gcgccaguucgacgcugcu

SEQ ID NO: 1601193 - RNA, 20 nt, Pseudomonas putida KT2440
gcgccaguucgacgcugcug

SEQ ID NO: 1601194 - RNA, 19 nt, Pseudomonas putida KT2440
gcgccaguucgcggcgcac

SEQ ID NO: 1601195 - RNA, 22 nt, Pseudomonas putida KT2440
gcgccaguucgcggcgcaccgc

SEQ ID NO: 1601196 - RNA, 20 nt, Pseudomonas putida KT2440
gcgccaguggcacccacagc

SEQ ID NO: 1601197 - RNA, 17 nt, Pseudomonas putida KT2440
gcgccaucuucacggca

SEQ ID NO: 1601198 - RNA, 17 nt, Pseudomonas putida KT2440
gcgccaucgcccacggc

SEQ ID NO: 1601199 - RNA, 19 nt, Pseudomonas putida KT2440
gcgccaucgcccacggcga

SEQ ID NO: 1601200 - RNA, 23 nt, Pseudomonas putida KT2440
gcgccaucggcacgccagcagcg

SEQ ID NO: 1601201 - RNA, 12 nt, Pseudomonas putida KT2440
gcgccagcaggu

SEQ ID NO: 1601202 - RNA, 17 nt, Pseudomonas putida KT2440
gcgccagcagguccagu

SEQ ID NO: 1601203 - RNA, 23 nt, Pseudomonas putida KT2440
gcgccagcaguuucagcggccgc

SEQ ID NO: 1601204 - RNA, 15 nt, Pseudomonas putida KT2440
gcgccagcuccacac

SEQ ID NO: 1601205 - RNA, 18 nt, Pseudomonas putida KT2440
gcgccagcacgcaggcca

SEQ ID NO: 1601206 - RNA, 22 nt, Pseudomonas putida KT2440
gcgccagcacgcaggccagcgc

SEQ ID NO: 1601207 - RNA, 17 nt, Pseudomonas putida KT2440
gcgccagcagccgggcc

SEQ ID NO: 1601208 - RNA, 20 nt, Pseudomonas putida KT2440
gcgccagcagccgggccuga

SEQ ID NO: 1601209 - RNA, 15 nt, Pseudomonas putida KT2440
gcgccaccgggcgcg

SEQ ID NO: 1601210 - RNA, 17 nt, Pseudomonas putida KT2440
gcgcauuuucaccgagc

SEQ ID NO: 1601211 - RNA, 15 nt, Pseudomonas putida KT2440
gcgcauuucguccag

SEQ ID NO: 1601212 - RNA, 20 nt, Pseudomonas putida KT2440
gcgcauuucguccaggcuca

SEQ ID NO: 1601213 - RNA, 20 nt, Pseudomonas putida KT2440
gcgccaaacgccagggccgg

SEQ ID NO: 1601214 - RNA, 23 nt, Pseudomonas putida KT2440
gcgccaauaccgcgcaucaucca

SEQ ID NO: 1601215 - RNA, 22 nt, Pseudomonas putida KT2440
gcgccaccagccccaaucccaa

SEQ ID NO: 1601216 - RNA, 12 nt, Pseudomonas putida KT2440
gcgccaccaucu

SEQ ID NO: 1601217 - RNA, 14 nt, Pseudomonas putida KT2440
gcgccacccaggca

SEQ ID NO: 1601218 - RNA, 14 nt, Pseudomonas putida KT2440
gcgccaccggcagc

SEQ ID NO: 1601219 - RNA, 21 nt, Pseudomonas putida KT2440
gcgccaaucaucgccagcagc

SEQ ID NO: 1601220 - RNA, 22 nt, Pseudomonas putida KT2440
gcgccaaucaucgccagcagcg

SEQ ID NO: 1601221 - RNA, 23 nt, Pseudomonas putida KT2440
gcgcauggcucaacuggcagggu

SEQ ID NO: 1601222 - RNA, 18 nt, Pseudomonas putida KT2440
gcgcauuucacgcacggc

SEQ ID NO: 1601223 - RNA, 22 nt, Pseudomonas putida KT2440
gcgcauuucacgcacggccuuc

SEQ ID NO: 1601224 - RNA, 13 nt, Pseudomonas putida KT2440
gcgcaugcgcgcc

SEQ ID NO: 1601225 - RNA, 18 nt, Pseudomonas putida KT2440
gcgcaugcucgcgggccu

SEQ ID NO: 1601226 - RNA, 18 nt, Pseudomonas putida KT2440
gcgcaugcugccaggcaa

SEQ ID NO: 1601227 - RNA, 22 nt, Pseudomonas putida KT2440
gcgcaugaugaaguggcgcagg

SEQ ID NO: 1601228 - RNA, 24 nt, Pseudomonas putida KT2440
gcgcaugaugaaguggcgcaggcu

SEQ ID NO: 1601229 - RNA, 11 nt, Pseudomonas putida KT2440
gcgcauggccu

SEQ ID NO: 1601230 - RNA, 19 nt, Pseudomonas putida KT2440
gcgcaucuuccagcacaag

SEQ ID NO: 1601231 - RNA, 14 nt, Pseudomonas putida KT2440
gcgcaugaaacucg

SEQ ID NO: 1601232 - RNA, 20 nt, Pseudomonas putida KT2440
gcgcaucggcgcgacagcgu

SEQ ID NO: 1601233 - RNA, 17 nt, Pseudomonas putida KT2440
gcgcaucgaccggcagg

SEQ ID NO: 1601234 - RNA, 14 nt, Pseudomonas putida KT2440
gcgcauccuccgcc

SEQ ID NO: 1601235 - RNA, 11 nt, Pseudomonas putida KT2440
gcgaguauccu

SEQ ID NO: 1601236 - RNA, 17 nt, Pseudomonas putida KT2440
gcgaguaaagccagcag

SEQ ID NO: 1601237 - RNA, 14 nt, Pseudomonas putida KT2440
gcgaguccugccuu

SEQ ID NO: 1601238 - RNA, 14 nt, Pseudomonas putida KT2440
gcgagucagggcuu

SEQ ID NO: 1601239 - RNA, 13 nt, Pseudomonas putida KT2440
gcgaguggccacg

SEQ ID NO: 1601240 - RNA, 14 nt, Pseudomonas putida KT2440
gcgauaaaccagca

SEQ ID NO: 1601241 - RNA, 18 nt, Pseudomonas putida KT2440
gcgauaucagcgccagca

SEQ ID NO: 1601242 - RNA, 20 nt, Pseudomonas putida KT2440
gcgaucaacgaaaucauguu

SEQ ID NO: 1601243 - RNA, 15 nt, Pseudomonas putida KT2440
gcgaucacgcaggcc

SEQ ID NO: 1601244 - RNA, 14 nt, Pseudomonas putida KT2440
gcgaucggcugguc

SEQ ID NO: 1601245 - RNA, 14 nt, Pseudomonas putida KT2440
gcgaugccgcgcgc

SEQ ID NO: 1601246 - RNA, 15 nt, Pseudomonas putida KT2440
gcgaugccgcgcgcc

SEQ ID NO: 1601247 - RNA, 19 nt, Pseudomonas putida KT2440
gcgaugcgccgcgcgggcg

SEQ ID NO: 1601248 - RNA, 23 nt, Pseudomonas putida KT2440
gcgaugcgccgcgcgggcggcgc

SEQ ID NO: 1601249 - RNA, 22 nt, Pseudomonas putida KT2440
gcgacguucuugccggugguga

SEQ ID NO: 1601250 - RNA, 21 nt, Pseudomonas putida KT2440
gcgacgcgguggagggcaccg

SEQ ID NO: 1601251 - RNA, 15 nt, Pseudomonas putida KT2440
gcgacggaucggcac

SEQ ID NO: 1601252 - RNA, 15 nt, Pseudomonas putida KT2440
gcgacgcugcccagc

SEQ ID NO: 1601253 - RNA, 18 nt, Pseudomonas putida KT2440
gcgacgcugcccagcaac

SEQ ID NO: 1601254 - RNA, 22 nt, Pseudomonas putida KT2440
gcgacuugugcauccugcacug

SEQ ID NO: 1601255 - RNA, 11 nt, Pseudomonas putida KT2440
gcgagcaggcc

SEQ ID NO: 1601256 - RNA, 12 nt, Pseudomonas putida KT2440
gcgagcaggccc

SEQ ID NO: 1601257 - RNA, 14 nt, Pseudomonas putida KT2440
gcgacgcagcagcg

SEQ ID NO: 1601258 - RNA, 13 nt, Pseudomonas putida KT2440
gcgacgccacccc

SEQ ID NO: 1601259 - RNA, 15 nt, Pseudomonas putida KT2440
gcgacgcaaggccgc

SEQ ID NO: 1601260 - RNA, 17 nt, Pseudomonas putida KT2440
gcgaccgacacgcggca

SEQ ID NO: 1601261 - RNA, 19 nt, Pseudomonas putida KT2440
gcgaccacaggcgcuugaa

SEQ ID NO: 1601262 - RNA, 17 nt, Pseudomonas putida KT2440
gcgacaugccggccacc

SEQ ID NO: 1601263 - RNA, 23 nt, Pseudomonas putida KT2440
gcgacagguaguuggccgggccu

SEQ ID NO: 1601264 - RNA, 14 nt, Pseudomonas putida KT2440
gcgaaugggcugca

SEQ ID NO: 1601265 - RNA, 16 nt, Pseudomonas putida KT2440
gcgaaugggcugcaaa

SEQ ID NO: 1601266 - RNA, 13 nt, Pseudomonas putida KT2440
gcgacagcucaag

SEQ ID NO: 1601267 - RNA, 15 nt, Pseudomonas putida KT2440
gcgacagcucaagcc

SEQ ID NO: 1601268 - RNA, 19 nt, Pseudomonas putida KT2440
gcgaauccagccggcccgg

SEQ ID NO: 1601269 - RNA, 20 nt, Pseudomonas putida KT2440
gcgaauccagccggcccggc

SEQ ID NO: 1601270 - RNA, 12 nt, Pseudomonas putida KT2440
gcgaaucugcau

SEQ ID NO: 1601271 - RNA, 18 nt, Pseudomonas putida KT2440
gcgaaugcgcucauccag

SEQ ID NO: 1601272 - RNA, 23 nt, Pseudomonas putida KT2440
gcgaaugaugaauaaugcuccag

SEQ ID NO: 1601273 - RNA, 16 nt, Pseudomonas putida KT2440
gcgaagaccgccgccc

SEQ ID NO: 1601274 - RNA, 19 nt, Pseudomonas putida KT2440
gcgaagacggcagaucagg

SEQ ID NO: 1601275 - RNA, 23 nt, Pseudomonas putida KT2440
gcgaagaggccaguaccagcagc

SEQ ID NO: 1601276 - RNA, 19 nt, Pseudomonas putida KT2440
gcgaagagggcgacaccgg

SEQ ID NO: 1601277 - RNA, 15 nt, Pseudomonas putida KT2440
gcgaagcaggcugcg

SEQ ID NO: 1601278 - RNA, 16 nt, Pseudomonas putida KT2440
gcgaauagcaacacau

SEQ ID NO: 1601279 - RNA, 21 nt, Pseudomonas putida KT2440
gcgaauacgguagcggcggca

SEQ ID NO: 1601280 - RNA, 17 nt, Pseudomonas putida KT2440
gcgaauacgguaguggc

SEQ ID NO: 1601281 - RNA, 20 nt, Pseudomonas putida KT2440
gcgaauacgauagcggcggc

SEQ ID NO: 1601282 - RNA, 14 nt, Pseudomonas putida KT2440
gcgaaucagcaugc

SEQ ID NO: 1601283 - RNA, 16 nt, Pseudomonas putida KT2440
gcgaagcggccccaau

SEQ ID NO: 1601284 - RNA, 13 nt, Pseudomonas putida KT2440
gcgaagcggcggg

SEQ ID NO: 1601285 - RNA, 17 nt, Pseudomonas putida KT2440
gccguuguucggcaaag

SEQ ID NO: 1601286 - RNA, 22 nt, Pseudomonas putida KT2440
gccguuuauugguuugacgcug

SEQ ID NO: 1601287 - RNA, 18 nt, Pseudomonas putida KT2440
gcgaacagcacugccagc

SEQ ID NO: 1601288 - RNA, 16 nt, Pseudomonas putida KT2440
gcgaaacacagcaggc

SEQ ID NO: 1601289 - RNA, 20 nt, Pseudomonas putida KT2440
gcgaaacacagcaggccaag

SEQ ID NO: 1601290 - RNA, 23 nt, Pseudomonas putida KT2440
gcgaaacacagcaggccaaggaa

SEQ ID NO: 1601291 - RNA, 23 nt, Pseudomonas putida KT2440
gcgaaacccucacgcgccagguc

SEQ ID NO: 1601292 - RNA, 22 nt, Pseudomonas putida KT2440
gcggaucagcgcguccagcaac

SEQ ID NO: 1601293 - RNA, 15 nt, Pseudomonas putida KT2440
gcggauagcgcgcca

SEQ ID NO: 1601294 - RNA, 17 nt, Pseudomonas putida KT2440
gcggagccagccacaga

SEQ ID NO: 1601295 - RNA, 16 nt, Pseudomonas putida KT2440
gcggagauuggccagc

SEQ ID NO: 1601296 - RNA, 20 nt, Pseudomonas putida KT2440
gcggacccuugugugggccu

SEQ ID NO: 1601297 - RNA, 16 nt, Pseudomonas putida KT2440
gcggacccggcauccu

SEQ ID NO: 1601298 - RNA, 22 nt, Pseudomonas putida KT2440
gcggaaguucacacucagccgc

SEQ ID NO: 1601299 - RNA, 19 nt, Pseudomonas putida KT2440
gcggaucaucggcacgccc

SEQ ID NO: 1601300 - RNA, 16 nt, Pseudomonas putida KT2440
gcggaucugacggcgc

SEQ ID NO: 1601301 - RNA, 17 nt, Pseudomonas putida KT2440
gcggaucugacggcgcu

SEQ ID NO: 1601302 - RNA, 21 nt, Pseudomonas putida KT2440
gcggaucugacggcgcugcug

SEQ ID NO: 1601303 - RNA, 12 nt, Pseudomonas putida KT2440
gcggaugagccu

SEQ ID NO: 1601304 - RNA, 21 nt, Pseudomonas putida KT2440
gcggcacaacgcgccaccgcc

SEQ ID NO: 1601305 - RNA, 20 nt, Pseudomonas putida KT2440
gcggcacccaauagcccacc

SEQ ID NO: 1601306 - RNA, 21 nt, Pseudomonas putida KT2440
gcggcaauucggccggccaga

SEQ ID NO: 1601307 - RNA, 15 nt, Pseudomonas putida KT2440
gcggcaauguugaag

SEQ ID NO: 1601308 - RNA, 18 nt, Pseudomonas putida KT2440
gcggcaaugcgccggucg

SEQ ID NO: 1601309 - RNA, 19 nt, Pseudomonas putida KT2440
gcggcaagguagccugcug

SEQ ID NO: 1601310 - RNA, 13 nt, Pseudomonas putida KT2440
gcggcaaaggugg

SEQ ID NO: 1601311 - RNA, 19 nt, Pseudomonas putida KT2440
gcggcaaagaucgcccagc

SEQ ID NO: 1601312 - RNA, 13 nt, Pseudomonas putida KT2440
gcggcaacaccag

SEQ ID NO: 1601313 - RNA, 14 nt, Pseudomonas putida KT2440
gcggcaacaccagc

SEQ ID NO: 1601314 - RNA, 17 nt, Pseudomonas putida KT2440
gcggcaacaccagcagc

SEQ ID NO: 1601315 - RNA, 24 nt, Pseudomonas putida KT2440
gcggcaacaccagcagccacgggu

SEQ ID NO: 1601316 - RNA, 21 nt, Pseudomonas putida KT2440
gcggcaaaugcggcgcgggcg

SEQ ID NO: 1601317 - RNA, 20 nt, Pseudomonas putida KT2440
gcggcaaccaccaacagcac

SEQ ID NO: 1601318 - RNA, 12 nt, Pseudomonas putida KT2440
gcggcaaccgga

SEQ ID NO: 1601319 - RNA, 16 nt, Pseudomonas putida KT2440
gcggcaaccugcucgc

SEQ ID NO: 1601320 - RNA, 22 nt, Pseudomonas putida KT2440
gcgcuucacgucuggcaccagu

SEQ ID NO: 1601321 - RNA, 14 nt, Pseudomonas putida KT2440
gcgcuuccuggccu

SEQ ID NO: 1601322 - RNA, 15 nt, Pseudomonas putida KT2440
gcgcuuggcggcccu

SEQ ID NO: 1601323 - RNA, 18 nt, Pseudomonas putida KT2440
gcgcuuggcaccggcagc

SEQ ID NO: 1601324 - RNA, 16 nt, Pseudomonas putida KT2440
gcgcuugaucugccag

SEQ ID NO: 1601325 - RNA, 19 nt, Pseudomonas putida KT2440
gcgcuugaucugccaggca

SEQ ID NO: 1601326 - RNA, 18 nt, Pseudomonas putida KT2440
gcgcuugagaccaggccu

SEQ ID NO: 1601327 - RNA, 22 nt, Pseudomonas putida KT2440
gcgcuugagaccaggccuggau

SEQ ID NO: 1601328 - RNA, 16 nt, Pseudomonas putida KT2440
gcgcuugagcguggca

SEQ ID NO: 1601329 - RNA, 19 nt, Pseudomonas putida KT2440
gcgcuugaggugccauagc

SEQ ID NO: 1601330 - RNA, 14 nt, Pseudomonas putida KT2440
gcggaacagugguu

SEQ ID NO: 1601331 - RNA, 15 nt, Pseudomonas putida KT2440
gcggaacuggcccug

SEQ ID NO: 1601332 - RNA, 22 nt, Pseudomonas putida KT2440
gcggaaggcgucacgcagggcc

SEQ ID NO: 1601333 - RNA, 13 nt, Pseudomonas putida KT2440
gcgcuuuuccagu

SEQ ID NO: 1601334 - RNA, 22 nt, Pseudomonas putida KT2440
gcgcuuugcaccccuuuuucuc

SEQ ID NO: 1601335 - RNA, 13 nt, Pseudomonas putida KT2440
gcggaacaauugc

SEQ ID NO: 1601336 - RNA, 21 nt, Pseudomonas putida KT2440
gcggaaauaccagacgcaggc

SEQ ID NO: 1601337 - RNA, 23 nt, Pseudomonas putida KT2440
gcgcugaagccaguacgcgccug

SEQ ID NO: 1601338 - RNA, 20 nt, Pseudomonas putida KT2440
gcgcugaccgggacgcaggc

SEQ ID NO: 1601339 - RNA, 17 nt, Pseudomonas putida KT2440
gcgcugacgcagggccu

SEQ ID NO: 1601340 - RNA, 16 nt, Pseudomonas putida KT2440
gcgcugcuggccuugc

SEQ ID NO: 1601341 - RNA, 18 nt, Pseudomonas putida KT2440
gcgcugacucagcggccu

SEQ ID NO: 1601342 - RNA, 19 nt, Pseudomonas putida KT2440
gcgcugacucagcggccuu

SEQ ID NO: 1601343 - RNA, 23 nt, Pseudomonas putida KT2440
gcgcugaucaagcccgcucgcca

SEQ ID NO: 1601344 - RNA, 14 nt, Pseudomonas putida KT2440
gcgcuggccaggcu

SEQ ID NO: 1601345 - RNA, 22 nt, Pseudomonas putida KT2440
gcgcuggccaggcuugguuugg

SEQ ID NO: 1601346 - RNA, 13 nt, Pseudomonas putida KT2440
gcgcuggccacga

SEQ ID NO: 1601347 - RNA, 22 nt, Pseudomonas putida KT2440
gcgcuggaauuauuggccagca

SEQ ID NO: 1601348 - RNA, 19 nt, Pseudomonas putida KT2440
gcgcucgagcccgccagca

SEQ ID NO: 1601349 - RNA, 13 nt, Pseudomonas putida KT2440
gcgcucgcgcagg

SEQ ID NO: 1601350 - RNA, 13 nt, Pseudomonas putida KT2440
gcgcguccagccc

SEQ ID NO: 1601351 - RNA, 18 nt, Pseudomonas putida KT2440
gcgcguaguacuccagca

SEQ ID NO: 1601352 - RNA, 21 nt, Pseudomonas putida KT2440
gcgcgguucuucgccugcagc

SEQ ID NO: 1601353 - RNA, 16 nt, Pseudomonas putida KT2440
gcgcgccuggucgccg

SEQ ID NO: 1601354 - RNA, 22 nt, Pseudomonas putida KT2440
gcgcgcgccuggguggcgcggu

SEQ ID NO: 1601355 - RNA, 20 nt, Pseudomonas putida KT2440
gcgcgccuggguggcgcggu

SEQ ID NO: 1601356 - RNA, 14 nt, Pseudomonas putida KT2440
gcgcgcccaggccc

SEQ ID NO: 1601357 - RNA, 21 nt, Pseudomonas putida KT2440
gcgcgaaaagccugcaccagu

SEQ ID NO: 1601358 - RNA, 18 nt, Pseudomonas putida KT2440
gcgcgaucagcgcacgac

SEQ ID NO: 1601359 - RNA, 15 nt, Pseudomonas putida KT2440
gcgcgcaucagccgc

SEQ ID NO: 1601360 - RNA, 17 nt, Pseudomonas putida KT2440
gcgcgcauccagcaggg

SEQ ID NO: 1601361 - RNA, 13 nt, Pseudomonas putida KT2440
gcgcgcgggcucu

SEQ ID NO: 1601362 - RNA, 16 nt, Pseudomonas putida KT2440
gcgcggccugcuccac

SEQ ID NO: 1601363 - RNA, 19 nt, Pseudomonas putida KT2440
gcgcggccggucgaagaag

SEQ ID NO: 1601364 - RNA, 23 nt, Pseudomonas putida KT2440
gcgcggugaccagcggcagcaag

SEQ ID NO: 1601365 - RNA, 22 nt, Pseudomonas putida KT2440
gcgcggcucgcugcgcuggcca

SEQ ID NO: 1601366 - RNA, 18 nt, Pseudomonas putida KT2440
gcgcggcuugcucgcggc

SEQ ID NO: 1601367 - RNA, 22 nt, Pseudomonas putida KT2440
gcgccugaaagcguauugccag

SEQ ID NO: 1601368 - RNA, 20 nt, Pseudomonas putida KT2440
gcgccucgcggugcaacaug

SEQ ID NO: 1601369 - RNA, 14 nt, Pseudomonas putida KT2440
gcgccuccagcagg

SEQ ID NO: 1601370 - RNA, 12 nt, Pseudomonas putida KT2440
gcgccuccagca

SEQ ID NO: 1601371 - RNA, 15 nt, Pseudomonas putida KT2440
gcgccuccaccugga

SEQ ID NO: 1601372 - RNA, 23 nt, Pseudomonas putida KT2440
gcgccuauccugugggagcgggc

SEQ ID NO: 1601373 - RNA, 18 nt, Pseudomonas putida KT2440
gcgccgguagcggcuggg

SEQ ID NO: 1601374 - RNA, 19 nt, Pseudomonas putida KT2440
gcgccgguagcggcugggc

SEQ ID NO: 1601375 - RNA, 15 nt, Pseudomonas putida KT2440
gcgccuugcgcacgc

SEQ ID NO: 1601376 - RNA, 22 nt, Pseudomonas putida KT2440
gcgccuugggcaacaccgccag

SEQ ID NO: 1601377 - RNA, 22 nt, Pseudomonas putida KT2440
gcgccuugauuaccagcgcccc

SEQ ID NO: 1601378 - RNA, 22 nt, Pseudomonas putida KT2440
gcgccugugagaucgagcgccg

SEQ ID NO: 1601379 - RNA, 21 nt, Pseudomonas putida KT2440
gcgccugugaucgagcgccgc

SEQ ID NO: 1601380 - RNA, 14 nt, Pseudomonas putida KT2440
gcgccuggcgcagu

SEQ ID NO: 1601381 - RNA, 16 nt, Pseudomonas putida KT2440
gcgccuggcccgcagc

SEQ ID NO: 1601382 - RNA, 16 nt, Pseudomonas putida KT2440
gcgccugcucauccac

SEQ ID NO: 1601383 - RNA, 12 nt, Pseudomonas putida KT2440
gcgccugcugcc

SEQ ID NO: 1601384 - RNA, 14 nt, Pseudomonas putida KT2440
gcgccugcggcauc

SEQ ID NO: 1601385 - RNA, 17 nt, Pseudomonas putida KT2440
gcgccugcgccagugcc

SEQ ID NO: 1601386 - RNA, 20 nt, Pseudomonas putida KT2440
gcgccugccgggucaaggcc

SEQ ID NO: 1601387 - RNA, 12 nt, Pseudomonas putida KT2440
gcgccugcagcg

SEQ ID NO: 1601388 - RNA, 20 nt, Pseudomonas putida KT2440
gcgcccagaacacggugaca

SEQ ID NO: 1601389 - RNA, 19 nt, Pseudomonas putida KT2440
gcgccgggacagcaccaug

SEQ ID NO: 1601390 - RNA, 14 nt, Pseudomonas putida KT2440
gcgccgcucugccc

SEQ ID NO: 1601391 - RNA, 13 nt, Pseudomonas putida KT2440
gcgggagcgggcg

SEQ ID NO: 1601392 - RNA, 19 nt, Pseudomonas putida KT2440
gcgggccguaguggcgccg

SEQ ID NO: 1601393 - RNA, 22 nt, Pseudomonas putida KT2440
gcggggucuuuucgccacuggc

SEQ ID NO: 1601394 - RNA, 14 nt, Pseudomonas putida KT2440
gcggggugcucugc

SEQ ID NO: 1601395 - RNA, 14 nt, Pseudomonas putida KT2440
gcgggcugaggaag

SEQ ID NO: 1601396 - RNA, 12 nt, Pseudomonas putida KT2440
gcgggcucgccc

SEQ ID NO: 1601397 - RNA, 22 nt, Pseudomonas putida KT2440
gcgggcguuguguugcugggcg

SEQ ID NO: 1601398 - RNA, 12 nt, Pseudomonas putida KT2440
gcgggcgcgccc

SEQ ID NO: 1601399 - RNA, 15 nt, Pseudomonas putida KT2440
gcgggcgcgcccgcu

SEQ ID NO: 1601400 - RNA, 19 nt, Pseudomonas putida KT2440
gcgggcgucggucgccccc

SEQ ID NO: 1601401 - RNA, 15 nt, Pseudomonas putida KT2440
gcgggcgucuuccag

SEQ ID NO: 1601402 - RNA, 17 nt, Pseudomonas putida KT2440
gcgguagugcggccggg

SEQ ID NO: 1601403 - RNA, 12 nt, Pseudomonas putida KT2440
gcggugaagacc

SEQ ID NO: 1601404 - RNA, 19 nt, Pseudomonas putida KT2440
gcggugaaacccucugggu

SEQ ID NO: 1601405 - RNA, 17 nt, Pseudomonas putida KT2440
gcggucuuguaucccag

SEQ ID NO: 1601406 - RNA, 13 nt, Pseudomonas putida KT2440
gcggucucggugc

SEQ ID NO: 1601407 - RNA, 14 nt, Pseudomonas putida KT2440
gcgguccugcacca

SEQ ID NO: 1601408 - RNA, 13 nt, Pseudomonas putida KT2440
gcgguccuggucg

SEQ ID NO: 1601409 - RNA, 22 nt, Pseudomonas putida KT2440
gcgguccgcccuugccaccagu

SEQ ID NO: 1601410 - RNA, 17 nt, Pseudomonas putida KT2440
gcggucguuacccaggu

SEQ ID NO: 1601411 - RNA, 18 nt, Pseudomonas putida KT2440
gcggucugcugcgucagc

SEQ ID NO: 1601412 - RNA, 22 nt, Pseudomonas putida KT2440
gcggguaaauguucucgccgcc

SEQ ID NO: 1601413 - RNA, 16 nt, Pseudomonas putida KT2440
gcggguaaacccgccc

SEQ ID NO: 1601414 - RNA, 19 nt, Pseudomonas putida KT2440
gcggguaaacccgcgccua

SEQ ID NO: 1601415 - RNA, 20 nt, Pseudomonas putida KT2440
gcggguaaagcccgcaguga

SEQ ID NO: 1601416 - RNA, 17 nt, Pseudomonas putida KT2440
gcgggucuuccaccacc

SEQ ID NO: 1601417 - RNA, 18 nt, Pseudomonas putida KT2440
gcgggugaaccgcgccua

SEQ ID NO: 1601418 - RNA, 22 nt, Pseudomonas putida KT2440
gcggguggaaauuggccagcag

SEQ ID NO: 1601419 - RNA, 22 nt, Pseudomonas putida KT2440
gcgguaccuggaauaccaccuc

SEQ ID NO: 1601420 - RNA, 15 nt, Pseudomonas putida KT2440
gcgguaccugugggg

SEQ ID NO: 1601421 - RNA, 20 nt, Pseudomonas putida KT2440
gcgguaccuguggggcaacu

SEQ ID NO: 1601422 - RNA, 15 nt, Pseudomonas putida KT2440
gcgguaccggccagc

SEQ ID NO: 1601423 - RNA, 15 nt, Pseudomonas putida KT2440
gcgguacagcaccca

SEQ ID NO: 1601424 - RNA, 13 nt, Pseudomonas putida KT2440
gcggcucgcucag

SEQ ID NO: 1601425 - RNA, 18 nt, Pseudomonas putida KT2440
gcggcugcucgaucaggu

SEQ ID NO: 1601426 - RNA, 16 nt, Pseudomonas putida KT2440
gcggcuguccagcaag

SEQ ID NO: 1601427 - RNA, 22 nt, Pseudomonas putida KT2440
gcggcuguccagcaagggccug

SEQ ID NO: 1601428 - RNA, 22 nt, Pseudomonas putida KT2440
gcggcugggccccaggcggugc

SEQ ID NO: 1601429 - RNA, 16 nt, Pseudomonas putida KT2440
gcggcugggcgcggcg

SEQ ID NO: 1601430 - RNA, 22 nt, Pseudomonas putida KT2440
gcggcguauacccggucagggu

SEQ ID NO: 1601431 - RNA, 23 nt, Pseudomonas putida KT2440
gcggcguauccgugagggcgccg

SEQ ID NO: 1601432 - RNA, 21 nt, Pseudomonas putida KT2440
gcggcguguaguagcuccagc

SEQ ID NO: 1601433 - RNA, 15 nt, Pseudomonas putida KT2440
gcggcgugcgcccgg

SEQ ID NO: 1601434 - RNA, 14 nt, Pseudomonas putida KT2440
gcggcguggccuca

SEQ ID NO: 1601435 - RNA, 16 nt, Pseudomonas putida KT2440
gcggcguuugcgagcg

SEQ ID NO: 1601436 - RNA, 17 nt, Pseudomonas putida KT2440
gcggcaccgucgccugc

SEQ ID NO: 1601437 - RNA, 22 nt, Pseudomonas putida KT2440
gcggcaccgucgccugcaaccc

SEQ ID NO: 1601438 - RNA, 17 nt, Pseudomonas putida KT2440
gcggcaccucguccagg

SEQ ID NO: 1601439 - RNA, 13 nt, Pseudomonas putida KT2440
gcggcgcccagca

SEQ ID NO: 1601440 - RNA, 15 nt, Pseudomonas putida KT2440
gcggcgcagggccuc

SEQ ID NO: 1601441 - RNA, 13 nt, Pseudomonas putida KT2440
gcggcgccugcca

SEQ ID NO: 1601442 - RNA, 13 nt, Pseudomonas putida KT2440
gcggcggccgagg

SEQ ID NO: 1601443 - RNA, 18 nt, Pseudomonas putida KT2440
gcgucaggccaugcccuu

SEQ ID NO: 1601444 - RNA, 20 nt, Pseudomonas putida KT2440
gcgucagcucaagcgcuccc

SEQ ID NO: 1601445 - RNA, 22 nt, Pseudomonas putida KT2440
gcgucagcucaagcgcuccccg

SEQ ID NO: 1601446 - RNA, 18 nt, Pseudomonas putida KT2440
gcgucaucaucagcaggc

SEQ ID NO: 1601447 - RNA, 15 nt, Pseudomonas putida KT2440
gcgucagucgccaac

SEQ ID NO: 1601448 - RNA, 19 nt, Pseudomonas putida KT2440
gcgucagggucucgcggcu

SEQ ID NO: 1601449 - RNA, 18 nt, Pseudomonas putida KT2440
gcgucacccgcgccacca

SEQ ID NO: 1601450 - RNA, 23 nt, Pseudomonas putida KT2440
gcgucacaucgguuucgccggug

SEQ ID NO: 1601451 - RNA, 22 nt, Pseudomonas putida KT2440
gcguauuuuugcgccaggcgca

SEQ ID NO: 1601452 - RNA, 20 nt, Pseudomonas putida KT2440
gcgucaacugccaggcuggc

SEQ ID NO: 1601453 - RNA, 19 nt, Pseudomonas putida KT2440
gcgucaagagcgacuggug

SEQ ID NO: 1601454 - RNA, 15 nt, Pseudomonas putida KT2440
gcggugcacggccug

SEQ ID NO: 1601455 - RNA, 23 nt, Pseudomonas putida KT2440
gcggugcacggccugcauccaca

SEQ ID NO: 1601456 - RNA, 14 nt, Pseudomonas putida KT2440
gcguaggcacaccc

SEQ ID NO: 1601457 - RNA, 21 nt, Pseudomonas putida KT2440
gcguauuugaccagcccgcug

SEQ ID NO: 1601458 - RNA, 18 nt, Pseudomonas putida KT2440
gcgucgaugcggccacag

SEQ ID NO: 1601459 - RNA, 22 nt, Pseudomonas putida KT2440
gcguccucauaaugcuccgcca

SEQ ID NO: 1601460 - RNA, 16 nt, Pseudomonas putida KT2440
gcguccgucgccggcc

SEQ ID NO: 1601461 - RNA, 19 nt, Pseudomonas putida KT2440
gcguccgucgccggccggc

SEQ ID NO: 1601462 - RNA, 16 nt, Pseudomonas putida KT2440
gcguccggcuugagac

SEQ ID NO: 1601463 - RNA, 17 nt, Pseudomonas putida KT2440
gcguccgagcggagcug

SEQ ID NO: 1601464 - RNA, 23 nt, Pseudomonas putida KT2440
gcguccaguucaaugccagcagu

SEQ ID NO: 1601465 - RNA, 22 nt, Pseudomonas putida KT2440
gcgucccccgguaccagcaggc

SEQ ID NO: 1601466 - RNA, 19 nt, Pseudomonas putida KT2440
gcguccccggguccaccuc

SEQ ID NO: 1601467 - RNA, 15 nt, Pseudomonas putida KT2440
gcguccacugcaccc

SEQ ID NO: 1601468 - RNA, 16 nt, Pseudomonas putida KT2440
gcguccagcaacagcu

SEQ ID NO: 1601469 - RNA, 20 nt, Pseudomonas putida KT2440
gcguccacagccaugccggc

SEQ ID NO: 1601470 - RNA, 18 nt, Pseudomonas putida KT2440
gcguccaggcccgccaga

SEQ ID NO: 1601471 - RNA, 12 nt, Pseudomonas putida KT2440
gcguccagcagu

SEQ ID NO: 1601472 - RNA, 14 nt, Pseudomonas putida KT2440
gcguccagggcagg

SEQ ID NO: 1601473 - RNA, 18 nt, Pseudomonas putida KT2440
gcguugcccccagccggu

SEQ ID NO: 1601474 - RNA, 23 nt, Pseudomonas putida KT2440
gcguucaggcaggaacuggcugc

SEQ ID NO: 1601475 - RNA, 18 nt, Pseudomonas putida KT2440
gcguucacaucgcccuuc

SEQ ID NO: 1601476 - RNA, 17 nt, Pseudomonas putida KT2440
gcguuggcagcaccacg

SEQ ID NO: 1601477 - RNA, 13 nt, Pseudomonas putida KT2440
gcguuggccaggu

SEQ ID NO: 1601478 - RNA, 20 nt, Pseudomonas putida KT2440
gcguugucgacugcacugcc

SEQ ID NO: 1601479 - RNA, 22 nt, Pseudomonas putida KT2440
gcguuggcguuauugcacuucc

SEQ ID NO: 1601480 - RNA, 14 nt, Pseudomonas putida KT2440
gcguguccagcagg

SEQ ID NO: 1601481 - RNA, 17 nt, Pseudomonas putida KT2440
gcguggcugcguucagg

SEQ ID NO: 1601482 - RNA, 18 nt, Pseudomonas putida KT2440
gcguggccgccaacagcg

SEQ ID NO: 1601483 - RNA, 20 nt, Pseudomonas putida KT2440
gcguggccugcaagccggcg

SEQ ID NO: 1601484 - RNA, 16 nt, Pseudomonas putida KT2440
gcguggccagcccaag

SEQ ID NO: 1601485 - RNA, 20 nt, Pseudomonas putida KT2440
gcguggcauccuuuaccugu

SEQ ID NO: 1601486 - RNA, 15 nt, Pseudomonas putida KT2440
gcgugcgcucaggcg

SEQ ID NO: 1601487 - RNA, 17 nt, Pseudomonas putida KT2440
gcgugccgcaugugcca

SEQ ID NO: 1601488 - RNA, 18 nt, Pseudomonas putida KT2440
gcgugccucagccaggcu

SEQ ID NO: 1601489 - RNA, 16 nt, Pseudomonas putida KT2440
gcgugccgucgagcag

SEQ ID NO: 1601490 - RNA, 16 nt, Pseudomonas putida KT2440
gcgugacgcggagccg

SEQ ID NO: 1601491 - RNA, 16 nt, Pseudomonas putida KT2440
gcgucggucgcugguu

SEQ ID NO: 1601492 - RNA, 12 nt, Pseudomonas putida KT2440
gcgucggcgcgc

SEQ ID NO: 1601493 - RNA, 14 nt, Pseudomonas putida KT2440
gcgucgcccagacg

SEQ ID NO: 1601494 - RNA, 18 nt, Pseudomonas putida KT2440
gcgucgcuucaucggcug

SEQ ID NO: 1601495 - RNA, 18 nt, Pseudomonas putida KT2440
gcgucggcagagcgccag

SEQ ID NO: 1601496 - RNA, 16 nt, Pseudomonas putida KT2440
gcgucgcggccccagg

SEQ ID NO: 1601497 - RNA, 23 nt, Pseudomonas putida KT2440
gcucuucgauccgcgccaucagc

SEQ ID NO: 1601498 - RNA, 13 nt, Pseudomonas putida KT2440
gcucuucuuucag

SEQ ID NO: 1601499 - RNA, 14 nt, Pseudomonas putida KT2440
gcucuucuuucagg

SEQ ID NO: 1601500 - RNA, 23 nt, Pseudomonas putida KT2440
gcucuugaacugggcauccagcu

SEQ ID NO: 1601501 - RNA, 15 nt, Pseudomonas putida KT2440
gcucuugcagcgagu

SEQ ID NO: 1601502 - RNA, 13 nt, Pseudomonas putida KT2440
gcugaaacaucag

SEQ ID NO: 1601503 - RNA, 15 nt, Pseudomonas putida KT2440
gcugaaaccgcgaau

SEQ ID NO: 1601504 - RNA, 21 nt, Pseudomonas putida KT2440
gcucuguuucugccccuggcc

SEQ ID NO: 1601505 - RNA, 19 nt, Pseudomonas putida KT2440
gcucuucaacaccagcaug

SEQ ID NO: 1601506 - RNA, 14 nt, Pseudomonas putida KT2440
gcucugcuccagcu

SEQ ID NO: 1601507 - RNA, 17 nt, Pseudomonas putida KT2440
gcucugcuccagcugcu

SEQ ID NO: 1601508 - RNA, 15 nt, Pseudomonas putida KT2440
gcucugauagcgagc

SEQ ID NO: 1601509 - RNA, 22 nt, Pseudomonas putida KT2440
gcucugacauaacaagaacaac

SEQ ID NO: 1601510 - RNA, 18 nt, Pseudomonas putida KT2440
gcucguguuagcugggcu

SEQ ID NO: 1601511 - RNA, 15 nt, Pseudomonas putida KT2440
gcucguuguccagca

SEQ ID NO: 1601512 - RNA, 17 nt, Pseudomonas putida KT2440
gcucguuguccagcagc

SEQ ID NO: 1601513 - RNA, 18 nt, Pseudomonas putida KT2440
gcucguuguccagcagca

SEQ ID NO: 1601514 - RNA, 12 nt, Pseudomonas putida KT2440
gcucgcccacac

SEQ ID NO: 1601515 - RNA, 14 nt, Pseudomonas putida KT2440
gcucgucaccaucg

SEQ ID NO: 1601516 - RNA, 14 nt, Pseudomonas putida KT2440
gcucgucaaccaca

SEQ ID NO: 1601517 - RNA, 16 nt, Pseudomonas putida KT2440
gcucgucaaccacagc

SEQ ID NO: 1601518 - RNA, 20 nt, Pseudomonas putida KT2440
gcucguccaggcccugcagc

SEQ ID NO: 1601519 - RNA, 16 nt, Pseudomonas putida KT2440
gcucgucgagcaacuu

SEQ ID NO: 1601520 - RNA, 16 nt, Pseudomonas putida KT2440
gcucguccugcagggc

SEQ ID NO: 1601521 - RNA, 16 nt, Pseudomonas putida KT2440
gcucgucgaacagcau

SEQ ID NO: 1601522 - RNA, 14 nt, Pseudomonas putida KT2440
gcucuccagcgaug

SEQ ID NO: 1601523 - RNA, 24 nt, Pseudomonas putida KT2440
gcucuccucucccaccagcauaug

SEQ ID NO: 1601524 - RNA, 20 nt, Pseudomonas putida KT2440
gcucucaacguucauccccu

SEQ ID NO: 1601525 - RNA, 15 nt, Pseudomonas putida KT2440
gcucucacagggacc

SEQ ID NO: 1601526 - RNA, 23 nt, Pseudomonas putida KT2440
gcugaagccaguacgcgccugca

SEQ ID NO: 1601527 - RNA, 15 nt, Pseudomonas putida KT2440
gcugaaccugaccuu

SEQ ID NO: 1601528 - RNA, 22 nt, Pseudomonas putida KT2440
gcugaaccugaccuugcugcuc

SEQ ID NO: 1601529 - RNA, 22 nt, Pseudomonas putida KT2440
gcugaacaacuccgggugcucc

SEQ ID NO: 1601530 - RNA, 20 nt, Pseudomonas putida KT2440
gcugaaguagcgcagauccc

SEQ ID NO: 1601531 - RNA, 17 nt, Pseudomonas putida KT2440
gcugaagugccaaggcu

SEQ ID NO: 1601532 - RNA, 23 nt, Pseudomonas putida KT2440
gcugaaugaaaaagccccgccag

SEQ ID NO: 1601533 - RNA, 21 nt, Pseudomonas putida KT2440
gcugaccacgccgaagcgcgc

SEQ ID NO: 1601534 - RNA, 12 nt, Pseudomonas putida KT2440
gcugaccaguug

SEQ ID NO: 1601535 - RNA, 18 nt, Pseudomonas putida KT2440
gcugaccccacccuugaa

SEQ ID NO: 1601536 - RNA, 19 nt, Pseudomonas putida KT2440
gcugaccggcacgggauca

SEQ ID NO: 1601537 - RNA, 22 nt, Pseudomonas putida KT2440
gcugaccgggucgacgcgcaag

SEQ ID NO: 1601538 - RNA, 22 nt, Pseudomonas putida KT2440
gcugauacgagucauccucacc

SEQ ID NO: 1601539 - RNA, 15 nt, Pseudomonas putida KT2440
gcugaucaagcccgc

SEQ ID NO: 1601540 - RNA, 20 nt, Pseudomonas putida KT2440
gcugaucaagcccgcucgcc

SEQ ID NO: 1601541 - RNA, 12 nt, Pseudomonas putida KT2440
gcugaucaccag

SEQ ID NO: 1601542 - RNA, 21 nt, Pseudomonas putida KT2440
gcugaucagguugcccgcaug

SEQ ID NO: 1601543 - RNA, 17 nt, Pseudomonas putida KT2440
gcugaucugaaaguuca

SEQ ID NO: 1601544 - RNA, 13 nt, Pseudomonas putida KT2440
gcugauguugaug

SEQ ID NO: 1601545 - RNA, 13 nt, Pseudomonas putida KT2440
gcugauggugguc

SEQ ID NO: 1601546 - RNA, 17 nt, Pseudomonas putida KT2440
gcugauggugucuucca

SEQ ID NO: 1601547 - RNA, 23 nt, Pseudomonas putida KT2440
gcugaugcgguagugcaggcgau

SEQ ID NO: 1601548 - RNA, 22 nt, Pseudomonas putida KT2440
gcugaugcucaagcgccagggc

SEQ ID NO: 1601549 - RNA, 15 nt, Pseudomonas putida KT2440
gcugagccggcuggc

SEQ ID NO: 1601550 - RNA, 15 nt, Pseudomonas putida KT2440
gcugagccaguucac

SEQ ID NO: 1601551 - RNA, 19 nt, Pseudomonas putida KT2440
gcugagcuugacuuccagc

SEQ ID NO: 1601552 - RNA, 20 nt, Pseudomonas putida KT2440
gcugagcuugacuuccagcu

SEQ ID NO: 1601553 - RNA, 17 nt, Pseudomonas putida KT2440
gcugagcaagcgcgcgc

SEQ ID NO: 1601554 - RNA, 19 nt, Pseudomonas putida KT2440
gcugagcagguuguccacc

SEQ ID NO: 1601555 - RNA, 17 nt, Pseudomonas putida KT2440
gcugacuuccagcagca

SEQ ID NO: 1601556 - RNA, 19 nt, Pseudomonas putida KT2440
gcugacuuccagcagcaca

SEQ ID NO: 1601557 - RNA, 14 nt, Pseudomonas putida KT2440
gcugacucagcggc

SEQ ID NO: 1601558 - RNA, 18 nt, Pseudomonas putida KT2440
gcugacucagcggccuuu

SEQ ID NO: 1601559 - RNA, 20 nt, Pseudomonas putida KT2440
gcucccagaaaggccgcugu

SEQ ID NO: 1601560 - RNA, 22 nt, Pseudomonas putida KT2440
gcuccauggcaauuggcuucca

SEQ ID NO: 1601561 - RNA, 19 nt, Pseudomonas putida KT2440
gcucccacaaaggccgcgu

SEQ ID NO: 1601562 - RNA, 16 nt, Pseudomonas putida KT2440
gcucccacaggccaac

SEQ ID NO: 1601563 - RNA, 19 nt, Pseudomonas putida KT2440
gcucccacagguccagcgc

SEQ ID NO: 1601564 - RNA, 15 nt, Pseudomonas putida KT2440
gcuccagggcaggcu

SEQ ID NO: 1601565 - RNA, 17 nt, Pseudomonas putida KT2440
gcuccagggcaggcuga

SEQ ID NO: 1601566 - RNA, 12 nt, Pseudomonas putida KT2440
gcuccagggugc

SEQ ID NO: 1601567 - RNA, 17 nt, Pseudomonas putida KT2440
gcuccaggugaaucagc

SEQ ID NO: 1601568 - RNA, 14 nt, Pseudomonas putida KT2440
gcuccaggcacagg

SEQ ID NO: 1601569 - RNA, 19 nt, Pseudomonas putida KT2440
gcuccaggcacaggcgcac

SEQ ID NO: 1601570 - RNA, 14 nt, Pseudomonas putida KT2440
gcuccaggcagccu

SEQ ID NO: 1601571 - RNA, 16 nt, Pseudomonas putida KT2440
gcuccaggcagccugc

SEQ ID NO: 1601572 - RNA, 18 nt, Pseudomonas putida KT2440
gcuccaggcagccugcca

SEQ ID NO: 1601573 - RNA, 19 nt, Pseudomonas putida KT2440
gcuccaggcagccugccag

SEQ ID NO: 1601574 - RNA, 20 nt, Pseudomonas putida KT2440
gcuccacaucuugccccggu

SEQ ID NO: 1601575 - RNA, 16 nt, Pseudomonas putida KT2440
gcuccaccaaggcuga

SEQ ID NO: 1601576 - RNA, 15 nt, Pseudomonas putida KT2440
gcuccaccacagcug

SEQ ID NO: 1601577 - RNA, 15 nt, Pseudomonas putida KT2440
gcuccaccugccacc

SEQ ID NO: 1601578 - RNA, 19 nt, Pseudomonas putida KT2440
gcuccaccugcuccagcac

SEQ ID NO: 1601579 - RNA, 20 nt, Pseudomonas putida KT2440
gcuccaccugcuccagcacc

SEQ ID NO: 1601580 - RNA, 21 nt, Pseudomonas putida KT2440
gcuccaccugcuccagcaccu

SEQ ID NO: 1601581 - RNA, 22 nt, Pseudomonas putida KT2440
gcuccaccuuccacucuuccac

SEQ ID NO: 1601582 - RNA, 21 nt, Pseudomonas putida KT2440
gcuccaccgaaaucagcaacg

SEQ ID NO: 1601583 - RNA, 18 nt, Pseudomonas putida KT2440
gcuccagcucacagcacu

SEQ ID NO: 1601584 - RNA, 17 nt, Pseudomonas putida KT2440
gcuccagcucggcuggc

SEQ ID NO: 1601585 - RNA, 19 nt, Pseudomonas putida KT2440
gcucagcuggauagaguac

SEQ ID NO: 1601586 - RNA, 22 nt, Pseudomonas putida KT2440
gcucagcugggcguuuccaggu

SEQ ID NO: 1601587 - RNA, 19 nt, Pseudomonas putida KT2440
gcucaucguaauggccuac

SEQ ID NO: 1601588 - RNA, 23 nt, Pseudomonas putida KT2440
gcucaucugccggcgaauccagc

SEQ ID NO: 1601589 - RNA, 19 nt, Pseudomonas putida KT2440
gcucaucuaccugagccug

SEQ ID NO: 1601590 - RNA, 16 nt, Pseudomonas putida KT2440
gcucauguccagguca

SEQ ID NO: 1601591 - RNA, 15 nt, Pseudomonas putida KT2440
gcucaugcgccaggg

SEQ ID NO: 1601592 - RNA, 21 nt, Pseudomonas putida KT2440
gcucagcgggcguaccuggcu

SEQ ID NO: 1601593 - RNA, 18 nt, Pseudomonas putida KT2440
gcucagcguacgcauggu

SEQ ID NO: 1601594 - RNA, 20 nt, Pseudomonas putida KT2440
gcucagcgugacgauggcca

SEQ ID NO: 1601595 - RNA, 20 nt, Pseudomonas putida KT2440
gcucgacguuuaccugcagc

SEQ ID NO: 1601596 - RNA, 14 nt, Pseudomonas putida KT2440
gcucgacgcgcgca

SEQ ID NO: 1601597 - RNA, 20 nt, Pseudomonas putida KT2440
gcucgagcccgccagcaggc

SEQ ID NO: 1601598 - RNA, 13 nt, Pseudomonas putida KT2440
gcuccuucaccag

SEQ ID NO: 1601599 - RNA, 22 nt, Pseudomonas putida KT2440
gcuccuucuucacccgcagcaa

SEQ ID NO: 1601600 - RNA, 22 nt, Pseudomonas putida KT2440
gcuccuugagguagucgaucca

SEQ ID NO: 1601601 - RNA, 17 nt, Pseudomonas putida KT2440
gcuccuggcccgcgccc

SEQ ID NO: 1601602 - RNA, 16 nt, Pseudomonas putida KT2440
gcuccuggccgcccgc

SEQ ID NO: 1601603 - RNA, 21 nt, Pseudomonas putida KT2440
gcuccuggucaucgaagccaa

SEQ ID NO: 1601604 - RNA, 18 nt, Pseudomonas putida KT2440
gcucgccgcccaguggca

SEQ ID NO: 1601605 - RNA, 16 nt, Pseudomonas putida KT2440
gcucgcccgcccgcuu

SEQ ID NO: 1601606 - RNA, 17 nt, Pseudomonas putida KT2440
gcucgcccgcccgcuuc

SEQ ID NO: 1601607 - RNA, 18 nt, Pseudomonas putida KT2440
gcucccgcgcaugcugcc

SEQ ID NO: 1601608 - RNA, 16 nt, Pseudomonas putida KT2440
gcuccccaaccaccuc

SEQ ID NO: 1601609 - RNA, 17 nt, Pseudomonas putida KT2440
gcuccccaaccaccucc

SEQ ID NO: 1601610 - RNA, 18 nt, Pseudomonas putida KT2440
gcuccccaaccaccuccc

SEQ ID NO: 1601611 - RNA, 22 nt, Pseudomonas putida KT2440
gcuccggcgaauccagcaggcu

SEQ ID NO: 1601612 - RNA, 23 nt, Pseudomonas putida KT2440
gcuccggcgacagcucaagcccu

SEQ ID NO: 1601613 - RNA, 14 nt, Pseudomonas putida KT2440
gcucaacagcaggu

SEQ ID NO: 1601614 - RNA, 14 nt, Pseudomonas putida KT2440
gcucaaccagccgc

SEQ ID NO: 1601615 - RNA, 23 nt, Pseudomonas putida KT2440
gcucaaccccaucaccuuggccg

SEQ ID NO: 1601616 - RNA, 18 nt, Pseudomonas putida KT2440
gcucaaaccccccaugcu

SEQ ID NO: 1601617 - RNA, 11 nt, Pseudomonas putida KT2440
gcucacgcagc

SEQ ID NO: 1601618 - RNA, 14 nt, Pseudomonas putida KT2440
gcucacgcagcccu

SEQ ID NO: 1601619 - RNA, 20 nt, Pseudomonas putida KT2440
gcucacgcagcccuuucagg

SEQ ID NO: 1601620 - RNA, 18 nt, Pseudomonas putida KT2440
gcucaccugguaccccuc

SEQ ID NO: 1601621 - RNA, 13 nt, Pseudomonas putida KT2440
gcucaaggugucg

SEQ ID NO: 1601622 - RNA, 15 nt, Pseudomonas putida KT2440
gcucaagcccugccg

SEQ ID NO: 1601623 - RNA, 13 nt, Pseudomonas putida KT2440
gcucaagcgcagc

SEQ ID NO: 1601624 - RNA, 18 nt, Pseudomonas putida KT2440
gcucaagcgcagccuugu

SEQ ID NO: 1601625 - RNA, 15 nt, Pseudomonas putida KT2440
gcucaagcgccaggg

SEQ ID NO: 1601626 - RNA, 16 nt, Pseudomonas putida KT2440
gcucaagcgccagggc

SEQ ID NO: 1601627 - RNA, 16 nt, Pseudomonas putida KT2440
gcuauugagagcagau

SEQ ID NO: 1601628 - RNA, 12 nt, Pseudomonas putida KT2440
gcucaaaaaaau

SEQ ID NO: 1601629 - RNA, 22 nt, Pseudomonas putida KT2440
gcuaucggacgaugaggccgga

SEQ ID NO: 1601630 - RNA, 15 nt, Pseudomonas putida KT2440
gcuaucggccagcaa

SEQ ID NO: 1601631 - RNA, 16 nt, Pseudomonas putida KT2440
gcuaucggccagcaaa

SEQ ID NO: 1601632 - RNA, 16 nt, Pseudomonas putida KT2440
gcuaucgccagcaggc

SEQ ID NO: 1601633 - RNA, 15 nt, Pseudomonas putida KT2440
gcuaucucaggccag

SEQ ID NO: 1601634 - RNA, 18 nt, Pseudomonas putida KT2440
gcuaucucaggccaguuc

SEQ ID NO: 1601635 - RNA, 23 nt, Pseudomonas putida KT2440
gcuagaauggcacccaucacgac

SEQ ID NO: 1601636 - RNA, 17 nt, Pseudomonas putida KT2440
gcccagaucacuuccac

SEQ ID NO: 1601637 - RNA, 21 nt, Pseudomonas putida KT2440
gcccagaucacuuccaccugc

SEQ ID NO: 1601638 - RNA, 16 nt, Pseudomonas putida KT2440
gcccagaucagcagca

SEQ ID NO: 1601639 - RNA, 14 nt, Pseudomonas putida KT2440
gcccagcagcccca

SEQ ID NO: 1601640 - RNA, 18 nt, Pseudomonas putida KT2440
gcccagcagguacagcac

SEQ ID NO: 1601641 - RNA, 14 nt, Pseudomonas putida KT2440
gcccagccccgagc

SEQ ID NO: 1601642 - RNA, 13 nt, Pseudomonas putida KT2440
gcccagccagcgu

SEQ ID NO: 1601643 - RNA, 12 nt, Pseudomonas putida KT2440
gcccagccaccg

SEQ ID NO: 1601644 - RNA, 13 nt, Pseudomonas putida KT2440
gcccagccaccga

SEQ ID NO: 1601645 - RNA, 18 nt, Pseudomonas putida KT2440
gcccagccaacccucgac

SEQ ID NO: 1601646 - RNA, 13 nt, Pseudomonas putida KT2440
gcccagcgccgcc

SEQ ID NO: 1601647 - RNA, 20 nt, Pseudomonas putida KT2440
gcccagcgccaccggcagca

SEQ ID NO: 1601648 - RNA, 19 nt, Pseudomonas putida KT2440
gcccagaaucucaaccacc

SEQ ID NO: 1601649 - RNA, 20 nt, Pseudomonas putida KT2440
gcccacgaucucacgcgcca

SEQ ID NO: 1601650 - RNA, 16 nt, Pseudomonas putida KT2440
gcccacgccuuccacc

SEQ ID NO: 1601651 - RNA, 12 nt, Pseudomonas putida KT2440
gcccaccaggau

SEQ ID NO: 1601652 - RNA, 14 nt, Pseudomonas putida KT2440
gcccacccaccaca

SEQ ID NO: 1601653 - RNA, 19 nt, Pseudomonas putida KT2440
gcccaccgucaggcucagc

SEQ ID NO: 1601654 - RNA, 23 nt, Pseudomonas putida KT2440
gcccaccgcauugcaggccagcg

SEQ ID NO: 1601655 - RNA, 20 nt, Pseudomonas putida KT2440
gcccaccgcguuggccaggu

SEQ ID NO: 1601656 - RNA, 16 nt, Pseudomonas putida KT2440
gccauuggugccaccg

SEQ ID NO: 1601657 - RNA, 19 nt, Pseudomonas putida KT2440
gccauuucuucagcaggaa

SEQ ID NO: 1601658 - RNA, 12 nt, Pseudomonas putida KT2440
gcccaaagcccg

SEQ ID NO: 1601659 - RNA, 21 nt, Pseudomonas putida KT2440
gcccaaacaacaaagccccgg

SEQ ID NO: 1601660 - RNA, 21 nt, Pseudomonas putida KT2440
gcccaacgaaaaaggcccugc

SEQ ID NO: 1601661 - RNA, 20 nt, Pseudomonas putida KT2440
gcccaacccagccagcgaca

SEQ ID NO: 1601662 - RNA, 17 nt, Pseudomonas putida KT2440
gcccaaagaaaagcccg

SEQ ID NO: 1601663 - RNA, 12 nt, Pseudomonas putida KT2440
gcccaaauguua

SEQ ID NO: 1601664 - RNA, 20 nt, Pseudomonas putida KT2440
gcccaauuuggccagcuucu

SEQ ID NO: 1601665 - RNA, 19 nt, Pseudomonas putida KT2440
gcccacacggcaagccacg

SEQ ID NO: 1601666 - RNA, 20 nt, Pseudomonas putida KT2440
gcccaccaauuacucggccc

SEQ ID NO: 1601667 - RNA, 14 nt, Pseudomonas putida KT2440
gcccaccaccagcc

SEQ ID NO: 1601668 - RNA, 13 nt, Pseudomonas putida KT2440
gcccaccaccggu

SEQ ID NO: 1601669 - RNA, 20 nt, Pseudomonas putida KT2440
gcccaccacgaacgccccca

SEQ ID NO: 1601670 - RNA, 23 nt, Pseudomonas putida KT2440
gcccaccacgaacgcccccagcc

SEQ ID NO: 1601671 - RNA, 14 nt, Pseudomonas putida KT2440
gcccaaggucagcc

SEQ ID NO: 1601672 - RNA, 12 nt, Pseudomonas putida KT2440
gcccaaggcacc

SEQ ID NO: 1601673 - RNA, 16 nt, Pseudomonas putida KT2440
gcccaaggcaccaacu

SEQ ID NO: 1601674 - RNA, 22 nt, Pseudomonas putida KT2440
gcccaagcggcacuaccaggcc

SEQ ID NO: 1601675 - RNA, 21 nt, Pseudomonas putida KT2440
gcccacaaguccgaacucccc

SEQ ID NO: 1601676 - RNA, 22 nt, Pseudomonas putida KT2440
gcccacaaguccgaacucccca

SEQ ID NO: 1601677 - RNA, 13 nt, Pseudomonas putida KT2440
gcccaauagacuu

SEQ ID NO: 1601678 - RNA, 17 nt, Pseudomonas putida KT2440
gcccaaucggguaaaac

SEQ ID NO: 1601679 - RNA, 20 nt, Pseudomonas putida KT2440
gccagucccuccugugcccg

SEQ ID NO: 1601680 - RNA, 13 nt, Pseudomonas putida KT2440
gccaucaaggccg

SEQ ID NO: 1601681 - RNA, 22 nt, Pseudomonas putida KT2440
gccaucacuuccggcugcagca

SEQ ID NO: 1601682 - RNA, 17 nt, Pseudomonas putida KT2440
gccaucaccgcccgcgc

SEQ ID NO: 1601683 - RNA, 14 nt, Pseudomonas putida KT2440
gccaguaggcugca

SEQ ID NO: 1601684 - RNA, 21 nt, Pseudomonas putida KT2440
gccaucgcagaaggccccguc

SEQ ID NO: 1601685 - RNA, 23 nt, Pseudomonas putida KT2440
gccauccgguaugcccaugcucu

SEQ ID NO: 1601686 - RNA, 14 nt, Pseudomonas putida KT2440
gccaucaggcagcu

SEQ ID NO: 1601687 - RNA, 19 nt, Pseudomonas putida KT2440
gccaucagcaagccgccga

SEQ ID NO: 1601688 - RNA, 12 nt, Pseudomonas putida KT2440
gccaucuucacg

SEQ ID NO: 1601689 - RNA, 17 nt, Pseudomonas putida KT2440
gccaugaucagcgccug

SEQ ID NO: 1601690 - RNA, 13 nt, Pseudomonas putida KT2440
gccaugggcagag

SEQ ID NO: 1601691 - RNA, 18 nt, Pseudomonas putida KT2440
gccauugaucaccuccac

SEQ ID NO: 1601692 - RNA, 21 nt, Pseudomonas putida KT2440
gccauugcaccacccccagcg

SEQ ID NO: 1601693 - RNA, 18 nt, Pseudomonas putida KT2440
gccauugacccgcuugca

SEQ ID NO: 1601694 - RNA, 14 nt, Pseudomonas putida KT2440
gccauugaggaagu

SEQ ID NO: 1601695 - RNA, 17 nt, Pseudomonas putida KT2440
gccauugaccuugguga

SEQ ID NO: 1601696 - RNA, 17 nt, Pseudomonas putida KT2440
gccauucucgccgccgc

SEQ ID NO: 1601697 - RNA, 22 nt, Pseudomonas putida KT2440
gccauucucgccgccgcugacc

SEQ ID NO: 1601698 - RNA, 17 nt, Pseudomonas putida KT2440
gccauucuucuccaggu

SEQ ID NO: 1601699 - RNA, 18 nt, Pseudomonas putida KT2440
gccauuccggcugcagcu

SEQ ID NO: 1601700 - RNA, 15 nt, Pseudomonas putida KT2440
gccauucaccagcuu

SEQ ID NO: 1601701 - RNA, 23 nt, Pseudomonas putida KT2440
gccauucaucguauugccccggc

SEQ ID NO: 1601702 - RNA, 13 nt, Pseudomonas putida KT2440
gccaugugcucgg

SEQ ID NO: 1601703 - RNA, 13 nt, Pseudomonas putida KT2440
gccaugugcuggc

SEQ ID NO: 1601704 - RNA, 14 nt, Pseudomonas putida KT2440
gccagcgcuccagc

SEQ ID NO: 1601705 - RNA, 15 nt, Pseudomonas putida KT2440
gccagcgcuccagca

SEQ ID NO: 1601706 - RNA, 17 nt, Pseudomonas putida KT2440
gccagcgugaaccggcu

SEQ ID NO: 1601707 - RNA, 18 nt, Pseudomonas putida KT2440
gccagcgucuuuggccug

SEQ ID NO: 1601708 - RNA, 17 nt, Pseudomonas putida KT2440
gccagcggccagcgccu

SEQ ID NO: 1601709 - RNA, 23 nt, Pseudomonas putida KT2440
gccagcggccagcgccuggcgca

SEQ ID NO: 1601710 - RNA, 13 nt, Pseudomonas putida KT2440
gccagcugcgcac

SEQ ID NO: 1601711 - RNA, 22 nt, Pseudomonas putida KT2440
gccagcguggccgccaacagcg

SEQ ID NO: 1601712 - RNA, 19 nt, Pseudomonas putida KT2440
gccagcuaucucccagccu

SEQ ID NO: 1601713 - RNA, 24 nt, Pseudomonas putida KT2440
gccagcuaucucccagccugggcg

SEQ ID NO: 1601714 - RNA, 14 nt, Pseudomonas putida KT2440
gccagcgccuggcg

SEQ ID NO: 1601715 - RNA, 17 nt, Pseudomonas putida KT2440
gccagcgccuggcgcag

SEQ ID NO: 1601716 - RNA, 17 nt, Pseudomonas putida KT2440
gccagcgccugcaggcc

SEQ ID NO: 1601717 - RNA, 14 nt, Pseudomonas putida KT2440
gccagccgccgccg

SEQ ID NO: 1601718 - RNA, 15 nt, Pseudomonas putida KT2440
gccagccgcucagcc

SEQ ID NO: 1601719 - RNA, 16 nt, Pseudomonas putida KT2440
gccagccgcucagcca

SEQ ID NO: 1601720 - RNA, 19 nt, Pseudomonas putida KT2440
gccagccuucgccaacugc

SEQ ID NO: 1601721 - RNA, 23 nt, Pseudomonas putida KT2440
gccagccuuaccccccugcacca

SEQ ID NO: 1601722 - RNA, 14 nt, Pseudomonas putida KT2440
gccagcgacagcau

SEQ ID NO: 1601723 - RNA, 20 nt, Pseudomonas putida KT2440
gccaggaucaacugccgcgc

SEQ ID NO: 1601724 - RNA, 17 nt, Pseudomonas putida KT2440
gccaggaucgagaccuu

SEQ ID NO: 1601725 - RNA, 18 nt, Pseudomonas putida KT2440
gccaggacggugguggcc

SEQ ID NO: 1601726 - RNA, 18 nt, Pseudomonas putida KT2440
gccaggagaacacccagc

SEQ ID NO: 1601727 - RNA, 11 nt, Pseudomonas putida KT2440
gccagcugcug

SEQ ID NO: 1601728 - RNA, 16 nt, Pseudomonas putida KT2440
gccagcugcugcccca

SEQ ID NO: 1601729 - RNA, 18 nt, Pseudomonas putida KT2440
gccagcugcugccccaug

SEQ ID NO: 1601730 - RNA, 16 nt, Pseudomonas putida KT2440
gccaggccgcacgcgc

SEQ ID NO: 1601731 - RNA, 21 nt, Pseudomonas putida KT2440
gccaggccggcgcagauggug

SEQ ID NO: 1601732 - RNA, 14 nt, Pseudomonas putida KT2440
gccaggcgcaggcc

SEQ ID NO: 1601733 - RNA, 13 nt, Pseudomonas putida KT2440
gccaggcgcagug

SEQ ID NO: 1601734 - RNA, 21 nt, Pseudomonas putida KT2440
gccaggugauuuccucuucac

SEQ ID NO: 1601735 - RNA, 15 nt, Pseudomonas putida KT2440
gccaggugccgggcu

SEQ ID NO: 1601736 - RNA, 18 nt, Pseudomonas putida KT2440
gccaggugauaguccagc

SEQ ID NO: 1601737 - RNA, 23 nt, Pseudomonas putida KT2440
gccagggugcgggcgucuuccag

SEQ ID NO: 1601738 - RNA, 21 nt, Pseudomonas putida KT2440
gccaggcugcgcuccaacugg

SEQ ID NO: 1601739 - RNA, 13 nt, Pseudomonas putida KT2440
gccaggcuugguu

SEQ ID NO: 1601740 - RNA, 16 nt, Pseudomonas putida KT2440
gccaggcuuuccaggu

SEQ ID NO: 1601741 - RNA, 13 nt, Pseudomonas putida KT2440
gccaggcucaggc

SEQ ID NO: 1601742 - RNA, 13 nt, Pseudomonas putida KT2440
gccaggcucucca

SEQ ID NO: 1601743 - RNA, 22 nt, Pseudomonas putida KT2440
gccaggcucuccagccgcugcu

SEQ ID NO: 1601744 - RNA, 16 nt, Pseudomonas putida KT2440
gccaggcguugugggu

SEQ ID NO: 1601745 - RNA, 23 nt, Pseudomonas putida KT2440
gccaggcguauucggccaccagc

SEQ ID NO: 1601746 - RNA, 19 nt, Pseudomonas putida KT2440
gccagcaguuucagcggcc

SEQ ID NO: 1601747 - RNA, 12 nt, Pseudomonas putida KT2440
gccagcaucacc

SEQ ID NO: 1601748 - RNA, 18 nt, Pseudomonas putida KT2440
gccagcaucacgccgcgc

SEQ ID NO: 1601749 - RNA, 22 nt, Pseudomonas putida KT2440
gccagcaucacgccgcgcuggc

SEQ ID NO: 1601750 - RNA, 22 nt, Pseudomonas putida KT2440
gccagcagcggguuccccagca

SEQ ID NO: 1601751 - RNA, 18 nt, Pseudomonas putida KT2440
gccagcagcuccauacca

SEQ ID NO: 1601752 - RNA, 15 nt, Pseudomonas putida KT2440
gccagcauggugcag

SEQ ID NO: 1601753 - RNA, 13 nt, Pseudomonas putida KT2440
gccagcauggccg

SEQ ID NO: 1601754 - RNA, 18 nt, Pseudomonas putida KT2440
gccagcaucucggccagu

SEQ ID NO: 1601755 - RNA, 17 nt, Pseudomonas putida KT2440
gccagcacgaacagcaa

SEQ ID NO: 1601756 - RNA, 15 nt, Pseudomonas putida KT2440
gccagcacgcaggcc

SEQ ID NO: 1601757 - RNA, 16 nt, Pseudomonas putida KT2440
gccagcacgcaggcca

SEQ ID NO: 1601758 - RNA, 18 nt, Pseudomonas putida KT2440
gccagcacgcaggccagc

SEQ ID NO: 1601759 - RNA, 21 nt, Pseudomonas putida KT2440
gccagcagccugugcggcucc

SEQ ID NO: 1601760 - RNA, 13 nt, Pseudomonas putida KT2440
gccagcagcgcau

SEQ ID NO: 1601761 - RNA, 18 nt, Pseudomonas putida KT2440
gccagcagcgcuccgcca

SEQ ID NO: 1601762 - RNA, 16 nt, Pseudomonas putida KT2440
gccagcagccccccuu

SEQ ID NO: 1601763 - RNA, 18 nt, Pseudomonas putida KT2440
gccagcccaggcuggcac

SEQ ID NO: 1601764 - RNA, 12 nt, Pseudomonas putida KT2440
gccagcccaucc

SEQ ID NO: 1601765 - RNA, 14 nt, Pseudomonas putida KT2440
gccagcccauggcg

SEQ ID NO: 1601766 - RNA, 17 nt, Pseudomonas putida KT2440
gccagcccauggcgcug

SEQ ID NO: 1601767 - RNA, 15 nt, Pseudomonas putida KT2440
gccagccccagcggc

SEQ ID NO: 1601768 - RNA, 12 nt, Pseudomonas putida KT2440
gccagccccagc

SEQ ID NO: 1601769 - RNA, 18 nt, Pseudomonas putida KT2440
gccagccaguacggcagc

SEQ ID NO: 1601770 - RNA, 20 nt, Pseudomonas putida KT2440
gccagccagcagcguaccca

SEQ ID NO: 1601771 - RNA, 14 nt, Pseudomonas putida KT2440
gccagccaccacca

SEQ ID NO: 1601772 - RNA, 17 nt, Pseudomonas putida KT2440
gccagccaacgcuggua

SEQ ID NO: 1601773 - RNA, 13 nt, Pseudomonas putida KT2440
gccagccaaccgc

SEQ ID NO: 1601774 - RNA, 22 nt, Pseudomonas putida KT2440
gccagaaaaguuggccaugucc

SEQ ID NO: 1601775 - RNA, 23 nt, Pseudomonas putida KT2440
gccagaaagccacugcaccaaug

SEQ ID NO: 1601776 - RNA, 22 nt, Pseudomonas putida KT2440
gccagcaacuggugaaucagcc

SEQ ID NO: 1601777 - RNA, 14 nt, Pseudomonas putida KT2440
gccagcaacgcagc

SEQ ID NO: 1601778 - RNA, 15 nt, Pseudomonas putida KT2440
gccagcaccaucagg

SEQ ID NO: 1601779 - RNA, 22 nt, Pseudomonas putida KT2440
gccagcacacgguaggcgucuu

SEQ ID NO: 1601780 - RNA, 15 nt, Pseudomonas putida KT2440
gccacuguugcagcg

SEQ ID NO: 1601781 - RNA, 18 nt, Pseudomonas putida KT2440
gccaccggcagcaccugc

SEQ ID NO: 1601782 - RNA, 19 nt, Pseudomonas putida KT2440
gccacuucgcgagcgagcg

SEQ ID NO: 1601783 - RNA, 21 nt, Pseudomonas putida KT2440
gccacuucgcggaaggcgacc

SEQ ID NO: 1601784 - RNA, 17 nt, Pseudomonas putida KT2440
gccaaugcucaguggac

SEQ ID NO: 1601785 - RNA, 17 nt, Pseudomonas putida KT2440
gccaaucucguugcgcc

SEQ ID NO: 1601786 - RNA, 20 nt, Pseudomonas putida KT2440
gccacaauggcgcacagggc

SEQ ID NO: 1601787 - RNA, 15 nt, Pseudomonas putida KT2440
gccacaauccgcugu

SEQ ID NO: 1601788 - RNA, 22 nt, Pseudomonas putida KT2440
gccacaacccaucacggccugc

SEQ ID NO: 1601789 - RNA, 18 nt, Pseudomonas putida KT2440
gccacaacccuugcagcg

SEQ ID NO: 1601790 - RNA, 16 nt, Pseudomonas putida KT2440
gccaauuugccagcgu

SEQ ID NO: 1601791 - RNA, 20 nt, Pseudomonas putida KT2440
gccaauuuccauaccaaugg

SEQ ID NO: 1601792 - RNA, 19 nt, Pseudomonas putida KT2440
gccaaguacggccagcagg

SEQ ID NO: 1601793 - RNA, 14 nt, Pseudomonas putida KT2440
gccaaguguuugaa

SEQ ID NO: 1601794 - RNA, 19 nt, Pseudomonas putida KT2440
gccaauaacucgcagcgca

SEQ ID NO: 1601795 - RNA, 16 nt, Pseudomonas putida KT2440
gccaaggccgcccagu

SEQ ID NO: 1601796 - RNA, 16 nt, Pseudomonas putida KT2440
gccaaggcuagccacg

SEQ ID NO: 1601797 - RNA, 18 nt, Pseudomonas putida KT2440
gccaagguugccaccagc

SEQ ID NO: 1601798 - RNA, 20 nt, Pseudomonas putida KT2440
gccaagguugccaccagcau

SEQ ID NO: 1601799 - RNA, 20 nt, Pseudomonas putida KT2440
gccaagguaaucuggcuguc

SEQ ID NO: 1601800 - RNA, 17 nt, Pseudomonas putida KT2440
gccaaggucagcaagcc

SEQ ID NO: 1601801 - RNA, 14 nt, Pseudomonas putida KT2440
gccaagguccagcc

SEQ ID NO: 1601802 - RNA, 15 nt, Pseudomonas putida KT2440
gccaauagcccgcug

SEQ ID NO: 1601803 - RNA, 18 nt, Pseudomonas putida KT2440
gccaauaccgcugcaaca

SEQ ID NO: 1601804 - RNA, 16 nt, Pseudomonas putida KT2440
gccaaucgaucugcuc

SEQ ID NO: 1601805 - RNA, 20 nt, Pseudomonas putida KT2440
gccaaucgaucugcucgccc

SEQ ID NO: 1601806 - RNA, 15 nt, Pseudomonas putida KT2440
gccaaucaucgccag

SEQ ID NO: 1601807 - RNA, 15 nt, Pseudomonas putida KT2440
gccaccgcgagcugu

SEQ ID NO: 1601808 - RNA, 22 nt, Pseudomonas putida KT2440
gccaccgcgagcugucgcgcca

SEQ ID NO: 1601809 - RNA, 20 nt, Pseudomonas putida KT2440
gccaccgcgauggauggcac

SEQ ID NO: 1601810 - RNA, 16 nt, Pseudomonas putida KT2440
gccaccgcgcgccagu

SEQ ID NO: 1601811 - RNA, 18 nt, Pseudomonas putida KT2440
gccacccggaccagcgcc

SEQ ID NO: 1601812 - RNA, 20 nt, Pseudomonas putida KT2440
gccacccggaccagcgccgc

SEQ ID NO: 1601813 - RNA, 21 nt, Pseudomonas putida KT2440
gccacccggaccagcgccgca

SEQ ID NO: 1601814 - RNA, 14 nt, Pseudomonas putida KT2440
gccacccgacgcca

SEQ ID NO: 1601815 - RNA, 15 nt, Pseudomonas putida KT2440
gccacccgcugggcu

SEQ ID NO: 1601816 - RNA, 16 nt, Pseudomonas putida KT2440
gccaccaugcucggcc

SEQ ID NO: 1601817 - RNA, 17 nt, Pseudomonas putida KT2440
gccaccaugcucggcca

SEQ ID NO: 1601818 - RNA, 19 nt, Pseudomonas putida KT2440
gccaccaugcucggccagc

SEQ ID NO: 1601819 - RNA, 20 nt, Pseudomonas putida KT2440
gccaccaugcucggccagcu

SEQ ID NO: 1601820 - RNA, 20 nt, Pseudomonas putida KT2440
gccaccccgcaaagcccugc

SEQ ID NO: 1601821 - RNA, 20 nt, Pseudomonas putida KT2440
gccacccccgccgccagggc

SEQ ID NO: 1601822 - RNA, 12 nt, Pseudomonas putida KT2440
gccaccccaggc

SEQ ID NO: 1601823 - RNA, 15 nt, Pseudomonas putida KT2440
gccaccccaggccac

SEQ ID NO: 1601824 - RNA, 22 nt, Pseudomonas putida KT2440
gccacccaggcauacagcuggc

SEQ ID NO: 1601825 - RNA, 23 nt, Pseudomonas putida KT2440
gccacccaggcauacagcuggcc

SEQ ID NO: 1601826 - RNA, 23 nt, Pseudomonas putida KT2440
gccacccagaucaucaucggcau

SEQ ID NO: 1601827 - RNA, 18 nt, Pseudomonas putida KT2440
gccacccagaugcgggcc

SEQ ID NO: 1601828 - RNA, 19 nt, Pseudomonas putida KT2440
gccacccagaugcgggccc

SEQ ID NO: 1601829 - RNA, 24 nt, Pseudomonas putida KT2440
gccacccaaggcauccagcucggc

SEQ ID NO: 1601830 - RNA, 20 nt, Pseudomonas putida KT2440
gccacccaccacggccuggc

SEQ ID NO: 1601831 - RNA, 21 nt, Pseudomonas putida KT2440
gccacccaccacggccuggcc

SEQ ID NO: 1601832 - RNA, 14 nt, Pseudomonas putida KT2440
gccaccaagucacu

SEQ ID NO: 1601833 - RNA, 22 nt, Pseudomonas putida KT2440
gccaccaaucugguuacccaac

SEQ ID NO: 1601834 - RNA, 17 nt, Pseudomonas putida KT2440
gccacacugucccggca

SEQ ID NO: 1601835 - RNA, 18 nt, Pseudomonas putida KT2440
gccacacacccgggcccg

SEQ ID NO: 1601836 - RNA, 18 nt, Pseudomonas putida KT2440
gccacacaaauccaggac

SEQ ID NO: 1601837 - RNA, 19 nt, Pseudomonas putida KT2440
gccacacgcugcugcuggc

SEQ ID NO: 1601838 - RNA, 19 nt, Pseudomonas putida KT2440
gcauuucgacgcagaggug

SEQ ID NO: 1601839 - RNA, 16 nt, Pseudomonas putida KT2440
gcauuucguccaggcu

SEQ ID NO: 1601840 - RNA, 17 nt, Pseudomonas putida KT2440
gccaaaaaaaccccagg

SEQ ID NO: 1601841 - RNA, 21 nt, Pseudomonas putida KT2440
gccaaaaaauccgccuggccg

SEQ ID NO: 1601842 - RNA, 19 nt, Pseudomonas putida KT2440
gccaaacuggaugauggua

SEQ ID NO: 1601843 - RNA, 22 nt, Pseudomonas putida KT2440
gccaaaguccugcaaaggcccu

SEQ ID NO: 1601844 - RNA, 22 nt, Pseudomonas putida KT2440
gccaaacaggaucuccucggcc

SEQ ID NO: 1601845 - RNA, 19 nt, Pseudomonas putida KT2440
gccaaaaccuguuccagcc

SEQ ID NO: 1601846 - RNA, 13 nt, Pseudomonas putida KT2440
gccaacugcagca

SEQ ID NO: 1601847 - RNA, 17 nt, Pseudomonas putida KT2440
gccaacugcgcccgccc

SEQ ID NO: 1601848 - RNA, 12 nt, Pseudomonas putida KT2440
gccaacugcucu

SEQ ID NO: 1601849 - RNA, 16 nt, Pseudomonas putida KT2440
gccaacugcucuacca

SEQ ID NO: 1601850 - RNA, 12 nt, Pseudomonas putida KT2440
gccaacucccca

SEQ ID NO: 1601851 - RNA, 15 nt, Pseudomonas putida KT2440
gccaacuccccaccc

SEQ ID NO: 1601852 - RNA, 17 nt, Pseudomonas putida KT2440
gccaacuccccacccag

SEQ ID NO: 1601853 - RNA, 18 nt, Pseudomonas putida KT2440
gccaacgcugcucggccu

SEQ ID NO: 1601854 - RNA, 16 nt, Pseudomonas putida KT2440
gccaacgccccaggcc

SEQ ID NO: 1601855 - RNA, 21 nt, Pseudomonas putida KT2440
gccaacgccccaggccgcggc

SEQ ID NO: 1601856 - RNA, 22 nt, Pseudomonas putida KT2440
gccaacgcccccgccacccccg

SEQ ID NO: 1601857 - RNA, 17 nt, Pseudomonas putida KT2440
gccaagccuugaucugc

SEQ ID NO: 1601858 - RNA, 23 nt, Pseudomonas putida KT2440
gccaagccggcuuugcgucauca

SEQ ID NO: 1601859 - RNA, 16 nt, Pseudomonas putida KT2440
gccaagcacgcacagu

SEQ ID NO: 1601860 - RNA, 16 nt, Pseudomonas putida KT2440
gccaagcggccccaau

SEQ ID NO: 1601861 - RNA, 16 nt, Pseudomonas putida KT2440
gccaagcggccccaga

SEQ ID NO: 1601862 - RNA, 23 nt, Pseudomonas putida KT2440
gccaagcggcucgucaaccacag

SEQ ID NO: 1601863 - RNA, 19 nt, Pseudomonas putida KT2440
gccaaccccuccuucaggu

SEQ ID NO: 1601864 - RNA, 14 nt, Pseudomonas putida KT2440
gccaaccacgccug

SEQ ID NO: 1601865 - RNA, 15 nt, Pseudomonas putida KT2440
gccaaccacccgggc

SEQ ID NO: 1601866 - RNA, 19 nt, Pseudomonas putida KT2440
gccaaccucaggccugcac

SEQ ID NO: 1601867 - RNA, 15 nt, Pseudomonas putida KT2440
gccaaauucgaccag

SEQ ID NO: 1601868 - RNA, 20 nt, Pseudomonas putida KT2440
gccaacaacaagcgcuggua

SEQ ID NO: 1601869 - RNA, 14 nt, Pseudomonas putida KT2440
gccaacaccaccuc

SEQ ID NO: 1601870 - RNA, 13 nt, Pseudomonas putida KT2440
gccaacagaggcc

SEQ ID NO: 1601871 - RNA, 15 nt, Pseudomonas putida KT2440
gccaacaggcagcau

SEQ ID NO: 1601872 - RNA, 21 nt, Pseudomonas putida KT2440
gcauuggcgugcucgcgcaug

SEQ ID NO: 1601873 - RNA, 20 nt, Pseudomonas putida KT2440
gcauuggcgcgcucgacggu

SEQ ID NO: 1601874 - RNA, 16 nt, Pseudomonas putida KT2440
gcauuggcggcaggcg

SEQ ID NO: 1601875 - RNA, 20 nt, Pseudomonas putida KT2440
gcauuggcggcaggcgcagc

SEQ ID NO: 1601876 - RNA, 14 nt, Pseudomonas putida KT2440
gcauugcagcccca

SEQ ID NO: 1601877 - RNA, 19 nt, Pseudomonas putida KT2440
gcauugauagcggcagcga

SEQ ID NO: 1601878 - RNA, 12 nt, Pseudomonas putida KT2440
gcauugccuguu

SEQ ID NO: 1601879 - RNA, 21 nt, Pseudomonas putida KT2440
gcauuuccagcgucagugaca

SEQ ID NO: 1601880 - RNA, 18 nt, Pseudomonas putida KT2440
gcauuggugccagcgcca

SEQ ID NO: 1601881 - RNA, 13 nt, Pseudomonas putida KT2440
gcauuguccucgu

SEQ ID NO: 1601882 - RNA, 20 nt, Pseudomonas putida KT2440
gcauucgcgcccgcagugca

SEQ ID NO: 1601883 - RNA, 18 nt, Pseudomonas putida KT2440
gcauucuucuccaacugg

SEQ ID NO: 1601884 - RNA, 16 nt, Pseudomonas putida KT2440
gcauucccggcgccau

SEQ ID NO: 1601885 - RNA, 22 nt, Pseudomonas putida KT2440
gcauggcaaacagcaccagccc

SEQ ID NO: 1601886 - RNA, 18 nt, Pseudomonas putida KT2440
gcaugcucggcggugccu

SEQ ID NO: 1601887 - RNA, 15 nt, Pseudomonas putida KT2440
gcaugcugccaggca

SEQ ID NO: 1601888 - RNA, 18 nt, Pseudomonas putida KT2440
gcaugcugccaggcaaag

SEQ ID NO: 1601889 - RNA, 16 nt, Pseudomonas putida KT2440
gcauggcccaugaucg

SEQ ID NO: 1601890 - RNA, 13 nt, Pseudomonas putida KT2440
gcauggccuggca

SEQ ID NO: 1601891 - RNA, 19 nt, Pseudomonas putida KT2440
gcauggccgaaaccagccc

SEQ ID NO: 1601892 - RNA, 23 nt, Pseudomonas putida KT2440
gcauggccgaaaccagccccuug

SEQ ID NO: 1601893 - RNA, 14 nt, Pseudomonas putida KT2440
gcauggcaaucggg

SEQ ID NO: 1601894 - RNA, 12 nt, Pseudomonas putida KT2440
gcauggcaugca

SEQ ID NO: 1601895 - RNA, 19 nt, Pseudomonas putida KT2440
gcauggccaguuccuggca

SEQ ID NO: 1601896 - RNA, 13 nt, Pseudomonas putida KT2440
gcaugggccaggg

SEQ ID NO: 1601897 - RNA, 21 nt, Pseudomonas putida KT2440
gcauggcgucggcgauggcgu

SEQ ID NO: 1601898 - RNA, 17 nt, Pseudomonas putida KT2440
gcauggcgugcccggca

SEQ ID NO: 1601899 - RNA, 18 nt, Pseudomonas putida KT2440
gcauggcguuguccagca

SEQ ID NO: 1601900 - RNA, 17 nt, Pseudomonas putida KT2440
gcauggugaagcccgcc

SEQ ID NO: 1601901 - RNA, 15 nt, Pseudomonas putida KT2440
gcauguagccacgcu

SEQ ID NO: 1601902 - RNA, 17 nt, Pseudomonas putida KT2440
gcauguagccacgcugc

SEQ ID NO: 1601903 - RNA, 14 nt, Pseudomonas putida KT2440
gcauguccagcccg

SEQ ID NO: 1601904 - RNA, 15 nt, Pseudomonas putida KT2440
gcauguccagucagg

SEQ ID NO: 1601905 - RNA, 12 nt, Pseudomonas putida KT2440
gcaugugccagg

SEQ ID NO: 1601906 - RNA, 15 nt, Pseudomonas putida KT2440
gcauguucaccaggu

SEQ ID NO: 1601907 - RNA, 13 nt, Pseudomonas putida KT2440
gcauguucaucac

SEQ ID NO: 1601908 - RNA, 14 nt, Pseudomonas putida KT2440
gcaugaacagcgcu

SEQ ID NO: 1601909 - RNA, 21 nt, Pseudomonas putida KT2440
gcaugaauagcgcacugagca

SEQ ID NO: 1601910 - RNA, 23 nt, Pseudomonas putida KT2440
gcaucuucuucacguccagccac

SEQ ID NO: 1601911 - RNA, 20 nt, Pseudomonas putida KT2440
gcaugaucaccgccagcggc

SEQ ID NO: 1601912 - RNA, 15 nt, Pseudomonas putida KT2440
gcaugagccuggccg

SEQ ID NO: 1601913 - RNA, 15 nt, Pseudomonas putida KT2440
gcaugcaucugcgcc

SEQ ID NO: 1601914 - RNA, 13 nt, Pseudomonas putida KT2440
gcaugcaagcagc

SEQ ID NO: 1601915 - RNA, 17 nt, Pseudomonas putida KT2440
gcaugcaggaggucagc

SEQ ID NO: 1601916 - RNA, 14 nt, Pseudomonas putida KT2440
gcaugcacggcagc

SEQ ID NO: 1601917 - RNA, 17 nt, Pseudomonas putida KT2440
gcaugcgggggccccac

SEQ ID NO: 1601918 - RNA, 18 nt, Pseudomonas putida KT2440
gcaugccuaucucuucca

SEQ ID NO: 1601919 - RNA, 18 nt, Pseudomonas putida KT2440
gcaugccagcagcuggcu

SEQ ID NO: 1601920 - RNA, 20 nt, Pseudomonas putida KT2440
gcaugcccgcucccacaggu

SEQ ID NO: 1601921 - RNA, 14 nt, Pseudomonas putida KT2440
gcaugcccagcgcc

SEQ ID NO: 1601922 - RNA, 20 nt, Pseudomonas putida KT2440
gcaugcccaguucgcgugcc

SEQ ID NO: 1601923 - RNA, 21 nt, Pseudomonas putida KT2440
gcaugccccucgaacagcgcc

SEQ ID NO: 1601924 - RNA, 23 nt, Pseudomonas putida KT2440
gcaucugccgggucggccugcuc

SEQ ID NO: 1601925 - RNA, 16 nt, Pseudomonas putida KT2440
gcaucugcugcggcag

SEQ ID NO: 1601926 - RNA, 20 nt, Pseudomonas putida KT2440
gcaucugcugcggcaggcug

SEQ ID NO: 1601927 - RNA, 23 nt, Pseudomonas putida KT2440
gcaucugcugcggcaggcuggca

SEQ ID NO: 1601928 - RNA, 16 nt, Pseudomonas putida KT2440
gcaucugcaccaggaa

SEQ ID NO: 1601929 - RNA, 22 nt, Pseudomonas putida KT2440
gcaucucggccagugcgugcag

SEQ ID NO: 1601930 - RNA, 13 nt, Pseudomonas putida KT2440
gcaucguccuugc

SEQ ID NO: 1601931 - RNA, 19 nt, Pseudomonas putida KT2440
gcaucgucacauccugcuc

SEQ ID NO: 1601932 - RNA, 18 nt, Pseudomonas putida KT2440
gcaucguuauccagcacc

SEQ ID NO: 1601933 - RNA, 21 nt, Pseudomonas putida KT2440
gcaucguuauccagcacccac

SEQ ID NO: 1601934 - RNA, 17 nt, Pseudomonas putida KT2440
gcaucgccaacagaggc

SEQ ID NO: 1601935 - RNA, 16 nt, Pseudomonas putida KT2440
gcaucggccuggggca

SEQ ID NO: 1601936 - RNA, 21 nt, Pseudomonas putida KT2440
gcaucggccuggggcaggccc

SEQ ID NO: 1601937 - RNA, 16 nt, Pseudomonas putida KT2440
gccguccccaaccggg

SEQ ID NO: 1601938 - RNA, 20 nt, Pseudomonas putida KT2440
gccguccaggaacgcugccu

SEQ ID NO: 1601939 - RNA, 12 nt, Pseudomonas putida KT2440
gccgucagcagc

SEQ ID NO: 1601940 - RNA, 14 nt, Pseudomonas putida KT2440
gccgucagcagcag

SEQ ID NO: 1601941 - RNA, 17 nt, Pseudomonas putida KT2440
gccgucagcagcaggcg

SEQ ID NO: 1601942 - RNA, 13 nt, Pseudomonas putida KT2440
gccguaggccagg

SEQ ID NO: 1601943 - RNA, 16 nt, Pseudomonas putida KT2440
gccguaggugaucagc

SEQ ID NO: 1601944 - RNA, 14 nt, Pseudomonas putida KT2440
gccguaggacagug

SEQ ID NO: 1601945 - RNA, 16 nt, Pseudomonas putida KT2440
gccguagccaaccgag

SEQ ID NO: 1601946 - RNA, 22 nt, Pseudomonas putida KT2440
gccguagccaaccgagucaaca

SEQ ID NO: 1601947 - RNA, 20 nt, Pseudomonas putida KT2440
gccguacugcugggucagca

SEQ ID NO: 1601948 - RNA, 21 nt, Pseudomonas putida KT2440
gccguacugcugggucagcac

SEQ ID NO: 1601949 - RNA, 22 nt, Pseudomonas putida KT2440
gccgguggcgaucucugcuucc

SEQ ID NO: 1601950 - RNA, 18 nt, Pseudomonas putida KT2440
gccgguggcggccgcagc

SEQ ID NO: 1601951 - RNA, 16 nt, Pseudomonas putida KT2440
gccgguguaccaucca

SEQ ID NO: 1601952 - RNA, 17 nt, Pseudomonas putida KT2440
gccgguguaccauccag

SEQ ID NO: 1601953 - RNA, 21 nt, Pseudomonas putida KT2440
gccggugguaauuggccggca

SEQ ID NO: 1601954 - RNA, 23 nt, Pseudomonas putida KT2440
gccgguggcuucguggugcuggc

SEQ ID NO: 1601955 - RNA, 17 nt, Pseudomonas putida KT2440
gccgguguucgcgggug

SEQ ID NO: 1601956 - RNA, 14 nt, Pseudomonas putida KT2440
gccgguugcgcagc

SEQ ID NO: 1601957 - RNA, 16 nt, Pseudomonas putida KT2440
gccguacaccaugcuc

SEQ ID NO: 1601958 - RNA, 15 nt, Pseudomonas putida KT2440
gccgguuucgucagg

SEQ ID NO: 1601959 - RNA, 20 nt, Pseudomonas putida KT2440
gccgguuucucgcagcagca

SEQ ID NO: 1601960 - RNA, 17 nt, Pseudomonas putida KT2440
gccgugaagaggccagu

SEQ ID NO: 1601961 - RNA, 21 nt, Pseudomonas putida KT2440
gccgugaagaggccagugagc

SEQ ID NO: 1601962 - RNA, 15 nt, Pseudomonas putida KT2440
gccgugccugggugg

SEQ ID NO: 1601963 - RNA, 14 nt, Pseudomonas putida KT2440
gccgugcucggccu

SEQ ID NO: 1601964 - RNA, 18 nt, Pseudomonas putida KT2440
gccgugcucggccuugcc

SEQ ID NO: 1601965 - RNA, 17 nt, Pseudomonas putida KT2440
gccguggcaaggcccgc

SEQ ID NO: 1601966 - RNA, 19 nt, Pseudomonas putida KT2440
gccguggcaaggcccgcgc

SEQ ID NO: 1601967 - RNA, 18 nt, Pseudomonas putida KT2440
gccguggcaggcaguucg

SEQ ID NO: 1601968 - RNA, 14 nt, Pseudomonas putida KT2440
gccgucgaccaggc

SEQ ID NO: 1601969 - RNA, 15 nt, Pseudomonas putida KT2440
gccgucgaccaggca

SEQ ID NO: 1601970 - RNA, 21 nt, Pseudomonas putida KT2440
gccgucgaacguccgcucuuc

SEQ ID NO: 1601971 - RNA, 13 nt, Pseudomonas putida KT2440
gccgucgaugccu

SEQ ID NO: 1601972 - RNA, 19 nt, Pseudomonas putida KT2440
gccgucgaugccugugucg

SEQ ID NO: 1601973 - RNA, 17 nt, Pseudomonas putida KT2440
gccgucgccucccccuc

SEQ ID NO: 1601974 - RNA, 23 nt, Pseudomonas putida KT2440
gccgucgccucccccuccacugu

SEQ ID NO: 1601975 - RNA, 18 nt, Pseudomonas putida KT2440
gccgucucgucacuggcu

SEQ ID NO: 1601976 - RNA, 21 nt, Pseudomonas putida KT2440
gccgucucgucacuggcugcu

SEQ ID NO: 1601977 - RNA, 22 nt, Pseudomonas putida KT2440
gccgucucgucacuggcugcug

SEQ ID NO: 1601978 - RNA, 20 nt, Pseudomonas putida KT2440
gccggcgccgguggcggccg

SEQ ID NO: 1601979 - RNA, 16 nt, Pseudomonas putida KT2440
gccggccagcgccugc

SEQ ID NO: 1601980 - RNA, 17 nt, Pseudomonas putida KT2440
gccggccaccagugcuu

SEQ ID NO: 1601981 - RNA, 20 nt, Pseudomonas putida KT2440
gccggccaaggucagcaagc

SEQ ID NO: 1601982 - RNA, 16 nt, Pseudomonas putida KT2440
gccggcgucggcgcgc

SEQ ID NO: 1601983 - RNA, 16 nt, Pseudomonas putida KT2440
gccgggaagcgcccgc

SEQ ID NO: 1601984 - RNA, 20 nt, Pseudomonas putida KT2440
gccgggaagcgcccgcccac

SEQ ID NO: 1601985 - RNA, 23 nt, Pseudomonas putida KT2440
gccggucacccccaucagcgggc

SEQ ID NO: 1601986 - RNA, 14 nt, Pseudomonas putida KT2440
gccggucagcagca

SEQ ID NO: 1601987 - RNA, 14 nt, Pseudomonas putida KT2440
gccggucacuggca

SEQ ID NO: 1601988 - RNA, 22 nt, Pseudomonas putida KT2440
gccggucacgauccccaccagc

SEQ ID NO: 1601989 - RNA, 14 nt, Pseudomonas putida KT2440
gccggucauccagc

SEQ ID NO: 1601990 - RNA, 17 nt, Pseudomonas putida KT2440
gccggucauccagcagc

SEQ ID NO: 1601991 - RNA, 14 nt, Pseudomonas putida KT2440
gccgguagcggcug

SEQ ID NO: 1601992 - RNA, 16 nt, Pseudomonas putida KT2440
gccgguagcggcuggg

SEQ ID NO: 1601993 - RNA, 22 nt, Pseudomonas putida KT2440
gccgguaggucuaaccgcgcug

SEQ ID NO: 1601994 - RNA, 15 nt, Pseudomonas putida KT2440
gccgggcucugggca

SEQ ID NO: 1601995 - RNA, 20 nt, Pseudomonas putida KT2440
gccggucggggugcugcgca

SEQ ID NO: 1601996 - RNA, 21 nt, Pseudomonas putida KT2440
gccggucuugucugacagcag

SEQ ID NO: 1601997 - RNA, 23 nt, Pseudomonas putida KT2440
gccggucuugucugacagcagga

SEQ ID NO: 1601998 - RNA, 15 nt, Pseudomonas putida KT2440
gccgcgucgcggccc

SEQ ID NO: 1601999 - RNA, 19 nt, Pseudomonas putida KT2440
gccgcgucgcggccccagg

SEQ ID NO: 1602000 - RNA, 22 nt, Pseudomonas putida KT2440
gccgcgucgcggccccagggcu

SEQ ID NO: 1602001 - RNA, 23 nt, Pseudomonas putida KT2440
gccgcucaccccauagggccagc

SEQ ID NO: 1602002 - RNA, 22 nt, Pseudomonas putida KT2440
gccgcucaccggccagcgcgcu

SEQ ID NO: 1602003 - RNA, 16 nt, Pseudomonas putida KT2440
gccgcucagccaccug

SEQ ID NO: 1602004 - RNA, 20 nt, Pseudomonas putida KT2440
gccgcucgauaugccgccgu

SEQ ID NO: 1602005 - RNA, 17 nt, Pseudomonas putida KT2440
gccgcugccagcagggc

SEQ ID NO: 1602006 - RNA, 15 nt, Pseudomonas putida KT2440
gccgcugccugggca

SEQ ID NO: 1602007 - RNA, 13 nt, Pseudomonas putida KT2440
gccgcuccagcuc

SEQ ID NO: 1602008 - RNA, 22 nt, Pseudomonas putida KT2440
gccgcuccagcucggcuggcug

SEQ ID NO: 1602009 - RNA, 22 nt, Pseudomonas putida KT2440
gccgcuccugcggucagccugc

SEQ ID NO: 1602010 - RNA, 15 nt, Pseudomonas putida KT2440
gccgcgcuggcgcgc

SEQ ID NO: 1602011 - RNA, 13 nt, Pseudomonas putida KT2440
gccgcgcugacca

SEQ ID NO: 1602012 - RNA, 14 nt, Pseudomonas putida KT2440
gccgcgcugacgca

SEQ ID NO: 1602013 - RNA, 18 nt, Pseudomonas putida KT2440
gccgcgcugacgcagggc

SEQ ID NO: 1602014 - RNA, 14 nt, Pseudomonas putida KT2440
gccgcgcuguggcg

SEQ ID NO: 1602015 - RNA, 22 nt, Pseudomonas putida KT2440
gccgcggaugugguggaacagg

SEQ ID NO: 1602016 - RNA, 14 nt, Pseudomonas putida KT2440
gccggagcuggagc

SEQ ID NO: 1602017 - RNA, 15 nt, Pseudomonas putida KT2440
gccggacuucuucaa

SEQ ID NO: 1602018 - RNA, 17 nt, Pseudomonas putida KT2440
gccggcaccgacagcaa

SEQ ID NO: 1602019 - RNA, 15 nt, Pseudomonas putida KT2440
gccggcaccgccaug

SEQ ID NO: 1602020 - RNA, 23 nt, Pseudomonas putida KT2440
gccggcagcgagcgcuggaucug

SEQ ID NO: 1602021 - RNA, 15 nt, Pseudomonas putida KT2440
gccggcagcaaggca

SEQ ID NO: 1602022 - RNA, 13 nt, Pseudomonas putida KT2440
gccggcacuuccu

SEQ ID NO: 1602023 - RNA, 15 nt, Pseudomonas putida KT2440
gccggcacggccggu

SEQ ID NO: 1602024 - RNA, 17 nt, Pseudomonas putida KT2440
gccggcacgcuaccacc

SEQ ID NO: 1602025 - RNA, 19 nt, Pseudomonas putida KT2440
gccggcacgcuaccaccug

SEQ ID NO: 1602026 - RNA, 14 nt, Pseudomonas putida KT2440
gccggcacgcccgc

SEQ ID NO: 1602027 - RNA, 14 nt, Pseudomonas putida KT2440
gccggaagaucagg

SEQ ID NO: 1602028 - RNA, 15 nt, Pseudomonas putida KT2440
gccgcuugcucaggc

SEQ ID NO: 1602029 - RNA, 16 nt, Pseudomonas putida KT2440
gccgcuucacuguccu

SEQ ID NO: 1602030 - RNA, 14 nt, Pseudomonas putida KT2440
gccgcuucuggaca

SEQ ID NO: 1602031 - RNA, 18 nt, Pseudomonas putida KT2440
gccgcuugaugucuccuu

SEQ ID NO: 1602032 - RNA, 14 nt, Pseudomonas putida KT2440
gccgcugugccagc

SEQ ID NO: 1602033 - RNA, 14 nt, Pseudomonas putida KT2440
gccgcuguucagcc

SEQ ID NO: 1602034 - RNA, 13 nt, Pseudomonas putida KT2440
gccgcugcgccug

SEQ ID NO: 1602035 - RNA, 15 nt, Pseudomonas putida KT2440
gccgcugcgcccgcc

SEQ ID NO: 1602036 - RNA, 18 nt, Pseudomonas putida KT2440
gccgccgcugcugcgccu

SEQ ID NO: 1602037 - RNA, 18 nt, Pseudomonas putida KT2440
gccgccgauagcagcacc

SEQ ID NO: 1602038 - RNA, 14 nt, Pseudomonas putida KT2440
gccgccgaggcacc

SEQ ID NO: 1602039 - RNA, 14 nt, Pseudomonas putida KT2440
gccgccgaacaggc

SEQ ID NO: 1602040 - RNA, 22 nt, Pseudomonas putida KT2440
gccgccgaacaggccggcugca

SEQ ID NO: 1602041 - RNA, 20 nt, Pseudomonas putida KT2440
gccgcccuugaggggcggcg

SEQ ID NO: 1602042 - RNA, 18 nt, Pseudomonas putida KT2440
gccgcccuuggugcacca

SEQ ID NO: 1602043 - RNA, 22 nt, Pseudomonas putida KT2440
gccgcaagcagucccagcaccg

SEQ ID NO: 1602044 - RNA, 16 nt, Pseudomonas putida KT2440
gccgcaagcccgcguu

SEQ ID NO: 1602045 - RNA, 19 nt, Pseudomonas putida KT2440
gccgcaaggccgcucccac

SEQ ID NO: 1602046 - RNA, 17 nt, Pseudomonas putida KT2440
gccgcgcgcccaucugc

SEQ ID NO: 1602047 - RNA, 22 nt, Pseudomonas putida KT2440
gccgcgcggcuugcucgcggcg

SEQ ID NO: 1602048 - RNA, 12 nt, Pseudomonas putida KT2440
gccgcgccgcgc

SEQ ID NO: 1602049 - RNA, 20 nt, Pseudomonas putida KT2440
gccgccugggucaaccccag

SEQ ID NO: 1602050 - RNA, 16 nt, Pseudomonas putida KT2440
gccgccugggucaggc

SEQ ID NO: 1602051 - RNA, 21 nt, Pseudomonas putida KT2440
gccgccuucuccagcucgcca

SEQ ID NO: 1602052 - RNA, 21 nt, Pseudomonas putida KT2440
gccgccgguguaccauccagu

SEQ ID NO: 1602053 - RNA, 15 nt, Pseudomonas putida KT2440
gccgccuugcggccc

SEQ ID NO: 1602054 - RNA, 21 nt, Pseudomonas putida KT2440
gccgccuuuaauuccggccgg

SEQ ID NO: 1602055 - RNA, 17 nt, Pseudomonas putida KT2440
gccgacucuucaccagc

SEQ ID NO: 1602056 - RNA, 18 nt, Pseudomonas putida KT2440
gccgagcauuacaggcag

SEQ ID NO: 1602057 - RNA, 17 nt, Pseudomonas putida KT2440
gccgagcaucuuccagc

SEQ ID NO: 1602058 - RNA, 21 nt, Pseudomonas putida KT2440
gccgagcaucuuccagccugc

SEQ ID NO: 1602059 - RNA, 13 nt, Pseudomonas putida KT2440
gccgagcgcgagc

SEQ ID NO: 1602060 - RNA, 18 nt, Pseudomonas putida KT2440
gccgagcgagugaccuug

SEQ ID NO: 1602061 - RNA, 19 nt, Pseudomonas putida KT2440
gccgagcgagugaccuugg

SEQ ID NO: 1602062 - RNA, 22 nt, Pseudomonas putida KT2440
gccgagccgauaugcggggucg

SEQ ID NO: 1602063 - RNA, 21 nt, Pseudomonas putida KT2440
gccgacuggcgcaccagcggc

SEQ ID NO: 1602064 - RNA, 12 nt, Pseudomonas putida KT2440
gccgagaaaugg

SEQ ID NO: 1602065 - RNA, 17 nt, Pseudomonas putida KT2440
gccgagaaauggcagug

SEQ ID NO: 1602066 - RNA, 20 nt, Pseudomonas putida KT2440
gccgauaaagcgucgcccgc

SEQ ID NO: 1602067 - RNA, 20 nt, Pseudomonas putida KT2440
gccgauaaagguugcccggc

SEQ ID NO: 1602068 - RNA, 18 nt, Pseudomonas putida KT2440
gccgaggucggcucgucg

SEQ ID NO: 1602069 - RNA, 22 nt, Pseudomonas putida KT2440
gccgagggguguaacccggguu

SEQ ID NO: 1602070 - RNA, 17 nt, Pseudomonas putida KT2440
gccgaggccggguuuuu

SEQ ID NO: 1602071 - RNA, 17 nt, Pseudomonas putida KT2440
gccgaucgaagcagcag

SEQ ID NO: 1602072 - RNA, 18 nt, Pseudomonas putida KT2440
gccgaucgaagcagcagc

SEQ ID NO: 1602073 - RNA, 17 nt, Pseudomonas putida KT2440
gccgaucagcuggguga

SEQ ID NO: 1602074 - RNA, 13 nt, Pseudomonas putida KT2440
gccgaucaggaag

SEQ ID NO: 1602075 - RNA, 21 nt, Pseudomonas putida KT2440
gccgaucaggaagccccgcgc

SEQ ID NO: 1602076 - RNA, 13 nt, Pseudomonas putida KT2440
gccgaucagcgag

SEQ ID NO: 1602077 - RNA, 14 nt, Pseudomonas putida KT2440
gccgaucagcgagu

SEQ ID NO: 1602078 - RNA, 14 nt, Pseudomonas putida KT2440
gccgcaaagcggcc

SEQ ID NO: 1602079 - RNA, 17 nt, Pseudomonas putida KT2440
gccgcaaagcggccccu

SEQ ID NO: 1602080 - RNA, 16 nt, Pseudomonas putida KT2440
gccgcaaagcggcccu

SEQ ID NO: 1602081 - RNA, 14 nt, Pseudomonas putida KT2440
gccgcaacgcggcc

SEQ ID NO: 1602082 - RNA, 15 nt, Pseudomonas putida KT2440
gccgcaacgcggccc

SEQ ID NO: 1602083 - RNA, 16 nt, Pseudomonas putida KT2440
gccgcaacgcggcccu

SEQ ID NO: 1602084 - RNA, 16 nt, Pseudomonas putida KT2440
gccgcaaccgccgcgc

SEQ ID NO: 1602085 - RNA, 14 nt, Pseudomonas putida KT2440
gccgauugccuggg

SEQ ID NO: 1602086 - RNA, 12 nt, Pseudomonas putida KT2440
gccgauugcugc

SEQ ID NO: 1602087 - RNA, 18 nt, Pseudomonas putida KT2440
gccgaaccagcagaaccc

SEQ ID NO: 1602088 - RNA, 21 nt, Pseudomonas putida KT2440
gccgaaccccaccagcacugc

SEQ ID NO: 1602089 - RNA, 13 nt, Pseudomonas putida KT2440
gccgaaaggugca

SEQ ID NO: 1602090 - RNA, 19 nt, Pseudomonas putida KT2440
gccgaacaccgccagcccg

SEQ ID NO: 1602091 - RNA, 15 nt, Pseudomonas putida KT2440
gccgaaaccagcccc

SEQ ID NO: 1602092 - RNA, 16 nt, Pseudomonas putida KT2440
gccgaaaccgcccggg

SEQ ID NO: 1602093 - RNA, 16 nt, Pseudomonas putida KT2440
gcccuuucacggcggu

SEQ ID NO: 1602094 - RNA, 16 nt, Pseudomonas putida KT2440
gcccuuucgcgggaga

SEQ ID NO: 1602095 - RNA, 22 nt, Pseudomonas putida KT2440
gcccuuucgcgggugaacccga

SEQ ID NO: 1602096 - RNA, 22 nt, Pseudomonas putida KT2440
gcccuuucgcgggugaacccgc

SEQ ID NO: 1602097 - RNA, 18 nt, Pseudomonas putida KT2440
gcccuuuguucauggugg

SEQ ID NO: 1602098 - RNA, 21 nt, Pseudomonas putida KT2440
gcccuuugguacugcgccggc

SEQ ID NO: 1602099 - RNA, 23 nt, Pseudomonas putida KT2440
gcccuuugguacugcgccggcca

SEQ ID NO: 1602100 - RNA, 17 nt, Pseudomonas putida KT2440
gcccuuuuucaccaggc

SEQ ID NO: 1602101 - RNA, 17 nt, Pseudomonas putida KT2440
gcccuucgcgggcacgc

SEQ ID NO: 1602102 - RNA, 15 nt, Pseudomonas putida KT2440
gcccuucgcggguga

SEQ ID NO: 1602103 - RNA, 14 nt, Pseudomonas putida KT2440
gcccuuccaccaca

SEQ ID NO: 1602104 - RNA, 22 nt, Pseudomonas putida KT2440
gcccuugaacagaccccagucg

SEQ ID NO: 1602105 - RNA, 16 nt, Pseudomonas putida KT2440
gcccuucuccgccuac

SEQ ID NO: 1602106 - RNA, 15 nt, Pseudomonas putida KT2440
gcccuucugcugcuc

SEQ ID NO: 1602107 - RNA, 15 nt, Pseudomonas putida KT2440
gcccuucacgcucau

SEQ ID NO: 1602108 - RNA, 20 nt, Pseudomonas putida KT2440
gcccuucagcguuuuauaaa

SEQ ID NO: 1602109 - RNA, 15 nt, Pseudomonas putida KT2440
gcccuucaggcccca

SEQ ID NO: 1602110 - RNA, 21 nt, Pseudomonas putida KT2440
gcccuuaaggucaaucaggga

SEQ ID NO: 1602111 - RNA, 13 nt, Pseudomonas putida KT2440
gcccuugcucggc

SEQ ID NO: 1602112 - RNA, 17 nt, Pseudomonas putida KT2440
gcccuugcucggccagc

SEQ ID NO: 1602113 - RNA, 18 nt, Pseudomonas putida KT2440
gcccuugcucggccagcc

SEQ ID NO: 1602114 - RNA, 15 nt, Pseudomonas putida KT2440
gcccuugcugcagca

SEQ ID NO: 1602115 - RNA, 19 nt, Pseudomonas putida KT2440
gcccuugcugcagcaggcu

SEQ ID NO: 1602116 - RNA, 17 nt, Pseudomonas putida KT2440
gcccuugcucaaugucu

SEQ ID NO: 1602117 - RNA, 18 nt, Pseudomonas putida KT2440
gcccuugcggaccaccug

SEQ ID NO: 1602118 - RNA, 15 nt, Pseudomonas putida KT2440
gcccuugucagccgc

SEQ ID NO: 1602119 - RNA, 15 nt, Pseudomonas putida KT2440
gccgaagccaugagc

SEQ ID NO: 1602120 - RNA, 19 nt, Pseudomonas putida KT2440
gccgaagccaugagcgagc

SEQ ID NO: 1602121 - RNA, 21 nt, Pseudomonas putida KT2440
gccgaacucgauucgccgggc

SEQ ID NO: 1602122 - RNA, 22 nt, Pseudomonas putida KT2440
gccgaacgggccaccaaaggcc

SEQ ID NO: 1602123 - RNA, 21 nt, Pseudomonas putida KT2440
gccgaacgcaagaaggcugcc

SEQ ID NO: 1602124 - RNA, 17 nt, Pseudomonas putida KT2440
gccgacccgggccagcc

SEQ ID NO: 1602125 - RNA, 18 nt, Pseudomonas putida KT2440
gccgacccgggccagcca

SEQ ID NO: 1602126 - RNA, 17 nt, Pseudomonas putida KT2440
gccgaccaagcgcccca

SEQ ID NO: 1602127 - RNA, 19 nt, Pseudomonas putida KT2440
gccgacagccaccgcgagc

SEQ ID NO: 1602128 - RNA, 22 nt, Pseudomonas putida KT2440
gccgacaguguugccggcgagc

SEQ ID NO: 1602129 - RNA, 17 nt, Pseudomonas putida KT2440
gccgacaucgaagcagu

SEQ ID NO: 1602130 - RNA, 16 nt, Pseudomonas putida KT2440
gcccuguggcuguggu

SEQ ID NO: 1602131 - RNA, 17 nt, Pseudomonas putida KT2440
gcccuguggcugugguu

SEQ ID NO: 1602132 - RNA, 17 nt, Pseudomonas putida KT2440
gcccuguacauccagcu

SEQ ID NO: 1602133 - RNA, 16 nt, Pseudomonas putida KT2440
gcccuggcccgccgcc

SEQ ID NO: 1602134 - RNA, 18 nt, Pseudomonas putida KT2440
gcccuggcccgccgccac

SEQ ID NO: 1602135 - RNA, 14 nt, Pseudomonas putida KT2440
gcccugaucccggc

SEQ ID NO: 1602136 - RNA, 18 nt, Pseudomonas putida KT2440
gcccugaucgccuccagg

SEQ ID NO: 1602137 - RNA, 19 nt, Pseudomonas putida KT2440
gcccugaucgccuccaggc

SEQ ID NO: 1602138 - RNA, 19 nt, Pseudomonas putida KT2440
gcccugcuugcggaacagg

SEQ ID NO: 1602139 - RNA, 21 nt, Pseudomonas putida KT2440
gcccugcagcuucccggccug

SEQ ID NO: 1602140 - RNA, 23 nt, Pseudomonas putida KT2440
gcccgugacuaguggccacuucg

SEQ ID NO: 1602141 - RNA, 15 nt, Pseudomonas putida KT2440
gcccgugccauccac

SEQ ID NO: 1602142 - RNA, 16 nt, Pseudomonas putida KT2440
gcccgugccucgcgca

SEQ ID NO: 1602143 - RNA, 15 nt, Pseudomonas putida KT2440
gcccgugccgcauca

SEQ ID NO: 1602144 - RNA, 17 nt, Pseudomonas putida KT2440
gcccgugccgcaucagc

SEQ ID NO: 1602145 - RNA, 18 nt, Pseudomonas putida KT2440
gcccucggauccaauguu

SEQ ID NO: 1602146 - RNA, 18 nt, Pseudomonas putida KT2440
gcccucggccaccuggcc

SEQ ID NO: 1602147 - RNA, 18 nt, Pseudomonas putida KT2440
gcccucgacaaucgccag

SEQ ID NO: 1602148 - RNA, 19 nt, Pseudomonas putida KT2440
gcccucgacaaucgccagg

SEQ ID NO: 1602149 - RNA, 20 nt, Pseudomonas putida KT2440
gcccucgacaaucgccaggu

SEQ ID NO: 1602150 - RNA, 18 nt, Pseudomonas putida KT2440
gcccucacucaccgcaca

SEQ ID NO: 1602151 - RNA, 15 nt, Pseudomonas putida KT2440
gcccucaacccucgc

SEQ ID NO: 1602152 - RNA, 13 nt, Pseudomonas putida KT2440
gcccggcauccgc

SEQ ID NO: 1602153 - RNA, 21 nt, Pseudomonas putida KT2440
gcccggcauccgccucauccu

SEQ ID NO: 1602154 - RNA, 15 nt, Pseudomonas putida KT2440
gcccggcauccuugg

SEQ ID NO: 1602155 - RNA, 20 nt, Pseudomonas putida KT2440
gcccggccacgucgguggcg

SEQ ID NO: 1602156 - RNA, 15 nt, Pseudomonas putida KT2440
gcccggccagcagga

SEQ ID NO: 1602157 - RNA, 17 nt, Pseudomonas putida KT2440
gcccggccagcaggacg

SEQ ID NO: 1602158 - RNA, 22 nt, Pseudomonas putida KT2440
gcccggcagguugcuggccuug

SEQ ID NO: 1602159 - RNA, 22 nt, Pseudomonas putida KT2440
gcccggcgccaaacgccagggc

SEQ ID NO: 1602160 - RNA, 22 nt, Pseudomonas putida KT2440
gcccgggaagugguuggcagug

SEQ ID NO: 1602161 - RNA, 17 nt, Pseudomonas putida KT2440
gcccggcuggauggcgc

SEQ ID NO: 1602162 - RNA, 14 nt, Pseudomonas putida KT2440
gcccggcuggccac

SEQ ID NO: 1602163 - RNA, 15 nt, Pseudomonas putida KT2440
gcccggcugaaaccg

SEQ ID NO: 1602164 - RNA, 14 nt, Pseudomonas putida KT2440
gcccggcuccgcgc

SEQ ID NO: 1602165 - RNA, 15 nt, Pseudomonas putida KT2440
gcccggucauacagc

SEQ ID NO: 1602166 - RNA, 20 nt, Pseudomonas putida KT2440
gcccgggcacgggccagcgc

SEQ ID NO: 1602167 - RNA, 14 nt, Pseudomonas putida KT2440
gcccggucccgcug

SEQ ID NO: 1602168 - RNA, 15 nt, Pseudomonas putida KT2440
gcccgguggcgcggc

SEQ ID NO: 1602169 - RNA, 16 nt, Pseudomonas putida KT2440
gcccgguggcgcggcc

SEQ ID NO: 1602170 - RNA, 17 nt, Pseudomonas putida KT2440
gcccgguggcgcggccg

SEQ ID NO: 1602171 - RNA, 10 nt, Pseudomonas putida KT2440
gcccggugcc

SEQ ID NO: 1602172 - RNA, 20 nt, Pseudomonas putida KT2440
gcccggugcccuugccgccc

SEQ ID NO: 1602173 - RNA, 14 nt, Pseudomonas putida KT2440
gcccggugccgcgc

SEQ ID NO: 1602174 - RNA, 21 nt, Pseudomonas putida KT2440
gcccguacagaccgccgggcc

SEQ ID NO: 1602175 - RNA, 15 nt, Pseudomonas putida KT2440
gcccgucugcgugca

SEQ ID NO: 1602176 - RNA, 15 nt, Pseudomonas putida KT2440
gcccgucuggcugca

SEQ ID NO: 1602177 - RNA, 15 nt, Pseudomonas putida KT2440
gcccgguuccagcgc

SEQ ID NO: 1602178 - RNA, 12 nt, Pseudomonas putida KT2440
gccccugcaucc

SEQ ID NO: 1602179 - RNA, 13 nt, Pseudomonas putida KT2440
gccccugcauccg

SEQ ID NO: 1602180 - RNA, 13 nt, Pseudomonas putida KT2440
gccccugccagca

SEQ ID NO: 1602181 - RNA, 16 nt, Pseudomonas putida KT2440
gccccugccagcacca

SEQ ID NO: 1602182 - RNA, 16 nt, Pseudomonas putida KT2440
gccccugcaacagggc

SEQ ID NO: 1602183 - RNA, 13 nt, Pseudomonas putida KT2440
gccccuuggcacg

SEQ ID NO: 1602184 - RNA, 14 nt, Pseudomonas putida KT2440
gccccuuuagcagg

SEQ ID NO: 1602185 - RNA, 23 nt, Pseudomonas putida KT2440
gccccuuuagcaggcaagcccgc

SEQ ID NO: 1602186 - RNA, 15 nt, Pseudomonas putida KT2440
gcccgaacgacacgg

SEQ ID NO: 1602187 - RNA, 18 nt, Pseudomonas putida KT2440
gcccgaaaccaugcaggu

SEQ ID NO: 1602188 - RNA, 18 nt, Pseudomonas putida KT2440
gcccgaaaccgccagcca

SEQ ID NO: 1602189 - RNA, 21 nt, Pseudomonas putida KT2440
gcccgaggaacggcuggcugc

SEQ ID NO: 1602190 - RNA, 21 nt, Pseudomonas putida KT2440
gcccgaagguguuugaccacc

SEQ ID NO: 1602191 - RNA, 21 nt, Pseudomonas putida KT2440
gcccgaucggguacuccacca

SEQ ID NO: 1602192 - RNA, 12 nt, Pseudomonas putida KT2440
gcccagcuggcu

SEQ ID NO: 1602193 - RNA, 14 nt, Pseudomonas putida KT2440
gcccagcuggcuca

SEQ ID NO: 1602194 - RNA, 16 nt, Pseudomonas putida KT2440
gccccggucagcagga

SEQ ID NO: 1602195 - RNA, 17 nt, Pseudomonas putida KT2440
gccccggucagcaggaa

SEQ ID NO: 1602196 - RNA, 20 nt, Pseudomonas putida KT2440
gccccgguccagcacacuga

SEQ ID NO: 1602197 - RNA, 13 nt, Pseudomonas putida KT2440
gcccaggaucacu

SEQ ID NO: 1602198 - RNA, 18 nt, Pseudomonas putida KT2440
gcccaggaucacuggccu

SEQ ID NO: 1602199 - RNA, 14 nt, Pseudomonas putida KT2440
gccccucaggcaca

SEQ ID NO: 1602200 - RNA, 15 nt, Pseudomonas putida KT2440
gccccuaccgccaac

SEQ ID NO: 1602201 - RNA, 17 nt, Pseudomonas putida KT2440
gccccucgaacagcgcc

SEQ ID NO: 1602202 - RNA, 23 nt, Pseudomonas putida KT2440
gccccucgaccacgcacagcugu

SEQ ID NO: 1602203 - RNA, 22 nt, Pseudomonas putida KT2440
gccccucgucacugacccucaa

SEQ ID NO: 1602204 - RNA, 16 nt, Pseudomonas putida KT2440
gcccagcuucuccagc

SEQ ID NO: 1602205 - RNA, 13 nt, Pseudomonas putida KT2440
gcccggauggggc

SEQ ID NO: 1602206 - RNA, 23 nt, Pseudomonas putida KT2440
gcccgcgguaaugcgcacggcuu

SEQ ID NO: 1602207 - RNA, 22 nt, Pseudomonas putida KT2440
gcccggcaaucgccaggcgcac

SEQ ID NO: 1602208 - RNA, 19 nt, Pseudomonas putida KT2440
gcccggcaauuucauccac

SEQ ID NO: 1602209 - RNA, 22 nt, Pseudomonas putida KT2440
gcccggcagaucgagcgccgcc

SEQ ID NO: 1602210 - RNA, 23 nt, Pseudomonas putida KT2440
gcccggcagaucgagcgccgccc

SEQ ID NO: 1602211 - RNA, 14 nt, Pseudomonas putida KT2440
gcccggcaccugcc

SEQ ID NO: 1602212 - RNA, 22 nt, Pseudomonas putida KT2440
gcccggcacgguugcgcccggc

SEQ ID NO: 1602213 - RNA, 17 nt, Pseudomonas putida KT2440
gcccgcuugcccgagga

SEQ ID NO: 1602214 - RNA, 13 nt, Pseudomonas putida KT2440
gcccgcuugcugu

SEQ ID NO: 1602215 - RNA, 17 nt, Pseudomonas putida KT2440
gcccgcuugcuguguua

SEQ ID NO: 1602216 - RNA, 22 nt, Pseudomonas putida KT2440
gcccgcuuuuggcugugcaccc

SEQ ID NO: 1602217 - RNA, 19 nt, Pseudomonas putida KT2440
gcccgcggaucgcgccuuc

SEQ ID NO: 1602218 - RNA, 16 nt, Pseudomonas putida KT2440
gcccgcggcucaccca

SEQ ID NO: 1602219 - RNA, 21 nt, Pseudomonas putida KT2440
gcccgcggcucacccaccagc

SEQ ID NO: 1602220 - RNA, 12 nt, Pseudomonas putida KT2440
gcccgcgcggcg

SEQ ID NO: 1602221 - RNA, 20 nt, Pseudomonas putida KT2440
gcccgcgcggcgcaucgcga

SEQ ID NO: 1602222 - RNA, 14 nt, Pseudomonas putida KT2440
gcccgcccagcugg

SEQ ID NO: 1602223 - RNA, 15 nt, Pseudomonas putida KT2440
gcccgcccagcuggc

SEQ ID NO: 1602224 - RNA, 21 nt, Pseudomonas putida KT2440
gcccgccccccaccuggcccu

SEQ ID NO: 1602225 - RNA, 21 nt, Pseudomonas putida KT2440
gcccgccccuuuagcaggcaa

SEQ ID NO: 1602226 - RNA, 17 nt, Pseudomonas putida KT2440
gcccgcccaccaccagc

SEQ ID NO: 1602227 - RNA, 13 nt, Pseudomonas putida KT2440
gcccgccaggcag

SEQ ID NO: 1602228 - RNA, 16 nt, Pseudomonas putida KT2440
gcccgcaacaaccugg

SEQ ID NO: 1602229 - RNA, 13 nt, Pseudomonas putida KT2440
gcccgcacagcac

SEQ ID NO: 1602230 - RNA, 21 nt, Pseudomonas putida KT2440
gcacugccuugcccugcagcu

SEQ ID NO: 1602231 - RNA, 17 nt, Pseudomonas putida KT2440
gcacugcgaagcccagu

SEQ ID NO: 1602232 - RNA, 12 nt, Pseudomonas putida KT2440
gcacuggccacc

SEQ ID NO: 1602233 - RNA, 14 nt, Pseudomonas putida KT2440
gcacuggccacccc

SEQ ID NO: 1602234 - RNA, 14 nt, Pseudomonas putida KT2440
gcacuggcaggccu

SEQ ID NO: 1602235 - RNA, 14 nt, Pseudomonas putida KT2440
gcacugcugccgcc

SEQ ID NO: 1602236 - RNA, 20 nt, Pseudomonas putida KT2440
gcacugcccaagccauccac

SEQ ID NO: 1602237 - RNA, 16 nt, Pseudomonas putida KT2440
gcacugccugcaugcg

SEQ ID NO: 1602238 - RNA, 15 nt, Pseudomonas putida KT2440
gcacugccuggccac

SEQ ID NO: 1602239 - RNA, 17 nt, Pseudomonas putida KT2440
gcacugccuggcucagg

SEQ ID NO: 1602240 - RNA, 16 nt, Pseudomonas putida KT2440
gcacugcacccucuuc

SEQ ID NO: 1602241 - RNA, 19 nt, Pseudomonas putida KT2440
gcacuccccaucagcagcu

SEQ ID NO: 1602242 - RNA, 20 nt, Pseudomonas putida KT2440
gcacucggguucgcagacgu

SEQ ID NO: 1602243 - RNA, 21 nt, Pseudomonas putida KT2440
gcacucgccgauaaagcgucg

SEQ ID NO: 1602244 - RNA, 23 nt, Pseudomonas putida KT2440
gcacugaccacuucaagcacgcc

SEQ ID NO: 1602245 - RNA, 17 nt, Pseudomonas putida KT2440
gcacugaacagcgccuu

SEQ ID NO: 1602246 - RNA, 18 nt, Pseudomonas putida KT2440
gcacugaauacaccagcu

SEQ ID NO: 1602247 - RNA, 21 nt, Pseudomonas putida KT2440
gcacugacaagauaguaggca

SEQ ID NO: 1602248 - RNA, 23 nt, Pseudomonas putida KT2440
gcacucucgcggugccuucaggc

SEQ ID NO: 1602249 - RNA, 17 nt, Pseudomonas putida KT2440
gcacucucgucaccuga

SEQ ID NO: 1602250 - RNA, 18 nt, Pseudomonas putida KT2440
gcacgugggucgggaaca

SEQ ID NO: 1602251 - RNA, 21 nt, Pseudomonas putida KT2440
gcacgugggucgggaacagcu

SEQ ID NO: 1602252 - RNA, 14 nt, Pseudomonas putida KT2440
gcacuacgccggcc

SEQ ID NO: 1602253 - RNA, 21 nt, Pseudomonas putida KT2440
gcacuaccaggcccaacagcg

SEQ ID NO: 1602254 - RNA, 13 nt, Pseudomonas putida KT2440
gcacuaagcgaaa

SEQ ID NO: 1602255 - RNA, 16 nt, Pseudomonas putida KT2440
gcacggcaaucaggcu

SEQ ID NO: 1602256 - RNA, 19 nt, Pseudomonas putida KT2440
gcacggcaccagcaccagc

SEQ ID NO: 1602257 - RNA, 17 nt, Pseudomonas putida KT2440
gcacggacgucgcgcug

SEQ ID NO: 1602258 - RNA, 21 nt, Pseudomonas putida KT2440
gcacggccuucccgccuggcg

SEQ ID NO: 1602259 - RNA, 23 nt, Pseudomonas putida KT2440
gcacggccuucccgccuggcgcc

SEQ ID NO: 1602260 - RNA, 21 nt, Pseudomonas putida KT2440
gcacggccuucuucgguggcg

SEQ ID NO: 1602261 - RNA, 23 nt, Pseudomonas putida KT2440
gcacggccuugucagcagcuuca

SEQ ID NO: 1602262 - RNA, 15 nt, Pseudomonas putida KT2440
gcacggccagccagc

SEQ ID NO: 1602263 - RNA, 18 nt, Pseudomonas putida KT2440
gcacggccagccagcagc

SEQ ID NO: 1602264 - RNA, 23 nt, Pseudomonas putida KT2440
gcacgcugcccaggugccaggcu

SEQ ID NO: 1602265 - RNA, 18 nt, Pseudomonas putida KT2440
gcacgcuuucacaaauag

SEQ ID NO: 1602266 - RNA, 18 nt, Pseudomonas putida KT2440
gcacgguugcgcccggcg

SEQ ID NO: 1602267 - RNA, 20 nt, Pseudomonas putida KT2440
gcacguccguuccugcaguu

SEQ ID NO: 1602268 - RNA, 22 nt, Pseudomonas putida KT2440
gcacggccuccaccaccugcag

SEQ ID NO: 1602269 - RNA, 14 nt, Pseudomonas putida KT2440
gcacggcugcccug

SEQ ID NO: 1602270 - RNA, 15 nt, Pseudomonas putida KT2440
gcacggcugcccugc

SEQ ID NO: 1602271 - RNA, 13 nt, Pseudomonas putida KT2440
gcacggcugucag

SEQ ID NO: 1602272 - RNA, 20 nt, Pseudomonas putida KT2440
gcacggcuucgcgcauuucg

SEQ ID NO: 1602273 - RNA, 21 nt, Pseudomonas putida KT2440
gcacggcgcugucggucagca

SEQ ID NO: 1602274 - RNA, 15 nt, Pseudomonas putida KT2440
gcacggcguagggcu

SEQ ID NO: 1602275 - RNA, 12 nt, Pseudomonas putida KT2440
gcacgggaucaa

SEQ ID NO: 1602276 - RNA, 22 nt, Pseudomonas putida KT2440
gcacgggccgauugccugggcg

SEQ ID NO: 1602277 - RNA, 20 nt, Pseudomonas putida KT2440
gcacccugcuauaucucugg

SEQ ID NO: 1602278 - RNA, 21 nt, Pseudomonas putida KT2440
gcaccgaucagcggcgccacc

SEQ ID NO: 1602279 - RNA, 14 nt, Pseudomonas putida KT2440
gcaccggcucugcc

SEQ ID NO: 1602280 - RNA, 22 nt, Pseudomonas putida KT2440
gcaccggccucuucgcgggcaa

SEQ ID NO: 1602281 - RNA, 19 nt, Pseudomonas putida KT2440
gcaccggcgaacagcaaug

SEQ ID NO: 1602282 - RNA, 16 nt, Pseudomonas putida KT2440
gcaccgccgcccacgc

SEQ ID NO: 1602283 - RNA, 21 nt, Pseudomonas putida KT2440
gcaccgccgcccacgccggca

SEQ ID NO: 1602284 - RNA, 16 nt, Pseudomonas putida KT2440
gcaccgccccggccag

SEQ ID NO: 1602285 - RNA, 18 nt, Pseudomonas putida KT2440
gcacccggcuaccaaucu

SEQ ID NO: 1602286 - RNA, 23 nt, Pseudomonas putida KT2440
gcacccggcuaccaaucuguacc

SEQ ID NO: 1602287 - RNA, 19 nt, Pseudomonas putida KT2440
gcacccggucgccgacggc

SEQ ID NO: 1602288 - RNA, 15 nt, Pseudomonas putida KT2440
gcacccgugccugcc

SEQ ID NO: 1602289 - RNA, 17 nt, Pseudomonas putida KT2440
gcacccgugccugccug

SEQ ID NO: 1602290 - RNA, 15 nt, Pseudomonas putida KT2440
gcacccgugcagggc

SEQ ID NO: 1602291 - RNA, 17 nt, Pseudomonas putida KT2440
gcacccgugcagggcug

SEQ ID NO: 1602292 - RNA, 12 nt, Pseudomonas putida KT2440
gcacccucacca

SEQ ID NO: 1602293 - RNA, 15 nt, Pseudomonas putida KT2440
gcacccucaccaacu

SEQ ID NO: 1602294 - RNA, 18 nt, Pseudomonas putida KT2440
gcaccaggcccagccggg

SEQ ID NO: 1602295 - RNA, 17 nt, Pseudomonas putida KT2440
gcaccagcuccuggccg

SEQ ID NO: 1602296 - RNA, 20 nt, Pseudomonas putida KT2440
gcaccagcgggcccagcagg

SEQ ID NO: 1602297 - RNA, 13 nt, Pseudomonas putida KT2440
gcaccacuguuca

SEQ ID NO: 1602298 - RNA, 19 nt, Pseudomonas putida KT2440
gcaccacguccggccagca

SEQ ID NO: 1602299 - RNA, 20 nt, Pseudomonas putida KT2440
gcaccacguccggccagcaa

SEQ ID NO: 1602300 - RNA, 17 nt, Pseudomonas putida KT2440
gcaccagauucaagccc

SEQ ID NO: 1602301 - RNA, 22 nt, Pseudomonas putida KT2440
gcaccgucgaggaaaagcagcu

SEQ ID NO: 1602302 - RNA, 17 nt, Pseudomonas putida KT2440
gcaccgguucgccgccg

SEQ ID NO: 1602303 - RNA, 16 nt, Pseudomonas putida KT2440
gcaccgggcgggugca

SEQ ID NO: 1602304 - RNA, 22 nt, Pseudomonas putida KT2440
gcaccugacgcaagcgcgccgc

SEQ ID NO: 1602305 - RNA, 18 nt, Pseudomonas putida KT2440
gcaccgugcaccagcacc

SEQ ID NO: 1602306 - RNA, 11 nt, Pseudomonas putida KT2440
gcaccuccaga

SEQ ID NO: 1602307 - RNA, 16 nt, Pseudomonas putida KT2440
gcaccugucccagcug

SEQ ID NO: 1602308 - RNA, 22 nt, Pseudomonas putida KT2440
gcaccugcagguaaugcgccgc

SEQ ID NO: 1602309 - RNA, 17 nt, Pseudomonas putida KT2440
gcaccugcagguacagc

SEQ ID NO: 1602310 - RNA, 14 nt, Pseudomonas putida KT2440
gcacgaucagcagc

SEQ ID NO: 1602311 - RNA, 15 nt, Pseudomonas putida KT2440
gcacgaucagcagca

SEQ ID NO: 1602312 - RNA, 16 nt, Pseudomonas putida KT2440
gcacgaucagcagcaa

SEQ ID NO: 1602313 - RNA, 14 nt, Pseudomonas putida KT2440
gcacgcccauuucc

SEQ ID NO: 1602314 - RNA, 19 nt, Pseudomonas putida KT2440
gcacgcccgcucccacagg

SEQ ID NO: 1602315 - RNA, 22 nt, Pseudomonas putida KT2440
gcacgcccgcucccacagggac

SEQ ID NO: 1602316 - RNA, 23 nt, Pseudomonas putida KT2440
gcacgcccggcaccugccgggca

SEQ ID NO: 1602317 - RNA, 16 nt, Pseudomonas putida KT2440
gcaauggcccuggaca

SEQ ID NO: 1602318 - RNA, 15 nt, Pseudomonas putida KT2440
gcaaugaaaaagccc

SEQ ID NO: 1602319 - RNA, 17 nt, Pseudomonas putida KT2440
gcaaucuucuugccggu

SEQ ID NO: 1602320 - RNA, 12 nt, Pseudomonas putida KT2440
gcaaucugcugg

SEQ ID NO: 1602321 - RNA, 16 nt, Pseudomonas putida KT2440
gcaaucugcagcagca

SEQ ID NO: 1602322 - RNA, 21 nt, Pseudomonas putida KT2440
gcaaucacgaacaccagcccc

SEQ ID NO: 1602323 - RNA, 14 nt, Pseudomonas putida KT2440
gcaaucaccgccag

SEQ ID NO: 1602324 - RNA, 21 nt, Pseudomonas putida KT2440
gcaaucgugaucauccccagc

SEQ ID NO: 1602325 - RNA, 22 nt, Pseudomonas putida KT2440
gcaaucgugaucauccccagca

SEQ ID NO: 1602326 - RNA, 24 nt, Pseudomonas putida KT2440
gcaaucgugaucauccccagcaug

SEQ ID NO: 1602327 - RNA, 19 nt, Pseudomonas putida KT2440
gcaaguagaaccacacaga

SEQ ID NO: 1602328 - RNA, 14 nt, Pseudomonas putida KT2440
gcaagguccuugua

SEQ ID NO: 1602329 - RNA, 14 nt, Pseudomonas putida KT2440
gcaaggucgccgcc

SEQ ID NO: 1602330 - RNA, 21 nt, Pseudomonas putida KT2440
gcaagguagccugcugacgca

SEQ ID NO: 1602331 - RNA, 23 nt, Pseudomonas putida KT2440
gcaagguagccugcugacgcagg

SEQ ID NO: 1602332 - RNA, 21 nt, Pseudomonas putida KT2440
gcaagguguuggucagggcac

SEQ ID NO: 1602333 - RNA, 20 nt, Pseudomonas putida KT2440
gcaaggugccaacaggcagc

SEQ ID NO: 1602334 - RNA, 20 nt, Pseudomonas putida KT2440
gcaagcgaugcacgccagca

SEQ ID NO: 1602335 - RNA, 15 nt, Pseudomonas putida KT2440
gcaagcgcaccugca

SEQ ID NO: 1602336 - RNA, 21 nt, Pseudomonas putida KT2440
gcaagcgcucaaaaugcuuuu

SEQ ID NO: 1602337 - RNA, 18 nt, Pseudomonas putida KT2440
gcaagggcgaaccaggug

SEQ ID NO: 1602338 - RNA, 19 nt, Pseudomonas putida KT2440
gcaagggcgaaccaggugc

SEQ ID NO: 1602339 - RNA, 17 nt, Pseudomonas putida KT2440
gcaagccgccgaccagg

SEQ ID NO: 1602340 - RNA, 15 nt, Pseudomonas putida KT2440
gcaagcccgcgaaga

SEQ ID NO: 1602341 - RNA, 22 nt, Pseudomonas putida KT2440
gcaagcccgcgaagaggccagg

SEQ ID NO: 1602342 - RNA, 17 nt, Pseudomonas putida KT2440
gcaagcccgcucccaca

SEQ ID NO: 1602343 - RNA, 15 nt, Pseudomonas putida KT2440
gcaagccuuugcgcc

SEQ ID NO: 1602344 - RNA, 21 nt, Pseudomonas putida KT2440
gcaagccuucgucgcuggcca

SEQ ID NO: 1602345 - RNA, 14 nt, Pseudomonas putida KT2440
gcaagccgugccug

SEQ ID NO: 1602346 - RNA, 21 nt, Pseudomonas putida KT2440
gcaagcaggugcgcaggcuuu

SEQ ID NO: 1602347 - RNA, 17 nt, Pseudomonas putida KT2440
gcaagcccauggcuggc

SEQ ID NO: 1602348 - RNA, 18 nt, Pseudomonas putida KT2440
gcaagcccauggcuggca

SEQ ID NO: 1602349 - RNA, 20 nt, Pseudomonas putida KT2440
gcaacuugcgggucagcagc

SEQ ID NO: 1602350 - RNA, 21 nt, Pseudomonas putida KT2440
gcaaauugcccggccagcgau

SEQ ID NO: 1602351 - RNA, 13 nt, Pseudomonas putida KT2440
gcaccacgccacc

SEQ ID NO: 1602352 - RNA, 18 nt, Pseudomonas putida KT2440
gcaccacgccaccaugcu

SEQ ID NO: 1602353 - RNA, 13 nt, Pseudomonas putida KT2440
gcaccacggcggc

SEQ ID NO: 1602354 - RNA, 14 nt, Pseudomonas putida KT2440
gcaccacgggcggc

SEQ ID NO: 1602355 - RNA, 18 nt, Pseudomonas putida KT2440
gcaccacggucggccugc

SEQ ID NO: 1602356 - RNA, 14 nt, Pseudomonas putida KT2440
gcaccacccccagc

SEQ ID NO: 1602357 - RNA, 22 nt, Pseudomonas putida KT2440
gcaccaccagggcgcgcuggcg

SEQ ID NO: 1602358 - RNA, 17 nt, Pseudomonas putida KT2440
gcaccacccaccagcag

SEQ ID NO: 1602359 - RNA, 15 nt, Pseudomonas putida KT2440
gcaccaccugaugca

SEQ ID NO: 1602360 - RNA, 23 nt, Pseudomonas putida KT2440
gcaccaccggacgcuugccaccc

SEQ ID NO: 1602361 - RNA, 22 nt, Pseudomonas putida KT2440
gcaccaaagaaaaucgacccac

SEQ ID NO: 1602362 - RNA, 23 nt, Pseudomonas putida KT2440
gcacaucacguuuggcagugcca

SEQ ID NO: 1602363 - RNA, 20 nt, Pseudomonas putida KT2440
gcaccaacacuuccagcauc

SEQ ID NO: 1602364 - RNA, 16 nt, Pseudomonas putida KT2440
gcaccaacugcacccg

SEQ ID NO: 1602365 - RNA, 21 nt, Pseudomonas putida KT2440
gcaccaacuggucggccuugc

SEQ ID NO: 1602366 - RNA, 18 nt, Pseudomonas putida KT2440
gcacacgucgccugggca

SEQ ID NO: 1602367 - RNA, 12 nt, Pseudomonas putida KT2440
gcacacuggcca

SEQ ID NO: 1602368 - RNA, 20 nt, Pseudomonas putida KT2440
gcacacugagcaccacauac

SEQ ID NO: 1602369 - RNA, 17 nt, Pseudomonas putida KT2440
gcacacugcccagcagc

SEQ ID NO: 1602370 - RNA, 18 nt, Pseudomonas putida KT2440
gcacacagcccaaagggc

SEQ ID NO: 1602371 - RNA, 21 nt, Pseudomonas putida KT2440
gcacauagcccugcucgucca

SEQ ID NO: 1602372 - RNA, 17 nt, Pseudomonas putida KT2440
gcacauagaccauuucg

SEQ ID NO: 1602373 - RNA, 15 nt, Pseudomonas putida KT2440
gcacagugcggcggc

SEQ ID NO: 1602374 - RNA, 14 nt, Pseudomonas putida KT2440
gcacagaacaauaa

SEQ ID NO: 1602375 - RNA, 21 nt, Pseudomonas putida KT2440
gcacagacaccgcaaaucacu

SEQ ID NO: 1602376 - RNA, 16 nt, Pseudomonas putida KT2440
gcacagauaaaccugc

SEQ ID NO: 1602377 - RNA, 17 nt, Pseudomonas putida KT2440
gcacagauaaaccugcc

SEQ ID NO: 1602378 - RNA, 14 nt, Pseudomonas putida KT2440
gcacaaggcugcgc

SEQ ID NO: 1602379 - RNA, 20 nt, Pseudomonas putida KT2440
gcacaaggcuguuccacagc

SEQ ID NO: 1602380 - RNA, 21 nt, Pseudomonas putida KT2440
gcacaaggcuguuccacagca

SEQ ID NO: 1602381 - RNA, 14 nt, Pseudomonas putida KT2440
gcacaagacugcug

SEQ ID NO: 1602382 - RNA, 18 nt, Pseudomonas putida KT2440
gcacaaggccgcucccac

SEQ ID NO: 1602383 - RNA, 23 nt, Pseudomonas putida KT2440
gcacaaucagcucgucagccacc

SEQ ID NO: 1602384 - RNA, 13 nt, Pseudomonas putida KT2440
gcaaugggcacaa

SEQ ID NO: 1602385 - RNA, 13 nt, Pseudomonas putida KT2440
gcaauguccagcc

SEQ ID NO: 1602386 - RNA, 15 nt, Pseudomonas putida KT2440
gcaauguccagcccg

SEQ ID NO: 1602387 - RNA, 22 nt, Pseudomonas putida KT2440
gcaauguucgcugccagcguuu

SEQ ID NO: 1602388 - RNA, 16 nt, Pseudomonas putida KT2440
gcaauugcgagguacc

SEQ ID NO: 1602389 - RNA, 16 nt, Pseudomonas putida KT2440
gcaauugcacccgcgg

SEQ ID NO: 1602390 - RNA, 14 nt, Pseudomonas putida KT2440
gcaauuggcuucca

SEQ ID NO: 1602391 - RNA, 14 nt, Pseudomonas putida KT2440
gcaauucgccggca

SEQ ID NO: 1602392 - RNA, 17 nt, Pseudomonas putida KT2440
gcaucccauucaucgau

SEQ ID NO: 1602393 - RNA, 13 nt, Pseudomonas putida KT2440
gcaucccccuccu

SEQ ID NO: 1602394 - RNA, 20 nt, Pseudomonas putida KT2440
gcaucccccuccuaagggga

SEQ ID NO: 1602395 - RNA, 14 nt, Pseudomonas putida KT2440
gcauccagcgccag

SEQ ID NO: 1602396 - RNA, 15 nt, Pseudomonas putida KT2440
gcauccagcgccaga

SEQ ID NO: 1602397 - RNA, 15 nt, Pseudomonas putida KT2440
gcauccagcuugcca

SEQ ID NO: 1602398 - RNA, 21 nt, Pseudomonas putida KT2440
gcauccaccucgucaugcagc

SEQ ID NO: 1602399 - RNA, 21 nt, Pseudomonas putida KT2440
gcauccagccauuccaggcua

SEQ ID NO: 1602400 - RNA, 18 nt, Pseudomonas putida KT2440
gcauccagcacugccugg

SEQ ID NO: 1602401 - RNA, 15 nt, Pseudomonas putida KT2440
gcauccaacgcugcc

SEQ ID NO: 1602402 - RNA, 18 nt, Pseudomonas putida KT2440
gcauccaacgcugccuug

SEQ ID NO: 1602403 - RNA, 19 nt, Pseudomonas putida KT2440
gcauccacaccagcggcgc

SEQ ID NO: 1602404 - RNA, 22 nt, Pseudomonas putida KT2440
gcauccacaccguacugcuuca

SEQ ID NO: 1602405 - RNA, 19 nt, Pseudomonas putida KT2440
gcauccacacgcugcugcg

SEQ ID NO: 1602406 - RNA, 15 nt, Pseudomonas putida KT2440
gcauccacaggcgcc

SEQ ID NO: 1602407 - RNA, 15 nt, Pseudomonas putida KT2440
gcauccgccucaucc

SEQ ID NO: 1602408 - RNA, 22 nt, Pseudomonas putida KT2440
gcaucgacgcuuccuuguccgc

SEQ ID NO: 1602409 - RNA, 14 nt, Pseudomonas putida KT2440
gcauccucaagcug

SEQ ID NO: 1602410 - RNA, 20 nt, Pseudomonas putida KT2440
gcauccuugggguacaccag

SEQ ID NO: 1602411 - RNA, 16 nt, Pseudomonas putida KT2440
gcaucgaacgccgccu

SEQ ID NO: 1602412 - RNA, 15 nt, Pseudomonas putida KT2440
gcaucgaagcaggcc

SEQ ID NO: 1602413 - RNA, 18 nt, Pseudomonas putida KT2440
gcaucgaagcgcaccagu

SEQ ID NO: 1602414 - RNA, 15 nt, Pseudomonas putida KT2440
gcauccugcacugca

SEQ ID NO: 1602415 - RNA, 19 nt, Pseudomonas putida KT2440
gcauccugcacugcaacac

SEQ ID NO: 1602416 - RNA, 17 nt, Pseudomonas putida KT2440
gcauccuccgcccugcc

SEQ ID NO: 1602417 - RNA, 20 nt, Pseudomonas putida KT2440
gcauccuccgcccugcccuc

SEQ ID NO: 1602418 - RNA, 13 nt, Pseudomonas putida KT2440
gcauccucggugc

SEQ ID NO: 1602419 - RNA, 14 nt, Pseudomonas putida KT2440
gcauccggcagcuc

SEQ ID NO: 1602420 - RNA, 16 nt, Pseudomonas putida KT2440
gcaucagcacacccag

SEQ ID NO: 1602421 - RNA, 19 nt, Pseudomonas putida KT2440
gcaucagcacacccagcac

SEQ ID NO: 1602422 - RNA, 13 nt, Pseudomonas putida KT2440
gcaucacgcuggc

SEQ ID NO: 1602423 - RNA, 16 nt, Pseudomonas putida KT2440
gcaucagccggcuucc

SEQ ID NO: 1602424 - RNA, 22 nt, Pseudomonas putida KT2440
gcaucauccaccacccuggcau

SEQ ID NO: 1602425 - RNA, 20 nt, Pseudomonas putida KT2440
gcaucaggcugcgcccgcac

SEQ ID NO: 1602426 - RNA, 15 nt, Pseudomonas putida KT2440
gcaucagugcaggug

SEQ ID NO: 1602427 - RNA, 18 nt, Pseudomonas putida KT2440
gcaucagugcaggugcac

SEQ ID NO: 1602428 - RNA, 17 nt, Pseudomonas putida KT2440
gcaucauccugcucgac

SEQ ID NO: 1602429 - RNA, 17 nt, Pseudomonas putida KT2440
gcaucauccugcuggcc

SEQ ID NO: 1602430 - RNA, 22 nt, Pseudomonas putida KT2440
gcaucaugauggucacgcggcc

SEQ ID NO: 1602431 - RNA, 14 nt, Pseudomonas putida KT2440
gcauaugccccagg

SEQ ID NO: 1602432 - RNA, 13 nt, Pseudomonas putida KT2440
gcaucacccgccc

SEQ ID NO: 1602433 - RNA, 20 nt, Pseudomonas putida KT2440
gcaucaaucgcuccaggcgg

SEQ ID NO: 1602434 - RNA, 18 nt, Pseudomonas putida KT2440
gcaucaacaggucgccgc

SEQ ID NO: 1602435 - RNA, 22 nt, Pseudomonas putida KT2440
gcagguuggugcaauugcaguu

SEQ ID NO: 1602436 - RNA, 18 nt, Pseudomonas putida KT2440
gcagguuguccaccgcgc

SEQ ID NO: 1602437 - RNA, 14 nt, Pseudomonas putida KT2440
gcagguugcuggug

SEQ ID NO: 1602438 - RNA, 17 nt, Pseudomonas putida KT2440
gcagguuggacagcgcc

SEQ ID NO: 1602439 - RNA, 18 nt, Pseudomonas putida KT2440
gcagguuggacagcgccc

SEQ ID NO: 1602440 - RNA, 20 nt, Pseudomonas putida KT2440
gcagguuggacagcgcccgg

SEQ ID NO: 1602441 - RNA, 22 nt, Pseudomonas putida KT2440
gcagguuggacagcgcccggcg

SEQ ID NO: 1602442 - RNA, 18 nt, Pseudomonas putida KT2440
gcagguugauccagcccu

SEQ ID NO: 1602443 - RNA, 18 nt, Pseudomonas putida KT2440
gcaggugcggcgcgacuc

SEQ ID NO: 1602444 - RNA, 15 nt, Pseudomonas putida KT2440
gcaggugcagggugc

SEQ ID NO: 1602445 - RNA, 14 nt, Pseudomonas putida KT2440
gcaggucuucucgg

SEQ ID NO: 1602446 - RNA, 22 nt, Pseudomonas putida KT2440
gcaggugcgcacgcugcccagg

SEQ ID NO: 1602447 - RNA, 18 nt, Pseudomonas putida KT2440
gcaggugcccaagcggca

SEQ ID NO: 1602448 - RNA, 17 nt, Pseudomonas putida KT2440
gcaggucggcacgcacc

SEQ ID NO: 1602449 - RNA, 13 nt, Pseudomonas putida KT2440
gcagggcaccagu

SEQ ID NO: 1602450 - RNA, 21 nt, Pseudomonas putida KT2440
gcagggcacacuucgccgugc

SEQ ID NO: 1602451 - RNA, 19 nt, Pseudomonas putida KT2440
gcagggaagguggccggca

SEQ ID NO: 1602452 - RNA, 18 nt, Pseudomonas putida KT2440
gcaggcuaucgaggggca

SEQ ID NO: 1602453 - RNA, 18 nt, Pseudomonas putida KT2440
gcagguugcuggccuugg

SEQ ID NO: 1602454 - RNA, 17 nt, Pseudomonas putida KT2440
gcagguuuuccagcccg

SEQ ID NO: 1602455 - RNA, 22 nt, Pseudomonas putida KT2440
gcagucccguuggcccgccagu

SEQ ID NO: 1602456 - RNA, 23 nt, Pseudomonas putida KT2440
gcagucgaaggggaucagcacgc

SEQ ID NO: 1602457 - RNA, 16 nt, Pseudomonas putida KT2440
gcagucgaccgggcag

SEQ ID NO: 1602458 - RNA, 13 nt, Pseudomonas putida KT2440
gcagucccaucug

SEQ ID NO: 1602459 - RNA, 22 nt, Pseudomonas putida KT2440
gcagucagggucucggccaauc

SEQ ID NO: 1602460 - RNA, 13 nt, Pseudomonas putida KT2440
gcagucaccacac

SEQ ID NO: 1602461 - RNA, 21 nt, Pseudomonas putida KT2440
gcagucaccacacggcagccc

SEQ ID NO: 1602462 - RNA, 18 nt, Pseudomonas putida KT2440
gcaguggcaagccgagca

SEQ ID NO: 1602463 - RNA, 16 nt, Pseudomonas putida KT2440
gcagugcggcaaccac

SEQ ID NO: 1602464 - RNA, 20 nt, Pseudomonas putida KT2440
gcagugccuggaugcgggcu

SEQ ID NO: 1602465 - RNA, 20 nt, Pseudomonas putida KT2440
gcagugccucgaccaccauc

SEQ ID NO: 1602466 - RNA, 21 nt, Pseudomonas putida KT2440
gcagugcccccgucagcggca

SEQ ID NO: 1602467 - RNA, 14 nt, Pseudomonas putida KT2440
gcagugccguggca

SEQ ID NO: 1602468 - RNA, 19 nt, Pseudomonas putida KT2440
gcagugcaucgaagcaggc

SEQ ID NO: 1602469 - RNA, 22 nt, Pseudomonas putida KT2440
gcagugcaucgaagcaggccgg

SEQ ID NO: 1602470 - RNA, 16 nt, Pseudomonas putida KT2440
gcagugcacgcgggcg

SEQ ID NO: 1602471 - RNA, 15 nt, Pseudomonas putida KT2440
gcagugccagcaaca

SEQ ID NO: 1602472 - RNA, 16 nt, Pseudomonas putida KT2440
gcagcuugcgcgccuu

SEQ ID NO: 1602473 - RNA, 13 nt, Pseudomonas putida KT2440
gcagcuugaacaa

SEQ ID NO: 1602474 - RNA, 22 nt, Pseudomonas putida KT2440
gcagcuugaggucgccaggggu

SEQ ID NO: 1602475 - RNA, 14 nt, Pseudomonas putida KT2440
gcaggaaacaccag

SEQ ID NO: 1602476 - RNA, 21 nt, Pseudomonas putida KT2440
gcaggccagcgcacagcugcc

SEQ ID NO: 1602477 - RNA, 19 nt, Pseudomonas putida KT2440
gcaggccaccggcagcacc

SEQ ID NO: 1602478 - RNA, 21 nt, Pseudomonas putida KT2440
gcaggccauauugcugagcca

SEQ ID NO: 1602479 - RNA, 17 nt, Pseudomonas putida KT2440
gcaggcauaucaagaau

SEQ ID NO: 1602480 - RNA, 13 nt, Pseudomonas putida KT2440
gcaggcaguaggc

SEQ ID NO: 1602481 - RNA, 17 nt, Pseudomonas putida KT2440
gcaggcaguaggccacc

SEQ ID NO: 1602482 - RNA, 18 nt, Pseudomonas putida KT2440
gcaggcaguaggccaccg

SEQ ID NO: 1602483 - RNA, 15 nt, Pseudomonas putida KT2440
gcaggcaagcccgcu

SEQ ID NO: 1602484 - RNA, 22 nt, Pseudomonas putida KT2440
gcaggcaauaaaaaaccccggc

SEQ ID NO: 1602485 - RNA, 23 nt, Pseudomonas putida KT2440
gcaggcccgccccuuuagcaggc

SEQ ID NO: 1602486 - RNA, 20 nt, Pseudomonas putida KT2440
gcaggccccugcaacagggc

SEQ ID NO: 1602487 - RNA, 16 nt, Pseudomonas putida KT2440
gcaggcccagguaacu

SEQ ID NO: 1602488 - RNA, 18 nt, Pseudomonas putida KT2440
gcaggcgguccagcaagc

SEQ ID NO: 1602489 - RNA, 16 nt, Pseudomonas putida KT2440
gcaggcgcacauccac

SEQ ID NO: 1602490 - RNA, 23 nt, Pseudomonas putida KT2440
gcagcggggauucaacagcgcga

SEQ ID NO: 1602491 - RNA, 17 nt, Pseudomonas putida KT2440
gcagcgggcucgcccac

SEQ ID NO: 1602492 - RNA, 21 nt, Pseudomonas putida KT2440
gcagcgggcucgcccacacgg

SEQ ID NO: 1602493 - RNA, 14 nt, Pseudomonas putida KT2440
gcagcgggcugccc

SEQ ID NO: 1602494 - RNA, 17 nt, Pseudomonas putida KT2440
gcagcgucggcagagcg

SEQ ID NO: 1602495 - RNA, 20 nt, Pseudomonas putida KT2440
gcagcguaauagcuggugaa

SEQ ID NO: 1602496 - RNA, 16 nt, Pseudomonas putida KT2440
gcagcugcagugcugg

SEQ ID NO: 1602497 - RNA, 15 nt, Pseudomonas putida KT2440
gcagcgccugcagcg

SEQ ID NO: 1602498 - RNA, 23 nt, Pseudomonas putida KT2440
gcagcgcgugcugguccuccccu

SEQ ID NO: 1602499 - RNA, 15 nt, Pseudomonas putida KT2440
gcagcggcuggcgcu

SEQ ID NO: 1602500 - RNA, 21 nt, Pseudomonas putida KT2440
gcagcgggagucgaaccugcc

SEQ ID NO: 1602501 - RNA, 20 nt, Pseudomonas putida KT2440
gcagcggcgucaccuuccug

SEQ ID NO: 1602502 - RNA, 18 nt, Pseudomonas putida KT2440
gcagcgcuaugccuugga

SEQ ID NO: 1602503 - RNA, 14 nt, Pseudomonas putida KT2440
gcagcgcuccgcca

SEQ ID NO: 1602504 - RNA, 22 nt, Pseudomonas putida KT2440
gcagcgcuccgccaaaccccag

SEQ ID NO: 1602505 - RNA, 14 nt, Pseudomonas putida KT2440
gcagcgcucgcugc

SEQ ID NO: 1602506 - RNA, 13 nt, Pseudomonas putida KT2440
gcagcgcugcaag

SEQ ID NO: 1602507 - RNA, 16 nt, Pseudomonas putida KT2440
gcacugggugcacagg

SEQ ID NO: 1602508 - RNA, 23 nt, Pseudomonas putida KT2440
gcacugucgauggcggugcgcac

SEQ ID NO: 1602509 - RNA, 19 nt, Pseudomonas putida KT2440
gcacuguaggcaaacagcu

SEQ ID NO: 1602510 - RNA, 13 nt, Pseudomonas putida KT2440
gcacuguugcugg

SEQ ID NO: 1602511 - RNA, 16 nt, Pseudomonas putida KT2440
gcacuguugcuggcga

SEQ ID NO: 1602512 - RNA, 20 nt, Pseudomonas putida KT2440
gcacuguuguccaagggaga

SEQ ID NO: 1602513 - RNA, 23 nt, Pseudomonas putida KT2440
gcagcaacaguuucuugccuucc

SEQ ID NO: 1602514 - RNA, 20 nt, Pseudomonas putida KT2440
gcagcacaucacacagcggc

SEQ ID NO: 1602515 - RNA, 18 nt, Pseudomonas putida KT2440
gcagauuuuuuuggaguc

SEQ ID NO: 1602516 - RNA, 17 nt, Pseudomonas putida KT2440
gcagcagcagccccagc

SEQ ID NO: 1602517 - RNA, 14 nt, Pseudomonas putida KT2440
gcagcagccccagc

SEQ ID NO: 1602518 - RNA, 17 nt, Pseudomonas putida KT2440
gcagcagugccagcaac

SEQ ID NO: 1602519 - RNA, 19 nt, Pseudomonas putida KT2440
gcagcagugccagcaacaa

SEQ ID NO: 1602520 - RNA, 21 nt, Pseudomonas putida KT2440
gcagcaccacgaagcgcggca

SEQ ID NO: 1602521 - RNA, 18 nt, Pseudomonas putida KT2440
gcagcaccgccaccaugc

SEQ ID NO: 1602522 - RNA, 13 nt, Pseudomonas putida KT2440
gcagcacccuucc

SEQ ID NO: 1602523 - RNA, 22 nt, Pseudomonas putida KT2440
gcagcaccgcugccagcugcgc

SEQ ID NO: 1602524 - RNA, 22 nt, Pseudomonas putida KT2440
gcagcagcccuucgcucaaccg

SEQ ID NO: 1602525 - RNA, 15 nt, Pseudomonas putida KT2440
gcagcagcaggcccg

SEQ ID NO: 1602526 - RNA, 15 nt, Pseudomonas putida KT2440
gcagccggcaccgcc

SEQ ID NO: 1602527 - RNA, 13 nt, Pseudomonas putida KT2440
gcagcgcaaaaaa

SEQ ID NO: 1602528 - RNA, 13 nt, Pseudomonas putida KT2440
gcagcgcaaucac

SEQ ID NO: 1602529 - RNA, 23 nt, Pseudomonas putida KT2440
gcagcgcacuuccacacccagcg

SEQ ID NO: 1602530 - RNA, 20 nt, Pseudomonas putida KT2440
gcagcgcaccgugcaccagc

SEQ ID NO: 1602531 - RNA, 23 nt, Pseudomonas putida KT2440
gcagcgcaccgugcaccagcacc

SEQ ID NO: 1602532 - RNA, 13 nt, Pseudomonas putida KT2440
gcagcgccgccag

SEQ ID NO: 1602533 - RNA, 14 nt, Pseudomonas putida KT2440
gcagcgccgccagg

SEQ ID NO: 1602534 - RNA, 16 nt, Pseudomonas putida KT2440
gcagcgccgccaggcc

SEQ ID NO: 1602535 - RNA, 16 nt, Pseudomonas putida KT2440
gcagcgcauccaccuc

SEQ ID NO: 1602536 - RNA, 15 nt, Pseudomonas putida KT2440
gcagcgcauggcuca

SEQ ID NO: 1602537 - RNA, 13 nt, Pseudomonas putida KT2440
gcagcaucuuccu

SEQ ID NO: 1602538 - RNA, 14 nt, Pseudomonas putida KT2440
gcagcaugaacagc

SEQ ID NO: 1602539 - RNA, 19 nt, Pseudomonas putida KT2440
gcagccaacgccccaggcc

SEQ ID NO: 1602540 - RNA, 13 nt, Pseudomonas putida KT2440
gcagccaacuggu

SEQ ID NO: 1602541 - RNA, 19 nt, Pseudomonas putida KT2440
gcagccaccacgguggcug

SEQ ID NO: 1602542 - RNA, 22 nt, Pseudomonas putida KT2440
gcagcccuucgccggcacgccc

SEQ ID NO: 1602543 - RNA, 18 nt, Pseudomonas putida KT2440
gcagcccuucgcgggcac

SEQ ID NO: 1602544 - RNA, 22 nt, Pseudomonas putida KT2440
gcagccccggcuuucucaagcc

SEQ ID NO: 1602545 - RNA, 14 nt, Pseudomonas putida KT2440
gcagccccugcaca

SEQ ID NO: 1602546 - RNA, 17 nt, Pseudomonas putida KT2440
gcaaaggccucuucagg

SEQ ID NO: 1602547 - RNA, 16 nt, Pseudomonas putida KT2440
gcaaagcggccccagg

SEQ ID NO: 1602548 - RNA, 16 nt, Pseudomonas putida KT2440
gcaaagcggcccccag

SEQ ID NO: 1602549 - RNA, 13 nt, Pseudomonas putida KT2440
gcaaagcagcccc

SEQ ID NO: 1602550 - RNA, 14 nt, Pseudomonas putida KT2440
gcaaagcagcccca

SEQ ID NO: 1602551 - RNA, 16 nt, Pseudomonas putida KT2440
gcaaagcagccccagg

SEQ ID NO: 1602552 - RNA, 14 nt, Pseudomonas putida KT2440
gcaaagcagccccc

SEQ ID NO: 1602553 - RNA, 16 nt, Pseudomonas putida KT2440
gcaaagcagcccccaa

SEQ ID NO: 1602554 - RNA, 13 nt, Pseudomonas putida KT2440
gcaaagcccugcc

SEQ ID NO: 1602555 - RNA, 19 nt, Pseudomonas putida KT2440
gcaaaguuauaagccccau

SEQ ID NO: 1602556 - RNA, 23 nt, Pseudomonas putida KT2440
gcaaauaaucagaauuugccccu

SEQ ID NO: 1602557 - RNA, 22 nt, Pseudomonas putida KT2440
gcaaaggcuugucaugccuugg

SEQ ID NO: 1602558 - RNA, 23 nt, Pseudomonas putida KT2440
gcaaaugcaccccugccaccagu

SEQ ID NO: 1602559 - RNA, 18 nt, Pseudomonas putida KT2440
gcaaaucgccaaucaggu

SEQ ID NO: 1602560 - RNA, 14 nt, Pseudomonas putida KT2440
gcaaauaccccagg

SEQ ID NO: 1602561 - RNA, 15 nt, Pseudomonas putida KT2440
gcaaauccuccugcg

SEQ ID NO: 1602562 - RNA, 22 nt, Pseudomonas putida KT2440
gcaaauccuccugcgcaugcaa

SEQ ID NO: 1602563 - RNA, 17 nt, Pseudomonas putida KT2440
gcaaacuucucgccuca

SEQ ID NO: 1602564 - RNA, 20 nt, Pseudomonas putida KT2440
gcaaagaacacuuccgggcu

SEQ ID NO: 1602565 - RNA, 18 nt, Pseudomonas putida KT2440
gcaaagaacagcgugcca

SEQ ID NO: 1602566 - RNA, 17 nt, Pseudomonas putida KT2440
gcaaagaaacaccaggc

SEQ ID NO: 1602567 - RNA, 16 nt, Pseudomonas putida KT2440
gcaaacaaaaagcacc

SEQ ID NO: 1602568 - RNA, 22 nt, Pseudomonas putida KT2440
gcaaacaccuugccccgcaggc

SEQ ID NO: 1602569 - RNA, 12 nt, Pseudomonas putida KT2440
gcaaacacccag

SEQ ID NO: 1602570 - RNA, 21 nt, Pseudomonas putida KT2440
gcaaacccgacaacagcugca

SEQ ID NO: 1602571 - RNA, 21 nt, Pseudomonas putida KT2440
gcaaacagccuaagguugcuc

SEQ ID NO: 1602572 - RNA, 22 nt, Pseudomonas putida KT2440
gcaaaaucgaccagggccuugg

SEQ ID NO: 1602573 - RNA, 12 nt, Pseudomonas putida KT2440
gauuuucacgcc

SEQ ID NO: 1602574 - RNA, 21 nt, Pseudomonas putida KT2440
gauuugccgucgcgcccaccg

SEQ ID NO: 1602575 - RNA, 14 nt, Pseudomonas putida KT2440
gauuggcaguccug

SEQ ID NO: 1602576 - RNA, 15 nt, Pseudomonas putida KT2440
gauuguggagcugaa

SEQ ID NO: 1602577 - RNA, 15 nt, Pseudomonas putida KT2440
gauuggaaaauguua

SEQ ID NO: 1602578 - RNA, 16 nt, Pseudomonas putida KT2440
gauugcgggcuuucug

SEQ ID NO: 1602579 - RNA, 23 nt, Pseudomonas putida KT2440
gauugccucaggccccaggccau

SEQ ID NO: 1602580 - RNA, 15 nt, Pseudomonas putida KT2440
gauugcugccgaccu

SEQ ID NO: 1602581 - RNA, 20 nt, Pseudomonas putida KT2440
gauugcuuauucuucuggcu

SEQ ID NO: 1602582 - RNA, 15 nt, Pseudomonas putida KT2440
gauugaucagcgccu

SEQ ID NO: 1602583 - RNA, 13 nt, Pseudomonas putida KT2440
gauucugccagcu

SEQ ID NO: 1602584 - RNA, 13 nt, Pseudomonas putida KT2440
gauugacccgacg

SEQ ID NO: 1602585 - RNA, 15 nt, Pseudomonas putida KT2440
gauuaucgagcuaca

SEQ ID NO: 1602586 - RNA, 18 nt, Pseudomonas putida KT2440
gauguccuugcuggccac

SEQ ID NO: 1602587 - RNA, 16 nt, Pseudomonas putida KT2440
gaugucgccguagcug

SEQ ID NO: 1602588 - RNA, 16 nt, Pseudomonas putida KT2440
gauggugcaggggggu

SEQ ID NO: 1602589 - RNA, 16 nt, Pseudomonas putida KT2440
gaugguugacagcgcu

SEQ ID NO: 1602590 - RNA, 20 nt, Pseudomonas putida KT2440
gaugguugacagcgcuucca

SEQ ID NO: 1602591 - RNA, 22 nt, Pseudomonas putida KT2440
gauguacgccaggugauuuccu

SEQ ID NO: 1602592 - RNA, 14 nt, Pseudomonas putida KT2440
gaugggcacuggcc

SEQ ID NO: 1602593 - RNA, 13 nt, Pseudomonas putida KT2440
gaugggcugcaaa

SEQ ID NO: 1602594 - RNA, 15 nt, Pseudomonas putida KT2440
gauggggcgugcaug

SEQ ID NO: 1602595 - RNA, 12 nt, Pseudomonas putida KT2440
gauggggggauu

SEQ ID NO: 1602596 - RNA, 23 nt, Pseudomonas putida KT2440
gaugguaacgggcaaaguccauc

SEQ ID NO: 1602597 - RNA, 23 nt, Pseudomonas putida KT2440
gauggcggaucagcgcguccagc

SEQ ID NO: 1602598 - RNA, 21 nt, Pseudomonas putida KT2440
gauggcauccacacgcugcug

SEQ ID NO: 1602599 - RNA, 15 nt, Pseudomonas putida KT2440
gaugcugcugcagug

SEQ ID NO: 1602600 - RNA, 12 nt, Pseudomonas putida KT2440
gaugcugugccg

SEQ ID NO: 1602601 - RNA, 16 nt, Pseudomonas putida KT2440
gaugcgguccgcccuu

SEQ ID NO: 1602602 - RNA, 15 nt, Pseudomonas putida KT2440
gaugcggugcagcac

SEQ ID NO: 1602603 - RNA, 20 nt, Pseudomonas putida KT2440
gaugccgccgcugccagcag

SEQ ID NO: 1602604 - RNA, 23 nt, Pseudomonas putida KT2440
gaugccaauuuccauaccaaugg

SEQ ID NO: 1602605 - RNA, 19 nt, Pseudomonas putida KT2440
gaugcccgggccuucaacc

SEQ ID NO: 1602606 - RNA, 23 nt, Pseudomonas putida KT2440
gaugccuuuguacgucucaucgu

SEQ ID NO: 1602607 - RNA, 13 nt, Pseudomonas putida KT2440
gaugcgccaguac

SEQ ID NO: 1602608 - RNA, 13 nt, Pseudomonas putida KT2440
gaugcggcugacc

SEQ ID NO: 1602609 - RNA, 15 nt, Pseudomonas putida KT2440
gaugcaucaauggcu

SEQ ID NO: 1602610 - RNA, 23 nt, Pseudomonas putida KT2440
gaugcaucaauggcugggggcgc

SEQ ID NO: 1602611 - RNA, 15 nt, Pseudomonas putida KT2440
gaugcaucagcucgg

SEQ ID NO: 1602612 - RNA, 16 nt, Pseudomonas putida KT2440
gaugcaggagcggcuu

SEQ ID NO: 1602613 - RNA, 21 nt, Pseudomonas putida KT2440
gaugaugauaccgaacagcac

SEQ ID NO: 1602614 - RNA, 23 nt, Pseudomonas putida KT2440
gaugaucaauaucaucacugcca

SEQ ID NO: 1602615 - RNA, 17 nt, Pseudomonas putida KT2440
gaugauccagcccacca

SEQ ID NO: 1602616 - RNA, 23 nt, Pseudomonas putida KT2440
gaugaucgcggcguugucagccu

SEQ ID NO: 1602617 - RNA, 13 nt, Pseudomonas putida KT2440
gaugaccaccagg

SEQ ID NO: 1602618 - RNA, 20 nt, Pseudomonas putida KT2440
gaugacacggauggcaccga

SEQ ID NO: 1602619 - RNA, 13 nt, Pseudomonas putida KT2440
gaucgguacaugc

SEQ ID NO: 1602620 - RNA, 22 nt, Pseudomonas putida KT2440
gaucggugccacccaaggcauc

SEQ ID NO: 1602621 - RNA, 22 nt, Pseudomonas putida KT2440
gaucgucggccccggccccagg

SEQ ID NO: 1602622 - RNA, 16 nt, Pseudomonas putida KT2440
gaucgucuggcacuga

SEQ ID NO: 1602623 - RNA, 14 nt, Pseudomonas putida KT2440
gauccgucaagggg

SEQ ID NO: 1602624 - RNA, 14 nt, Pseudomonas putida KT2440
gauccgggugcugg

SEQ ID NO: 1602625 - RNA, 22 nt, Pseudomonas putida KT2440
gauccucugugggagcggccuu

SEQ ID NO: 1602626 - RNA, 22 nt, Pseudomonas putida KT2440
gauccucaucguccaccgcgcc

SEQ ID NO: 1602627 - RNA, 19 nt, Pseudomonas putida KT2440
gaucgacaaccccagcccg

SEQ ID NO: 1602628 - RNA, 15 nt, Pseudomonas putida KT2440
gaucgaagcagcagc

SEQ ID NO: 1602629 - RNA, 16 nt, Pseudomonas putida KT2440
gaucgaacaacugucc

SEQ ID NO: 1602630 - RNA, 17 nt, Pseudomonas putida KT2440
gaucgaaaucagccuuc

SEQ ID NO: 1602631 - RNA, 22 nt, Pseudomonas putida KT2440
gaucgaaagcugcgcacauuga

SEQ ID NO: 1602632 - RNA, 19 nt, Pseudomonas putida KT2440
gauccuuggcgaaggcugc

SEQ ID NO: 1602633 - RNA, 15 nt, Pseudomonas putida KT2440
gauccagcccaccac

SEQ ID NO: 1602634 - RNA, 16 nt, Pseudomonas putida KT2440
gauccgccccauagcc

SEQ ID NO: 1602635 - RNA, 16 nt, Pseudomonas putida KT2440
gauccgauaaucuugc

SEQ ID NO: 1602636 - RNA, 20 nt, Pseudomonas putida KT2440
gaucccuacccccuccucca

SEQ ID NO: 1602637 - RNA, 15 nt, Pseudomonas putida KT2440
gaucggcguggucca

SEQ ID NO: 1602638 - RNA, 18 nt, Pseudomonas putida KT2440
gaucggcgugguccagcg

SEQ ID NO: 1602639 - RNA, 19 nt, Pseudomonas putida KT2440
gaucggcgugcggcuggcu

SEQ ID NO: 1602640 - RNA, 14 nt, Pseudomonas putida KT2440
gaucggccgccaga

SEQ ID NO: 1602641 - RNA, 17 nt, Pseudomonas putida KT2440
gaucggcagugccgcag

SEQ ID NO: 1602642 - RNA, 22 nt, Pseudomonas putida KT2440
gaucgcggcguugucagccuuc

SEQ ID NO: 1602643 - RNA, 22 nt, Pseudomonas putida KT2440
gaucgcuugucuccaugucgaa

SEQ ID NO: 1602644 - RNA, 16 nt, Pseudomonas putida KT2440
gaucgccagccccagc

SEQ ID NO: 1602645 - RNA, 23 nt, Pseudomonas putida KT2440
gaucgccagccccagcccggugc

SEQ ID NO: 1602646 - RNA, 21 nt, Pseudomonas putida KT2440
gaucgcaagcuggcgcaagcc

SEQ ID NO: 1602647 - RNA, 17 nt, Pseudomonas putida KT2440
gaucgccgucgaccagg

SEQ ID NO: 1602648 - RNA, 15 nt, Pseudomonas putida KT2440
gaucgcgcaagccuu

SEQ ID NO: 1602649 - RNA, 15 nt, Pseudomonas putida KT2440
gaucgcgcagcagcu

SEQ ID NO: 1602650 - RNA, 13 nt, Pseudomonas putida KT2440
gaucgcgcuggca

SEQ ID NO: 1602651 - RNA, 17 nt, Pseudomonas putida KT2440
gauauguccauccaugc

SEQ ID NO: 1602652 - RNA, 17 nt, Pseudomonas putida KT2440
gauaucagcgccagcac

SEQ ID NO: 1602653 - RNA, 11 nt, Pseudomonas putida KT2440
gaucagcucau

SEQ ID NO: 1602654 - RNA, 22 nt, Pseudomonas putida KT2440
gaucaggaacaaucuucuucau

SEQ ID NO: 1602655 - RNA, 14 nt, Pseudomonas putida KT2440
gaucaggcaggcca

SEQ ID NO: 1602656 - RNA, 12 nt, Pseudomonas putida KT2440
gaucaggcaguc

SEQ ID NO: 1602657 - RNA, 17 nt, Pseudomonas putida KT2440
gaucaggcuucagaagc

SEQ ID NO: 1602658 - RNA, 19 nt, Pseudomonas putida KT2440
gaucaggcuucagaagccu

SEQ ID NO: 1602659 - RNA, 14 nt, Pseudomonas putida KT2440
gaucagcuggguga

SEQ ID NO: 1602660 - RNA, 17 nt, Pseudomonas putida KT2440
gaucagguugcccagca

SEQ ID NO: 1602661 - RNA, 16 nt, Pseudomonas putida KT2440
gaucagguuacuggcc

SEQ ID NO: 1602662 - RNA, 17 nt, Pseudomonas putida KT2440
gaucagguuacuggcca

SEQ ID NO: 1602663 - RNA, 13 nt, Pseudomonas putida KT2440
gaucaggucgaca

SEQ ID NO: 1602664 - RNA, 17 nt, Pseudomonas putida KT2440
gaucaggucggcggccu

SEQ ID NO: 1602665 - RNA, 17 nt, Pseudomonas putida KT2440
gaucagguaauccggca

SEQ ID NO: 1602666 - RNA, 15 nt, Pseudomonas putida KT2440
gaucagguaccccuc

SEQ ID NO: 1602667 - RNA, 17 nt, Pseudomonas putida KT2440
gaucauguccuugcugc

SEQ ID NO: 1602668 - RNA, 18 nt, Pseudomonas putida KT2440
gaucauguccuugcugcg

SEQ ID NO: 1602669 - RNA, 22 nt, Pseudomonas putida KT2440
gaucauucaggcacggcaccag

SEQ ID NO: 1602670 - RNA, 20 nt, Pseudomonas putida KT2440
gaucagccgcgcugacgcag

SEQ ID NO: 1602671 - RNA, 20 nt, Pseudomonas putida KT2440
gaucagcgcggugaccagcg

SEQ ID NO: 1602672 - RNA, 16 nt, Pseudomonas putida KT2440
gaucagcgccucgccc

SEQ ID NO: 1602673 - RNA, 22 nt, Pseudomonas putida KT2440
gaucagcgccugcucauccacc

SEQ ID NO: 1602674 - RNA, 15 nt, Pseudomonas putida KT2440
gaucagcgccugcug

SEQ ID NO: 1602675 - RNA, 14 nt, Pseudomonas putida KT2440
gaucaacgcaggcu

SEQ ID NO: 1602676 - RNA, 20 nt, Pseudomonas putida KT2440
gaucaacgccgccagcggcu

SEQ ID NO: 1602677 - RNA, 15 nt, Pseudomonas putida KT2440
gauacccaauaaaaa

SEQ ID NO: 1602678 - RNA, 23 nt, Pseudomonas putida KT2440
gauacccacgcccaaccccaggc

SEQ ID NO: 1602679 - RNA, 13 nt, Pseudomonas putida KT2440
gauacccaggcgc

SEQ ID NO: 1602680 - RNA, 15 nt, Pseudomonas putida KT2440
gauaccgaggaggag

SEQ ID NO: 1602681 - RNA, 14 nt, Pseudomonas putida KT2440
gauaccccgcugcc

SEQ ID NO: 1602682 - RNA, 22 nt, Pseudomonas putida KT2440
gauacccgcacgaacagcggca

SEQ ID NO: 1602683 - RNA, 21 nt, Pseudomonas putida KT2440
gauacaccacuggugccggca

SEQ ID NO: 1602684 - RNA, 13 nt, Pseudomonas putida KT2440
gauacacccgcuc

SEQ ID NO: 1602685 - RNA, 18 nt, Pseudomonas putida KT2440
gauacuggcccggcggga

SEQ ID NO: 1602686 - RNA, 21 nt, Pseudomonas putida KT2440
gauacuggcgcugaucaucga

SEQ ID NO: 1602687 - RNA, 13 nt, Pseudomonas putida KT2440
gauacgccuguaa

SEQ ID NO: 1602688 - RNA, 21 nt, Pseudomonas putida KT2440
gauacugcacccucucugugg

SEQ ID NO: 1602689 - RNA, 14 nt, Pseudomonas putida KT2440
gauaaaaguaauac

SEQ ID NO: 1602690 - RNA, 16 nt, Pseudomonas putida KT2440
gaguucccaggcagcc

SEQ ID NO: 1602691 - RNA, 22 nt, Pseudomonas putida KT2440
gaguuagacaauucugaaggug

SEQ ID NO: 1602692 - RNA, 16 nt, Pseudomonas putida KT2440
gaauuucugcaccuug

SEQ ID NO: 1602693 - RNA, 18 nt, Pseudomonas putida KT2440
gaauuugccccuuccuug

SEQ ID NO: 1602694 - RNA, 21 nt, Pseudomonas putida KT2440
gagugcucgccucacagcgcc

SEQ ID NO: 1602695 - RNA, 18 nt, Pseudomonas putida KT2440
gagucuauggaugccagc

SEQ ID NO: 1602696 - RNA, 13 nt, Pseudomonas putida KT2440
gaguccagcugca

SEQ ID NO: 1602697 - RNA, 19 nt, Pseudomonas putida KT2440
gagucagugugaccuucaa

SEQ ID NO: 1602698 - RNA, 11 nt, Pseudomonas putida KT2440
gagucaugaag

SEQ ID NO: 1602699 - RNA, 21 nt, Pseudomonas putida KT2440
gagucagcuugugccgcggcu

SEQ ID NO: 1602700 - RNA, 12 nt, Pseudomonas putida KT2440
cuuuuccccuua

SEQ ID NO: 1602701 - RNA, 12 nt, Pseudomonas putida KT2440
cuuuuccagcuc

SEQ ID NO: 1602702 - RNA, 21 nt, Pseudomonas putida KT2440
cuuugaaacggucagcggcag

SEQ ID NO: 1602703 - RNA, 14 nt, Pseudomonas putida KT2440
cuuuugaagucggc

SEQ ID NO: 1602704 - RNA, 15 nt, Pseudomonas putida KT2440
cuuuuggcucaggug

SEQ ID NO: 1602705 - RNA, 14 nt, Pseudomonas putida KT2440
cuuuuccugcugca

SEQ ID NO: 1602706 - RNA, 18 nt, Pseudomonas putida KT2440
cuuuuccugcugcaacaa

SEQ ID NO: 1602707 - RNA, 16 nt, Pseudomonas putida KT2440
cuuuucuuuacaaccc

SEQ ID NO: 1602708 - RNA, 13 nt, Pseudomonas putida KT2440
cuuuuuccagcgc

SEQ ID NO: 1602709 - RNA, 21 nt, Pseudomonas putida KT2440
gaaaaggcccugcauaugcag

SEQ ID NO: 1602710 - RNA, 14 nt, Pseudomonas putida KT2440
gaaaagcaucaacu

SEQ ID NO: 1602711 - RNA, 15 nt, Pseudomonas putida KT2440
gaaaagccgcuggcc

SEQ ID NO: 1602712 - RNA, 13 nt, Pseudomonas putida KT2440
gaaaagcaaggcu

SEQ ID NO: 1602713 - RNA, 17 nt, Pseudomonas putida KT2440
gaaaagcaaggcucagg

SEQ ID NO: 1602714 - RNA, 19 nt, Pseudomonas putida KT2440
gaaaacucggucaggcaga

SEQ ID NO: 1602715 - RNA, 20 nt, Pseudomonas putida KT2440
gaaaaggccaaccacccggg

SEQ ID NO: 1602716 - RNA, 20 nt, Pseudomonas putida KT2440
gaaaagguagugcaccaacg

SEQ ID NO: 1602717 - RNA, 16 nt, Pseudomonas putida KT2440
gaaaaucagcuauuga

SEQ ID NO: 1602718 - RNA, 21 nt, Pseudomonas putida KT2440
gaaaaucucguucaugcccuu

SEQ ID NO: 1602719 - RNA, 23 nt, Pseudomonas putida KT2440
gaaaaucucguucaugcccuucu

SEQ ID NO: 1602720 - RNA, 15 nt, Pseudomonas putida KT2440
gaaacacagcaggcc

SEQ ID NO: 1602721 - RNA, 16 nt, Pseudomonas putida KT2440
gaaacacagcaggcca

SEQ ID NO: 1602722 - RNA, 14 nt, Pseudomonas putida KT2440
gaaaaagcccggcc

SEQ ID NO: 1602723 - RNA, 15 nt, Pseudomonas putida KT2440
gaaaaagaacagacc

SEQ ID NO: 1602724 - RNA, 19 nt, Pseudomonas putida KT2440
gaaaacgaaacgccaggca

SEQ ID NO: 1602725 - RNA, 12 nt, Pseudomonas putida KT2440
gaaaaccuccca

SEQ ID NO: 1602726 - RNA, 20 nt, Pseudomonas putida KT2440
gaaaacagcgcgcgaaucac

SEQ ID NO: 1602727 - RNA, 20 nt, Pseudomonas putida KT2440
gaaaaacgccgggcacugcc

SEQ ID NO: 1602728 - RNA, 15 nt, Pseudomonas putida KT2440
gaaaaaaagauuugc

SEQ ID NO: 1602729 - RNA, 15 nt, Pseudomonas putida KT2440
gaaaaaaagggcacc

SEQ ID NO: 1602730 - RNA, 21 nt, Pseudomonas putida KT2440
gaaaaaaagggcaccuccaga

SEQ ID NO: 1602731 - RNA, 20 nt, Pseudomonas putida KT2440
cuuuuuuuugccuggaauuc

SEQ ID NO: 1602732 - RNA, 19 nt, Pseudomonas putida KT2440
cuuuuuucgggcugcugcc

SEQ ID NO: 1602733 - RNA, 12 nt, Pseudomonas putida KT2440
gaaacaccagca

SEQ ID NO: 1602734 - RNA, 15 nt, Pseudomonas putida KT2440
gaaacaguuucuuca

SEQ ID NO: 1602735 - RNA, 14 nt, Pseudomonas putida KT2440
gaaacccagggcag

SEQ ID NO: 1602736 - RNA, 11 nt, Pseudomonas putida KT2440
gaaacccagua

SEQ ID NO: 1602737 - RNA, 17 nt, Pseudomonas putida KT2440
gaaaccaugcaggucga

SEQ ID NO: 1602738 - RNA, 15 nt, Pseudomonas putida KT2440
gaaaccacugcuguu

SEQ ID NO: 1602739 - RNA, 20 nt, Pseudomonas putida KT2440
gaaaccacaguggguggcac

SEQ ID NO: 1602740 - RNA, 17 nt, Pseudomonas putida KT2440
gaaacgccgggucagcu

SEQ ID NO: 1602741 - RNA, 18 nt, Pseudomonas putida KT2440
gaaacgcggcaaccugca

SEQ ID NO: 1602742 - RNA, 15 nt, Pseudomonas putida KT2440
gaaacgccagcuguu

SEQ ID NO: 1602743 - RNA, 15 nt, Pseudomonas putida KT2440
gaaaccgcgugccga

SEQ ID NO: 1602744 - RNA, 18 nt, Pseudomonas putida KT2440
gaaaccgaaaccacugcu

SEQ ID NO: 1602745 - RNA, 12 nt, Pseudomonas putida KT2440
gaaacccucacg

SEQ ID NO: 1602746 - RNA, 19 nt, Pseudomonas putida KT2440
gaaacccucuggguagcca

SEQ ID NO: 1602747 - RNA, 14 nt, Pseudomonas putida KT2440
gaaacccgcgccua

SEQ ID NO: 1602748 - RNA, 23 nt, Pseudomonas putida KT2440
gaaagaacuugguccagaaaaua

SEQ ID NO: 1602749 - RNA, 20 nt, Pseudomonas putida KT2440
gaaacugcgcucaaccagcc

SEQ ID NO: 1602750 - RNA, 14 nt, Pseudomonas putida KT2440
gaaacugcgcuggu

SEQ ID NO: 1602751 - RNA, 16 nt, Pseudomonas putida KT2440
gaaacucacgcauggc

SEQ ID NO: 1602752 - RNA, 17 nt, Pseudomonas putida KT2440
gaaacucacgcauggcc

SEQ ID NO: 1602753 - RNA, 19 nt, Pseudomonas putida KT2440
gaaacucacgcgccagggu

SEQ ID NO: 1602754 - RNA, 18 nt, Pseudomonas putida KT2440
gaaagcgcaaucaaagca

SEQ ID NO: 1602755 - RNA, 17 nt, Pseudomonas putida KT2440
gaaaggccgcugugcca

SEQ ID NO: 1602756 - RNA, 16 nt, Pseudomonas putida KT2440
gaaagggccagcacaa

SEQ ID NO: 1602757 - RNA, 23 nt, Pseudomonas putida KT2440
gaaagggccagcacaaccacugc

SEQ ID NO: 1602758 - RNA, 18 nt, Pseudomonas putida KT2440
gaaagggccaguccaggc

SEQ ID NO: 1602759 - RNA, 20 nt, Pseudomonas putida KT2440
gaaagggccgcaaggccgcu

SEQ ID NO: 1602760 - RNA, 19 nt, Pseudomonas putida KT2440
gaaauaccagacgcaggca

SEQ ID NO: 1602761 - RNA, 19 nt, Pseudomonas putida KT2440
gaaauacccaacuccagcg

SEQ ID NO: 1602762 - RNA, 22 nt, Pseudomonas putida KT2440
gaaauaacgcgggcaaugucca

SEQ ID NO: 1602763 - RNA, 17 nt, Pseudomonas putida KT2440
gaacagcguggccagcc

SEQ ID NO: 1602764 - RNA, 19 nt, Pseudomonas putida KT2440
gaacagcucuuccaguuuc

SEQ ID NO: 1602765 - RNA, 13 nt, Pseudomonas putida KT2440
gaacagcggcagc

SEQ ID NO: 1602766 - RNA, 15 nt, Pseudomonas putida KT2440
gaacagcggcagcaa

SEQ ID NO: 1602767 - RNA, 18 nt, Pseudomonas putida KT2440
gaacagcggcagcaacac

SEQ ID NO: 1602768 - RNA, 17 nt, Pseudomonas putida KT2440
gaacagcucgaucagug

SEQ ID NO: 1602769 - RNA, 19 nt, Pseudomonas putida KT2440
gaacaggaucagcggcuug

SEQ ID NO: 1602770 - RNA, 13 nt, Pseudomonas putida KT2440
gaacaggccggcu

SEQ ID NO: 1602771 - RNA, 16 nt, Pseudomonas putida KT2440
gaacaggccugcggcc

SEQ ID NO: 1602772 - RNA, 21 nt, Pseudomonas putida KT2440
gaacaggccugcggccaggcc

SEQ ID NO: 1602773 - RNA, 14 nt, Pseudomonas putida KT2440
gaacaggcagacca

SEQ ID NO: 1602774 - RNA, 14 nt, Pseudomonas putida KT2440
gaacagggccggcc

SEQ ID NO: 1602775 - RNA, 17 nt, Pseudomonas putida KT2440
gaacagguugcgcgccg

SEQ ID NO: 1602776 - RNA, 19 nt, Pseudomonas putida KT2440
gaacaguggcccgaugauc

SEQ ID NO: 1602777 - RNA, 18 nt, Pseudomonas putida KT2440
gaacaguguggugcggcu

SEQ ID NO: 1602778 - RNA, 14 nt, Pseudomonas putida KT2440
gaacaugccacggc

SEQ ID NO: 1602779 - RNA, 17 nt, Pseudomonas putida KT2440
gaacauugcagggcggc

SEQ ID NO: 1602780 - RNA, 15 nt, Pseudomonas putida KT2440
gaacauguuuucagu

SEQ ID NO: 1602781 - RNA, 19 nt, Pseudomonas putida KT2440
gaacaagcgcgacuggugc

SEQ ID NO: 1602782 - RNA, 24 nt, Pseudomonas putida KT2440
gaacaccccgauucacagcagauc

SEQ ID NO: 1602783 - RNA, 19 nt, Pseudomonas putida KT2440
gaacacccgcgugugcucg

SEQ ID NO: 1602784 - RNA, 21 nt, Pseudomonas putida KT2440
gaacacauagucgauacccag

SEQ ID NO: 1602785 - RNA, 19 nt, Pseudomonas putida KT2440
gaacaccacugucagccag

SEQ ID NO: 1602786 - RNA, 20 nt, Pseudomonas putida KT2440
gaacaccacugucagccagc

SEQ ID NO: 1602787 - RNA, 13 nt, Pseudomonas putida KT2440
gaacagcacugcc

SEQ ID NO: 1602788 - RNA, 19 nt, Pseudomonas putida KT2440
gaacagcaccgccauggcc

SEQ ID NO: 1602789 - RNA, 20 nt, Pseudomonas putida KT2440
gaacagcgcagccaccagcu

SEQ ID NO: 1602790 - RNA, 12 nt, Pseudomonas putida KT2440
gaacagcgccac

SEQ ID NO: 1602791 - RNA, 14 nt, Pseudomonas putida KT2440
gaacacggcguggu

SEQ ID NO: 1602792 - RNA, 17 nt, Pseudomonas putida KT2440
gaacacgugggggaucu

SEQ ID NO: 1602793 - RNA, 15 nt, Pseudomonas putida KT2440
gaacagacaacauca

SEQ ID NO: 1602794 - RNA, 16 nt, Pseudomonas putida KT2440
gaacacugccaacggg

SEQ ID NO: 1602795 - RNA, 23 nt, Pseudomonas putida KT2440
gaaauugcaggggcugcaaggca

SEQ ID NO: 1602796 - RNA, 15 nt, Pseudomonas putida KT2440
gaaauuggccagcag

SEQ ID NO: 1602797 - RNA, 16 nt, Pseudomonas putida KT2440
gaaauuggccagcagg

SEQ ID NO: 1602798 - RNA, 18 nt, Pseudomonas putida KT2440
gaaauuggccagcaggcc

SEQ ID NO: 1602799 - RNA, 22 nt, Pseudomonas putida KT2440
gaaauuggccagcaggucaggc

SEQ ID NO: 1602800 - RNA, 22 nt, Pseudomonas putida KT2440
gaacaaccugaacaaggccugg

SEQ ID NO: 1602801 - RNA, 13 nt, Pseudomonas putida KT2440
gaaauucaaguac

SEQ ID NO: 1602802 - RNA, 14 nt, Pseudomonas putida KT2440
gaaauucaccugcc

SEQ ID NO: 1602803 - RNA, 19 nt, Pseudomonas putida KT2440
gaaauucaccugccgggca

SEQ ID NO: 1602804 - RNA, 18 nt, Pseudomonas putida KT2440
gaaauguucacggcggcc

SEQ ID NO: 1602805 - RNA, 21 nt, Pseudomonas putida KT2440
gaaaucugccugcugcaacag

SEQ ID NO: 1602806 - RNA, 21 nt, Pseudomonas putida KT2440
gaaauggcuuccggcgcuggu

SEQ ID NO: 1602807 - RNA, 12 nt, Pseudomonas putida KT2440
gaaauggaauuu

SEQ ID NO: 1602808 - RNA, 20 nt, Pseudomonas putida KT2440
gaaaugguugaagaucaggu

SEQ ID NO: 1602809 - RNA, 14 nt, Pseudomonas putida KT2440
gaaauccaccagcu

SEQ ID NO: 1602810 - RNA, 17 nt, Pseudomonas putida KT2440
gaaauccagccgcccga

SEQ ID NO: 1602811 - RNA, 23 nt, Pseudomonas putida KT2440
gaaaucggggcugcuuugcagcc

SEQ ID NO: 1602812 - RNA, 20 nt, Pseudomonas putida KT2440
gaacuugucuguacugcggc

SEQ ID NO: 1602813 - RNA, 14 nt, Pseudomonas putida KT2440
gaacuucuccagcg

SEQ ID NO: 1602814 - RNA, 16 nt, Pseudomonas putida KT2440
gaagaacagcgaagcc

SEQ ID NO: 1602815 - RNA, 14 nt, Pseudomonas putida KT2440
gaagaacaccugca

SEQ ID NO: 1602816 - RNA, 20 nt, Pseudomonas putida KT2440
gaagacggucuccccuuccc

SEQ ID NO: 1602817 - RNA, 13 nt, Pseudomonas putida KT2440
gaagaauguagaa

SEQ ID NO: 1602818 - RNA, 13 nt, Pseudomonas putida KT2440
gaagaauugcugg

SEQ ID NO: 1602819 - RNA, 13 nt, Pseudomonas putida KT2440
gaagaauucaggc

SEQ ID NO: 1602820 - RNA, 21 nt, Pseudomonas putida KT2440
gaagauauugguccagccaca

SEQ ID NO: 1602821 - RNA, 23 nt, Pseudomonas putida KT2440
gaagaucgguacaugcgaacgca

SEQ ID NO: 1602822 - RNA, 16 nt, Pseudomonas putida KT2440
gaagaucgccgcgcug

SEQ ID NO: 1602823 - RNA, 18 nt, Pseudomonas putida KT2440
gaagaugaagaaaccacc

SEQ ID NO: 1602824 - RNA, 11 nt, Pseudomonas putida KT2440
gaagaggccgg

SEQ ID NO: 1602825 - RNA, 13 nt, Pseudomonas putida KT2440
gaagaggccggca

SEQ ID NO: 1602826 - RNA, 14 nt, Pseudomonas putida KT2440
gaagaggccggcac

SEQ ID NO: 1602827 - RNA, 17 nt, Pseudomonas putida KT2440
gaagaggccggcacagg

SEQ ID NO: 1602828 - RNA, 23 nt, Pseudomonas putida KT2440
gaagaggccggcacaggaaggca

SEQ ID NO: 1602829 - RNA, 13 nt, Pseudomonas putida KT2440
gaagaggccggcc

SEQ ID NO: 1602830 - RNA, 13 nt, Pseudomonas putida KT2440
gaagaguggaucg

SEQ ID NO: 1602831 - RNA, 14 nt, Pseudomonas putida KT2440
gaagaggccaggac

SEQ ID NO: 1602832 - RNA, 22 nt, Pseudomonas putida KT2440
gaagaggccaguaccagcagca

SEQ ID NO: 1602833 - RNA, 20 nt, Pseudomonas putida KT2440
gaagaggcccgaacagacaa

SEQ ID NO: 1602834 - RNA, 18 nt, Pseudomonas putida KT2440
gaagagauauguccaucc

SEQ ID NO: 1602835 - RNA, 20 nt, Pseudomonas putida KT2440
gaagaugacuggccggagcu

SEQ ID NO: 1602836 - RNA, 13 nt, Pseudomonas putida KT2440
gaagcagccacca

SEQ ID NO: 1602837 - RNA, 18 nt, Pseudomonas putida KT2440
gaagcagccaccacggug

SEQ ID NO: 1602838 - RNA, 12 nt, Pseudomonas putida KT2440
gaagcagcagcu

SEQ ID NO: 1602839 - RNA, 13 nt, Pseudomonas putida KT2440
gaagcagaucauc

SEQ ID NO: 1602840 - RNA, 15 nt, Pseudomonas putida KT2440
gaagcagaucaucau

SEQ ID NO: 1602841 - RNA, 15 nt, Pseudomonas putida KT2440
gaagcagugcugcca

SEQ ID NO: 1602842 - RNA, 14 nt, Pseudomonas putida KT2440
gaagcaccagguuu

SEQ ID NO: 1602843 - RNA, 20 nt, Pseudomonas putida KT2440
gaagcccguacagaccgccg

SEQ ID NO: 1602844 - RNA, 13 nt, Pseudomonas putida KT2440
gaagccccgcgcg

SEQ ID NO: 1602845 - RNA, 21 nt, Pseudomonas putida KT2440
gaagccauaucccgccagguc

SEQ ID NO: 1602846 - RNA, 22 nt, Pseudomonas putida KT2440
gaagccaugagcgagcucaacc

SEQ ID NO: 1602847 - RNA, 16 nt, Pseudomonas putida KT2440
gaagcgcaccucggcc

SEQ ID NO: 1602848 - RNA, 21 nt, Pseudomonas putida KT2440
gaagcgcaccucggccagugc

SEQ ID NO: 1602849 - RNA, 14 nt, Pseudomonas putida KT2440
gaagccucaccgcc

SEQ ID NO: 1602850 - RNA, 22 nt, Pseudomonas putida KT2440
gaagccucaccgccgcauuagc

SEQ ID NO: 1602851 - RNA, 13 nt, Pseudomonas putida KT2440
gaagcgaacacag

SEQ ID NO: 1602852 - RNA, 14 nt, Pseudomonas putida KT2440
gaagcgcgggucuu

SEQ ID NO: 1602853 - RNA, 13 nt, Pseudomonas putida KT2440
gaagcggccggcc

SEQ ID NO: 1602854 - RNA, 22 nt, Pseudomonas putida KT2440
gaaggcaaucggguacacgcca

SEQ ID NO: 1602855 - RNA, 19 nt, Pseudomonas putida KT2440
gaaggccagccgagccaag

SEQ ID NO: 1602856 - RNA, 14 nt, Pseudomonas putida KT2440
gaaggcauccaggg

SEQ ID NO: 1602857 - RNA, 17 nt, Pseudomonas putida KT2440
gaaggcauccagggcgu

SEQ ID NO: 1602858 - RNA, 22 nt, Pseudomonas putida KT2440
gaaggcaucgaacuccugcacc

SEQ ID NO: 1602859 - RNA, 15 nt, Pseudomonas putida KT2440
gaaggccguggcaag

SEQ ID NO: 1602860 - RNA, 22 nt, Pseudomonas putida KT2440
gaaggccucacgcaucugcgcu

SEQ ID NO: 1602861 - RNA, 18 nt, Pseudomonas putida KT2440
gaaggccgccggcaacug

SEQ ID NO: 1602862 - RNA, 20 nt, Pseudomonas putida KT2440
gaagcuugcagucaccuggc

SEQ ID NO: 1602863 - RNA, 21 nt, Pseudomonas putida KT2440
gaagcuuccaguuggccggca

SEQ ID NO: 1602864 - RNA, 13 nt, Pseudomonas putida KT2440
gaaggacaucacc

SEQ ID NO: 1602865 - RNA, 15 nt, Pseudomonas putida KT2440
gaaggacaucaccag

SEQ ID NO: 1602866 - RNA, 15 nt, Pseudomonas putida KT2440
gaaggagagccucgg

SEQ ID NO: 1602867 - RNA, 23 nt, Pseudomonas putida KT2440
gaagcuggagucguugcgcuggu

SEQ ID NO: 1602868 - RNA, 24 nt, Pseudomonas putida KT2440
gaagcuggagucguugcgcugguu

SEQ ID NO: 1602869 - RNA, 14 nt, Pseudomonas putida KT2440
gaagcugcagcagc

SEQ ID NO: 1602870 - RNA, 17 nt, Pseudomonas putida KT2440
gaagcuguacagcgcau

SEQ ID NO: 1602871 - RNA, 22 nt, Pseudomonas putida KT2440
gaagcucuggucgaucuucagc

SEQ ID NO: 1602872 - RNA, 17 nt, Pseudomonas putida KT2440
gaagcucgaucugccug

SEQ ID NO: 1602873 - RNA, 14 nt, Pseudomonas putida KT2440
gaagcucccggcau

SEQ ID NO: 1602874 - RNA, 15 nt, Pseudomonas putida KT2440
gaagcuaaagagucc

SEQ ID NO: 1602875 - RNA, 16 nt, Pseudomonas putida KT2440
gaagcuaaagaguccg

SEQ ID NO: 1602876 - RNA, 17 nt, Pseudomonas putida KT2440
gaagcgguugaccgccg

SEQ ID NO: 1602877 - RNA, 16 nt, Pseudomonas putida KT2440
gaagcggggaggccgg

SEQ ID NO: 1602878 - RNA, 16 nt, Pseudomonas putida KT2440
gaagcggcgcuuuucu

SEQ ID NO: 1602879 - RNA, 20 nt, Pseudomonas putida KT2440
gaacucgucaccgccccagc

SEQ ID NO: 1602880 - RNA, 17 nt, Pseudomonas putida KT2440
gaacucuggcaacagcu

SEQ ID NO: 1602881 - RNA, 16 nt, Pseudomonas putida KT2440
gaacugauaacucuuc

SEQ ID NO: 1602882 - RNA, 14 nt, Pseudomonas putida KT2440
gaacuccccaccag

SEQ ID NO: 1602883 - RNA, 18 nt, Pseudomonas putida KT2440
gaacuccccaccaggcaa

SEQ ID NO: 1602884 - RNA, 17 nt, Pseudomonas putida KT2440
gaacucaugcuccugcg

SEQ ID NO: 1602885 - RNA, 11 nt, Pseudomonas putida KT2440
gaacuccucca

SEQ ID NO: 1602886 - RNA, 20 nt, Pseudomonas putida KT2440
gaacuggcugccgcugacca

SEQ ID NO: 1602887 - RNA, 18 nt, Pseudomonas putida KT2440
gaacugggcauccagcuu

SEQ ID NO: 1602888 - RNA, 17 nt, Pseudomonas putida KT2440
gaacuggaggugauggu

SEQ ID NO: 1602889 - RNA, 23 nt, Pseudomonas putida KT2440
gaacuggaugauccagcccacca

SEQ ID NO: 1602890 - RNA, 24 nt, Pseudomonas putida KT2440
gaacuggaugauccagcccaccac

SEQ ID NO: 1602891 - RNA, 16 nt, Pseudomonas putida KT2440
gaacugcugcacuggc

SEQ ID NO: 1602892 - RNA, 15 nt, Pseudomonas putida KT2440
gaacugcaagcucga

SEQ ID NO: 1602893 - RNA, 13 nt, Pseudomonas putida KT2440
gaacggaacaggu

SEQ ID NO: 1602894 - RNA, 21 nt, Pseudomonas putida KT2440
gaacgcuguuggcagccacga

SEQ ID NO: 1602895 - RNA, 12 nt, Pseudomonas putida KT2440
gaacgcugcgcg

SEQ ID NO: 1602896 - RNA, 15 nt, Pseudomonas putida KT2440
gaacgcugcgcgggu

SEQ ID NO: 1602897 - RNA, 20 nt, Pseudomonas putida KT2440
gaacgggccaccaaaggccu

SEQ ID NO: 1602898 - RNA, 23 nt, Pseudomonas putida KT2440
gaacgggccaccaaaggccuuga

SEQ ID NO: 1602899 - RNA, 23 nt, Pseudomonas putida KT2440
gaacguuucgucauccaccgccc

SEQ ID NO: 1602900 - RNA, 19 nt, Pseudomonas putida KT2440
gaacguuuccagcaaccgc

SEQ ID NO: 1602901 - RNA, 19 nt, Pseudomonas putida KT2440
gaacgacagcugcaacaga

SEQ ID NO: 1602902 - RNA, 23 nt, Pseudomonas putida KT2440
gaacgacaaacuccuugaaauuc

SEQ ID NO: 1602903 - RNA, 17 nt, Pseudomonas putida KT2440
gaaccuggaucgcucuc

SEQ ID NO: 1602904 - RNA, 15 nt, Pseudomonas putida KT2440
gaaccugugcacagc

SEQ ID NO: 1602905 - RNA, 20 nt, Pseudomonas putida KT2440
gaaccugaugcgagcuaccu

SEQ ID NO: 1602906 - RNA, 18 nt, Pseudomonas putida KT2440
gaacgccugcagggccug

SEQ ID NO: 1602907 - RNA, 16 nt, Pseudomonas putida KT2440
gaacgccuuggccucg

SEQ ID NO: 1602908 - RNA, 20 nt, Pseudomonas putida KT2440
gaacgcagcuuccgccacca

SEQ ID NO: 1602909 - RNA, 18 nt, Pseudomonas putida KT2440
gaacgcaauaugcaccuu

SEQ ID NO: 1602910 - RNA, 21 nt, Pseudomonas putida KT2440
gaacgcaaaaaaccgcaccca

SEQ ID NO: 1602911 - RNA, 21 nt, Pseudomonas putida KT2440
gaacgaugcccgggccuucaa

SEQ ID NO: 1602912 - RNA, 13 nt, Pseudomonas putida KT2440
gaaccaccagugg

SEQ ID NO: 1602913 - RNA, 22 nt, Pseudomonas putida KT2440
gaaccccccguaggagcgggcu

SEQ ID NO: 1602914 - RNA, 21 nt, Pseudomonas putida KT2440
gaaccccaguugaucaacccg

SEQ ID NO: 1602915 - RNA, 22 nt, Pseudomonas putida KT2440
gaaccccaguugaucaacccgu

SEQ ID NO: 1602916 - RNA, 15 nt, Pseudomonas putida KT2440
gaacccacuguaggg

SEQ ID NO: 1602917 - RNA, 21 nt, Pseudomonas putida KT2440
gaacccaaucauauacaucga

SEQ ID NO: 1602918 - RNA, 15 nt, Pseudomonas putida KT2440
gaaccaucccacuca

SEQ ID NO: 1602919 - RNA, 14 nt, Pseudomonas putida KT2440
gaaccgcucccagg

SEQ ID NO: 1602920 - RNA, 15 nt, Pseudomonas putida KT2440
gaaccggcgcuggcc

SEQ ID NO: 1602921 - RNA, 23 nt, Pseudomonas putida KT2440
gaaccggcuguuggccuucccuu

SEQ ID NO: 1602922 - RNA, 19 nt, Pseudomonas putida KT2440
gaacccgcuccuaccgggg

SEQ ID NO: 1602923 - RNA, 21 nt, Pseudomonas putida KT2440
gaacccgcuggcgaucaggca

SEQ ID NO: 1602924 - RNA, 23 nt, Pseudomonas putida KT2440
gaaccgcaacuggcccgcgccag

SEQ ID NO: 1602925 - RNA, 11 nt, Pseudomonas putida KT2440
gaauugcagcc

SEQ ID NO: 1602926 - RNA, 19 nt, Pseudomonas putida KT2440
gaauugcagcccgcaggcu

SEQ ID NO: 1602927 - RNA, 19 nt, Pseudomonas putida KT2440
gaaugggcugcaaagcagc

SEQ ID NO: 1602928 - RNA, 14 nt, Pseudomonas putida KT2440
gaaugucaccgcgg

SEQ ID NO: 1602929 - RNA, 20 nt, Pseudomonas putida KT2440
gaaugguguggggguucagc

SEQ ID NO: 1602930 - RNA, 17 nt, Pseudomonas putida KT2440
gaaucuugcgcgccagc

SEQ ID NO: 1602931 - RNA, 20 nt, Pseudomonas putida KT2440
gaaucuugcgcgccagcgca

SEQ ID NO: 1602932 - RNA, 21 nt, Pseudomonas putida KT2440
gaaucuugcgcgccagcgcau

SEQ ID NO: 1602933 - RNA, 17 nt, Pseudomonas putida KT2440
gaaucuggcucugcagc

SEQ ID NO: 1602934 - RNA, 22 nt, Pseudomonas putida KT2440
gaaugaccagggaaauuggcca

SEQ ID NO: 1602935 - RNA, 16 nt, Pseudomonas putida KT2440
gaaucucaaccaccuc

SEQ ID NO: 1602936 - RNA, 17 nt, Pseudomonas putida KT2440
gaaucucaaccaccucu

SEQ ID NO: 1602937 - RNA, 20 nt, Pseudomonas putida KT2440
gaaucgcucaugccccgcac

SEQ ID NO: 1602938 - RNA, 17 nt, Pseudomonas putida KT2440
gaaucggcuccaggcac

SEQ ID NO: 1602939 - RNA, 17 nt, Pseudomonas putida KT2440
gaaucggcuucagguuc

SEQ ID NO: 1602940 - RNA, 20 nt, Pseudomonas putida KT2440
gaaucagagcgaaaugggcc

SEQ ID NO: 1602941 - RNA, 22 nt, Pseudomonas putida KT2440
gaaucagcaaaccgaccaggca

SEQ ID NO: 1602942 - RNA, 20 nt, Pseudomonas putida KT2440
gaaucagccagccuucgcca

SEQ ID NO: 1602943 - RNA, 15 nt, Pseudomonas putida KT2440
gaaucagcggcaggc

SEQ ID NO: 1602944 - RNA, 17 nt, Pseudomonas putida KT2440
gaauccugcugaguccg

SEQ ID NO: 1602945 - RNA, 20 nt, Pseudomonas putida KT2440
gaauccugcugaguccgcca

SEQ ID NO: 1602946 - RNA, 15 nt, Pseudomonas putida KT2440
gaaguuccugcucuc

SEQ ID NO: 1602947 - RNA, 17 nt, Pseudomonas putida KT2440
gaaguugaagcgccggu

SEQ ID NO: 1602948 - RNA, 16 nt, Pseudomonas putida KT2440
gaauaaaaaaagggcg

SEQ ID NO: 1602949 - RNA, 15 nt, Pseudomonas putida KT2440
gaagucagccagguu

SEQ ID NO: 1602950 - RNA, 13 nt, Pseudomonas putida KT2440
gaagucgccacac

SEQ ID NO: 1602951 - RNA, 18 nt, Pseudomonas putida KT2440
gaagucgauguucagcac

SEQ ID NO: 1602952 - RNA, 23 nt, Pseudomonas putida KT2440
gaagucguccacgcgcaggccac

SEQ ID NO: 1602953 - RNA, 19 nt, Pseudomonas putida KT2440
gaagucgguggucaccagc

SEQ ID NO: 1602954 - RNA, 14 nt, Pseudomonas putida KT2440
gaaguggcagaacu

SEQ ID NO: 1602955 - RNA, 15 nt, Pseudomonas putida KT2440
gaaguggauauccag

SEQ ID NO: 1602956 - RNA, 20 nt, Pseudomonas putida KT2440
gaagugcacugccuggcuca

SEQ ID NO: 1602957 - RNA, 21 nt, Pseudomonas putida KT2440
gaagugcacugccuggcucag

SEQ ID NO: 1602958 - RNA, 17 nt, Pseudomonas putida KT2440
gaaguagcgcucuuugc

SEQ ID NO: 1602959 - RNA, 17 nt, Pseudomonas putida KT2440
gaagucaaccaacuccu

SEQ ID NO: 1602960 - RNA, 22 nt, Pseudomonas putida KT2440
gaaggugauguugcccggcaug

SEQ ID NO: 1602961 - RNA, 14 nt, Pseudomonas putida KT2440
gaagguggccggca

SEQ ID NO: 1602962 - RNA, 16 nt, Pseudomonas putida KT2440
gaaggcgaauagcauc

SEQ ID NO: 1602963 - RNA, 23 nt, Pseudomonas putida KT2440
gaaggcgacuuucgggucgccuu

SEQ ID NO: 1602964 - RNA, 15 nt, Pseudomonas putida KT2440
gaaggcuacauccag

SEQ ID NO: 1602965 - RNA, 14 nt, Pseudomonas putida KT2440
gaaggcucaguaau

SEQ ID NO: 1602966 - RNA, 18 nt, Pseudomonas putida KT2440
gaaggcugccuggcccgc

SEQ ID NO: 1602967 - RNA, 16 nt, Pseudomonas putida KT2440
gaaggcgucacccgcg

SEQ ID NO: 1602968 - RNA, 16 nt, Pseudomonas putida KT2440
gaaggcgucacgcagg

SEQ ID NO: 1602969 - RNA, 20 nt, Pseudomonas putida KT2440
gaagggauguuggaauaaga

SEQ ID NO: 1602970 - RNA, 17 nt, Pseudomonas putida KT2440
gaaggggaucagcacgc

SEQ ID NO: 1602971 - RNA, 21 nt, Pseudomonas putida KT2440
gaauacgauauccgcagcccc

SEQ ID NO: 1602972 - RNA, 19 nt, Pseudomonas putida KT2440
gaauacgagggugaaccca

SEQ ID NO: 1602973 - RNA, 18 nt, Pseudomonas putida KT2440
gaauacggucgcggcggc

SEQ ID NO: 1602974 - RNA, 20 nt, Pseudomonas putida KT2440
gaauacgguggcggcagcaa

SEQ ID NO: 1602975 - RNA, 20 nt, Pseudomonas putida KT2440
gaauaccaggcccgcuaucc

SEQ ID NO: 1602976 - RNA, 17 nt, Pseudomonas putida KT2440
gaauaaugcuccagcga

SEQ ID NO: 1602977 - RNA, 21 nt, Pseudomonas putida KT2440
gaauagaacacuggcaggcuc

SEQ ID NO: 1602978 - RNA, 19 nt, Pseudomonas putida KT2440
cuguuucgcccaaauguua

SEQ ID NO: 1602979 - RNA, 20 nt, Pseudomonas putida KT2440
cuguuucugccccuggccca

SEQ ID NO: 1602980 - RNA, 23 nt, Pseudomonas putida KT2440
cuguuucuucaaggccgccaccu

SEQ ID NO: 1602981 - RNA, 12 nt, Pseudomonas putida KT2440
cuguuucaccag

SEQ ID NO: 1602982 - RNA, 23 nt, Pseudomonas putida KT2440
cuguuucaccagcaggucggcac

SEQ ID NO: 1602983 - RNA, 13 nt, Pseudomonas putida KT2440
cuguuugcugguc

SEQ ID NO: 1602984 - RNA, 13 nt, Pseudomonas putida KT2440
cuguuuugagagg

SEQ ID NO: 1602985 - RNA, 14 nt, Pseudomonas putida KT2440
cuguuuucaaggcg

SEQ ID NO: 1602986 - RNA, 22 nt, Pseudomonas putida KT2440
cuguucuugaacucgccgcgca

SEQ ID NO: 1602987 - RNA, 23 nt, Pseudomonas putida KT2440
cuguugaaggcguuuuccagguu

SEQ ID NO: 1602988 - RNA, 15 nt, Pseudomonas putida KT2440
cuguugagcagcagc

SEQ ID NO: 1602989 - RNA, 16 nt, Pseudomonas putida KT2440
cuguugagcagcagcc

SEQ ID NO: 1602990 - RNA, 14 nt, Pseudomonas putida KT2440
cugucguccagcuc

SEQ ID NO: 1602991 - RNA, 20 nt, Pseudomonas putida KT2440
cugucguuauccugcagcac

SEQ ID NO: 1602992 - RNA, 13 nt, Pseudomonas putida KT2440
cugucguugaucc

SEQ ID NO: 1602993 - RNA, 19 nt, Pseudomonas putida KT2440
cuguucgcuggagaacagc

SEQ ID NO: 1602994 - RNA, 15 nt, Pseudomonas putida KT2440
cuguugccgccacca

SEQ ID NO: 1602995 - RNA, 14 nt, Pseudomonas putida KT2440
cuguugccgcuucg

SEQ ID NO: 1602996 - RNA, 22 nt, Pseudomonas putida KT2440
cuguuggccuucccuucuuugu

SEQ ID NO: 1602997 - RNA, 21 nt, Pseudomonas putida KT2440
cuguuguccaagggagagucc

SEQ ID NO: 1602998 - RNA, 15 nt, Pseudomonas putida KT2440
cuuacaacugcucca

SEQ ID NO: 1602999 - RNA, 22 nt, Pseudomonas putida KT2440
cuuacaaaucaguaaguugaau

SEQ ID NO: 1603000 - RNA, 16 nt, Pseudomonas putida KT2440
cuuacgaacggguugg

SEQ ID NO: 1603001 - RNA, 16 nt, Pseudomonas putida KT2440
cuuaaucaaugcaagu

SEQ ID NO: 1603002 - RNA, 20 nt, Pseudomonas putida KT2440
cuuauccgcuggcuuguccu

SEQ ID NO: 1603003 - RNA, 17 nt, Pseudomonas putida KT2440
cuuacuaucacgccuug

SEQ ID NO: 1603004 - RNA, 19 nt, Pseudomonas putida KT2440
cuucacgucuggcaccagu

SEQ ID NO: 1603005 - RNA, 18 nt, Pseudomonas putida KT2440
cuucacgggucaugccac

SEQ ID NO: 1603006 - RNA, 21 nt, Pseudomonas putida KT2440
cuucacgccagccguugaucc

SEQ ID NO: 1603007 - RNA, 14 nt, Pseudomonas putida KT2440
cuucagccuuuucc

SEQ ID NO: 1603008 - RNA, 17 nt, Pseudomonas putida KT2440
cuucagccuuuuccagc

SEQ ID NO: 1603009 - RNA, 23 nt, Pseudomonas putida KT2440
cuucagccuuuuccagcucggcc

SEQ ID NO: 1603010 - RNA, 18 nt, Pseudomonas putida KT2440
cuucagccaccgcacucu

SEQ ID NO: 1603011 - RNA, 18 nt, Pseudomonas putida KT2440
cuucauccaucgcaaucc

SEQ ID NO: 1603012 - RNA, 21 nt, Pseudomonas putida KT2440
cuucaugcaauaaccaaucaa

SEQ ID NO: 1603013 - RNA, 16 nt, Pseudomonas putida KT2440
cuucagguaagucagc

SEQ ID NO: 1603014 - RNA, 20 nt, Pseudomonas putida KT2440
cuucagguaauccaccagcc

SEQ ID NO: 1603015 - RNA, 19 nt, Pseudomonas putida KT2440
cuucagggucgggcacagg

SEQ ID NO: 1603016 - RNA, 22 nt, Pseudomonas putida KT2440
cuucagggucgggcacaggccc

SEQ ID NO: 1603017 - RNA, 19 nt, Pseudomonas putida KT2440
cuucaggcugcgccgccuc

SEQ ID NO: 1603018 - RNA, 16 nt, Pseudomonas putida KT2440
cuucagguucugccgg

SEQ ID NO: 1603019 - RNA, 21 nt, Pseudomonas putida KT2440
cuucagguuuggggugagcga

SEQ ID NO: 1603020 - RNA, 15 nt, Pseudomonas putida KT2440
cuucagugcuucaca

SEQ ID NO: 1603021 - RNA, 18 nt, Pseudomonas putida KT2440
cuucaggcgcucaccccg

SEQ ID NO: 1603022 - RNA, 20 nt, Pseudomonas putida KT2440
cuucaggcgcucaccccgcc

SEQ ID NO: 1603023 - RNA, 20 nt, Pseudomonas putida KT2440
cuucagcgcggcaaccugcu

SEQ ID NO: 1603024 - RNA, 19 nt, Pseudomonas putida KT2440
cuucagcgggcuacacgcg

SEQ ID NO: 1603025 - RNA, 18 nt, Pseudomonas putida KT2440
cuucagcgggucgagcca

SEQ ID NO: 1603026 - RNA, 23 nt, Pseudomonas putida KT2440
cuucgccaagguccagccacgaa

SEQ ID NO: 1603027 - RNA, 17 nt, Pseudomonas putida KT2440
cuucgcccgaccgccag

SEQ ID NO: 1603028 - RNA, 22 nt, Pseudomonas putida KT2440
cuucgcccgaccgccagcccgc

SEQ ID NO: 1603029 - RNA, 14 nt, Pseudomonas putida KT2440
cuucgccagcgcca

SEQ ID NO: 1603030 - RNA, 18 nt, Pseudomonas putida KT2440
cuucgccacugccacugg

SEQ ID NO: 1603031 - RNA, 19 nt, Pseudomonas putida KT2440
cuucgcccgguuccaauac

SEQ ID NO: 1603032 - RNA, 12 nt, Pseudomonas putida KT2440
cuucgccgccau

SEQ ID NO: 1603033 - RNA, 13 nt, Pseudomonas putida KT2440
cuucgccugcagc

SEQ ID NO: 1603034 - RNA, 19 nt, Pseudomonas putida KT2440
cuucgccguacuggcugca

SEQ ID NO: 1603035 - RNA, 23 nt, Pseudomonas putida KT2440
cuucgccguacuggcugcacugg

SEQ ID NO: 1603036 - RNA, 21 nt, Pseudomonas putida KT2440
cuucgccggcaucgccuccag

SEQ ID NO: 1603037 - RNA, 23 nt, Pseudomonas putida KT2440
cuucgcgcucgaacaacgccucg

SEQ ID NO: 1603038 - RNA, 19 nt, Pseudomonas putida KT2440
cuucgcggcaagcccgcuc

SEQ ID NO: 1603039 - RNA, 16 nt, Pseudomonas putida KT2440
cuucgcggaaggccuc

SEQ ID NO: 1603040 - RNA, 12 nt, Pseudomonas putida KT2440
cuucgcgaccca

SEQ ID NO: 1603041 - RNA, 20 nt, Pseudomonas putida KT2440
cuuccggcaccccuuucucc

SEQ ID NO: 1603042 - RNA, 18 nt, Pseudomonas putida KT2440
cuuccucgugaccgacca

SEQ ID NO: 1603043 - RNA, 21 nt, Pseudomonas putida KT2440
cuuccucgaacgacagcugca

SEQ ID NO: 1603044 - RNA, 19 nt, Pseudomonas putida KT2440
cuuccucgacccagccacc

SEQ ID NO: 1603045 - RNA, 19 nt, Pseudomonas putida KT2440
cuucgaucaggcagucuuc

SEQ ID NO: 1603046 - RNA, 16 nt, Pseudomonas putida KT2440
cuucgaucgccggcag

SEQ ID NO: 1603047 - RNA, 20 nt, Pseudomonas putida KT2440
cuucgaucuggaucacugcc

SEQ ID NO: 1603048 - RNA, 14 nt, Pseudomonas putida KT2440
cuucgauucaggcc

SEQ ID NO: 1603049 - RNA, 16 nt, Pseudomonas putida KT2440
cuucgauucaggccuu

SEQ ID NO: 1603050 - RNA, 14 nt, Pseudomonas putida KT2440
cuucccacguaccu

SEQ ID NO: 1603051 - RNA, 18 nt, Pseudomonas putida KT2440
cuuccauuugcgcuggcu

SEQ ID NO: 1603052 - RNA, 20 nt, Pseudomonas putida KT2440
cuuccaugccuucuucgaug

SEQ ID NO: 1603053 - RNA, 23 nt, Pseudomonas putida KT2440
cuuccauggcaucggacgcgugg

SEQ ID NO: 1603054 - RNA, 18 nt, Pseudomonas putida KT2440
cuuccgaccggucauaca

SEQ ID NO: 1603055 - RNA, 17 nt, Pseudomonas putida KT2440
cuuccgcgugccccccc

SEQ ID NO: 1603056 - RNA, 21 nt, Pseudomonas putida KT2440
cuuccaguuccauccaguccg

SEQ ID NO: 1603057 - RNA, 14 nt, Pseudomonas putida KT2440
cuuucaugccuggc

SEQ ID NO: 1603058 - RNA, 16 nt, Pseudomonas putida KT2440
cuuuccauuacuccag

SEQ ID NO: 1603059 - RNA, 19 nt, Pseudomonas putida KT2440
cuuucauaccccuccggcc

SEQ ID NO: 1603060 - RNA, 14 nt, Pseudomonas putida KT2440
cuuucccccagcca

SEQ ID NO: 1603061 - RNA, 16 nt, Pseudomonas putida KT2440
cuuucgacaugcaguu

SEQ ID NO: 1603062 - RNA, 18 nt, Pseudomonas putida KT2440
cuuuccugaaaccccgcc

SEQ ID NO: 1603063 - RNA, 20 nt, Pseudomonas putida KT2440
cuuucgagagccgggcaaug

SEQ ID NO: 1603064 - RNA, 23 nt, Pseudomonas putida KT2440
cuuucgcgggcgcgcccgcuccc

SEQ ID NO: 1603065 - RNA, 14 nt, Pseudomonas putida KT2440
cuuucucccaggcc

SEQ ID NO: 1603066 - RNA, 15 nt, Pseudomonas putida KT2440
cuuucucccaggccg

SEQ ID NO: 1603067 - RNA, 16 nt, Pseudomonas putida KT2440
cuuucucccaggccga

SEQ ID NO: 1603068 - RNA, 21 nt, Pseudomonas putida KT2440
cuuucaggcgcagcacaaggc

SEQ ID NO: 1603069 - RNA, 21 nt, Pseudomonas putida KT2440
cuuucaggguauugaacggcg

SEQ ID NO: 1603070 - RNA, 20 nt, Pseudomonas putida KT2440
cuuucaggugcuucggcucu

SEQ ID NO: 1603071 - RNA, 16 nt, Pseudomonas putida KT2440
cuugucccggcccagc

SEQ ID NO: 1603072 - RNA, 17 nt, Pseudomonas putida KT2440
cuuguccagguuugggu

SEQ ID NO: 1603073 - RNA, 22 nt, Pseudomonas putida KT2440
cuugucagucucuuucaacagc

SEQ ID NO: 1603074 - RNA, 23 nt, Pseudomonas putida KT2440
cuuggagcgcgcccccgaccacc

SEQ ID NO: 1603075 - RNA, 13 nt, Pseudomonas putida KT2440
cuuggacaggccc

SEQ ID NO: 1603076 - RNA, 22 nt, Pseudomonas putida KT2440
cuuggaaauguucaacagccgc

SEQ ID NO: 1603077 - RNA, 20 nt, Pseudomonas putida KT2440
cuugugcuuccagcugucau

SEQ ID NO: 1603078 - RNA, 15 nt, Pseudomonas putida KT2440
cuugugcaucaaguc

SEQ ID NO: 1603079 - RNA, 20 nt, Pseudomonas putida KT2440
cuugugcaguucgcacagcu

SEQ ID NO: 1603080 - RNA, 14 nt, Pseudomonas putida KT2440
cuugugcggcccuc

SEQ ID NO: 1603081 - RNA, 16 nt, Pseudomonas putida KT2440
cuuguccagcaggcca

SEQ ID NO: 1603082 - RNA, 12 nt, Pseudomonas putida KT2440
cuugugugggcc

SEQ ID NO: 1603083 - RNA, 21 nt, Pseudomonas putida KT2440
cuuguguuuugccuccagcuu

SEQ ID NO: 1603084 - RNA, 19 nt, Pseudomonas putida KT2440
cuuguguugccacccggcu

SEQ ID NO: 1603085 - RNA, 17 nt, Pseudomonas putida KT2440
cuugugugccugcuccg

SEQ ID NO: 1603086 - RNA, 22 nt, Pseudomonas putida KT2440
cuugugugccugcuccggaauc

SEQ ID NO: 1603087 - RNA, 22 nt, Pseudomonas putida KT2440
cuuguuacccgcauaaccacca

SEQ ID NO: 1603088 - RNA, 17 nt, Pseudomonas putida KT2440
cuuguuauggcacugaa

SEQ ID NO: 1603089 - RNA, 15 nt, Pseudomonas putida KT2440
cuuguugguguggca

SEQ ID NO: 1603090 - RNA, 18 nt, Pseudomonas putida KT2440
cuuguucgagcgccauga

SEQ ID NO: 1603091 - RNA, 19 nt, Pseudomonas putida KT2440
cuuguucuguuucaccagc

SEQ ID NO: 1603092 - RNA, 15 nt, Pseudomonas putida KT2440
cuuguugccacccag

SEQ ID NO: 1603093 - RNA, 22 nt, Pseudomonas putida KT2440
cuuguuggccaccaucgccggc

SEQ ID NO: 1603094 - RNA, 17 nt, Pseudomonas putida KT2440
cuuuaaaacuaauauuu

SEQ ID NO: 1603095 - RNA, 19 nt, Pseudomonas putida KT2440
cuugcguuucuucaucccu

SEQ ID NO: 1603096 - RNA, 23 nt, Pseudomonas putida KT2440
cuugcugaugauauuugccacuc

SEQ ID NO: 1603097 - RNA, 17 nt, Pseudomonas putida KT2440
cuugcuccaccaggcca

SEQ ID NO: 1603098 - RNA, 18 nt, Pseudomonas putida KT2440
cuugcuccaccaggccac

SEQ ID NO: 1603099 - RNA, 16 nt, Pseudomonas putida KT2440
cuugcuccaguucauu

SEQ ID NO: 1603100 - RNA, 22 nt, Pseudomonas putida KT2440
cuugcuccaguucauucccggc

SEQ ID NO: 1603101 - RNA, 17 nt, Pseudomonas putida KT2440
cuugcucgcggcgcagg

SEQ ID NO: 1603102 - RNA, 11 nt, Pseudomonas putida KT2440
cuugcgcggcg

SEQ ID NO: 1603103 - RNA, 15 nt, Pseudomonas putida KT2440
cuugcgcggcgcgcc

SEQ ID NO: 1603104 - RNA, 19 nt, Pseudomonas putida KT2440
cuugcgcgccuugcgccag

SEQ ID NO: 1603105 - RNA, 12 nt, Pseudomonas putida KT2440
cuugcgccccag

SEQ ID NO: 1603106 - RNA, 17 nt, Pseudomonas putida KT2440
cuugcaggaagcggcgc

SEQ ID NO: 1603107 - RNA, 21 nt, Pseudomonas putida KT2440
cuugcaggaagcggcgcuuuu

SEQ ID NO: 1603108 - RNA, 18 nt, Pseudomonas putida KT2440
cuugcagcgccgcaucca

SEQ ID NO: 1603109 - RNA, 11 nt, Pseudomonas putida KT2440
cuugcagcgcu

SEQ ID NO: 1603110 - RNA, 19 nt, Pseudomonas putida KT2440
cuugcagccccugcaauuu

SEQ ID NO: 1603111 - RNA, 23 nt, Pseudomonas putida KT2440
cuugccguccagguccaggccag

SEQ ID NO: 1603112 - RNA, 17 nt, Pseudomonas putida KT2440
cuugccgguaccgccac

SEQ ID NO: 1603113 - RNA, 18 nt, Pseudomonas putida KT2440
cuugccgguaccgccacc

SEQ ID NO: 1603114 - RNA, 11 nt, Pseudomonas putida KT2440
cuugccggcaa

SEQ ID NO: 1603115 - RNA, 20 nt, Pseudomonas putida KT2440
cuugcagucaccuggcccac

SEQ ID NO: 1603116 - RNA, 19 nt, Pseudomonas putida KT2440
cuugagcuucagcgcgcca

SEQ ID NO: 1603117 - RNA, 20 nt, Pseudomonas putida KT2440
cuugagcguggcaaacccgg

SEQ ID NO: 1603118 - RNA, 21 nt, Pseudomonas putida KT2440
cuugagcuggccguccagcug

SEQ ID NO: 1603119 - RNA, 23 nt, Pseudomonas putida KT2440
cuugagcuggccguccagcugag

SEQ ID NO: 1603120 - RNA, 18 nt, Pseudomonas putida KT2440
cuugagccuugugcugug

SEQ ID NO: 1603121 - RNA, 13 nt, Pseudomonas putida KT2440
cuugagcgcagcg

SEQ ID NO: 1603122 - RNA, 14 nt, Pseudomonas putida KT2440
cuugagcgcagcga

SEQ ID NO: 1603123 - RNA, 15 nt, Pseudomonas putida KT2440
cuugagcgcgccgcc

SEQ ID NO: 1603124 - RNA, 19 nt, Pseudomonas putida KT2440
cuugauggcggcuucaaga

SEQ ID NO: 1603125 - RNA, 22 nt, Pseudomonas putida KT2440
cuugaugggccagaaauggugu

SEQ ID NO: 1603126 - RNA, 22 nt, Pseudomonas putida KT2440
cuugaugcugucgucaagcucu

SEQ ID NO: 1603127 - RNA, 16 nt, Pseudomonas putida KT2440
cuugcaccaacggcuu

SEQ ID NO: 1603128 - RNA, 17 nt, Pseudomonas putida KT2440
cuugcaccugucccagc

SEQ ID NO: 1603129 - RNA, 21 nt, Pseudomonas putida KT2440
cuugcaccugucccagcuggc

SEQ ID NO: 1603130 - RNA, 22 nt, Pseudomonas putida KT2440
cuugaggggcggcguuuucguu

SEQ ID NO: 1603131 - RNA, 21 nt, Pseudomonas putida KT2440
cuugagguagucgauccaggu

SEQ ID NO: 1603132 - RNA, 16 nt, Pseudomonas putida KT2440
cuugaguucccaggca

SEQ ID NO: 1603133 - RNA, 18 nt, Pseudomonas putida KT2440
cuugaguugaguggggug

SEQ ID NO: 1603134 - RNA, 22 nt, Pseudomonas putida KT2440
cuugaguugagugggguggaag

SEQ ID NO: 1603135 - RNA, 18 nt, Pseudomonas putida KT2440
cuugagguccgccucgau

SEQ ID NO: 1603136 - RNA, 21 nt, Pseudomonas putida KT2440
cuugaggugccauagcaccag

SEQ ID NO: 1603137 - RNA, 22 nt, Pseudomonas putida KT2440
cuugaggugccauagcaccagc

SEQ ID NO: 1603138 - RNA, 18 nt, Pseudomonas putida KT2440
cuucucgaccagcgccag

SEQ ID NO: 1603139 - RNA, 16 nt, Pseudomonas putida KT2440
cuucucgcgcuuggcc

SEQ ID NO: 1603140 - RNA, 14 nt, Pseudomonas putida KT2440
cuucucgcucagca

SEQ ID NO: 1603141 - RNA, 20 nt, Pseudomonas putida KT2440
cuucgcgggcucgcccacuc

SEQ ID NO: 1603142 - RNA, 19 nt, Pseudomonas putida KT2440
cuucgcggguaaacccgcu

SEQ ID NO: 1603143 - RNA, 20 nt, Pseudomonas putida KT2440
cuucgcggguaaacccgcuc

SEQ ID NO: 1603144 - RNA, 20 nt, Pseudomonas putida KT2440
cuucgcgggugaacccgcuc

SEQ ID NO: 1603145 - RNA, 14 nt, Pseudomonas putida KT2440
cuucgcgggcacgc

SEQ ID NO: 1603146 - RNA, 20 nt, Pseudomonas putida KT2440
cuucgcgggcacgcccgcuc

SEQ ID NO: 1603147 - RNA, 12 nt, Pseudomonas putida KT2440
cuucgcgggcau

SEQ ID NO: 1603148 - RNA, 15 nt, Pseudomonas putida KT2440
cuucgcgggcaugcc

SEQ ID NO: 1603149 - RNA, 20 nt, Pseudomonas putida KT2440
cuucgcgggcaugcccgcuc

SEQ ID NO: 1603150 - RNA, 12 nt, Pseudomonas putida KT2440
cuucgcgggcaa

SEQ ID NO: 1603151 - RNA, 16 nt, Pseudomonas putida KT2440
cuucgcgggcaagccc

SEQ ID NO: 1603152 - RNA, 17 nt, Pseudomonas putida KT2440
cuucgcgggcaagcccg

SEQ ID NO: 1603153 - RNA, 18 nt, Pseudomonas putida KT2440
cuucgcgggcaagcccgc

SEQ ID NO: 1603154 - RNA, 20 nt, Pseudomonas putida KT2440
cuucgcgggcaagcccgcuc

SEQ ID NO: 1603155 - RNA, 15 nt, Pseudomonas putida KT2440
cuucugcuucagcuc

SEQ ID NO: 1603156 - RNA, 13 nt, Pseudomonas putida KT2440
cuucugccgguag

SEQ ID NO: 1603157 - RNA, 12 nt, Pseudomonas putida KT2440
cuucugcacucc

SEQ ID NO: 1603158 - RNA, 20 nt, Pseudomonas putida KT2440
cuucucuuccgccagccaac

SEQ ID NO: 1603159 - RNA, 15 nt, Pseudomonas putida KT2440
cuucugaccaaucca

SEQ ID NO: 1603160 - RNA, 18 nt, Pseudomonas putida KT2440
cuucugaccaauccagcc

SEQ ID NO: 1603161 - RNA, 22 nt, Pseudomonas putida KT2440
cuucuugaagcguucagucagu

SEQ ID NO: 1603162 - RNA, 12 nt, Pseudomonas putida KT2440
cuucuugcaaaa

SEQ ID NO: 1603163 - RNA, 17 nt, Pseudomonas putida KT2440
cuucuucggucagcugg

SEQ ID NO: 1603164 - RNA, 18 nt, Pseudomonas putida KT2440
cuucuguggaaaaccgcu

SEQ ID NO: 1603165 - RNA, 17 nt, Pseudomonas putida KT2440
cuucuggcccugggagu

SEQ ID NO: 1603166 - RNA, 21 nt, Pseudomonas putida KT2440
cuucuggcuggagccguccag

SEQ ID NO: 1603167 - RNA, 13 nt, Pseudomonas putida KT2440
cuucuggcugggc

SEQ ID NO: 1603168 - RNA, 15 nt, Pseudomonas putida KT2440
cuucuggcugggcuu

SEQ ID NO: 1603169 - RNA, 18 nt, Pseudomonas putida KT2440
cuggcgcaagccgugccu

SEQ ID NO: 1603170 - RNA, 18 nt, Pseudomonas putida KT2440
cuggcgcgaccaucaccg

SEQ ID NO: 1603171 - RNA, 15 nt, Pseudomonas putida KT2440
cuggccuuccagcug

SEQ ID NO: 1603172 - RNA, 15 nt, Pseudomonas putida KT2440
cuggccugccccagc

SEQ ID NO: 1603173 - RNA, 19 nt, Pseudomonas putida KT2440
cuggcgagaaggcguggug

SEQ ID NO: 1603174 - RNA, 21 nt, Pseudomonas putida KT2440
cuggcgagaaggcguggugca

SEQ ID NO: 1603175 - RNA, 17 nt, Pseudomonas putida KT2440
cuggcgagaauacccau

SEQ ID NO: 1603176 - RNA, 23 nt, Pseudomonas putida KT2440
cuggcgaucgaacaacuguccug

SEQ ID NO: 1603177 - RNA, 14 nt, Pseudomonas putida KT2440
cuggcgaucaggca

SEQ ID NO: 1603178 - RNA, 15 nt, Pseudomonas putida KT2440
cuggcgaucaggcag

SEQ ID NO: 1603179 - RNA, 18 nt, Pseudomonas putida KT2440
cuggccucuucgcgggua

SEQ ID NO: 1603180 - RNA, 15 nt, Pseudomonas putida KT2440
cuggcccggugcaag

SEQ ID NO: 1603181 - RNA, 18 nt, Pseudomonas putida KT2440
cuggcccucugcguggua

SEQ ID NO: 1603182 - RNA, 16 nt, Pseudomonas putida KT2440
cuggcccgcgccaggc

SEQ ID NO: 1603183 - RNA, 23 nt, Pseudomonas putida KT2440
cuggcccgcuugcccgaggaacg

SEQ ID NO: 1603184 - RNA, 15 nt, Pseudomonas putida KT2440
cuggcccgcagcgcu

SEQ ID NO: 1603185 - RNA, 20 nt, Pseudomonas putida KT2440
cuggcggaucugacggcgcu

SEQ ID NO: 1603186 - RNA, 22 nt, Pseudomonas putida KT2440
cuggcgcuuccuuccuggaagc

SEQ ID NO: 1603187 - RNA, 22 nt, Pseudomonas putida KT2440
cuggcgcgauuggacuguggga

SEQ ID NO: 1603188 - RNA, 19 nt, Pseudomonas putida KT2440
cuggcgcucaauggcaccg

SEQ ID NO: 1603189 - RNA, 14 nt, Pseudomonas putida KT2440
cuggcgcuccaugu

SEQ ID NO: 1603190 - RNA, 22 nt, Pseudomonas putida KT2440
cuggcgcuccauguaacgcucc

SEQ ID NO: 1603191 - RNA, 20 nt, Pseudomonas putida KT2440
cuggcaccaguuccagggcg

SEQ ID NO: 1603192 - RNA, 18 nt, Pseudomonas putida KT2440
cuggcagcuucucgcggc

SEQ ID NO: 1603193 - RNA, 18 nt, Pseudomonas putida KT2440
cuggcauaguccaggaag

SEQ ID NO: 1603194 - RNA, 15 nt, Pseudomonas putida KT2440
cuggcaucgccucgu

SEQ ID NO: 1603195 - RNA, 16 nt, Pseudomonas putida KT2440
cuggcaucggucaccg

SEQ ID NO: 1603196 - RNA, 14 nt, Pseudomonas putida KT2440
cuggccacccggcu

SEQ ID NO: 1603197 - RNA, 22 nt, Pseudomonas putida KT2440
cuggccacauggaucagcucau

SEQ ID NO: 1603198 - RNA, 13 nt, Pseudomonas putida KT2440
cuggccaccacca

SEQ ID NO: 1603199 - RNA, 16 nt, Pseudomonas putida KT2440
cuggccaccaccaucu

SEQ ID NO: 1603200 - RNA, 22 nt, Pseudomonas putida KT2440
cuggccaccaccaucucgccca

SEQ ID NO: 1603201 - RNA, 19 nt, Pseudomonas putida KT2440
cuggccaccgaaguucagc

SEQ ID NO: 1603202 - RNA, 23 nt, Pseudomonas putida KT2440
cuggccaaggguuugccaggcgc

SEQ ID NO: 1603203 - RNA, 21 nt, Pseudomonas putida KT2440
cuggccaaggucuccagcacc

SEQ ID NO: 1603204 - RNA, 16 nt, Pseudomonas putida KT2440
cuggccaacuccccac

SEQ ID NO: 1603205 - RNA, 17 nt, Pseudomonas putida KT2440
cuggccaacuccccacc

SEQ ID NO: 1603206 - RNA, 18 nt, Pseudomonas putida KT2440
cuggccaacuccccaccc

SEQ ID NO: 1603207 - RNA, 19 nt, Pseudomonas putida KT2440
cuggccaacuccccaccca

SEQ ID NO: 1603208 - RNA, 15 nt, Pseudomonas putida KT2440
cuggcccgaacagca

SEQ ID NO: 1603209 - RNA, 14 nt, Pseudomonas putida KT2440
cuggcccgaacgca

SEQ ID NO: 1603210 - RNA, 16 nt, Pseudomonas putida KT2440
cuggcccgaacgcagc

SEQ ID NO: 1603211 - RNA, 17 nt, Pseudomonas putida KT2440
cuggcccacgccuucca

SEQ ID NO: 1603212 - RNA, 20 nt, Pseudomonas putida KT2440
cuggcccaguacgccaccca

SEQ ID NO: 1603213 - RNA, 12 nt, Pseudomonas putida KT2440
cuggaggucaug

SEQ ID NO: 1603214 - RNA, 16 nt, Pseudomonas putida KT2440
cuggcaggcucagggc

SEQ ID NO: 1603215 - RNA, 18 nt, Pseudomonas putida KT2440
cuggcaggcucagggcag

SEQ ID NO: 1603216 - RNA, 20 nt, Pseudomonas putida KT2440
cuggcaggcucagggcagca

SEQ ID NO: 1603217 - RNA, 21 nt, Pseudomonas putida KT2440
cuggcaggcucagggcagcaa

SEQ ID NO: 1603218 - RNA, 16 nt, Pseudomonas putida KT2440
cuggcacagaacaaua

SEQ ID NO: 1603219 - RNA, 17 nt, Pseudomonas putida KT2440
cuggcacagaacaauaa

SEQ ID NO: 1603220 - RNA, 18 nt, Pseudomonas putida KT2440
cuggcacagaacaauaaa

SEQ ID NO: 1603221 - RNA, 16 nt, Pseudomonas putida KT2440
cuggcacccacgcgcu

SEQ ID NO: 1603222 - RNA, 16 nt, Pseudomonas putida KT2440
cuggcaaucagcucuu

SEQ ID NO: 1603223 - RNA, 23 nt, Pseudomonas putida KT2440
cuggcaaucagcucuucgaucuc

SEQ ID NO: 1603224 - RNA, 23 nt, Pseudomonas putida KT2440
cuggaauucgcugcgcaucaccc

SEQ ID NO: 1603225 - RNA, 20 nt, Pseudomonas putida KT2440
cuggaagugcugagaggguc

SEQ ID NO: 1603226 - RNA, 13 nt, Pseudomonas putida KT2440
cuggaauaccacc

SEQ ID NO: 1603227 - RNA, 15 nt, Pseudomonas putida KT2440
cuggaauaccaccuc

SEQ ID NO: 1603228 - RNA, 14 nt, Pseudomonas putida KT2440
cuggaacugcugca

SEQ ID NO: 1603229 - RNA, 14 nt, Pseudomonas putida KT2440
cuggaacugguuga

SEQ ID NO: 1603230 - RNA, 17 nt, Pseudomonas putida KT2440
cuggaagagcaggaaga

SEQ ID NO: 1603231 - RNA, 19 nt, Pseudomonas putida KT2440
cuggaaauucucggcugcc

SEQ ID NO: 1603232 - RNA, 20 nt, Pseudomonas putida KT2440
cuggaaauucucggcugccu

SEQ ID NO: 1603233 - RNA, 20 nt, Pseudomonas putida KT2440
cuggacaugcacgccacgcc

SEQ ID NO: 1603234 - RNA, 12 nt, Pseudomonas putida KT2440
cuggacaaucuc

SEQ ID NO: 1603235 - RNA, 17 nt, Pseudomonas putida KT2440
cuggaccccgcccuagc

SEQ ID NO: 1603236 - RNA, 20 nt, Pseudomonas putida KT2440
cuggacccaaucgcugugca

SEQ ID NO: 1603237 - RNA, 21 nt, Pseudomonas putida KT2440
cuggagaucuugucgaccugg

SEQ ID NO: 1603238 - RNA, 19 nt, Pseudomonas putida KT2440
cuggagacgaacagcgccg

SEQ ID NO: 1603239 - RNA, 22 nt, Pseudomonas putida KT2440
cugcuugaacgagccagccagg

SEQ ID NO: 1603240 - RNA, 15 nt, Pseudomonas putida KT2440
cugcuugaacacaua

SEQ ID NO: 1603241 - RNA, 23 nt, Pseudomonas putida KT2440
cugcuugaacacauagaacaggu

SEQ ID NO: 1603242 - RNA, 16 nt, Pseudomonas putida KT2440
cugcucauacugcuga

SEQ ID NO: 1603243 - RNA, 18 nt, Pseudomonas putida KT2440
cugcucauccagcaaaua

SEQ ID NO: 1603244 - RNA, 19 nt, Pseudomonas putida KT2440
cugcucagcuacgcuggac

SEQ ID NO: 1603245 - RNA, 19 nt, Pseudomonas putida KT2440
cugcucagccaaccgcccc

SEQ ID NO: 1603246 - RNA, 14 nt, Pseudomonas putida KT2440
cugcucacccgacc

SEQ ID NO: 1603247 - RNA, 23 nt, Pseudomonas putida KT2440
cugcuauaucucugguacaacaa

SEQ ID NO: 1603248 - RNA, 17 nt, Pseudomonas putida KT2440
cugcuuugggagcagga

SEQ ID NO: 1603249 - RNA, 20 nt, Pseudomonas putida KT2440
cuggaaaagcaaggcucagg

SEQ ID NO: 1603250 - RNA, 14 nt, Pseudomonas putida KT2440
cuggaaaaugcccc

SEQ ID NO: 1603251 - RNA, 20 nt, Pseudomonas putida KT2440
cuggaaaaugcccccgccga

SEQ ID NO: 1603252 - RNA, 22 nt, Pseudomonas putida KT2440
cugcuugcccagauccauguac

SEQ ID NO: 1603253 - RNA, 20 nt, Pseudomonas putida KT2440
cugcuugaucaggcccggcu

SEQ ID NO: 1603254 - RNA, 15 nt, Pseudomonas putida KT2440
cugucccagcuggca

SEQ ID NO: 1603255 - RNA, 23 nt, Pseudomonas putida KT2440
cuguccccccagggcgcaacgcc

SEQ ID NO: 1603256 - RNA, 15 nt, Pseudomonas putida KT2440
cugucgcuacgcgcc

SEQ ID NO: 1603257 - RNA, 16 nt, Pseudomonas putida KT2440
cugucggucacagcag

SEQ ID NO: 1603258 - RNA, 20 nt, Pseudomonas putida KT2440
cugucaguggucuucaaggc

SEQ ID NO: 1603259 - RNA, 18 nt, Pseudomonas putida KT2440
cugucagaacgccgggag

SEQ ID NO: 1603260 - RNA, 19 nt, Pseudomonas putida KT2440
cugucaagcguuuuuugga

SEQ ID NO: 1603261 - RNA, 17 nt, Pseudomonas putida KT2440
cuguauguguguguccg

SEQ ID NO: 1603262 - RNA, 23 nt, Pseudomonas putida KT2440
cuguauguguguguccgccacca

SEQ ID NO: 1603263 - RNA, 17 nt, Pseudomonas putida KT2440
cuggugccggccucuuc

SEQ ID NO: 1603264 - RNA, 21 nt, Pseudomonas putida KT2440
cuguaaccugguuguagcccg

SEQ ID NO: 1603265 - RNA, 21 nt, Pseudomonas putida KT2440
cuguaaugucccgucggccuc

SEQ ID NO: 1603266 - RNA, 18 nt, Pseudomonas putida KT2440
cuguacagcacaccuucc

SEQ ID NO: 1603267 - RNA, 16 nt, Pseudomonas putida KT2440
cuguacaacgcagccg

SEQ ID NO: 1603268 - RNA, 13 nt, Pseudomonas putida KT2440
cuguacacagccc

SEQ ID NO: 1603269 - RNA, 12 nt, Pseudomonas putida KT2440
cuggguccaggc

SEQ ID NO: 1603270 - RNA, 13 nt, Pseudomonas putida KT2440
cuggguccaggca

SEQ ID NO: 1603271 - RNA, 15 nt, Pseudomonas putida KT2440
cuggguccaggcaca

SEQ ID NO: 1603272 - RNA, 16 nt, Pseudomonas putida KT2440
cuggguccaggcacac

SEQ ID NO: 1603273 - RNA, 12 nt, Pseudomonas putida KT2440
cuggggcugacg

SEQ ID NO: 1603274 - RNA, 17 nt, Pseudomonas putida KT2440
cuggggcugcaccgcag

SEQ ID NO: 1603275 - RNA, 20 nt, Pseudomonas putida KT2440
cuggggcugcaccgcagccc

SEQ ID NO: 1603276 - RNA, 21 nt, Pseudomonas putida KT2440
cuggggcugcaccgcagcccc

SEQ ID NO: 1603277 - RNA, 12 nt, Pseudomonas putida KT2440
cuggggccgcaa

SEQ ID NO: 1603278 - RNA, 18 nt, Pseudomonas putida KT2440
cuggggccagccggcgcu

SEQ ID NO: 1603279 - RNA, 22 nt, Pseudomonas putida KT2440
cugggcuucuaccugagcuuca

SEQ ID NO: 1603280 - RNA, 14 nt, Pseudomonas putida KT2440
cugguacagcucac

SEQ ID NO: 1603281 - RNA, 13 nt, Pseudomonas putida KT2440
cugguaauccucg

SEQ ID NO: 1603282 - RNA, 19 nt, Pseudomonas putida KT2440
cugguacaucacacuacac

SEQ ID NO: 1603283 - RNA, 15 nt, Pseudomonas putida KT2440
cugguacaacaacaa

SEQ ID NO: 1603284 - RNA, 16 nt, Pseudomonas putida KT2440
cugguacaacaacaaa

SEQ ID NO: 1603285 - RNA, 19 nt, Pseudomonas putida KT2440
cugguacaacaacaaaaaa

SEQ ID NO: 1603286 - RNA, 20 nt, Pseudomonas putida KT2440
cugguacaacaacaaaaaaa

SEQ ID NO: 1603287 - RNA, 16 nt, Pseudomonas putida KT2440
cugguacagauggcac

SEQ ID NO: 1603288 - RNA, 22 nt, Pseudomonas putida KT2440
cuggguggugucgaccaaaaau

SEQ ID NO: 1603289 - RNA, 20 nt, Pseudomonas putida KT2440
cugggugguaucugccgaug

SEQ ID NO: 1603290 - RNA, 15 nt, Pseudomonas putida KT2440
cugggcuucaugcug

SEQ ID NO: 1603291 - RNA, 21 nt, Pseudomonas putida KT2440
cugggcuucaugcugcugcag

SEQ ID NO: 1603292 - RNA, 22 nt, Pseudomonas putida KT2440
cugggcuucgacaaccggggca

SEQ ID NO: 1603293 - RNA, 22 nt, Pseudomonas putida KT2440
cugggcgaugaucgccuggccg

SEQ ID NO: 1603294 - RNA, 18 nt, Pseudomonas putida KT2440
cugggcgaacgccugcag

SEQ ID NO: 1603295 - RNA, 15 nt, Pseudomonas putida KT2440
cuggcggcugcccgu

SEQ ID NO: 1603296 - RNA, 17 nt, Pseudomonas putida KT2440
cuggcgggcaaacuggc

SEQ ID NO: 1603297 - RNA, 14 nt, Pseudomonas putida KT2440
cuggugaaggcagg

SEQ ID NO: 1603298 - RNA, 15 nt, Pseudomonas putida KT2440
cuggugaaggcaggu

SEQ ID NO: 1603299 - RNA, 20 nt, Pseudomonas putida KT2440
cuggugaaagucgaccagca

SEQ ID NO: 1603300 - RNA, 21 nt, Pseudomonas putida KT2440
cuggugaaagucgaccagcag

SEQ ID NO: 1603301 - RNA, 17 nt, Pseudomonas putida KT2440
cuggugaaucagcccca

SEQ ID NO: 1603302 - RNA, 20 nt, Pseudomonas putida KT2440
cuggugaaucagccccagcc

SEQ ID NO: 1603303 - RNA, 19 nt, Pseudomonas putida KT2440
cuggugcagguugauccag

SEQ ID NO: 1603304 - RNA, 21 nt, Pseudomonas putida KT2440
cuggugcagguugauccagcc

SEQ ID NO: 1603305 - RNA, 22 nt, Pseudomonas putida KT2440
cuggucgaaccaguacugggcg

SEQ ID NO: 1603306 - RNA, 22 nt, Pseudomonas putida KT2440
cuggucgcgugccgccaguucg

SEQ ID NO: 1603307 - RNA, 22 nt, Pseudomonas putida KT2440
cuggucggccuugccgcuguug

SEQ ID NO: 1603308 - RNA, 14 nt, Pseudomonas putida KT2440
cuggucggccaccc

SEQ ID NO: 1603309 - RNA, 21 nt, Pseudomonas putida KT2440
cuggucuucguuacgcccggc

SEQ ID NO: 1603310 - RNA, 22 nt, Pseudomonas putida KT2440
cuggucagucgagucgacagug

SEQ ID NO: 1603311 - RNA, 15 nt, Pseudomonas putida KT2440
cuggucauacuccag

SEQ ID NO: 1603312 - RNA, 20 nt, Pseudomonas putida KT2440
cugguccgggcccaugccac

SEQ ID NO: 1603313 - RNA, 16 nt, Pseudomonas putida KT2440
cugguccgugagaaag

SEQ ID NO: 1603314 - RNA, 16 nt, Pseudomonas putida KT2440
cugguccacgguucug

SEQ ID NO: 1603315 - RNA, 22 nt, Pseudomonas putida KT2440
cugguccacgguucuggcagcu

SEQ ID NO: 1603316 - RNA, 13 nt, Pseudomonas putida KT2440
cuggucacggcca

SEQ ID NO: 1603317 - RNA, 15 nt, Pseudomonas putida KT2440
cuggucaaacaaugc

SEQ ID NO: 1603318 - RNA, 15 nt, Pseudomonas putida KT2440
cuggucacucugccg

SEQ ID NO: 1603319 - RNA, 17 nt, Pseudomonas putida KT2440
cugguacuccacuucca

SEQ ID NO: 1603320 - RNA, 22 nt, Pseudomonas putida KT2440
cugguagucauccucuucguug

SEQ ID NO: 1603321 - RNA, 14 nt, Pseudomonas putida KT2440
cugcguacccagcc

SEQ ID NO: 1603322 - RNA, 16 nt, Pseudomonas putida KT2440
cugcguacccagcccc

SEQ ID NO: 1603323 - RNA, 23 nt, Pseudomonas putida KT2440
cugcggugggcacacaccgggug

SEQ ID NO: 1603324 - RNA, 16 nt, Pseudomonas putida KT2440
cugcgugccugcugcu

SEQ ID NO: 1603325 - RNA, 18 nt, Pseudomonas putida KT2440
cugcgugguaugcauggg

SEQ ID NO: 1603326 - RNA, 12 nt, Pseudomonas putida KT2440
cugcguucaggc

SEQ ID NO: 1603327 - RNA, 14 nt, Pseudomonas putida KT2440
cugcguucaggcag

SEQ ID NO: 1603328 - RNA, 17 nt, Pseudomonas putida KT2440
cugcguucaggcaggaa

SEQ ID NO: 1603329 - RNA, 18 nt, Pseudomonas putida KT2440
cugcguuuaccggcaccg

SEQ ID NO: 1603330 - RNA, 14 nt, Pseudomonas putida KT2440
cugcguuggccauc

SEQ ID NO: 1603331 - RNA, 22 nt, Pseudomonas putida KT2440
cugcguuggcuucuucgcgggc

SEQ ID NO: 1603332 - RNA, 16 nt, Pseudomonas putida KT2440
cugcggucgagcugcc

SEQ ID NO: 1603333 - RNA, 17 nt, Pseudomonas putida KT2440
cugcggggugcucugcc

SEQ ID NO: 1603334 - RNA, 18 nt, Pseudomonas putida KT2440
cugcggggugcucugccg

SEQ ID NO: 1603335 - RNA, 21 nt, Pseudomonas putida KT2440
cugcggguaaagcccgcagug

SEQ ID NO: 1603336 - RNA, 13 nt, Pseudomonas putida KT2440
cugcgggugucga

SEQ ID NO: 1603337 - RNA, 21 nt, Pseudomonas putida KT2440
cugcgggcguuguguugcugg

SEQ ID NO: 1603338 - RNA, 19 nt, Pseudomonas putida KT2440
cugcggcuguucgcagcac

SEQ ID NO: 1603339 - RNA, 16 nt, Pseudomonas putida KT2440
cugcgcagcccuccca

SEQ ID NO: 1603340 - RNA, 24 nt, Pseudomonas putida KT2440
cugcgcaggcgccgccagcugcug

SEQ ID NO: 1603341 - RNA, 21 nt, Pseudomonas putida KT2440
cugcgcaucacccgccccucu

SEQ ID NO: 1603342 - RNA, 22 nt, Pseudomonas putida KT2440
cugcgcaugaaacucgcgcgcg

SEQ ID NO: 1603343 - RNA, 12 nt, Pseudomonas putida KT2440
cugcgccaaagc

SEQ ID NO: 1603344 - RNA, 20 nt, Pseudomonas putida KT2440
cugcgccccagguugcaccu

SEQ ID NO: 1603345 - RNA, 14 nt, Pseudomonas putida KT2440
cugcgcccgcacag

SEQ ID NO: 1603346 - RNA, 19 nt, Pseudomonas putida KT2440
cugcgccccgcucgccugg

SEQ ID NO: 1603347 - RNA, 21 nt, Pseudomonas putida KT2440
cugccugcaauucgcuguaca

SEQ ID NO: 1603348 - RNA, 17 nt, Pseudomonas putida KT2440
cugccugcaggcugccg

SEQ ID NO: 1603349 - RNA, 19 nt, Pseudomonas putida KT2440
cugccugcaugcgugccuu

SEQ ID NO: 1603350 - RNA, 17 nt, Pseudomonas putida KT2440
cugccugauugccuggc

SEQ ID NO: 1603351 - RNA, 17 nt, Pseudomonas putida KT2440
cugccugcugcaacagc

SEQ ID NO: 1603352 - RNA, 14 nt, Pseudomonas putida KT2440
cugccuggccacug

SEQ ID NO: 1603353 - RNA, 15 nt, Pseudomonas putida KT2440
cugccuggccacugu

SEQ ID NO: 1603354 - RNA, 13 nt, Pseudomonas putida KT2440
cugccuggcccuc

SEQ ID NO: 1603355 - RNA, 15 nt, Pseudomonas putida KT2440
cugccugggcaccaa

SEQ ID NO: 1603356 - RNA, 22 nt, Pseudomonas putida KT2440
cugcgccgaucaggaaggccuu

SEQ ID NO: 1603357 - RNA, 18 nt, Pseudomonas putida KT2440
cugcgcccuuugcgggug

SEQ ID NO: 1603358 - RNA, 16 nt, Pseudomonas putida KT2440
cugcgccgagaggcgc

SEQ ID NO: 1603359 - RNA, 17 nt, Pseudomonas putida KT2440
cugcgccugccgggcca

SEQ ID NO: 1603360 - RNA, 13 nt, Pseudomonas putida KT2440
cugcgccugcugg

SEQ ID NO: 1603361 - RNA, 15 nt, Pseudomonas putida KT2440
cugcgcgccauggcg

SEQ ID NO: 1603362 - RNA, 17 nt, Pseudomonas putida KT2440
cugcgcgggaagcccgu

SEQ ID NO: 1603363 - RNA, 12 nt, Pseudomonas putida KT2440
cugcgcggccuu

SEQ ID NO: 1603364 - RNA, 16 nt, Pseudomonas putida KT2440
cugcgcggccuugccg

SEQ ID NO: 1603365 - RNA, 14 nt, Pseudomonas putida KT2440
cugcgcggccacua

SEQ ID NO: 1603366 - RNA, 13 nt, Pseudomonas putida KT2440
cugcgcggcagcc

SEQ ID NO: 1603367 - RNA, 14 nt, Pseudomonas putida KT2440
cugcgcggcagccc

SEQ ID NO: 1603368 - RNA, 16 nt, Pseudomonas putida KT2440
cugcccggcguucagg

SEQ ID NO: 1603369 - RNA, 13 nt, Pseudomonas putida KT2440
cugcccggcugga

SEQ ID NO: 1603370 - RNA, 13 nt, Pseudomonas putida KT2440
cugcccgggccgc

SEQ ID NO: 1603371 - RNA, 19 nt, Pseudomonas putida KT2440
cugcccgggccgcuugcuc

SEQ ID NO: 1603372 - RNA, 20 nt, Pseudomonas putida KT2440
cugcccgggccgcuugcuca

SEQ ID NO: 1603373 - RNA, 21 nt, Pseudomonas putida KT2440
cugcccggcauacuugggcgc

SEQ ID NO: 1603374 - RNA, 16 nt, Pseudomonas putida KT2440
cugcccggccagcagg

SEQ ID NO: 1603375 - RNA, 24 nt, Pseudomonas putida KT2440
cugcccgcgccacccgcugggcuu

SEQ ID NO: 1603376 - RNA, 19 nt, Pseudomonas putida KT2440
cugcccgcgugcgcccaga

SEQ ID NO: 1603377 - RNA, 22 nt, Pseudomonas putida KT2440
cugccccaacugcauccgcccc

SEQ ID NO: 1603378 - RNA, 17 nt, Pseudomonas putida KT2440
cugccaucucgccaagc

SEQ ID NO: 1603379 - RNA, 16 nt, Pseudomonas putida KT2440
cugccaugcaaggcaa

SEQ ID NO: 1603380 - RNA, 14 nt, Pseudomonas putida KT2440
cugccaugcagguc

SEQ ID NO: 1603381 - RNA, 20 nt, Pseudomonas putida KT2440
cugccauagcgcugcaccga

SEQ ID NO: 1603382 - RNA, 17 nt, Pseudomonas putida KT2440
cugccaguucaugcagc

SEQ ID NO: 1603383 - RNA, 15 nt, Pseudomonas putida KT2440
cugccauaagcccaa

SEQ ID NO: 1603384 - RNA, 17 nt, Pseudomonas putida KT2440
cugccauacagccagaa

SEQ ID NO: 1603385 - RNA, 22 nt, Pseudomonas putida KT2440
cugcccagcagccccacgccca

SEQ ID NO: 1603386 - RNA, 14 nt, Pseudomonas putida KT2440
cugcccaggugcca

SEQ ID NO: 1603387 - RNA, 21 nt, Pseudomonas putida KT2440
cugcccaggaucacuggccug

SEQ ID NO: 1603388 - RNA, 19 nt, Pseudomonas putida KT2440
cugccagcugcgcugccug

SEQ ID NO: 1603389 - RNA, 14 nt, Pseudomonas putida KT2440
cugccaggcaaagu

SEQ ID NO: 1603390 - RNA, 15 nt, Pseudomonas putida KT2440
cugccaggaagcucg

SEQ ID NO: 1603391 - RNA, 22 nt, Pseudomonas putida KT2440
cugccaggucaccgcccagcuu

SEQ ID NO: 1603392 - RNA, 14 nt, Pseudomonas putida KT2440
cugccaggccaaac

SEQ ID NO: 1603393 - RNA, 20 nt, Pseudomonas putida KT2440
cugccagucgcacaggucca

SEQ ID NO: 1603394 - RNA, 17 nt, Pseudomonas putida KT2440
cugccaguaaggcuugc

SEQ ID NO: 1603395 - RNA, 19 nt, Pseudomonas putida KT2440
cugccaguaaggcuugcuc

SEQ ID NO: 1603396 - RNA, 22 nt, Pseudomonas putida KT2440
cugccaccccgcaaagcccugc

SEQ ID NO: 1603397 - RNA, 12 nt, Pseudomonas putida KT2440
cugccacccucc

SEQ ID NO: 1603398 - RNA, 18 nt, Pseudomonas putida KT2440
cugccacccacaggcacg

SEQ ID NO: 1603399 - RNA, 16 nt, Pseudomonas putida KT2440
cugccacgcccgcugc

SEQ ID NO: 1603400 - RNA, 22 nt, Pseudomonas putida KT2440
cugccggucguagcgucucagu

SEQ ID NO: 1603401 - RNA, 24 nt, Pseudomonas putida KT2440
cugccggggcuuuguuuacaaccu

SEQ ID NO: 1603402 - RNA, 15 nt, Pseudomonas putida KT2440
cugccgguacagccu

SEQ ID NO: 1603403 - RNA, 19 nt, Pseudomonas putida KT2440
cugccgguacagccuacca

SEQ ID NO: 1603404 - RNA, 19 nt, Pseudomonas putida KT2440
cugccgguaccacugcuuc

SEQ ID NO: 1603405 - RNA, 18 nt, Pseudomonas putida KT2440
cugccgggucaaggccag

SEQ ID NO: 1603406 - RNA, 16 nt, Pseudomonas putida KT2440
cugccgggucggccug

SEQ ID NO: 1603407 - RNA, 22 nt, Pseudomonas putida KT2440
cugccgggucggccugcucgcu

SEQ ID NO: 1603408 - RNA, 21 nt, Pseudomonas putida KT2440
cugccgggcaaagcgggucgc

SEQ ID NO: 1603409 - RNA, 17 nt, Pseudomonas putida KT2440
cugccgggccaccaccg

SEQ ID NO: 1603410 - RNA, 18 nt, Pseudomonas putida KT2440
cugccgggccaccaccgc

SEQ ID NO: 1603411 - RNA, 14 nt, Pseudomonas putida KT2440
cugccuaccaccgc

SEQ ID NO: 1603412 - RNA, 18 nt, Pseudomonas putida KT2440
cugccuacccaggcaacg

SEQ ID NO: 1603413 - RNA, 22 nt, Pseudomonas putida KT2440
cugccucaauaccccgcccucu

SEQ ID NO: 1603414 - RNA, 15 nt, Pseudomonas putida KT2440
cugccgugcagguca

SEQ ID NO: 1603415 - RNA, 19 nt, Pseudomonas putida KT2440
cugccgugaucgccgggcg

SEQ ID NO: 1603416 - RNA, 14 nt, Pseudomonas putida KT2440
cugccguccccaac

SEQ ID NO: 1603417 - RNA, 14 nt, Pseudomonas putida KT2440
cugccgcugaccug

SEQ ID NO: 1603418 - RNA, 15 nt, Pseudomonas putida KT2440
cugccggcaccgugg

SEQ ID NO: 1603419 - RNA, 23 nt, Pseudomonas putida KT2440
cugccggcagggcuuucuucucu

SEQ ID NO: 1603420 - RNA, 16 nt, Pseudomonas putida KT2440
cugccggccagcgccu

SEQ ID NO: 1603421 - RNA, 18 nt, Pseudomonas putida KT2440
cugccggccagcgccugc

SEQ ID NO: 1603422 - RNA, 15 nt, Pseudomonas putida KT2440
cugcccgggcaaagc

SEQ ID NO: 1603423 - RNA, 22 nt, Pseudomonas putida KT2440
cugcccgucaguuugggcgggc

SEQ ID NO: 1603424 - RNA, 19 nt, Pseudomonas putida KT2440
cugccgaaacuccgguaac

SEQ ID NO: 1603425 - RNA, 18 nt, Pseudomonas putida KT2440
cugccgaggccaugugcu

SEQ ID NO: 1603426 - RNA, 22 nt, Pseudomonas putida KT2440
cugccgaugggcacuggccacc

SEQ ID NO: 1603427 - RNA, 15 nt, Pseudomonas putida KT2440
cugaucugccccucg

SEQ ID NO: 1603428 - RNA, 14 nt, Pseudomonas putida KT2440
cugaucucuucagc

SEQ ID NO: 1603429 - RNA, 18 nt, Pseudomonas putida KT2440
cugaucucuucagccacc

SEQ ID NO: 1603430 - RNA, 19 nt, Pseudomonas putida KT2440
cugaucuguaauagccuca

SEQ ID NO: 1603431 - RNA, 16 nt, Pseudomonas putida KT2440
cugaucugcccuuccu

SEQ ID NO: 1603432 - RNA, 14 nt, Pseudomonas putida KT2440
cugaugaaagcgca

SEQ ID NO: 1603433 - RNA, 14 nt, Pseudomonas putida KT2440
cugauuacccugcg

SEQ ID NO: 1603434 - RNA, 22 nt, Pseudomonas putida KT2440
cugauugccuggcuuuccaggu

SEQ ID NO: 1603435 - RNA, 20 nt, Pseudomonas putida KT2440
cugcaaaggcaugggccagg

SEQ ID NO: 1603436 - RNA, 21 nt, Pseudomonas putida KT2440
cugcaaauaccccaggcaaaa

SEQ ID NO: 1603437 - RNA, 17 nt, Pseudomonas putida KT2440
cugcaacucggccuugu

SEQ ID NO: 1603438 - RNA, 16 nt, Pseudomonas putida KT2440
cugcaagguccaggcg

SEQ ID NO: 1603439 - RNA, 18 nt, Pseudomonas putida KT2440
cugcaaggcaaugcccau

SEQ ID NO: 1603440 - RNA, 19 nt, Pseudomonas putida KT2440
cugcaaagcgcgucugaua

SEQ ID NO: 1603441 - RNA, 16 nt, Pseudomonas putida KT2440
cugcaaagcagcccca

SEQ ID NO: 1603442 - RNA, 17 nt, Pseudomonas putida KT2440
cugcaaagcagccccag

SEQ ID NO: 1603443 - RNA, 23 nt, Pseudomonas putida KT2440
cugcaaagcagcccccaacccuc

SEQ ID NO: 1603444 - RNA, 16 nt, Pseudomonas putida KT2440
cugcaaagcagccccg

SEQ ID NO: 1603445 - RNA, 13 nt, Pseudomonas putida KT2440
cugcaaacgcagg

SEQ ID NO: 1603446 - RNA, 21 nt, Pseudomonas putida KT2440
cugcaaucagcucacaggcuc

SEQ ID NO: 1603447 - RNA, 16 nt, Pseudomonas putida KT2440
cugcaaugcagccccu

SEQ ID NO: 1603448 - RNA, 18 nt, Pseudomonas putida KT2440
cugcagaaccgccagcac

SEQ ID NO: 1603449 - RNA, 13 nt, Pseudomonas putida KT2440
cugcacuggccuc

SEQ ID NO: 1603450 - RNA, 17 nt, Pseudomonas putida KT2440
cugcacugcacccucuu

SEQ ID NO: 1603451 - RNA, 12 nt, Pseudomonas putida KT2440
cugcacugccag

SEQ ID NO: 1603452 - RNA, 13 nt, Pseudomonas putida KT2440
cugcacugccagc

SEQ ID NO: 1603453 - RNA, 12 nt, Pseudomonas putida KT2440
cugcacuuccac

SEQ ID NO: 1603454 - RNA, 14 nt, Pseudomonas putida KT2440
cugcacuuccacac

SEQ ID NO: 1603455 - RNA, 15 nt, Pseudomonas putida KT2440
cugcacuuccacacc

SEQ ID NO: 1603456 - RNA, 19 nt, Pseudomonas putida KT2440
cugcacuaagggcaggccu

SEQ ID NO: 1603457 - RNA, 17 nt, Pseudomonas putida KT2440
cugcacgucgcugucuu

SEQ ID NO: 1603458 - RNA, 16 nt, Pseudomonas putida KT2440
cugcacgucgcgcagg

SEQ ID NO: 1603459 - RNA, 19 nt, Pseudomonas putida KT2440
cugcacgucgcgcagggcc

SEQ ID NO: 1603460 - RNA, 20 nt, Pseudomonas putida KT2440
cugcacgucgcgcagggccu

SEQ ID NO: 1603461 - RNA, 18 nt, Pseudomonas putida KT2440
cugcagggcccagccacc

SEQ ID NO: 1603462 - RNA, 14 nt, Pseudomonas putida KT2440
cugcagggccucca

SEQ ID NO: 1603463 - RNA, 18 nt, Pseudomonas putida KT2440
cugcagggaacugcgcga

SEQ ID NO: 1603464 - RNA, 19 nt, Pseudomonas putida KT2440
cugcagauugcaucacuga

SEQ ID NO: 1603465 - RNA, 13 nt, Pseudomonas putida KT2440
cugcaggcucuga

SEQ ID NO: 1603466 - RNA, 17 nt, Pseudomonas putida KT2440
cugcaggcucugaaugu

SEQ ID NO: 1603467 - RNA, 13 nt, Pseudomonas putida KT2440
cugcaggcccagg

SEQ ID NO: 1603468 - RNA, 21 nt, Pseudomonas putida KT2440
cugcagaucaccagcucgccc

SEQ ID NO: 1603469 - RNA, 22 nt, Pseudomonas putida KT2440
cugcagagcgucaaccaggcgc

SEQ ID NO: 1603470 - RNA, 13 nt, Pseudomonas putida KT2440
cugcagagcucag

SEQ ID NO: 1603471 - RNA, 21 nt, Pseudomonas putida KT2440
cugcagguggugguccccuuc

SEQ ID NO: 1603472 - RNA, 20 nt, Pseudomonas putida KT2440
cugcagguaguuuuccagcc

SEQ ID NO: 1603473 - RNA, 19 nt, Pseudomonas putida KT2440
cugcaggucggccagcucg

SEQ ID NO: 1603474 - RNA, 18 nt, Pseudomonas putida KT2440
cugcagguucugaaucug

SEQ ID NO: 1603475 - RNA, 22 nt, Pseudomonas putida KT2440
cugcagguucugaaucuggcuc

SEQ ID NO: 1603476 - RNA, 21 nt, Pseudomonas putida KT2440
cugcagguugaaacguagcag

SEQ ID NO: 1603477 - RNA, 15 nt, Pseudomonas putida KT2440
cugcagugcugggca

SEQ ID NO: 1603478 - RNA, 19 nt, Pseudomonas putida KT2440
cugcagugccucacgcaug

SEQ ID NO: 1603479 - RNA, 13 nt, Pseudomonas putida KT2440
cugcagucagguu

SEQ ID NO: 1603480 - RNA, 14 nt, Pseudomonas putida KT2440
cugcagucagguug

SEQ ID NO: 1603481 - RNA, 22 nt, Pseudomonas putida KT2440
cugcagucagguugcacagcau

SEQ ID NO: 1603482 - RNA, 21 nt, Pseudomonas putida KT2440
cugagggucgugagccugcac

SEQ ID NO: 1603483 - RNA, 19 nt, Pseudomonas putida KT2440
cugaggguuguugaagaag

SEQ ID NO: 1603484 - RNA, 21 nt, Pseudomonas putida KT2440
cugaggguuguugaagaagaa

SEQ ID NO: 1603485 - RNA, 13 nt, Pseudomonas putida KT2440
cugagguucagcg

SEQ ID NO: 1603486 - RNA, 23 nt, Pseudomonas putida KT2440
cugaguauucuccuucuuccaga

SEQ ID NO: 1603487 - RNA, 16 nt, Pseudomonas putida KT2440
cugagucggccucgau

SEQ ID NO: 1603488 - RNA, 13 nt, Pseudomonas putida KT2440
cugaguccgccac

SEQ ID NO: 1603489 - RNA, 20 nt, Pseudomonas putida KT2440
cugaggcccgaagguguuug

SEQ ID NO: 1603490 - RNA, 21 nt, Pseudomonas putida KT2440
cugaggcaccgguucgccgcc

SEQ ID NO: 1603491 - RNA, 16 nt, Pseudomonas putida KT2440
cugagcuucaacgcga

SEQ ID NO: 1603492 - RNA, 20 nt, Pseudomonas putida KT2440
cucuaucaccuguuccccca

SEQ ID NO: 1603493 - RNA, 15 nt, Pseudomonas putida KT2440
cugaucacuugcuca

SEQ ID NO: 1603494 - RNA, 13 nt, Pseudomonas putida KT2440
cugaucagacuuu

SEQ ID NO: 1603495 - RNA, 16 nt, Pseudomonas putida KT2440
cugaucaccgccgcca

SEQ ID NO: 1603496 - RNA, 16 nt, Pseudomonas putida KT2440
cugaucaauccucugc

SEQ ID NO: 1603497 - RNA, 23 nt, Pseudomonas putida KT2440
cugaucaauccucugcccgcagc

SEQ ID NO: 1603498 - RNA, 17 nt, Pseudomonas putida KT2440
cugauccgccuggcccg

SEQ ID NO: 1603499 - RNA, 16 nt, Pseudomonas putida KT2440
cugaucgccuccaggc

SEQ ID NO: 1603500 - RNA, 21 nt, Pseudomonas putida KT2440
cugauccgcuuucggcagugu

SEQ ID NO: 1603501 - RNA, 21 nt, Pseudomonas putida KT2440
cugaucccggccguugaaggc

SEQ ID NO: 1603502 - RNA, 22 nt, Pseudomonas putida KT2440
cugauacgcgacaguucgccac

SEQ ID NO: 1603503 - RNA, 19 nt, Pseudomonas putida KT2440
cugauagcgcuuuuccagu

SEQ ID NO: 1603504 - RNA, 22 nt, Pseudomonas putida KT2440
cugauagcgcuuuuccaguucc

SEQ ID NO: 1603505 - RNA, 16 nt, Pseudomonas putida KT2440
cugauagccagggccu

SEQ ID NO: 1603506 - RNA, 16 nt, Pseudomonas putida KT2440
cuaucucuuccagcgu

SEQ ID NO: 1603507 - RNA, 13 nt, Pseudomonas putida KT2440
cuaucucccagcc

SEQ ID NO: 1603508 - RNA, 14 nt, Pseudomonas putida KT2440
cuaucucccagccu

SEQ ID NO: 1603509 - RNA, 19 nt, Pseudomonas putida KT2440
cuaucugcguuucgcuggc

SEQ ID NO: 1603510 - RNA, 18 nt, Pseudomonas putida KT2440
cuauccuacgcgccaguc

SEQ ID NO: 1603511 - RNA, 21 nt, Pseudomonas putida KT2440
cuauccuacgcgccagucaga

SEQ ID NO: 1603512 - RNA, 15 nt, Pseudomonas putida KT2440
cuagccgccugccgc

SEQ ID NO: 1603513 - RNA, 17 nt, Pseudomonas putida KT2440
cuagaggaucugaaugu

SEQ ID NO: 1603514 - RNA, 13 nt, Pseudomonas putida KT2440
cuagcaaggccuc

SEQ ID NO: 1603515 - RNA, 20 nt, Pseudomonas putida KT2440
cuagcagucccaucugguug

SEQ ID NO: 1603516 - RNA, 21 nt, Pseudomonas putida KT2440
cuagcagucccaucugguugg

SEQ ID NO: 1603517 - RNA, 22 nt, Pseudomonas putida KT2440
cuagaaacagauagaucaugca

SEQ ID NO: 1603518 - RNA, 19 nt, Pseudomonas putida KT2440
cuacuacggccugugucca

SEQ ID NO: 1603519 - RNA, 14 nt, Pseudomonas putida KT2440
cuaccuccagcccg

SEQ ID NO: 1603520 - RNA, 16 nt, Pseudomonas putida KT2440
cuaccuccagcccggc

SEQ ID NO: 1603521 - RNA, 18 nt, Pseudomonas putida KT2440
cuaccuccagcccggcuu

SEQ ID NO: 1603522 - RNA, 17 nt, Pseudomonas putida KT2440
cuaccugagccugcagg

SEQ ID NO: 1603523 - RNA, 19 nt, Pseudomonas putida KT2440
cuacgacccugaagcccug

SEQ ID NO: 1603524 - RNA, 19 nt, Pseudomonas putida KT2440
cuacgcagucagccacauc

SEQ ID NO: 1603525 - RNA, 15 nt, Pseudomonas putida KT2440
cuacgcccccagccu

SEQ ID NO: 1603526 - RNA, 17 nt, Pseudomonas putida KT2440
cuacgcccccagccuug

SEQ ID NO: 1603527 - RNA, 22 nt, Pseudomonas putida KT2440
cuacgccgccccacucgcgcag

SEQ ID NO: 1603528 - RNA, 14 nt, Pseudomonas putida KT2440
cuacgcaggcaccg

SEQ ID NO: 1603529 - RNA, 14 nt, Pseudomonas putida KT2440
cuacgagacggugg

SEQ ID NO: 1603530 - RNA, 20 nt, Pseudomonas putida KT2440
cuacgagacgguggcugcca

SEQ ID NO: 1603531 - RNA, 20 nt, Pseudomonas putida KT2440
cuacgcaaaccaaacgcccg

SEQ ID NO: 1603532 - RNA, 16 nt, Pseudomonas putida KT2440
cuacgcagcacccggu

SEQ ID NO: 1603533 - RNA, 12 nt, Pseudomonas putida KT2440
cuacgcuggacu

SEQ ID NO: 1603534 - RNA, 19 nt, Pseudomonas putida KT2440
cuacgcucguccaggcccu

SEQ ID NO: 1603535 - RNA, 21 nt, Pseudomonas putida KT2440
cuacgcucguccaggcccugc

SEQ ID NO: 1603536 - RNA, 15 nt, Pseudomonas putida KT2440
cuacgucagcuugca

SEQ ID NO: 1603537 - RNA, 17 nt, Pseudomonas putida KT2440
cuacgggggggcgcagg

SEQ ID NO: 1603538 - RNA, 20 nt, Pseudomonas putida KT2440
cuacgggggggcgcagggug

SEQ ID NO: 1603539 - RNA, 14 nt, Pseudomonas putida KT2440
cucaggugcaccuc

SEQ ID NO: 1603540 - RNA, 15 nt, Pseudomonas putida KT2440
cucagguagaccugc

SEQ ID NO: 1603541 - RNA, 18 nt, Pseudomonas putida KT2440
cucagguaggcagcaacg

SEQ ID NO: 1603542 - RNA, 16 nt, Pseudomonas putida KT2440
cucagguggcugucug

SEQ ID NO: 1603543 - RNA, 19 nt, Pseudomonas putida KT2440
cucagguuacgcaccagcu

SEQ ID NO: 1603544 - RNA, 20 nt, Pseudomonas putida KT2440
cucaucaccaggcccgcaag

SEQ ID NO: 1603545 - RNA, 14 nt, Pseudomonas putida KT2440
cucauccuuuuuug

SEQ ID NO: 1603546 - RNA, 23 nt, Pseudomonas putida KT2440
cucaucgaugcccgucccuucau

SEQ ID NO: 1603547 - RNA, 19 nt, Pseudomonas putida KT2440
cucauccucgcccaccagc

SEQ ID NO: 1603548 - RNA, 13 nt, Pseudomonas putida KT2440
cucaucggcggcu

SEQ ID NO: 1603549 - RNA, 23 nt, Pseudomonas putida KT2440
cucaucggcggcuuccagggcug

SEQ ID NO: 1603550 - RNA, 15 nt, Pseudomonas putida KT2440
cucaucggcauugcu

SEQ ID NO: 1603551 - RNA, 13 nt, Pseudomonas putida KT2440
cucaucugccggc

SEQ ID NO: 1603552 - RNA, 14 nt, Pseudomonas putida KT2440
cucaucugccggcg

SEQ ID NO: 1603553 - RNA, 17 nt, Pseudomonas putida KT2440
cucaucugcgccagugg

SEQ ID NO: 1603554 - RNA, 21 nt, Pseudomonas putida KT2440
cucaugggugucggcauacag

SEQ ID NO: 1603555 - RNA, 18 nt, Pseudomonas putida KT2440
cucauggucagccggcag

SEQ ID NO: 1603556 - RNA, 19 nt, Pseudomonas putida KT2440
cucagaaucagcuugccau

SEQ ID NO: 1603557 - RNA, 15 nt, Pseudomonas putida KT2440
cucagaccaacaacu

SEQ ID NO: 1603558 - RNA, 21 nt, Pseudomonas putida KT2440
cucaccggcaaucgacucaag

SEQ ID NO: 1603559 - RNA, 16 nt, Pseudomonas putida KT2440
cucaccggccagcgcg

SEQ ID NO: 1603560 - RNA, 16 nt, Pseudomonas putida KT2440
cucaccuacugccguc

SEQ ID NO: 1603561 - RNA, 22 nt, Pseudomonas putida KT2440
cucagcagguugaacagcagcg

SEQ ID NO: 1603562 - RNA, 16 nt, Pseudomonas putida KT2440
cucagccaggcugagc

SEQ ID NO: 1603563 - RNA, 21 nt, Pseudomonas putida KT2440
cucagccaggcugagcccggc

SEQ ID NO: 1603564 - RNA, 18 nt, Pseudomonas putida KT2440
cucagccacgcuggcacc

SEQ ID NO: 1603565 - RNA, 17 nt, Pseudomonas putida KT2440
cucagccaaccgcccca

SEQ ID NO: 1603566 - RNA, 18 nt, Pseudomonas putida KT2440
cucagccaaccgccccac

SEQ ID NO: 1603567 - RNA, 22 nt, Pseudomonas putida KT2440
cucagcccauuucaccugcucu

SEQ ID NO: 1603568 - RNA, 20 nt, Pseudomonas putida KT2440
cucagcugggcguuuccagg

SEQ ID NO: 1603569 - RNA, 14 nt, Pseudomonas putida KT2440
cucagcugcugcuc

SEQ ID NO: 1603570 - RNA, 14 nt, Pseudomonas putida KT2440
cucagcuuacgccu

SEQ ID NO: 1603571 - RNA, 18 nt, Pseudomonas putida KT2440
cucaccacaucggcggca

SEQ ID NO: 1603572 - RNA, 12 nt, Pseudomonas putida KT2440
cucacauucacc

SEQ ID NO: 1603573 - RNA, 15 nt, Pseudomonas putida KT2440
cucacauucaccgcc

SEQ ID NO: 1603574 - RNA, 10 nt, Pseudomonas putida KT2440
cucaauucca

SEQ ID NO: 1603575 - RNA, 15 nt, Pseudomonas putida KT2440
cucaagucugcauag

SEQ ID NO: 1603576 - RNA, 16 nt, Pseudomonas putida KT2440
cucaagguuguauuua

SEQ ID NO: 1603577 - RNA, 23 nt, Pseudomonas putida KT2440
cucaagggcgcugaucaagcccg

SEQ ID NO: 1603578 - RNA, 17 nt, Pseudomonas putida KT2440
cucaaggcuuuccaccu

SEQ ID NO: 1603579 - RNA, 23 nt, Pseudomonas putida KT2440
cucaagggauuggcaacaaugua

SEQ ID NO: 1603580 - RNA, 17 nt, Pseudomonas putida KT2440
cucaaggccggcagcca

SEQ ID NO: 1603581 - RNA, 21 nt, Pseudomonas putida KT2440
cucaagggguacgaacgccag

SEQ ID NO: 1603582 - RNA, 21 nt, Pseudomonas putida KT2440
cucaagugccuuggcggcgga

SEQ ID NO: 1603583 - RNA, 20 nt, Pseudomonas putida KT2440
cucaacccgccugacgccgc

SEQ ID NO: 1603584 - RNA, 15 nt, Pseudomonas putida KT2440
cucaacccucgccca

SEQ ID NO: 1603585 - RNA, 17 nt, Pseudomonas putida KT2440
cucaaccagcugcgugg

SEQ ID NO: 1603586 - RNA, 13 nt, Pseudomonas putida KT2440
cucaaccuggauu

SEQ ID NO: 1603587 - RNA, 16 nt, Pseudomonas putida KT2440
cuauuaaugcacgccu

SEQ ID NO: 1603588 - RNA, 13 nt, Pseudomonas putida KT2440
cucaaaggcagcc

SEQ ID NO: 1603589 - RNA, 11 nt, Pseudomonas putida KT2440
cucaaaaaaau

SEQ ID NO: 1603590 - RNA, 17 nt, Pseudomonas putida KT2440
cucgcgcuguuccagcc

SEQ ID NO: 1603591 - RNA, 14 nt, Pseudomonas putida KT2440
cucgcgcugccagg

SEQ ID NO: 1603592 - RNA, 15 nt, Pseudomonas putida KT2440
cucgcgcuuggccag

SEQ ID NO: 1603593 - RNA, 14 nt, Pseudomonas putida KT2440
cucgcgcauccagc

SEQ ID NO: 1603594 - RNA, 12 nt, Pseudomonas putida KT2440
cucgcgcagcau

SEQ ID NO: 1603595 - RNA, 13 nt, Pseudomonas putida KT2440
cucgcgcagcaca

SEQ ID NO: 1603596 - RNA, 23 nt, Pseudomonas putida KT2440
cucgcgcaggguuuucagcgccg

SEQ ID NO: 1603597 - RNA, 21 nt, Pseudomonas putida KT2440
cucgccauucaccagcuucag

SEQ ID NO: 1603598 - RNA, 13 nt, Pseudomonas putida KT2440
cucgccagccugc

SEQ ID NO: 1603599 - RNA, 17 nt, Pseudomonas putida KT2440
cucgccagccugcagcg

SEQ ID NO: 1603600 - RNA, 13 nt, Pseudomonas putida KT2440
cucgcccagcagc

SEQ ID NO: 1603601 - RNA, 14 nt, Pseudomonas putida KT2440
cucgcccaccgaca

SEQ ID NO: 1603602 - RNA, 16 nt, Pseudomonas putida KT2440
cucgccggccuuggcg

SEQ ID NO: 1603603 - RNA, 19 nt, Pseudomonas putida KT2440
cucgcucagcaacugggca

SEQ ID NO: 1603604 - RNA, 23 nt, Pseudomonas putida KT2440
cucgcucaggccaugcugcgcca

SEQ ID NO: 1603605 - RNA, 14 nt, Pseudomonas putida KT2440
cucgcucaggcucu

SEQ ID NO: 1603606 - RNA, 13 nt, Pseudomonas putida KT2440
cucgcugccccag

SEQ ID NO: 1603607 - RNA, 16 nt, Pseudomonas putida KT2440
cucgcugccccagucu

SEQ ID NO: 1603608 - RNA, 22 nt, Pseudomonas putida KT2440
cucgauaugccgccguucaggc

SEQ ID NO: 1603609 - RNA, 19 nt, Pseudomonas putida KT2440
cucgaucaccugcggccug

SEQ ID NO: 1603610 - RNA, 22 nt, Pseudomonas putida KT2440
cucgagugcgcugaucgaaagc

SEQ ID NO: 1603611 - RNA, 18 nt, Pseudomonas putida KT2440
cucgaugguuaucuucuc

SEQ ID NO: 1603612 - RNA, 23 nt, Pseudomonas putida KT2440
cucgaugugcgugaacacugcca

SEQ ID NO: 1603613 - RNA, 21 nt, Pseudomonas putida KT2440
cucgauuagcuccaccagcgg

SEQ ID NO: 1603614 - RNA, 15 nt, Pseudomonas putida KT2440
cucgaugggccgcuc

SEQ ID NO: 1603615 - RNA, 19 nt, Pseudomonas putida KT2440
cucgagaaacucacgcaug

SEQ ID NO: 1603616 - RNA, 18 nt, Pseudomonas putida KT2440
cucgaccagaucagccgu

SEQ ID NO: 1603617 - RNA, 14 nt, Pseudomonas putida KT2440
cucgaccaccaucg

SEQ ID NO: 1603618 - RNA, 14 nt, Pseudomonas putida KT2440
cucgacauccagcg

SEQ ID NO: 1603619 - RNA, 13 nt, Pseudomonas putida KT2440
cuccugcagggaa

SEQ ID NO: 1603620 - RNA, 23 nt, Pseudomonas putida KT2440
cuccugcagcaggccgcugagga

SEQ ID NO: 1603621 - RNA, 18 nt, Pseudomonas putida KT2440
cuccugcacauacaaaau

SEQ ID NO: 1603622 - RNA, 15 nt, Pseudomonas putida KT2440
cucgacacccagucg

SEQ ID NO: 1603623 - RNA, 13 nt, Pseudomonas putida KT2440
cucgacagcaacu

SEQ ID NO: 1603624 - RNA, 11 nt, Pseudomonas putida KT2440
cucgacagcca

SEQ ID NO: 1603625 - RNA, 17 nt, Pseudomonas putida KT2440
cucgacagccaccugcc

SEQ ID NO: 1603626 - RNA, 15 nt, Pseudomonas putida KT2440
cuccugauccaccuc

SEQ ID NO: 1603627 - RNA, 22 nt, Pseudomonas putida KT2440
cuccugcagguaucacgcgagc

SEQ ID NO: 1603628 - RNA, 21 nt, Pseudomonas putida KT2440
cucgacaacccgcgcugccuc

SEQ ID NO: 1603629 - RNA, 16 nt, Pseudomonas putida KT2440
cucgucgaacagcaug

SEQ ID NO: 1603630 - RNA, 19 nt, Pseudomonas putida KT2440
cucguccaucuugcugcuc

SEQ ID NO: 1603631 - RNA, 17 nt, Pseudomonas putida KT2440
cucggugugcaccuggu

SEQ ID NO: 1603632 - RNA, 12 nt, Pseudomonas putida KT2440
cucguccaggcc

SEQ ID NO: 1603633 - RNA, 20 nt, Pseudomonas putida KT2440
cucguuucacagcacaaggc

SEQ ID NO: 1603634 - RNA, 18 nt, Pseudomonas putida KT2440
cucuaccacgccgcugcc

SEQ ID NO: 1603635 - RNA, 14 nt, Pseudomonas putida KT2440
cucggugaacaggu

SEQ ID NO: 1603636 - RNA, 14 nt, Pseudomonas putida KT2440
cucggucggcuggc

SEQ ID NO: 1603637 - RNA, 19 nt, Pseudomonas putida KT2440
cucggucggcuggcacucc

SEQ ID NO: 1603638 - RNA, 21 nt, Pseudomonas putida KT2440
cucggucucacaggcgcugaa

SEQ ID NO: 1603639 - RNA, 21 nt, Pseudomonas putida KT2440
cucggucucauaggcgcugaa

SEQ ID NO: 1603640 - RNA, 19 nt, Pseudomonas putida KT2440
cucgguccaccccaugugg

SEQ ID NO: 1603641 - RNA, 16 nt, Pseudomonas putida KT2440
cucggucgacaggggc

SEQ ID NO: 1603642 - RNA, 16 nt, Pseudomonas putida KT2440
cucggcgcucaagcgu

SEQ ID NO: 1603643 - RNA, 23 nt, Pseudomonas putida KT2440
cucggcgcggucaagcucguccu

SEQ ID NO: 1603644 - RNA, 15 nt, Pseudomonas putida KT2440
cucggcgcgugccgc

SEQ ID NO: 1603645 - RNA, 19 nt, Pseudomonas putida KT2440
cucggccggggcaaccugg

SEQ ID NO: 1603646 - RNA, 16 nt, Pseudomonas putida KT2440
cucggcguucagcucg

SEQ ID NO: 1603647 - RNA, 16 nt, Pseudomonas putida KT2440
cucggcguagcaggua

SEQ ID NO: 1603648 - RNA, 18 nt, Pseudomonas putida KT2440
cucggcguagcagguacg

SEQ ID NO: 1603649 - RNA, 12 nt, Pseudomonas putida KT2440
cucggcucuccu

SEQ ID NO: 1603650 - RNA, 18 nt, Pseudomonas putida KT2440
cucgcuggcuuguucggc

SEQ ID NO: 1603651 - RNA, 15 nt, Pseudomonas putida KT2440
cucgcuggccaccag

SEQ ID NO: 1603652 - RNA, 19 nt, Pseudomonas putida KT2440
cucgcuuuccaaaccugcg

SEQ ID NO: 1603653 - RNA, 21 nt, Pseudomonas putida KT2440
cucgcuuuccaaaccugcgac

SEQ ID NO: 1603654 - RNA, 15 nt, Pseudomonas putida KT2440
cucggaugccacgcu

SEQ ID NO: 1603655 - RNA, 23 nt, Pseudomonas putida KT2440
cucggacggugguaucugguagg

SEQ ID NO: 1603656 - RNA, 14 nt, Pseudomonas putida KT2440
cucggacuucagcu

SEQ ID NO: 1603657 - RNA, 17 nt, Pseudomonas putida KT2440
cucggacacgucacuga

SEQ ID NO: 1603658 - RNA, 20 nt, Pseudomonas putida KT2440
cucggacagcuucugguugu

SEQ ID NO: 1603659 - RNA, 21 nt, Pseudomonas putida KT2440
cucgcuucccccaaucuccag

SEQ ID NO: 1603660 - RNA, 21 nt, Pseudomonas putida KT2440
cucggccgcauccugcgugcu

SEQ ID NO: 1603661 - RNA, 23 nt, Pseudomonas putida KT2440
cucggccaguaccaggucgccag

SEQ ID NO: 1603662 - RNA, 15 nt, Pseudomonas putida KT2440
cucggccagguacuc

SEQ ID NO: 1603663 - RNA, 20 nt, Pseudomonas putida KT2440
cucggccagguacucgcgcu

SEQ ID NO: 1603664 - RNA, 23 nt, Pseudomonas putida KT2440
cucggcccauuccgggucgccag

SEQ ID NO: 1603665 - RNA, 14 nt, Pseudomonas putida KT2440
cucccgcugccuuc

SEQ ID NO: 1603666 - RNA, 16 nt, Pseudomonas putida KT2440
cucccgcgcauccucc

SEQ ID NO: 1603667 - RNA, 21 nt, Pseudomonas putida KT2440
cucccgcgcauccuccgcccu

SEQ ID NO: 1603668 - RNA, 23 nt, Pseudomonas putida KT2440
cucccgcgcaugcugccaggcaa

SEQ ID NO: 1603669 - RNA, 13 nt, Pseudomonas putida KT2440
cucccccuccacc

SEQ ID NO: 1603670 - RNA, 24 nt, Pseudomonas putida KT2440
cucccgcacauuucacagcaaaaa

SEQ ID NO: 1603671 - RNA, 12 nt, Pseudomonas putida KT2440
cucccgagccag

SEQ ID NO: 1603672 - RNA, 23 nt, Pseudomonas putida KT2440
cucccgagccaggaagaucacgu

SEQ ID NO: 1603673 - RNA, 18 nt, Pseudomonas putida KT2440
cuccgauuguggccggcg

SEQ ID NO: 1603674 - RNA, 18 nt, Pseudomonas putida KT2440
cuccgaacgccuuggccu

SEQ ID NO: 1603675 - RNA, 20 nt, Pseudomonas putida KT2440
cuccgcacaggcuggccacc

SEQ ID NO: 1603676 - RNA, 23 nt, Pseudomonas putida KT2440
cucccacaggaauggcaccagau

SEQ ID NO: 1603677 - RNA, 24 nt, Pseudomonas putida KT2440
cucccacaggaaugucaccgcggc

SEQ ID NO: 1603678 - RNA, 21 nt, Pseudomonas putida KT2440
cucccacagggaccucacagc

SEQ ID NO: 1603679 - RNA, 22 nt, Pseudomonas putida KT2440
cucccacagggaccucacagcc

SEQ ID NO: 1603680 - RNA, 13 nt, Pseudomonas putida KT2440
cucccacagguaa

SEQ ID NO: 1603681 - RNA, 22 nt, Pseudomonas putida KT2440
cucccacagguaaugcacaagu

SEQ ID NO: 1603682 - RNA, 19 nt, Pseudomonas putida KT2440
cucccacagguccagcgca

SEQ ID NO: 1603683 - RNA, 17 nt, Pseudomonas putida KT2440
cucccacaggugcagca

SEQ ID NO: 1603684 - RNA, 22 nt, Pseudomonas putida KT2440
cucccacaggugcagcacaggu

SEQ ID NO: 1603685 - RNA, 22 nt, Pseudomonas putida KT2440
cucccacagguuuagcgcuggc

SEQ ID NO: 1603686 - RNA, 23 nt, Pseudomonas putida KT2440
cucccacagguuuagcgcuggcu

SEQ ID NO: 1603687 - RNA, 22 nt, Pseudomonas putida KT2440
cucccacaaaggaaauccccau

SEQ ID NO: 1603688 - RNA, 21 nt, Pseudomonas putida KT2440
cuccauggccagggcaaacac

SEQ ID NO: 1603689 - RNA, 22 nt, Pseudomonas putida KT2440
cuccauggccagggcaaacaca

SEQ ID NO: 1603690 - RNA, 16 nt, Pseudomonas putida KT2440
cuccaugucgaauaac

SEQ ID NO: 1603691 - RNA, 18 nt, Pseudomonas putida KT2440
cuccaugucggaagccug

SEQ ID NO: 1603692 - RNA, 22 nt, Pseudomonas putida KT2440
cuccaugggcaggcccagguaa

SEQ ID NO: 1603693 - RNA, 15 nt, Pseudomonas putida KT2440
cuccccaccaggcaa

SEQ ID NO: 1603694 - RNA, 13 nt, Pseudomonas putida KT2440
cucccagcgcugu

SEQ ID NO: 1603695 - RNA, 16 nt, Pseudomonas putida KT2440
cucccaguacaugauc

SEQ ID NO: 1603696 - RNA, 17 nt, Pseudomonas putida KT2440
cuccgccaaaccccagc

SEQ ID NO: 1603697 - RNA, 17 nt, Pseudomonas putida KT2440
cuccgccaauugcgcca

SEQ ID NO: 1603698 - RNA, 14 nt, Pseudomonas putida KT2440
cuccgcccugcccu

SEQ ID NO: 1603699 - RNA, 19 nt, Pseudomonas putida KT2440
cuccgcccguaugcauccg

SEQ ID NO: 1603700 - RNA, 21 nt, Pseudomonas putida KT2440
cuccgcccguaugcauccgcc

SEQ ID NO: 1603701 - RNA, 12 nt, Pseudomonas putida KT2440
cuccgccccaaa

SEQ ID NO: 1603702 - RNA, 19 nt, Pseudomonas putida KT2440
cuccggcccaucccgcuuc

SEQ ID NO: 1603703 - RNA, 23 nt, Pseudomonas putida KT2440
cuccgggugaucauucaggcacg

SEQ ID NO: 1603704 - RNA, 13 nt, Pseudomonas putida KT2440
cuccgggugcggc

SEQ ID NO: 1603705 - RNA, 17 nt, Pseudomonas putida KT2440
cuccgggugcuccuuau

SEQ ID NO: 1603706 - RNA, 20 nt, Pseudomonas putida KT2440
cuccuacaggauggccgcag

SEQ ID NO: 1603707 - RNA, 14 nt, Pseudomonas putida KT2440
cuccuacgaaagcc

SEQ ID NO: 1603708 - RNA, 22 nt, Pseudomonas putida KT2440
cuccuacgacggccugcgcccg

SEQ ID NO: 1603709 - RNA, 20 nt, Pseudomonas putida KT2440
cuccuacgacgggcugagcc

SEQ ID NO: 1603710 - RNA, 17 nt, Pseudomonas putida KT2440
cuccuacgacggucugc

SEQ ID NO: 1603711 - RNA, 19 nt, Pseudomonas putida KT2440
cuccuacggaaucugcacc

SEQ ID NO: 1603712 - RNA, 20 nt, Pseudomonas putida KT2440
cuccucgaucaccugcggcc

SEQ ID NO: 1603713 - RNA, 21 nt, Pseudomonas putida KT2440
cuccucgaucaccugcggccu

SEQ ID NO: 1603714 - RNA, 14 nt, Pseudomonas putida KT2440
cuccucggccagcg

SEQ ID NO: 1603715 - RNA, 19 nt, Pseudomonas putida KT2440
cuccagagaaccgcacacu

SEQ ID NO: 1603716 - RNA, 21 nt, Pseudomonas putida KT2440
cuccagacgcuguacguccaa

SEQ ID NO: 1603717 - RNA, 17 nt, Pseudomonas putida KT2440
cuccagcaagcgcucau

SEQ ID NO: 1603718 - RNA, 18 nt, Pseudomonas putida KT2440
cuccagcaacaucugccg

SEQ ID NO: 1603719 - RNA, 22 nt, Pseudomonas putida KT2440
cuccagcaacaacgccuuggcc

SEQ ID NO: 1603720 - RNA, 15 nt, Pseudomonas putida KT2440
cuccagcacaccgcg

SEQ ID NO: 1603721 - RNA, 14 nt, Pseudomonas putida KT2440
cuccagcagugccg

SEQ ID NO: 1603722 - RNA, 10 nt, Pseudomonas putida KT2440
cuccagcagc

SEQ ID NO: 1603723 - RNA, 14 nt, Pseudomonas putida KT2440
cuccagcagguuca

SEQ ID NO: 1603724 - RNA, 20 nt, Pseudomonas putida KT2440
cuccagccaacggucgauca

SEQ ID NO: 1603725 - RNA, 23 nt, Pseudomonas putida KT2440
cuccagccaacggucgaucagcu

SEQ ID NO: 1603726 - RNA, 13 nt, Pseudomonas putida KT2440
cuccagcaccuga

SEQ ID NO: 1603727 - RNA, 21 nt, Pseudomonas putida KT2440
cuccagcaccgauucaaagcc

SEQ ID NO: 1603728 - RNA, 22 nt, Pseudomonas putida KT2440
cuccagcaccgauucaaagcca

SEQ ID NO: 1603729 - RNA, 13 nt, Pseudomonas putida KT2440
cuccagcaccgcc

SEQ ID NO: 1603730 - RNA, 17 nt, Pseudomonas putida KT2440
cuccagcagcuccacau

SEQ ID NO: 1603731 - RNA, 17 nt, Pseudomonas putida KT2440
cuccagcacuuuugcca

SEQ ID NO: 1603732 - RNA, 23 nt, Pseudomonas putida KT2440
cuccacuggaacucgaucggcac

SEQ ID NO: 1603733 - RNA, 17 nt, Pseudomonas putida KT2440
cuccagaaaaucagggg

SEQ ID NO: 1603734 - RNA, 16 nt, Pseudomonas putida KT2440
cuccacggcaaucggc

SEQ ID NO: 1603735 - RNA, 14 nt, Pseudomonas putida KT2440
cuccaccugcucca

SEQ ID NO: 1603736 - RNA, 17 nt, Pseudomonas putida KT2440
cuccaccugcuccagca

SEQ ID NO: 1603737 - RNA, 13 nt, Pseudomonas putida KT2440
cuccaccuucaau

SEQ ID NO: 1603738 - RNA, 14 nt, Pseudomonas putida KT2440
cuccagcucgcgcg

SEQ ID NO: 1603739 - RNA, 11 nt, Pseudomonas putida KT2440
cuccagcugaa

SEQ ID NO: 1603740 - RNA, 14 nt, Pseudomonas putida KT2440
cuccagcuggccau

SEQ ID NO: 1603741 - RNA, 17 nt, Pseudomonas putida KT2440
cuccagcuuuggcugca

SEQ ID NO: 1603742 - RNA, 23 nt, Pseudomonas putida KT2440
cuccagcuccuggcccgcgcccu

SEQ ID NO: 1603743 - RNA, 14 nt, Pseudomonas putida KT2440
cuccagcuccaggc

SEQ ID NO: 1603744 - RNA, 22 nt, Pseudomonas putida KT2440
cuccagcucaaccccaaaccgc

SEQ ID NO: 1603745 - RNA, 15 nt, Pseudomonas putida KT2440
cuccagcucacagca

SEQ ID NO: 1603746 - RNA, 16 nt, Pseudomonas putida KT2440
cuccagcucacagcac

SEQ ID NO: 1603747 - RNA, 17 nt, Pseudomonas putida KT2440
cuccagcucacagcacu

SEQ ID NO: 1603748 - RNA, 15 nt, Pseudomonas putida KT2440
cuccaggcacaggcg

SEQ ID NO: 1603749 - RNA, 19 nt, Pseudomonas putida KT2440
cuccaggcgaccaugcggc

SEQ ID NO: 1603750 - RNA, 20 nt, Pseudomonas putida KT2440
cuccagcgcgguagauuuca

SEQ ID NO: 1603751 - RNA, 16 nt, Pseudomonas putida KT2440
cuccagccgacggcca

SEQ ID NO: 1603752 - RNA, 18 nt, Pseudomonas putida KT2440
cuccagcccugcucgcca

SEQ ID NO: 1603753 - RNA, 14 nt, Pseudomonas putida KT2440
cuccagccgcugcu

SEQ ID NO: 1603754 - RNA, 15 nt, Pseudomonas putida KT2440
cuccagcgccagcag

SEQ ID NO: 1603755 - RNA, 16 nt, Pseudomonas putida KT2440
cuccagcgccagcagc

SEQ ID NO: 1603756 - RNA, 23 nt, Pseudomonas putida KT2440
cuccagcgccagcagccgggccu

SEQ ID NO: 1603757 - RNA, 19 nt, Pseudomonas putida KT2440
cuccaggugaaucagcggc

SEQ ID NO: 1603758 - RNA, 21 nt, Pseudomonas putida KT2440
cuccaggugaaucagcggcag

SEQ ID NO: 1603759 - RNA, 16 nt, Pseudomonas putida KT2440
cuccagggucugcgcu

SEQ ID NO: 1603760 - RNA, 19 nt, Pseudomonas putida KT2440
cuccagguaauccagcucg

SEQ ID NO: 1603761 - RNA, 19 nt, Pseudomonas putida KT2440
cuccaguucauucccggcc

SEQ ID NO: 1603762 - RNA, 14 nt, Pseudomonas putida KT2440
cuccaucuccagcu

SEQ ID NO: 1603763 - RNA, 16 nt, Pseudomonas putida KT2440
cuccauagguuaucca

SEQ ID NO: 1603764 - RNA, 19 nt, Pseudomonas putida KT2440
cguggccggcaucgcagcg

SEQ ID NO: 1603765 - RNA, 16 nt, Pseudomonas putida KT2440
cguggccacgcccggu

SEQ ID NO: 1603766 - RNA, 22 nt, Pseudomonas putida KT2440
cguggcuugcgacuugugcauc

SEQ ID NO: 1603767 - RNA, 16 nt, Pseudomonas putida KT2440
cguggcugcguucagg

SEQ ID NO: 1603768 - RNA, 19 nt, Pseudomonas putida KT2440
cguggcugcguucaggcag

SEQ ID NO: 1603769 - RNA, 16 nt, Pseudomonas putida KT2440
cguggugcgggccacc

SEQ ID NO: 1603770 - RNA, 17 nt, Pseudomonas putida KT2440
cguggugaauggcgagc

SEQ ID NO: 1603771 - RNA, 23 nt, Pseudomonas putida KT2440
cguggggucugcccggccagcag

SEQ ID NO: 1603772 - RNA, 17 nt, Pseudomonas putida KT2440
cgugggucgggaacagc

SEQ ID NO: 1603773 - RNA, 16 nt, Pseudomonas putida KT2440
cgugggucacgcagag

SEQ ID NO: 1603774 - RNA, 20 nt, Pseudomonas putida KT2440
cgugggucaugucggcagcc

SEQ ID NO: 1603775 - RNA, 14 nt, Pseudomonas putida KT2440
cgugcuuccaccuc

SEQ ID NO: 1603776 - RNA, 19 nt, Pseudomonas putida KT2440
cgugcugcaggcuggcaau

SEQ ID NO: 1603777 - RNA, 14 nt, Pseudomonas putida KT2440
cguggacagcagcu

SEQ ID NO: 1603778 - RNA, 18 nt, Pseudomonas putida KT2440
cguggcaaucuucuugcc

SEQ ID NO: 1603779 - RNA, 22 nt, Pseudomonas putida KT2440
cguggcagcccccccagcaacg

SEQ ID NO: 1603780 - RNA, 16 nt, Pseudomonas putida KT2440
cguggcaggcaguucg

SEQ ID NO: 1603781 - RNA, 19 nt, Pseudomonas putida KT2440
cgugcgccucaugcagcac

SEQ ID NO: 1603782 - RNA, 19 nt, Pseudomonas putida KT2440
cgugcgcuacaagccggcg

SEQ ID NO: 1603783 - RNA, 15 nt, Pseudomonas putida KT2440
cgugcgggcccccuc

SEQ ID NO: 1603784 - RNA, 13 nt, Pseudomonas putida KT2440
cgugcucgcgcau

SEQ ID NO: 1603785 - RNA, 21 nt, Pseudomonas putida KT2440
cgugcucacgccccuuggcac

SEQ ID NO: 1603786 - RNA, 14 nt, Pseudomonas putida KT2440
cgugcucaggcggc

SEQ ID NO: 1603787 - RNA, 18 nt, Pseudomonas putida KT2440
cgugcucaggcggccaaa

SEQ ID NO: 1603788 - RNA, 19 nt, Pseudomonas putida KT2440
cgugguugagguucugcuc

SEQ ID NO: 1603789 - RNA, 23 nt, Pseudomonas putida KT2440
cgugguucuugccgagcagcgcg

SEQ ID NO: 1603790 - RNA, 20 nt, Pseudomonas putida KT2440
cgugguucaucaccagcccc

SEQ ID NO: 1603791 - RNA, 22 nt, Pseudomonas putida KT2440
cguguaguagcuccagcccagc

SEQ ID NO: 1603792 - RNA, 23 nt, Pseudomonas putida KT2440
cgugugcugcguuguugggaagc

SEQ ID NO: 1603793 - RNA, 21 nt, Pseudomonas putida KT2440
cguuaccccguugcgcagcag

SEQ ID NO: 1603794 - RNA, 23 nt, Pseudomonas putida KT2440
cguguucaaugccccgaccaccg

SEQ ID NO: 1603795 - RNA, 13 nt, Pseudomonas putida KT2440
cguguugagcaac

SEQ ID NO: 1603796 - RNA, 14 nt, Pseudomonas putida KT2440
cguuccagccaggc

SEQ ID NO: 1603797 - RNA, 19 nt, Pseudomonas putida KT2440
cguucgcccaggcgccgca

SEQ ID NO: 1603798 - RNA, 19 nt, Pseudomonas putida KT2440
cguucaccguugccgccac

SEQ ID NO: 1603799 - RNA, 16 nt, Pseudomonas putida KT2440
cguuacucccacagcg

SEQ ID NO: 1603800 - RNA, 13 nt, Pseudomonas putida KT2440
cguuuccaggcuu

SEQ ID NO: 1603801 - RNA, 13 nt, Pseudomonas putida KT2440
cguuuccagcaac

SEQ ID NO: 1603802 - RNA, 19 nt, Pseudomonas putida KT2440
cguuuaccugcagcucagc

SEQ ID NO: 1603803 - RNA, 21 nt, Pseudomonas putida KT2440
cguuuaccugcagcucagcca

SEQ ID NO: 1603804 - RNA, 17 nt, Pseudomonas putida KT2440
cguuggccgccagcggc

SEQ ID NO: 1603805 - RNA, 16 nt, Pseudomonas putida KT2440
cguuggccaggucgac

SEQ ID NO: 1603806 - RNA, 16 nt, Pseudomonas putida KT2440
cguuggccaccaccag

SEQ ID NO: 1603807 - RNA, 21 nt, Pseudomonas putida KT2440
cguuggccaaaccguccaggu

SEQ ID NO: 1603808 - RNA, 13 nt, Pseudomonas putida KT2440
cguugcuucugua

SEQ ID NO: 1603809 - RNA, 23 nt, Pseudomonas putida KT2440
cguuugcgaagguaaccugguuc

SEQ ID NO: 1603810 - RNA, 16 nt, Pseudomonas putida KT2440
cguuucgaucucgcca

SEQ ID NO: 1603811 - RNA, 18 nt, Pseudomonas putida KT2440
cuaaaccgcgaugcugca

SEQ ID NO: 1603812 - RNA, 14 nt, Pseudomonas putida KT2440
cuaaagcauuucga

SEQ ID NO: 1603813 - RNA, 14 nt, Pseudomonas putida KT2440
cuaagcagggaaau

SEQ ID NO: 1603814 - RNA, 23 nt, Pseudomonas putida KT2440
cuaagcagggaaaugaccugaag

SEQ ID NO: 1603815 - RNA, 15 nt, Pseudomonas putida KT2440
cuaaccucugcaugc

SEQ ID NO: 1603816 - RNA, 16 nt, Pseudomonas putida KT2440
cgucucgucacuggcu

SEQ ID NO: 1603817 - RNA, 20 nt, Pseudomonas putida KT2440
cgucucuuucaggcacagca

SEQ ID NO: 1603818 - RNA, 17 nt, Pseudomonas putida KT2440
cgucuggaucugaggcg

SEQ ID NO: 1603819 - RNA, 22 nt, Pseudomonas putida KT2440
cgucuugaucacgucggcguca

SEQ ID NO: 1603820 - RNA, 21 nt, Pseudomonas putida KT2440
cgucuuguaguucaucuucuu

SEQ ID NO: 1603821 - RNA, 20 nt, Pseudomonas putida KT2440
cgucuuuuccgugcaaccgc

SEQ ID NO: 1603822 - RNA, 15 nt, Pseudomonas putida KT2440
cgucggucgccccca

SEQ ID NO: 1603823 - RNA, 12 nt, Pseudomonas putida KT2440
cgucgucauggu

SEQ ID NO: 1603824 - RNA, 22 nt, Pseudomonas putida KT2440
cgucggcguggaacaacggcuc

SEQ ID NO: 1603825 - RNA, 17 nt, Pseudomonas putida KT2440
cgucggcgucagccgcg

SEQ ID NO: 1603826 - RNA, 19 nt, Pseudomonas putida KT2440
cgucguccucgaacucaug

SEQ ID NO: 1603827 - RNA, 20 nt, Pseudomonas putida KT2440
cgucucgaugcaauccgcca

SEQ ID NO: 1603828 - RNA, 22 nt, Pseudomonas putida KT2440
cgucucgcaagaagcauuacuu

SEQ ID NO: 1603829 - RNA, 18 nt, Pseudomonas putida KT2440
cgucucgaacggcgccag

SEQ ID NO: 1603830 - RNA, 21 nt, Pseudomonas putida KT2440
cgucucgaacggcgccagcag

SEQ ID NO: 1603831 - RNA, 13 nt, Pseudomonas putida KT2440
cgucguugcaguu

SEQ ID NO: 1603832 - RNA, 13 nt, Pseudomonas putida KT2440
cgugagggggcac

SEQ ID NO: 1603833 - RNA, 16 nt, Pseudomonas putida KT2440
cgugagggggcacgcg

SEQ ID NO: 1603834 - RNA, 18 nt, Pseudomonas putida KT2440
cgugagggggcacgcggc

SEQ ID NO: 1603835 - RNA, 17 nt, Pseudomonas putida KT2440
cgugagccugcacccgc

SEQ ID NO: 1603836 - RNA, 17 nt, Pseudomonas putida KT2440
cgugauagauaucaagc

SEQ ID NO: 1603837 - RNA, 14 nt, Pseudomonas putida KT2440
cgugaucaucagcg

SEQ ID NO: 1603838 - RNA, 14 nt, Pseudomonas putida KT2440
cgugaucaucccca

SEQ ID NO: 1603839 - RNA, 16 nt, Pseudomonas putida KT2440
cgugaucauccccagc

SEQ ID NO: 1603840 - RNA, 20 nt, Pseudomonas putida KT2440
cgugaucauccccagcaugg

SEQ ID NO: 1603841 - RNA, 19 nt, Pseudomonas putida KT2440
cgugaugguaucugccagc

SEQ ID NO: 1603842 - RNA, 21 nt, Pseudomonas putida KT2440
cgugaugguaucugccagcac

SEQ ID NO: 1603843 - RNA, 22 nt, Pseudomonas putida KT2440
cgugaugguaucugccagcacg

SEQ ID NO: 1603844 - RNA, 18 nt, Pseudomonas putida KT2440
cgugaagcggccaccugc

SEQ ID NO: 1603845 - RNA, 13 nt, Pseudomonas putida KT2440
cgugaacuggagg

SEQ ID NO: 1603846 - RNA, 13 nt, Pseudomonas putida KT2440
cgugagaccugca

SEQ ID NO: 1603847 - RNA, 22 nt, Pseudomonas putida KT2440
cgugcacuuucgcggcccagcc

SEQ ID NO: 1603848 - RNA, 19 nt, Pseudomonas putida KT2440
cgugcacgcuugagcgcgc

SEQ ID NO: 1603849 - RNA, 21 nt, Pseudomonas putida KT2440
cgugcacgcuugagcgcgccg

SEQ ID NO: 1603850 - RNA, 23 nt, Pseudomonas putida KT2440
cgugcacgcuugagcgcgccgcc

SEQ ID NO: 1603851 - RNA, 23 nt, Pseudomonas putida KT2440
cgugcacggccuugucagcagcu

SEQ ID NO: 1603852 - RNA, 22 nt, Pseudomonas putida KT2440
cgugcacccaaccugccgaucu

SEQ ID NO: 1603853 - RNA, 17 nt, Pseudomonas putida KT2440
cgugcaaggaucaccaa

SEQ ID NO: 1603854 - RNA, 17 nt, Pseudomonas putida KT2440
cgugcagcugcaccgac

SEQ ID NO: 1603855 - RNA, 19 nt, Pseudomonas putida KT2440
cgugcagguugcuggugga

SEQ ID NO: 1603856 - RNA, 18 nt, Pseudomonas putida KT2440
cgugcaucugcuccccca

SEQ ID NO: 1603857 - RNA, 21 nt, Pseudomonas putida KT2440
cgugcccggcaaucgccaggc

SEQ ID NO: 1603858 - RNA, 23 nt, Pseudomonas putida KT2440
cgugcccggcauccgccucaucc

SEQ ID NO: 1603859 - RNA, 19 nt, Pseudomonas putida KT2440
cgugcccagaucacuucca

SEQ ID NO: 1603860 - RNA, 23 nt, Pseudomonas putida KT2440
cgugccagagaauuucuccccag

SEQ ID NO: 1603861 - RNA, 20 nt, Pseudomonas putida KT2440
cgugcauacacccggucgcu

SEQ ID NO: 1603862 - RNA, 15 nt, Pseudomonas putida KT2440
cgugcauguagccaa

SEQ ID NO: 1603863 - RNA, 19 nt, Pseudomonas putida KT2440
cgugccucgcccaggucaa

SEQ ID NO: 1603864 - RNA, 14 nt, Pseudomonas putida KT2440
cgugccugcugcuc

SEQ ID NO: 1603865 - RNA, 19 nt, Pseudomonas putida KT2440
cgugccugguugcccaugc

SEQ ID NO: 1603866 - RNA, 13 nt, Pseudomonas putida KT2440
cgucgccaaucuc

SEQ ID NO: 1603867 - RNA, 16 nt, Pseudomonas putida KT2440
cgucgccacgcgggcu

SEQ ID NO: 1603868 - RNA, 19 nt, Pseudomonas putida KT2440
cgucgaucuggaugaaguc

SEQ ID NO: 1603869 - RNA, 17 nt, Pseudomonas putida KT2440
cgucgagcaccacggcg

SEQ ID NO: 1603870 - RNA, 20 nt, Pseudomonas putida KT2440
cgucgagcaccacggcggcg

SEQ ID NO: 1603871 - RNA, 19 nt, Pseudomonas putida KT2440
cgucgagcaugaugauguc

SEQ ID NO: 1603872 - RNA, 23 nt, Pseudomonas putida KT2440
cgucgacgacgaucucguccagg

SEQ ID NO: 1603873 - RNA, 14 nt, Pseudomonas putida KT2440
cgucgcggccccag

SEQ ID NO: 1603874 - RNA, 22 nt, Pseudomonas putida KT2440
cgucgcgaugggcugcaaagca

SEQ ID NO: 1603875 - RNA, 15 nt, Pseudomonas putida KT2440
cgucgcgcagggccu

SEQ ID NO: 1603876 - RNA, 22 nt, Pseudomonas putida KT2440
cgucgccugcaaccccuggaaa

SEQ ID NO: 1603877 - RNA, 19 nt, Pseudomonas putida KT2440
cgucgccucaccuccaccg

SEQ ID NO: 1603878 - RNA, 18 nt, Pseudomonas putida KT2440
cgucgccucccccuccac

SEQ ID NO: 1603879 - RNA, 15 nt, Pseudomonas putida KT2440
cgucgccggccggcu

SEQ ID NO: 1603880 - RNA, 18 nt, Pseudomonas putida KT2440
cgucggcgcgcaacagca

SEQ ID NO: 1603881 - RNA, 13 nt, Pseudomonas putida KT2440
cgucggccccggc

SEQ ID NO: 1603882 - RNA, 18 nt, Pseudomonas putida KT2440
cgucggccaugccacccc

SEQ ID NO: 1603883 - RNA, 17 nt, Pseudomonas putida KT2440
cgucgcuggccagcuuc

SEQ ID NO: 1603884 - RNA, 15 nt, Pseudomonas putida KT2440
cgucggcaccggcga

SEQ ID NO: 1603885 - RNA, 21 nt, Pseudomonas putida KT2440
cguccuugagaaccuccgcca

SEQ ID NO: 1603886 - RNA, 23 nt, Pseudomonas putida KT2440
cguccuugagaaccuccgccaac

SEQ ID NO: 1603887 - RNA, 14 nt, Pseudomonas putida KT2440
cgucgaacacggcg

SEQ ID NO: 1603888 - RNA, 16 nt, Pseudomonas putida KT2440
cgucgaacucgcgccc

SEQ ID NO: 1603889 - RNA, 20 nt, Pseudomonas putida KT2440
cgucgaaugcgacugaggca

SEQ ID NO: 1603890 - RNA, 17 nt, Pseudomonas putida KT2440
cgucgaccaggcauugu

SEQ ID NO: 1603891 - RNA, 19 nt, Pseudomonas putida KT2440
cguccucgacccacggcug

SEQ ID NO: 1603892 - RNA, 21 nt, Pseudomonas putida KT2440
cguccucgacccacggcugaa

SEQ ID NO: 1603893 - RNA, 17 nt, Pseudomonas putida KT2440
cguccuggucacggcca

SEQ ID NO: 1603894 - RNA, 16 nt, Pseudomonas putida KT2440
cguccugcccccaaug

SEQ ID NO: 1603895 - RNA, 17 nt, Pseudomonas putida KT2440
cguccggcaaucugccc

SEQ ID NO: 1603896 - RNA, 13 nt, Pseudomonas putida KT2440
cguccgccgcgcu

SEQ ID NO: 1603897 - RNA, 16 nt, Pseudomonas putida KT2440
cgucccugcccgaucg

SEQ ID NO: 1603898 - RNA, 22 nt, Pseudomonas putida KT2440
cgucccugcccgaucgccucgc

SEQ ID NO: 1603899 - RNA, 14 nt, Pseudomonas putida KT2440
cguccgagcggagc

SEQ ID NO: 1603900 - RNA, 17 nt, Pseudomonas putida KT2440
cgucccgaaagggccgc

SEQ ID NO: 1603901 - RNA, 23 nt, Pseudomonas putida KT2440
cgucccgaaagggccgcaaagcg

SEQ ID NO: 1603902 - RNA, 14 nt, Pseudomonas putida KT2440
cguccccgggucca

SEQ ID NO: 1603903 - RNA, 20 nt, Pseudomonas putida KT2440
cguccccggguccaccucug

SEQ ID NO: 1603904 - RNA, 15 nt, Pseudomonas putida KT2440
cguccaucaccgcca

SEQ ID NO: 1603905 - RNA, 18 nt, Pseudomonas putida KT2440
cguccaucuugcugcucu

SEQ ID NO: 1603906 - RNA, 20 nt, Pseudomonas putida KT2440
cguccaucuugcugcucugc

SEQ ID NO: 1603907 - RNA, 18 nt, Pseudomonas putida KT2440
cguccaguuggcggcgca

SEQ ID NO: 1603908 - RNA, 18 nt, Pseudomonas putida KT2440
cguccauguuacggccca

SEQ ID NO: 1603909 - RNA, 17 nt, Pseudomonas putida KT2440
cguccagcucgcgcagg

SEQ ID NO: 1603910 - RNA, 21 nt, Pseudomonas putida KT2440
cguccagcugagcgccaucca

SEQ ID NO: 1603911 - RNA, 18 nt, Pseudomonas putida KT2440
cguccaggaacgcugccu

SEQ ID NO: 1603912 - RNA, 17 nt, Pseudomonas putida KT2440
cguccagguccaggcca

SEQ ID NO: 1603913 - RNA, 22 nt, Pseudomonas putida KT2440
cguccagguccaggccagcuuc

SEQ ID NO: 1603914 - RNA, 17 nt, Pseudomonas putida KT2440
cguccaggcccgccaga

SEQ ID NO: 1603915 - RNA, 17 nt, Pseudomonas putida KT2440
cguacuggcugcacugg

SEQ ID NO: 1603916 - RNA, 17 nt, Pseudomonas putida KT2440
cguccacugcacccgug

SEQ ID NO: 1603917 - RNA, 18 nt, Pseudomonas putida KT2440
cguccacuaccuccagcc

SEQ ID NO: 1603918 - RNA, 20 nt, Pseudomonas putida KT2440
cguccacuaccuccagcccg

SEQ ID NO: 1603919 - RNA, 15 nt, Pseudomonas putida KT2440
cguccacgcgcaggc

SEQ ID NO: 1603920 - RNA, 13 nt, Pseudomonas putida KT2440
cgcggcccacagu

SEQ ID NO: 1603921 - RNA, 14 nt, Pseudomonas putida KT2440
cgcggccugugccc

SEQ ID NO: 1603922 - RNA, 12 nt, Pseudomonas putida KT2440
cgcgggcgcgcc

SEQ ID NO: 1603923 - RNA, 19 nt, Pseudomonas putida KT2440
cgcggcuucgaugcccggc

SEQ ID NO: 1603924 - RNA, 17 nt, Pseudomonas putida KT2440
cgcggcuugcucgcggc

SEQ ID NO: 1603925 - RNA, 14 nt, Pseudomonas putida KT2440
cgcgggagacccgu

SEQ ID NO: 1603926 - RNA, 20 nt, Pseudomonas putida KT2440
cgcggcagcaugaacagcgc

SEQ ID NO: 1603927 - RNA, 21 nt, Pseudomonas putida KT2440
cgcggcagcagcagccccagc

SEQ ID NO: 1603928 - RNA, 20 nt, Pseudomonas putida KT2440
cgcggcagcccuucgcgggc

SEQ ID NO: 1603929 - RNA, 17 nt, Pseudomonas putida KT2440
cgcggcacccaauagcc

SEQ ID NO: 1603930 - RNA, 21 nt, Pseudomonas putida KT2440
cgcggcaccggcuugagcagu

SEQ ID NO: 1603931 - RNA, 15 nt, Pseudomonas putida KT2440
cgcggcaaucacgaa

SEQ ID NO: 1603932 - RNA, 21 nt, Pseudomonas putida KT2440
cgcggcacaacgcgccaccgc

SEQ ID NO: 1603933 - RNA, 22 nt, Pseudomonas putida KT2440
cgcggcacaacgcgccaccgcc

SEQ ID NO: 1603934 - RNA, 17 nt, Pseudomonas putida KT2440
cgcggaucaacccgcga

SEQ ID NO: 1603935 - RNA, 19 nt, Pseudomonas putida KT2440
cgcggaccuugucgccagu

SEQ ID NO: 1603936 - RNA, 23 nt, Pseudomonas putida KT2440
cgcgcugguaagccucgagcgcu

SEQ ID NO: 1603937 - RNA, 19 nt, Pseudomonas putida KT2440
cgcgcuguuccagcccggc

SEQ ID NO: 1603938 - RNA, 15 nt, Pseudomonas putida KT2440
cgcgcuucagggucg

SEQ ID NO: 1603939 - RNA, 18 nt, Pseudomonas putida KT2440
cgcgcuugaagggggcua

SEQ ID NO: 1603940 - RNA, 16 nt, Pseudomonas putida KT2440
cgcgcuuggcggcccu

SEQ ID NO: 1603941 - RNA, 23 nt, Pseudomonas putida KT2440
cgcgcuaaaggccgcuccugcac

SEQ ID NO: 1603942 - RNA, 15 nt, Pseudomonas putida KT2440
cgcgcugccaggccg

SEQ ID NO: 1603943 - RNA, 14 nt, Pseudomonas putida KT2440
cgcgcugcagcucc

SEQ ID NO: 1603944 - RNA, 13 nt, Pseudomonas putida KT2440
cgcgcgcuggcuc

SEQ ID NO: 1603945 - RNA, 22 nt, Pseudomonas putida KT2440
cgcgcggccgccuccugcugcu

SEQ ID NO: 1603946 - RNA, 15 nt, Pseudomonas putida KT2440
cgcgcgggcggcgcu

SEQ ID NO: 1603947 - RNA, 14 nt, Pseudomonas putida KT2440
cgcgcgggcucugu

SEQ ID NO: 1603948 - RNA, 15 nt, Pseudomonas putida KT2440
cgcgcggcucggcca

SEQ ID NO: 1603949 - RNA, 18 nt, Pseudomonas putida KT2440
cgcgcgguucaccagcag

SEQ ID NO: 1603950 - RNA, 18 nt, Pseudomonas putida KT2440
cgcgccuggucgccgcca

SEQ ID NO: 1603951 - RNA, 20 nt, Pseudomonas putida KT2440
cgcgccuugcgccaggugcc

SEQ ID NO: 1603952 - RNA, 19 nt, Pseudomonas putida KT2440
cgcgccuugggcaacaccg

SEQ ID NO: 1603953 - RNA, 12 nt, Pseudomonas putida KT2440
cgcgccuccagc

SEQ ID NO: 1603954 - RNA, 16 nt, Pseudomonas putida KT2440
cgcgcgaaggcccgcu

SEQ ID NO: 1603955 - RNA, 13 nt, Pseudomonas putida KT2440
cgcgcgcccaggc

SEQ ID NO: 1603956 - RNA, 14 nt, Pseudomonas putida KT2440
cgcgcgcccaggcc

SEQ ID NO: 1603957 - RNA, 16 nt, Pseudomonas putida KT2440
cgcgcgaugcgccgcg

SEQ ID NO: 1603958 - RNA, 21 nt, Pseudomonas putida KT2440
cgcgcgccaguucgcggcgca

SEQ ID NO: 1603959 - RNA, 21 nt, Pseudomonas putida KT2440
cgcgcgcauccacaggcgccc

SEQ ID NO: 1603960 - RNA, 22 nt, Pseudomonas putida KT2440
cgcgcgcauccacaggcgcccc

SEQ ID NO: 1603961 - RNA, 13 nt, Pseudomonas putida KT2440
cgcgccugcaccu

SEQ ID NO: 1603962 - RNA, 18 nt, Pseudomonas putida KT2440
cgcgccugcaccuggcug

SEQ ID NO: 1603963 - RNA, 18 nt, Pseudomonas putida KT2440
cgcgccuacagcggccug

SEQ ID NO: 1603964 - RNA, 20 nt, Pseudomonas putida KT2440
cgcgccuacaggcaaccgca

SEQ ID NO: 1603965 - RNA, 21 nt, Pseudomonas putida KT2440
cgccagcaaugcccgcucgcu

SEQ ID NO: 1603966 - RNA, 11 nt, Pseudomonas putida KT2440
cgcuccagcuc

SEQ ID NO: 1603967 - RNA, 21 nt, Pseudomonas putida KT2440
cgcuccagucguggcgcuggc

SEQ ID NO: 1603968 - RNA, 23 nt, Pseudomonas putida KT2440
cgcuccaucaugcgguccugguc

SEQ ID NO: 1603969 - RNA, 16 nt, Pseudomonas putida KT2440
cgcuccauccagucgg

SEQ ID NO: 1603970 - RNA, 20 nt, Pseudomonas putida KT2440
cgcuccauccagucggcgcu

SEQ ID NO: 1603971 - RNA, 13 nt, Pseudomonas putida KT2440
cgcuccaacuggc

SEQ ID NO: 1603972 - RNA, 21 nt, Pseudomonas putida KT2440
cgcuccagcagcuccacaucu

SEQ ID NO: 1603973 - RNA, 18 nt, Pseudomonas putida KT2440
cgcucaugaacagcgccc

SEQ ID NO: 1603974 - RNA, 23 nt, Pseudomonas putida KT2440
cgcuccucggccguaaaguccgu

SEQ ID NO: 1603975 - RNA, 24 nt, Pseudomonas putida KT2440
cgcuccuacaaagcggcgcggccc

SEQ ID NO: 1603976 - RNA, 18 nt, Pseudomonas putida KT2440
cgcuccuacgacggccug

SEQ ID NO: 1603977 - RNA, 19 nt, Pseudomonas putida KT2440
cgcuccuacgacggccugc

SEQ ID NO: 1603978 - RNA, 21 nt, Pseudomonas putida KT2440
cgcuccuacgacggucugcgu

SEQ ID NO: 1603979 - RNA, 23 nt, Pseudomonas putida KT2440
cgcucgaacaacgccucgggcgc

SEQ ID NO: 1603980 - RNA, 16 nt, Pseudomonas putida KT2440
cgcuccugcacaaccc

SEQ ID NO: 1603981 - RNA, 24 nt, Pseudomonas putida KT2440
cgcuccgacaaaugcaccacgcgc

SEQ ID NO: 1603982 - RNA, 19 nt, Pseudomonas putida KT2440
cgcucgagcccgccagcag

SEQ ID NO: 1603983 - RNA, 16 nt, Pseudomonas putida KT2440
cgcucgacgcgcgcag

SEQ ID NO: 1603984 - RNA, 20 nt, Pseudomonas putida KT2440
cgcucgacgcgcgcagccug

SEQ ID NO: 1603985 - RNA, 13 nt, Pseudomonas putida KT2440
cgcucgaccagau

SEQ ID NO: 1603986 - RNA, 14 nt, Pseudomonas putida KT2440
cgcucgacagcaac

SEQ ID NO: 1603987 - RNA, 16 nt, Pseudomonas putida KT2440
cgcucgcccagcagcc

SEQ ID NO: 1603988 - RNA, 17 nt, Pseudomonas putida KT2440
cgcucgcgaauguucuc

SEQ ID NO: 1603989 - RNA, 16 nt, Pseudomonas putida KT2440
cgcucuggcacucaag

SEQ ID NO: 1603990 - RNA, 17 nt, Pseudomonas putida KT2440
cgcucuucaaccgccuc

SEQ ID NO: 1603991 - RNA, 21 nt, Pseudomonas putida KT2440
cgcucuguaucgaacaggcag

SEQ ID NO: 1603992 - RNA, 21 nt, Pseudomonas putida KT2440
cgcugaacaacuccgggugcu

SEQ ID NO: 1603993 - RNA, 19 nt, Pseudomonas putida KT2440
cgcugaacacgcaggucuu

SEQ ID NO: 1603994 - RNA, 15 nt, Pseudomonas putida KT2440
cgcugacgcagggcc

SEQ ID NO: 1603995 - RNA, 13 nt, Pseudomonas putida KT2440
cgcucgcgccgcc

SEQ ID NO: 1603996 - RNA, 17 nt, Pseudomonas putida KT2440
cgcugacuuccagcagc

SEQ ID NO: 1603997 - RNA, 20 nt, Pseudomonas putida KT2440
cgcugagaccgaggggccgc

SEQ ID NO: 1603998 - RNA, 22 nt, Pseudomonas putida KT2440
cgcugcacaggccagccccagc

SEQ ID NO: 1603999 - RNA, 22 nt, Pseudomonas putida KT2440
cgcugcaccgaaggccgccggc

SEQ ID NO: 1604000 - RNA, 17 nt, Pseudomonas putida KT2440
cgcugcacgucgcgcag

SEQ ID NO: 1604001 - RNA, 13 nt, Pseudomonas putida KT2440
cgcugcacuucca

SEQ ID NO: 1604002 - RNA, 15 nt, Pseudomonas putida KT2440
cgcguuggcagcacc

SEQ ID NO: 1604003 - RNA, 13 nt, Pseudomonas putida KT2440
cgcuaccauggcc

SEQ ID NO: 1604004 - RNA, 20 nt, Pseudomonas putida KT2440
cgcuacccaaacucuugagc

SEQ ID NO: 1604005 - RNA, 17 nt, Pseudomonas putida KT2440
cgcuacaccggccugga

SEQ ID NO: 1604006 - RNA, 16 nt, Pseudomonas putida KT2440
cgcguucgcccaggcg

SEQ ID NO: 1604007 - RNA, 20 nt, Pseudomonas putida KT2440
cgcguucacaucgcccuucu

SEQ ID NO: 1604008 - RNA, 13 nt, Pseudomonas putida KT2440
cgcucaccccgcc

SEQ ID NO: 1604009 - RNA, 14 nt, Pseudomonas putida KT2440
cgcucaccccgccc

SEQ ID NO: 1604010 - RNA, 15 nt, Pseudomonas putida KT2440
cgcucaccggccagc

SEQ ID NO: 1604011 - RNA, 19 nt, Pseudomonas putida KT2440
cgcucagugugggggcggc

SEQ ID NO: 1604012 - RNA, 21 nt, Pseudomonas putida KT2440
cgcucagugugggggcggccu

SEQ ID NO: 1604013 - RNA, 20 nt, Pseudomonas putida KT2440
cgcucaacuccauggccagg

SEQ ID NO: 1604014 - RNA, 13 nt, Pseudomonas putida KT2440
cgcgguggagggc

SEQ ID NO: 1604015 - RNA, 19 nt, Pseudomonas putida KT2440
cgcggugccuucaggcgcu

SEQ ID NO: 1604016 - RNA, 12 nt, Pseudomonas putida KT2440
cgcgggcucgcc

SEQ ID NO: 1604017 - RNA, 17 nt, Pseudomonas putida KT2440
cgcgucugccgcagccc

SEQ ID NO: 1604018 - RNA, 19 nt, Pseudomonas putida KT2440
cgcgucucuuucaggcaca

SEQ ID NO: 1604019 - RNA, 21 nt, Pseudomonas putida KT2440
cgcgucucuuucaggcacagc

SEQ ID NO: 1604020 - RNA, 15 nt, Pseudomonas putida KT2440
cgcguguagcccgcu

SEQ ID NO: 1604021 - RNA, 22 nt, Pseudomonas putida KT2440
cgcgugugcucgaggaagcggc

SEQ ID NO: 1604022 - RNA, 14 nt, Pseudomonas putida KT2440
cgcgugugcaggug

SEQ ID NO: 1604023 - RNA, 17 nt, Pseudomonas putida KT2440
cgcgucagcucaagcgc

SEQ ID NO: 1604024 - RNA, 17 nt, Pseudomonas putida KT2440
cgcguaggugcgcggcc

SEQ ID NO: 1604025 - RNA, 18 nt, Pseudomonas putida KT2440
cgcguaguacuccagcag

SEQ ID NO: 1604026 - RNA, 23 nt, Pseudomonas putida KT2440
cgcguauccuugcccaccaggau

SEQ ID NO: 1604027 - RNA, 12 nt, Pseudomonas putida KT2440
cggccacuuaca

SEQ ID NO: 1604028 - RNA, 14 nt, Pseudomonas putida KT2440
cggccacgcgcgcc

SEQ ID NO: 1604029 - RNA, 18 nt, Pseudomonas putida KT2440
cggccaccuugccaucgg

SEQ ID NO: 1604030 - RNA, 21 nt, Pseudomonas putida KT2440
cggccacccggaccagcgccg

SEQ ID NO: 1604031 - RNA, 15 nt, Pseudomonas putida KT2440
cggccaccgaccaug

SEQ ID NO: 1604032 - RNA, 13 nt, Pseudomonas putida KT2440
cggccaccgccgg

SEQ ID NO: 1604033 - RNA, 14 nt, Pseudomonas putida KT2440
cggccaccugcccc

SEQ ID NO: 1604034 - RNA, 17 nt, Pseudomonas putida KT2440
cggccaccugccccagc

SEQ ID NO: 1604035 - RNA, 19 nt, Pseudomonas putida KT2440
cggccaccugccccagcgu

SEQ ID NO: 1604036 - RNA, 13 nt, Pseudomonas putida KT2440
cggccaccagccc

SEQ ID NO: 1604037 - RNA, 14 nt, Pseudomonas putida KT2440
cggccaccaccggg

SEQ ID NO: 1604038 - RNA, 18 nt, Pseudomonas putida KT2440
cggccagggcccgccgcg

SEQ ID NO: 1604039 - RNA, 21 nt, Pseudomonas putida KT2440
cggccaggcucgacggcgcaa

SEQ ID NO: 1604040 - RNA, 13 nt, Pseudomonas putida KT2440
cggccagggcauc

SEQ ID NO: 1604041 - RNA, 22 nt, Pseudomonas putida KT2440
cggccaggccggcgcagauggu

SEQ ID NO: 1604042 - RNA, 22 nt, Pseudomonas putida KT2440
cggccaggccgugcuugaggcc

SEQ ID NO: 1604043 - RNA, 22 nt, Pseudomonas putida KT2440
cggccagcacuacgccggccaa

SEQ ID NO: 1604044 - RNA, 17 nt, Pseudomonas putida KT2440
cggccagcugcgcaccg

SEQ ID NO: 1604045 - RNA, 21 nt, Pseudomonas putida KT2440
cggccagcugcgcaccggcuu

SEQ ID NO: 1604046 - RNA, 22 nt, Pseudomonas putida KT2440
cggccagcugcgcaccggcuuc

SEQ ID NO: 1604047 - RNA, 17 nt, Pseudomonas putida KT2440
cggccagcucgccaaac

SEQ ID NO: 1604048 - RNA, 18 nt, Pseudomonas putida KT2440
cggccaaucgaucugcuc

SEQ ID NO: 1604049 - RNA, 15 nt, Pseudomonas putida KT2440
cggccaaucgcggcc

SEQ ID NO: 1604050 - RNA, 18 nt, Pseudomonas putida KT2440
cggccaaggucagcaagc

SEQ ID NO: 1604051 - RNA, 14 nt, Pseudomonas putida KT2440
cggccacagcgcca

SEQ ID NO: 1604052 - RNA, 22 nt, Pseudomonas putida KT2440
cggccaaugaucgagcgcaccu

SEQ ID NO: 1604053 - RNA, 12 nt, Pseudomonas putida KT2440
cggccaccaccc

SEQ ID NO: 1604054 - RNA, 18 nt, Pseudomonas putida KT2440
cggcauuuccagcgucag

SEQ ID NO: 1604055 - RNA, 16 nt, Pseudomonas putida KT2440
cggcagcucgccgugg

SEQ ID NO: 1604056 - RNA, 13 nt, Pseudomonas putida KT2440
cggcagcugauac

SEQ ID NO: 1604057 - RNA, 21 nt, Pseudomonas putida KT2440
cggcaucugccgggucggccu

SEQ ID NO: 1604058 - RNA, 14 nt, Pseudomonas putida KT2440
cggcagcucaccgg

SEQ ID NO: 1604059 - RNA, 19 nt, Pseudomonas putida KT2440
cggcagcucaccggcaauc

SEQ ID NO: 1604060 - RNA, 21 nt, Pseudomonas putida KT2440
cggcagcucgcgcugcgcagc

SEQ ID NO: 1604061 - RNA, 17 nt, Pseudomonas putida KT2440
cggcaugcacggcagca

SEQ ID NO: 1604062 - RNA, 20 nt, Pseudomonas putida KT2440
cggcaugcacuuccaggaag

SEQ ID NO: 1604063 - RNA, 15 nt, Pseudomonas putida KT2440
cggcauggcgugccc

SEQ ID NO: 1604064 - RNA, 22 nt, Pseudomonas putida KT2440
cggcauggcgugcccggcaauc

SEQ ID NO: 1604065 - RNA, 21 nt, Pseudomonas putida KT2440
cggcauguucaucaccggcca

SEQ ID NO: 1604066 - RNA, 14 nt, Pseudomonas putida KT2440
cggcauguagccac

SEQ ID NO: 1604067 - RNA, 18 nt, Pseudomonas putida KT2440
cggaucaccuggccgugu

SEQ ID NO: 1604068 - RNA, 14 nt, Pseudomonas putida KT2440
cggaucacuuccau

SEQ ID NO: 1604069 - RNA, 19 nt, Pseudomonas putida KT2440
cggaucacuuccauggcau

SEQ ID NO: 1604070 - RNA, 15 nt, Pseudomonas putida KT2440
cggaucagcgcgucc

SEQ ID NO: 1604071 - RNA, 21 nt, Pseudomonas putida KT2440
cggaucagcgcguccagcaac

SEQ ID NO: 1604072 - RNA, 21 nt, Pseudomonas putida KT2440
cggauagcgccgaucagcuua

SEQ ID NO: 1604073 - RNA, 16 nt, Pseudomonas putida KT2440
cggaguggaagauggu

SEQ ID NO: 1604074 - RNA, 15 nt, Pseudomonas putida KT2440
cggauaccgcuggcc

SEQ ID NO: 1604075 - RNA, 15 nt, Pseudomonas putida KT2440
cggaucaucuccaug

SEQ ID NO: 1604076 - RNA, 13 nt, Pseudomonas putida KT2440
cggcaacggccac

SEQ ID NO: 1604077 - RNA, 14 nt, Pseudomonas putida KT2440
cggcaacuggcauc

SEQ ID NO: 1604078 - RNA, 16 nt, Pseudomonas putida KT2440
cggcaacuccuccagc

SEQ ID NO: 1604079 - RNA, 17 nt, Pseudomonas putida KT2440
cggcaacuccuccagcc

SEQ ID NO: 1604080 - RNA, 20 nt, Pseudomonas putida KT2440
cggcaacgauacccacgccc

SEQ ID NO: 1604081 - RNA, 13 nt, Pseudomonas putida KT2440
cggcaacgccagc

SEQ ID NO: 1604082 - RNA, 12 nt, Pseudomonas putida KT2440
cggcaaugguca

SEQ ID NO: 1604083 - RNA, 15 nt, Pseudomonas putida KT2440
cggcaaucugcagca

SEQ ID NO: 1604084 - RNA, 18 nt, Pseudomonas putida KT2440
cggcaaucugcagcagca

SEQ ID NO: 1604085 - RNA, 22 nt, Pseudomonas putida KT2440
cggcaaugaccaagcaacgcaa

SEQ ID NO: 1604086 - RNA, 19 nt, Pseudomonas putida KT2440
cggcaaucgggaucaugcc

SEQ ID NO: 1604087 - RNA, 18 nt, Pseudomonas putida KT2440
cggcaaucaggcugauca

SEQ ID NO: 1604088 - RNA, 15 nt, Pseudomonas putida KT2440
cggcaauaccggcca

SEQ ID NO: 1604089 - RNA, 20 nt, Pseudomonas putida KT2440
cggcaaucacgaacaccagc

SEQ ID NO: 1604090 - RNA, 21 nt, Pseudomonas putida KT2440
cggcaaggcgaccugccagcc

SEQ ID NO: 1604091 - RNA, 20 nt, Pseudomonas putida KT2440
cggcaaggcguaccggcaac

SEQ ID NO: 1604092 - RNA, 17 nt, Pseudomonas putida KT2440
cggcaagguacugaucc

SEQ ID NO: 1604093 - RNA, 16 nt, Pseudomonas putida KT2440
cggcaagcuugccagc

SEQ ID NO: 1604094 - RNA, 14 nt, Pseudomonas putida KT2440
cggcaagccaaagu

SEQ ID NO: 1604095 - RNA, 13 nt, Pseudomonas putida KT2440
cggcacgcgggcc

SEQ ID NO: 1604096 - RNA, 15 nt, Pseudomonas putida KT2440
cggcacgcguacccc

SEQ ID NO: 1604097 - RNA, 21 nt, Pseudomonas putida KT2440
cggcacaacgcgccaccgccg

SEQ ID NO: 1604098 - RNA, 20 nt, Pseudomonas putida KT2440
cggcaauugccaccggcgcu

SEQ ID NO: 1604099 - RNA, 19 nt, Pseudomonas putida KT2440
cggcacacgguuuccaggc

SEQ ID NO: 1604100 - RNA, 23 nt, Pseudomonas putida KT2440
cggcacacgcaccaccccggggc

SEQ ID NO: 1604101 - RNA, 16 nt, Pseudomonas putida KT2440
cggcacaccacgccaa

SEQ ID NO: 1604102 - RNA, 20 nt, Pseudomonas putida KT2440
cggcacaccacgccaaccug

SEQ ID NO: 1604103 - RNA, 17 nt, Pseudomonas putida KT2440
cggcagcaugaacagcg

SEQ ID NO: 1604104 - RNA, 21 nt, Pseudomonas putida KT2440
cggcagcaucgaccugccacu

SEQ ID NO: 1604105 - RNA, 15 nt, Pseudomonas putida KT2440
cggcagccaccgccg

SEQ ID NO: 1604106 - RNA, 19 nt, Pseudomonas putida KT2440
cggcagccaccgccggcca

SEQ ID NO: 1604107 - RNA, 23 nt, Pseudomonas putida KT2440
cggcagccaggguguacuucacc

SEQ ID NO: 1604108 - RNA, 18 nt, Pseudomonas putida KT2440
cggcagaucgagcgccgc

SEQ ID NO: 1604109 - RNA, 16 nt, Pseudomonas putida KT2440
cggcagcaacacgacg

SEQ ID NO: 1604110 - RNA, 21 nt, Pseudomonas putida KT2440
cggcagcaacacgacgauggc

SEQ ID NO: 1604111 - RNA, 14 nt, Pseudomonas putida KT2440
cggcagcagcaaug

SEQ ID NO: 1604112 - RNA, 16 nt, Pseudomonas putida KT2440
cggcagcagcagcccc

SEQ ID NO: 1604113 - RNA, 16 nt, Pseudomonas putida KT2440
cggcacuccagcgagu

SEQ ID NO: 1604114 - RNA, 16 nt, Pseudomonas putida KT2440
cggcagauccugcagc

SEQ ID NO: 1604115 - RNA, 19 nt, Pseudomonas putida KT2440
cggcagauacaaccccaga

SEQ ID NO: 1604116 - RNA, 14 nt, Pseudomonas putida KT2440
cggcagagccggug

SEQ ID NO: 1604117 - RNA, 13 nt, Pseudomonas putida KT2440
cgcuuggccacca

SEQ ID NO: 1604118 - RNA, 14 nt, Pseudomonas putida KT2440
cgcuuggccaccac

SEQ ID NO: 1604119 - RNA, 18 nt, Pseudomonas putida KT2440
cgcuuggucggcgccccu

SEQ ID NO: 1604120 - RNA, 22 nt, Pseudomonas putida KT2440
cgcuuggaaauguucaacagcc

SEQ ID NO: 1604121 - RNA, 23 nt, Pseudomonas putida KT2440
cgcuuggaucuuuucgggcaagg

SEQ ID NO: 1604122 - RNA, 21 nt, Pseudomonas putida KT2440
cgcuuggcaccggcagcagca

SEQ ID NO: 1604123 - RNA, 18 nt, Pseudomonas putida KT2440
cgcuucggcgggguuuuu

SEQ ID NO: 1604124 - RNA, 20 nt, Pseudomonas putida KT2440
cgcuucggugugcuccagcu

SEQ ID NO: 1604125 - RNA, 22 nt, Pseudomonas putida KT2440
cgcuucggugugcuccagcucc

SEQ ID NO: 1604126 - RNA, 23 nt, Pseudomonas putida KT2440
cgcuucggugugcuccagcucca

SEQ ID NO: 1604127 - RNA, 14 nt, Pseudomonas putida KT2440
cgcuucgccgcgcu

SEQ ID NO: 1604128 - RNA, 23 nt, Pseudomonas putida KT2440
cgcuucgcggccaagccgcugcc

SEQ ID NO: 1604129 - RNA, 22 nt, Pseudomonas putida KT2440
cgcuucccccaaucuccagccc

SEQ ID NO: 1604130 - RNA, 17 nt, Pseudomonas putida KT2440
cgcuucggcaugcacgg

SEQ ID NO: 1604131 - RNA, 13 nt, Pseudomonas putida KT2440
cgcuuccuggccu

SEQ ID NO: 1604132 - RNA, 15 nt, Pseudomonas putida KT2440
cgcuuccuggccuuc

SEQ ID NO: 1604133 - RNA, 17 nt, Pseudomonas putida KT2440
cgcuuccuggccuuccu

SEQ ID NO: 1604134 - RNA, 15 nt, Pseudomonas putida KT2440
cgcuucgccagcgcc

SEQ ID NO: 1604135 - RNA, 14 nt, Pseudomonas putida KT2440
cgcuucgaacaccc

SEQ ID NO: 1604136 - RNA, 15 nt, Pseudomonas putida KT2440
cgcuucaccgcgcac

SEQ ID NO: 1604137 - RNA, 19 nt, Pseudomonas putida KT2440
cgcuucaccgcgcaccucc

SEQ ID NO: 1604138 - RNA, 20 nt, Pseudomonas putida KT2440
cgcuucagccuuuuccagcu

SEQ ID NO: 1604139 - RNA, 12 nt, Pseudomonas putida KT2440
cgcugccgccuu

SEQ ID NO: 1604140 - RNA, 19 nt, Pseudomonas putida KT2440
cgcugccaaaguccggcga

SEQ ID NO: 1604141 - RNA, 15 nt, Pseudomonas putida KT2440
cgcugccugcgcuuc

SEQ ID NO: 1604142 - RNA, 19 nt, Pseudomonas putida KT2440
cgcugccuugcccagcucc

SEQ ID NO: 1604143 - RNA, 22 nt, Pseudomonas putida KT2440
cgcugccuugcccagcuccagc

SEQ ID NO: 1604144 - RNA, 15 nt, Pseudomonas putida KT2440
cgcugccuccacacc

SEQ ID NO: 1604145 - RNA, 17 nt, Pseudomonas putida KT2440
cgcugccuuccaaccag

SEQ ID NO: 1604146 - RNA, 16 nt, Pseudomonas putida KT2440
cgcugccuuccgccau

SEQ ID NO: 1604147 - RNA, 23 nt, Pseudomonas putida KT2440
cgcuuuggcagcagccucggccu

SEQ ID NO: 1604148 - RNA, 16 nt, Pseudomonas putida KT2440
cgcuuugcacccgcgc

SEQ ID NO: 1604149 - RNA, 16 nt, Pseudomonas putida KT2440
cgcuugucgccacccg

SEQ ID NO: 1604150 - RNA, 20 nt, Pseudomonas putida KT2440
cgcuugucgagguugcgcuc

SEQ ID NO: 1604151 - RNA, 16 nt, Pseudomonas putida KT2440
cggaagauacccgcca

SEQ ID NO: 1604152 - RNA, 16 nt, Pseudomonas putida KT2440
cggaagcaaccgugac

SEQ ID NO: 1604153 - RNA, 18 nt, Pseudomonas putida KT2440
cggaagcucuccaggguu

SEQ ID NO: 1604154 - RNA, 22 nt, Pseudomonas putida KT2440
cggaaggcaucgaacuccugca

SEQ ID NO: 1604155 - RNA, 16 nt, Pseudomonas putida KT2440
cggaaggggccgcaaa

SEQ ID NO: 1604156 - RNA, 18 nt, Pseudomonas putida KT2440
cggagagguggcagaaca

SEQ ID NO: 1604157 - RNA, 15 nt, Pseudomonas putida KT2440
cggagaacaugaaag

SEQ ID NO: 1604158 - RNA, 23 nt, Pseudomonas putida KT2440
cggacucgacgucguaggcuuug

SEQ ID NO: 1604159 - RNA, 15 nt, Pseudomonas putida KT2440
cggacgucccagcag

SEQ ID NO: 1604160 - RNA, 13 nt, Pseudomonas putida KT2440
cggaaugcccggg

SEQ ID NO: 1604161 - RNA, 20 nt, Pseudomonas putida KT2440
cggaaugcucgucaccaucg

SEQ ID NO: 1604162 - RNA, 23 nt, Pseudomonas putida KT2440
cggaauguuaccggccuggcauu

SEQ ID NO: 1604163 - RNA, 17 nt, Pseudomonas putida KT2440
cggacaggcgcuugacc

SEQ ID NO: 1604164 - RNA, 16 nt, Pseudomonas putida KT2440
cggacagguuggcgcc

SEQ ID NO: 1604165 - RNA, 24 nt, Pseudomonas putida KT2440
cggacccuugugugggccuugcuc

SEQ ID NO: 1604166 - RNA, 21 nt, Pseudomonas putida KT2440
cggacccagcggucagcaucu

SEQ ID NO: 1604167 - RNA, 15 nt, Pseudomonas putida KT2440
cggaccugccgcagc

SEQ ID NO: 1604168 - RNA, 12 nt, Pseudomonas putida KT2440
cguacccggcug

SEQ ID NO: 1604169 - RNA, 19 nt, Pseudomonas putida KT2440
cguacccgccaccccaggc

SEQ ID NO: 1604170 - RNA, 12 nt, Pseudomonas putida KT2440
cguaccagcagg

SEQ ID NO: 1604171 - RNA, 14 nt, Pseudomonas putida KT2440
cguaccagccgcac

SEQ ID NO: 1604172 - RNA, 16 nt, Pseudomonas putida KT2440
cguacaugguguaguc

SEQ ID NO: 1604173 - RNA, 18 nt, Pseudomonas putida KT2440
cguacgcgggcagacuuc

SEQ ID NO: 1604174 - RNA, 13 nt, Pseudomonas putida KT2440
cguacggccuugg

SEQ ID NO: 1604175 - RNA, 16 nt, Pseudomonas putida KT2440
cguacagcugcucacc

SEQ ID NO: 1604176 - RNA, 21 nt, Pseudomonas putida KT2440
cguacagcgacaugccggcca

SEQ ID NO: 1604177 - RNA, 15 nt, Pseudomonas putida KT2440
cgguugaugcagcgc

SEQ ID NO: 1604178 - RNA, 16 nt, Pseudomonas putida KT2440
cgguugcagcacacuc

SEQ ID NO: 1604179 - RNA, 19 nt, Pseudomonas putida KT2440
cgguugcaggacuacaucu

SEQ ID NO: 1604180 - RNA, 13 nt, Pseudomonas putida KT2440
cgguugccaagca

SEQ ID NO: 1604181 - RNA, 21 nt, Pseudomonas putida KT2440
cgguuuuuccaugcgcgcagc

SEQ ID NO: 1604182 - RNA, 20 nt, Pseudomonas putida KT2440
cgguucgaccaauggcugcg

SEQ ID NO: 1604183 - RNA, 22 nt, Pseudomonas putida KT2440
cgguucgaccgacaugccaaag

SEQ ID NO: 1604184 - RNA, 20 nt, Pseudomonas putida KT2440
cgguucuccugugccggccu

SEQ ID NO: 1604185 - RNA, 16 nt, Pseudomonas putida KT2440
cgguucuggucaccca

SEQ ID NO: 1604186 - RNA, 15 nt, Pseudomonas putida KT2440
cgguucugccggggc

SEQ ID NO: 1604187 - RNA, 13 nt, Pseudomonas putida KT2440
cgguucuucgccu

SEQ ID NO: 1604188 - RNA, 14 nt, Pseudomonas putida KT2440
cgguugaccgccgc

SEQ ID NO: 1604189 - RNA, 16 nt, Pseudomonas putida KT2440
cgguugaccgccgcca

SEQ ID NO: 1604190 - RNA, 13 nt, Pseudomonas putida KT2440
cgguggcggccgc

SEQ ID NO: 1604191 - RNA, 20 nt, Pseudomonas putida KT2440
cgguggaaucggcuccaggc

SEQ ID NO: 1604192 - RNA, 17 nt, Pseudomonas putida KT2440
cggugcuuucugcugug

SEQ ID NO: 1604193 - RNA, 15 nt, Pseudomonas putida KT2440
cgguggaagcuggcu

SEQ ID NO: 1604194 - RNA, 15 nt, Pseudomonas putida KT2440
cggugcugccgaggc

SEQ ID NO: 1604195 - RNA, 15 nt, Pseudomonas putida KT2440
cggugcuccuuuauu

SEQ ID NO: 1604196 - RNA, 14 nt, Pseudomonas putida KT2440
cggugcugaccacc

SEQ ID NO: 1604197 - RNA, 17 nt, Pseudomonas putida KT2440
cggugcguacucgacca

SEQ ID NO: 1604198 - RNA, 15 nt, Pseudomonas putida KT2440
cgguguaccauccag

SEQ ID NO: 1604199 - RNA, 21 nt, Pseudomonas putida KT2440
cggugugcuccagcuccaggc

SEQ ID NO: 1604200 - RNA, 20 nt, Pseudomonas putida KT2440
cgguguaucggccaguugcc

SEQ ID NO: 1604201 - RNA, 13 nt, Pseudomonas putida KT2440
cgguggcucacau

SEQ ID NO: 1604202 - RNA, 12 nt, Pseudomonas putida KT2440
cgguggcucucc

SEQ ID NO: 1604203 - RNA, 15 nt, Pseudomonas putida KT2440
cgguggcguggccac

SEQ ID NO: 1604204 - RNA, 20 nt, Pseudomonas putida KT2440
cggugugcugcggccaccgc

SEQ ID NO: 1604205 - RNA, 18 nt, Pseudomonas putida KT2440
cggugccgccugggucag

SEQ ID NO: 1604206 - RNA, 16 nt, Pseudomonas putida KT2440
cggugaauuccuugca

SEQ ID NO: 1604207 - RNA, 16 nt, Pseudomonas putida KT2440
cggucagcauccagcc

SEQ ID NO: 1604208 - RNA, 21 nt, Pseudomonas putida KT2440
cggucagacgcggaacuggcu

SEQ ID NO: 1604209 - RNA, 14 nt, Pseudomonas putida KT2440
cggucagcaccgug

SEQ ID NO: 1604210 - RNA, 15 nt, Pseudomonas putida KT2440
cggucacuggcgaca

SEQ ID NO: 1604211 - RNA, 18 nt, Pseudomonas putida KT2440
cggucuuuuccccuuaua

SEQ ID NO: 1604212 - RNA, 16 nt, Pseudomonas putida KT2440
cggugaaaccaccccg

SEQ ID NO: 1604213 - RNA, 23 nt, Pseudomonas putida KT2440
cggugaaaccaccccggcguuca

SEQ ID NO: 1604214 - RNA, 13 nt, Pseudomonas putida KT2440
cggugaagccgac

SEQ ID NO: 1604215 - RNA, 20 nt, Pseudomonas putida KT2440
cggucugguaacccucgcuc

SEQ ID NO: 1604216 - RNA, 18 nt, Pseudomonas putida KT2440
cggggccucuucgcagca

SEQ ID NO: 1604217 - RNA, 16 nt, Pseudomonas putida KT2440
cggggcccggacaggg

SEQ ID NO: 1604218 - RNA, 15 nt, Pseudomonas putida KT2440
cgggcugcugccgcc

SEQ ID NO: 1604219 - RNA, 16 nt, Pseudomonas putida KT2440
cgggcugcucccgcag

SEQ ID NO: 1604220 - RNA, 16 nt, Pseudomonas putida KT2440
cggggaauggcccagc

SEQ ID NO: 1604221 - RNA, 18 nt, Pseudomonas putida KT2440
cggggaauggcccagcca

SEQ ID NO: 1604222 - RNA, 15 nt, Pseudomonas putida KT2440
cgggccaaggucauc

SEQ ID NO: 1604223 - RNA, 18 nt, Pseudomonas putida KT2440
cgggcugagcccaaccuc

SEQ ID NO: 1604224 - RNA, 21 nt, Pseudomonas putida KT2440
cgggcugagcccaaccucuga

SEQ ID NO: 1604225 - RNA, 22 nt, Pseudomonas putida KT2440
cgggcaugcccgcgaagggcuc

SEQ ID NO: 1604226 - RNA, 14 nt, Pseudomonas putida KT2440
cgggcaugcccgcu

SEQ ID NO: 1604227 - RNA, 17 nt, Pseudomonas putida KT2440
cgggcaugcccgcuccc

SEQ ID NO: 1604228 - RNA, 13 nt, Pseudomonas putida KT2440
cgggccaccaccg

SEQ ID NO: 1604229 - RNA, 13 nt, Pseudomonas putida KT2440
cggguaccaccug

SEQ ID NO: 1604230 - RNA, 17 nt, Pseudomonas putida KT2440
cggguaccaccugggcg

SEQ ID NO: 1604231 - RNA, 20 nt, Pseudomonas putida KT2440
cggguaaauguucucgccgc

SEQ ID NO: 1604232 - RNA, 15 nt, Pseudomonas putida KT2440
cggggugucugggca

SEQ ID NO: 1604233 - RNA, 19 nt, Pseudomonas putida KT2440
cggguaaagcccgcaguga

SEQ ID NO: 1604234 - RNA, 20 nt, Pseudomonas putida KT2440
cggguaagccaugcgcaggc

SEQ ID NO: 1604235 - RNA, 16 nt, Pseudomonas putida KT2440
cggguaagccggcggc

SEQ ID NO: 1604236 - RNA, 19 nt, Pseudomonas putida KT2440
cgggucaugccaccgccac

SEQ ID NO: 1604237 - RNA, 16 nt, Pseudomonas putida KT2440
cgggucauccggccga

SEQ ID NO: 1604238 - RNA, 13 nt, Pseudomonas putida KT2440
cggguccagcaac

SEQ ID NO: 1604239 - RNA, 16 nt, Pseudomonas putida KT2440
cgggucagccugccau

SEQ ID NO: 1604240 - RNA, 17 nt, Pseudomonas putida KT2440
cgggggcagugcccagu

SEQ ID NO: 1604241 - RNA, 16 nt, Pseudomonas putida KT2440
cgggggccccaccagg

SEQ ID NO: 1604242 - RNA, 22 nt, Pseudomonas putida KT2440
cggguaaaacgccccccggcuc

SEQ ID NO: 1604243 - RNA, 20 nt, Pseudomonas putida KT2440
cggguaaacccccuccugau

SEQ ID NO: 1604244 - RNA, 15 nt, Pseudomonas putida KT2440
cggguaaacccgcuc

SEQ ID NO: 1604245 - RNA, 15 nt, Pseudomonas putida KT2440
cgggguguggccaau

SEQ ID NO: 1604246 - RNA, 17 nt, Pseudomonas putida KT2440
cgggucuuccaccaccu

SEQ ID NO: 1604247 - RNA, 15 nt, Pseudomonas putida KT2440
cgggucuacccgcga

SEQ ID NO: 1604248 - RNA, 20 nt, Pseudomonas putida KT2440
cgggucuacccgcgaaaggg

SEQ ID NO: 1604249 - RNA, 12 nt, Pseudomonas putida KT2440
cgggugagcgcg

SEQ ID NO: 1604250 - RNA, 13 nt, Pseudomonas putida KT2440
cgggugaccaggc

SEQ ID NO: 1604251 - RNA, 18 nt, Pseudomonas putida KT2440
cgggugaccaggcccagc

SEQ ID NO: 1604252 - RNA, 20 nt, Pseudomonas putida KT2440
cgggugaccaggcccagcag

SEQ ID NO: 1604253 - RNA, 14 nt, Pseudomonas putida KT2440
cggguccaguuccu

SEQ ID NO: 1604254 - RNA, 16 nt, Pseudomonas putida KT2440
cgggucggcgccaggc

SEQ ID NO: 1604255 - RNA, 14 nt, Pseudomonas putida KT2440
cgggucggccugcu

SEQ ID NO: 1604256 - RNA, 18 nt, Pseudomonas putida KT2440
cggguggagauuggccag

SEQ ID NO: 1604257 - RNA, 21 nt, Pseudomonas putida KT2440
cggguggagauuggccagcag

SEQ ID NO: 1604258 - RNA, 17 nt, Pseudomonas putida KT2440
cggguggaaauuggcca

SEQ ID NO: 1604259 - RNA, 21 nt, Pseudomonas putida KT2440
cggguggaaauuggccagcag

SEQ ID NO: 1604260 - RNA, 19 nt, Pseudomonas putida KT2440
cggguggaaauuggcgagc

SEQ ID NO: 1604261 - RNA, 16 nt, Pseudomonas putida KT2440
cgggugcgagaggcgc

SEQ ID NO: 1604262 - RNA, 12 nt, Pseudomonas putida KT2440
cgggugcccggg

SEQ ID NO: 1604263 - RNA, 22 nt, Pseudomonas putida KT2440
cgggugaacccgcuccugcagg

SEQ ID NO: 1604264 - RNA, 21 nt, Pseudomonas putida KT2440
cgggugcagccgcacccaggc

SEQ ID NO: 1604265 - RNA, 14 nt, Pseudomonas putida KT2440
cgguacccgccagc

SEQ ID NO: 1604266 - RNA, 18 nt, Pseudomonas putida KT2440
cgguacccgccagcaauu

SEQ ID NO: 1604267 - RNA, 14 nt, Pseudomonas putida KT2440
cgguaccgccacca

SEQ ID NO: 1604268 - RNA, 17 nt, Pseudomonas putida KT2440
cgguaccgccaccaauc

SEQ ID NO: 1604269 - RNA, 12 nt, Pseudomonas putida KT2440
cgguaccagcag

SEQ ID NO: 1604270 - RNA, 13 nt, Pseudomonas putida KT2440
cgguaccagcagg

SEQ ID NO: 1604271 - RNA, 21 nt, Pseudomonas putida KT2440
cgguacagccuaccaacgcag

SEQ ID NO: 1604272 - RNA, 17 nt, Pseudomonas putida KT2440
cgguagccccagccggc

SEQ ID NO: 1604273 - RNA, 16 nt, Pseudomonas putida KT2440
cgguaucggccagccg

SEQ ID NO: 1604274 - RNA, 17 nt, Pseudomonas putida KT2440
cgguaucggccagccgu

SEQ ID NO: 1604275 - RNA, 21 nt, Pseudomonas putida KT2440
cgguauucgagaaugugcuuc

SEQ ID NO: 1604276 - RNA, 17 nt, Pseudomonas putida KT2440
cggucacugagccaggc

SEQ ID NO: 1604277 - RNA, 21 nt, Pseudomonas putida KT2440
cgguaaacguggucagccacg

SEQ ID NO: 1604278 - RNA, 18 nt, Pseudomonas putida KT2440
cgguaaagcgcgccucca

SEQ ID NO: 1604279 - RNA, 20 nt, Pseudomonas putida KT2440
cgguaaacaauucccagccu

SEQ ID NO: 1604280 - RNA, 17 nt, Pseudomonas putida KT2440
cgguaacuggcccaccc

SEQ ID NO: 1604281 - RNA, 19 nt, Pseudomonas putida KT2440
cgguaacguggacagcagc

SEQ ID NO: 1604282 - RNA, 16 nt, Pseudomonas putida KT2440
cgguaaugcccgcagg

SEQ ID NO: 1604283 - RNA, 14 nt, Pseudomonas putida KT2440
cggguuuacccgcg

SEQ ID NO: 1604284 - RNA, 15 nt, Pseudomonas putida KT2440
cggguuuacccgcga

SEQ ID NO: 1604285 - RNA, 21 nt, Pseudomonas putida KT2440
cggguuuacccgcgaacaggc

SEQ ID NO: 1604286 - RNA, 14 nt, Pseudomonas putida KT2440
cggguuugcguggu

SEQ ID NO: 1604287 - RNA, 17 nt, Pseudomonas putida KT2440
cggguucaagggcaggg

SEQ ID NO: 1604288 - RNA, 13 nt, Pseudomonas putida KT2440
cggguucuccccc

SEQ ID NO: 1604289 - RNA, 15 nt, Pseudomonas putida KT2440
cggguucucccccau

SEQ ID NO: 1604290 - RNA, 23 nt, Pseudomonas putida KT2440
cggguucucccccaucaguugca

SEQ ID NO: 1604291 - RNA, 19 nt, Pseudomonas putida KT2440
cgggcaaggcaaguuccuu

SEQ ID NO: 1604292 - RNA, 23 nt, Pseudomonas putida KT2440
cgggcaaggucgaugcugcugag

SEQ ID NO: 1604293 - RNA, 14 nt, Pseudomonas putida KT2440
cgggcaacugcgcc

SEQ ID NO: 1604294 - RNA, 13 nt, Pseudomonas putida KT2440
cgggcaagcccgc

SEQ ID NO: 1604295 - RNA, 14 nt, Pseudomonas putida KT2440
cgggcaagcccgca

SEQ ID NO: 1604296 - RNA, 14 nt, Pseudomonas putida KT2440
cgggcaagcccgcu

SEQ ID NO: 1604297 - RNA, 22 nt, Pseudomonas putida KT2440
cgggcaagcccgcucccacagg

SEQ ID NO: 1604298 - RNA, 20 nt, Pseudomonas putida KT2440
cgggcaaagcgggucgccag

SEQ ID NO: 1604299 - RNA, 16 nt, Pseudomonas putida KT2440
cgggauuugccgucgc

SEQ ID NO: 1604300 - RNA, 18 nt, Pseudomonas putida KT2440
cgggauuguucccacagg

SEQ ID NO: 1604301 - RNA, 16 nt, Pseudomonas putida KT2440
cgggcaaacaggcuga

SEQ ID NO: 1604302 - RNA, 23 nt, Pseudomonas putida KT2440
cgggcagaccugcuggcacugcg

SEQ ID NO: 1604303 - RNA, 13 nt, Pseudomonas putida KT2440
cgggcagacgacc

SEQ ID NO: 1604304 - RNA, 13 nt, Pseudomonas putida KT2440
cgggcaauggcca

SEQ ID NO: 1604305 - RNA, 19 nt, Pseudomonas putida KT2440
cgggaugcucugcagcagc

SEQ ID NO: 1604306 - RNA, 20 nt, Pseudomonas putida KT2440
cgggaugcucugcagcagcg

SEQ ID NO: 1604307 - RNA, 17 nt, Pseudomonas putida KT2440
cgggauggcaccggcag

SEQ ID NO: 1604308 - RNA, 19 nt, Pseudomonas putida KT2440
cgggaugguaacgggcaaa

SEQ ID NO: 1604309 - RNA, 15 nt, Pseudomonas putida KT2440
cgggauaaccgcaga

SEQ ID NO: 1604310 - RNA, 20 nt, Pseudomonas putida KT2440
cgggauaaccgcagauggcc

SEQ ID NO: 1604311 - RNA, 23 nt, Pseudomonas putida KT2440
cgggaucaccgcaagcugcaccg

SEQ ID NO: 1604312 - RNA, 16 nt, Pseudomonas putida KT2440
cgggaucagcacgccc

SEQ ID NO: 1604313 - RNA, 14 nt, Pseudomonas putida KT2440
cgggaacagcagca

SEQ ID NO: 1604314 - RNA, 17 nt, Pseudomonas putida KT2440
cgggaacagcagcaccg

SEQ ID NO: 1604315 - RNA, 21 nt, Pseudomonas putida KT2440
cgggaacagcucuggcagcag

SEQ ID NO: 1604316 - RNA, 16 nt, Pseudomonas putida KT2440
cgggacagcaccaugc

SEQ ID NO: 1604317 - RNA, 17 nt, Pseudomonas putida KT2440
cgggaccagcaccaccu

SEQ ID NO: 1604318 - RNA, 18 nt, Pseudomonas putida KT2440
cggcugaccaccucggcc

SEQ ID NO: 1604319 - RNA, 14 nt, Pseudomonas putida KT2440
cggcugcugguucu

SEQ ID NO: 1604320 - RNA, 21 nt, Pseudomonas putida KT2440
cggcuggccacguaggcacuc

SEQ ID NO: 1604321 - RNA, 16 nt, Pseudomonas putida KT2440
cggcuugcccgggcgc

SEQ ID NO: 1604322 - RNA, 20 nt, Pseudomonas putida KT2440
cggcuugcuccaagugccgu

SEQ ID NO: 1604323 - RNA, 20 nt, Pseudomonas putida KT2440
cggcuuggcacgaaacgcca

SEQ ID NO: 1604324 - RNA, 19 nt, Pseudomonas putida KT2440
cggcgucgaacaacggcag

SEQ ID NO: 1604325 - RNA, 13 nt, Pseudomonas putida KT2440
cggcgucgagcag

SEQ ID NO: 1604326 - RNA, 14 nt, Pseudomonas putida KT2440
cggcguccaggccc

SEQ ID NO: 1604327 - RNA, 21 nt, Pseudomonas putida KT2440
cggcguauggcuucacggcca

SEQ ID NO: 1604328 - RNA, 20 nt, Pseudomonas putida KT2440
cggcgguucugcgcacgacc

SEQ ID NO: 1604329 - RNA, 18 nt, Pseudomonas putida KT2440
cggcguauacccggucag

SEQ ID NO: 1604330 - RNA, 14 nt, Pseudomonas putida KT2440
cggcgcuggccggu

SEQ ID NO: 1604331 - RNA, 16 nt, Pseudomonas putida KT2440
cggcgcugggcuuacg

SEQ ID NO: 1604332 - RNA, 23 nt, Pseudomonas putida KT2440
cggcggcagauacaaccccagau

SEQ ID NO: 1604333 - RNA, 20 nt, Pseudomonas putida KT2440
cggcggaacaauugcucuug

SEQ ID NO: 1604334 - RNA, 22 nt, Pseudomonas putida KT2440
cggcuccaccgaaaucagcaac

SEQ ID NO: 1604335 - RNA, 16 nt, Pseudomonas putida KT2440
cggcuccaccugcucc

SEQ ID NO: 1604336 - RNA, 21 nt, Pseudomonas putida KT2440
cggcuccaccugcuccagcac

SEQ ID NO: 1604337 - RNA, 17 nt, Pseudomonas putida KT2440
cggcgucggcgcgcaac

SEQ ID NO: 1604338 - RNA, 19 nt, Pseudomonas putida KT2440
cggcgucgucaaggaagcu

SEQ ID NO: 1604339 - RNA, 14 nt, Pseudomonas putida KT2440
cggcuccaggcaca

SEQ ID NO: 1604340 - RNA, 14 nt, Pseudomonas putida KT2440
cggcucccccucca

SEQ ID NO: 1604341 - RNA, 13 nt, Pseudomonas putida KT2440
cggcucggccacc

SEQ ID NO: 1604342 - RNA, 14 nt, Pseudomonas putida KT2440
cggcucgcucaggc

SEQ ID NO: 1604343 - RNA, 15 nt, Pseudomonas putida KT2440
cggcucgcugaacac

SEQ ID NO: 1604344 - RNA, 21 nt, Pseudomonas putida KT2440
cggcucucgaaguagcgcucu

SEQ ID NO: 1604345 - RNA, 20 nt, Pseudomonas putida KT2440
cggcucuaucuucaggcauc

SEQ ID NO: 1604346 - RNA, 21 nt, Pseudomonas putida KT2440
cggcucuaucuucaggcauca

SEQ ID NO: 1604347 - RNA, 19 nt, Pseudomonas putida KT2440
cggcugaacuuccaggucg

SEQ ID NO: 1604348 - RNA, 19 nt, Pseudomonas putida KT2440
cggcugagccggcuggcgu

SEQ ID NO: 1604349 - RNA, 22 nt, Pseudomonas putida KT2440
cggccuugucagcagcuucagc

SEQ ID NO: 1604350 - RNA, 18 nt, Pseudomonas putida KT2440
cggccuuggccgcuggcc

SEQ ID NO: 1604351 - RNA, 22 nt, Pseudomonas putida KT2440
cggccuuggccgcuggcccuuc

SEQ ID NO: 1604352 - RNA, 15 nt, Pseudomonas putida KT2440
cggccccaguggcuu

SEQ ID NO: 1604353 - RNA, 14 nt, Pseudomonas putida KT2440
cggccccacgcagu

SEQ ID NO: 1604354 - RNA, 15 nt, Pseudomonas putida KT2440
cggccccaggugcca

SEQ ID NO: 1604355 - RNA, 22 nt, Pseudomonas putida KT2440
cggccaucgaacaccacccggu

SEQ ID NO: 1604356 - RNA, 20 nt, Pseudomonas putida KT2440
cggccaguugccccaggccc

SEQ ID NO: 1604357 - RNA, 24 nt, Pseudomonas putida KT2440
cggcccaucgcauaugccccaggc

SEQ ID NO: 1604358 - RNA, 13 nt, Pseudomonas putida KT2440
cggcgaacacagc

SEQ ID NO: 1604359 - RNA, 22 nt, Pseudomonas putida KT2440
cggcgaacaccccgauucacag

SEQ ID NO: 1604360 - RNA, 23 nt, Pseudomonas putida KT2440
cggcgaagucacaccaucggccg

SEQ ID NO: 1604361 - RNA, 14 nt, Pseudomonas putida KT2440
cggcgaaugcugca

SEQ ID NO: 1604362 - RNA, 20 nt, Pseudomonas putida KT2440
cggcgaauccagcaggcuug

SEQ ID NO: 1604363 - RNA, 19 nt, Pseudomonas putida KT2440
cggcgaauccagccggccc

SEQ ID NO: 1604364 - RNA, 21 nt, Pseudomonas putida KT2440
cggcgauacucaccgccgccc

SEQ ID NO: 1604365 - RNA, 20 nt, Pseudomonas putida KT2440
cggcgaguccugccuuccac

SEQ ID NO: 1604366 - RNA, 16 nt, Pseudomonas putida KT2440
cggcgaugccgcgcgc

SEQ ID NO: 1604367 - RNA, 15 nt, Pseudomonas putida KT2440
cggcgaugcgccccc

SEQ ID NO: 1604368 - RNA, 17 nt, Pseudomonas putida KT2440
cggcgaucugucaggug

SEQ ID NO: 1604369 - RNA, 18 nt, Pseudomonas putida KT2440
cggcgauggucugcucca

SEQ ID NO: 1604370 - RNA, 15 nt, Pseudomonas putida KT2440
cggcgcgacuccugu

SEQ ID NO: 1604371 - RNA, 13 nt, Pseudomonas putida KT2440
cggcgcgcaacag

SEQ ID NO: 1604372 - RNA, 13 nt, Pseudomonas putida KT2440
cggcgccugccac

SEQ ID NO: 1604373 - RNA, 14 nt, Pseudomonas putida KT2440
cggcgccugccacg

SEQ ID NO: 1604374 - RNA, 18 nt, Pseudomonas putida KT2440
cggcgccgucuucagaca

SEQ ID NO: 1604375 - RNA, 13 nt, Pseudomonas putida KT2440
cggcgccuccagc

SEQ ID NO: 1604376 - RNA, 16 nt, Pseudomonas putida KT2440
cggcgccuccagcaac

SEQ ID NO: 1604377 - RNA, 13 nt, Pseudomonas putida KT2440
cggcgccugacac

SEQ ID NO: 1604378 - RNA, 19 nt, Pseudomonas putida KT2440
cggcgccgguggcggccgc

SEQ ID NO: 1604379 - RNA, 22 nt, Pseudomonas putida KT2440
cggcgccgguggcggccgcagc

SEQ ID NO: 1604380 - RNA, 15 nt, Pseudomonas putida KT2440
cggcgcgccuggcuc

SEQ ID NO: 1604381 - RNA, 14 nt, Pseudomonas putida KT2440
cggcgcgcgcgacc

SEQ ID NO: 1604382 - RNA, 12 nt, Pseudomonas putida KT2440
cggcgcgcccgg

SEQ ID NO: 1604383 - RNA, 20 nt, Pseudomonas putida KT2440
cggcgcuggacagcggcagc

SEQ ID NO: 1604384 - RNA, 21 nt, Pseudomonas putida KT2440
cggcgccaucggcacgccagc

SEQ ID NO: 1604385 - RNA, 13 nt, Pseudomonas putida KT2440
cggcgccccuuuu

SEQ ID NO: 1604386 - RNA, 16 nt, Pseudomonas putida KT2440
cggcgccgccaggcag

SEQ ID NO: 1604387 - RNA, 18 nt, Pseudomonas putida KT2440
cggcgccgccaggcagca

SEQ ID NO: 1604388 - RNA, 14 nt, Pseudomonas putida KT2440
cggcgcaaugaaaa

SEQ ID NO: 1604389 - RNA, 13 nt, Pseudomonas putida KT2440
cggcgcacgcaug

SEQ ID NO: 1604390 - RNA, 23 nt, Pseudomonas putida KT2440
cggcgcacgcaugcgcgacagca

SEQ ID NO: 1604391 - RNA, 17 nt, Pseudomonas putida KT2440
cggcgccacccagaaca

SEQ ID NO: 1604392 - RNA, 20 nt, Pseudomonas putida KT2440
cggcgccaaucaucgccagc

SEQ ID NO: 1604393 - RNA, 13 nt, Pseudomonas putida KT2440
cggcgcagggccu

SEQ ID NO: 1604394 - RNA, 16 nt, Pseudomonas putida KT2440
cccuggcaugcugaug

SEQ ID NO: 1604395 - RNA, 14 nt, Pseudomonas putida KT2440
cccuggaaacccuu

SEQ ID NO: 1604396 - RNA, 12 nt, Pseudomonas putida KT2440
cccuggcccgcc

SEQ ID NO: 1604397 - RNA, 17 nt, Pseudomonas putida KT2440
cccugcugcuggcacgc

SEQ ID NO: 1604398 - RNA, 19 nt, Pseudomonas putida KT2440
cccugcugcuggcacgccu

SEQ ID NO: 1604399 - RNA, 16 nt, Pseudomonas putida KT2440
cccugcuugaccaugg

SEQ ID NO: 1604400 - RNA, 20 nt, Pseudomonas putida KT2440
cccugcucgccaucgccccg

SEQ ID NO: 1604401 - RNA, 22 nt, Pseudomonas putida KT2440
cccugcucguccaucaccgcca

SEQ ID NO: 1604402 - RNA, 21 nt, Pseudomonas putida KT2440
cccugcggcuguucgcagcac

SEQ ID NO: 1604403 - RNA, 20 nt, Pseudomonas putida KT2440
cccugcguccccggguccac

SEQ ID NO: 1604404 - RNA, 18 nt, Pseudomonas putida KT2440
cccugcccccaaagccgc

SEQ ID NO: 1604405 - RNA, 20 nt, Pseudomonas putida KT2440
cccugcccccaaagccgcca

SEQ ID NO: 1604406 - RNA, 22 nt, Pseudomonas putida KT2440
cccugcccucgacaaucgccag

SEQ ID NO: 1604407 - RNA, 17 nt, Pseudomonas putida KT2440
cccugcagagcucagcg

SEQ ID NO: 1604408 - RNA, 16 nt, Pseudomonas putida KT2440
cccugcgccgccaccu

SEQ ID NO: 1604409 - RNA, 18 nt, Pseudomonas putida KT2440
cccugcgccgccaccugc

SEQ ID NO: 1604410 - RNA, 13 nt, Pseudomonas putida KT2440
cccugcgccgcca

SEQ ID NO: 1604411 - RNA, 22 nt, Pseudomonas putida KT2440
cccugcgccaaaaccuguucca

SEQ ID NO: 1604412 - RNA, 14 nt, Pseudomonas putida KT2440
cccugccuaccacc

SEQ ID NO: 1604413 - RNA, 23 nt, Pseudomonas putida KT2440
cccugccuaccaccgcauccgca

SEQ ID NO: 1604414 - RNA, 17 nt, Pseudomonas putida KT2440
cccugccucagcucuuc

SEQ ID NO: 1604415 - RNA, 16 nt, Pseudomonas putida KT2440
ccccuggaaccccauc

SEQ ID NO: 1604416 - RNA, 19 nt, Pseudomonas putida KT2440
ccccuuccgaccggucaua

SEQ ID NO: 1604417 - RNA, 18 nt, Pseudomonas putida KT2440
ccccuuccccaggccgcc

SEQ ID NO: 1604418 - RNA, 16 nt, Pseudomonas putida KT2440
ccccuucgacgcucaa

SEQ ID NO: 1604419 - RNA, 19 nt, Pseudomonas putida KT2440
ccccuucaaggggccccug

SEQ ID NO: 1604420 - RNA, 18 nt, Pseudomonas putida KT2440
ccccuucaucacccaguu

SEQ ID NO: 1604421 - RNA, 20 nt, Pseudomonas putida KT2440
cccucguucgcgggcacgcc

SEQ ID NO: 1604422 - RNA, 22 nt, Pseudomonas putida KT2440
cccucgguuucucaccccgugu

SEQ ID NO: 1604423 - RNA, 20 nt, Pseudomonas putida KT2440
cccucucgaauccccuuaua

SEQ ID NO: 1604424 - RNA, 17 nt, Pseudomonas putida KT2440
cccugcaaggccagcgg

SEQ ID NO: 1604425 - RNA, 15 nt, Pseudomonas putida KT2440
cccugauaggacugc

SEQ ID NO: 1604426 - RNA, 16 nt, Pseudomonas putida KT2440
cccugaucgccuccag

SEQ ID NO: 1604427 - RNA, 19 nt, Pseudomonas putida KT2440
cccugaucgccuccaggcg

SEQ ID NO: 1604428 - RNA, 20 nt, Pseudomonas putida KT2440
cccucuucgcgggcacgccc

SEQ ID NO: 1604429 - RNA, 19 nt, Pseudomonas putida KT2440
cccugaacuuggccuccag

SEQ ID NO: 1604430 - RNA, 20 nt, Pseudomonas putida KT2440
cccugaacuuggccuccagc

SEQ ID NO: 1604431 - RNA, 21 nt, Pseudomonas putida KT2440
cccugacaggcgaucagucag

SEQ ID NO: 1604432 - RNA, 14 nt, Pseudomonas putida KT2440
cccugaaggccgcu

SEQ ID NO: 1604433 - RNA, 22 nt, Pseudomonas putida KT2440
cccugacucgaccgccgcacag

SEQ ID NO: 1604434 - RNA, 18 nt, Pseudomonas putida KT2440
cccuugcgggaacaccca

SEQ ID NO: 1604435 - RNA, 19 nt, Pseudomonas putida KT2440
cccuugccgccccgugccc

SEQ ID NO: 1604436 - RNA, 12 nt, Pseudomonas putida KT2440
cccuucugcugc

SEQ ID NO: 1604437 - RNA, 17 nt, Pseudomonas putida KT2440
cccuucuggugaaaguc

SEQ ID NO: 1604438 - RNA, 18 nt, Pseudomonas putida KT2440
cccuuuuucaccaggcgg

SEQ ID NO: 1604439 - RNA, 21 nt, Pseudomonas putida KT2440
cccuuuuuuuauucccggccu

SEQ ID NO: 1604440 - RNA, 13 nt, Pseudomonas putida KT2440
ccgaaaaggccaa

SEQ ID NO: 1604441 - RNA, 15 nt, Pseudomonas putida KT2440
ccgaacagcaccgcc

SEQ ID NO: 1604442 - RNA, 17 nt, Pseudomonas putida KT2440
ccgaacagcaccgccau

SEQ ID NO: 1604443 - RNA, 19 nt, Pseudomonas putida KT2440
ccgaacccgcugccaccca

SEQ ID NO: 1604444 - RNA, 17 nt, Pseudomonas putida KT2440
ccgaacccgcuggcgau

SEQ ID NO: 1604445 - RNA, 21 nt, Pseudomonas putida KT2440
ccgaacccgcuggcgaucagg

SEQ ID NO: 1604446 - RNA, 23 nt, Pseudomonas putida KT2440
ccgaacccgcuggcgaucaggca

SEQ ID NO: 1604447 - RNA, 14 nt, Pseudomonas putida KT2440
ccgaaguggcggcu

SEQ ID NO: 1604448 - RNA, 12 nt, Pseudomonas putida KT2440
cccuuccagcuu

SEQ ID NO: 1604449 - RNA, 21 nt, Pseudomonas putida KT2440
cccuuccagcuucugcaacuc

SEQ ID NO: 1604450 - RNA, 17 nt, Pseudomonas putida KT2440
cccuuccccccuggccu

SEQ ID NO: 1604451 - RNA, 18 nt, Pseudomonas putida KT2440
cccuuccgcgugcccccc

SEQ ID NO: 1604452 - RNA, 23 nt, Pseudomonas putida KT2440
cccuucaucgccggguccaccag

SEQ ID NO: 1604453 - RNA, 18 nt, Pseudomonas putida KT2440
cccuucauacagcgccuc

SEQ ID NO: 1604454 - RNA, 20 nt, Pseudomonas putida KT2440
cccuucaugcgcccuggcgg

SEQ ID NO: 1604455 - RNA, 17 nt, Pseudomonas putida KT2440
cccuucgccggcacgcc

SEQ ID NO: 1604456 - RNA, 20 nt, Pseudomonas putida KT2440
cccuucgccggcacgcccgc

SEQ ID NO: 1604457 - RNA, 22 nt, Pseudomonas putida KT2440
cccuucgccggcacgcccgcuc

SEQ ID NO: 1604458 - RNA, 21 nt, Pseudomonas putida KT2440
cccuucgcggcaagcccgcuc

SEQ ID NO: 1604459 - RNA, 20 nt, Pseudomonas putida KT2440
cccuucgcggaagcucucca

SEQ ID NO: 1604460 - RNA, 22 nt, Pseudomonas putida KT2440
cccuucggaaacaguuucuuca

SEQ ID NO: 1604461 - RNA, 22 nt, Pseudomonas putida KT2440
cccuucggcaaucaccgccagg

SEQ ID NO: 1604462 - RNA, 18 nt, Pseudomonas putida KT2440
cccuucggccagcaguuc

SEQ ID NO: 1604463 - RNA, 21 nt, Pseudomonas putida KT2440
cccuucggccagcaguucguc

SEQ ID NO: 1604464 - RNA, 15 nt, Pseudomonas putida KT2440
cccuguuucuucaag

SEQ ID NO: 1604465 - RNA, 23 nt, Pseudomonas putida KT2440
cccuguuucuucaaggccgccac

SEQ ID NO: 1604466 - RNA, 14 nt, Pseudomonas putida KT2440
cccuggggggcucc

SEQ ID NO: 1604467 - RNA, 17 nt, Pseudomonas putida KT2440
cccuggguuuauuucuc

SEQ ID NO: 1604468 - RNA, 22 nt, Pseudomonas putida KT2440
cccuggguuuauuucucuuccu

SEQ ID NO: 1604469 - RNA, 22 nt, Pseudomonas putida KT2440
cccuggguuuuuuuaugggcag

SEQ ID NO: 1604470 - RNA, 16 nt, Pseudomonas putida KT2440
cccugggauuucggcg

SEQ ID NO: 1604471 - RNA, 14 nt, Pseudomonas putida KT2440
cccuguucccucaa

SEQ ID NO: 1604472 - RNA, 14 nt, Pseudomonas putida KT2440
cccuguggcugugg

SEQ ID NO: 1604473 - RNA, 22 nt, Pseudomonas putida KT2440
cccugugggagcggccuugugc

SEQ ID NO: 1604474 - RNA, 23 nt, Pseudomonas putida KT2440
cccuguaggcgcaacucagcgca

SEQ ID NO: 1604475 - RNA, 21 nt, Pseudomonas putida KT2440
ccgaugccagguacacguugg

SEQ ID NO: 1604476 - RNA, 16 nt, Pseudomonas putida KT2440
ccgaucucgccagccu

SEQ ID NO: 1604477 - RNA, 18 nt, Pseudomonas putida KT2440
ccgaucucgccagccugc

SEQ ID NO: 1604478 - RNA, 19 nt, Pseudomonas putida KT2440
ccgaucucgccagccugca

SEQ ID NO: 1604479 - RNA, 13 nt, Pseudomonas putida KT2440
ccgaugcgcccgc

SEQ ID NO: 1604480 - RNA, 19 nt, Pseudomonas putida KT2440
ccgaugcgcccgccgcccg

SEQ ID NO: 1604481 - RNA, 13 nt, Pseudomonas putida KT2440
ccgaugccgucga

SEQ ID NO: 1604482 - RNA, 12 nt, Pseudomonas putida KT2440
ccgaugccugug

SEQ ID NO: 1604483 - RNA, 20 nt, Pseudomonas putida KT2440
ccgauguagucguccugccc

SEQ ID NO: 1604484 - RNA, 16 nt, Pseudomonas putida KT2440
ccgauguccuugcugg

SEQ ID NO: 1604485 - RNA, 13 nt, Pseudomonas putida KT2440
ccgaugugugucc

SEQ ID NO: 1604486 - RNA, 19 nt, Pseudomonas putida KT2440
ccgauuacaagggccugug

SEQ ID NO: 1604487 - RNA, 20 nt, Pseudomonas putida KT2440
ccgauguuguggcuguucag

SEQ ID NO: 1604488 - RNA, 15 nt, Pseudomonas putida KT2440
ccgcaacgcggcccu

SEQ ID NO: 1604489 - RNA, 21 nt, Pseudomonas putida KT2440
ccgcaacuggcccgcgccagg

SEQ ID NO: 1604490 - RNA, 16 nt, Pseudomonas putida KT2440
ccgcaagcagucccag

SEQ ID NO: 1604491 - RNA, 19 nt, Pseudomonas putida KT2440
ccgcaagcagucccagcac

SEQ ID NO: 1604492 - RNA, 14 nt, Pseudomonas putida KT2440
ccgcaacaccagga

SEQ ID NO: 1604493 - RNA, 14 nt, Pseudomonas putida KT2440
ccgcaacccagccc

SEQ ID NO: 1604494 - RNA, 17 nt, Pseudomonas putida KT2440
ccgcaacccagccccag

SEQ ID NO: 1604495 - RNA, 18 nt, Pseudomonas putida KT2440
ccgcaaccgggucggcgc

SEQ ID NO: 1604496 - RNA, 13 nt, Pseudomonas putida KT2440
ccgauuuggcccg

SEQ ID NO: 1604497 - RNA, 16 nt, Pseudomonas putida KT2440
ccgcaaagcccugccu

SEQ ID NO: 1604498 - RNA, 20 nt, Pseudomonas putida KT2440
ccgcaaagcggccccagugg

SEQ ID NO: 1604499 - RNA, 16 nt, Pseudomonas putida KT2440
ccgcaaagcggccccc

SEQ ID NO: 1604500 - RNA, 18 nt, Pseudomonas putida KT2440
ccgcaaagcggcccccag

SEQ ID NO: 1604501 - RNA, 21 nt, Pseudomonas putida KT2440
ccgcaaagcggcccccagcaa

SEQ ID NO: 1604502 - RNA, 19 nt, Pseudomonas putida KT2440
ccgcaaagcggccccuucg

SEQ ID NO: 1604503 - RNA, 21 nt, Pseudomonas putida KT2440
ccgcacugugcuggggccagc

SEQ ID NO: 1604504 - RNA, 14 nt, Pseudomonas putida KT2440
ccgcacucugcugc

SEQ ID NO: 1604505 - RNA, 13 nt, Pseudomonas putida KT2440
ccgcacugcugcc

SEQ ID NO: 1604506 - RNA, 17 nt, Pseudomonas putida KT2440
ccgcacugcugccgccc

SEQ ID NO: 1604507 - RNA, 13 nt, Pseudomonas putida KT2440
ccgcacuccccau

SEQ ID NO: 1604508 - RNA, 17 nt, Pseudomonas putida KT2440
ccgcaccagaccagcag

SEQ ID NO: 1604509 - RNA, 13 nt, Pseudomonas putida KT2440
ccgcaagcugcac

SEQ ID NO: 1604510 - RNA, 16 nt, Pseudomonas putida KT2440
ccgcacccaggccacg

SEQ ID NO: 1604511 - RNA, 13 nt, Pseudomonas putida KT2440
ccgcacccagcag

SEQ ID NO: 1604512 - RNA, 21 nt, Pseudomonas putida KT2440
ccgcacccgcaagcgccgaug

SEQ ID NO: 1604513 - RNA, 15 nt, Pseudomonas putida KT2440
ccgcaggugcaggcu

SEQ ID NO: 1604514 - RNA, 11 nt, Pseudomonas putida KT2440
ccgcaggucac

SEQ ID NO: 1604515 - RNA, 16 nt, Pseudomonas putida KT2440
ccgcagguccaccugg

SEQ ID NO: 1604516 - RNA, 21 nt, Pseudomonas putida KT2440
ccgcagucccguuggcccgcc

SEQ ID NO: 1604517 - RNA, 20 nt, Pseudomonas putida KT2440
ccgcaggcuaucgaggggca

SEQ ID NO: 1604518 - RNA, 23 nt, Pseudomonas putida KT2440
ccgcaggcccaaacauugugcgc

SEQ ID NO: 1604519 - RNA, 17 nt, Pseudomonas putida KT2440
ccgcaggccgcagccuc

SEQ ID NO: 1604520 - RNA, 17 nt, Pseudomonas putida KT2440
ccgcaggccaaugcagc

SEQ ID NO: 1604521 - RNA, 13 nt, Pseudomonas putida KT2440
ccgcagccccagc

SEQ ID NO: 1604522 - RNA, 15 nt, Pseudomonas putida KT2440
ccgcagcccagcgcc

SEQ ID NO: 1604523 - RNA, 18 nt, Pseudomonas putida KT2440
ccgcagcccagcgccgcc

SEQ ID NO: 1604524 - RNA, 14 nt, Pseudomonas putida KT2440
ccgcagccccgccg

SEQ ID NO: 1604525 - RNA, 17 nt, Pseudomonas putida KT2440
ccgcagcuucaacucca

SEQ ID NO: 1604526 - RNA, 21 nt, Pseudomonas putida KT2440
ccgacgccaggaaggucacca

SEQ ID NO: 1604527 - RNA, 20 nt, Pseudomonas putida KT2440
ccgaccuguguccacccccg

SEQ ID NO: 1604528 - RNA, 13 nt, Pseudomonas putida KT2440
ccgacgaacaggg

SEQ ID NO: 1604529 - RNA, 21 nt, Pseudomonas putida KT2440
ccgacgaacagggccggcccc

SEQ ID NO: 1604530 - RNA, 15 nt, Pseudomonas putida KT2440
ccgacgauaccgccc

SEQ ID NO: 1604531 - RNA, 22 nt, Pseudomonas putida KT2440
ccgagaaugaaacuccaucguc

SEQ ID NO: 1604532 - RNA, 12 nt, Pseudomonas putida KT2440
ccgagaacaggc

SEQ ID NO: 1604533 - RNA, 20 nt, Pseudomonas putida KT2440
ccgacuugauugccgacucc

SEQ ID NO: 1604534 - RNA, 12 nt, Pseudomonas putida KT2440
ccgacgugcagg

SEQ ID NO: 1604535 - RNA, 20 nt, Pseudomonas putida KT2440
ccgagagcaguuccuucagc

SEQ ID NO: 1604536 - RNA, 16 nt, Pseudomonas putida KT2440
ccgagcaaagcccgcc

SEQ ID NO: 1604537 - RNA, 17 nt, Pseudomonas putida KT2440
ccgagcaaagcccgccc

SEQ ID NO: 1604538 - RNA, 19 nt, Pseudomonas putida KT2440
ccgaucagcggcgccaccc

SEQ ID NO: 1604539 - RNA, 20 nt, Pseudomonas putida KT2440
ccgaucagcggcgccaccca

SEQ ID NO: 1604540 - RNA, 19 nt, Pseudomonas putida KT2440
ccgaucagguugcccagca

SEQ ID NO: 1604541 - RNA, 15 nt, Pseudomonas putida KT2440
ccgaucacucggcag

SEQ ID NO: 1604542 - RNA, 20 nt, Pseudomonas putida KT2440
ccgauaaagguugcccggcg

SEQ ID NO: 1604543 - RNA, 13 nt, Pseudomonas putida KT2440
ccgaggggccgcu

SEQ ID NO: 1604544 - RNA, 19 nt, Pseudomonas putida KT2440
ccgagggugaggugcugca

SEQ ID NO: 1604545 - RNA, 15 nt, Pseudomonas putida KT2440
ccgagucuccgcgcu

SEQ ID NO: 1604546 - RNA, 19 nt, Pseudomonas putida KT2440
ccgaggaauugcgccagga

SEQ ID NO: 1604547 - RNA, 18 nt, Pseudomonas putida KT2440
ccgaggaaguacgccggc

SEQ ID NO: 1604548 - RNA, 14 nt, Pseudomonas putida KT2440
ccgaggcgccgacg

SEQ ID NO: 1604549 - RNA, 16 nt, Pseudomonas putida KT2440
ccggaauuucugcacc

SEQ ID NO: 1604550 - RNA, 21 nt, Pseudomonas putida KT2440
ccggacucacccgcaccucac

SEQ ID NO: 1604551 - RNA, 20 nt, Pseudomonas putida KT2440
ccggaacguuuccagcaacc

SEQ ID NO: 1604552 - RNA, 14 nt, Pseudomonas putida KT2440
ccgcuuucacuuca

SEQ ID NO: 1604553 - RNA, 14 nt, Pseudomonas putida KT2440
ccgcuuucagccga

SEQ ID NO: 1604554 - RNA, 17 nt, Pseudomonas putida KT2440
ccgcuuuggcagcagcc

SEQ ID NO: 1604555 - RNA, 23 nt, Pseudomonas putida KT2440
ccgcuuuggcagcagccucggcc

SEQ ID NO: 1604556 - RNA, 20 nt, Pseudomonas putida KT2440
ccgcuuuuggcugugcaccc

SEQ ID NO: 1604557 - RNA, 22 nt, Pseudomonas putida KT2440
ccggcaccgccucuaccacgcc

SEQ ID NO: 1604558 - RNA, 21 nt, Pseudomonas putida KT2440
ccggcaccugcuugccgcugg

SEQ ID NO: 1604559 - RNA, 23 nt, Pseudomonas putida KT2440
ccggcaaucgggauggcaccggc

SEQ ID NO: 1604560 - RNA, 20 nt, Pseudomonas putida KT2440
ccggauagagcccggcgcag

SEQ ID NO: 1604561 - RNA, 21 nt, Pseudomonas putida KT2440
ccggcaacgaacuugcggaac

SEQ ID NO: 1604562 - RNA, 17 nt, Pseudomonas putida KT2440
ccggcaaggcauccaga

SEQ ID NO: 1604563 - RNA, 19 nt, Pseudomonas putida KT2440
ccggcaaggcauccagaaa

SEQ ID NO: 1604564 - RNA, 17 nt, Pseudomonas putida KT2440
ccggcaagcccauggcu

SEQ ID NO: 1604565 - RNA, 21 nt, Pseudomonas putida KT2440
ccggcaacgauacccacgccc

SEQ ID NO: 1604566 - RNA, 18 nt, Pseudomonas putida KT2440
ccggcaacccuucggcca

SEQ ID NO: 1604567 - RNA, 19 nt, Pseudomonas putida KT2440
ccggcagaucgagcgccgc

SEQ ID NO: 1604568 - RNA, 22 nt, Pseudomonas putida KT2440
ccggcagaucgagcgccgcccg

SEQ ID NO: 1604569 - RNA, 15 nt, Pseudomonas putida KT2440
ccggcagcaccugcc

SEQ ID NO: 1604570 - RNA, 15 nt, Pseudomonas putida KT2440
ccggcagcaaggcau

SEQ ID NO: 1604571 - RNA, 20 nt, Pseudomonas putida KT2440
ccggcacgguugcgcccggc

SEQ ID NO: 1604572 - RNA, 13 nt, Pseudomonas putida KT2440
ccggcacugcaca

SEQ ID NO: 1604573 - RNA, 14 nt, Pseudomonas putida KT2440
ccggcacugcacag

SEQ ID NO: 1604574 - RNA, 14 nt, Pseudomonas putida KT2440
ccggccaagcgccg

SEQ ID NO: 1604575 - RNA, 14 nt, Pseudomonas putida KT2440
ccggcauucccggc

SEQ ID NO: 1604576 - RNA, 17 nt, Pseudomonas putida KT2440
ccgcgccuccagcuggc

SEQ ID NO: 1604577 - RNA, 23 nt, Pseudomonas putida KT2440
ccgcgccuacaggcaaccgcauc

SEQ ID NO: 1604578 - RNA, 18 nt, Pseudomonas putida KT2440
ccgcgccuacaggcccca

SEQ ID NO: 1604579 - RNA, 20 nt, Pseudomonas putida KT2440
ccgcgccucgaucccgccgc

SEQ ID NO: 1604580 - RNA, 22 nt, Pseudomonas putida KT2440
ccgcgccucgaucccgccgcca

SEQ ID NO: 1604581 - RNA, 16 nt, Pseudomonas putida KT2440
ccgcggcucacccacc

SEQ ID NO: 1604582 - RNA, 19 nt, Pseudomonas putida KT2440
ccgcggcucacccaccagc

SEQ ID NO: 1604583 - RNA, 14 nt, Pseudomonas putida KT2440
ccgcguaggugcgc

SEQ ID NO: 1604584 - RNA, 14 nt, Pseudomonas putida KT2440
ccgcguacagcugc

SEQ ID NO: 1604585 - RNA, 22 nt, Pseudomonas putida KT2440
ccgcguuugcaacuggcgcagg

SEQ ID NO: 1604586 - RNA, 18 nt, Pseudomonas putida KT2440
ccgcguucgcccaggcgc

SEQ ID NO: 1604587 - RNA, 22 nt, Pseudomonas putida KT2440
ccgcguucgcccaggcgccgca

SEQ ID NO: 1604588 - RNA, 18 nt, Pseudomonas putida KT2440
ccgcuggaccuggcuggc

SEQ ID NO: 1604589 - RNA, 13 nt, Pseudomonas putida KT2440
ccgcuggcuucaa

SEQ ID NO: 1604590 - RNA, 21 nt, Pseudomonas putida KT2440
ccgcuggccgcacccagcagg

SEQ ID NO: 1604591 - RNA, 20 nt, Pseudomonas putida KT2440
ccgcuucacccucgcgcagc

SEQ ID NO: 1604592 - RNA, 15 nt, Pseudomonas putida KT2440
ccgcuucaacagcuu

SEQ ID NO: 1604593 - RNA, 12 nt, Pseudomonas putida KT2440
ccgcuuggcggc

SEQ ID NO: 1604594 - RNA, 15 nt, Pseudomonas putida KT2440
ccgcuuggcggccca

SEQ ID NO: 1604595 - RNA, 18 nt, Pseudomonas putida KT2440
ccgcuucgaccauuggac

SEQ ID NO: 1604596 - RNA, 12 nt, Pseudomonas putida KT2440
ccgcuugcugug

SEQ ID NO: 1604597 - RNA, 15 nt, Pseudomonas putida KT2440
ccgcucaaacccggc

SEQ ID NO: 1604598 - RNA, 16 nt, Pseudomonas putida KT2440
ccgcucagccaccugu

SEQ ID NO: 1604599 - RNA, 21 nt, Pseudomonas putida KT2440
ccgcucaccggccagcgcgcu

SEQ ID NO: 1604600 - RNA, 16 nt, Pseudomonas putida KT2440
ccgcucugcccgcgcc

SEQ ID NO: 1604601 - RNA, 17 nt, Pseudomonas putida KT2440
ccgcucguacgucgccu

SEQ ID NO: 1604602 - RNA, 16 nt, Pseudomonas putida KT2440
ccgcugaccacaaagc

SEQ ID NO: 1604603 - RNA, 15 nt, Pseudomonas putida KT2440
ccgcugaccacgccg

SEQ ID NO: 1604604 - RNA, 16 nt, Pseudomonas putida KT2440
ccgcugaacaacuccg

SEQ ID NO: 1604605 - RNA, 22 nt, Pseudomonas putida KT2440
ccgcugaacaacuccgggugcu

SEQ ID NO: 1604606 - RNA, 16 nt, Pseudomonas putida KT2440
ccgcugaaccucaccg

SEQ ID NO: 1604607 - RNA, 16 nt, Pseudomonas putida KT2440
ccgcugcaugcucggc

SEQ ID NO: 1604608 - RNA, 12 nt, Pseudomonas putida KT2440
ccgcugcauggc

SEQ ID NO: 1604609 - RNA, 20 nt, Pseudomonas putida KT2440
ccgcugccauagcgcugcac

SEQ ID NO: 1604610 - RNA, 16 nt, Pseudomonas putida KT2440
ccgcugccaccuucca

SEQ ID NO: 1604611 - RNA, 14 nt, Pseudomonas putida KT2440
ccgcugccagcagg

SEQ ID NO: 1604612 - RNA, 15 nt, Pseudomonas putida KT2440
ccgcugccagcugcg

SEQ ID NO: 1604613 - RNA, 13 nt, Pseudomonas putida KT2440
ccgcugcccgucc

SEQ ID NO: 1604614 - RNA, 22 nt, Pseudomonas putida KT2440
ccgccgggguaauggcgcugga

SEQ ID NO: 1604615 - RNA, 14 nt, Pseudomonas putida KT2440
ccgccgugcaguuc

SEQ ID NO: 1604616 - RNA, 19 nt, Pseudomonas putida KT2440
ccgccguguucccagcacc

SEQ ID NO: 1604617 - RNA, 16 nt, Pseudomonas putida KT2440
ccgccgguugcgcagc

SEQ ID NO: 1604618 - RNA, 19 nt, Pseudomonas putida KT2440
ccgccgguugcgcagccgg

SEQ ID NO: 1604619 - RNA, 22 nt, Pseudomonas putida KT2440
ccgccgguuucucgcagcagca

SEQ ID NO: 1604620 - RNA, 21 nt, Pseudomonas putida KT2440
ccgccgguguaccauccagua

SEQ ID NO: 1604621 - RNA, 20 nt, Pseudomonas putida KT2440
ccgccguugaaagacugcuc

SEQ ID NO: 1604622 - RNA, 15 nt, Pseudomonas putida KT2440
ccgccuccugcugcu

SEQ ID NO: 1604623 - RNA, 23 nt, Pseudomonas putida KT2440
ccgccucgaacaccugcgccccg

SEQ ID NO: 1604624 - RNA, 17 nt, Pseudomonas putida KT2440
ccgccucauccucgccc

SEQ ID NO: 1604625 - RNA, 19 nt, Pseudomonas putida KT2440
ccgccugacgccgccagcg

SEQ ID NO: 1604626 - RNA, 23 nt, Pseudomonas putida KT2440
ccgccugacgccgccagcgcucc

SEQ ID NO: 1604627 - RNA, 21 nt, Pseudomonas putida KT2440
ccgccucggcuacgccgccgc

SEQ ID NO: 1604628 - RNA, 14 nt, Pseudomonas putida KT2440
ccgccucgaccugg

SEQ ID NO: 1604629 - RNA, 15 nt, Pseudomonas putida KT2440
ccgcgacgcggcccc

SEQ ID NO: 1604630 - RNA, 14 nt, Pseudomonas putida KT2440
ccgcgacucguccg

SEQ ID NO: 1604631 - RNA, 22 nt, Pseudomonas putida KT2440
ccgcgaguaaagccagcagccu

SEQ ID NO: 1604632 - RNA, 21 nt, Pseudomonas putida KT2440
ccgcgcaacgcgccauggccu

SEQ ID NO: 1604633 - RNA, 15 nt, Pseudomonas putida KT2440
ccgccuucuccagcu

SEQ ID NO: 1604634 - RNA, 14 nt, Pseudomonas putida KT2440
ccgccuucgccaag

SEQ ID NO: 1604635 - RNA, 16 nt, Pseudomonas putida KT2440
ccgccuugcggccccg

SEQ ID NO: 1604636 - RNA, 14 nt, Pseudomonas putida KT2440
ccgccuuggcagcc

SEQ ID NO: 1604637 - RNA, 15 nt, Pseudomonas putida KT2440
ccgccuuggcagccu

SEQ ID NO: 1604638 - RNA, 23 nt, Pseudomonas putida KT2440
ccgccuuggcauagcgcucgcgc

SEQ ID NO: 1604639 - RNA, 14 nt, Pseudomonas putida KT2440
ccgcgcccucuucc

SEQ ID NO: 1604640 - RNA, 15 nt, Pseudomonas putida KT2440
ccgcgcccucuuccg

SEQ ID NO: 1604641 - RNA, 20 nt, Pseudomonas putida KT2440
ccgcgccgaucacaccggca

SEQ ID NO: 1604642 - RNA, 13 nt, Pseudomonas putida KT2440
ccgcgcagcuucc

SEQ ID NO: 1604643 - RNA, 15 nt, Pseudomonas putida KT2440
ccgcgcagcggcccc

SEQ ID NO: 1604644 - RNA, 15 nt, Pseudomonas putida KT2440
ccgcgcagccuuuga

SEQ ID NO: 1604645 - RNA, 17 nt, Pseudomonas putida KT2440
ccgcgcaccuccugcgg

SEQ ID NO: 1604646 - RNA, 21 nt, Pseudomonas putida KT2440
ccgcgcaccuccugcggcaga

SEQ ID NO: 1604647 - RNA, 21 nt, Pseudomonas putida KT2440
ccgcauacacaucggucggcc

SEQ ID NO: 1604648 - RNA, 17 nt, Pseudomonas putida KT2440
ccgcauaaccaccaccg

SEQ ID NO: 1604649 - RNA, 20 nt, Pseudomonas putida KT2440
ccgccauucuucuccaggug

SEQ ID NO: 1604650 - RNA, 16 nt, Pseudomonas putida KT2440
ccgccaugaucugccc

SEQ ID NO: 1604651 - RNA, 13 nt, Pseudomonas putida KT2440
ccgcccaguaccg

SEQ ID NO: 1604652 - RNA, 18 nt, Pseudomonas putida KT2440
ccgccccagcgcgccagc

SEQ ID NO: 1604653 - RNA, 18 nt, Pseudomonas putida KT2440
ccgccccacucgcgcagc

SEQ ID NO: 1604654 - RNA, 17 nt, Pseudomonas putida KT2440
ccgccgccaccagcgcc

SEQ ID NO: 1604655 - RNA, 20 nt, Pseudomonas putida KT2440
ccgccggcaacuccuccagc

SEQ ID NO: 1604656 - RNA, 15 nt, Pseudomonas putida KT2440
ccgccggcacuuccu

SEQ ID NO: 1604657 - RNA, 21 nt, Pseudomonas putida KT2440
ccgccgcugaccacgccgaag

SEQ ID NO: 1604658 - RNA, 18 nt, Pseudomonas putida KT2440
ccugcgugcugugcacug

SEQ ID NO: 1604659 - RNA, 20 nt, Pseudomonas putida KT2440
ccugcgugcugugcacugcg

SEQ ID NO: 1604660 - RNA, 20 nt, Pseudomonas putida KT2440
ccugcguugcccccagccgg

SEQ ID NO: 1604661 - RNA, 17 nt, Pseudomonas putida KT2440
ccugcugacaccgcugc

SEQ ID NO: 1604662 - RNA, 21 nt, Pseudomonas putida KT2440
ccugcucgcucaggcucuuga

SEQ ID NO: 1604663 - RNA, 17 nt, Pseudomonas putida KT2440
ccugcguaauuccugug

SEQ ID NO: 1604664 - RNA, 17 nt, Pseudomonas putida KT2440
ccugcucguccaucacc

SEQ ID NO: 1604665 - RNA, 14 nt, Pseudomonas putida KT2440
ccugcugcagcucc

SEQ ID NO: 1604666 - RNA, 17 nt, Pseudomonas putida KT2440
ccugcugcagcuccgga

SEQ ID NO: 1604667 - RNA, 13 nt, Pseudomonas putida KT2440
ccugcugcaggcu

SEQ ID NO: 1604668 - RNA, 14 nt, Pseudomonas putida KT2440
ccuggagagcccca

SEQ ID NO: 1604669 - RNA, 14 nt, Pseudomonas putida KT2440
ccuggaggucaugu

SEQ ID NO: 1604670 - RNA, 13 nt, Pseudomonas putida KT2440
ccuggaugcguug

SEQ ID NO: 1604671 - RNA, 23 nt, Pseudomonas putida KT2440
ccuggcgugcuguugagccaggg

SEQ ID NO: 1604672 - RNA, 19 nt, Pseudomonas putida KT2440
ccugggccaguaccuucug

SEQ ID NO: 1604673 - RNA, 14 nt, Pseudomonas putida KT2440
ccuggcggcccgcc

SEQ ID NO: 1604674 - RNA, 17 nt, Pseudomonas putida KT2440
ccuggcgguaaacgugg

SEQ ID NO: 1604675 - RNA, 11 nt, Pseudomonas putida KT2440
ccuggccaccc

SEQ ID NO: 1604676 - RNA, 19 nt, Pseudomonas putida KT2440
ccuggcauagcaguccugc

SEQ ID NO: 1604677 - RNA, 14 nt, Pseudomonas putida KT2440
ccugggcguucuga

SEQ ID NO: 1604678 - RNA, 17 nt, Pseudomonas putida KT2440
ccugggucagcuccucu

SEQ ID NO: 1604679 - RNA, 18 nt, Pseudomonas putida KT2440
ccuggguccaggcacacc

SEQ ID NO: 1604680 - RNA, 17 nt, Pseudomonas putida KT2440
ccugggugaccaccagc

SEQ ID NO: 1604681 - RNA, 12 nt, Pseudomonas putida KT2440
ccugguaccccu

SEQ ID NO: 1604682 - RNA, 15 nt, Pseudomonas putida KT2440
ccugguacagauggc

SEQ ID NO: 1604683 - RNA, 11 nt, Pseudomonas putida KT2440
ccuggguuuua

SEQ ID NO: 1604684 - RNA, 23 nt, Pseudomonas putida KT2440
ccugguaggucacuucagugcug

SEQ ID NO: 1604685 - RNA, 17 nt, Pseudomonas putida KT2440
ccuggucacgcaguucg

SEQ ID NO: 1604686 - RNA, 17 nt, Pseudomonas putida KT2440
ccuggucacggccaccc

SEQ ID NO: 1604687 - RNA, 18 nt, Pseudomonas putida KT2440
ccugucgcucuuaauuca

SEQ ID NO: 1604688 - RNA, 22 nt, Pseudomonas putida KT2440
ccugucgcgacgggcugcuccc

SEQ ID NO: 1604689 - RNA, 18 nt, Pseudomonas putida KT2440
ccugucguuauccugcag

SEQ ID NO: 1604690 - RNA, 15 nt, Pseudomonas putida KT2440
ccugugggagcggcc

SEQ ID NO: 1604691 - RNA, 15 nt, Pseudomonas putida KT2440
ccugugggagcgggc

SEQ ID NO: 1604692 - RNA, 19 nt, Pseudomonas putida KT2440
ccuguggggcaacugcgcg

SEQ ID NO: 1604693 - RNA, 17 nt, Pseudomonas putida KT2440
ccuguggguaugccacg

SEQ ID NO: 1604694 - RNA, 21 nt, Pseudomonas putida KT2440
ccugugccggcagcgagcgcu

SEQ ID NO: 1604695 - RNA, 17 nt, Pseudomonas putida KT2440
ccugugccggccucuuc

SEQ ID NO: 1604696 - RNA, 19 nt, Pseudomonas putida KT2440
ccuguaggcgcaacucagc

SEQ ID NO: 1604697 - RNA, 18 nt, Pseudomonas putida KT2440
ccugucauggcagucgua

SEQ ID NO: 1604698 - RNA, 17 nt, Pseudomonas putida KT2440
ccugcacgcucagugug

SEQ ID NO: 1604699 - RNA, 19 nt, Pseudomonas putida KT2440
ccugcacggcaaaguccag

SEQ ID NO: 1604700 - RNA, 21 nt, Pseudomonas putida KT2440
ccugcacugcacccucuuccu

SEQ ID NO: 1604701 - RNA, 12 nt, Pseudomonas putida KT2440
ccugcacuggcc

SEQ ID NO: 1604702 - RNA, 16 nt, Pseudomonas putida KT2440
ccugcacuggccucuu

SEQ ID NO: 1604703 - RNA, 17 nt, Pseudomonas putida KT2440
ccugcaccaguuccugg

SEQ ID NO: 1604704 - RNA, 18 nt, Pseudomonas putida KT2440
ccugcaccaguuccuggc

SEQ ID NO: 1604705 - RNA, 20 nt, Pseudomonas putida KT2440
ccugcacaucggccaccgcc

SEQ ID NO: 1604706 - RNA, 19 nt, Pseudomonas putida KT2440
ccugcacacugcccagcag

SEQ ID NO: 1604707 - RNA, 21 nt, Pseudomonas putida KT2440
ccugcaagccggcgaacagca

SEQ ID NO: 1604708 - RNA, 15 nt, Pseudomonas putida KT2440
ccugcaauuucuuga

SEQ ID NO: 1604709 - RNA, 14 nt, Pseudomonas putida KT2440
ccugcaacugggca

SEQ ID NO: 1604710 - RNA, 17 nt, Pseudomonas putida KT2440
ccugaaugucaucugag

SEQ ID NO: 1604711 - RNA, 16 nt, Pseudomonas putida KT2440
ccugcaacgucgccac

SEQ ID NO: 1604712 - RNA, 21 nt, Pseudomonas putida KT2440
ccugccgaugggcacuggcca

SEQ ID NO: 1604713 - RNA, 19 nt, Pseudomonas putida KT2440
ccugcccgaucgccucgcu

SEQ ID NO: 1604714 - RNA, 17 nt, Pseudomonas putida KT2440
ccugcccgccccccacc

SEQ ID NO: 1604715 - RNA, 13 nt, Pseudomonas putida KT2440
ccugcccgccguc

SEQ ID NO: 1604716 - RNA, 16 nt, Pseudomonas putida KT2440
ccugcccgccguccag

SEQ ID NO: 1604717 - RNA, 17 nt, Pseudomonas putida KT2440
ccugcaugcgugccuug

SEQ ID NO: 1604718 - RNA, 19 nt, Pseudomonas putida KT2440
ccugcauggcauucgccac

SEQ ID NO: 1604719 - RNA, 20 nt, Pseudomonas putida KT2440
ccugcauggcauucgccacu

SEQ ID NO: 1604720 - RNA, 22 nt, Pseudomonas putida KT2440
ccugcaugucuucgcccgguuc

SEQ ID NO: 1604721 - RNA, 14 nt, Pseudomonas putida KT2440
ccugcauccacacc

SEQ ID NO: 1604722 - RNA, 22 nt, Pseudomonas putida KT2440
ccugcauccacaccagcggcgc

SEQ ID NO: 1604723 - RNA, 18 nt, Pseudomonas putida KT2440
ccugcauccguucggcgc

SEQ ID NO: 1604724 - RNA, 17 nt, Pseudomonas putida KT2440
ccugcagguacagcagc

SEQ ID NO: 1604725 - RNA, 16 nt, Pseudomonas putida KT2440
ccugcagcacccuucc

SEQ ID NO: 1604726 - RNA, 10 nt, Pseudomonas putida KT2440
ccugcagaga

SEQ ID NO: 1604727 - RNA, 18 nt, Pseudomonas putida KT2440
ccugcagagacaucucca

SEQ ID NO: 1604728 - RNA, 22 nt, Pseudomonas putida KT2440
ccugcagagacaucuccauagg

SEQ ID NO: 1604729 - RNA, 18 nt, Pseudomonas putida KT2440
ccugcagagcucagcgug

SEQ ID NO: 1604730 - RNA, 21 nt, Pseudomonas putida KT2440
ccugcggcuguccagcaaggg

SEQ ID NO: 1604731 - RNA, 23 nt, Pseudomonas putida KT2440
ccugcggcugccccaacugcauc

SEQ ID NO: 1604732 - RNA, 18 nt, Pseudomonas putida KT2440
ccugcgggucauccucaa

SEQ ID NO: 1604733 - RNA, 16 nt, Pseudomonas putida KT2440
ccugcgcuugcaccag

SEQ ID NO: 1604734 - RNA, 20 nt, Pseudomonas putida KT2440
ccugcggcagauccugcagc

SEQ ID NO: 1604735 - RNA, 14 nt, Pseudomonas putida KT2440
ccugcgccgccacc

SEQ ID NO: 1604736 - RNA, 13 nt, Pseudomonas putida KT2440
ccugcgccaggca

SEQ ID NO: 1604737 - RNA, 11 nt, Pseudomonas putida KT2440
ccugcgccgcc

SEQ ID NO: 1604738 - RNA, 18 nt, Pseudomonas putida KT2440
ccugcgcacggcgcuggg

SEQ ID NO: 1604739 - RNA, 21 nt, Pseudomonas putida KT2440
ccugcgauagaucagcgaugc

SEQ ID NO: 1604740 - RNA, 21 nt, Pseudomonas putida KT2440
ccugcgauugcgauccgcccc

SEQ ID NO: 1604741 - RNA, 22 nt, Pseudomonas putida KT2440
ccugcgauugcgauccgcccca

SEQ ID NO: 1604742 - RNA, 15 nt, Pseudomonas putida KT2440
ccugccuaccaccgc

SEQ ID NO: 1604743 - RNA, 15 nt, Pseudomonas putida KT2440
ccugaacgaugcccg

SEQ ID NO: 1604744 - RNA, 19 nt, Pseudomonas putida KT2440
ccugaacgaugcccgggcc

SEQ ID NO: 1604745 - RNA, 21 nt, Pseudomonas putida KT2440
ccugaacggugaagucaacca

SEQ ID NO: 1604746 - RNA, 17 nt, Pseudomonas putida KT2440
ccugaagcccuggauga

SEQ ID NO: 1604747 - RNA, 14 nt, Pseudomonas putida KT2440
ccugaacaaggccu

SEQ ID NO: 1604748 - RNA, 18 nt, Pseudomonas putida KT2440
ccugaaccaugcgccgcu

SEQ ID NO: 1604749 - RNA, 16 nt, Pseudomonas putida KT2440
ccugaaaccccgcccc

SEQ ID NO: 1604750 - RNA, 20 nt, Pseudomonas putida KT2440
ccucuugaauccccuuauaa

SEQ ID NO: 1604751 - RNA, 15 nt, Pseudomonas putida KT2440
ccucuucggccagca

SEQ ID NO: 1604752 - RNA, 20 nt, Pseudomonas putida KT2440
ccucuugcugcaacagcucc

SEQ ID NO: 1604753 - RNA, 16 nt, Pseudomonas putida KT2440
ccucguuacuggugga

SEQ ID NO: 1604754 - RNA, 18 nt, Pseudomonas putida KT2440
ccucguucgcgggcacgc

SEQ ID NO: 1604755 - RNA, 21 nt, Pseudomonas putida KT2440
ccucgcuacccaaacucuuga

SEQ ID NO: 1604756 - RNA, 21 nt, Pseudomonas putida KT2440
ccucguaacgagccuuggcca

SEQ ID NO: 1604757 - RNA, 16 nt, Pseudomonas putida KT2440
ccucgguacccgccag

SEQ ID NO: 1604758 - RNA, 18 nt, Pseudomonas putida KT2440
ccucgguacccgccagca

SEQ ID NO: 1604759 - RNA, 17 nt, Pseudomonas putida KT2440
ccucggucgccgagccg

SEQ ID NO: 1604760 - RNA, 16 nt, Pseudomonas putida KT2440
ccucgacccccuugcc

SEQ ID NO: 1604761 - RNA, 20 nt, Pseudomonas putida KT2440
ccucgacccccuugccagca

SEQ ID NO: 1604762 - RNA, 13 nt, Pseudomonas putida KT2440
ccucgaccgcacc

SEQ ID NO: 1604763 - RNA, 13 nt, Pseudomonas putida KT2440
ccucgaccuggcc

SEQ ID NO: 1604764 - RNA, 13 nt, Pseudomonas putida KT2440
ccucgacacccag

SEQ ID NO: 1604765 - RNA, 20 nt, Pseudomonas putida KT2440
ccucgaccacgaucuuggcc

SEQ ID NO: 1604766 - RNA, 18 nt, Pseudomonas putida KT2440
ccucgaccacgcacagcu

SEQ ID NO: 1604767 - RNA, 19 nt, Pseudomonas putida KT2440
ccucgaacagcgccggcag

SEQ ID NO: 1604768 - RNA, 15 nt, Pseudomonas putida KT2440
ccucgacgggcaggc

SEQ ID NO: 1604769 - RNA, 21 nt, Pseudomonas putida KT2440
ccucgcgcguugcagccauag

SEQ ID NO: 1604770 - RNA, 18 nt, Pseudomonas putida KT2440
ccucgcgcaacaccgcca

SEQ ID NO: 1604771 - RNA, 19 nt, Pseudomonas putida KT2440
ccucgcgcaacaccgccag

SEQ ID NO: 1604772 - RNA, 13 nt, Pseudomonas putida KT2440
ccuacgucagcuu

SEQ ID NO: 1604773 - RNA, 17 nt, Pseudomonas putida KT2440
ccucaucccccggccca

SEQ ID NO: 1604774 - RNA, 15 nt, Pseudomonas putida KT2440
ccucaucaguuccga

SEQ ID NO: 1604775 - RNA, 17 nt, Pseudomonas putida KT2440
ccucaugcagcaccucc

SEQ ID NO: 1604776 - RNA, 20 nt, Pseudomonas putida KT2440
ccucauucaaagccugcucc

SEQ ID NO: 1604777 - RNA, 20 nt, Pseudomonas putida KT2440
ccucauccucgcccaccagc

SEQ ID NO: 1604778 - RNA, 18 nt, Pseudomonas putida KT2440
ccuacccccuccuccagc

SEQ ID NO: 1604779 - RNA, 21 nt, Pseudomonas putida KT2440
ccuacccgaggguggucuugg

SEQ ID NO: 1604780 - RNA, 16 nt, Pseudomonas putida KT2440
ccuacagcaaccgcgu

SEQ ID NO: 1604781 - RNA, 13 nt, Pseudomonas putida KT2440
ccuacccaggcaa

SEQ ID NO: 1604782 - RNA, 15 nt, Pseudomonas putida KT2440
ccuaccgcccgcgcu

SEQ ID NO: 1604783 - RNA, 17 nt, Pseudomonas putida KT2440
ccuacgacggccugcgc

SEQ ID NO: 1604784 - RNA, 22 nt, Pseudomonas putida KT2440
ccuacgggcaaccgcauccccg

SEQ ID NO: 1604785 - RNA, 22 nt, Pseudomonas putida KT2440
ccuacgggcgagcgcgcaggcg

SEQ ID NO: 1604786 - RNA, 22 nt, Pseudomonas putida KT2440
ccuacgggggggcgcagggugu

SEQ ID NO: 1604787 - RNA, 23 nt, Pseudomonas putida KT2440
ccuacggggguucacagccggca

SEQ ID NO: 1604788 - RNA, 12 nt, Pseudomonas putida KT2440
ccuacccgggcg

SEQ ID NO: 1604789 - RNA, 12 nt, Pseudomonas putida KT2440
ccuccagcuggc

SEQ ID NO: 1604790 - RNA, 20 nt, Pseudomonas putida KT2440
ccuccagguucggguaauag

SEQ ID NO: 1604791 - RNA, 15 nt, Pseudomonas putida KT2440
ccuccaguugccagu

SEQ ID NO: 1604792 - RNA, 19 nt, Pseudomonas putida KT2440
ccuccagcacaccgcgcac

SEQ ID NO: 1604793 - RNA, 12 nt, Pseudomonas putida KT2440
ccuccagcagcg

SEQ ID NO: 1604794 - RNA, 20 nt, Pseudomonas putida KT2440
ccuccagcagcgacaccagc

SEQ ID NO: 1604795 - RNA, 16 nt, Pseudomonas putida KT2440
ccuccagcccggcuuc

SEQ ID NO: 1604796 - RNA, 20 nt, Pseudomonas putida KT2440
ccuccagcccggcuucacag

SEQ ID NO: 1604797 - RNA, 22 nt, Pseudomonas putida KT2440
ccuccagcccugcucgccaaau

SEQ ID NO: 1604798 - RNA, 18 nt, Pseudomonas putida KT2440
ccucauucagugccuggg

SEQ ID NO: 1604799 - RNA, 21 nt, Pseudomonas putida KT2440
ccucauucagugccuggguca

SEQ ID NO: 1604800 - RNA, 20 nt, Pseudomonas putida KT2440
ccuccaacucgcgcauccag

SEQ ID NO: 1604801 - RNA, 13 nt, Pseudomonas putida KT2440
ccuccaccccgca

SEQ ID NO: 1604802 - RNA, 19 nt, Pseudomonas putida KT2440
ccuccaccccgcaggccgc

SEQ ID NO: 1604803 - RNA, 22 nt, Pseudomonas putida KT2440
ccuccaccccgcaggccgcagc

SEQ ID NO: 1604804 - RNA, 15 nt, Pseudomonas putida KT2440
ccuccacccgguccc

SEQ ID NO: 1604805 - RNA, 12 nt, Pseudomonas putida KT2440
ccuccaccuuca

SEQ ID NO: 1604806 - RNA, 15 nt, Pseudomonas putida KT2440
ccuccuaaggggaag

SEQ ID NO: 1604807 - RNA, 11 nt, Pseudomonas putida KT2440
ccuccggcccc

SEQ ID NO: 1604808 - RNA, 21 nt, Pseudomonas putida KT2440
ccuccucgcgggcaaacccgc

SEQ ID NO: 1604809 - RNA, 18 nt, Pseudomonas putida KT2440
ccuccugaccaacuuuuc

SEQ ID NO: 1604810 - RNA, 24 nt, Pseudomonas putida KT2440
ccuccugcggcagauccugcagcc

SEQ ID NO: 1604811 - RNA, 21 nt, Pseudomonas putida KT2440
ccuccuucagguaauccacca

SEQ ID NO: 1604812 - RNA, 18 nt, Pseudomonas putida KT2440
ccuccgagucuccgcgcu

SEQ ID NO: 1604813 - RNA, 13 nt, Pseudomonas putida KT2440
ccucccccacccc

SEQ ID NO: 1604814 - RNA, 20 nt, Pseudomonas putida KT2440
ccucccccacccccgcccca

SEQ ID NO: 1604815 - RNA, 18 nt, Pseudomonas putida KT2440
ccuccccaaucaccagga

SEQ ID NO: 1604816 - RNA, 13 nt, Pseudomonas putida KT2440
ccguucaggucau

SEQ ID NO: 1604817 - RNA, 20 nt, Pseudomonas putida KT2440
ccguguacgacugccgcccu

SEQ ID NO: 1604818 - RNA, 23 nt, Pseudomonas putida KT2440
ccgugguaucgcuuacagauguc

SEQ ID NO: 1604819 - RNA, 22 nt, Pseudomonas putida KT2440
ccguggucgccuucacugcgcg

SEQ ID NO: 1604820 - RNA, 23 nt, Pseudomonas putida KT2440
ccgugcuguguuucgcccccggc

SEQ ID NO: 1604821 - RNA, 17 nt, Pseudomonas putida KT2440
ccgugcggccaaagcug

SEQ ID NO: 1604822 - RNA, 14 nt, Pseudomonas putida KT2440
ccgugagcauggca

SEQ ID NO: 1604823 - RNA, 13 nt, Pseudomonas putida KT2440
ccgugagccagga

SEQ ID NO: 1604824 - RNA, 18 nt, Pseudomonas putida KT2440
ccgugaagacgcacacuc

SEQ ID NO: 1604825 - RNA, 21 nt, Pseudomonas putida KT2440
ccgugaagacgcacacucccc

SEQ ID NO: 1604826 - RNA, 16 nt, Pseudomonas putida KT2440
ccgugaaccaucccac

SEQ ID NO: 1604827 - RNA, 18 nt, Pseudomonas putida KT2440
ccgugaaccaucccacuc

SEQ ID NO: 1604828 - RNA, 14 nt, Pseudomonas putida KT2440
ccgugcccaccagc

SEQ ID NO: 1604829 - RNA, 17 nt, Pseudomonas putida KT2440
ccgugcccgcccacgcc

SEQ ID NO: 1604830 - RNA, 18 nt, Pseudomonas putida KT2440
ccgugccgcaucagccgg

SEQ ID NO: 1604831 - RNA, 13 nt, Pseudomonas putida KT2440
ccgugccuuccag

SEQ ID NO: 1604832 - RNA, 14 nt, Pseudomonas putida KT2440
ccguucgccagcuu

SEQ ID NO: 1604833 - RNA, 22 nt, Pseudomonas putida KT2440
ccguugcugcggggugcucugc

SEQ ID NO: 1604834 - RNA, 20 nt, Pseudomonas putida KT2440
ccguuugcuggccugcagcc

SEQ ID NO: 1604835 - RNA, 17 nt, Pseudomonas putida KT2440
ccguuggccaccaccag

SEQ ID NO: 1604836 - RNA, 22 nt, Pseudomonas putida KT2440
ccuacaggggacgcauauccuu

SEQ ID NO: 1604837 - RNA, 21 nt, Pseudomonas putida KT2440
ccuacaggaaucugucagccu

SEQ ID NO: 1604838 - RNA, 16 nt, Pseudomonas putida KT2440
ccuacaggcaaccgca

SEQ ID NO: 1604839 - RNA, 22 nt, Pseudomonas putida KT2440
ccuacaggcaaccgcauccccu

SEQ ID NO: 1604840 - RNA, 24 nt, Pseudomonas putida KT2440
ccguacugcugggucagcacuugc

SEQ ID NO: 1604841 - RNA, 15 nt, Pseudomonas putida KT2440
ccguacuggcugcac

SEQ ID NO: 1604842 - RNA, 23 nt, Pseudomonas putida KT2440
ccguacucggucugguaacccuc

SEQ ID NO: 1604843 - RNA, 20 nt, Pseudomonas putida KT2440
ccguacgguagccccagccg

SEQ ID NO: 1604844 - RNA, 18 nt, Pseudomonas putida KT2440
ccguagcggucaugcagc

SEQ ID NO: 1604845 - RNA, 14 nt, Pseudomonas putida KT2440
ccggugcccuugcc

SEQ ID NO: 1604846 - RNA, 22 nt, Pseudomonas putida KT2440
ccggugccauccaccgcgccag

SEQ ID NO: 1604847 - RNA, 20 nt, Pseudomonas putida KT2440
ccggugcaacugccacgccc

SEQ ID NO: 1604848 - RNA, 18 nt, Pseudomonas putida KT2440
ccgucguuguucuucagg

SEQ ID NO: 1604849 - RNA, 23 nt, Pseudomonas putida KT2440
ccgucuuccucgacccagccacc

SEQ ID NO: 1604850 - RNA, 15 nt, Pseudomonas putida KT2440
ccgucgaugccugug

SEQ ID NO: 1604851 - RNA, 15 nt, Pseudomonas putida KT2440
ccgucgagccggguc

SEQ ID NO: 1604852 - RNA, 15 nt, Pseudomonas putida KT2440
ccgucaggccucccc

SEQ ID NO: 1604853 - RNA, 16 nt, Pseudomonas putida KT2440
ccgucaggccuccccg

SEQ ID NO: 1604854 - RNA, 15 nt, Pseudomonas putida KT2440
ccgucagcggcaaca

SEQ ID NO: 1604855 - RNA, 18 nt, Pseudomonas putida KT2440
ccggucacuggcgacagc

SEQ ID NO: 1604856 - RNA, 16 nt, Pseudomonas putida KT2440
ccggucaccugcaaca

SEQ ID NO: 1604857 - RNA, 14 nt, Pseudomonas putida KT2440
ccggucacccccau

SEQ ID NO: 1604858 - RNA, 20 nt, Pseudomonas putida KT2440
ccggucacccccaucagcgg

SEQ ID NO: 1604859 - RNA, 20 nt, Pseudomonas putida KT2440
ccgguauuggccacguugau

SEQ ID NO: 1604860 - RNA, 21 nt, Pseudomonas putida KT2440
ccgguagugaugcaucagcuc

SEQ ID NO: 1604861 - RNA, 17 nt, Pseudomonas putida KT2440
ccgguaacuggcccacc

SEQ ID NO: 1604862 - RNA, 18 nt, Pseudomonas putida KT2440
ccgggucaaggccagcgc

SEQ ID NO: 1604863 - RNA, 21 nt, Pseudomonas putida KT2440
ccgggucaaggccagcgccug

SEQ ID NO: 1604864 - RNA, 14 nt, Pseudomonas putida KT2440
ccgggucacggcug

SEQ ID NO: 1604865 - RNA, 23 nt, Pseudomonas putida KT2440
ccggguacagccccugcauccgu

SEQ ID NO: 1604866 - RNA, 19 nt, Pseudomonas putida KT2440
ccggguaaucgccaggccc

SEQ ID NO: 1604867 - RNA, 21 nt, Pseudomonas putida KT2440
ccgggguguuacgccaggcgu

SEQ ID NO: 1604868 - RNA, 18 nt, Pseudomonas putida KT2440
ccggggccgcaaggcggc

SEQ ID NO: 1604869 - RNA, 12 nt, Pseudomonas putida KT2440
ccgggucagcuc

SEQ ID NO: 1604870 - RNA, 13 nt, Pseudomonas putida KT2440
ccgggucagcucg

SEQ ID NO: 1604871 - RNA, 16 nt, Pseudomonas putida KT2440
ccggguucugcaggau

SEQ ID NO: 1604872 - RNA, 16 nt, Pseudomonas putida KT2440
ccggguuuacaccacc

SEQ ID NO: 1604873 - RNA, 16 nt, Pseudomonas putida KT2440
ccgggacagcaccaug

SEQ ID NO: 1604874 - RNA, 15 nt, Pseudomonas putida KT2440
ccgggccaccaccgc

SEQ ID NO: 1604875 - RNA, 19 nt, Pseudomonas putida KT2440
ccgggaaaagccugccagg

SEQ ID NO: 1604876 - RNA, 22 nt, Pseudomonas putida KT2440
ccgggaagcgcccgcccaccac

SEQ ID NO: 1604877 - RNA, 16 nt, Pseudomonas putida KT2440
ccgggaacagccgcgc

SEQ ID NO: 1604878 - RNA, 20 nt, Pseudomonas putida KT2440
ccgggaacaggugcgcgcgc

SEQ ID NO: 1604879 - RNA, 16 nt, Pseudomonas putida KT2440
ccggcuugucuuccag

SEQ ID NO: 1604880 - RNA, 19 nt, Pseudomonas putida KT2440
ccggcuuguucuguuucac

SEQ ID NO: 1604881 - RNA, 19 nt, Pseudomonas putida KT2440
ccgggccaugcuuuccagg

SEQ ID NO: 1604882 - RNA, 22 nt, Pseudomonas putida KT2440
ccgggcgguugucgaccuggcu

SEQ ID NO: 1604883 - RNA, 15 nt, Pseudomonas putida KT2440
ccgggcgggugcaug

SEQ ID NO: 1604884 - RNA, 18 nt, Pseudomonas putida KT2440
ccgggcgggugcauggcu

SEQ ID NO: 1604885 - RNA, 19 nt, Pseudomonas putida KT2440
ccgggcgggugcauggcuc

SEQ ID NO: 1604886 - RNA, 12 nt, Pseudomonas putida KT2440
ccggggcagcau

SEQ ID NO: 1604887 - RNA, 13 nt, Pseudomonas putida KT2440
ccggggcaggcug

SEQ ID NO: 1604888 - RNA, 22 nt, Pseudomonas putida KT2440
ccggggcaggcugugcggcaac

SEQ ID NO: 1604889 - RNA, 14 nt, Pseudomonas putida KT2440
ccggggcaaccugg

SEQ ID NO: 1604890 - RNA, 12 nt, Pseudomonas putida KT2440
ccggggaaaggu

SEQ ID NO: 1604891 - RNA, 17 nt, Pseudomonas putida KT2440
ccgggcugcugcgcagc

SEQ ID NO: 1604892 - RNA, 20 nt, Pseudomonas putida KT2440
ccggcgucgaucugcaggug

SEQ ID NO: 1604893 - RNA, 21 nt, Pseudomonas putida KT2440
ccggcgucgaucugcaggugg

SEQ ID NO: 1604894 - RNA, 17 nt, Pseudomonas putida KT2440
ccggcgucccggccagc

SEQ ID NO: 1604895 - RNA, 20 nt, Pseudomonas putida KT2440
ccggcggugaugccauugau

SEQ ID NO: 1604896 - RNA, 23 nt, Pseudomonas putida KT2440
ccggcggcgcgaaucagcgccuc

SEQ ID NO: 1604897 - RNA, 18 nt, Pseudomonas putida KT2440
ccggcggauagccccgcc

SEQ ID NO: 1604898 - RNA, 21 nt, Pseudomonas putida KT2440
ccggcggcgaacaucugcucg

SEQ ID NO: 1604899 - RNA, 15 nt, Pseudomonas putida KT2440
ccggccaccaggcgc

SEQ ID NO: 1604900 - RNA, 20 nt, Pseudomonas putida KT2440
ccggccaggcucgacggcgc

SEQ ID NO: 1604901 - RNA, 16 nt, Pseudomonas putida KT2440
ccggccaggccgugcu

SEQ ID NO: 1604902 - RNA, 13 nt, Pseudomonas putida KT2440
ccggccagugccu

SEQ ID NO: 1604903 - RNA, 20 nt, Pseudomonas putida KT2440
ccggcugguacuccacuucc

SEQ ID NO: 1604904 - RNA, 21 nt, Pseudomonas putida KT2440
ccggcugguacuccacuucca

SEQ ID NO: 1604905 - RNA, 14 nt, Pseudomonas putida KT2440
ccggcugcauccac

SEQ ID NO: 1604906 - RNA, 22 nt, Pseudomonas putida KT2440
ccggcugaaauggcggcccagc

SEQ ID NO: 1604907 - RNA, 23 nt, Pseudomonas putida KT2440
ccggcugaaauggcggcccagcc

SEQ ID NO: 1604908 - RNA, 22 nt, Pseudomonas putida KT2440
ccggcuugagcaguucauccgg

SEQ ID NO: 1604909 - RNA, 15 nt, Pseudomonas putida KT2440
ccggcuugccuucaa

SEQ ID NO: 1604910 - RNA, 16 nt, Pseudomonas putida KT2440
ccggcuuggcaccucc

SEQ ID NO: 1604911 - RNA, 15 nt, Pseudomonas putida KT2440
ccggcuugcgcccgu

SEQ ID NO: 1604912 - RNA, 22 nt, Pseudomonas putida KT2440
ccggcuugcuccaagugccgug

SEQ ID NO: 1604913 - RNA, 13 nt, Pseudomonas putida KT2440
ccggcugucucca

SEQ ID NO: 1604914 - RNA, 14 nt, Pseudomonas putida KT2440
ccggcuggacaccu

SEQ ID NO: 1604915 - RNA, 16 nt, Pseudomonas putida KT2440
ccggcgucggcgcgca

SEQ ID NO: 1604916 - RNA, 17 nt, Pseudomonas putida KT2440
ccggcguguccagcagg

SEQ ID NO: 1604917 - RNA, 14 nt, Pseudomonas putida KT2440
ccggcgugccgucg

SEQ ID NO: 1604918 - RNA, 16 nt, Pseudomonas putida KT2440
ccggcuaucggccagc

SEQ ID NO: 1604919 - RNA, 24 nt, Pseudomonas putida KT2440
ccggcuaggcgaucggcuuucauu

SEQ ID NO: 1604920 - RNA, 17 nt, Pseudomonas putida KT2440
ccggcucaucaggcgau

SEQ ID NO: 1604921 - RNA, 13 nt, Pseudomonas putida KT2440
ccggcuccacacc

SEQ ID NO: 1604922 - RNA, 20 nt, Pseudomonas putida KT2440
ccggcuccaccugcuccagc

SEQ ID NO: 1604923 - RNA, 16 nt, Pseudomonas putida KT2440
ccggcucgccauugau

SEQ ID NO: 1604924 - RNA, 13 nt, Pseudomonas putida KT2440
cgaggccccagac

SEQ ID NO: 1604925 - RNA, 20 nt, Pseudomonas putida KT2440
cgaggcccgaacuggccggu

SEQ ID NO: 1604926 - RNA, 17 nt, Pseudomonas putida KT2440
cgaggaugcggcugacc

SEQ ID NO: 1604927 - RNA, 18 nt, Pseudomonas putida KT2440
cgaggauuuucaccuucg

SEQ ID NO: 1604928 - RNA, 15 nt, Pseudomonas putida KT2440
cgaggcaaucagggc

SEQ ID NO: 1604929 - RNA, 20 nt, Pseudomonas putida KT2440
cgaggcguuggccaaaccgu

SEQ ID NO: 1604930 - RNA, 14 nt, Pseudomonas putida KT2440
cgaggcgugaucac

SEQ ID NO: 1604931 - RNA, 14 nt, Pseudomonas putida KT2440
cgaggacagcaucu

SEQ ID NO: 1604932 - RNA, 15 nt, Pseudomonas putida KT2440
cgaggaauugcgcca

SEQ ID NO: 1604933 - RNA, 23 nt, Pseudomonas putida KT2440
cgaggaauugcgccaggauggcu

SEQ ID NO: 1604934 - RNA, 20 nt, Pseudomonas putida KT2440
cgaggacaacaaggacugcc

SEQ ID NO: 1604935 - RNA, 18 nt, Pseudomonas putida KT2440
cgagcuuuguagcucccu

SEQ ID NO: 1604936 - RNA, 14 nt, Pseudomonas putida KT2440
cgaggaaacccgcg

SEQ ID NO: 1604937 - RNA, 14 nt, Pseudomonas putida KT2440
cgagcguuuuucuc

SEQ ID NO: 1604938 - RNA, 13 nt, Pseudomonas putida KT2440
cgagcuacagccc

SEQ ID NO: 1604939 - RNA, 15 nt, Pseudomonas putida KT2440
cgagcuacagccccu

SEQ ID NO: 1604940 - RNA, 16 nt, Pseudomonas putida KT2440
cgagcugauccgccug

SEQ ID NO: 1604941 - RNA, 17 nt, Pseudomonas putida KT2440
cgagcugauccgccugg

SEQ ID NO: 1604942 - RNA, 20 nt, Pseudomonas putida KT2440
cgagcugaaagugccgccuc

SEQ ID NO: 1604943 - RNA, 21 nt, Pseudomonas putida KT2440
cgagcgccugauuacccugcg

SEQ ID NO: 1604944 - RNA, 15 nt, Pseudomonas putida KT2440
cgagcgaacagcucg

SEQ ID NO: 1604945 - RNA, 15 nt, Pseudomonas putida KT2440
cgagccuugccaacg

SEQ ID NO: 1604946 - RNA, 20 nt, Pseudomonas putida KT2440
cgagccuugccaacggcacu

SEQ ID NO: 1604947 - RNA, 15 nt, Pseudomonas putida KT2440
cgagccuuggccagc

SEQ ID NO: 1604948 - RNA, 14 nt, Pseudomonas putida KT2440
cgagccgcugccaa

SEQ ID NO: 1604949 - RNA, 17 nt, Pseudomonas putida KT2440
cgagccggguccacccg

SEQ ID NO: 1604950 - RNA, 17 nt, Pseudomonas putida KT2440
cgaguuuccggcaaaga

SEQ ID NO: 1604951 - RNA, 22 nt, Pseudomonas putida KT2440
cgauauguggggcgugcucggc

SEQ ID NO: 1604952 - RNA, 13 nt, Pseudomonas putida KT2440
cgauacccagcca

SEQ ID NO: 1604953 - RNA, 14 nt, Pseudomonas putida KT2440
cgauacccaggcgc

SEQ ID NO: 1604954 - RNA, 14 nt, Pseudomonas putida KT2440
cgauacccaauaaa

SEQ ID NO: 1604955 - RNA, 15 nt, Pseudomonas putida KT2440
cgaguaacccuggca

SEQ ID NO: 1604956 - RNA, 13 nt, Pseudomonas putida KT2440
cgagucagggcuu

SEQ ID NO: 1604957 - RNA, 13 nt, Pseudomonas putida KT2440
cgaguccugccuu

SEQ ID NO: 1604958 - RNA, 15 nt, Pseudomonas putida KT2440
cgaguauccccacca

SEQ ID NO: 1604959 - RNA, 22 nt, Pseudomonas putida KT2440
cgagugaccuuggcugggucca

SEQ ID NO: 1604960 - RNA, 16 nt, Pseudomonas putida KT2440
cgagugcccgcgcagg

SEQ ID NO: 1604961 - RNA, 19 nt, Pseudomonas putida KT2440
cgaguggaucaaccgacca

SEQ ID NO: 1604962 - RNA, 12 nt, Pseudomonas putida KT2440
cgacgucggcgu

SEQ ID NO: 1604963 - RNA, 18 nt, Pseudomonas putida KT2440
cgacguuuaccugcagcu

SEQ ID NO: 1604964 - RNA, 14 nt, Pseudomonas putida KT2440
cgacucuucaccag

SEQ ID NO: 1604965 - RNA, 16 nt, Pseudomonas putida KT2440
cgacuccaccgcgcgc

SEQ ID NO: 1604966 - RNA, 16 nt, Pseudomonas putida KT2440
cgacucacgcucguug

SEQ ID NO: 1604967 - RNA, 15 nt, Pseudomonas putida KT2440
cgacuucccgcaagc

SEQ ID NO: 1604968 - RNA, 13 nt, Pseudomonas putida KT2440
cgacuucaaugcc

SEQ ID NO: 1604969 - RNA, 16 nt, Pseudomonas putida KT2440
cgacugcacugccagc

SEQ ID NO: 1604970 - RNA, 16 nt, Pseudomonas putida KT2440
cgacugaggcaccggu

SEQ ID NO: 1604971 - RNA, 23 nt, Pseudomonas putida KT2440
cgacugcaagcgaugcacgccag

SEQ ID NO: 1604972 - RNA, 18 nt, Pseudomonas putida KT2440
cgacugacgcuacgccgc

SEQ ID NO: 1604973 - RNA, 16 nt, Pseudomonas putida KT2440
cgacuggugcucugca

SEQ ID NO: 1604974 - RNA, 17 nt, Pseudomonas putida KT2440
cgacuggugcucugcag

SEQ ID NO: 1604975 - RNA, 21 nt, Pseudomonas putida KT2440
cgacgcuuggcguaauccagc

SEQ ID NO: 1604976 - RNA, 17 nt, Pseudomonas putida KT2440
cgacggaacggccgcac

SEQ ID NO: 1604977 - RNA, 20 nt, Pseudomonas putida KT2440
cgacggauuggaaaauguua

SEQ ID NO: 1604978 - RNA, 12 nt, Pseudomonas putida KT2440
cgacgcgcgcag

SEQ ID NO: 1604979 - RNA, 17 nt, Pseudomonas putida KT2440
cgacgccuuggcgcagc

SEQ ID NO: 1604980 - RNA, 21 nt, Pseudomonas putida KT2440
cgacgccuuggcgcagcaagg

SEQ ID NO: 1604981 - RNA, 14 nt, Pseudomonas putida KT2440
cgacgggcugagcc

SEQ ID NO: 1604982 - RNA, 15 nt, Pseudomonas putida KT2440
cgagaagcagaacau

SEQ ID NO: 1604983 - RNA, 16 nt, Pseudomonas putida KT2440
cgagaacagcuggaug

SEQ ID NO: 1604984 - RNA, 20 nt, Pseudomonas putida KT2440
cgagaaacucacgcauggcc

SEQ ID NO: 1604985 - RNA, 17 nt, Pseudomonas putida KT2440
cgagaccuugccuuccg

SEQ ID NO: 1604986 - RNA, 16 nt, Pseudomonas putida KT2440
cgagacgguggcugcc

SEQ ID NO: 1604987 - RNA, 21 nt, Pseudomonas putida KT2440
cgagaucagguggaucagggu

SEQ ID NO: 1604988 - RNA, 22 nt, Pseudomonas putida KT2440
cgagaucagguggaucaggguc

SEQ ID NO: 1604989 - RNA, 17 nt, Pseudomonas putida KT2440
cgagagcggcuucuacc

SEQ ID NO: 1604990 - RNA, 13 nt, Pseudomonas putida KT2440
cgagaggcgcugc

SEQ ID NO: 1604991 - RNA, 20 nt, Pseudomonas putida KT2440
cgagcaucugcugcggcagg

SEQ ID NO: 1604992 - RNA, 16 nt, Pseudomonas putida KT2440
cgagcaucuuccagcc

SEQ ID NO: 1604993 - RNA, 18 nt, Pseudomonas putida KT2440
cgagcaucuuccagccug

SEQ ID NO: 1604994 - RNA, 23 nt, Pseudomonas putida KT2440
cgagcaugaggauacgacgcauc

SEQ ID NO: 1604995 - RNA, 16 nt, Pseudomonas putida KT2440
cgagcauuacaggcag

SEQ ID NO: 1604996 - RNA, 17 nt, Pseudomonas putida KT2440
cgagcagguucaggcgc

SEQ ID NO: 1604997 - RNA, 18 nt, Pseudomonas putida KT2440
cgagccauugacccgcuu

SEQ ID NO: 1604998 - RNA, 21 nt, Pseudomonas putida KT2440
cgagccccauucgcugcguca

SEQ ID NO: 1604999 - RNA, 13 nt, Pseudomonas putida KT2440
cgagcccgccagc

SEQ ID NO: 1605000 - RNA, 23 nt, Pseudomonas putida KT2440
cgagcccgccagcaggccaccgg

SEQ ID NO: 1605001 - RNA, 24 nt, Pseudomonas putida KT2440
cgagcccgccagcaggccaccggc

SEQ ID NO: 1605002 - RNA, 16 nt, Pseudomonas putida KT2440
cgagccgaacagcagg

SEQ ID NO: 1605003 - RNA, 17 nt, Pseudomonas putida KT2440
cgagcagccuggcauuu

SEQ ID NO: 1605004 - RNA, 16 nt, Pseudomonas putida KT2440
cgagcaggcccgcccc

SEQ ID NO: 1605005 - RNA, 17 nt, Pseudomonas putida KT2440
cgcaguucgauguaggc

SEQ ID NO: 1605006 - RNA, 16 nt, Pseudomonas putida KT2440
cgcaguucguccaggc

SEQ ID NO: 1605007 - RNA, 18 nt, Pseudomonas putida KT2440
cgcauagcagaacagaaa

SEQ ID NO: 1605008 - RNA, 19 nt, Pseudomonas putida KT2440
cgcauagcagaacagaaac

SEQ ID NO: 1605009 - RNA, 17 nt, Pseudomonas putida KT2440
cgcauaugccccaggca

SEQ ID NO: 1605010 - RNA, 13 nt, Pseudomonas putida KT2440
cgcaucagccgcg

SEQ ID NO: 1605011 - RNA, 16 nt, Pseudomonas putida KT2440
cgcaucagccgcgccc

SEQ ID NO: 1605012 - RNA, 17 nt, Pseudomonas putida KT2440
cgcaucagccgcgcccu

SEQ ID NO: 1605013 - RNA, 21 nt, Pseudomonas putida KT2440
cgcaucacccgccccucuucc

SEQ ID NO: 1605014 - RNA, 21 nt, Pseudomonas putida KT2440
cgcaucaacgaaucauccucg

SEQ ID NO: 1605015 - RNA, 22 nt, Pseudomonas putida KT2440
cgcaucaacguucccaauguca

SEQ ID NO: 1605016 - RNA, 13 nt, Pseudomonas putida KT2440
cgcaucaggcugc

SEQ ID NO: 1605017 - RNA, 19 nt, Pseudomonas putida KT2440
cgcaucaggcugcgcccgc

SEQ ID NO: 1605018 - RNA, 23 nt, Pseudomonas putida KT2440
cgcaucauggcggugaauagcag

SEQ ID NO: 1605019 - RNA, 13 nt, Pseudomonas putida KT2440
cgcauccagccag

SEQ ID NO: 1605020 - RNA, 17 nt, Pseudomonas putida KT2440
cgcauccagcacugccu

SEQ ID NO: 1605021 - RNA, 20 nt, Pseudomonas putida KT2440
cgcaucgcuguccuuggcca

SEQ ID NO: 1605022 - RNA, 17 nt, Pseudomonas putida KT2440
cgcaugacuuccaggua

SEQ ID NO: 1605023 - RNA, 15 nt, Pseudomonas putida KT2440
cgcaugcccgcgcaa

SEQ ID NO: 1605024 - RNA, 23 nt, Pseudomonas putida KT2440
cgcaucguuauccagcacccaca

SEQ ID NO: 1605025 - RNA, 19 nt, Pseudomonas putida KT2440
cgcaucugcaccggcagcg

SEQ ID NO: 1605026 - RNA, 18 nt, Pseudomonas putida KT2440
cgcaucgcgagcaagcuc

SEQ ID NO: 1605027 - RNA, 15 nt, Pseudomonas putida KT2440
cgcagggucgcgccc

SEQ ID NO: 1605028 - RNA, 18 nt, Pseudomonas putida KT2440
cgcaggguggcgcugacc

SEQ ID NO: 1605029 - RNA, 14 nt, Pseudomonas putida KT2440
cgcagggugucggu

SEQ ID NO: 1605030 - RNA, 19 nt, Pseudomonas putida KT2440
cgcagggugugcugcugcc

SEQ ID NO: 1605031 - RNA, 15 nt, Pseudomonas putida KT2440
cgcagguacucgccg

SEQ ID NO: 1605032 - RNA, 19 nt, Pseudomonas putida KT2440
cgcaggucuucucggcaga

SEQ ID NO: 1605033 - RNA, 20 nt, Pseudomonas putida KT2440
cgcaggucuugcccacuucc

SEQ ID NO: 1605034 - RNA, 15 nt, Pseudomonas putida KT2440
cgcagugcagccgcg

SEQ ID NO: 1605035 - RNA, 16 nt, Pseudomonas putida KT2440
cgcaggcccagcaggu

SEQ ID NO: 1605036 - RNA, 18 nt, Pseudomonas putida KT2440
cgcaggcgacgagccagu

SEQ ID NO: 1605037 - RNA, 13 nt, Pseudomonas putida KT2440
cgcaggccgcagc

SEQ ID NO: 1605038 - RNA, 13 nt, Pseudomonas putida KT2440
cgcaggcgcaacu

SEQ ID NO: 1605039 - RNA, 13 nt, Pseudomonas putida KT2440
cgcaggcgcgaca

SEQ ID NO: 1605040 - RNA, 16 nt, Pseudomonas putida KT2440
cgcaggcgccgccagc

SEQ ID NO: 1605041 - RNA, 19 nt, Pseudomonas putida KT2440
cgcaggcgccgccagcugc

SEQ ID NO: 1605042 - RNA, 19 nt, Pseudomonas putida KT2440
cgcagcguaauagcuggug

SEQ ID NO: 1605043 - RNA, 13 nt, Pseudomonas putida KT2440
cgcagcuccacug

SEQ ID NO: 1605044 - RNA, 14 nt, Pseudomonas putida KT2440
cgcagcacccgguc

SEQ ID NO: 1605045 - RNA, 20 nt, Pseudomonas putida KT2440
cgcagcacaagacugcugug

SEQ ID NO: 1605046 - RNA, 19 nt, Pseudomonas putida KT2440
cgcagcacaucacacagcg

SEQ ID NO: 1605047 - RNA, 16 nt, Pseudomonas putida KT2440
cgcauuugcuccaggg

SEQ ID NO: 1605048 - RNA, 23 nt, Pseudomonas putida KT2440
cgcauugcccgcgacgaaaccca

SEQ ID NO: 1605049 - RNA, 22 nt, Pseudomonas putida KT2440
cgcauucgcggguaaacccggg

SEQ ID NO: 1605050 - RNA, 15 nt, Pseudomonas putida KT2440
cgcaugcucgcugcu

SEQ ID NO: 1605051 - RNA, 18 nt, Pseudomonas putida KT2440
cgcaugcucguuguaguc

SEQ ID NO: 1605052 - RNA, 13 nt, Pseudomonas putida KT2440
cgcaugcgcgcca

SEQ ID NO: 1605053 - RNA, 19 nt, Pseudomonas putida KT2440
cgcauggcaaucgggccgg

SEQ ID NO: 1605054 - RNA, 23 nt, Pseudomonas putida KT2440
cgcauggugguagggaaauccuc

SEQ ID NO: 1605055 - RNA, 23 nt, Pseudomonas putida KT2440
cgcauggccuggucgaaggucag

SEQ ID NO: 1605056 - RNA, 20 nt, Pseudomonas putida KT2440
cgcaugcugccaggcaaagu

SEQ ID NO: 1605057 - RNA, 20 nt, Pseudomonas putida KT2440
cgccaacuguuucugcucuu

SEQ ID NO: 1605058 - RNA, 16 nt, Pseudomonas putida KT2440
cgccaaccgcgccagc

SEQ ID NO: 1605059 - RNA, 17 nt, Pseudomonas putida KT2440
cgccaacgcccccgcca

SEQ ID NO: 1605060 - RNA, 24 nt, Pseudomonas putida KT2440
cgccaaccucaggccugcacugca

SEQ ID NO: 1605061 - RNA, 15 nt, Pseudomonas putida KT2440
cgccaaccugaucau

SEQ ID NO: 1605062 - RNA, 15 nt, Pseudomonas putida KT2440
cgccaaccccacgcc

SEQ ID NO: 1605063 - RNA, 20 nt, Pseudomonas putida KT2440
cgccaaauucgaccagcagu

SEQ ID NO: 1605064 - RNA, 13 nt, Pseudomonas putida KT2440
cgccaacaacaag

SEQ ID NO: 1605065 - RNA, 14 nt, Pseudomonas putida KT2440
cgccaacagcaccc

SEQ ID NO: 1605066 - RNA, 16 nt, Pseudomonas putida KT2440
cgccaacagcacccgc

SEQ ID NO: 1605067 - RNA, 14 nt, Pseudomonas putida KT2440
cgccaacaccaccu

SEQ ID NO: 1605068 - RNA, 15 nt, Pseudomonas putida KT2440
cgccaacaccaccuc

SEQ ID NO: 1605069 - RNA, 17 nt, Pseudomonas putida KT2440
cgccaaagcgagcaugg

SEQ ID NO: 1605070 - RNA, 17 nt, Pseudomonas putida KT2440
cgccaaaccucaaaugc

SEQ ID NO: 1605071 - RNA, 17 nt, Pseudomonas putida KT2440
cgccaaacgccagggcc

SEQ ID NO: 1605072 - RNA, 21 nt, Pseudomonas putida KT2440
cgccaauacccacgucgacuu

SEQ ID NO: 1605073 - RNA, 14 nt, Pseudomonas putida KT2440
cgccaauagcccgc

SEQ ID NO: 1605074 - RNA, 15 nt, Pseudomonas putida KT2440
cgccaaucaucgcca

SEQ ID NO: 1605075 - RNA, 14 nt, Pseudomonas putida KT2440
cgccaagccgccau

SEQ ID NO: 1605076 - RNA, 16 nt, Pseudomonas putida KT2440
cgccaagauccgcggc

SEQ ID NO: 1605077 - RNA, 20 nt, Pseudomonas putida KT2440
cgccacccccgccgccaggg

SEQ ID NO: 1605078 - RNA, 22 nt, Pseudomonas putida KT2440
cgccaaucucguugcgccaggc

SEQ ID NO: 1605079 - RNA, 14 nt, Pseudomonas putida KT2440
cgccaccgccgugc

SEQ ID NO: 1605080 - RNA, 15 nt, Pseudomonas putida KT2440
cgccaccgcgcgcca

SEQ ID NO: 1605081 - RNA, 23 nt, Pseudomonas putida KT2440
cgccacgccggucgggcacuugu

SEQ ID NO: 1605082 - RNA, 13 nt, Pseudomonas putida KT2440
cgccacgccgcca

SEQ ID NO: 1605083 - RNA, 14 nt, Pseudomonas putida KT2440
cgccacgccgccag

SEQ ID NO: 1605084 - RNA, 19 nt, Pseudomonas putida KT2440
cgccacgcccaacccagcc

SEQ ID NO: 1605085 - RNA, 14 nt, Pseudomonas putida KT2440
cgccacggccaccu

SEQ ID NO: 1605086 - RNA, 20 nt, Pseudomonas putida KT2440
cgccagacaacuggccaggg

SEQ ID NO: 1605087 - RNA, 19 nt, Pseudomonas putida KT2440
cgccagaagguaucggcca

SEQ ID NO: 1605088 - RNA, 16 nt, Pseudomonas putida KT2440
cgccagaaaccaagau

SEQ ID NO: 1605089 - RNA, 20 nt, Pseudomonas putida KT2440
cgccagaaaauucucccggg

SEQ ID NO: 1605090 - RNA, 14 nt, Pseudomonas putida KT2440
cgccagaccaccuc

SEQ ID NO: 1605091 - RNA, 13 nt, Pseudomonas putida KT2440
cgcaagcgcgccg

SEQ ID NO: 1605092 - RNA, 17 nt, Pseudomonas putida KT2440
cgcaaccucguugcugg

SEQ ID NO: 1605093 - RNA, 13 nt, Pseudomonas putida KT2440
cgcaaccugggca

SEQ ID NO: 1605094 - RNA, 15 nt, Pseudomonas putida KT2440
cgcaacgaucggcau

SEQ ID NO: 1605095 - RNA, 18 nt, Pseudomonas putida KT2440
cgcaagaaggcugcccuc

SEQ ID NO: 1605096 - RNA, 21 nt, Pseudomonas putida KT2440
cgcaacccagccccagugugc

SEQ ID NO: 1605097 - RNA, 13 nt, Pseudomonas putida KT2440
cgcaacagugccc

SEQ ID NO: 1605098 - RNA, 19 nt, Pseudomonas putida KT2440
cgcaacaguuuucaaugcu

SEQ ID NO: 1605099 - RNA, 20 nt, Pseudomonas putida KT2440
cgcacaugaagccgcgcagg

SEQ ID NO: 1605100 - RNA, 17 nt, Pseudomonas putida KT2440
cgcacauaccucaucag

SEQ ID NO: 1605101 - RNA, 14 nt, Pseudomonas putida KT2440
cgcacaugccugca

SEQ ID NO: 1605102 - RNA, 12 nt, Pseudomonas putida KT2440
cgcaccaaggcg

SEQ ID NO: 1605103 - RNA, 15 nt, Pseudomonas putida KT2440
cgcacaaacaaccgu

SEQ ID NO: 1605104 - RNA, 14 nt, Pseudomonas putida KT2440
cgcaauccuugccc

SEQ ID NO: 1605105 - RNA, 21 nt, Pseudomonas putida KT2440
cgcaauccuugcccucgccca

SEQ ID NO: 1605106 - RNA, 19 nt, Pseudomonas putida KT2440
cgcaaucaccgccgcccgg

SEQ ID NO: 1605107 - RNA, 14 nt, Pseudomonas putida KT2440
cgcacggucuccgg

SEQ ID NO: 1605108 - RNA, 23 nt, Pseudomonas putida KT2440
cgcacgguaggugaugcggcccu

SEQ ID NO: 1605109 - RNA, 18 nt, Pseudomonas putida KT2440
cgcacguacuccaccaag

SEQ ID NO: 1605110 - RNA, 19 nt, Pseudomonas putida KT2440
cgcacgugggucgggaaca

SEQ ID NO: 1605111 - RNA, 23 nt, Pseudomonas putida KT2440
cgcacgugggucgggaacagcuc

SEQ ID NO: 1605112 - RNA, 12 nt, Pseudomonas putida KT2440
cgcagagcgccc

SEQ ID NO: 1605113 - RNA, 17 nt, Pseudomonas putida KT2440
cgcagagcgcccaccaa

SEQ ID NO: 1605114 - RNA, 18 nt, Pseudomonas putida KT2440
cgcagagcgccccggcaa

SEQ ID NO: 1605115 - RNA, 22 nt, Pseudomonas putida KT2440
cgcagagcggcccugagccuug

SEQ ID NO: 1605116 - RNA, 19 nt, Pseudomonas putida KT2440
cgcagagcauggucaugcc

SEQ ID NO: 1605117 - RNA, 17 nt, Pseudomonas putida KT2440
cgcagauaaccuggcuc

SEQ ID NO: 1605118 - RNA, 14 nt, Pseudomonas putida KT2440
cgcagacuggguga

SEQ ID NO: 1605119 - RNA, 14 nt, Pseudomonas putida KT2440
cgcaccgcggaugc

SEQ ID NO: 1605120 - RNA, 19 nt, Pseudomonas putida KT2440
cgcacgauccccggccggu

SEQ ID NO: 1605121 - RNA, 16 nt, Pseudomonas putida KT2440
cgcaccgggcaaaaaa

SEQ ID NO: 1605122 - RNA, 17 nt, Pseudomonas putida KT2440
cgcacgaagaucaccga

SEQ ID NO: 1605123 - RNA, 16 nt, Pseudomonas putida KT2440
cgcacgcaggauguca

SEQ ID NO: 1605124 - RNA, 19 nt, Pseudomonas putida KT2440
cgcacgcaugcgcgacagc

SEQ ID NO: 1605125 - RNA, 21 nt, Pseudomonas putida KT2440
cgauuuccuucuuguuguuca

SEQ ID NO: 1605126 - RNA, 14 nt, Pseudomonas putida KT2440
cgcaaaaaacuuca

SEQ ID NO: 1605127 - RNA, 15 nt, Pseudomonas putida KT2440
cgcaaaaccaccagc

SEQ ID NO: 1605128 - RNA, 20 nt, Pseudomonas putida KT2440
cgauuuuuuugaaaaaaaga

SEQ ID NO: 1605129 - RNA, 16 nt, Pseudomonas putida KT2440
cgauuuuuuuguccac

SEQ ID NO: 1605130 - RNA, 15 nt, Pseudomonas putida KT2440
cgauuggcaguccug

SEQ ID NO: 1605131 - RNA, 16 nt, Pseudomonas putida KT2440
cgauugccuuccuuga

SEQ ID NO: 1605132 - RNA, 18 nt, Pseudomonas putida KT2440
cgauugcguuuccugugu

SEQ ID NO: 1605133 - RNA, 12 nt, Pseudomonas putida KT2440
cgauugccaggg

SEQ ID NO: 1605134 - RNA, 12 nt, Pseudomonas putida KT2440
cgauuccaaggu

SEQ ID NO: 1605135 - RNA, 13 nt, Pseudomonas putida KT2440
cgauuccagcagg

SEQ ID NO: 1605136 - RNA, 20 nt, Pseudomonas putida KT2440
cgauucugccagcuccuggc

SEQ ID NO: 1605137 - RNA, 22 nt, Pseudomonas putida KT2440
cgaucaaugggccgaucacgaa

SEQ ID NO: 1605138 - RNA, 13 nt, Pseudomonas putida KT2440
cgaucaccagcac

SEQ ID NO: 1605139 - RNA, 14 nt, Pseudomonas putida KT2440
cgaucaccagcccc

SEQ ID NO: 1605140 - RNA, 20 nt, Pseudomonas putida KT2440
cgaucacgcaggcccagcag

SEQ ID NO: 1605141 - RNA, 23 nt, Pseudomonas putida KT2440
cgaucacggggcgacgcaucugc

SEQ ID NO: 1605142 - RNA, 17 nt, Pseudomonas putida KT2440
cgaucaaaacucugcag

SEQ ID NO: 1605143 - RNA, 15 nt, Pseudomonas putida KT2440
cgaugcgcagagcca

SEQ ID NO: 1605144 - RNA, 16 nt, Pseudomonas putida KT2440
cgaugcccuccagccc

SEQ ID NO: 1605145 - RNA, 16 nt, Pseudomonas putida KT2440
cgaugggcugcaaagc

SEQ ID NO: 1605146 - RNA, 12 nt, Pseudomonas putida KT2440
cgauggucaacc

SEQ ID NO: 1605147 - RNA, 19 nt, Pseudomonas putida KT2440
cgaugucggcgugcaccac

SEQ ID NO: 1605148 - RNA, 17 nt, Pseudomonas putida KT2440
cgauguccuugcuggcc

SEQ ID NO: 1605149 - RNA, 16 nt, Pseudomonas putida KT2440
cgaugucgauccacuc

SEQ ID NO: 1605150 - RNA, 21 nt, Pseudomonas putida KT2440
cgaugucguggucgccgucgc

SEQ ID NO: 1605151 - RNA, 15 nt, Pseudomonas putida KT2440
cgaugggcaggccau

SEQ ID NO: 1605152 - RNA, 12 nt, Pseudomonas putida KT2440
cgaugcugugcc

SEQ ID NO: 1605153 - RNA, 21 nt, Pseudomonas putida KT2440
cgaugcuuuugauggucuccg

SEQ ID NO: 1605154 - RNA, 21 nt, Pseudomonas putida KT2440
cgauggaauaggucacguugu

SEQ ID NO: 1605155 - RNA, 22 nt, Pseudomonas putida KT2440
cgaaaugauccccggcgacggc

SEQ ID NO: 1605156 - RNA, 21 nt, Pseudomonas putida KT2440
cgaaaucguaggucacggucu

SEQ ID NO: 1605157 - RNA, 13 nt, Pseudomonas putida KT2440
cgaaaucagccuu

SEQ ID NO: 1605158 - RNA, 15 nt, Pseudomonas putida KT2440
cgaaaucagccuuca

SEQ ID NO: 1605159 - RNA, 18 nt, Pseudomonas putida KT2440
cgaaauacccaacuccag

SEQ ID NO: 1605160 - RNA, 23 nt, Pseudomonas putida KT2440
cgaacacauagucgauacccagg

SEQ ID NO: 1605161 - RNA, 22 nt, Pseudomonas putida KT2440
cgaacaacuguccugugcgcau

SEQ ID NO: 1605162 - RNA, 17 nt, Pseudomonas putida KT2440
cgaacaaggcucagcug

SEQ ID NO: 1605163 - RNA, 19 nt, Pseudomonas putida KT2440
cgaacaaggcucagcugau

SEQ ID NO: 1605164 - RNA, 21 nt, Pseudomonas putida KT2440
cgaacaaggcucagcugaugu

SEQ ID NO: 1605165 - RNA, 21 nt, Pseudomonas putida KT2440
cgaaagcccauaaaccccagc

SEQ ID NO: 1605166 - RNA, 18 nt, Pseudomonas putida KT2440
cgaaagcgguugagauga

SEQ ID NO: 1605167 - RNA, 13 nt, Pseudomonas putida KT2440
cgaaaggggcgca

SEQ ID NO: 1605168 - RNA, 20 nt, Pseudomonas putida KT2440
cgaaacccaguacggcgcca

SEQ ID NO: 1605169 - RNA, 15 nt, Pseudomonas putida KT2440
cgaaacccggcgcag

SEQ ID NO: 1605170 - RNA, 17 nt, Pseudomonas putida KT2440
cgaaacccggcgcagcg

SEQ ID NO: 1605171 - RNA, 16 nt, Pseudomonas putida KT2440
cgaaacgccacgccca

SEQ ID NO: 1605172 - RNA, 23 nt, Pseudomonas putida KT2440
cgaaacgccacgcccaacccagc

SEQ ID NO: 1605173 - RNA, 22 nt, Pseudomonas putida KT2440
cgaaacugcgcucaaccagccg

SEQ ID NO: 1605174 - RNA, 21 nt, Pseudomonas putida KT2440
cgaaacgcaggcucugcgcca

SEQ ID NO: 1605175 - RNA, 14 nt, Pseudomonas putida KT2440
cgaacgcccccagc

SEQ ID NO: 1605176 - RNA, 20 nt, Pseudomonas putida KT2440
cgaacgcgguaagcaccacc

SEQ ID NO: 1605177 - RNA, 13 nt, Pseudomonas putida KT2440
cgaaccucaguac

SEQ ID NO: 1605178 - RNA, 12 nt, Pseudomonas putida KT2440
cgaaccacaucg

SEQ ID NO: 1605179 - RNA, 18 nt, Pseudomonas putida KT2440
cgaaccaccgaugcugug

SEQ ID NO: 1605180 - RNA, 18 nt, Pseudomonas putida KT2440
cgaacauggccacggugu

SEQ ID NO: 1605181 - RNA, 12 nt, Pseudomonas putida KT2440
cgaacagccaga

SEQ ID NO: 1605182 - RNA, 17 nt, Pseudomonas putida KT2440
cgaacacuucacgcaca

SEQ ID NO: 1605183 - RNA, 17 nt, Pseudomonas putida KT2440
cgaacagcacgauggcg

SEQ ID NO: 1605184 - RNA, 17 nt, Pseudomonas putida KT2440
cgaacagcacugccagc

SEQ ID NO: 1605185 - RNA, 13 nt, Pseudomonas putida KT2440
cgaacagcaaugu

SEQ ID NO: 1605186 - RNA, 20 nt, Pseudomonas putida KT2440
cgaacagggccucgauuucu

SEQ ID NO: 1605187 - RNA, 13 nt, Pseudomonas putida KT2440
ccuuuuccugcug

SEQ ID NO: 1605188 - RNA, 19 nt, Pseudomonas putida KT2440
ccuuuuuuuauuuuucugg

SEQ ID NO: 1605189 - RNA, 20 nt, Pseudomonas putida KT2440
ccuuuuuucgggcugcugcc

SEQ ID NO: 1605190 - RNA, 14 nt, Pseudomonas putida KT2440
cgaaaccagccccu

SEQ ID NO: 1605191 - RNA, 15 nt, Pseudomonas putida KT2440
cgaaaccagccccuu

SEQ ID NO: 1605192 - RNA, 15 nt, Pseudomonas putida KT2440
cgaaaaucguaagga

SEQ ID NO: 1605193 - RNA, 20 nt, Pseudomonas putida KT2440
cgaaaacggcggcccggcca

SEQ ID NO: 1605194 - RNA, 17 nt, Pseudomonas putida KT2440
ccuuucugcuuccacuc

SEQ ID NO: 1605195 - RNA, 15 nt, Pseudomonas putida KT2440
ccuuucuccagcaac

SEQ ID NO: 1605196 - RNA, 19 nt, Pseudomonas putida KT2440
ccuuucgcgggcgcgcccg

SEQ ID NO: 1605197 - RNA, 22 nt, Pseudomonas putida KT2440
ccuuucgcgggugaacccgcuc

SEQ ID NO: 1605198 - RNA, 23 nt, Pseudomonas putida KT2440
ccuuuccgcacucaggugagcca

SEQ ID NO: 1605199 - RNA, 15 nt, Pseudomonas putida KT2440
ccuuucccaugacga

SEQ ID NO: 1605200 - RNA, 20 nt, Pseudomonas putida KT2440
ccuuucauguaaagcagaau

SEQ ID NO: 1605201 - RNA, 19 nt, Pseudomonas putida KT2440
ccuuucagcgcccagaaca

SEQ ID NO: 1605202 - RNA, 20 nt, Pseudomonas putida KT2440
ccuugccgcuguugaucagg

SEQ ID NO: 1605203 - RNA, 14 nt, Pseudomonas putida KT2440
ccuugccuuccggc

SEQ ID NO: 1605204 - RNA, 19 nt, Pseudomonas putida KT2440
ccuugcgagccugggucac

SEQ ID NO: 1605205 - RNA, 20 nt, Pseudomonas putida KT2440
ccuugcgauaccccgcugcc

SEQ ID NO: 1605206 - RNA, 14 nt, Pseudomonas putida KT2440
ccuugcgcaucaag

SEQ ID NO: 1605207 - RNA, 16 nt, Pseudomonas putida KT2440
ccuugcggaccaccug

SEQ ID NO: 1605208 - RNA, 21 nt, Pseudomonas putida KT2440
ccuugcggaccaccugggcca

SEQ ID NO: 1605209 - RNA, 16 nt, Pseudomonas putida KT2440
ccuugcggcaagcuca

SEQ ID NO: 1605210 - RNA, 17 nt, Pseudomonas putida KT2440
ccuugcgggaacaccca

SEQ ID NO: 1605211 - RNA, 21 nt, Pseudomonas putida KT2440
ccuugcgucgcgaugggcugc

SEQ ID NO: 1605212 - RNA, 17 nt, Pseudomonas putida KT2440
ccuugcgugccucagcc

SEQ ID NO: 1605213 - RNA, 18 nt, Pseudomonas putida KT2440
ccuugcgugccucagcca

SEQ ID NO: 1605214 - RNA, 17 nt, Pseudomonas putida KT2440
ccuugcguugcaacaag

SEQ ID NO: 1605215 - RNA, 16 nt, Pseudomonas putida KT2440
ccuugcugcagcaggc

SEQ ID NO: 1605216 - RNA, 22 nt, Pseudomonas putida KT2440
ccuugcugaaauccagccgccc

SEQ ID NO: 1605217 - RNA, 23 nt, Pseudomonas putida KT2440
ccuugcugaaauccagccgcccg

SEQ ID NO: 1605218 - RNA, 21 nt, Pseudomonas putida KT2440
ccuugcucgaaugccgcugcu

SEQ ID NO: 1605219 - RNA, 13 nt, Pseudomonas putida KT2440
ccuugcucggcca

SEQ ID NO: 1605220 - RNA, 16 nt, Pseudomonas putida KT2440
ccuugcuggccaccgc

SEQ ID NO: 1605221 - RNA, 19 nt, Pseudomonas putida KT2440
ccuugcuggccaccgcgcu

SEQ ID NO: 1605222 - RNA, 18 nt, Pseudomonas putida KT2440
ccuugcuggaacugcugc

SEQ ID NO: 1605223 - RNA, 15 nt, Pseudomonas putida KT2440
ccuugcuugaccuug

SEQ ID NO: 1605224 - RNA, 18 nt, Pseudomonas putida KT2440
ccuugcuuggcagcggcu

SEQ ID NO: 1605225 - RNA, 17 nt, Pseudomonas putida KT2440
ccuuggacgcuggcagc

SEQ ID NO: 1605226 - RNA, 20 nt, Pseudomonas putida KT2440
ccuugaucuguccuccugcc

SEQ ID NO: 1605227 - RNA, 14 nt, Pseudomonas putida KT2440
ccuugaucaggccc

SEQ ID NO: 1605228 - RNA, 21 nt, Pseudomonas putida KT2440
ccuugaucaggggccgcgcag

SEQ ID NO: 1605229 - RNA, 23 nt, Pseudomonas putida KT2440
ccuugagguagucgauccaggug

SEQ ID NO: 1605230 - RNA, 15 nt, Pseudomonas putida KT2440
ccuugauacgcccau

SEQ ID NO: 1605231 - RNA, 14 nt, Pseudomonas putida KT2440
ccuugaucaaugcc

SEQ ID NO: 1605232 - RNA, 17 nt, Pseudomonas putida KT2440
ccuugaucaaugcccgu

SEQ ID NO: 1605233 - RNA, 20 nt, Pseudomonas putida KT2440
ccuugaguucccaggcagcc

SEQ ID NO: 1605234 - RNA, 22 nt, Pseudomonas putida KT2440
ccuugaguucccaggcagccuc

SEQ ID NO: 1605235 - RNA, 15 nt, Pseudomonas putida KT2440
ccuugaggggcggcg

SEQ ID NO: 1605236 - RNA, 17 nt, Pseudomonas putida KT2440
ccuugagaucagcaacc

SEQ ID NO: 1605237 - RNA, 16 nt, Pseudomonas putida KT2440
ccuugcacucccccuu

SEQ ID NO: 1605238 - RNA, 12 nt, Pseudomonas putida KT2440
ccuugcagcgcc

SEQ ID NO: 1605239 - RNA, 20 nt, Pseudomonas putida KT2440
ccuugauuaccagcgccccg

SEQ ID NO: 1605240 - RNA, 22 nt, Pseudomonas putida KT2440
ccuugauuaccagcgccccgcc

SEQ ID NO: 1605241 - RNA, 13 nt, Pseudomonas putida KT2440
ccuugcccagcuc

SEQ ID NO: 1605242 - RNA, 18 nt, Pseudomonas putida KT2440
ccuugcagcgccgcaucc

SEQ ID NO: 1605243 - RNA, 23 nt, Pseudomonas putida KT2440
ccuugcagcgccgcauccagcac

SEQ ID NO: 1605244 - RNA, 16 nt, Pseudomonas putida KT2440
ccuugcagggcaccag

SEQ ID NO: 1605245 - RNA, 20 nt, Pseudomonas putida KT2440
ccuugccagcauggugcagg

SEQ ID NO: 1605246 - RNA, 21 nt, Pseudomonas putida KT2440
ccuugugcaguucgcacagcu

SEQ ID NO: 1605247 - RNA, 19 nt, Pseudomonas putida KT2440
ccuugugcgccaccgacuc

SEQ ID NO: 1605248 - RNA, 18 nt, Pseudomonas putida KT2440
ccuuguuauccaggcugg

SEQ ID NO: 1605249 - RNA, 22 nt, Pseudomonas putida KT2440
ccuuguuccacgcgcaggcgcu

SEQ ID NO: 1605250 - RNA, 19 nt, Pseudomonas putida KT2440
ccuuguucaucgcauucuu

SEQ ID NO: 1605251 - RNA, 14 nt, Pseudomonas putida KT2440
ccuugugugcguug

SEQ ID NO: 1605252 - RNA, 14 nt, Pseudomonas putida KT2440
ccuuggccaccuuc

SEQ ID NO: 1605253 - RNA, 21 nt, Pseudomonas putida KT2440
ccuuggccagcucauccagcc

SEQ ID NO: 1605254 - RNA, 19 nt, Pseudomonas putida KT2440
ccuuggcacggccagccag

SEQ ID NO: 1605255 - RNA, 21 nt, Pseudomonas putida KT2440
ccuuggcacggccagccagca

SEQ ID NO: 1605256 - RNA, 13 nt, Pseudomonas putida KT2440
ccuuggcagccuc

SEQ ID NO: 1605257 - RNA, 17 nt, Pseudomonas putida KT2440
ccuuggacaccaggcug

SEQ ID NO: 1605258 - RNA, 18 nt, Pseudomonas putida KT2440
ccuuggacaccaggcugg

SEQ ID NO: 1605259 - RNA, 16 nt, Pseudomonas putida KT2440
ccuugggcaacaccgc

SEQ ID NO: 1605260 - RNA, 19 nt, Pseudomonas putida KT2440
ccuuggcuuccugcuggcu

SEQ ID NO: 1605261 - RNA, 21 nt, Pseudomonas putida KT2440
ccuuggcgcggcggauaagcu

SEQ ID NO: 1605262 - RNA, 22 nt, Pseudomonas putida KT2440
ccuuggcgcguuucgaucucgc

SEQ ID NO: 1605263 - RNA, 13 nt, Pseudomonas putida KT2440
ccuuggccgccag

SEQ ID NO: 1605264 - RNA, 16 nt, Pseudomonas putida KT2440
ccuuggccgcuggccc

SEQ ID NO: 1605265 - RNA, 23 nt, Pseudomonas putida KT2440
ccuuggcgacgugcccagaucac

SEQ ID NO: 1605266 - RNA, 13 nt, Pseudomonas putida KT2440
ccuuggcgcagca

SEQ ID NO: 1605267 - RNA, 13 nt, Pseudomonas putida KT2440
ccuuggccugggg

SEQ ID NO: 1605268 - RNA, 16 nt, Pseudomonas putida KT2440
ccuuggccuuggcagc

SEQ ID NO: 1605269 - RNA, 18 nt, Pseudomonas putida KT2440
ccuuggugcgcgcaucca

SEQ ID NO: 1605270 - RNA, 13 nt, Pseudomonas putida KT2440
ccuuggugcaaug

SEQ ID NO: 1605271 - RNA, 13 nt, Pseudomonas putida KT2440
ccuuggugcacca

SEQ ID NO: 1605272 - RNA, 21 nt, Pseudomonas putida KT2440
ccuuggugcaugcaagcagcc

SEQ ID NO: 1605273 - RNA, 18 nt, Pseudomonas putida KT2440
ccuugggcgaggacagca

SEQ ID NO: 1605274 - RNA, 19 nt, Pseudomonas putida KT2440
ccuugggcucagccgccac

SEQ ID NO: 1605275 - RNA, 15 nt, Pseudomonas putida KT2440
ccuuguccagcaggc

SEQ ID NO: 1605276 - RNA, 14 nt, Pseudomonas putida KT2440
ccuugucagccgcc

SEQ ID NO: 1605277 - RNA, 14 nt, Pseudomonas putida KT2440
ccuugucaguucug

SEQ ID NO: 1605278 - RNA, 18 nt, Pseudomonas putida KT2440
ccuugucaguucugcuca

SEQ ID NO: 1605279 - RNA, 21 nt, Pseudomonas putida KT2440
ccuugucaguucugcucagcu

SEQ ID NO: 1605280 - RNA, 21 nt, Pseudomonas putida KT2440
ccuugucggcacgcgccagca

SEQ ID NO: 1605281 - RNA, 22 nt, Pseudomonas putida KT2440
ccuugucggcacgcgccagcag

SEQ ID NO: 1605282 - RNA, 11 nt, Pseudomonas putida KT2440
ccuugucucug

SEQ ID NO: 1605283 - RNA, 13 nt, Pseudomonas putida KT2440
ccuuccuugccca

SEQ ID NO: 1605284 - RNA, 21 nt, Pseudomonas putida KT2440
ccuucgaccagaacagcucga

SEQ ID NO: 1605285 - RNA, 16 nt, Pseudomonas putida KT2440
ccuucgcaggcacgcc

SEQ ID NO: 1605286 - RNA, 21 nt, Pseudomonas putida KT2440
ccuucgcaggcacgcccgcuc

SEQ ID NO: 1605287 - RNA, 20 nt, Pseudomonas putida KT2440
ccuucgccaagguccagcca

SEQ ID NO: 1605288 - RNA, 17 nt, Pseudomonas putida KT2440
ccuucgcucaggugcac

SEQ ID NO: 1605289 - RNA, 21 nt, Pseudomonas putida KT2440
ccuucgcucaggugcaccucc

SEQ ID NO: 1605290 - RNA, 21 nt, Pseudomonas putida KT2440
ccuucggaaacaguuucuuca

SEQ ID NO: 1605291 - RNA, 20 nt, Pseudomonas putida KT2440
ccuucgcgggcuuuuuuuug

SEQ ID NO: 1605292 - RNA, 19 nt, Pseudomonas putida KT2440
ccuucgcgggugaacccgc

SEQ ID NO: 1605293 - RNA, 20 nt, Pseudomonas putida KT2440
ccuucggcaaucaccgccag

SEQ ID NO: 1605294 - RNA, 20 nt, Pseudomonas putida KT2440
ccuucggagguagccaccug

SEQ ID NO: 1605295 - RNA, 14 nt, Pseudomonas putida KT2440
ccuguguccacccc

SEQ ID NO: 1605296 - RNA, 21 nt, Pseudomonas putida KT2440
ccuuccaaccagccagccacc

SEQ ID NO: 1605297 - RNA, 20 nt, Pseudomonas putida KT2440
ccuuccacucuuccaccgcc

SEQ ID NO: 1605298 - RNA, 19 nt, Pseudomonas putida KT2440
ccuuccagcaaagugcgca

SEQ ID NO: 1605299 - RNA, 16 nt, Pseudomonas putida KT2440
ccuuccagcccgccug

SEQ ID NO: 1605300 - RNA, 17 nt, Pseudomonas putida KT2440
ccuuccagcccgccugc

SEQ ID NO: 1605301 - RNA, 14 nt, Pseudomonas putida KT2440
ccuuccagcugcgg

SEQ ID NO: 1605302 - RNA, 21 nt, Pseudomonas putida KT2440
ccuuccagcugcggcuggguc

SEQ ID NO: 1605303 - RNA, 22 nt, Pseudomonas putida KT2440
ccuuccagcugcggcuggguca

SEQ ID NO: 1605304 - RNA, 14 nt, Pseudomonas putida KT2440
ccuuccaugccccu

SEQ ID NO: 1605305 - RNA, 21 nt, Pseudomonas putida KT2440
ccuuccugggcuucaugcugc

SEQ ID NO: 1605306 - RNA, 19 nt, Pseudomonas putida KT2440
ccuuccgcgugccccccca

SEQ ID NO: 1605307 - RNA, 22 nt, Pseudomonas putida KT2440
ccuucccgccuggcgccugcgc

SEQ ID NO: 1605308 - RNA, 17 nt, Pseudomonas putida KT2440
ccuuccgaccggucaua

SEQ ID NO: 1605309 - RNA, 22 nt, Pseudomonas putida KT2440
ccuucuuccagaacggcgcccg

SEQ ID NO: 1605310 - RNA, 14 nt, Pseudomonas putida KT2440
ccuucuugugcaca

SEQ ID NO: 1605311 - RNA, 18 nt, Pseudomonas putida KT2440
ccuugaacggcauuucca

SEQ ID NO: 1605312 - RNA, 16 nt, Pseudomonas putida KT2440
ccuugaagaacaccug

SEQ ID NO: 1605313 - RNA, 20 nt, Pseudomonas putida KT2440
ccuugaagaacaccugcagc

SEQ ID NO: 1605314 - RNA, 23 nt, Pseudomonas putida KT2440
ccuugaagugcgcaauccuugcc

SEQ ID NO: 1605315 - RNA, 14 nt, Pseudomonas putida KT2440
ccuugaccagcuug

SEQ ID NO: 1605316 - RNA, 22 nt, Pseudomonas putida KT2440
ccuucugcgucgacucuuccca

SEQ ID NO: 1605317 - RNA, 12 nt, Pseudomonas putida KT2440
ccuucucuuccg

SEQ ID NO: 1605318 - RNA, 14 nt, Pseudomonas putida KT2440
ccuucucuuccgcc

SEQ ID NO: 1605319 - RNA, 13 nt, Pseudomonas putida KT2440
ccuucucuuccgg

SEQ ID NO: 1605320 - RNA, 14 nt, Pseudomonas putida KT2440
ccuucuggcagccg

SEQ ID NO: 1605321 - RNA, 16 nt, Pseudomonas putida KT2440
ccuucuggcagccgcc

SEQ ID NO: 1605322 - RNA, 18 nt, Pseudomonas putida KT2440
ccuucucgaacagcuggc

SEQ ID NO: 1605323 - RNA, 17 nt, Pseudomonas putida KT2440
ccuucggugcuggcgcu

SEQ ID NO: 1605324 - RNA, 21 nt, Pseudomonas putida KT2440
ccuucggugcuggcgcucaau

SEQ ID NO: 1605325 - RNA, 19 nt, Pseudomonas putida KT2440
ccuucgucgcuggccagcu

SEQ ID NO: 1605326 - RNA, 14 nt, Pseudomonas putida KT2440
cgaaggcuccagca

SEQ ID NO: 1605327 - RNA, 16 nt, Pseudomonas putida KT2440
cgaaggcggucgcgcg

SEQ ID NO: 1605328 - RNA, 13 nt, Pseudomonas putida KT2440
cgaagggccgcaa

SEQ ID NO: 1605329 - RNA, 13 nt, Pseudomonas putida KT2440
cgaagggcugccg

SEQ ID NO: 1605330 - RNA, 16 nt, Pseudomonas putida KT2440
cgaaggggcgcccaga

SEQ ID NO: 1605331 - RNA, 22 nt, Pseudomonas putida KT2440
cgaaguacggcuugccggcaau

SEQ ID NO: 1605332 - RNA, 21 nt, Pseudomonas putida KT2440
cgaaguucagcacgggcagcu

SEQ ID NO: 1605333 - RNA, 14 nt, Pseudomonas putida KT2440
cgaagcgcucaugc

SEQ ID NO: 1605334 - RNA, 20 nt, Pseudomonas putida KT2440
cgaagcgcucccaggccucg

SEQ ID NO: 1605335 - RNA, 18 nt, Pseudomonas putida KT2440
cgaagcgccuggagagcc

SEQ ID NO: 1605336 - RNA, 14 nt, Pseudomonas putida KT2440
cgaagcgcaggucc

SEQ ID NO: 1605337 - RNA, 21 nt, Pseudomonas putida KT2440
cgaagccgaaucgcucugccg

SEQ ID NO: 1605338 - RNA, 18 nt, Pseudomonas putida KT2440
cgaagccgacccgggcca

SEQ ID NO: 1605339 - RNA, 13 nt, Pseudomonas putida KT2440
cgaagcgacagcg

SEQ ID NO: 1605340 - RNA, 14 nt, Pseudomonas putida KT2440
cgaaggccagcaaa

SEQ ID NO: 1605341 - RNA, 20 nt, Pseudomonas putida KT2440
cgaaggccgccggcaacugg

SEQ ID NO: 1605342 - RNA, 18 nt, Pseudomonas putida KT2440
cgaaggcgcuccccugcu

SEQ ID NO: 1605343 - RNA, 21 nt, Pseudomonas putida KT2440
cgaagcuaucgccagcaggcc

SEQ ID NO: 1605344 - RNA, 22 nt, Pseudomonas putida KT2440
cgaagcugucgaacgcugccug

SEQ ID NO: 1605345 - RNA, 15 nt, Pseudomonas putida KT2440
cgaagcugccacugc

SEQ ID NO: 1605346 - RNA, 14 nt, Pseudomonas putida KT2440
cgaacuucuccagc

SEQ ID NO: 1605347 - RNA, 18 nt, Pseudomonas putida KT2440
cgaacuucuccagcgucc

SEQ ID NO: 1605348 - RNA, 20 nt, Pseudomonas putida KT2440
cgaacucgauucgccgggcc

SEQ ID NO: 1605349 - RNA, 13 nt, Pseudomonas putida KT2440
cgaacuccugcac

SEQ ID NO: 1605350 - RNA, 16 nt, Pseudomonas putida KT2440
cgaacuccccaccagg

SEQ ID NO: 1605351 - RNA, 17 nt, Pseudomonas putida KT2440
cgaacugcagagccugc

SEQ ID NO: 1605352 - RNA, 22 nt, Pseudomonas putida KT2440
cgaacguuucgucauccaccgc

SEQ ID NO: 1605353 - RNA, 14 nt, Pseudomonas putida KT2440
cgaacgggcucacc

SEQ ID NO: 1605354 - RNA, 18 nt, Pseudomonas putida KT2440
cgaacggcgccagcagug

SEQ ID NO: 1605355 - RNA, 13 nt, Pseudomonas putida KT2440
cgaagaccgccgc

SEQ ID NO: 1605356 - RNA, 19 nt, Pseudomonas putida KT2440
cgaagaccgccgcccaggu

SEQ ID NO: 1605357 - RNA, 21 nt, Pseudomonas putida KT2440
cgaagaggccaguaccagcag

SEQ ID NO: 1605358 - RNA, 23 nt, Pseudomonas putida KT2440
cgaagaggccaguaccagcagca

SEQ ID NO: 1605359 - RNA, 18 nt, Pseudomonas putida KT2440
cgaagaggccggaccugc

SEQ ID NO: 1605360 - RNA, 23 nt, Pseudomonas putida KT2440
cgaagaggccggcacaggaaggc

SEQ ID NO: 1605361 - RNA, 17 nt, Pseudomonas putida KT2440
cgaagccaugucuucac

SEQ ID NO: 1605362 - RNA, 14 nt, Pseudomonas putida KT2440
cgaagcaccacugg

SEQ ID NO: 1605363 - RNA, 18 nt, Pseudomonas putida KT2440
cgaagcaccacuggauga

SEQ ID NO: 1605364 - RNA, 13 nt, Pseudomonas putida KT2440
cgaagcagcagcu

SEQ ID NO: 1605365 - RNA, 14 nt, Pseudomonas putida KT2440
cgaagcagccacca

SEQ ID NO: 1605366 - RNA, 15 nt, Pseudomonas putida KT2440
cgaagaucagcucau

SEQ ID NO: 1605367 - RNA, 23 nt, Pseudomonas putida KT2440
cgacaacgguguggccagugcca

SEQ ID NO: 1605368 - RNA, 18 nt, Pseudomonas putida KT2440
cgacaaccggggcaggcu

SEQ ID NO: 1605369 - RNA, 23 nt, Pseudomonas putida KT2440
cgacaaccgacggguuacccugg

SEQ ID NO: 1605370 - RNA, 19 nt, Pseudomonas putida KT2440
cgacaaccccagcccgaag

SEQ ID NO: 1605371 - RNA, 18 nt, Pseudomonas putida KT2440
cgacaaagcucaaaugcu

SEQ ID NO: 1605372 - RNA, 18 nt, Pseudomonas putida KT2440
cgacaagauaacaccccc

SEQ ID NO: 1605373 - RNA, 22 nt, Pseudomonas putida KT2440
cgacaagauaacaccccccagc

SEQ ID NO: 1605374 - RNA, 13 nt, Pseudomonas putida KT2440
cgacaagccacgc

SEQ ID NO: 1605375 - RNA, 13 nt, Pseudomonas putida KT2440
cgacaaaaacaac

SEQ ID NO: 1605376 - RNA, 12 nt, Pseudomonas putida KT2440
cgacaaaaaccu

SEQ ID NO: 1605377 - RNA, 21 nt, Pseudomonas putida KT2440
cgacaaacuccuugaaauuca

SEQ ID NO: 1605378 - RNA, 18 nt, Pseudomonas putida KT2440
cgacaauuuggggcugcc

SEQ ID NO: 1605379 - RNA, 13 nt, Pseudomonas putida KT2440
cgacacaccaaug

SEQ ID NO: 1605380 - RNA, 13 nt, Pseudomonas putida KT2440
cgacaccaaugcc

SEQ ID NO: 1605381 - RNA, 18 nt, Pseudomonas putida KT2440
cgacaccagcgcaccacu

SEQ ID NO: 1605382 - RNA, 15 nt, Pseudomonas putida KT2440
cgacacggcaggguu

SEQ ID NO: 1605383 - RNA, 18 nt, Pseudomonas putida KT2440
cgacacgggguguugcuu

SEQ ID NO: 1605384 - RNA, 22 nt, Pseudomonas putida KT2440
cgacaccggucucaaacaaaaa

SEQ ID NO: 1605385 - RNA, 22 nt, Pseudomonas putida KT2440
cgacacgcgaaucgccagggcu

SEQ ID NO: 1605386 - RNA, 23 nt, Pseudomonas putida KT2440
cgacacgcgaaucgccagggcuc

SEQ ID NO: 1605387 - RNA, 19 nt, Pseudomonas putida KT2440
cgacacugaucucgcgcau

SEQ ID NO: 1605388 - RNA, 17 nt, Pseudomonas putida KT2440
cgacacuugguccaggg

SEQ ID NO: 1605389 - RNA, 21 nt, Pseudomonas putida KT2440
cgacacuugguccagggccau

SEQ ID NO: 1605390 - RNA, 12 nt, Pseudomonas putida KT2440
cgaauccugcug

SEQ ID NO: 1605391 - RNA, 13 nt, Pseudomonas putida KT2440
cgaauccugcuga

SEQ ID NO: 1605392 - RNA, 15 nt, Pseudomonas putida KT2440
cgaauccccuuauaa

SEQ ID NO: 1605393 - RNA, 13 nt, Pseudomonas putida KT2440
cgaaucagccagc

SEQ ID NO: 1605394 - RNA, 14 nt, Pseudomonas putida KT2440
cgaauagcaacaca

SEQ ID NO: 1605395 - RNA, 13 nt, Pseudomonas putida KT2440
cgaauaccaguaa

SEQ ID NO: 1605396 - RNA, 19 nt, Pseudomonas putida KT2440
cgaaugggcugcaaagcag

SEQ ID NO: 1605397 - RNA, 22 nt, Pseudomonas putida KT2440
cgaaugaugaauaaugcuccag

SEQ ID NO: 1605398 - RNA, 22 nt, Pseudomonas putida KT2440
cgaaugcaaugguaaauucaau

SEQ ID NO: 1605399 - RNA, 12 nt, Pseudomonas putida KT2440
cgaaucugcaug

SEQ ID NO: 1605400 - RNA, 15 nt, Pseudomonas putida KT2440
cgaauucagcccgcu

SEQ ID NO: 1605401 - RNA, 20 nt, Pseudomonas putida KT2440
cgacagugcccgcugaaaca

SEQ ID NO: 1605402 - RNA, 22 nt, Pseudomonas putida KT2440
cgacagguaguuggccgggccu

SEQ ID NO: 1605403 - RNA, 21 nt, Pseudomonas putida KT2440
cgacaggggcgcagagcgccc

SEQ ID NO: 1605404 - RNA, 16 nt, Pseudomonas putida KT2440
cgacaggcgucggggc

SEQ ID NO: 1605405 - RNA, 19 nt, Pseudomonas putida KT2440
cgacagcguugcuccagcu

SEQ ID NO: 1605406 - RNA, 18 nt, Pseudomonas putida KT2440
cgacagcucaagcccugc

SEQ ID NO: 1605407 - RNA, 19 nt, Pseudomonas putida KT2440
cgacagcuugcccagcugc

SEQ ID NO: 1605408 - RNA, 18 nt, Pseudomonas putida KT2440
cgacagcuuguugccagc

SEQ ID NO: 1605409 - RNA, 15 nt, Pseudomonas putida KT2440
cgacagcaucggcag

SEQ ID NO: 1605410 - RNA, 18 nt, Pseudomonas putida KT2440
cgacagcaucggcagguc

SEQ ID NO: 1605411 - RNA, 22 nt, Pseudomonas putida KT2440
cgacagccucaaggccggcagc

SEQ ID NO: 1605412 - RNA, 21 nt, Pseudomonas putida KT2440
cgacaugccaaagaaggacuc

SEQ ID NO: 1605413 - RNA, 19 nt, Pseudomonas putida KT2440
cgacaugccggccaccaca

SEQ ID NO: 1605414 - RNA, 18 nt, Pseudomonas putida KT2440
cgaccaaaugagugagcu

SEQ ID NO: 1605415 - RNA, 12 nt, Pseudomonas putida KT2440
cgacauccacgu

SEQ ID NO: 1605416 - RNA, 13 nt, Pseudomonas putida KT2440
cgacauccagcgc

SEQ ID NO: 1605417 - RNA, 20 nt, Pseudomonas putida KT2440
cgacccacaggcacaggccc

SEQ ID NO: 1605418 - RNA, 12 nt, Pseudomonas putida KT2440
cgacccaccaua

SEQ ID NO: 1605419 - RNA, 14 nt, Pseudomonas putida KT2440
cgacccaccgacca

SEQ ID NO: 1605420 - RNA, 17 nt, Pseudomonas putida KT2440
cgacccgcccgccaugc

SEQ ID NO: 1605421 - RNA, 23 nt, Pseudomonas putida KT2440
cgacccgccuggugccagcggcc

SEQ ID NO: 1605422 - RNA, 17 nt, Pseudomonas putida KT2440
cgaccagggccuuggcc

SEQ ID NO: 1605423 - RNA, 15 nt, Pseudomonas putida KT2440
cgaccaguaccgcgc

SEQ ID NO: 1605424 - RNA, 17 nt, Pseudomonas putida KT2440
cgaccaguaccgcgccu

SEQ ID NO: 1605425 - RNA, 16 nt, Pseudomonas putida KT2440
cgaccaaguuuucgca

SEQ ID NO: 1605426 - RNA, 22 nt, Pseudomonas putida KT2440
cgaccaauugguuaaaagccaa

SEQ ID NO: 1605427 - RNA, 13 nt, Pseudomonas putida KT2440
cgaccagcgccag

SEQ ID NO: 1605428 - RNA, 14 nt, Pseudomonas putida KT2440
cgaccagaucagcc

SEQ ID NO: 1605429 - RNA, 11 nt, Pseudomonas putida KT2440
cgaccagcagu

SEQ ID NO: 1605430 - RNA, 19 nt, Pseudomonas putida KT2440
cgacgaacucaacgcaacu

SEQ ID NO: 1605431 - RNA, 23 nt, Pseudomonas putida KT2440
cgaccuuggacgcuggcagcuug

SEQ ID NO: 1605432 - RNA, 20 nt, Pseudomonas putida KT2440
cgaccuguguccacccccgc

SEQ ID NO: 1605433 - RNA, 16 nt, Pseudomonas putida KT2440
cgaccuucacgccagc

SEQ ID NO: 1605434 - RNA, 15 nt, Pseudomonas putida KT2440
cgacgaaggccuugg

SEQ ID NO: 1605435 - RNA, 21 nt, Pseudomonas putida KT2440
cgacgaccaguucgacgcugc

SEQ ID NO: 1605436 - RNA, 22 nt, Pseudomonas putida KT2440
cgacgauacccagcgcgcgcag

SEQ ID NO: 1605437 - RNA, 18 nt, Pseudomonas putida KT2440
cgacgauaccgcccaggu

SEQ ID NO: 1605438 - RNA, 16 nt, Pseudomonas putida KT2440
cgacgauaccggcgcu

SEQ ID NO: 1605439 - RNA, 23 nt, Pseudomonas putida KT2440
cgacgaugaugcgguccgcccuu

SEQ ID NO: 1605440 - RNA, 16 nt, Pseudomonas putida KT2440
cgacgauggacagccc

SEQ ID NO: 1605441 - RNA, 18 nt, Pseudomonas putida KT2440
cgacgauggacagcccaa

SEQ ID NO: 1605442 - RNA, 20 nt, Pseudomonas putida KT2440
cgacgauguaugccaaccca

SEQ ID NO: 1605443 - RNA, 15 nt, Pseudomonas putida KT2440
cgacgcaaggccgcu

SEQ ID NO: 1605444 - RNA, 23 nt, Pseudomonas putida KT2440
cgacgcauucgcgggugaacccg

SEQ ID NO: 1605445 - RNA, 15 nt, Pseudomonas putida KT2440
cgacgccccggccug

SEQ ID NO: 1605446 - RNA, 17 nt, Pseudomonas putida KT2440
cgaccucggccaggucg

SEQ ID NO: 1605447 - RNA, 14 nt, Pseudomonas putida KT2440
cgaccucacgcagg

SEQ ID NO: 1605448 - RNA, 11 nt, Pseudomonas putida KT2440
cgaccugcagg

SEQ ID NO: 1605449 - RNA, 16 nt, Pseudomonas putida KT2440
cgaccugcaggcccug

SEQ ID NO: 1605450 - RNA, 14 nt, Pseudomonas putida KT2440
cgaccugccacugc

SEQ ID NO: 1605451 - RNA, 14 nt, Pseudomonas putida KT2440
cgaccugccagccu

SEQ ID NO: 1605452 - RNA, 23 nt, Pseudomonas putida KT2440
cgaccuggcccgaacgcagcgcc

SEQ ID NO: 1605453 - RNA, 15 nt, Pseudomonas putida KT2440
cgaccuggcccgcuu

SEQ ID NO: 1605454 - RNA, 18 nt, Pseudomonas putida KT2440
cgaccggguaaucgccag

SEQ ID NO: 1605455 - RNA, 22 nt, Pseudomonas putida KT2440
cgaccggguaaucgccaggccc

SEQ ID NO: 1605456 - RNA, 18 nt, Pseudomonas putida KT2440
cgaccgguggccugagcc

SEQ ID NO: 1605457 - RNA, 23 nt, Pseudomonas putida KT2440
cgaccgguggccugagccggucg

SEQ ID NO: 1605458 - RNA, 15 nt, Pseudomonas putida KT2440
cgaccggucggccau

SEQ ID NO: 1605459 - RNA, 17 nt, Pseudomonas putida KT2440
cgacccuguagccccgc

SEQ ID NO: 1605460 - RNA, 17 nt, Pseudomonas putida KT2440
cgacccugaagcccugg

SEQ ID NO: 1605461 - RNA, 17 nt, Pseudomonas putida KT2440
cgaccgcaccggccacc

SEQ ID NO: 1605462 - RNA, 17 nt, Pseudomonas putida KT2440
cgaccgcacuccccauc

SEQ ID NO: 1605463 - RNA, 13 nt, Pseudomonas putida KT2440
cgacccggccgcu

SEQ ID NO: 1605464 - RNA, 15 nt, Pseudomonas putida KT2440
cgacccgggccagcc

SEQ ID NO: 1605465 - RNA, 15 nt, Pseudomonas putida KT2440
cccagaucacuucca

SEQ ID NO: 1605466 - RNA, 16 nt, Pseudomonas putida KT2440
cccagaucagcagcac

SEQ ID NO: 1605467 - RNA, 19 nt, Pseudomonas putida KT2440
cccagauagccauugcggc

SEQ ID NO: 1605468 - RNA, 16 nt, Pseudomonas putida KT2440
cccagaugcgggcccu

SEQ ID NO: 1605469 - RNA, 14 nt, Pseudomonas putida KT2440
cccagaaaggccgc

SEQ ID NO: 1605470 - RNA, 13 nt, Pseudomonas putida KT2440
cccagaaucauca

SEQ ID NO: 1605471 - RNA, 19 nt, Pseudomonas putida KT2440
cccagaaucucaaccaccu

SEQ ID NO: 1605472 - RNA, 16 nt, Pseudomonas putida KT2440
cccagaacggcacgcc

SEQ ID NO: 1605473 - RNA, 20 nt, Pseudomonas putida KT2440
cccacuuggaaaacagcgcg

SEQ ID NO: 1605474 - RNA, 16 nt, Pseudomonas putida KT2440
cccacucgcgcagcac

SEQ ID NO: 1605475 - RNA, 19 nt, Pseudomonas putida KT2440
cccacuucaauggcacccu

SEQ ID NO: 1605476 - RNA, 17 nt, Pseudomonas putida KT2440
cccacgaucucacgcgc

SEQ ID NO: 1605477 - RNA, 13 nt, Pseudomonas putida KT2440
cccacgaacacaa

SEQ ID NO: 1605478 - RNA, 22 nt, Pseudomonas putida KT2440
cccaacgcaaauccuccugcgc

SEQ ID NO: 1605479 - RNA, 13 nt, Pseudomonas putida KT2440
cccaacuccagcg

SEQ ID NO: 1605480 - RNA, 15 nt, Pseudomonas putida KT2440
cccaaggucagccag

SEQ ID NO: 1605481 - RNA, 22 nt, Pseudomonas putida KT2440
cccaaguacaacugccacccuc

SEQ ID NO: 1605482 - RNA, 13 nt, Pseudomonas putida KT2440
cccaaggcaucca

SEQ ID NO: 1605483 - RNA, 22 nt, Pseudomonas putida KT2440
cccaagcggcacuaccaggccc

SEQ ID NO: 1605484 - RNA, 23 nt, Pseudomonas putida KT2440
cccaagccauccaccagccccag

SEQ ID NO: 1605485 - RNA, 14 nt, Pseudomonas putida KT2440
cccaaucaccagga

SEQ ID NO: 1605486 - RNA, 15 nt, Pseudomonas putida KT2440
cccaauacccaacag

SEQ ID NO: 1605487 - RNA, 17 nt, Pseudomonas putida KT2440
cccaauagcccaccguc

SEQ ID NO: 1605488 - RNA, 19 nt, Pseudomonas putida KT2440
cccaauaaaaacaacaggu

SEQ ID NO: 1605489 - RNA, 21 nt, Pseudomonas putida KT2440
cccacccucgcacuccgcccg

SEQ ID NO: 1605490 - RNA, 12 nt, Pseudomonas putida KT2440
cccacccaccac

SEQ ID NO: 1605491 - RNA, 19 nt, Pseudomonas putida KT2440
cccacauguaaugaaaauc

SEQ ID NO: 1605492 - RNA, 19 nt, Pseudomonas putida KT2440
cccacaggaaucaccagac

SEQ ID NO: 1605493 - RNA, 13 nt, Pseudomonas putida KT2440
cccacaggcacag

SEQ ID NO: 1605494 - RNA, 13 nt, Pseudomonas putida KT2440
cccacagggagga

SEQ ID NO: 1605495 - RNA, 19 nt, Pseudomonas putida KT2440
cccacagggcgcguguagc

SEQ ID NO: 1605496 - RNA, 13 nt, Pseudomonas putida KT2440
cccacagguccag

SEQ ID NO: 1605497 - RNA, 15 nt, Pseudomonas putida KT2440
cccacagguccagcg

SEQ ID NO: 1605498 - RNA, 20 nt, Pseudomonas putida KT2440
cccacagugucccggccagg

SEQ ID NO: 1605499 - RNA, 16 nt, Pseudomonas putida KT2440
cccaaugucacuucuu

SEQ ID NO: 1605500 - RNA, 16 nt, Pseudomonas putida KT2440
cccaaucgccgcaacc

SEQ ID NO: 1605501 - RNA, 18 nt, Pseudomonas putida KT2440
cccaaucgccgcaaccgc

SEQ ID NO: 1605502 - RNA, 13 nt, Pseudomonas putida KT2440
cccaaucgcugug

SEQ ID NO: 1605503 - RNA, 13 nt, Pseudomonas putida KT2440
cccaaucuccagc

SEQ ID NO: 1605504 - RNA, 20 nt, Pseudomonas putida KT2440
cccaaugggcaccggccacc

SEQ ID NO: 1605505 - RNA, 22 nt, Pseudomonas putida KT2440
cccaaugguuuaguccugcagc

SEQ ID NO: 1605506 - RNA, 13 nt, Pseudomonas putida KT2440
ccauucccugcac

SEQ ID NO: 1605507 - RNA, 13 nt, Pseudomonas putida KT2440
ccauuccgccguc

SEQ ID NO: 1605508 - RNA, 16 nt, Pseudomonas putida KT2440
ccauuccggcugcagc

SEQ ID NO: 1605509 - RNA, 13 nt, Pseudomonas putida KT2440
ccauucauuuuug

SEQ ID NO: 1605510 - RNA, 22 nt, Pseudomonas putida KT2440
ccauucgcgggcaugcccgcuc

SEQ ID NO: 1605511 - RNA, 22 nt, Pseudomonas putida KT2440
ccauucgcggguaaacccgcuc

SEQ ID NO: 1605512 - RNA, 15 nt, Pseudomonas putida KT2440
ccauucguccgacca

SEQ ID NO: 1605513 - RNA, 15 nt, Pseudomonas putida KT2440
ccauucucgccgccg

SEQ ID NO: 1605514 - RNA, 12 nt, Pseudomonas putida KT2440
ccauugcuccau

SEQ ID NO: 1605515 - RNA, 22 nt, Pseudomonas putida KT2440
ccauuggcgucagcguugcugg

SEQ ID NO: 1605516 - RNA, 22 nt, Pseudomonas putida KT2440
ccauuggggcugcauugcagcc

SEQ ID NO: 1605517 - RNA, 18 nt, Pseudomonas putida KT2440
ccauuggggggucugguu

SEQ ID NO: 1605518 - RNA, 20 nt, Pseudomonas putida KT2440
ccauucacgguucuggucac

SEQ ID NO: 1605519 - RNA, 20 nt, Pseudomonas putida KT2440
ccauguugucacccagcacu

SEQ ID NO: 1605520 - RNA, 17 nt, Pseudomonas putida KT2440
ccauguguacgccgcug

SEQ ID NO: 1605521 - RNA, 21 nt, Pseudomonas putida KT2440
ccauguucaccguacccgcca

SEQ ID NO: 1605522 - RNA, 17 nt, Pseudomonas putida KT2440
ccaugucgaaccacauc

SEQ ID NO: 1605523 - RNA, 12 nt, Pseudomonas putida KT2440
ccauguccaugg

SEQ ID NO: 1605524 - RNA, 14 nt, Pseudomonas putida KT2440
ccauguccauggca

SEQ ID NO: 1605525 - RNA, 13 nt, Pseudomonas putida KT2440
ccauggcccugau

SEQ ID NO: 1605526 - RNA, 16 nt, Pseudomonas putida KT2440
ccauggcgcagcucca

SEQ ID NO: 1605527 - RNA, 21 nt, Pseudomonas putida KT2440
ccauggcgcagcuccacugga

SEQ ID NO: 1605528 - RNA, 19 nt, Pseudomonas putida KT2440
ccaugggcaggcccaggua

SEQ ID NO: 1605529 - RNA, 15 nt, Pseudomonas putida KT2440
ccauggcuggcagca

SEQ ID NO: 1605530 - RNA, 16 nt, Pseudomonas putida KT2440
ccauguaacgcuccac

SEQ ID NO: 1605531 - RNA, 15 nt, Pseudomonas putida KT2440
ccauguacugcagac

SEQ ID NO: 1605532 - RNA, 16 nt, Pseudomonas putida KT2440
ccauguagaccaccag

SEQ ID NO: 1605533 - RNA, 21 nt, Pseudomonas putida KT2440
ccaugguaaaagccgccacau

SEQ ID NO: 1605534 - RNA, 14 nt, Pseudomonas putida KT2440
ccaugcgcgcagcg

SEQ ID NO: 1605535 - RNA, 17 nt, Pseudomonas putida KT2440
ccaugcgaccaguaccg

SEQ ID NO: 1605536 - RNA, 20 nt, Pseudomonas putida KT2440
ccaugcgaacugcagagccu

SEQ ID NO: 1605537 - RNA, 23 nt, Pseudomonas putida KT2440
ccaugcucaccgccaacccgauc

SEQ ID NO: 1605538 - RNA, 13 nt, Pseudomonas putida KT2440
ccaugcucggcca

SEQ ID NO: 1605539 - RNA, 22 nt, Pseudomonas putida KT2440
ccauggccaggucggucagcac

SEQ ID NO: 1605540 - RNA, 21 nt, Pseudomonas putida KT2440
ccauggcaauuggcuuccagg

SEQ ID NO: 1605541 - RNA, 15 nt, Pseudomonas putida KT2440
ccaugcuuuccaggu

SEQ ID NO: 1605542 - RNA, 14 nt, Pseudomonas putida KT2440
ccaugcugcgccag

SEQ ID NO: 1605543 - RNA, 13 nt, Pseudomonas putida KT2440
ccaugcugcugcc

SEQ ID NO: 1605544 - RNA, 14 nt, Pseudomonas putida KT2440
ccaugcugcugccc

SEQ ID NO: 1605545 - RNA, 14 nt, Pseudomonas putida KT2440
cccaggugccaggc

SEQ ID NO: 1605546 - RNA, 16 nt, Pseudomonas putida KT2440
cccaggugcugaugcc

SEQ ID NO: 1605547 - RNA, 21 nt, Pseudomonas putida KT2440
cccaggugcugaugcccaaac

SEQ ID NO: 1605548 - RNA, 14 nt, Pseudomonas putida KT2440
cccaggcggugcac

SEQ ID NO: 1605549 - RNA, 19 nt, Pseudomonas putida KT2440
cccaggcggugcacggccu

SEQ ID NO: 1605550 - RNA, 16 nt, Pseudomonas putida KT2440
cccaguacgccaccca

SEQ ID NO: 1605551 - RNA, 15 nt, Pseudomonas putida KT2440
cccagucgaaaccga

SEQ ID NO: 1605552 - RNA, 17 nt, Pseudomonas putida KT2440
cccagucgccccgccag

SEQ ID NO: 1605553 - RNA, 14 nt, Pseudomonas putida KT2440
cccaggcgccgcag

SEQ ID NO: 1605554 - RNA, 13 nt, Pseudomonas putida KT2440
cccaggcgcgccu

SEQ ID NO: 1605555 - RNA, 16 nt, Pseudomonas putida KT2440
cccagcuugcccagca

SEQ ID NO: 1605556 - RNA, 12 nt, Pseudomonas putida KT2440
cccagcuugccc

SEQ ID NO: 1605557 - RNA, 16 nt, Pseudomonas putida KT2440
cccagcuucuccagca

SEQ ID NO: 1605558 - RNA, 17 nt, Pseudomonas putida KT2440
cccagccagucgcgcaa

SEQ ID NO: 1605559 - RNA, 22 nt, Pseudomonas putida KT2440
cccagccagucgcgcaacugcc

SEQ ID NO: 1605560 - RNA, 18 nt, Pseudomonas putida KT2440
cccagcucgaucagcugg

SEQ ID NO: 1605561 - RNA, 21 nt, Pseudomonas putida KT2440
cccagcucgcuggccaccagc

SEQ ID NO: 1605562 - RNA, 13 nt, Pseudomonas putida KT2440
cccagcuccagca

SEQ ID NO: 1605563 - RNA, 20 nt, Pseudomonas putida KT2440
cccagcucuuugggggugcu

SEQ ID NO: 1605564 - RNA, 23 nt, Pseudomonas putida KT2440
cccagcaugaacgcagcuuccgc

SEQ ID NO: 1605565 - RNA, 19 nt, Pseudomonas putida KT2440
cccagccacccggcgcgca

SEQ ID NO: 1605566 - RNA, 18 nt, Pseudomonas putida KT2440
cccagcauggccgaaacc

SEQ ID NO: 1605567 - RNA, 19 nt, Pseudomonas putida KT2440
cccauaccucuucacugcu

SEQ ID NO: 1605568 - RNA, 22 nt, Pseudomonas putida KT2440
cccauaccucuucacugcucau

SEQ ID NO: 1605569 - RNA, 16 nt, Pseudomonas putida KT2440
cccauaaaccccagcc

SEQ ID NO: 1605570 - RNA, 15 nt, Pseudomonas putida KT2440
cccauaaaagccuca

SEQ ID NO: 1605571 - RNA, 20 nt, Pseudomonas putida KT2440
cccauagcuuuccagcaugu

SEQ ID NO: 1605572 - RNA, 16 nt, Pseudomonas putida KT2440
cccauagccugcugcu

SEQ ID NO: 1605573 - RNA, 17 nt, Pseudomonas putida KT2440
cccaguucuuggcggcu

SEQ ID NO: 1605574 - RNA, 20 nt, Pseudomonas putida KT2440
cccaguugaucaacccgugc

SEQ ID NO: 1605575 - RNA, 20 nt, Pseudomonas putida KT2440
cccagugugcaaacacccag

SEQ ID NO: 1605576 - RNA, 23 nt, Pseudomonas putida KT2440
cccagugcgcgcaacagugcccc

SEQ ID NO: 1605577 - RNA, 14 nt, Pseudomonas putida KT2440
cccaguuccaugcg

SEQ ID NO: 1605578 - RNA, 15 nt, Pseudomonas putida KT2440
cccaguucuccggca

SEQ ID NO: 1605579 - RNA, 18 nt, Pseudomonas putida KT2440
cccaguucacgcaggcgc

SEQ ID NO: 1605580 - RNA, 18 nt, Pseudomonas putida KT2440
cccaucgcacacccuguc

SEQ ID NO: 1605581 - RNA, 12 nt, Pseudomonas putida KT2440
cccaucugcucg

SEQ ID NO: 1605582 - RNA, 14 nt, Pseudomonas putida KT2440
cccaucugcucgcc

SEQ ID NO: 1605583 - RNA, 13 nt, Pseudomonas putida KT2440
cccaucugguugg

SEQ ID NO: 1605584 - RNA, 14 nt, Pseudomonas putida KT2440
cccaucaccagccc

SEQ ID NO: 1605585 - RNA, 13 nt, Pseudomonas putida KT2440
cccaucacgcggu

SEQ ID NO: 1605586 - RNA, 15 nt, Pseudomonas putida KT2440
cccaucagcgccgcc

SEQ ID NO: 1605587 - RNA, 16 nt, Pseudomonas putida KT2440
cccaucagcgccgcca

SEQ ID NO: 1605588 - RNA, 14 nt, Pseudomonas putida KT2440
cccaucagcagcug

SEQ ID NO: 1605589 - RNA, 15 nt, Pseudomonas putida KT2440
cccaucagcagcugc

SEQ ID NO: 1605590 - RNA, 21 nt, Pseudomonas putida KT2440
cccauccaacgcauccaggcg

SEQ ID NO: 1605591 - RNA, 16 nt, Pseudomonas putida KT2440
cccaucccgcuucgcc

SEQ ID NO: 1605592 - RNA, 23 nt, Pseudomonas putida KT2440
cccccaaucgccgcaaccgccgc

SEQ ID NO: 1605593 - RNA, 17 nt, Pseudomonas putida KT2440
cccccaaucuccagccc

SEQ ID NO: 1605594 - RNA, 14 nt, Pseudomonas putida KT2440
cccccuccuccagc

SEQ ID NO: 1605595 - RNA, 13 nt, Pseudomonas putida KT2440
cccccguaggagc

SEQ ID NO: 1605596 - RNA, 18 nt, Pseudomonas putida KT2440
cccccgucucggcaauca

SEQ ID NO: 1605597 - RNA, 14 nt, Pseudomonas putida KT2440
cccccggcggcggc

SEQ ID NO: 1605598 - RNA, 18 nt, Pseudomonas putida KT2440
ccccaugaugaccaccag

SEQ ID NO: 1605599 - RNA, 12 nt, Pseudomonas putida KT2440
ccccaucggcac

SEQ ID NO: 1605600 - RNA, 22 nt, Pseudomonas putida KT2440
ccccaugcgaacugcagagccu

SEQ ID NO: 1605601 - RNA, 15 nt, Pseudomonas putida KT2440
ccccauaccucuuca

SEQ ID NO: 1605602 - RNA, 17 nt, Pseudomonas putida KT2440
ccccauaccucuucacu

SEQ ID NO: 1605603 - RNA, 15 nt, Pseudomonas putida KT2440
ccccaucagcagcug

SEQ ID NO: 1605604 - RNA, 20 nt, Pseudomonas putida KT2440
ccccaucaccuuggccgccc

SEQ ID NO: 1605605 - RNA, 16 nt, Pseudomonas putida KT2440
ccccaucaccagcccg

SEQ ID NO: 1605606 - RNA, 15 nt, Pseudomonas putida KT2440
ccccaucaguugcag

SEQ ID NO: 1605607 - RNA, 18 nt, Pseudomonas putida KT2440
ccccaguccgucucuuca

SEQ ID NO: 1605608 - RNA, 19 nt, Pseudomonas putida KT2440
ccccaguccgucucuucag

SEQ ID NO: 1605609 - RNA, 17 nt, Pseudomonas putida KT2440
ccccagggcgcaacgcc

SEQ ID NO: 1605610 - RNA, 14 nt, Pseudomonas putida KT2440
ccccaggugccaac

SEQ ID NO: 1605611 - RNA, 18 nt, Pseudomonas putida KT2440
ccccagggcccucaaccc

SEQ ID NO: 1605612 - RNA, 18 nt, Pseudomonas putida KT2440
ccccaggccauccagcgg

SEQ ID NO: 1605613 - RNA, 23 nt, Pseudomonas putida KT2440
ccccaggcugccaaaccgcccca

SEQ ID NO: 1605614 - RNA, 12 nt, Pseudomonas putida KT2440
ccccagcgccuu

SEQ ID NO: 1605615 - RNA, 19 nt, Pseudomonas putida KT2440
ccccagcgcgccagcaggu

SEQ ID NO: 1605616 - RNA, 16 nt, Pseudomonas putida KT2440
ccccagcgccuccacc

SEQ ID NO: 1605617 - RNA, 23 nt, Pseudomonas putida KT2440
ccccagcccgcccacaugcgagc

SEQ ID NO: 1605618 - RNA, 13 nt, Pseudomonas putida KT2440
ccccagccucagc

SEQ ID NO: 1605619 - RNA, 12 nt, Pseudomonas putida KT2440
ccccgguccagc

SEQ ID NO: 1605620 - RNA, 17 nt, Pseudomonas putida KT2440
ccccgguucucgcgaac

SEQ ID NO: 1605621 - RNA, 19 nt, Pseudomonas putida KT2440
ccccuccacccaccuuggc

SEQ ID NO: 1605622 - RNA, 23 nt, Pseudomonas putida KT2440
ccccuccacccggucccgcccgg

SEQ ID NO: 1605623 - RNA, 19 nt, Pseudomonas putida KT2440
ccccuccagcacaccgcgc

SEQ ID NO: 1605624 - RNA, 14 nt, Pseudomonas putida KT2440
ccccuccggccccg

SEQ ID NO: 1605625 - RNA, 19 nt, Pseudomonas putida KT2440
ccccguguacgacugccgc

SEQ ID NO: 1605626 - RNA, 21 nt, Pseudomonas putida KT2440
ccccguguacgacugccgccc

SEQ ID NO: 1605627 - RNA, 19 nt, Pseudomonas putida KT2440
ccccggcccagccccgagc

SEQ ID NO: 1605628 - RNA, 16 nt, Pseudomonas putida KT2440
ccccggccagugaagc

SEQ ID NO: 1605629 - RNA, 17 nt, Pseudomonas putida KT2440
ccccggccaggccggcg

SEQ ID NO: 1605630 - RNA, 14 nt, Pseudomonas putida KT2440
ccccggccugcaca

SEQ ID NO: 1605631 - RNA, 15 nt, Pseudomonas putida KT2440
ccccggcgacggcga

SEQ ID NO: 1605632 - RNA, 20 nt, Pseudomonas putida KT2440
ccccggcgccgccaggcagc

SEQ ID NO: 1605633 - RNA, 13 nt, Pseudomonas putida KT2440
ccccgggugcagc

SEQ ID NO: 1605634 - RNA, 19 nt, Pseudomonas putida KT2440
cccccuguagauaggcugu

SEQ ID NO: 1605635 - RNA, 15 nt, Pseudomonas putida KT2440
ccccgaccacccggu

SEQ ID NO: 1605636 - RNA, 13 nt, Pseudomonas putida KT2440
ccccggcaauaca

SEQ ID NO: 1605637 - RNA, 22 nt, Pseudomonas putida KT2440
cccccuuuggccuaccgcccgc

SEQ ID NO: 1605638 - RNA, 15 nt, Pseudomonas putida KT2440
ccccgaacgcgguaa

SEQ ID NO: 1605639 - RNA, 12 nt, Pseudomonas putida KT2440
cccccugcacca

SEQ ID NO: 1605640 - RNA, 21 nt, Pseudomonas putida KT2440
cccccugguuuuccaccggca

SEQ ID NO: 1605641 - RNA, 19 nt, Pseudomonas putida KT2440
cccccuucaaugccgggaa

SEQ ID NO: 1605642 - RNA, 14 nt, Pseudomonas putida KT2440
ccaugaucagcgcc

SEQ ID NO: 1605643 - RNA, 16 nt, Pseudomonas putida KT2440
ccaugaacagcacgcc

SEQ ID NO: 1605644 - RNA, 14 nt, Pseudomonas putida KT2440
ccaugaaguucauc

SEQ ID NO: 1605645 - RNA, 13 nt, Pseudomonas putida KT2440
ccaugccuucuuc

SEQ ID NO: 1605646 - RNA, 18 nt, Pseudomonas putida KT2440
ccaugccguaagccgcag

SEQ ID NO: 1605647 - RNA, 15 nt, Pseudomonas putida KT2440
ccaugccccccgcca

SEQ ID NO: 1605648 - RNA, 22 nt, Pseudomonas putida KT2440
ccaugccccgaguaacccuggc

SEQ ID NO: 1605649 - RNA, 16 nt, Pseudomonas putida KT2440
ccaugccacccccggc

SEQ ID NO: 1605650 - RNA, 15 nt, Pseudomonas putida KT2440
ccaucgucugcauca

SEQ ID NO: 1605651 - RNA, 15 nt, Pseudomonas putida KT2440
ccaucuaagccucca

SEQ ID NO: 1605652 - RNA, 16 nt, Pseudomonas putida KT2440
ccaucuaagccuccag

SEQ ID NO: 1605653 - RNA, 16 nt, Pseudomonas putida KT2440
ccaucucgccaagcau

SEQ ID NO: 1605654 - RNA, 15 nt, Pseudomonas putida KT2440
ccaucuccagcucaa

SEQ ID NO: 1605655 - RNA, 18 nt, Pseudomonas putida KT2440
ccaucuccagcucaaccc

SEQ ID NO: 1605656 - RNA, 16 nt, Pseudomonas putida KT2440
ccauccucggccaggc

SEQ ID NO: 1605657 - RNA, 20 nt, Pseudomonas putida KT2440
ccauccuugaagaacaccug

SEQ ID NO: 1605658 - RNA, 21 nt, Pseudomonas putida KT2440
ccauccuugaagaacaccugc

SEQ ID NO: 1605659 - RNA, 17 nt, Pseudomonas putida KT2440
ccauccugcuguagcgc

SEQ ID NO: 1605660 - RNA, 11 nt, Pseudomonas putida KT2440
ccaucaccgcc

SEQ ID NO: 1605661 - RNA, 13 nt, Pseudomonas putida KT2440
ccaucaccgccag

SEQ ID NO: 1605662 - RNA, 16 nt, Pseudomonas putida KT2440
ccauccaacgcaucca

SEQ ID NO: 1605663 - RNA, 22 nt, Pseudomonas putida KT2440
ccauccacggcguugccccuuc

SEQ ID NO: 1605664 - RNA, 17 nt, Pseudomonas putida KT2440
ccauccacaucgccagg

SEQ ID NO: 1605665 - RNA, 16 nt, Pseudomonas putida KT2440
ccauccaccagcccca

SEQ ID NO: 1605666 - RNA, 17 nt, Pseudomonas putida KT2440
ccauccagggcuuccug

SEQ ID NO: 1605667 - RNA, 17 nt, Pseudomonas putida KT2440
ccauccaguccgccagc

SEQ ID NO: 1605668 - RNA, 17 nt, Pseudomonas putida KT2440
ccauagcgcugcaccga

SEQ ID NO: 1605669 - RNA, 15 nt, Pseudomonas putida KT2440
ccauagccugcugcu

SEQ ID NO: 1605670 - RNA, 14 nt, Pseudomonas putida KT2440
ccauagcaccagcg

SEQ ID NO: 1605671 - RNA, 12 nt, Pseudomonas putida KT2440
ccauaccugcuu

SEQ ID NO: 1605672 - RNA, 19 nt, Pseudomonas putida KT2440
ccauaccucuucacugcuc

SEQ ID NO: 1605673 - RNA, 22 nt, Pseudomonas putida KT2440
ccauaccucccgcacugcugcc

SEQ ID NO: 1605674 - RNA, 16 nt, Pseudomonas putida KT2440
ccauagcuuuccagca

SEQ ID NO: 1605675 - RNA, 18 nt, Pseudomonas putida KT2440
ccauaguugaccagcacc

SEQ ID NO: 1605676 - RNA, 14 nt, Pseudomonas putida KT2440
ccaucaccagcccg

SEQ ID NO: 1605677 - RNA, 22 nt, Pseudomonas putida KT2440
ccaucaccaguuuuuguaccug

SEQ ID NO: 1605678 - RNA, 18 nt, Pseudomonas putida KT2440
ccaguaccacuuccaaca

SEQ ID NO: 1605679 - RNA, 14 nt, Pseudomonas putida KT2440
ccaguaccagcagc

SEQ ID NO: 1605680 - RNA, 18 nt, Pseudomonas putida KT2440
ccaguacgcgccugcacc

SEQ ID NO: 1605681 - RNA, 22 nt, Pseudomonas putida KT2440
ccaguacgcgccugcaccuggc

SEQ ID NO: 1605682 - RNA, 19 nt, Pseudomonas putida KT2440
ccaguacggccaucagcaa

SEQ ID NO: 1605683 - RNA, 21 nt, Pseudomonas putida KT2440
ccaguacggccaucagcaagc

SEQ ID NO: 1605684 - RNA, 22 nt, Pseudomonas putida KT2440
ccaguacggccaucagcaagcc

SEQ ID NO: 1605685 - RNA, 21 nt, Pseudomonas putida KT2440
ccaguaccgcgccuccagcug

SEQ ID NO: 1605686 - RNA, 14 nt, Pseudomonas putida KT2440
ccaguacgccaccc

SEQ ID NO: 1605687 - RNA, 19 nt, Pseudomonas putida KT2440
ccaguacgccacccagaug

SEQ ID NO: 1605688 - RNA, 17 nt, Pseudomonas putida KT2440
ccaguacgccagcagcg

SEQ ID NO: 1605689 - RNA, 19 nt, Pseudomonas putida KT2440
ccaguacgccagcagcgca

SEQ ID NO: 1605690 - RNA, 15 nt, Pseudomonas putida KT2440
ccagugucugcaacu

SEQ ID NO: 1605691 - RNA, 18 nt, Pseudomonas putida KT2440
ccagugugcaaacaccca

SEQ ID NO: 1605692 - RNA, 16 nt, Pseudomonas putida KT2440
ccaguucauucccggc

SEQ ID NO: 1605693 - RNA, 18 nt, Pseudomonas putida KT2440
ccaguuccauccaguccg

SEQ ID NO: 1605694 - RNA, 16 nt, Pseudomonas putida KT2440
ccaguucaugcagcgu

SEQ ID NO: 1605695 - RNA, 21 nt, Pseudomonas putida KT2440
ccaguucauggcucacaccca

SEQ ID NO: 1605696 - RNA, 15 nt, Pseudomonas putida KT2440
ccaguucagcgcccg

SEQ ID NO: 1605697 - RNA, 12 nt, Pseudomonas putida KT2440
ccaguucagcuc

SEQ ID NO: 1605698 - RNA, 16 nt, Pseudomonas putida KT2440
ccaguucaccauccgc

SEQ ID NO: 1605699 - RNA, 19 nt, Pseudomonas putida KT2440
ccaguucgacgcugcuguc

SEQ ID NO: 1605700 - RNA, 13 nt, Pseudomonas putida KT2440
ccaguuccuggcg

SEQ ID NO: 1605701 - RNA, 16 nt, Pseudomonas putida KT2440
ccaguuuuuguaccug

SEQ ID NO: 1605702 - RNA, 14 nt, Pseudomonas putida KT2440
ccagcuuggcgccc

SEQ ID NO: 1605703 - RNA, 15 nt, Pseudomonas putida KT2440
ccaggaacgcugccu

SEQ ID NO: 1605704 - RNA, 21 nt, Pseudomonas putida KT2440
ccaggacuucccggcaccgcu

SEQ ID NO: 1605705 - RNA, 22 nt, Pseudomonas putida KT2440
ccaggaucagcgugugcugggu

SEQ ID NO: 1605706 - RNA, 23 nt, Pseudomonas putida KT2440
ccaggaucaacugccgcgccgcc

SEQ ID NO: 1605707 - RNA, 17 nt, Pseudomonas putida KT2440
ccagcugaagugccaag

SEQ ID NO: 1605708 - RNA, 22 nt, Pseudomonas putida KT2440
ccagcugaagugccaaggcuuu

SEQ ID NO: 1605709 - RNA, 18 nt, Pseudomonas putida KT2440
ccagcucuggagguagcc

SEQ ID NO: 1605710 - RNA, 19 nt, Pseudomonas putida KT2440
ccagcuguacgcuggccaa

SEQ ID NO: 1605711 - RNA, 15 nt, Pseudomonas putida KT2440
ccagcuuggcaggcu

SEQ ID NO: 1605712 - RNA, 15 nt, Pseudomonas putida KT2440
ccagcuugccgucgc

SEQ ID NO: 1605713 - RNA, 15 nt, Pseudomonas putida KT2440
ccagcuucggccacg

SEQ ID NO: 1605714 - RNA, 14 nt, Pseudomonas putida KT2440
ccagcuucuccagc

SEQ ID NO: 1605715 - RNA, 15 nt, Pseudomonas putida KT2440
ccagcuucugcuggu

SEQ ID NO: 1605716 - RNA, 15 nt, Pseudomonas putida KT2440
ccagccccgcaugcu

SEQ ID NO: 1605717 - RNA, 18 nt, Pseudomonas putida KT2440
ccagcccgauggccuuga

SEQ ID NO: 1605718 - RNA, 23 nt, Pseudomonas putida KT2440
ccagccccucauucaaagccugc

SEQ ID NO: 1605719 - RNA, 16 nt, Pseudomonas putida KT2440
ccagcggccacuuaca

SEQ ID NO: 1605720 - RNA, 14 nt, Pseudomonas putida KT2440
ccagcggucugcug

SEQ ID NO: 1605721 - RNA, 23 nt, Pseudomonas putida KT2440
ccagcggucugcugcgucagcau

SEQ ID NO: 1605722 - RNA, 18 nt, Pseudomonas putida KT2440
ccagcggugccagucauu

SEQ ID NO: 1605723 - RNA, 14 nt, Pseudomonas putida KT2440
ccagcggcgcggcc

SEQ ID NO: 1605724 - RNA, 15 nt, Pseudomonas putida KT2440
ccagcguaagcuggc

SEQ ID NO: 1605725 - RNA, 15 nt, Pseudomonas putida KT2440
ccagcguggccgcca

SEQ ID NO: 1605726 - RNA, 21 nt, Pseudomonas putida KT2440
ccagcguggccugcaagccgg

SEQ ID NO: 1605727 - RNA, 15 nt, Pseudomonas putida KT2440
ccagcucaccggcua

SEQ ID NO: 1605728 - RNA, 16 nt, Pseudomonas putida KT2440
ccagcuccaccuucca

SEQ ID NO: 1605729 - RNA, 20 nt, Pseudomonas putida KT2440
ccagcuccaccuuccacucu

SEQ ID NO: 1605730 - RNA, 16 nt, Pseudomonas putida KT2440
ccagggcaaucgccaa

SEQ ID NO: 1605731 - RNA, 22 nt, Pseudomonas putida KT2440
ccagggcaaaaugcagcaagcu

SEQ ID NO: 1605732 - RNA, 23 nt, Pseudomonas putida KT2440
ccagggacgaacccuugaccuug

SEQ ID NO: 1605733 - RNA, 16 nt, Pseudomonas putida KT2440
ccaggcuuuccagguc

SEQ ID NO: 1605734 - RNA, 18 nt, Pseudomonas putida KT2440
ccagggcccucaacccuc

SEQ ID NO: 1605735 - RNA, 21 nt, Pseudomonas putida KT2440
ccagggcccucaacccucgcc

SEQ ID NO: 1605736 - RNA, 13 nt, Pseudomonas putida KT2440
ccagggcccgccg

SEQ ID NO: 1605737 - RNA, 23 nt, Pseudomonas putida KT2440
ccagggcaucgaucccuggggcc

SEQ ID NO: 1605738 - RNA, 15 nt, Pseudomonas putida KT2440
ccagggcaucggaca

SEQ ID NO: 1605739 - RNA, 17 nt, Pseudomonas putida KT2440
ccagggcaucggacagg

SEQ ID NO: 1605740 - RNA, 16 nt, Pseudomonas putida KT2440
ccagggcaucggcgcc

SEQ ID NO: 1605741 - RNA, 18 nt, Pseudomonas putida KT2440
ccagggccuuggccuggg

SEQ ID NO: 1605742 - RNA, 16 nt, Pseudomonas putida KT2440
ccagggccugaccgcc

SEQ ID NO: 1605743 - RNA, 12 nt, Pseudomonas putida KT2440
ccaggcgcgccu

SEQ ID NO: 1605744 - RNA, 13 nt, Pseudomonas putida KT2440
ccaggcgccgagc

SEQ ID NO: 1605745 - RNA, 15 nt, Pseudomonas putida KT2440
ccaggcgcagcagcu

SEQ ID NO: 1605746 - RNA, 18 nt, Pseudomonas putida KT2440
ccaggcgcagcagcucgu

SEQ ID NO: 1605747 - RNA, 20 nt, Pseudomonas putida KT2440
ccaggcgacggaacggccgc

SEQ ID NO: 1605748 - RNA, 18 nt, Pseudomonas putida KT2440
ccaggccuuucagcgccc

SEQ ID NO: 1605749 - RNA, 23 nt, Pseudomonas putida KT2440
ccaggccuuucagcgcccagaac

SEQ ID NO: 1605750 - RNA, 12 nt, Pseudomonas putida KT2440
ccaggccuuuga

SEQ ID NO: 1605751 - RNA, 14 nt, Pseudomonas putida KT2440
ccaggccuggaugc

SEQ ID NO: 1605752 - RNA, 14 nt, Pseudomonas putida KT2440
ccaggcagccucca

SEQ ID NO: 1605753 - RNA, 15 nt, Pseudomonas putida KT2440
ccaggcacaggcgca

SEQ ID NO: 1605754 - RNA, 15 nt, Pseudomonas putida KT2440
ccaggcaccgaguac

SEQ ID NO: 1605755 - RNA, 14 nt, Pseudomonas putida KT2440
ccaggcagcagacu

SEQ ID NO: 1605756 - RNA, 22 nt, Pseudomonas putida KT2440
ccaggccgugcuugaggccgcc

SEQ ID NO: 1605757 - RNA, 15 nt, Pseudomonas putida KT2440
ccaggccucaagccu

SEQ ID NO: 1605758 - RNA, 19 nt, Pseudomonas putida KT2440
ccaggccucaagccucgcg

SEQ ID NO: 1605759 - RNA, 19 nt, Pseudomonas putida KT2440
ccaggugcucagccacgcu

SEQ ID NO: 1605760 - RNA, 12 nt, Pseudomonas putida KT2440
ccaggugcugcg

SEQ ID NO: 1605761 - RNA, 22 nt, Pseudomonas putida KT2440
ccagguggaagcgcgcaucagc

SEQ ID NO: 1605762 - RNA, 15 nt, Pseudomonas putida KT2440
ccaggugccaggcuc

SEQ ID NO: 1605763 - RNA, 16 nt, Pseudomonas putida KT2440
ccaggugccaggcuca

SEQ ID NO: 1605764 - RNA, 21 nt, Pseudomonas putida KT2440
ccaggugcagguacugcaugu

SEQ ID NO: 1605765 - RNA, 16 nt, Pseudomonas putida KT2440
ccaggucuuccuccga

SEQ ID NO: 1605766 - RNA, 18 nt, Pseudomonas putida KT2440
ccaggugaugcaggcaau

SEQ ID NO: 1605767 - RNA, 19 nt, Pseudomonas putida KT2440
ccagggcgcaacgcccgcg

SEQ ID NO: 1605768 - RNA, 17 nt, Pseudomonas putida KT2440
ccagggcggcgcccagu

SEQ ID NO: 1605769 - RNA, 18 nt, Pseudomonas putida KT2440
ccagggcucuaccccuuc

SEQ ID NO: 1605770 - RNA, 23 nt, Pseudomonas putida KT2440
ccaggguggcguugagcuugagc

SEQ ID NO: 1605771 - RNA, 14 nt, Pseudomonas putida KT2440
ccagguacaggcaa

SEQ ID NO: 1605772 - RNA, 16 nt, Pseudomonas putida KT2440
ccagguaaaccugccu

SEQ ID NO: 1605773 - RNA, 18 nt, Pseudomonas putida KT2440
ccagguuauacgccgccg

SEQ ID NO: 1605774 - RNA, 17 nt, Pseudomonas putida KT2440
ccagguuggccgccgcc

SEQ ID NO: 1605775 - RNA, 18 nt, Pseudomonas putida KT2440
ccagguuggccgccgcca

SEQ ID NO: 1605776 - RNA, 15 nt, Pseudomonas putida KT2440
ccagguuggcaaacu

SEQ ID NO: 1605777 - RNA, 20 nt, Pseudomonas putida KT2440
ccagguucuguagcgcaaug

SEQ ID NO: 1605778 - RNA, 18 nt, Pseudomonas putida KT2440
ccaguaaugcagccggcc

SEQ ID NO: 1605779 - RNA, 19 nt, Pseudomonas putida KT2440
ccaguaaugcagccggccc

SEQ ID NO: 1605780 - RNA, 14 nt, Pseudomonas putida KT2440
ccagguuugcugcc

SEQ ID NO: 1605781 - RNA, 12 nt, Pseudomonas putida KT2440
ccagguuguagg

SEQ ID NO: 1605782 - RNA, 18 nt, Pseudomonas putida KT2440
ccagaaucuggggccgcg

SEQ ID NO: 1605783 - RNA, 21 nt, Pseudomonas putida KT2440
ccagaaacggcuugaacccgu

SEQ ID NO: 1605784 - RNA, 17 nt, Pseudomonas putida KT2440
ccagaaacccagggcag

SEQ ID NO: 1605785 - RNA, 16 nt, Pseudomonas putida KT2440
ccagaaacggcggcag

SEQ ID NO: 1605786 - RNA, 14 nt, Pseudomonas putida KT2440
ccagaaagcccgca

SEQ ID NO: 1605787 - RNA, 19 nt, Pseudomonas putida KT2440
ccagaacuucaccccguac

SEQ ID NO: 1605788 - RNA, 19 nt, Pseudomonas putida KT2440
ccagaaaaguuggccaugu

SEQ ID NO: 1605789 - RNA, 15 nt, Pseudomonas putida KT2440
ccacgucgccagcgg

SEQ ID NO: 1605790 - RNA, 16 nt, Pseudomonas putida KT2440
ccacguucccgccaug

SEQ ID NO: 1605791 - RNA, 19 nt, Pseudomonas putida KT2440
ccacguuauccagcugcaa

SEQ ID NO: 1605792 - RNA, 15 nt, Pseudomonas putida KT2440
ccagagagcugagau

SEQ ID NO: 1605793 - RNA, 16 nt, Pseudomonas putida KT2440
ccagagagcugagauc

SEQ ID NO: 1605794 - RNA, 13 nt, Pseudomonas putida KT2440
ccagacucagcug

SEQ ID NO: 1605795 - RNA, 13 nt, Pseudomonas putida KT2440
ccagagcgcgcca

SEQ ID NO: 1605796 - RNA, 19 nt, Pseudomonas putida KT2440
ccagagcgcgccacgcacc

SEQ ID NO: 1605797 - RNA, 14 nt, Pseudomonas putida KT2440
ccagagcguccucg

SEQ ID NO: 1605798 - RNA, 12 nt, Pseudomonas putida KT2440
ccagaggcgcgu

SEQ ID NO: 1605799 - RNA, 23 nt, Pseudomonas putida KT2440
ccagagggaagggcgucugcucc

SEQ ID NO: 1605800 - RNA, 13 nt, Pseudomonas putida KT2440
ccagacgcaggca

SEQ ID NO: 1605801 - RNA, 15 nt, Pseudomonas putida KT2440
ccagacgggcauggu

SEQ ID NO: 1605802 - RNA, 15 nt, Pseudomonas putida KT2440
ccagacggccuucga

SEQ ID NO: 1605803 - RNA, 16 nt, Pseudomonas putida KT2440
ccagacgaugauggcc

SEQ ID NO: 1605804 - RNA, 23 nt, Pseudomonas putida KT2440
ccagaccuugcgcacggccucca

SEQ ID NO: 1605805 - RNA, 18 nt, Pseudomonas putida KT2440
ccagaccuggaggucaug

SEQ ID NO: 1605806 - RNA, 19 nt, Pseudomonas putida KT2440
ccagacccugacucaugcc

SEQ ID NO: 1605807 - RNA, 20 nt, Pseudomonas putida KT2440
ccagacccgcuucgccgcgc

SEQ ID NO: 1605808 - RNA, 15 nt, Pseudomonas putida KT2440
ccagaccagcagcag

SEQ ID NO: 1605809 - RNA, 22 nt, Pseudomonas putida KT2440
ccagacauugaagaagcccccg

SEQ ID NO: 1605810 - RNA, 23 nt, Pseudomonas putida KT2440
ccagaugaaguagaacuggcgca

SEQ ID NO: 1605811 - RNA, 21 nt, Pseudomonas putida KT2440
ccagaucggcagugccgcagu

SEQ ID NO: 1605812 - RNA, 12 nt, Pseudomonas putida KT2440
ccagaucggcca

SEQ ID NO: 1605813 - RNA, 17 nt, Pseudomonas putida KT2440
ccagcaaccgccccugc

SEQ ID NO: 1605814 - RNA, 17 nt, Pseudomonas putida KT2440
ccagcaacaugccggcc

SEQ ID NO: 1605815 - RNA, 18 nt, Pseudomonas putida KT2440
ccagcaacgcagccagga

SEQ ID NO: 1605816 - RNA, 15 nt, Pseudomonas putida KT2440
ccagcaacggccgcg

SEQ ID NO: 1605817 - RNA, 15 nt, Pseudomonas putida KT2440
ccagcaacugcgccc

SEQ ID NO: 1605818 - RNA, 19 nt, Pseudomonas putida KT2440
ccagcaagggccugugccg

SEQ ID NO: 1605819 - RNA, 15 nt, Pseudomonas putida KT2440
ccagcacggccagca

SEQ ID NO: 1605820 - RNA, 19 nt, Pseudomonas putida KT2440
ccagcacgucacccacuuc

SEQ ID NO: 1605821 - RNA, 22 nt, Pseudomonas putida KT2440
ccagcacuuuugccaccacccg

SEQ ID NO: 1605822 - RNA, 23 nt, Pseudomonas putida KT2440
ccagcacuuuugccaccacccgg

SEQ ID NO: 1605823 - RNA, 21 nt, Pseudomonas putida KT2440
ccagcacuucguccagggugg

SEQ ID NO: 1605824 - RNA, 22 nt, Pseudomonas putida KT2440
ccagcacugccuggccacuguu

SEQ ID NO: 1605825 - RNA, 13 nt, Pseudomonas putida KT2440
ccagcacccgcuu

SEQ ID NO: 1605826 - RNA, 12 nt, Pseudomonas putida KT2440
ccagcaccgccc

SEQ ID NO: 1605827 - RNA, 14 nt, Pseudomonas putida KT2440
ccagcacaccgcgc

SEQ ID NO: 1605828 - RNA, 20 nt, Pseudomonas putida KT2440
ccagcaccagcgcgaucacc

SEQ ID NO: 1605829 - RNA, 19 nt, Pseudomonas putida KT2440
ccagcacagauaaaccugc

SEQ ID NO: 1605830 - RNA, 17 nt, Pseudomonas putida KT2440
ccagccacuccgccucg

SEQ ID NO: 1605831 - RNA, 17 nt, Pseudomonas putida KT2440
ccagccaacccucgacc

SEQ ID NO: 1605832 - RNA, 20 nt, Pseudomonas putida KT2440
ccagccaacccucgaccucg

SEQ ID NO: 1605833 - RNA, 20 nt, Pseudomonas putida KT2440
ccagccaggcacuggccagc

SEQ ID NO: 1605834 - RNA, 16 nt, Pseudomonas putida KT2440
ccagccagccaccacc

SEQ ID NO: 1605835 - RNA, 11 nt, Pseudomonas putida KT2440
ccagccagcga

SEQ ID NO: 1605836 - RNA, 18 nt, Pseudomonas putida KT2440
ccagccaguacggcagcc

SEQ ID NO: 1605837 - RNA, 13 nt, Pseudomonas putida KT2440
ccagccccagcgg

SEQ ID NO: 1605838 - RNA, 15 nt, Pseudomonas putida KT2440
ccagcaugaaccgcu

SEQ ID NO: 1605839 - RNA, 22 nt, Pseudomonas putida KT2440
ccagcauggccgaaaccagccc

SEQ ID NO: 1605840 - RNA, 15 nt, Pseudomonas putida KT2440
ccagcaugcugguua

SEQ ID NO: 1605841 - RNA, 13 nt, Pseudomonas putida KT2440
ccagcauggacca

SEQ ID NO: 1605842 - RNA, 17 nt, Pseudomonas putida KT2440
ccagcagcgccugcagc

SEQ ID NO: 1605843 - RNA, 11 nt, Pseudomonas putida KT2440
ccagcagcgcg

SEQ ID NO: 1605844 - RNA, 16 nt, Pseudomonas putida KT2440
ccagcagcgcauggcu

SEQ ID NO: 1605845 - RNA, 21 nt, Pseudomonas putida KT2440
ccagcagcgacaccagcgcac

SEQ ID NO: 1605846 - RNA, 23 nt, Pseudomonas putida KT2440
ccagcagcgacaccagcgcacca

SEQ ID NO: 1605847 - RNA, 18 nt, Pseudomonas putida KT2440
ccagcagccccacgccca

SEQ ID NO: 1605848 - RNA, 21 nt, Pseudomonas putida KT2440
ccagcaucaacaggucgccgc

SEQ ID NO: 1605849 - RNA, 9 nt, Pseudomonas putida KT2440
ccagcagcg

SEQ ID NO: 1605850 - RNA, 14 nt, Pseudomonas putida KT2440
ccacggccuucuuc

SEQ ID NO: 1605851 - RNA, 13 nt, Pseudomonas putida KT2440
ccacggccgcgca

SEQ ID NO: 1605852 - RNA, 18 nt, Pseudomonas putida KT2440
ccacgguacuuggcgcug

SEQ ID NO: 1605853 - RNA, 17 nt, Pseudomonas putida KT2440
ccacgcccgcugcaugc

SEQ ID NO: 1605854 - RNA, 20 nt, Pseudomonas putida KT2440
ccacgcccgucaccuugcca

SEQ ID NO: 1605855 - RNA, 14 nt, Pseudomonas putida KT2440
ccacgcccuggccc

SEQ ID NO: 1605856 - RNA, 13 nt, Pseudomonas putida KT2440
ccacgcucgugca

SEQ ID NO: 1605857 - RNA, 17 nt, Pseudomonas putida KT2440
ccacgcucgugcaggcu

SEQ ID NO: 1605858 - RNA, 15 nt, Pseudomonas putida KT2440
ccacgcccaacccca

SEQ ID NO: 1605859 - RNA, 16 nt, Pseudomonas putida KT2440
ccacgcccaaccccag

SEQ ID NO: 1605860 - RNA, 17 nt, Pseudomonas putida KT2440
ccacgcccaaccccagc

SEQ ID NO: 1605861 - RNA, 14 nt, Pseudomonas putida KT2440
ccacgccagaaccu

SEQ ID NO: 1605862 - RNA, 15 nt, Pseudomonas putida KT2440
ccacgccagaaccug

SEQ ID NO: 1605863 - RNA, 16 nt, Pseudomonas putida KT2440
ccacgccaccaugcuc

SEQ ID NO: 1605864 - RNA, 14 nt, Pseudomonas putida KT2440
ccacgaugccuggg

SEQ ID NO: 1605865 - RNA, 14 nt, Pseudomonas putida KT2440
ccacgcugccagga

SEQ ID NO: 1605866 - RNA, 20 nt, Pseudomonas putida KT2440
ccacggcaauucgccggcag

SEQ ID NO: 1605867 - RNA, 21 nt, Pseudomonas putida KT2440
ccacggaacaucgaggcgcgc

SEQ ID NO: 1605868 - RNA, 21 nt, Pseudomonas putida KT2440
ccacggaucaccacgucuucc

SEQ ID NO: 1605869 - RNA, 21 nt, Pseudomonas putida KT2440
ccaccgaccuguguccacccc

SEQ ID NO: 1605870 - RNA, 15 nt, Pseudomonas putida KT2440
ccaccccgcaggccg

SEQ ID NO: 1605871 - RNA, 19 nt, Pseudomonas putida KT2440
ccaccccgcaggccgcagc

SEQ ID NO: 1605872 - RNA, 12 nt, Pseudomonas putida KT2440
ccacccccgucu

SEQ ID NO: 1605873 - RNA, 17 nt, Pseudomonas putida KT2440
ccacccccgcacccggc

SEQ ID NO: 1605874 - RNA, 15 nt, Pseudomonas putida KT2440
ccacccccgccgcca

SEQ ID NO: 1605875 - RNA, 20 nt, Pseudomonas putida KT2440
ccacccuccgggucaggccg

SEQ ID NO: 1605876 - RNA, 17 nt, Pseudomonas putida KT2440
ccacccugaugcagcag

SEQ ID NO: 1605877 - RNA, 12 nt, Pseudomonas putida KT2440
ccaccccuugca

SEQ ID NO: 1605878 - RNA, 23 nt, Pseudomonas putida KT2440
ccaccguugcgcucgagcccgcc

SEQ ID NO: 1605879 - RNA, 18 nt, Pseudomonas putida KT2440
ccaccgucaggcucagca

SEQ ID NO: 1605880 - RNA, 18 nt, Pseudomonas putida KT2440
ccaccgucgaagcccgcg

SEQ ID NO: 1605881 - RNA, 14 nt, Pseudomonas putida KT2440
ccaccuccaccccg

SEQ ID NO: 1605882 - RNA, 20 nt, Pseudomonas putida KT2440
ccaccucgacccccuugcca

SEQ ID NO: 1605883 - RNA, 13 nt, Pseudomonas putida KT2440
ccaccuuccacuc

SEQ ID NO: 1605884 - RNA, 16 nt, Pseudomonas putida KT2440
ccaccuuacuugcaca

SEQ ID NO: 1605885 - RNA, 20 nt, Pseudomonas putida KT2440
ccacgaucgacaaccccagc

SEQ ID NO: 1605886 - RNA, 22 nt, Pseudomonas putida KT2440
ccacgaucgacaaccccagccc

SEQ ID NO: 1605887 - RNA, 16 nt, Pseudomonas putida KT2440
ccacgaucuuggccag

SEQ ID NO: 1605888 - RNA, 18 nt, Pseudomonas putida KT2440
ccacgaucuuggccaggg

SEQ ID NO: 1605889 - RNA, 16 nt, Pseudomonas putida KT2440
ccacgaucacgcccgg

SEQ ID NO: 1605890 - RNA, 13 nt, Pseudomonas putida KT2440
ccaccaccgaccg

SEQ ID NO: 1605891 - RNA, 20 nt, Pseudomonas putida KT2440
ccaccaccgcugauggccaa

SEQ ID NO: 1605892 - RNA, 13 nt, Pseudomonas putida KT2440
ccaccaccuccau

SEQ ID NO: 1605893 - RNA, 20 nt, Pseudomonas putida KT2440
ccaccaccguauuaaggcaa

SEQ ID NO: 1605894 - RNA, 12 nt, Pseudomonas putida KT2440
ccaccacccugu

SEQ ID NO: 1605895 - RNA, 13 nt, Pseudomonas putida KT2440
ccaccacccuggc

SEQ ID NO: 1605896 - RNA, 14 nt, Pseudomonas putida KT2440
ccaccacccuggca

SEQ ID NO: 1605897 - RNA, 16 nt, Pseudomonas putida KT2440
ccaccacaaaccacag

SEQ ID NO: 1605898 - RNA, 17 nt, Pseudomonas putida KT2440
ccaccacaaaccacagc

SEQ ID NO: 1605899 - RNA, 18 nt, Pseudomonas putida KT2440
ccaccaagggugucaaca

SEQ ID NO: 1605900 - RNA, 14 nt, Pseudomonas putida KT2440
ccaccaaggcugac

SEQ ID NO: 1605901 - RNA, 23 nt, Pseudomonas putida KT2440
ccaccaaggcugacgccaguugg

SEQ ID NO: 1605902 - RNA, 20 nt, Pseudomonas putida KT2440
ccaccaagucgauuuucacg

SEQ ID NO: 1605903 - RNA, 18 nt, Pseudomonas putida KT2440
ccacauacugcuucugcc

SEQ ID NO: 1605904 - RNA, 18 nt, Pseudomonas putida KT2440
ccacauccgaccccagca

SEQ ID NO: 1605905 - RNA, 21 nt, Pseudomonas putida KT2440
ccacauccagcgccuccccca

SEQ ID NO: 1605906 - RNA, 23 nt, Pseudomonas putida KT2440
ccacaugccagcuaucucccagc

SEQ ID NO: 1605907 - RNA, 17 nt, Pseudomonas putida KT2440
ccacauggaucagcuca

SEQ ID NO: 1605908 - RNA, 21 nt, Pseudomonas putida KT2440
ccacauggaucagcucauaga

SEQ ID NO: 1605909 - RNA, 14 nt, Pseudomonas putida KT2440
ccacaugcugcgcc

SEQ ID NO: 1605910 - RNA, 20 nt, Pseudomonas putida KT2440
ccacaugcugcgccccaggu

SEQ ID NO: 1605911 - RNA, 15 nt, Pseudomonas putida KT2440
ccaccagaugaccaa

SEQ ID NO: 1605912 - RNA, 17 nt, Pseudomonas putida KT2440
ccaccagauucgccaag

SEQ ID NO: 1605913 - RNA, 12 nt, Pseudomonas putida KT2440
ccaccagcaccu

SEQ ID NO: 1605914 - RNA, 13 nt, Pseudomonas putida KT2440
ccaccacuucugg

SEQ ID NO: 1605915 - RNA, 22 nt, Pseudomonas putida KT2440
ccaccacuucuggcugggcuuc

SEQ ID NO: 1605916 - RNA, 19 nt, Pseudomonas putida KT2440
ccaccacgaugccugggcg

SEQ ID NO: 1605917 - RNA, 13 nt, Pseudomonas putida KT2440
ccaccaccugcag

SEQ ID NO: 1605918 - RNA, 13 nt, Pseudomonas putida KT2440
ccaccagcaggcu

SEQ ID NO: 1605919 - RNA, 15 nt, Pseudomonas putida KT2440
ccaccagcaggcugc

SEQ ID NO: 1605920 - RNA, 15 nt, Pseudomonas putida KT2440
ccaccagcagugccc

SEQ ID NO: 1605921 - RNA, 12 nt, Pseudomonas putida KT2440
ccaccagcccga

SEQ ID NO: 1605922 - RNA, 15 nt, Pseudomonas putida KT2440
ccaccagcccguccg

SEQ ID NO: 1605923 - RNA, 19 nt, Pseudomonas putida KT2440
ccaccagcgccgccaaaaa

SEQ ID NO: 1605924 - RNA, 18 nt, Pseudomonas putida KT2440
ccaccagcgcccuucacg

SEQ ID NO: 1605925 - RNA, 21 nt, Pseudomonas putida KT2440
ccaccagcugcaccaccugcu

SEQ ID NO: 1605926 - RNA, 16 nt, Pseudomonas putida KT2440
ccaccaggccuuugac

SEQ ID NO: 1605927 - RNA, 12 nt, Pseudomonas putida KT2440
ccaccaguucca

SEQ ID NO: 1605928 - RNA, 12 nt, Pseudomonas putida KT2440
ccaccagugcuu

SEQ ID NO: 1605929 - RNA, 17 nt, Pseudomonas putida KT2440
ccaccaucuccagcucg

SEQ ID NO: 1605930 - RNA, 23 nt, Pseudomonas putida KT2440
ccaccaucuccagcucgccgccc

SEQ ID NO: 1605931 - RNA, 20 nt, Pseudomonas putida KT2440
ccaccaucuugcccagggcu

SEQ ID NO: 1605932 - RNA, 21 nt, Pseudomonas putida KT2440
ccaccaugaacagcacgccca

SEQ ID NO: 1605933 - RNA, 22 nt, Pseudomonas putida KT2440
ccaccaugaacagcacgcccaa

SEQ ID NO: 1605934 - RNA, 23 nt, Pseudomonas putida KT2440
ccaccaugaacagcacgcccaag

SEQ ID NO: 1605935 - RNA, 19 nt, Pseudomonas putida KT2440
ccacccccagcgaccagcu

SEQ ID NO: 1605936 - RNA, 15 nt, Pseudomonas putida KT2440
ccacccccagcgccu

SEQ ID NO: 1605937 - RNA, 22 nt, Pseudomonas putida KT2440
ccaccccaagcauagccaaacu

SEQ ID NO: 1605938 - RNA, 21 nt, Pseudomonas putida KT2440
ccaccccagcguuccugggcg

SEQ ID NO: 1605939 - RNA, 15 nt, Pseudomonas putida KT2440
ccaccccaggccacu

SEQ ID NO: 1605940 - RNA, 22 nt, Pseudomonas putida KT2440
ccacccagaugcgggcccuggu

SEQ ID NO: 1605941 - RNA, 18 nt, Pseudomonas putida KT2440
ccacccagaacagccaca

SEQ ID NO: 1605942 - RNA, 13 nt, Pseudomonas putida KT2440
ccacaaaccacag

SEQ ID NO: 1605943 - RNA, 16 nt, Pseudomonas putida KT2440
ccacaaaaccuuccau

SEQ ID NO: 1605944 - RNA, 23 nt, Pseudomonas putida KT2440
ccaauugguuaaaagccaacugc

SEQ ID NO: 1605945 - RNA, 15 nt, Pseudomonas putida KT2440
ccacaaccccugcaa

SEQ ID NO: 1605946 - RNA, 21 nt, Pseudomonas putida KT2440
ccaaugcagcuuugaggcuca

SEQ ID NO: 1605947 - RNA, 17 nt, Pseudomonas putida KT2440
ccaaugcugccuuuucc

SEQ ID NO: 1605948 - RNA, 21 nt, Pseudomonas putida KT2440
ccaauggacgcgcaagccgcu

SEQ ID NO: 1605949 - RNA, 20 nt, Pseudomonas putida KT2440
ccaauggcaaucgccuggcg

SEQ ID NO: 1605950 - RNA, 23 nt, Pseudomonas putida KT2440
ccaaugggcaccggccaccaggc

SEQ ID NO: 1605951 - RNA, 13 nt, Pseudomonas putida KT2440
ccacaggcacagg

SEQ ID NO: 1605952 - RNA, 12 nt, Pseudomonas putida KT2440
ccacaggcgccc

SEQ ID NO: 1605953 - RNA, 19 nt, Pseudomonas putida KT2440
ccacaggcgcuugaagaag

SEQ ID NO: 1605954 - RNA, 21 nt, Pseudomonas putida KT2440
ccacaggcgcuugaagaagcc

SEQ ID NO: 1605955 - RNA, 17 nt, Pseudomonas putida KT2440
ccacagggaccgcaucu

SEQ ID NO: 1605956 - RNA, 15 nt, Pseudomonas putida KT2440
ccacagggaggauug

SEQ ID NO: 1605957 - RNA, 16 nt, Pseudomonas putida KT2440
ccacaggggccgcgca

SEQ ID NO: 1605958 - RNA, 14 nt, Pseudomonas putida KT2440
ccacagguccagcg

SEQ ID NO: 1605959 - RNA, 20 nt, Pseudomonas putida KT2440
ccacagguccagcgcaggcu

SEQ ID NO: 1605960 - RNA, 22 nt, Pseudomonas putida KT2440
ccacaggugacaagcugcgccc

SEQ ID NO: 1605961 - RNA, 18 nt, Pseudomonas putida KT2440
ccacagguaaugcacaag

SEQ ID NO: 1605962 - RNA, 15 nt, Pseudomonas putida KT2440
ccacagguaccaggc

SEQ ID NO: 1605963 - RNA, 17 nt, Pseudomonas putida KT2440
ccacagguacucgcaag

SEQ ID NO: 1605964 - RNA, 20 nt, Pseudomonas putida KT2440
ccacagguacucgcaagcuc

SEQ ID NO: 1605965 - RNA, 23 nt, Pseudomonas putida KT2440
ccacagguuuagcgcuggcuuug

SEQ ID NO: 1605966 - RNA, 15 nt, Pseudomonas putida KT2440
ccacagcggccacag

SEQ ID NO: 1605967 - RNA, 20 nt, Pseudomonas putida KT2440
ccacagcggccacagcgcca

SEQ ID NO: 1605968 - RNA, 22 nt, Pseudomonas putida KT2440
ccacagcggccacagcgccaac

SEQ ID NO: 1605969 - RNA, 17 nt, Pseudomonas putida KT2440
ccacaggaauggcacca

SEQ ID NO: 1605970 - RNA, 21 nt, Pseudomonas putida KT2440
ccacagcugcugcagggccca

SEQ ID NO: 1605971 - RNA, 17 nt, Pseudomonas putida KT2440
ccacagccauuggccca

SEQ ID NO: 1605972 - RNA, 22 nt, Pseudomonas putida KT2440
ccacaccgaagcuugcagucac

SEQ ID NO: 1605973 - RNA, 12 nt, Pseudomonas putida KT2440
ccacaccagcgg

SEQ ID NO: 1605974 - RNA, 15 nt, Pseudomonas putida KT2440
ccacaccagcggcgc

SEQ ID NO: 1605975 - RNA, 17 nt, Pseudomonas putida KT2440
ccacaccacagcugcac

SEQ ID NO: 1605976 - RNA, 19 nt, Pseudomonas putida KT2440
ccacacaccccagaacggc

SEQ ID NO: 1605977 - RNA, 19 nt, Pseudomonas putida KT2440
ccacacaccgcaacccagc

SEQ ID NO: 1605978 - RNA, 18 nt, Pseudomonas putida KT2440
ccacaccguacugcuuca

SEQ ID NO: 1605979 - RNA, 22 nt, Pseudomonas putida KT2440
ccacaccugccaggccaaacag

SEQ ID NO: 1605980 - RNA, 15 nt, Pseudomonas putida KT2440
ccacacgcugcugcg

SEQ ID NO: 1605981 - RNA, 18 nt, Pseudomonas putida KT2440
ccacacggcaagccacgc

SEQ ID NO: 1605982 - RNA, 21 nt, Pseudomonas putida KT2440
ccacacggcaagccacgccag

SEQ ID NO: 1605983 - RNA, 12 nt, Pseudomonas putida KT2440
ccacacggcagc

SEQ ID NO: 1605984 - RNA, 16 nt, Pseudomonas putida KT2440
ccacacggcagcccca

SEQ ID NO: 1605985 - RNA, 21 nt, Pseudomonas putida KT2440
ccacacucgacgcugccgucu

SEQ ID NO: 1605986 - RNA, 22 nt, Pseudomonas putida KT2440
ccacacguuguccgacagcuug

SEQ ID NO: 1605987 - RNA, 17 nt, Pseudomonas putida KT2440
ccaauaccgcugcaaca

SEQ ID NO: 1605988 - RNA, 18 nt, Pseudomonas putida KT2440
ccaauaacucgcagcgca

SEQ ID NO: 1605989 - RNA, 14 nt, Pseudomonas putida KT2440
ccaaucaccugcac

SEQ ID NO: 1605990 - RNA, 16 nt, Pseudomonas putida KT2440
ccaaucaccaggauug

SEQ ID NO: 1605991 - RNA, 17 nt, Pseudomonas putida KT2440
ccaaucaucgccagcag

SEQ ID NO: 1605992 - RNA, 19 nt, Pseudomonas putida KT2440
ccaaucaucgccagcagcg

SEQ ID NO: 1605993 - RNA, 23 nt, Pseudomonas putida KT2440
ccaaucgaucugcucgcccaccg

SEQ ID NO: 1605994 - RNA, 14 nt, Pseudomonas putida KT2440
ccaaucgcaugcuc

SEQ ID NO: 1605995 - RNA, 17 nt, Pseudomonas putida KT2440
ccaagccauccaccagc

SEQ ID NO: 1605996 - RNA, 15 nt, Pseudomonas putida KT2440
ccaagcaacgcaaca

SEQ ID NO: 1605997 - RNA, 14 nt, Pseudomonas putida KT2440
ccaagcacggcgcc

SEQ ID NO: 1605998 - RNA, 20 nt, Pseudomonas putida KT2440
ccaaguguuugaagcuaaac

SEQ ID NO: 1605999 - RNA, 20 nt, Pseudomonas putida KT2440
ccaaguggcuggacaagcca

SEQ ID NO: 1606000 - RNA, 12 nt, Pseudomonas putida KT2440
ccaauaaaaaca

SEQ ID NO: 1606001 - RNA, 15 nt, Pseudomonas putida KT2440
ccaagggcucgucca

SEQ ID NO: 1606002 - RNA, 15 nt, Pseudomonas putida KT2440
ccaaggcuggccaga

SEQ ID NO: 1606003 - RNA, 20 nt, Pseudomonas putida KT2440
ccaagggucgacaccaggau

SEQ ID NO: 1606004 - RNA, 16 nt, Pseudomonas putida KT2440
ccaagcggccccagau

SEQ ID NO: 1606005 - RNA, 14 nt, Pseudomonas putida KT2440
ccaaggccaacugc

SEQ ID NO: 1606006 - RNA, 14 nt, Pseudomonas putida KT2440
ccaaggcaccaacu

SEQ ID NO: 1606007 - RNA, 22 nt, Pseudomonas putida KT2440
ccaaggcauaaaaaagggcccc

SEQ ID NO: 1606008 - RNA, 12 nt, Pseudomonas putida KT2440
ccaaggcaucca

SEQ ID NO: 1606009 - RNA, 20 nt, Pseudomonas putida KT2440
ccaaggcgguggaguaccug

SEQ ID NO: 1606010 - RNA, 22 nt, Pseudomonas putida KT2440
ccaaggccucgaacagcaguuc

SEQ ID NO: 1606011 - RNA, 22 nt, Pseudomonas putida KT2440
ccaaggccucuaccgcugcucc

SEQ ID NO: 1606012 - RNA, 18 nt, Pseudomonas putida KT2440
ccaaggcgagggcuucgc

SEQ ID NO: 1606013 - RNA, 17 nt, Pseudomonas putida KT2440
ccaaccacgccugcgcc

SEQ ID NO: 1606014 - RNA, 13 nt, Pseudomonas putida KT2440
ccaaccagcucac

SEQ ID NO: 1606015 - RNA, 18 nt, Pseudomonas putida KT2440
ccaaccaaaggaggcugu

SEQ ID NO: 1606016 - RNA, 12 nt, Pseudomonas putida KT2440
ccaacauucacg

SEQ ID NO: 1606017 - RNA, 11 nt, Pseudomonas putida KT2440
ccaacaggcug

SEQ ID NO: 1606018 - RNA, 17 nt, Pseudomonas putida KT2440
ccaacaggcuggcaucg

SEQ ID NO: 1606019 - RNA, 20 nt, Pseudomonas putida KT2440
ccaacccucacucgcggcca

SEQ ID NO: 1606020 - RNA, 20 nt, Pseudomonas putida KT2440
ccaaccgagucaacacggcu

SEQ ID NO: 1606021 - RNA, 17 nt, Pseudomonas putida KT2440
ccaaccgcuucaccgcg

SEQ ID NO: 1606022 - RNA, 18 nt, Pseudomonas putida KT2440
ccaaccgcuucaccgcgc

SEQ ID NO: 1606023 - RNA, 16 nt, Pseudomonas putida KT2440
ccaaccggcuuguagc

SEQ ID NO: 1606024 - RNA, 17 nt, Pseudomonas putida KT2440
ccaacccggucccgccc

SEQ ID NO: 1606025 - RNA, 21 nt, Pseudomonas putida KT2440
ccaacccggucccgcccucca

SEQ ID NO: 1606026 - RNA, 24 nt, Pseudomonas putida KT2440
ccaacccggucccgcccuccagcc

SEQ ID NO: 1606027 - RNA, 18 nt, Pseudomonas putida KT2440
ccaaccccgcagacagcu

SEQ ID NO: 1606028 - RNA, 11 nt, Pseudomonas putida KT2440
ccaaccccagc

SEQ ID NO: 1606029 - RNA, 12 nt, Pseudomonas putida KT2440
ccaaccccagcg

SEQ ID NO: 1606030 - RNA, 19 nt, Pseudomonas putida KT2440
ccaacacggugaugcgccc

SEQ ID NO: 1606031 - RNA, 18 nt, Pseudomonas putida KT2440
ccaaauucgaccagcagu

SEQ ID NO: 1606032 - RNA, 21 nt, Pseudomonas putida KT2440
ccaaaugcccgccaaaaggcc

SEQ ID NO: 1606033 - RNA, 15 nt, Pseudomonas putida KT2440
ccaacuccccaccca

SEQ ID NO: 1606034 - RNA, 12 nt, Pseudomonas putida KT2440
ccaacuccagcg

SEQ ID NO: 1606035 - RNA, 20 nt, Pseudomonas putida KT2440
ccaacucgcgcauccagcca

SEQ ID NO: 1606036 - RNA, 15 nt, Pseudomonas putida KT2440
ccaacugcgcccgcc

SEQ ID NO: 1606037 - RNA, 22 nt, Pseudomonas putida KT2440
ccaacuuuuccgcuuugcacug

SEQ ID NO: 1606038 - RNA, 13 nt, Pseudomonas putida KT2440
ccaacugcucuac

SEQ ID NO: 1606039 - RNA, 18 nt, Pseudomonas putida KT2440
ccaacuggcgcaucuucc

SEQ ID NO: 1606040 - RNA, 19 nt, Pseudomonas putida KT2440
ccaacugcacccgccagcc

SEQ ID NO: 1606041 - RNA, 17 nt, Pseudomonas putida KT2440
ccaacuguuucugcucu

SEQ ID NO: 1606042 - RNA, 19 nt, Pseudomonas putida KT2440
ccaacuguuucugcucuuc

SEQ ID NO: 1606043 - RNA, 17 nt, Pseudomonas putida KT2440
ccaacgucaaccgugcc

SEQ ID NO: 1606044 - RNA, 22 nt, Pseudomonas putida KT2440
ccaacgggcggaacuggcccug

SEQ ID NO: 1606045 - RNA, 17 nt, Pseudomonas putida KT2440
ccaaccugaucauucac

SEQ ID NO: 1606046 - RNA, 17 nt, Pseudomonas putida KT2440
ccaaccguuccugcagg

SEQ ID NO: 1606047 - RNA, 16 nt, Pseudomonas putida KT2440
ccaaccuuccagcaaa

SEQ ID NO: 1606048 - RNA, 22 nt, Pseudomonas putida KT2440
ccaaccguacccuuccuggaga

SEQ ID NO: 1606049 - RNA, 21 nt, Pseudomonas putida KT2440
ccaacgccaguugucgcuggg

SEQ ID NO: 1606050 - RNA, 17 nt, Pseudomonas putida KT2440
ccaaaguccugcaaagg

SEQ ID NO: 1606051 - RNA, 18 nt, Pseudomonas putida KT2440
ccaaaguccugcaaaggc

SEQ ID NO: 1606052 - RNA, 22 nt, Pseudomonas putida KT2440
ccaaagggcugggcgaacgccu

SEQ ID NO: 1606053 - RNA, 15 nt, Pseudomonas putida KT2440
ccaaagcuguugaag

SEQ ID NO: 1606054 - RNA, 14 nt, Pseudomonas putida KT2440
ccaaacgcccgcgc

SEQ ID NO: 1606055 - RNA, 15 nt, Pseudomonas putida KT2440
ccaaagcccgugccg

SEQ ID NO: 1606056 - RNA, 17 nt, Pseudomonas putida KT2440
ccaaaagcccacucaau

SEQ ID NO: 1606057 - RNA, 17 nt, Pseudomonas putida KT2440
ccaaaccguccagguag

SEQ ID NO: 1606058 - RNA, 12 nt, Pseudomonas putida KT2440
ccaaaccccagc

SEQ ID NO: 1606059 - RNA, 16 nt, Pseudomonas putida KT2440
ccaaaccccagcaagg

SEQ ID NO: 1606060 - RNA, 21 nt, Pseudomonas putida KT2440
ccaaaccauggcgucaggcgu

SEQ ID NO: 1606061 - RNA, 18 nt, Pseudomonas putida KT2440
ccaaaaguugcucaaacc

SEQ ID NO: 1606062 - RNA, 15 nt, Pseudomonas putida KT2440
cagggauacugcuga

SEQ ID NO: 1606063 - RNA, 14 nt, Pseudomonas putida KT2440
cagguaacgggcaa

SEQ ID NO: 1606064 - RNA, 21 nt, Pseudomonas putida KT2440
cagguaacugccgaccuuggg

SEQ ID NO: 1606065 - RNA, 13 nt, Pseudomonas putida KT2440
cagggcaaagccc

SEQ ID NO: 1606066 - RNA, 15 nt, Pseudomonas putida KT2440
cagggcaaagcccag

SEQ ID NO: 1606067 - RNA, 15 nt, Pseudomonas putida KT2440
cagguacgaagccau

SEQ ID NO: 1606068 - RNA, 17 nt, Pseudomonas putida KT2440
cagguacgaagccaugu

SEQ ID NO: 1606069 - RNA, 22 nt, Pseudomonas putida KT2440
cagguacgaagccaugucuuca

SEQ ID NO: 1606070 - RNA, 20 nt, Pseudomonas putida KT2440
cagguacaguucccggugcu

SEQ ID NO: 1606071 - RNA, 13 nt, Pseudomonas putida KT2440
cagguacauguug

SEQ ID NO: 1606072 - RNA, 15 nt, Pseudomonas putida KT2440
cagguagccuuccag

SEQ ID NO: 1606073 - RNA, 18 nt, Pseudomonas putida KT2440
cagguacucgccgggcgu

SEQ ID NO: 1606074 - RNA, 21 nt, Pseudomonas putida KT2440
cagguacucugucacccgcug

SEQ ID NO: 1606075 - RNA, 20 nt, Pseudomonas putida KT2440
cagguacucgcccgccaggu

SEQ ID NO: 1606076 - RNA, 14 nt, Pseudomonas putida KT2440
cagguaguucaugu

SEQ ID NO: 1606077 - RNA, 15 nt, Pseudomonas putida KT2440
cagguaggcagcaac

SEQ ID NO: 1606078 - RNA, 18 nt, Pseudomonas putida KT2440
cagguaggccgcagccau

SEQ ID NO: 1606079 - RNA, 13 nt, Pseudomonas putida KT2440
cagguagcugggc

SEQ ID NO: 1606080 - RNA, 19 nt, Pseudomonas putida KT2440
cagguaggcgccacgccgc

SEQ ID NO: 1606081 - RNA, 21 nt, Pseudomonas putida KT2440
cagguaggugcugaccgccug

SEQ ID NO: 1606082 - RNA, 18 nt, Pseudomonas putida KT2440
cagguagcucgacgccgu

SEQ ID NO: 1606083 - RNA, 16 nt, Pseudomonas putida KT2440
caggucaaucuugugg

SEQ ID NO: 1606084 - RNA, 18 nt, Pseudomonas putida KT2440
caggucauuugcagugcu

SEQ ID NO: 1606085 - RNA, 15 nt, Pseudomonas putida KT2440
caggucaugaugccc

SEQ ID NO: 1606086 - RNA, 23 nt, Pseudomonas putida KT2440
caggucaugaugcccgucggcgu

SEQ ID NO: 1606087 - RNA, 16 nt, Pseudomonas putida KT2440
cagguccagcgcaggc

SEQ ID NO: 1606088 - RNA, 12 nt, Pseudomonas putida KT2440
cagguccagcuc

SEQ ID NO: 1606089 - RNA, 20 nt, Pseudomonas putida KT2440
caggucauaguucuggcugc

SEQ ID NO: 1606090 - RNA, 22 nt, Pseudomonas putida KT2440
caggucauaguucuggcugccu

SEQ ID NO: 1606091 - RNA, 16 nt, Pseudomonas putida KT2440
caggucaccgcccagc

SEQ ID NO: 1606092 - RNA, 15 nt, Pseudomonas putida KT2440
cagguauccgggucc

SEQ ID NO: 1606093 - RNA, 13 nt, Pseudomonas putida KT2440
caggugacccugg

SEQ ID NO: 1606094 - RNA, 17 nt, Pseudomonas putida KT2440
caggugacccuggaaaa

SEQ ID NO: 1606095 - RNA, 13 nt, Pseudomonas putida KT2440
caggugcagcaca

SEQ ID NO: 1606096 - RNA, 14 nt, Pseudomonas putida KT2440
caggugauuuccuc

SEQ ID NO: 1606097 - RNA, 15 nt, Pseudomonas putida KT2440
caggugcaacccggc

SEQ ID NO: 1606098 - RNA, 17 nt, Pseudomonas putida KT2440
caggugcaacccggccu

SEQ ID NO: 1606099 - RNA, 14 nt, Pseudomonas putida KT2440
caggugcaccuccg

SEQ ID NO: 1606100 - RNA, 15 nt, Pseudomonas putida KT2440
caggugcaccuccgc

SEQ ID NO: 1606101 - RNA, 17 nt, Pseudomonas putida KT2440
caggugcaccuccgccc

SEQ ID NO: 1606102 - RNA, 20 nt, Pseudomonas putida KT2440
caggugauaguccagcaacu

SEQ ID NO: 1606103 - RNA, 20 nt, Pseudomonas putida KT2440
caggugaucguugcgcgcca

SEQ ID NO: 1606104 - RNA, 14 nt, Pseudomonas putida KT2440
caggucggccagcu

SEQ ID NO: 1606105 - RNA, 21 nt, Pseudomonas putida KT2440
caggucggcggccucggucca

SEQ ID NO: 1606106 - RNA, 17 nt, Pseudomonas putida KT2440
caggucucgaacgcugu

SEQ ID NO: 1606107 - RNA, 18 nt, Pseudomonas putida KT2440
caggucucgaacgcugug

SEQ ID NO: 1606108 - RNA, 23 nt, Pseudomonas putida KT2440
caggucugccagugucaguugcu

SEQ ID NO: 1606109 - RNA, 16 nt, Pseudomonas putida KT2440
caggucucccgccccc

SEQ ID NO: 1606110 - RNA, 20 nt, Pseudomonas putida KT2440
caggucgacgaucgccgcca

SEQ ID NO: 1606111 - RNA, 16 nt, Pseudomonas putida KT2440
caggucgaucccgccg

SEQ ID NO: 1606112 - RNA, 21 nt, Pseudomonas putida KT2440
caggucgaugaucgccgccgc

SEQ ID NO: 1606113 - RNA, 20 nt, Pseudomonas putida KT2440
caggucgacaugcaccacgc

SEQ ID NO: 1606114 - RNA, 14 nt, Pseudomonas putida KT2440
caggucgaccugcc

SEQ ID NO: 1606115 - RNA, 16 nt, Pseudomonas putida KT2440
caggucgaccugccag

SEQ ID NO: 1606116 - RNA, 17 nt, Pseudomonas putida KT2440
caggucgaccugccagu

SEQ ID NO: 1606117 - RNA, 15 nt, Pseudomonas putida KT2440
caggucgacacccag

SEQ ID NO: 1606118 - RNA, 18 nt, Pseudomonas putida KT2440
caggucgacacccagcac

SEQ ID NO: 1606119 - RNA, 15 nt, Pseudomonas putida KT2440
caggucgaacagccc

SEQ ID NO: 1606120 - RNA, 17 nt, Pseudomonas putida KT2440
caggucgaacagccccc

SEQ ID NO: 1606121 - RNA, 15 nt, Pseudomonas putida KT2440
cagguccugcuccac

SEQ ID NO: 1606122 - RNA, 18 nt, Pseudomonas putida KT2440
cagguccugcuccacccg

SEQ ID NO: 1606123 - RNA, 19 nt, Pseudomonas putida KT2440
cagguccgguaacuggccc

SEQ ID NO: 1606124 - RNA, 20 nt, Pseudomonas putida KT2440
cagguccgguaacuggccca

SEQ ID NO: 1606125 - RNA, 19 nt, Pseudomonas putida KT2440
cagguccggaaacucacgc

SEQ ID NO: 1606126 - RNA, 17 nt, Pseudomonas putida KT2440
cagguccgagugcucga

SEQ ID NO: 1606127 - RNA, 14 nt, Pseudomonas putida KT2440
caggucgccaggcu

SEQ ID NO: 1606128 - RNA, 16 nt, Pseudomonas putida KT2440
caggucgccaggcuuc

SEQ ID NO: 1606129 - RNA, 17 nt, Pseudomonas putida KT2440
caggucgauguccaggc

SEQ ID NO: 1606130 - RNA, 19 nt, Pseudomonas putida KT2440
caggucgauguccaggccg

SEQ ID NO: 1606131 - RNA, 21 nt, Pseudomonas putida KT2440
caggucgccagcaccaucagg

SEQ ID NO: 1606132 - RNA, 15 nt, Pseudomonas putida KT2440
caggucggcaaccau

SEQ ID NO: 1606133 - RNA, 17 nt, Pseudomonas putida KT2440
caggucggcacgcaccu

SEQ ID NO: 1606134 - RNA, 13 nt, Pseudomonas putida KT2440
caggucggccagc

SEQ ID NO: 1606135 - RNA, 18 nt, Pseudomonas putida KT2440
caggucgcugugcggcgu

SEQ ID NO: 1606136 - RNA, 20 nt, Pseudomonas putida KT2440
caggucgcgguucgacugcc

SEQ ID NO: 1606137 - RNA, 23 nt, Pseudomonas putida KT2440
caggucgcgguucgacugccgcu

SEQ ID NO: 1606138 - RNA, 19 nt, Pseudomonas putida KT2440
caggucgcuaucggcaggc

SEQ ID NO: 1606139 - RNA, 22 nt, Pseudomonas putida KT2440
caggucgcgcugcagcuccuug

SEQ ID NO: 1606140 - RNA, 17 nt, Pseudomonas putida KT2440
caggucgcggagccaau

SEQ ID NO: 1606141 - RNA, 17 nt, Pseudomonas putida KT2440
caggucgccuugaaaag

SEQ ID NO: 1606142 - RNA, 21 nt, Pseudomonas putida KT2440
cagguuguucggcaggcucug

SEQ ID NO: 1606143 - RNA, 17 nt, Pseudomonas putida KT2440
cagguuguucaccuugg

SEQ ID NO: 1606144 - RNA, 18 nt, Pseudomonas putida KT2440
cagguuguucaccuuggg

SEQ ID NO: 1606145 - RNA, 14 nt, Pseudomonas putida KT2440
cagguuguggccca

SEQ ID NO: 1606146 - RNA, 14 nt, Pseudomonas putida KT2440
cagguuguccaccg

SEQ ID NO: 1606147 - RNA, 15 nt, Pseudomonas putida KT2440
cagguuguccaccgc

SEQ ID NO: 1606148 - RNA, 15 nt, Pseudomonas putida KT2440
cagguuuuccagccc

SEQ ID NO: 1606149 - RNA, 18 nt, Pseudomonas putida KT2440
cagguuuggguuggcuuu

SEQ ID NO: 1606150 - RNA, 23 nt, Pseudomonas putida KT2440
caguaaugcagccggccccugcu

SEQ ID NO: 1606151 - RNA, 22 nt, Pseudomonas putida KT2440
caggugcaggagcaaacagccu

SEQ ID NO: 1606152 - RNA, 12 nt, Pseudomonas putida KT2440
caggugcaggcu

SEQ ID NO: 1606153 - RNA, 16 nt, Pseudomonas putida KT2440
caggugcaggcucggc

SEQ ID NO: 1606154 - RNA, 19 nt, Pseudomonas putida KT2440
caggugcagguucgaccac

SEQ ID NO: 1606155 - RNA, 15 nt, Pseudomonas putida KT2440
caggugccaggcuca

SEQ ID NO: 1606156 - RNA, 23 nt, Pseudomonas putida KT2440
caggugcccaugaucuugcugcc

SEQ ID NO: 1606157 - RNA, 17 nt, Pseudomonas putida KT2440
caggugccguuccggca

SEQ ID NO: 1606158 - RNA, 14 nt, Pseudomonas putida KT2440
cagguucaagccua

SEQ ID NO: 1606159 - RNA, 13 nt, Pseudomonas putida KT2440
cagguuacuggcc

SEQ ID NO: 1606160 - RNA, 16 nt, Pseudomonas putida KT2440
cagguuacuggccaau

SEQ ID NO: 1606161 - RNA, 18 nt, Pseudomonas putida KT2440
cagguugaccaacgccag

SEQ ID NO: 1606162 - RNA, 20 nt, Pseudomonas putida KT2440
cagguucugaaucuggcucu

SEQ ID NO: 1606163 - RNA, 13 nt, Pseudomonas putida KT2440
cagguugaacagc

SEQ ID NO: 1606164 - RNA, 16 nt, Pseudomonas putida KT2440
cagguugaacagcagc

SEQ ID NO: 1606165 - RNA, 19 nt, Pseudomonas putida KT2440
cagguuccauagugugcuc

SEQ ID NO: 1606166 - RNA, 16 nt, Pseudomonas putida KT2440
cagguucgaauccugc

SEQ ID NO: 1606167 - RNA, 21 nt, Pseudomonas putida KT2440
cagguucgaauccugcugagu

SEQ ID NO: 1606168 - RNA, 23 nt, Pseudomonas putida KT2440
cagguucgaccaccgcaggugca

SEQ ID NO: 1606169 - RNA, 15 nt, Pseudomonas putida KT2440
cagguucgaccagaa

SEQ ID NO: 1606170 - RNA, 15 nt, Pseudomonas putida KT2440
caguaggcugcagcc

SEQ ID NO: 1606171 - RNA, 23 nt, Pseudomonas putida KT2440
caguaucgccccggucagcagga

SEQ ID NO: 1606172 - RNA, 22 nt, Pseudomonas putida KT2440
caguacgggcccuuucgcgggu

SEQ ID NO: 1606173 - RNA, 14 nt, Pseudomonas putida KT2440
caguacgccaccca

SEQ ID NO: 1606174 - RNA, 20 nt, Pseudomonas putida KT2440
caguacgccacccagaugcg

SEQ ID NO: 1606175 - RNA, 15 nt, Pseudomonas putida KT2440
caguacgccagcagc

SEQ ID NO: 1606176 - RNA, 14 nt, Pseudomonas putida KT2440
caguaccuucuggc

SEQ ID NO: 1606177 - RNA, 14 nt, Pseudomonas putida KT2440
caguacgaugcugc

SEQ ID NO: 1606178 - RNA, 23 nt, Pseudomonas putida KT2440
caguacgaugcugcgggcguugu

SEQ ID NO: 1606179 - RNA, 23 nt, Pseudomonas putida KT2440
caguacgcaggcauacaggacca

SEQ ID NO: 1606180 - RNA, 19 nt, Pseudomonas putida KT2440
caguaccuaggguucaaau

SEQ ID NO: 1606181 - RNA, 16 nt, Pseudomonas putida KT2440
cagucccagcaccgcg

SEQ ID NO: 1606182 - RNA, 21 nt, Pseudomonas putida KT2440
cagucccaguugugacuagag

SEQ ID NO: 1606183 - RNA, 13 nt, Pseudomonas putida KT2440
caguccaggccaa

SEQ ID NO: 1606184 - RNA, 22 nt, Pseudomonas putida KT2440
caguccaucaccaccauuugaa

SEQ ID NO: 1606185 - RNA, 15 nt, Pseudomonas putida KT2440
caguccacuugcguu

SEQ ID NO: 1606186 - RNA, 17 nt, Pseudomonas putida KT2440
caguauugcgucaggcu

SEQ ID NO: 1606187 - RNA, 14 nt, Pseudomonas putida KT2440
caguuucaucaccg

SEQ ID NO: 1606188 - RNA, 22 nt, Pseudomonas putida KT2440
caguuucaccugaccaucagcc

SEQ ID NO: 1606189 - RNA, 18 nt, Pseudomonas putida KT2440
caguucgucgagcaucug

SEQ ID NO: 1606190 - RNA, 22 nt, Pseudomonas putida KT2440
caguucgucgagcaucugcugc

SEQ ID NO: 1606191 - RNA, 17 nt, Pseudomonas putida KT2440
caguucguccaggcuuu

SEQ ID NO: 1606192 - RNA, 22 nt, Pseudomonas putida KT2440
caguucggcggccccggcgccg

SEQ ID NO: 1606193 - RNA, 12 nt, Pseudomonas putida KT2440
caguuucuucag

SEQ ID NO: 1606194 - RNA, 18 nt, Pseudomonas putida KT2440
caguuucuugccuuccac

SEQ ID NO: 1606195 - RNA, 15 nt, Pseudomonas putida KT2440
caguuucgcgacgag

SEQ ID NO: 1606196 - RNA, 22 nt, Pseudomonas putida KT2440
caguuuucaaugcugcucgccc

SEQ ID NO: 1606197 - RNA, 17 nt, Pseudomonas putida KT2440
cauaaaaaaacccgcug

SEQ ID NO: 1606198 - RNA, 17 nt, Pseudomonas putida KT2440
cauaagcugucagcacc

SEQ ID NO: 1606199 - RNA, 19 nt, Pseudomonas putida KT2440
cauaagcugucagcaccug

SEQ ID NO: 1606200 - RNA, 23 nt, Pseudomonas putida KT2440
caguccgguagcgcgccugcuuu

SEQ ID NO: 1606201 - RNA, 21 nt, Pseudomonas putida KT2440
cagugccaugaacaccaccgc

SEQ ID NO: 1606202 - RNA, 22 nt, Pseudomonas putida KT2440
cagugccaugaacaccaccgcg

SEQ ID NO: 1606203 - RNA, 13 nt, Pseudomonas putida KT2440
cagugaucaucac

SEQ ID NO: 1606204 - RNA, 22 nt, Pseudomonas putida KT2440
cagugaucaucacacucgcccc

SEQ ID NO: 1606205 - RNA, 15 nt, Pseudomonas putida KT2440
cagugccugaccggu

SEQ ID NO: 1606206 - RNA, 14 nt, Pseudomonas putida KT2440
cagugccugugaga

SEQ ID NO: 1606207 - RNA, 14 nt, Pseudomonas putida KT2440
cagugccuggguca

SEQ ID NO: 1606208 - RNA, 18 nt, Pseudomonas putida KT2440
cagugccugggucagcuc

SEQ ID NO: 1606209 - RNA, 19 nt, Pseudomonas putida KT2440
cagugccugggucagcucc

SEQ ID NO: 1606210 - RNA, 20 nt, Pseudomonas putida KT2440
cagugccugggucagcuccu

SEQ ID NO: 1606211 - RNA, 18 nt, Pseudomonas putida KT2440
cagugccgugaguggccu

SEQ ID NO: 1606212 - RNA, 15 nt, Pseudomonas putida KT2440
cagugcgcagguacg

SEQ ID NO: 1606213 - RNA, 22 nt, Pseudomonas putida KT2440
caguucaccauccgccagguau

SEQ ID NO: 1606214 - RNA, 23 nt, Pseudomonas putida KT2440
caguucacgcaggcgcaggugca

SEQ ID NO: 1606215 - RNA, 17 nt, Pseudomonas putida KT2440
caguucacggaucgcca

SEQ ID NO: 1606216 - RNA, 18 nt, Pseudomonas putida KT2440
cagugguugugcuggccc

SEQ ID NO: 1606217 - RNA, 15 nt, Pseudomonas putida KT2440
caguggugcucagcg

SEQ ID NO: 1606218 - RNA, 15 nt, Pseudomonas putida KT2440
caguuccuucagcag

SEQ ID NO: 1606219 - RNA, 15 nt, Pseudomonas putida KT2440
caguuccuugagcac

SEQ ID NO: 1606220 - RNA, 20 nt, Pseudomonas putida KT2440
caguucgaugcgaagcaagc

SEQ ID NO: 1606221 - RNA, 18 nt, Pseudomonas putida KT2440
caguucgacgcugcuguc

SEQ ID NO: 1606222 - RNA, 14 nt, Pseudomonas putida KT2440
caguucgcacagcu

SEQ ID NO: 1606223 - RNA, 20 nt, Pseudomonas putida KT2440
caguucggaaaacuccugcu

SEQ ID NO: 1606224 - RNA, 20 nt, Pseudomonas putida KT2440
caguucgcgugccaccucug

SEQ ID NO: 1606225 - RNA, 20 nt, Pseudomonas putida KT2440
caguucgcggcgcaccgcuu

SEQ ID NO: 1606226 - RNA, 12 nt, Pseudomonas putida KT2440
caguuccuggcg

SEQ ID NO: 1606227 - RNA, 20 nt, Pseudomonas putida KT2440
caguuccuggcgcuccucca

SEQ ID NO: 1606228 - RNA, 17 nt, Pseudomonas putida KT2440
caguuccaccggcaagc

SEQ ID NO: 1606229 - RNA, 22 nt, Pseudomonas putida KT2440
caguuccaccggcaagcccaug

SEQ ID NO: 1606230 - RNA, 13 nt, Pseudomonas putida KT2440
caggccugcacug

SEQ ID NO: 1606231 - RNA, 18 nt, Pseudomonas putida KT2440
caggccugcacugcaccc

SEQ ID NO: 1606232 - RNA, 19 nt, Pseudomonas putida KT2440
caggcgaagcguucaugcc

SEQ ID NO: 1606233 - RNA, 23 nt, Pseudomonas putida KT2440
caggcgaaugcgcccggccaggu

SEQ ID NO: 1606234 - RNA, 15 nt, Pseudomonas putida KT2440
caggccuugccgcuc

SEQ ID NO: 1606235 - RNA, 16 nt, Pseudomonas putida KT2440
caggccuuucugcucg

SEQ ID NO: 1606236 - RNA, 18 nt, Pseudomonas putida KT2440
caggcccuuucgcgggua

SEQ ID NO: 1606237 - RNA, 21 nt, Pseudomonas putida KT2440
caggccgaaaaaaucaugcgc

SEQ ID NO: 1606238 - RNA, 17 nt, Pseudomonas putida KT2440
caggccgaaaccgcccg

SEQ ID NO: 1606239 - RNA, 18 nt, Pseudomonas putida KT2440
caggccgaaaccgcccgg

SEQ ID NO: 1606240 - RNA, 17 nt, Pseudomonas putida KT2440
caggccucaagccucgc

SEQ ID NO: 1606241 - RNA, 22 nt, Pseudomonas putida KT2440
caggccucaagccucgcgcaac

SEQ ID NO: 1606242 - RNA, 21 nt, Pseudomonas putida KT2440
caggcccugacgccagcgcug

SEQ ID NO: 1606243 - RNA, 17 nt, Pseudomonas putida KT2440
caggcccgccagagcau

SEQ ID NO: 1606244 - RNA, 22 nt, Pseudomonas putida KT2440
caggcccgccagagcauggcca

SEQ ID NO: 1606245 - RNA, 23 nt, Pseudomonas putida KT2440
caggcccggcccuuucgcgggua

SEQ ID NO: 1606246 - RNA, 15 nt, Pseudomonas putida KT2440
caggcccgugacgaa

SEQ ID NO: 1606247 - RNA, 18 nt, Pseudomonas putida KT2440
caggcgacggaacggccg

SEQ ID NO: 1606248 - RNA, 13 nt, Pseudomonas putida KT2440
caggcgacgcagu

SEQ ID NO: 1606249 - RNA, 18 nt, Pseudomonas putida KT2440
caggcgacuggaaggcgc

SEQ ID NO: 1606250 - RNA, 17 nt, Pseudomonas putida KT2440
caggcgcagcacgccgu

SEQ ID NO: 1606251 - RNA, 17 nt, Pseudomonas putida KT2440
caggcgauucaggcuuu

SEQ ID NO: 1606252 - RNA, 21 nt, Pseudomonas putida KT2440
caggcgauucaggcuuugcug

SEQ ID NO: 1606253 - RNA, 23 nt, Pseudomonas putida KT2440
caggcgcugguugacggcuuuga

SEQ ID NO: 1606254 - RNA, 23 nt, Pseudomonas putida KT2440
caggcgcuggcgccagccgccac

SEQ ID NO: 1606255 - RNA, 21 nt, Pseudomonas putida KT2440
caggcgcucgcuccagggcag

SEQ ID NO: 1606256 - RNA, 14 nt, Pseudomonas putida KT2440
caggcgcagcagcu

SEQ ID NO: 1606257 - RNA, 15 nt, Pseudomonas putida KT2440
caggcgcagcgcaug

SEQ ID NO: 1606258 - RNA, 15 nt, Pseudomonas putida KT2440
caggcguaaacccag

SEQ ID NO: 1606259 - RNA, 18 nt, Pseudomonas putida KT2440
caggcguaacucagcaac

SEQ ID NO: 1606260 - RNA, 19 nt, Pseudomonas putida KT2440
caggcguaacucagcaacg

SEQ ID NO: 1606261 - RNA, 14 nt, Pseudomonas putida KT2440
caggcggcccggca

SEQ ID NO: 1606262 - RNA, 18 nt, Pseudomonas putida KT2440
caggcucuugaacugggc

SEQ ID NO: 1606263 - RNA, 17 nt, Pseudomonas putida KT2440
caggcucucagcccauu

SEQ ID NO: 1606264 - RNA, 23 nt, Pseudomonas putida KT2440
caggcucucagcccauuucaccu

SEQ ID NO: 1606265 - RNA, 14 nt, Pseudomonas putida KT2440
caggcucuccagcc

SEQ ID NO: 1606266 - RNA, 15 nt, Pseudomonas putida KT2440
caggcucuccucauc

SEQ ID NO: 1606267 - RNA, 16 nt, Pseudomonas putida KT2440
caggcguauucggcca

SEQ ID NO: 1606268 - RNA, 19 nt, Pseudomonas putida KT2440
caggcguacaucagccucg

SEQ ID NO: 1606269 - RNA, 15 nt, Pseudomonas putida KT2440
caggcgucaggcuug

SEQ ID NO: 1606270 - RNA, 13 nt, Pseudomonas putida KT2440
caggcuggccagc

SEQ ID NO: 1606271 - RNA, 21 nt, Pseudomonas putida KT2440
caggcuggccaccaugaacag

SEQ ID NO: 1606272 - RNA, 19 nt, Pseudomonas putida KT2440
caggcuggcaaucagcucu

SEQ ID NO: 1606273 - RNA, 21 nt, Pseudomonas putida KT2440
caggcuggcgacgccaccccg

SEQ ID NO: 1606274 - RNA, 19 nt, Pseudomonas putida KT2440
caggcuggcggccaaugcu

SEQ ID NO: 1606275 - RNA, 23 nt, Pseudomonas putida KT2440
caggcugcgcccgcacagcacgu

SEQ ID NO: 1606276 - RNA, 14 nt, Pseudomonas putida KT2440
caggcugcgccgcc

SEQ ID NO: 1606277 - RNA, 19 nt, Pseudomonas putida KT2440
caggcugcgcgccauggcg

SEQ ID NO: 1606278 - RNA, 20 nt, Pseudomonas putida KT2440
caggcugcgugccugcugcu

SEQ ID NO: 1606279 - RNA, 12 nt, Pseudomonas putida KT2440
caggcugacccg

SEQ ID NO: 1606280 - RNA, 18 nt, Pseudomonas putida KT2440
caggcugaucaccgccgc

SEQ ID NO: 1606281 - RNA, 17 nt, Pseudomonas putida KT2440
caggcuuacaucggcga

SEQ ID NO: 1606282 - RNA, 14 nt, Pseudomonas putida KT2440
caggcuugaagcug

SEQ ID NO: 1606283 - RNA, 21 nt, Pseudomonas putida KT2440
caggcuggguggugucgacca

SEQ ID NO: 1606284 - RNA, 24 nt, Pseudomonas putida KT2440
caggcugucggcgucggccaugcc

SEQ ID NO: 1606285 - RNA, 19 nt, Pseudomonas putida KT2440
caggcuguuccauuucccu

SEQ ID NO: 1606286 - RNA, 18 nt, Pseudomonas putida KT2440
caggcuuucggccacccg

SEQ ID NO: 1606287 - RNA, 23 nt, Pseudomonas putida KT2440
caggcuuguccuugagcgccgcg

SEQ ID NO: 1606288 - RNA, 17 nt, Pseudomonas putida KT2440
caggaucaugugcgcca

SEQ ID NO: 1606289 - RNA, 14 nt, Pseudomonas putida KT2440
caggaucacuggcc

SEQ ID NO: 1606290 - RNA, 18 nt, Pseudomonas putida KT2440
caggaucacuggccugga

SEQ ID NO: 1606291 - RNA, 14 nt, Pseudomonas putida KT2440
caggaacagcgcag

SEQ ID NO: 1606292 - RNA, 17 nt, Pseudomonas putida KT2440
caggaacagcgcagcca

SEQ ID NO: 1606293 - RNA, 23 nt, Pseudomonas putida KT2440
caggaacagcgcagccaccagcu

SEQ ID NO: 1606294 - RNA, 19 nt, Pseudomonas putida KT2440
caggaacagcggcagcaac

SEQ ID NO: 1606295 - RNA, 17 nt, Pseudomonas putida KT2440
caggaacagcguggcca

SEQ ID NO: 1606296 - RNA, 15 nt, Pseudomonas putida KT2440
caggauacccaucuc

SEQ ID NO: 1606297 - RNA, 23 nt, Pseudomonas putida KT2440
caggaacacuucgcuuucaccuu

SEQ ID NO: 1606298 - RNA, 18 nt, Pseudomonas putida KT2440
caggaacaaucuucuuca

SEQ ID NO: 1606299 - RNA, 22 nt, Pseudomonas putida KT2440
caggaacaaucuucuucaucac

SEQ ID NO: 1606300 - RNA, 16 nt, Pseudomonas putida KT2440
caggcacccagccagc

SEQ ID NO: 1606301 - RNA, 16 nt, Pseudomonas putida KT2440
caggcaccgcacccgg

SEQ ID NO: 1606302 - RNA, 16 nt, Pseudomonas putida KT2440
caggcacaggccagcc

SEQ ID NO: 1606303 - RNA, 14 nt, Pseudomonas putida KT2440
caggcacaggccca

SEQ ID NO: 1606304 - RNA, 18 nt, Pseudomonas putida KT2440
caggcacaggcgcacacg

SEQ ID NO: 1606305 - RNA, 15 nt, Pseudomonas putida KT2440
caggcacagcacggc

SEQ ID NO: 1606306 - RNA, 15 nt, Pseudomonas putida KT2440
caggauggccgcagg

SEQ ID NO: 1606307 - RNA, 18 nt, Pseudomonas putida KT2440
caggaugcuucggcugau

SEQ ID NO: 1606308 - RNA, 22 nt, Pseudomonas putida KT2440
caggauggcaaagcgcagcaau

SEQ ID NO: 1606309 - RNA, 17 nt, Pseudomonas putida KT2440
caggauggcaccgauca

SEQ ID NO: 1606310 - RNA, 23 nt, Pseudomonas putida KT2440
caggauuuucagcgcgaaacccu

SEQ ID NO: 1606311 - RNA, 20 nt, Pseudomonas putida KT2440
caggcaaagaaacaccaggc

SEQ ID NO: 1606312 - RNA, 20 nt, Pseudomonas putida KT2440
caggcaaagaaugccgccca

SEQ ID NO: 1606313 - RNA, 20 nt, Pseudomonas putida KT2440
caggcaaaguugagcgccgc

SEQ ID NO: 1606314 - RNA, 21 nt, Pseudomonas putida KT2440
caggcaaaguugagcgccgcg

SEQ ID NO: 1606315 - RNA, 20 nt, Pseudomonas putida KT2440
caggccccgauacagcgcgc

SEQ ID NO: 1606316 - RNA, 17 nt, Pseudomonas putida KT2440
caggcccgacuccaccg

SEQ ID NO: 1606317 - RNA, 19 nt, Pseudomonas putida KT2440
caggcccgacuccaccgcg

SEQ ID NO: 1606318 - RNA, 19 nt, Pseudomonas putida KT2440
caggccccugcaacagggc

SEQ ID NO: 1606319 - RNA, 20 nt, Pseudomonas putida KT2440
caggccccugcaacagggcg

SEQ ID NO: 1606320 - RNA, 14 nt, Pseudomonas putida KT2440
caggccccaggcca

SEQ ID NO: 1606321 - RNA, 15 nt, Pseudomonas putida KT2440
caggccccaggccau

SEQ ID NO: 1606322 - RNA, 19 nt, Pseudomonas putida KT2440
caggccccaggccauccag

SEQ ID NO: 1606323 - RNA, 23 nt, Pseudomonas putida KT2440
caggcccauuucgcgggucaggg

SEQ ID NO: 1606324 - RNA, 14 nt, Pseudomonas putida KT2440
caggcccagccggg

SEQ ID NO: 1606325 - RNA, 16 nt, Pseudomonas putida KT2440
caggcccagccgggcc

SEQ ID NO: 1606326 - RNA, 16 nt, Pseudomonas putida KT2440
caggccagcgcacagc

SEQ ID NO: 1606327 - RNA, 20 nt, Pseudomonas putida KT2440
caggccaguuccucggccug

SEQ ID NO: 1606328 - RNA, 12 nt, Pseudomonas putida KT2440
caggcccaccag

SEQ ID NO: 1606329 - RNA, 23 nt, Pseudomonas putida KT2440
caggcccagcagguacagcaccc

SEQ ID NO: 1606330 - RNA, 13 nt, Pseudomonas putida KT2440
caggcccagcaug

SEQ ID NO: 1606331 - RNA, 22 nt, Pseudomonas putida KT2440
caggcccacggcguccaggccc

SEQ ID NO: 1606332 - RNA, 15 nt, Pseudomonas putida KT2440
caggcauuccccggu

SEQ ID NO: 1606333 - RNA, 22 nt, Pseudomonas putida KT2440
caggcauuccccggucagcaug

SEQ ID NO: 1606334 - RNA, 16 nt, Pseudomonas putida KT2440
caggcauacaggacca

SEQ ID NO: 1606335 - RNA, 17 nt, Pseudomonas putida KT2440
caggcauacaggaccag

SEQ ID NO: 1606336 - RNA, 19 nt, Pseudomonas putida KT2440
caggcauacaggaccaggc

SEQ ID NO: 1606337 - RNA, 19 nt, Pseudomonas putida KT2440
caggcauaccgcaacaccu

SEQ ID NO: 1606338 - RNA, 19 nt, Pseudomonas putida KT2440
caggccaccggcagcaccu

SEQ ID NO: 1606339 - RNA, 20 nt, Pseudomonas putida KT2440
caggccaccggcagcaccug

SEQ ID NO: 1606340 - RNA, 18 nt, Pseudomonas putida KT2440
caggccacugguacagcu

SEQ ID NO: 1606341 - RNA, 20 nt, Pseudomonas putida KT2440
caggccaaguacggccagca

SEQ ID NO: 1606342 - RNA, 22 nt, Pseudomonas putida KT2440
caggccaacaaaaaaagcccgc

SEQ ID NO: 1606343 - RNA, 18 nt, Pseudomonas putida KT2440
cagcuugucgaccaggau

SEQ ID NO: 1606344 - RNA, 18 nt, Pseudomonas putida KT2440
cagcuuguugccagcggc

SEQ ID NO: 1606345 - RNA, 22 nt, Pseudomonas putida KT2440
cagcuuggccauuuccggcccg

SEQ ID NO: 1606346 - RNA, 20 nt, Pseudomonas putida KT2440
cagcuuggucagggcaaagc

SEQ ID NO: 1606347 - RNA, 20 nt, Pseudomonas putida KT2440
cagcuugugaaccccacccc

SEQ ID NO: 1606348 - RNA, 14 nt, Pseudomonas putida KT2440
cagcuugugccgcu

SEQ ID NO: 1606349 - RNA, 16 nt, Pseudomonas putida KT2440
cagcugguucugcugc

SEQ ID NO: 1606350 - RNA, 23 nt, Pseudomonas putida KT2440
cagcugguucugcugcagccaac

SEQ ID NO: 1606351 - RNA, 13 nt, Pseudomonas putida KT2440
cagcuuccugugc

SEQ ID NO: 1606352 - RNA, 15 nt, Pseudomonas putida KT2440
cagcuuccugugccg

SEQ ID NO: 1606353 - RNA, 18 nt, Pseudomonas putida KT2440
cagcuggcucaucugccg

SEQ ID NO: 1606354 - RNA, 15 nt, Pseudomonas putida KT2440
cagcuucuccagcaa

SEQ ID NO: 1606355 - RNA, 17 nt, Pseudomonas putida KT2440
cagcuucuccagcaagc

SEQ ID NO: 1606356 - RNA, 21 nt, Pseudomonas putida KT2440
cagcuucucgcgcuuggccag

SEQ ID NO: 1606357 - RNA, 14 nt, Pseudomonas putida KT2440
cagcuucugcuggu

SEQ ID NO: 1606358 - RNA, 19 nt, Pseudomonas putida KT2440
cagcuucugcuugcucugu

SEQ ID NO: 1606359 - RNA, 14 nt, Pseudomonas putida KT2440
cagcucagccagca

SEQ ID NO: 1606360 - RNA, 16 nt, Pseudomonas putida KT2440
cagcucacuggcaucc

SEQ ID NO: 1606361 - RNA, 16 nt, Pseudomonas putida KT2440
cagcucacuggccaac

SEQ ID NO: 1606362 - RNA, 12 nt, Pseudomonas putida KT2440
cagcucacagca

SEQ ID NO: 1606363 - RNA, 15 nt, Pseudomonas putida KT2440
cagcucacagcacuc

SEQ ID NO: 1606364 - RNA, 19 nt, Pseudomonas putida KT2440
cagcucacagcacucguug

SEQ ID NO: 1606365 - RNA, 16 nt, Pseudomonas putida KT2440
cagcuccucugccgac

SEQ ID NO: 1606366 - RNA, 12 nt, Pseudomonas putida KT2440
cagcuccuggcc

SEQ ID NO: 1606367 - RNA, 19 nt, Pseudomonas putida KT2440
cagcuccuggcccgcgccc

SEQ ID NO: 1606368 - RNA, 16 nt, Pseudomonas putida KT2440
cagcuccuggcucagu

SEQ ID NO: 1606369 - RNA, 17 nt, Pseudomonas putida KT2440
cagcucgaaaccggccu

SEQ ID NO: 1606370 - RNA, 16 nt, Pseudomonas putida KT2440
cagcucgaucagcugg

SEQ ID NO: 1606371 - RNA, 22 nt, Pseudomonas putida KT2440
cagcugcauuggcggcaggcgc

SEQ ID NO: 1606372 - RNA, 12 nt, Pseudomonas putida KT2440
cagcugccacuc

SEQ ID NO: 1606373 - RNA, 22 nt, Pseudomonas putida KT2440
cagcugccacucuucaccaugg

SEQ ID NO: 1606374 - RNA, 22 nt, Pseudomonas putida KT2440
cagcugccauuucuucagcagg

SEQ ID NO: 1606375 - RNA, 15 nt, Pseudomonas putida KT2440
cagcugcaccaccug

SEQ ID NO: 1606376 - RNA, 14 nt, Pseudomonas putida KT2440
cagcugcgcacgca

SEQ ID NO: 1606377 - RNA, 15 nt, Pseudomonas putida KT2440
cagcugccggccagc

SEQ ID NO: 1606378 - RNA, 17 nt, Pseudomonas putida KT2440
cagcugccggccagcgc

SEQ ID NO: 1606379 - RNA, 19 nt, Pseudomonas putida KT2440
cagcugccggccagcgccu

SEQ ID NO: 1606380 - RNA, 16 nt, Pseudomonas putida KT2440
cagcucuuccaguuuc

SEQ ID NO: 1606381 - RNA, 15 nt, Pseudomonas putida KT2440
cagcucuggucaccu

SEQ ID NO: 1606382 - RNA, 15 nt, Pseudomonas putida KT2440
cagcucugcgacuga

SEQ ID NO: 1606383 - RNA, 21 nt, Pseudomonas putida KT2440
cagcugagcgccauccaccug

SEQ ID NO: 1606384 - RNA, 16 nt, Pseudomonas putida KT2440
cagcgggcugcccggu

SEQ ID NO: 1606385 - RNA, 15 nt, Pseudomonas putida KT2440
cagcgggcucgccca

SEQ ID NO: 1606386 - RNA, 19 nt, Pseudomonas putida KT2440
cagcgggcuacacgcgccc

SEQ ID NO: 1606387 - RNA, 17 nt, Pseudomonas putida KT2440
cagcgggggcagugccc

SEQ ID NO: 1606388 - RNA, 19 nt, Pseudomonas putida KT2440
cagcgggggcagugcccag

SEQ ID NO: 1606389 - RNA, 20 nt, Pseudomonas putida KT2440
cagcgggucgucgcccaggc

SEQ ID NO: 1606390 - RNA, 14 nt, Pseudomonas putida KT2440
cagcggguccucga

SEQ ID NO: 1606391 - RNA, 18 nt, Pseudomonas putida KT2440
cagcggguuccccagcaa

SEQ ID NO: 1606392 - RNA, 13 nt, Pseudomonas putida KT2440
cagcgggaacggu

SEQ ID NO: 1606393 - RNA, 13 nt, Pseudomonas putida KT2440
cagcgggcacagg

SEQ ID NO: 1606394 - RNA, 17 nt, Pseudomonas putida KT2440
cagcgggcccagcaggu

SEQ ID NO: 1606395 - RNA, 17 nt, Pseudomonas putida KT2440
cagcgggcgauugccag

SEQ ID NO: 1606396 - RNA, 19 nt, Pseudomonas putida KT2440
cagcgggcgauugccaggg

SEQ ID NO: 1606397 - RNA, 22 nt, Pseudomonas putida KT2440
cagcgggcgauugccagggugc

SEQ ID NO: 1606398 - RNA, 20 nt, Pseudomonas putida KT2440
cacugaguaacucaccuggu

SEQ ID NO: 1606399 - RNA, 22 nt, Pseudomonas putida KT2440
cagcgucaugcgguacagcacu

SEQ ID NO: 1606400 - RNA, 13 nt, Pseudomonas putida KT2440
cagcgucaggguc

SEQ ID NO: 1606401 - RNA, 20 nt, Pseudomonas putida KT2440
cagcgucagggucucgcggc

SEQ ID NO: 1606402 - RNA, 13 nt, Pseudomonas putida KT2440
cagcgucacccgu

SEQ ID NO: 1606403 - RNA, 15 nt, Pseudomonas putida KT2440
cagcgguugagauga

SEQ ID NO: 1606404 - RNA, 21 nt, Pseudomonas putida KT2440
cagcgguucgaccaauggcug

SEQ ID NO: 1606405 - RNA, 16 nt, Pseudomonas putida KT2440
cagcguauagccaccg

SEQ ID NO: 1606406 - RNA, 21 nt, Pseudomonas putida KT2440
cagcguuccugggcguucuga

SEQ ID NO: 1606407 - RNA, 13 nt, Pseudomonas putida KT2440
cagcguucggcca

SEQ ID NO: 1606408 - RNA, 19 nt, Pseudomonas putida KT2440
cagcguucggccagcacua

SEQ ID NO: 1606409 - RNA, 23 nt, Pseudomonas putida KT2440
cagcguucgggucaacucaggcu

SEQ ID NO: 1606410 - RNA, 21 nt, Pseudomonas putida KT2440
cagcguuuguaaguaggcgcu

SEQ ID NO: 1606411 - RNA, 13 nt, Pseudomonas putida KT2440
cagcgucggcaga

SEQ ID NO: 1606412 - RNA, 21 nt, Pseudomonas putida KT2440
cagcgucggcagagcgccagc

SEQ ID NO: 1606413 - RNA, 17 nt, Pseudomonas putida KT2440
cagcgucugcuugccca

SEQ ID NO: 1606414 - RNA, 22 nt, Pseudomonas putida KT2440
cagcguggccagcccaaggaag

SEQ ID NO: 1606415 - RNA, 17 nt, Pseudomonas putida KT2440
cagcgugacgauggcca

SEQ ID NO: 1606416 - RNA, 20 nt, Pseudomonas putida KT2440
cagcgugaccugggccgggu

SEQ ID NO: 1606417 - RNA, 15 nt, Pseudomonas putida KT2440
cauguagaccaccag

SEQ ID NO: 1606418 - RNA, 16 nt, Pseudomonas putida KT2440
cauguagaccaccagc

SEQ ID NO: 1606419 - RNA, 19 nt, Pseudomonas putida KT2440
cauguacgucaaguaggca

SEQ ID NO: 1606420 - RNA, 20 nt, Pseudomonas putida KT2440
cauguacucuucgacggucg

SEQ ID NO: 1606421 - RNA, 15 nt, Pseudomonas putida KT2440
cauguacugcagaca

SEQ ID NO: 1606422 - RNA, 17 nt, Pseudomonas putida KT2440
cauguagccaaucaucu

SEQ ID NO: 1606423 - RNA, 14 nt, Pseudomonas putida KT2440
cauguaaagcagaa

SEQ ID NO: 1606424 - RNA, 16 nt, Pseudomonas putida KT2440
cauggcgguccaccgc

SEQ ID NO: 1606425 - RNA, 16 nt, Pseudomonas putida KT2440
cauggcgcgccaugcc

SEQ ID NO: 1606426 - RNA, 18 nt, Pseudomonas putida KT2440
cauggcguuguccagcag

SEQ ID NO: 1606427 - RNA, 19 nt, Pseudomonas putida KT2440
cauggcguuguccagcagg

SEQ ID NO: 1606428 - RNA, 17 nt, Pseudomonas putida KT2440
cauggcucaacuggcag

SEQ ID NO: 1606429 - RNA, 22 nt, Pseudomonas putida KT2440
cauggcucaacuggcaggguuc

SEQ ID NO: 1606430 - RNA, 14 nt, Pseudomonas putida KT2440
caugucccaguuca

SEQ ID NO: 1606431 - RNA, 21 nt, Pseudomonas putida KT2440
cauguaggagauucuauggcc

SEQ ID NO: 1606432 - RNA, 15 nt, Pseudomonas putida KT2440
cauguagcgccuggc

SEQ ID NO: 1606433 - RNA, 22 nt, Pseudomonas putida KT2440
cauguagcgccuggccugcaga

SEQ ID NO: 1606434 - RNA, 22 nt, Pseudomonas putida KT2440
cauguccggggucaucaggacg

SEQ ID NO: 1606435 - RNA, 15 nt, Pseudomonas putida KT2440
caugucgcuuugggg

SEQ ID NO: 1606436 - RNA, 17 nt, Pseudomonas putida KT2440
caugucggaagccugca

SEQ ID NO: 1606437 - RNA, 20 nt, Pseudomonas putida KT2440
caugucggcagucuugcuga

SEQ ID NO: 1606438 - RNA, 21 nt, Pseudomonas putida KT2440
cauggccgccaaggcgaugcu

SEQ ID NO: 1606439 - RNA, 21 nt, Pseudomonas putida KT2440
cauggccgagccaagaggcag

SEQ ID NO: 1606440 - RNA, 20 nt, Pseudomonas putida KT2440
cauggccgaaaccagccccu

SEQ ID NO: 1606441 - RNA, 21 nt, Pseudomonas putida KT2440
cauggccgaaaccagccccuu

SEQ ID NO: 1606442 - RNA, 20 nt, Pseudomonas putida KT2440
cauggcauucgccacuugcu

SEQ ID NO: 1606443 - RNA, 21 nt, Pseudomonas putida KT2440
cauggcauucgccacuugcug

SEQ ID NO: 1606444 - RNA, 21 nt, Pseudomonas putida KT2440
cauggcccugaucugccccuc

SEQ ID NO: 1606445 - RNA, 18 nt, Pseudomonas putida KT2440
caugcuggccaaggucuc

SEQ ID NO: 1606446 - RNA, 12 nt, Pseudomonas putida KT2440
caugcugcgaca

SEQ ID NO: 1606447 - RNA, 17 nt, Pseudomonas putida KT2440
caugcugcgccccaggu

SEQ ID NO: 1606448 - RNA, 15 nt, Pseudomonas putida KT2440
caugcugcugcagca

SEQ ID NO: 1606449 - RNA, 18 nt, Pseudomonas putida KT2440
caugcucggccagcucgc

SEQ ID NO: 1606450 - RNA, 19 nt, Pseudomonas putida KT2440
caugcucugcgcaaaggcu

SEQ ID NO: 1606451 - RNA, 15 nt, Pseudomonas putida KT2440
caugcucagcugggc

SEQ ID NO: 1606452 - RNA, 16 nt, Pseudomonas putida KT2440
caugcucgcgggccug

SEQ ID NO: 1606453 - RNA, 19 nt, Pseudomonas putida KT2440
caugccggccaccacacug

SEQ ID NO: 1606454 - RNA, 14 nt, Pseudomonas putida KT2440
caugccgccgaugu

SEQ ID NO: 1606455 - RNA, 14 nt, Pseudomonas putida KT2440
caugcucaccagcu

SEQ ID NO: 1606456 - RNA, 18 nt, Pseudomonas putida KT2440
caugcucaccagcuucug

SEQ ID NO: 1606457 - RNA, 16 nt, Pseudomonas putida KT2440
caugccggccccagac

SEQ ID NO: 1606458 - RNA, 19 nt, Pseudomonas putida KT2440
caugccagcuaucucccag

SEQ ID NO: 1606459 - RNA, 21 nt, Pseudomonas putida KT2440
caugccaagcccacacaccgc

SEQ ID NO: 1606460 - RNA, 17 nt, Pseudomonas putida KT2440
caugccacgcaccacca

SEQ ID NO: 1606461 - RNA, 17 nt, Pseudomonas putida KT2440
caugccacccaugccac

SEQ ID NO: 1606462 - RNA, 22 nt, Pseudomonas putida KT2440
caugccaccgccacugaccagc

SEQ ID NO: 1606463 - RNA, 17 nt, Pseudomonas putida KT2440
caugcccagcgccaccg

SEQ ID NO: 1606464 - RNA, 23 nt, Pseudomonas putida KT2440
caugaucaccgccagcggcaagc

SEQ ID NO: 1606465 - RNA, 18 nt, Pseudomonas putida KT2440
caugaucagcugccacuc

SEQ ID NO: 1606466 - RNA, 21 nt, Pseudomonas putida KT2440
caugaucggguucuuccaagu

SEQ ID NO: 1606467 - RNA, 14 nt, Pseudomonas putida KT2440
caugaucgccgccg

SEQ ID NO: 1606468 - RNA, 23 nt, Pseudomonas putida KT2440
caugaucgcgcuuggcaccggca

SEQ ID NO: 1606469 - RNA, 23 nt, Pseudomonas putida KT2440
caugaucgcggcaaugcgccggu

SEQ ID NO: 1606470 - RNA, 18 nt, Pseudomonas putida KT2440
caugagcgagcucaacca

SEQ ID NO: 1606471 - RNA, 16 nt, Pseudomonas putida KT2440
caugagccuggccggu

SEQ ID NO: 1606472 - RNA, 23 nt, Pseudomonas putida KT2440
caugagccuggccgguguggcca

SEQ ID NO: 1606473 - RNA, 21 nt, Pseudomonas putida KT2440
caugaggauacgacgcaucag

SEQ ID NO: 1606474 - RNA, 23 nt, Pseudomonas putida KT2440
caugaggaucgucacguuuuuug

SEQ ID NO: 1606475 - RNA, 22 nt, Pseudomonas putida KT2440
caugcagguucgaccagaacau

SEQ ID NO: 1606476 - RNA, 21 nt, Pseudomonas putida KT2440
caugcagguugcccucggcca

SEQ ID NO: 1606477 - RNA, 18 nt, Pseudomonas putida KT2440
caugcaguucuaccagca

SEQ ID NO: 1606478 - RNA, 19 nt, Pseudomonas putida KT2440
caugcaguucuaccagcag

SEQ ID NO: 1606479 - RNA, 22 nt, Pseudomonas putida KT2440
caugcaguucuaccagcagcuc

SEQ ID NO: 1606480 - RNA, 17 nt, Pseudomonas putida KT2440
caugcaguugagcccuc

SEQ ID NO: 1606481 - RNA, 19 nt, Pseudomonas putida KT2440
caugcaggucgaccugcca

SEQ ID NO: 1606482 - RNA, 20 nt, Pseudomonas putida KT2440
caugcaucugcgccccgcuc

SEQ ID NO: 1606483 - RNA, 14 nt, Pseudomonas putida KT2440
caugcagcaccucc

SEQ ID NO: 1606484 - RNA, 21 nt, Pseudomonas putida KT2440
caugcaggucaucgaacaccu

SEQ ID NO: 1606485 - RNA, 21 nt, Pseudomonas putida KT2440
caugaugaaguggcgcaggcu

SEQ ID NO: 1606486 - RNA, 14 nt, Pseudomonas putida KT2440
caugauguacgcca

SEQ ID NO: 1606487 - RNA, 14 nt, Pseudomonas putida KT2440
caugacuuccaggu

SEQ ID NO: 1606488 - RNA, 21 nt, Pseudomonas putida KT2440
caugaacucaguuacagaggc

SEQ ID NO: 1606489 - RNA, 18 nt, Pseudomonas putida KT2440
caugaagcuucaaaccaa

SEQ ID NO: 1606490 - RNA, 18 nt, Pseudomonas putida KT2440
caugaaggacaucaccag

SEQ ID NO: 1606491 - RNA, 20 nt, Pseudomonas putida KT2440
caugaaggacaucaccaggc

SEQ ID NO: 1606492 - RNA, 22 nt, Pseudomonas putida KT2440
caugaagcggccggccccccca

SEQ ID NO: 1606493 - RNA, 13 nt, Pseudomonas putida KT2440
caugaagggacuu

SEQ ID NO: 1606494 - RNA, 12 nt, Pseudomonas putida KT2440
caugaaggugua

SEQ ID NO: 1606495 - RNA, 19 nt, Pseudomonas putida KT2440
caugaagccaugggcagag

SEQ ID NO: 1606496 - RNA, 13 nt, Pseudomonas putida KT2440
caugaacacauac

SEQ ID NO: 1606497 - RNA, 21 nt, Pseudomonas putida KT2440
cauuucgcgcagggugccggc

SEQ ID NO: 1606498 - RNA, 14 nt, Pseudomonas putida KT2440
cauuucguccaggc

SEQ ID NO: 1606499 - RNA, 17 nt, Pseudomonas putida KT2440
cauuuccgggcaaugca

SEQ ID NO: 1606500 - RNA, 23 nt, Pseudomonas putida KT2440
cauuuccggguuaccgcacagca

SEQ ID NO: 1606501 - RNA, 22 nt, Pseudomonas putida KT2440
cauuuccggcccgguuggcgcu

SEQ ID NO: 1606502 - RNA, 13 nt, Pseudomonas putida KT2440
cauuucacuggcu

SEQ ID NO: 1606503 - RNA, 21 nt, Pseudomonas putida KT2440
cauuucacuggcuuccucuuc

SEQ ID NO: 1606504 - RNA, 22 nt, Pseudomonas putida KT2440
cauuucacuggcuuccucuuca

SEQ ID NO: 1606505 - RNA, 18 nt, Pseudomonas putida KT2440
cauuucaccugcucuggc

SEQ ID NO: 1606506 - RNA, 20 nt, Pseudomonas putida KT2440
cauuguaucggaaagccgag

SEQ ID NO: 1606507 - RNA, 17 nt, Pseudomonas putida KT2440
cauugcucacugaccac

SEQ ID NO: 1606508 - RNA, 18 nt, Pseudomonas putida KT2440
cauugcggccgucaacga

SEQ ID NO: 1606509 - RNA, 23 nt, Pseudomonas putida KT2440
cauuggcggcaggcgcagcugcc

SEQ ID NO: 1606510 - RNA, 19 nt, Pseudomonas putida KT2440
cauuggcguugagccgcca

SEQ ID NO: 1606511 - RNA, 16 nt, Pseudomonas putida KT2440
cauuggugccagcgcc

SEQ ID NO: 1606512 - RNA, 22 nt, Pseudomonas putida KT2440
cauuggugugggugaaguguua

SEQ ID NO: 1606513 - RNA, 13 nt, Pseudomonas putida KT2440
cauuggugaaagc

SEQ ID NO: 1606514 - RNA, 17 nt, Pseudomonas putida KT2440
cauugggucccugguuc

SEQ ID NO: 1606515 - RNA, 18 nt, Pseudomonas putida KT2440
cauucggugcagcggcag

SEQ ID NO: 1606516 - RNA, 13 nt, Pseudomonas putida KT2440
cauucuucuccaa

SEQ ID NO: 1606517 - RNA, 23 nt, Pseudomonas putida KT2440
cauguucaacgcaaugggcacaa

SEQ ID NO: 1606518 - RNA, 15 nt, Pseudomonas putida KT2440
cauucaaagccugcu

SEQ ID NO: 1606519 - RNA, 21 nt, Pseudomonas putida KT2440
cauucaaagccugcuccagca

SEQ ID NO: 1606520 - RNA, 17 nt, Pseudomonas putida KT2440
cauucgauagccugcaa

SEQ ID NO: 1606521 - RNA, 13 nt, Pseudomonas putida KT2440
cauucgcccgcac

SEQ ID NO: 1606522 - RNA, 20 nt, Pseudomonas putida KT2440
cauucgcgggcaugcccgcu

SEQ ID NO: 1606523 - RNA, 21 nt, Pseudomonas putida KT2440
cauuccguuggccaccaccag

SEQ ID NO: 1606524 - RNA, 19 nt, Pseudomonas putida KT2440
cauucaggcacggcaccag

SEQ ID NO: 1606525 - RNA, 18 nt, Pseudomonas putida KT2440
cauucagcagcgccuggu

SEQ ID NO: 1606526 - RNA, 23 nt, Pseudomonas putida KT2440
cauucaucguauugccccggcca

SEQ ID NO: 1606527 - RNA, 13 nt, Pseudomonas putida KT2440
cauagaucagcau

SEQ ID NO: 1606528 - RNA, 11 nt, Pseudomonas putida KT2440
cauagcaccag

SEQ ID NO: 1606529 - RNA, 15 nt, Pseudomonas putida KT2440
cauagcaggaacacc

SEQ ID NO: 1606530 - RNA, 13 nt, Pseudomonas putida KT2440
cauagcccugcuc

SEQ ID NO: 1606531 - RNA, 14 nt, Pseudomonas putida KT2440
cauagccugcugcu

SEQ ID NO: 1606532 - RNA, 12 nt, Pseudomonas putida KT2440
cauagaaauggc

SEQ ID NO: 1606533 - RNA, 14 nt, Pseudomonas putida KT2440
cauagcucagcugg

SEQ ID NO: 1606534 - RNA, 17 nt, Pseudomonas putida KT2440
cauagcgguacagcacc

SEQ ID NO: 1606535 - RNA, 18 nt, Pseudomonas putida KT2440
cauagcgguacagcaccc

SEQ ID NO: 1606536 - RNA, 14 nt, Pseudomonas putida KT2440
cauaggccagcucc

SEQ ID NO: 1606537 - RNA, 19 nt, Pseudomonas putida KT2440
cauagcuggcacugcccaa

SEQ ID NO: 1606538 - RNA, 15 nt, Pseudomonas putida KT2440
cauauaccgcgcacg

SEQ ID NO: 1606539 - RNA, 21 nt, Pseudomonas putida KT2440
cauauacgcacacgaccuugg

SEQ ID NO: 1606540 - RNA, 13 nt, Pseudomonas putida KT2440
cauaguggguaua

SEQ ID NO: 1606541 - RNA, 23 nt, Pseudomonas putida KT2440
cauagucgauacccaggcgcgcc

SEQ ID NO: 1606542 - RNA, 17 nt, Pseudomonas putida KT2440
cauagugugcucacggu

SEQ ID NO: 1606543 - RNA, 17 nt, Pseudomonas putida KT2440
cauaguugaccagcacc

SEQ ID NO: 1606544 - RNA, 13 nt, Pseudomonas putida KT2440
cauaucagccaac

SEQ ID NO: 1606545 - RNA, 21 nt, Pseudomonas putida KT2440
cauauugcugagccaguucac

SEQ ID NO: 1606546 - RNA, 22 nt, Pseudomonas putida KT2440
caucaaagacuccgcuucauca

SEQ ID NO: 1606547 - RNA, 15 nt, Pseudomonas putida KT2440
caucaauauccagcc

SEQ ID NO: 1606548 - RNA, 14 nt, Pseudomonas putida KT2440
caucaauaccggca

SEQ ID NO: 1606549 - RNA, 13 nt, Pseudomonas putida KT2440
caucaccaggccc

SEQ ID NO: 1606550 - RNA, 14 nt, Pseudomonas putida KT2440
caucaccaggcccg

SEQ ID NO: 1606551 - RNA, 13 nt, Pseudomonas putida KT2440
caucaccagcccc

SEQ ID NO: 1606552 - RNA, 17 nt, Pseudomonas putida KT2440
caucaccacgcccuggc

SEQ ID NO: 1606553 - RNA, 20 nt, Pseudomonas putida KT2440
caucaccacaaaaccuucca

SEQ ID NO: 1606554 - RNA, 15 nt, Pseudomonas putida KT2440
caucaccacccccag

SEQ ID NO: 1606555 - RNA, 14 nt, Pseudomonas putida KT2440
caucaccagcagcu

SEQ ID NO: 1606556 - RNA, 16 nt, Pseudomonas putida KT2440
caucacguuacgccag

SEQ ID NO: 1606557 - RNA, 13 nt, Pseudomonas putida KT2440
caucacgucacag

SEQ ID NO: 1606558 - RNA, 15 nt, Pseudomonas putida KT2440
caucacacucgcccc

SEQ ID NO: 1606559 - RNA, 17 nt, Pseudomonas putida KT2440
caucacacucgccccca

SEQ ID NO: 1606560 - RNA, 14 nt, Pseudomonas putida KT2440
caucagcagcugcc

SEQ ID NO: 1606561 - RNA, 17 nt, Pseudomonas putida KT2440
caucagagcgugaagcg

SEQ ID NO: 1606562 - RNA, 21 nt, Pseudomonas putida KT2440
caucagagcgugaagcggaca

SEQ ID NO: 1606563 - RNA, 16 nt, Pseudomonas putida KT2440
caucagcaagccgccg

SEQ ID NO: 1606564 - RNA, 16 nt, Pseudomonas putida KT2440
caucagcaacccggcc

SEQ ID NO: 1606565 - RNA, 16 nt, Pseudomonas putida KT2440
caucacugccaccgug

SEQ ID NO: 1606566 - RNA, 18 nt, Pseudomonas putida KT2440
caucacucuugcgccagu

SEQ ID NO: 1606567 - RNA, 19 nt, Pseudomonas putida KT2440
caucuccauagguuaucca

SEQ ID NO: 1606568 - RNA, 20 nt, Pseudomonas putida KT2440
caucuccauagguuauccac

SEQ ID NO: 1606569 - RNA, 19 nt, Pseudomonas putida KT2440
caucuccagcucgccgccc

SEQ ID NO: 1606570 - RNA, 20 nt, Pseudomonas putida KT2440
caucuccagcucgccgccca

SEQ ID NO: 1606571 - RNA, 21 nt, Pseudomonas putida KT2440
caucuccagcucgccgcccag

SEQ ID NO: 1606572 - RNA, 23 nt, Pseudomonas putida KT2440
caucuccaaugcgucaucgacuu

SEQ ID NO: 1606573 - RNA, 18 nt, Pseudomonas putida KT2440
caucucaaucgcaugcag

SEQ ID NO: 1606574 - RNA, 18 nt, Pseudomonas putida KT2440
caucucaaggcuuuccac

SEQ ID NO: 1606575 - RNA, 12 nt, Pseudomonas putida KT2440
caucuaccagcu

SEQ ID NO: 1606576 - RNA, 20 nt, Pseudomonas putida KT2440
caucuaccugauguccaaau

SEQ ID NO: 1606577 - RNA, 16 nt, Pseudomonas putida KT2440
caucggccucucucag

SEQ ID NO: 1606578 - RNA, 22 nt, Pseudomonas putida KT2440
caucggcaggucauuggcgcca

SEQ ID NO: 1606579 - RNA, 21 nt, Pseudomonas putida KT2440
caucggcaguagagcccccag

SEQ ID NO: 1606580 - RNA, 22 nt, Pseudomonas putida KT2440
caucgguuuuuccaugcgcgca

SEQ ID NO: 1606581 - RNA, 16 nt, Pseudomonas putida KT2440
cauccugcaaggcaau

SEQ ID NO: 1606582 - RNA, 18 nt, Pseudomonas putida KT2440
caucgaucccuggggcca

SEQ ID NO: 1606583 - RNA, 21 nt, Pseudomonas putida KT2440
caucgauggucuucgccgcca

SEQ ID NO: 1606584 - RNA, 22 nt, Pseudomonas putida KT2440
cauccugcgugcugugcacugc

SEQ ID NO: 1606585 - RNA, 19 nt, Pseudomonas putida KT2440
cauccugcuguagcgccca

SEQ ID NO: 1606586 - RNA, 21 nt, Pseudomonas putida KT2440
cauccugcuguagcgcccaca

SEQ ID NO: 1606587 - RNA, 23 nt, Pseudomonas putida KT2440
cauccuggucacucugccgcccc

SEQ ID NO: 1606588 - RNA, 23 nt, Pseudomonas putida KT2440
caucgauuucgccaucgcccguc

SEQ ID NO: 1606589 - RNA, 14 nt, Pseudomonas putida KT2440
caucgcacacccug

SEQ ID NO: 1606590 - RNA, 17 nt, Pseudomonas putida KT2440
caucgcauaugccccag

SEQ ID NO: 1606591 - RNA, 19 nt, Pseudomonas putida KT2440
caucgcagggucgcgcccc

SEQ ID NO: 1606592 - RNA, 20 nt, Pseudomonas putida KT2440
caucgcagggucgcgcccca

SEQ ID NO: 1606593 - RNA, 12 nt, Pseudomonas putida KT2440
caucgccaagcc

SEQ ID NO: 1606594 - RNA, 14 nt, Pseudomonas putida KT2440
caucgccaagccgc

SEQ ID NO: 1606595 - RNA, 16 nt, Pseudomonas putida KT2440
caucgccaagccgcca

SEQ ID NO: 1606596 - RNA, 14 nt, Pseudomonas putida KT2440
caucgccaccggca

SEQ ID NO: 1606597 - RNA, 20 nt, Pseudomonas putida KT2440
caucgccucggcacugcacg

SEQ ID NO: 1606598 - RNA, 13 nt, Pseudomonas putida KT2440
caucgccuccagc

SEQ ID NO: 1606599 - RNA, 23 nt, Pseudomonas putida KT2440
caucgcugacuuccagcagcaca

SEQ ID NO: 1606600 - RNA, 14 nt, Pseudomonas putida KT2440
caucgcugcccggg

SEQ ID NO: 1606601 - RNA, 13 nt, Pseudomonas putida KT2440
caucgcuguccuu

SEQ ID NO: 1606602 - RNA, 21 nt, Pseudomonas putida KT2440
caucgcuguccuuggccaacu

SEQ ID NO: 1606603 - RNA, 18 nt, Pseudomonas putida KT2440
caucggauaucugcgcca

SEQ ID NO: 1606604 - RNA, 21 nt, Pseudomonas putida KT2440
caucggauaucugcgccaccg

SEQ ID NO: 1606605 - RNA, 12 nt, Pseudomonas putida KT2440
caucggcaaaca

SEQ ID NO: 1606606 - RNA, 14 nt, Pseudomonas putida KT2440
caucggcaaacaca

SEQ ID NO: 1606607 - RNA, 15 nt, Pseudomonas putida KT2440
caucggcaaacacau

SEQ ID NO: 1606608 - RNA, 18 nt, Pseudomonas putida KT2440
caucccgcugugcagcgc

SEQ ID NO: 1606609 - RNA, 14 nt, Pseudomonas putida KT2440
cauccccccagccc

SEQ ID NO: 1606610 - RNA, 20 nt, Pseudomonas putida KT2440
caucccccggcccagccccg

SEQ ID NO: 1606611 - RNA, 13 nt, Pseudomonas putida KT2440
caucccccuccua

SEQ ID NO: 1606612 - RNA, 20 nt, Pseudomonas putida KT2440
caucccccuccuaaggggaa

SEQ ID NO: 1606613 - RNA, 21 nt, Pseudomonas putida KT2440
cauccaugcaaucaccauccc

SEQ ID NO: 1606614 - RNA, 17 nt, Pseudomonas putida KT2440
caucccagaacuucacc

SEQ ID NO: 1606615 - RNA, 16 nt, Pseudomonas putida KT2440
caucccuguacagauc

SEQ ID NO: 1606616 - RNA, 22 nt, Pseudomonas putida KT2440
cauccgaucuugaaccguugcg

SEQ ID NO: 1606617 - RNA, 19 nt, Pseudomonas putida KT2440
cauccgagcugagcagcgg

SEQ ID NO: 1606618 - RNA, 19 nt, Pseudomonas putida KT2440
cauccgcaacaugaagcca

SEQ ID NO: 1606619 - RNA, 20 nt, Pseudomonas putida KT2440
cauccggcagcucaccggca

SEQ ID NO: 1606620 - RNA, 19 nt, Pseudomonas putida KT2440
cauccggcggcaucucgca

SEQ ID NO: 1606621 - RNA, 14 nt, Pseudomonas putida KT2440
caucaggaacagcu

SEQ ID NO: 1606622 - RNA, 15 nt, Pseudomonas putida KT2440
caucaggaacagcuc

SEQ ID NO: 1606623 - RNA, 20 nt, Pseudomonas putida KT2440
caucaggacggucaugcuca

SEQ ID NO: 1606624 - RNA, 15 nt, Pseudomonas putida KT2440
cauccaacgcaucca

SEQ ID NO: 1606625 - RNA, 18 nt, Pseudomonas putida KT2440
cauccaacgcauccaggc

SEQ ID NO: 1606626 - RNA, 18 nt, Pseudomonas putida KT2440
cauccaagugcuaaugcu

SEQ ID NO: 1606627 - RNA, 18 nt, Pseudomonas putida KT2440
cauccacaaucagcacug

SEQ ID NO: 1606628 - RNA, 13 nt, Pseudomonas putida KT2440
cauccacacccug

SEQ ID NO: 1606629 - RNA, 15 nt, Pseudomonas putida KT2440
cauccacauaggcca

SEQ ID NO: 1606630 - RNA, 18 nt, Pseudomonas putida KT2440
cauccacauaggccagcu

SEQ ID NO: 1606631 - RNA, 14 nt, Pseudomonas putida KT2440
cauccacaucgcca

SEQ ID NO: 1606632 - RNA, 15 nt, Pseudomonas putida KT2440
cauccacaucgccag

SEQ ID NO: 1606633 - RNA, 15 nt, Pseudomonas putida KT2440
cauccacaccguacu

SEQ ID NO: 1606634 - RNA, 13 nt, Pseudomonas putida KT2440
cauccacaccuuc

SEQ ID NO: 1606635 - RNA, 18 nt, Pseudomonas putida KT2440
cauccacacgcugcugcg

SEQ ID NO: 1606636 - RNA, 15 nt, Pseudomonas putida KT2440
cauccacaggcgccc

SEQ ID NO: 1606637 - RNA, 15 nt, Pseudomonas putida KT2440
cauccagaucggcag

SEQ ID NO: 1606638 - RNA, 18 nt, Pseudomonas putida KT2440
cauccagccauuccaggc

SEQ ID NO: 1606639 - RNA, 13 nt, Pseudomonas putida KT2440
cauccagccgcgu

SEQ ID NO: 1606640 - RNA, 14 nt, Pseudomonas putida KT2440
cauccagcgccgcg

SEQ ID NO: 1606641 - RNA, 17 nt, Pseudomonas putida KT2440
cauccagcgccuccccc

SEQ ID NO: 1606642 - RNA, 22 nt, Pseudomonas putida KT2440
cauccagcgccucccccagcgc

SEQ ID NO: 1606643 - RNA, 18 nt, Pseudomonas putida KT2440
cauccagcuccagcacca

SEQ ID NO: 1606644 - RNA, 16 nt, Pseudomonas putida KT2440
cauccagcuucuugug

SEQ ID NO: 1606645 - RNA, 22 nt, Pseudomonas putida KT2440
cauccagguuccccccacgcac

SEQ ID NO: 1606646 - RNA, 15 nt, Pseudomonas putida KT2440
cauccagggcuuccu

SEQ ID NO: 1606647 - RNA, 17 nt, Pseudomonas putida KT2440
cauccagggcuuccugc

SEQ ID NO: 1606648 - RNA, 13 nt, Pseudomonas putida KT2440
cauccaggcugca

SEQ ID NO: 1606649 - RNA, 19 nt, Pseudomonas putida KT2440
cauccaggcugcacuggca

SEQ ID NO: 1606650 - RNA, 16 nt, Pseudomonas putida KT2440
cauccaucgcaauccc

SEQ ID NO: 1606651 - RNA, 17 nt, Pseudomonas putida KT2440
cauccaucgcaaucccc

SEQ ID NO: 1606652 - RNA, 23 nt, Pseudomonas putida KT2440
caaaaugcagcaagcuggcaccg

SEQ ID NO: 1606653 - RNA, 16 nt, Pseudomonas putida KT2440
caaaauucuccccgcu

SEQ ID NO: 1606654 - RNA, 16 nt, Pseudomonas putida KT2440
caaacaaaaagcaccu

SEQ ID NO: 1606655 - RNA, 20 nt, Pseudomonas putida KT2440
caaacaaaaagcaccucuug

SEQ ID NO: 1606656 - RNA, 18 nt, Pseudomonas putida KT2440
caaaaguuggcugaccgg

SEQ ID NO: 1606657 - RNA, 19 nt, Pseudomonas putida KT2440
caaaaguugcucaaaccau

SEQ ID NO: 1606658 - RNA, 19 nt, Pseudomonas putida KT2440
caaacugauucacgcccuu

SEQ ID NO: 1606659 - RNA, 20 nt, Pseudomonas putida KT2440
caaacucuccuugcguugca

SEQ ID NO: 1606660 - RNA, 21 nt, Pseudomonas putida KT2440
caaacgaugcgggcuuucuca

SEQ ID NO: 1606661 - RNA, 21 nt, Pseudomonas putida KT2440
caaaccguccagguagcgcuc

SEQ ID NO: 1606662 - RNA, 15 nt, Pseudomonas putida KT2440
caaaccgcacccggc

SEQ ID NO: 1606663 - RNA, 15 nt, Pseudomonas putida KT2440
caaaccgaccaggca

SEQ ID NO: 1606664 - RNA, 17 nt, Pseudomonas putida KT2440
caaaccgacccugcugc

SEQ ID NO: 1606665 - RNA, 19 nt, Pseudomonas putida KT2440
caaaccgacccugcugcug

SEQ ID NO: 1606666 - RNA, 19 nt, Pseudomonas putida KT2440
caaaccugcgaccacacug

SEQ ID NO: 1606667 - RNA, 21 nt, Pseudomonas putida KT2440
caaacauugugcgccccccug

SEQ ID NO: 1606668 - RNA, 14 nt, Pseudomonas putida KT2440
caaaccccccaugc

SEQ ID NO: 1606669 - RNA, 22 nt, Pseudomonas putida KT2440
caaaccccccaugcucaccagc

SEQ ID NO: 1606670 - RNA, 23 nt, Pseudomonas putida KT2440
caaaccccccaugcucaccagcu

SEQ ID NO: 1606671 - RNA, 24 nt, Pseudomonas putida KT2440
caaacccgcgccuacaggcaaccg

SEQ ID NO: 1606672 - RNA, 14 nt, Pseudomonas putida KT2440
caaacccucggcca

SEQ ID NO: 1606673 - RNA, 22 nt, Pseudomonas putida KT2440
caaaccauuggugaaagcgcaa

SEQ ID NO: 1606674 - RNA, 18 nt, Pseudomonas putida KT2440
caaaccauggaagcucag

SEQ ID NO: 1606675 - RNA, 18 nt, Pseudomonas putida KT2440
caaaccagcggucugcug

SEQ ID NO: 1606676 - RNA, 15 nt, Pseudomonas putida KT2440
caaacaggaucuccu

SEQ ID NO: 1606677 - RNA, 20 nt, Pseudomonas putida KT2440
caaacaggaucuccucggcc

SEQ ID NO: 1606678 - RNA, 19 nt, Pseudomonas putida KT2440
caaacagcucgacaacccg

SEQ ID NO: 1606679 - RNA, 13 nt, Pseudomonas putida KT2440
caaacagcaccag

SEQ ID NO: 1606680 - RNA, 19 nt, Pseudomonas putida KT2440
caaacaccggccccccagc

SEQ ID NO: 1606681 - RNA, 21 nt, Pseudomonas putida KT2440
caaacaccggccccccagcca

SEQ ID NO: 1606682 - RNA, 13 nt, Pseudomonas putida KT2440
caaacacccagcu

SEQ ID NO: 1606683 - RNA, 23 nt, Pseudomonas putida KT2440
caaacacccagcucgccaacacc

SEQ ID NO: 1606684 - RNA, 11 nt, Pseudomonas putida KT2440
caaacacaucc

SEQ ID NO: 1606685 - RNA, 22 nt, Pseudomonas putida KT2440
caaagcgcgucugauagccagg

SEQ ID NO: 1606686 - RNA, 23 nt, Pseudomonas putida KT2440
caaagcgcgucugauagccaggg

SEQ ID NO: 1606687 - RNA, 19 nt, Pseudomonas putida KT2440
caaagcguucgguguccuu

SEQ ID NO: 1606688 - RNA, 22 nt, Pseudomonas putida KT2440
caaagcguucgguguccuugca

SEQ ID NO: 1606689 - RNA, 14 nt, Pseudomonas putida KT2440
caaagcuguugaag

SEQ ID NO: 1606690 - RNA, 16 nt, Pseudomonas putida KT2440
caaagcuguugaaggc

SEQ ID NO: 1606691 - RNA, 23 nt, Pseudomonas putida KT2440
caaagcugaaugaaaaagccccg

SEQ ID NO: 1606692 - RNA, 22 nt, Pseudomonas putida KT2440
caaagcggccccaggugccaac

SEQ ID NO: 1606693 - RNA, 22 nt, Pseudomonas putida KT2440
caaagcggcccccacgccgacc

SEQ ID NO: 1606694 - RNA, 15 nt, Pseudomonas putida KT2440
caaagcggccccuuc

SEQ ID NO: 1606695 - RNA, 20 nt, Pseudomonas putida KT2440
caaacugcuggaaaaagaac

SEQ ID NO: 1606696 - RNA, 21 nt, Pseudomonas putida KT2440
caaacugcuggaaaaagaaca

SEQ ID NO: 1606697 - RNA, 18 nt, Pseudomonas putida KT2440
caaauacgguugcagcac

SEQ ID NO: 1606698 - RNA, 14 nt, Pseudomonas putida KT2440
caaaggcagccucg

SEQ ID NO: 1606699 - RNA, 14 nt, Pseudomonas putida KT2440
caacaaaucggccu

SEQ ID NO: 1606700 - RNA, 21 nt, Pseudomonas putida KT2440
caaaucuucccgcguccaggg

SEQ ID NO: 1606701 - RNA, 13 nt, Pseudomonas putida KT2440
caaaugcggcgcg

SEQ ID NO: 1606702 - RNA, 14 nt, Pseudomonas putida KT2440
caaaugcugccaug

SEQ ID NO: 1606703 - RNA, 18 nt, Pseudomonas putida KT2440
caacaaggacugccugau

SEQ ID NO: 1606704 - RNA, 21 nt, Pseudomonas putida KT2440
caacacccucacccacuccgg

SEQ ID NO: 1606705 - RNA, 17 nt, Pseudomonas putida KT2440
caacaccggucaggucc

SEQ ID NO: 1606706 - RNA, 20 nt, Pseudomonas putida KT2440
caacaccguagcgagcaccg

SEQ ID NO: 1606707 - RNA, 23 nt, Pseudomonas putida KT2440
caacaccguagcgagcaccggca

SEQ ID NO: 1606708 - RNA, 16 nt, Pseudomonas putida KT2440
caacaacaaaaaaaac

SEQ ID NO: 1606709 - RNA, 19 nt, Pseudomonas putida KT2440
caacaacagucaacaauca

SEQ ID NO: 1606710 - RNA, 19 nt, Pseudomonas putida KT2440
caacaguuucuugccuucc

SEQ ID NO: 1606711 - RNA, 12 nt, Pseudomonas putida KT2440
caacagugcccc

SEQ ID NO: 1606712 - RNA, 21 nt, Pseudomonas putida KT2440
caacaguuuucaaugcugcuc

SEQ ID NO: 1606713 - RNA, 15 nt, Pseudomonas putida KT2440
caacagccacgcccg

SEQ ID NO: 1606714 - RNA, 19 nt, Pseudomonas putida KT2440
caacagcaccggccaggcu

SEQ ID NO: 1606715 - RNA, 16 nt, Pseudomonas putida KT2440
caacagcccggugaag

SEQ ID NO: 1606716 - RNA, 23 nt, Pseudomonas putida KT2440
caacagcgcggagagguggcaga

SEQ ID NO: 1606717 - RNA, 14 nt, Pseudomonas putida KT2440
caacaggucggcgc

SEQ ID NO: 1606718 - RNA, 19 nt, Pseudomonas putida KT2440
caacaggucggcgcgcgca

SEQ ID NO: 1606719 - RNA, 22 nt, Pseudomonas putida KT2440
caaggcacgugauaccugggcu

SEQ ID NO: 1606720 - RNA, 22 nt, Pseudomonas putida KT2440
caaggcaucggcgccuucgccc

SEQ ID NO: 1606721 - RNA, 19 nt, Pseudomonas putida KT2440
caaggcaucgggaucgauu

SEQ ID NO: 1606722 - RNA, 15 nt, Pseudomonas putida KT2440
caaggccaaccacgc

SEQ ID NO: 1606723 - RNA, 16 nt, Pseudomonas putida KT2440
caaggccaacugcgcc

SEQ ID NO: 1606724 - RNA, 20 nt, Pseudomonas putida KT2440
caaggcaauaccgauggccc

SEQ ID NO: 1606725 - RNA, 21 nt, Pseudomonas putida KT2440
caaggcaaugcccauggccag

SEQ ID NO: 1606726 - RNA, 18 nt, Pseudomonas putida KT2440
caaggaugucggucaugg

SEQ ID NO: 1606727 - RNA, 12 nt, Pseudomonas putida KT2440
caagcuggucag

SEQ ID NO: 1606728 - RNA, 15 nt, Pseudomonas putida KT2440
caagcuccccagcaa

SEQ ID NO: 1606729 - RNA, 16 nt, Pseudomonas putida KT2440
caagcugcaccgccac

SEQ ID NO: 1606730 - RNA, 19 nt, Pseudomonas putida KT2440
caagcuggcaccggcgcca

SEQ ID NO: 1606731 - RNA, 18 nt, Pseudomonas putida KT2440
caagcuggcgcaagccgu

SEQ ID NO: 1606732 - RNA, 23 nt, Pseudomonas putida KT2440
caagcuggcgcaaucuugccacg

SEQ ID NO: 1606733 - RNA, 15 nt, Pseudomonas putida KT2440
caagcgcgcgcccac

SEQ ID NO: 1606734 - RNA, 16 nt, Pseudomonas putida KT2440
caagcgaugcacgcca

SEQ ID NO: 1606735 - RNA, 13 nt, Pseudomonas putida KT2440
caagcacaaggcc

SEQ ID NO: 1606736 - RNA, 18 nt, Pseudomonas putida KT2440
caagccugccaaaucccu

SEQ ID NO: 1606737 - RNA, 15 nt, Pseudomonas putida KT2440
caagcgcaugguggu

SEQ ID NO: 1606738 - RNA, 20 nt, Pseudomonas putida KT2440
caagcgcaggcgguuggcca

SEQ ID NO: 1606739 - RNA, 15 nt, Pseudomonas putida KT2440
caagcgcauaggcaa

SEQ ID NO: 1606740 - RNA, 23 nt, Pseudomonas putida KT2440
caagcgacauaaaaaagccccgg

SEQ ID NO: 1606741 - RNA, 22 nt, Pseudomonas putida KT2440
caagcgacgugcaaggaucacc

SEQ ID NO: 1606742 - RNA, 13 nt, Pseudomonas putida KT2440
caagcgccgucga

SEQ ID NO: 1606743 - RNA, 18 nt, Pseudomonas putida KT2440
caagugccguccgcugcc

SEQ ID NO: 1606744 - RNA, 23 nt, Pseudomonas putida KT2440
caagugccucgucaucgaacagu

SEQ ID NO: 1606745 - RNA, 15 nt, Pseudomonas putida KT2440
caagugccccuggcu

SEQ ID NO: 1606746 - RNA, 23 nt, Pseudomonas putida KT2440
caaguggccuuguugccacccag

SEQ ID NO: 1606747 - RNA, 23 nt, Pseudomonas putida KT2440
caagucgugccggaacaaccccu

SEQ ID NO: 1606748 - RNA, 18 nt, Pseudomonas putida KT2440
caagguuggggccaggcu

SEQ ID NO: 1606749 - RNA, 18 nt, Pseudomonas putida KT2440
caagguuucacgccgcug

SEQ ID NO: 1606750 - RNA, 16 nt, Pseudomonas putida KT2440
caagguuucagcagcg

SEQ ID NO: 1606751 - RNA, 17 nt, Pseudomonas putida KT2440
caaguacaccggcagca

SEQ ID NO: 1606752 - RNA, 14 nt, Pseudomonas putida KT2440
caaggccagugccg

SEQ ID NO: 1606753 - RNA, 16 nt, Pseudomonas putida KT2440
caaggccagugccgca

SEQ ID NO: 1606754 - RNA, 20 nt, Pseudomonas putida KT2440
caaggccagugccgcaagca

SEQ ID NO: 1606755 - RNA, 18 nt, Pseudomonas putida KT2440
caaggccagcccauggcg

SEQ ID NO: 1606756 - RNA, 19 nt, Pseudomonas putida KT2440
caaggcccgcgccgacagc

SEQ ID NO: 1606757 - RNA, 11 nt, Pseudomonas putida KT2440
caaggcuuccg

SEQ ID NO: 1606758 - RNA, 18 nt, Pseudomonas putida KT2440
caaggcugcucuccuggg

SEQ ID NO: 1606759 - RNA, 20 nt, Pseudomonas putida KT2440
caagggauaucaggcccugg

SEQ ID NO: 1606760 - RNA, 12 nt, Pseudomonas putida KT2440
caagggccaggu

SEQ ID NO: 1606761 - RNA, 23 nt, Pseudomonas putida KT2440
caaguugacccugaaucagcaaa

SEQ ID NO: 1606762 - RNA, 14 nt, Pseudomonas putida KT2440
caaguucaagguca

SEQ ID NO: 1606763 - RNA, 15 nt, Pseudomonas putida KT2440
caaguucccgauccu

SEQ ID NO: 1606764 - RNA, 14 nt, Pseudomonas putida KT2440
caaguucccgugcg

SEQ ID NO: 1606765 - RNA, 23 nt, Pseudomonas putida KT2440
caauaccagccuggccccaccca

SEQ ID NO: 1606766 - RNA, 15 nt, Pseudomonas putida KT2440
caauacauccaggcc

SEQ ID NO: 1606767 - RNA, 16 nt, Pseudomonas putida KT2440
caauacauccaggccc

SEQ ID NO: 1606768 - RNA, 21 nt, Pseudomonas putida KT2440
caauacgaauguuauccaugu

SEQ ID NO: 1606769 - RNA, 21 nt, Pseudomonas putida KT2440
caaucaacgguggccagcagc

SEQ ID NO: 1606770 - RNA, 16 nt, Pseudomonas putida KT2440
caaucacgaacaccag

SEQ ID NO: 1606771 - RNA, 20 nt, Pseudomonas putida KT2440
caagaagcauuacuucuugg

SEQ ID NO: 1606772 - RNA, 16 nt, Pseudomonas putida KT2440
caagaacaacacggca

SEQ ID NO: 1606773 - RNA, 17 nt, Pseudomonas putida KT2440
caagaaaucgggucauc

SEQ ID NO: 1606774 - RNA, 19 nt, Pseudomonas putida KT2440
caacucgcgcauccagcca

SEQ ID NO: 1606775 - RNA, 18 nt, Pseudomonas putida KT2440
caacuugauuggaguuuu

SEQ ID NO: 1606776 - RNA, 16 nt, Pseudomonas putida KT2440
caacuugugcaucaag

SEQ ID NO: 1606777 - RNA, 20 nt, Pseudomonas putida KT2440
caacuugcgggucagcagca

SEQ ID NO: 1606778 - RNA, 15 nt, Pseudomonas putida KT2440
caacuuuugcuggcu

SEQ ID NO: 1606779 - RNA, 20 nt, Pseudomonas putida KT2440
caagauaacaccccccagca

SEQ ID NO: 1606780 - RNA, 22 nt, Pseudomonas putida KT2440
caagaguuguuguuccaucaug

SEQ ID NO: 1606781 - RNA, 22 nt, Pseudomonas putida KT2440
caagacacggacucauagcuca

SEQ ID NO: 1606782 - RNA, 15 nt, Pseudomonas putida KT2440
caagaccagaaaccc

SEQ ID NO: 1606783 - RNA, 14 nt, Pseudomonas putida KT2440
caagaaugcccggg

SEQ ID NO: 1606784 - RNA, 22 nt, Pseudomonas putida KT2440
caagacugcuguggaacagccu

SEQ ID NO: 1606785 - RNA, 19 nt, Pseudomonas putida KT2440
caacgaaaaaggcccugca

SEQ ID NO: 1606786 - RNA, 14 nt, Pseudomonas putida KT2440
caacgaaucagcca

SEQ ID NO: 1606787 - RNA, 18 nt, Pseudomonas putida KT2440
caacgacuggucauacuc

SEQ ID NO: 1606788 - RNA, 12 nt, Pseudomonas putida KT2440
caacgcacccgc

SEQ ID NO: 1606789 - RNA, 18 nt, Pseudomonas putida KT2440
caacgcaacugcggcccc

SEQ ID NO: 1606790 - RNA, 18 nt, Pseudomonas putida KT2440
caacgcaacaaccccguc

SEQ ID NO: 1606791 - RNA, 18 nt, Pseudomonas putida KT2440
caacgauacccacgccca

SEQ ID NO: 1606792 - RNA, 14 nt, Pseudomonas putida KT2440
caacgauaauuacc

SEQ ID NO: 1606793 - RNA, 18 nt, Pseudomonas putida KT2440
caacgauugggcggcagu

SEQ ID NO: 1606794 - RNA, 14 nt, Pseudomonas putida KT2440
caacgaggccgcca

SEQ ID NO: 1606795 - RNA, 20 nt, Pseudomonas putida KT2440
caaccuguuccggccucuuc

SEQ ID NO: 1606796 - RNA, 21 nt, Pseudomonas putida KT2440
caaccugcucgcucaggcucu

SEQ ID NO: 1606797 - RNA, 21 nt, Pseudomonas putida KT2440
caaccugcugggcaagggccu

SEQ ID NO: 1606798 - RNA, 17 nt, Pseudomonas putida KT2440
caaccuguaacucagcu

SEQ ID NO: 1606799 - RNA, 23 nt, Pseudomonas putida KT2440
caacaucggugaucgcaaaacaa

SEQ ID NO: 1606800 - RNA, 21 nt, Pseudomonas putida KT2440
caacuccugcguacccagccc

SEQ ID NO: 1606801 - RNA, 16 nt, Pseudomonas putida KT2440
caacucgcuuccccca

SEQ ID NO: 1606802 - RNA, 14 nt, Pseudomonas putida KT2440
caacuccccaccca

SEQ ID NO: 1606803 - RNA, 17 nt, Pseudomonas putida KT2440
caacuccaccccuucca

SEQ ID NO: 1606804 - RNA, 19 nt, Pseudomonas putida KT2440
caacuccacguucccgcca

SEQ ID NO: 1606805 - RNA, 21 nt, Pseudomonas putida KT2440
caacucaggcugagcagacca

SEQ ID NO: 1606806 - RNA, 22 nt, Pseudomonas putida KT2440
caacucagcgcagcuucucaag

SEQ ID NO: 1606807 - RNA, 14 nt, Pseudomonas putida KT2440
caacucaauuuccc

SEQ ID NO: 1606808 - RNA, 14 nt, Pseudomonas putida KT2440
caacguucccaaug

SEQ ID NO: 1606809 - RNA, 14 nt, Pseudomonas putida KT2440
caacgcgccaccgc

SEQ ID NO: 1606810 - RNA, 19 nt, Pseudomonas putida KT2440
caacgcgacgguugacagc

SEQ ID NO: 1606811 - RNA, 16 nt, Pseudomonas putida KT2440
caacgccucgcugccu

SEQ ID NO: 1606812 - RNA, 18 nt, Pseudomonas putida KT2440
caacgccuugcgcucgac

SEQ ID NO: 1606813 - RNA, 20 nt, Pseudomonas putida KT2440
caacgccuuggccugcggga

SEQ ID NO: 1606814 - RNA, 14 nt, Pseudomonas putida KT2440
caacggcugugccg

SEQ ID NO: 1606815 - RNA, 17 nt, Pseudomonas putida KT2440
caacggguucagguaca

SEQ ID NO: 1606816 - RNA, 21 nt, Pseudomonas putida KT2440
caacggugaacggcgggcgga

SEQ ID NO: 1606817 - RNA, 13 nt, Pseudomonas putida KT2440
auuuuggauuuuu

SEQ ID NO: 1606818 - RNA, 20 nt, Pseudomonas putida KT2440
auuugaggaagugauuugau

SEQ ID NO: 1606819 - RNA, 12 nt, Pseudomonas putida KT2440
auuugcagcaca

SEQ ID NO: 1606820 - RNA, 14 nt, Pseudomonas putida KT2440
auuucugcaccuug

SEQ ID NO: 1606821 - RNA, 11 nt, Pseudomonas putida KT2440
auuucugcaug

SEQ ID NO: 1606822 - RNA, 24 nt, Pseudomonas putida KT2440
auuucugcauguccagcccguucu

SEQ ID NO: 1606823 - RNA, 13 nt, Pseudomonas putida KT2440
auuucguccaggc

SEQ ID NO: 1606824 - RNA, 18 nt, Pseudomonas putida KT2440
auuucuaguacuuuuuca

SEQ ID NO: 1606825 - RNA, 15 nt, Pseudomonas putida KT2440
auuuacugcagaaca

SEQ ID NO: 1606826 - RNA, 11 nt, Pseudomonas putida KT2440
auuuacagcca

SEQ ID NO: 1606827 - RNA, 18 nt, Pseudomonas putida KT2440
auuuccaccggcuugccc

SEQ ID NO: 1606828 - RNA, 13 nt, Pseudomonas putida KT2440
auuucacagcaaa

SEQ ID NO: 1606829 - RNA, 15 nt, Pseudomonas putida KT2440
auuucacagcaaaaa

SEQ ID NO: 1606830 - RNA, 21 nt, Pseudomonas putida KT2440
auuuaugccgcguuccuuucu

SEQ ID NO: 1606831 - RNA, 19 nt, Pseudomonas putida KT2440
auuucaauuaugagugcca

SEQ ID NO: 1606832 - RNA, 15 nt, Pseudomonas putida KT2440
auuccgucccaguua

SEQ ID NO: 1606833 - RNA, 17 nt, Pseudomonas putida KT2440
auuccggcugcagcuug

SEQ ID NO: 1606834 - RNA, 19 nt, Pseudomonas putida KT2440
auuccgccgucaccgccgc

SEQ ID NO: 1606835 - RNA, 22 nt, Pseudomonas putida KT2440
auucccggccacugguaguuca

SEQ ID NO: 1606836 - RNA, 22 nt, Pseudomonas putida KT2440
auucgcggguaaacccauuccu

SEQ ID NO: 1606837 - RNA, 18 nt, Pseudomonas putida KT2440
auucgcgcccgcagugca

SEQ ID NO: 1606838 - RNA, 22 nt, Pseudomonas putida KT2440
auucgcuguacagcacaccuuc

SEQ ID NO: 1606839 - RNA, 13 nt, Pseudomonas putida KT2440
auguugcaaggau

SEQ ID NO: 1606840 - RNA, 19 nt, Pseudomonas putida KT2440
auguugcaaggaucauuug

SEQ ID NO: 1606841 - RNA, 24 nt, Pseudomonas putida KT2440
auuccagaaucugcacacugcgcu

SEQ ID NO: 1606842 - RNA, 16 nt, Pseudomonas putida KT2440
auuccagcaggggacg

SEQ ID NO: 1606843 - RNA, 21 nt, Pseudomonas putida KT2440
auuccaaugagaauaauucuu

SEQ ID NO: 1606844 - RNA, 12 nt, Pseudomonas putida KT2440
auugcagcccca

SEQ ID NO: 1606845 - RNA, 13 nt, Pseudomonas putida KT2440
auugaugcucagg

SEQ ID NO: 1606846 - RNA, 14 nt, Pseudomonas putida KT2440
auugauagcggcag

SEQ ID NO: 1606847 - RNA, 19 nt, Pseudomonas putida KT2440
auugcugaucccugccccc

SEQ ID NO: 1606848 - RNA, 23 nt, Pseudomonas putida KT2440
auugcugccggaccugccgcagc

SEQ ID NO: 1606849 - RNA, 21 nt, Pseudomonas putida KT2440
auugcugcgguaccggccagc

SEQ ID NO: 1606850 - RNA, 15 nt, Pseudomonas putida KT2440
auuggcgagcaggcc

SEQ ID NO: 1606851 - RNA, 13 nt, Pseudomonas putida KT2440
auuggcggcaggc

SEQ ID NO: 1606852 - RNA, 15 nt, Pseudomonas putida KT2440
auuggcggcaggcgc

SEQ ID NO: 1606853 - RNA, 16 nt, Pseudomonas putida KT2440
auuggcccacgcucug

SEQ ID NO: 1606854 - RNA, 15 nt, Pseudomonas putida KT2440
auuggcaucgcugcc

SEQ ID NO: 1606855 - RNA, 21 nt, Pseudomonas putida KT2440
auuggccacgcccaaccccag

SEQ ID NO: 1606856 - RNA, 19 nt, Pseudomonas putida KT2440
auuggccagcaggcccggc

SEQ ID NO: 1606857 - RNA, 16 nt, Pseudomonas putida KT2440
auuggccagcagggcc

SEQ ID NO: 1606858 - RNA, 19 nt, Pseudomonas putida KT2440
auuggccagcagggccggc

SEQ ID NO: 1606859 - RNA, 14 nt, Pseudomonas putida KT2440
auuggaaaauguua

SEQ ID NO: 1606860 - RNA, 22 nt, Pseudomonas putida KT2440
auugccaccggcgcugcguugg

SEQ ID NO: 1606861 - RNA, 20 nt, Pseudomonas putida KT2440
auugcgcgucacugcaccuc

SEQ ID NO: 1606862 - RNA, 17 nt, Pseudomonas putida KT2440
auugcgggcuuucuggu

SEQ ID NO: 1606863 - RNA, 18 nt, Pseudomonas putida KT2440
auucuucuggcuuucugg

SEQ ID NO: 1606864 - RNA, 22 nt, Pseudomonas putida KT2440
auucuucgucaguccaucacca

SEQ ID NO: 1606865 - RNA, 23 nt, Pseudomonas putida KT2440
auucugccaugauccgcauauca

SEQ ID NO: 1606866 - RNA, 15 nt, Pseudomonas putida KT2440
cacucgcggccauga

SEQ ID NO: 1606867 - RNA, 17 nt, Pseudomonas putida KT2440
cacucggcaaucagcau

SEQ ID NO: 1606868 - RNA, 20 nt, Pseudomonas putida KT2440
cacucguuucacagcacaag

SEQ ID NO: 1606869 - RNA, 19 nt, Pseudomonas putida KT2440
cacucgaauucagcccgcu

SEQ ID NO: 1606870 - RNA, 20 nt, Pseudomonas putida KT2440
cacucgaauucagcccgcuc

SEQ ID NO: 1606871 - RNA, 21 nt, Pseudomonas putida KT2440
cacuccggucguacacucacc

SEQ ID NO: 1606872 - RNA, 20 nt, Pseudomonas putida KT2440
cacuccgcuuucagccgagc

SEQ ID NO: 1606873 - RNA, 12 nt, Pseudomonas putida KT2440
cacugacagcau

SEQ ID NO: 1606874 - RNA, 18 nt, Pseudomonas putida KT2440
cacugacccucaagugcc

SEQ ID NO: 1606875 - RNA, 20 nt, Pseudomonas putida KT2440
cacugacccucaagugccgu

SEQ ID NO: 1606876 - RNA, 15 nt, Pseudomonas putida KT2440
cacugaccaccugga

SEQ ID NO: 1606877 - RNA, 14 nt, Pseudomonas putida KT2440
cacugaacagcgcc

SEQ ID NO: 1606878 - RNA, 14 nt, Pseudomonas putida KT2440
cacucugccgcccc

SEQ ID NO: 1606879 - RNA, 16 nt, Pseudomonas putida KT2440
cacucugccgccccuc

SEQ ID NO: 1606880 - RNA, 19 nt, Pseudomonas putida KT2440
cacucugccgccccuccac

SEQ ID NO: 1606881 - RNA, 23 nt, Pseudomonas putida KT2440
cacucugccgccccuccacccac

SEQ ID NO: 1606882 - RNA, 13 nt, Pseudomonas putida KT2440
cacuccagcgagu

SEQ ID NO: 1606883 - RNA, 22 nt, Pseudomonas putida KT2440
cacucaguuaaucagcaacgcc

SEQ ID NO: 1606884 - RNA, 11 nt, Pseudomonas putida KT2440
cacucaccgca

SEQ ID NO: 1606885 - RNA, 15 nt, Pseudomonas putida KT2440
cacucaccgcgccca

SEQ ID NO: 1606886 - RNA, 14 nt, Pseudomonas putida KT2440
cacuaccuccagcc

SEQ ID NO: 1606887 - RNA, 15 nt, Pseudomonas putida KT2440
cacuaccuccagccc

SEQ ID NO: 1606888 - RNA, 18 nt, Pseudomonas putida KT2440
cacuaagcgaaacaccag

SEQ ID NO: 1606889 - RNA, 15 nt, Pseudomonas putida KT2440
cacgugccuucacca

SEQ ID NO: 1606890 - RNA, 21 nt, Pseudomonas putida KT2440
cacgugggucgggaacagcuc

SEQ ID NO: 1606891 - RNA, 20 nt, Pseudomonas putida KT2440
cacguuguagcccaccaccu

SEQ ID NO: 1606892 - RNA, 12 nt, Pseudomonas putida KT2440
cacguucugcag

SEQ ID NO: 1606893 - RNA, 21 nt, Pseudomonas putida KT2440
cacguucgggcauugcucacu

SEQ ID NO: 1606894 - RNA, 19 nt, Pseudomonas putida KT2440
cacguaccuggcugcagug

SEQ ID NO: 1606895 - RNA, 17 nt, Pseudomonas putida KT2440
cacguagcucaauuucu

SEQ ID NO: 1606896 - RNA, 17 nt, Pseudomonas putida KT2440
cacgguugcgcccggcg

SEQ ID NO: 1606897 - RNA, 18 nt, Pseudomonas putida KT2440
cacguccguuccugcagu

SEQ ID NO: 1606898 - RNA, 19 nt, Pseudomonas putida KT2440
cacguccguuccugcaguu

SEQ ID NO: 1606899 - RNA, 22 nt, Pseudomonas putida KT2440
cacguccuucggagguagccac

SEQ ID NO: 1606900 - RNA, 20 nt, Pseudomonas putida KT2440
cacgucggcgucagccgcgg

SEQ ID NO: 1606901 - RNA, 23 nt, Pseudomonas putida KT2440
cacgucgcgauugaucagcgccu

SEQ ID NO: 1606902 - RNA, 19 nt, Pseudomonas putida KT2440
cacguccggccagcaacag

SEQ ID NO: 1606903 - RNA, 14 nt, Pseudomonas putida KT2440
cacgucacagccaa

SEQ ID NO: 1606904 - RNA, 16 nt, Pseudomonas putida KT2440
cacgucacagccaagc

SEQ ID NO: 1606905 - RNA, 15 nt, Pseudomonas putida KT2440
cacguagaacaggcc

SEQ ID NO: 1606906 - RNA, 22 nt, Pseudomonas putida KT2440
cacguagaacaggccugcggcc

SEQ ID NO: 1606907 - RNA, 20 nt, Pseudomonas putida KT2440
cacggucggccugcgcucca

SEQ ID NO: 1606908 - RNA, 16 nt, Pseudomonas putida KT2440
cacgguguauccagcc

SEQ ID NO: 1606909 - RNA, 19 nt, Pseudomonas putida KT2440
cacgguguauccagcccgg

SEQ ID NO: 1606910 - RNA, 12 nt, Pseudomonas putida KT2440
cacggugguggu

SEQ ID NO: 1606911 - RNA, 13 nt, Pseudomonas putida KT2440
cacgguucuggca

SEQ ID NO: 1606912 - RNA, 15 nt, Pseudomonas putida KT2440
cacgguucuggucac

SEQ ID NO: 1606913 - RNA, 18 nt, Pseudomonas putida KT2440
cacggugucgucgcuguc

SEQ ID NO: 1606914 - RNA, 17 nt, Pseudomonas putida KT2440
cacgguguccgccgccg

SEQ ID NO: 1606915 - RNA, 16 nt, Pseudomonas putida KT2440
cacgggcuucguccgu

SEQ ID NO: 1606916 - RNA, 13 nt, Pseudomonas putida KT2440
cacgggucaccac

SEQ ID NO: 1606917 - RNA, 14 nt, Pseudomonas putida KT2440
cacgguacgggcaa

SEQ ID NO: 1606918 - RNA, 23 nt, Pseudomonas putida KT2440
cacgguagccagucugcuccacc

SEQ ID NO: 1606919 - RNA, 19 nt, Pseudomonas putida KT2440
cacgguauagugguaugau

SEQ ID NO: 1606920 - RNA, 17 nt, Pseudomonas putida KT2440
cacgguaugcagguacc

SEQ ID NO: 1606921 - RNA, 23 nt, Pseudomonas putida KT2440
cacggguaagccggcggccaucg

SEQ ID NO: 1606922 - RNA, 20 nt, Pseudomonas putida KT2440
cacgcaacugaugggucuug

SEQ ID NO: 1606923 - RNA, 17 nt, Pseudomonas putida KT2440
cacgcaagcggcccuga

SEQ ID NO: 1606924 - RNA, 15 nt, Pseudomonas putida KT2440
cacgcaccaccccgg

SEQ ID NO: 1606925 - RNA, 18 nt, Pseudomonas putida KT2440
cacgcaccaccccggggc

SEQ ID NO: 1606926 - RNA, 15 nt, Pseudomonas putida KT2440
cacgcacggccuucc

SEQ ID NO: 1606927 - RNA, 14 nt, Pseudomonas putida KT2440
cacgcaccucggcc

SEQ ID NO: 1606928 - RNA, 15 nt, Pseudomonas putida KT2440
cacgcagagcauggu

SEQ ID NO: 1606929 - RNA, 17 nt, Pseudomonas putida KT2440
cacgcagccaguucgac

SEQ ID NO: 1606930 - RNA, 21 nt, Pseudomonas putida KT2440
cacgcagccaguucgacaggu

SEQ ID NO: 1606931 - RNA, 15 nt, Pseudomonas putida KT2440
cacgcaggccagcgc

SEQ ID NO: 1606932 - RNA, 15 nt, Pseudomonas putida KT2440
cacgaucuuggccag

SEQ ID NO: 1606933 - RNA, 17 nt, Pseudomonas putida KT2440
cacgaucucacgcgcca

SEQ ID NO: 1606934 - RNA, 20 nt, Pseudomonas putida KT2440
cacgaucgccaaccccaacc

SEQ ID NO: 1606935 - RNA, 12 nt, Pseudomonas putida KT2440
cacgaucaugcu

SEQ ID NO: 1606936 - RNA, 20 nt, Pseudomonas putida KT2440
cacgaucaugcuggccagga

SEQ ID NO: 1606937 - RNA, 14 nt, Pseudomonas putida KT2440
cacgaucagcagca

SEQ ID NO: 1606938 - RNA, 14 nt, Pseudomonas putida KT2440
cacgauccccacca

SEQ ID NO: 1606939 - RNA, 16 nt, Pseudomonas putida KT2440
cacgcccauggcucca

SEQ ID NO: 1606940 - RNA, 19 nt, Pseudomonas putida KT2440
cacgccauccccccagccc

SEQ ID NO: 1606941 - RNA, 21 nt, Pseudomonas putida KT2440
cacgccauuguucgccucguc

SEQ ID NO: 1606942 - RNA, 15 nt, Pseudomonas putida KT2440
cacgcaucugcaccg

SEQ ID NO: 1606943 - RNA, 15 nt, Pseudomonas putida KT2440
cacgcaucugcaccu

SEQ ID NO: 1606944 - RNA, 18 nt, Pseudomonas putida KT2440
cacgcaucugcaccuggu

SEQ ID NO: 1606945 - RNA, 14 nt, Pseudomonas putida KT2440
cacgcaucugcgcu

SEQ ID NO: 1606946 - RNA, 15 nt, Pseudomonas putida KT2440
cacgccaccgcgcgc

SEQ ID NO: 1606947 - RNA, 16 nt, Pseudomonas putida KT2440
cacgccaccgcgcgcc

SEQ ID NO: 1606948 - RNA, 14 nt, Pseudomonas putida KT2440
cacgccaccaugcu

SEQ ID NO: 1606949 - RNA, 16 nt, Pseudomonas putida KT2440
cacgccagaaccugac

SEQ ID NO: 1606950 - RNA, 18 nt, Pseudomonas putida KT2440
cacgccgguaucacccag

SEQ ID NO: 1606951 - RNA, 14 nt, Pseudomonas putida KT2440
cacgccgcugcggc

SEQ ID NO: 1606952 - RNA, 13 nt, Pseudomonas putida KT2440
cacgcccuggccc

SEQ ID NO: 1606953 - RNA, 21 nt, Pseudomonas putida KT2440
cacgcccuggcccgccgccac

SEQ ID NO: 1606954 - RNA, 14 nt, Pseudomonas putida KT2440
cacgcccggcaccu

SEQ ID NO: 1606955 - RNA, 22 nt, Pseudomonas putida KT2440
cacgcccggcaccugccgggca

SEQ ID NO: 1606956 - RNA, 11 nt, Pseudomonas putida KT2440
cacgcccggcc

SEQ ID NO: 1606957 - RNA, 13 nt, Pseudomonas putida KT2440
cacgcccgggcca

SEQ ID NO: 1606958 - RNA, 15 nt, Pseudomonas putida KT2440
cacgcccgugcucac

SEQ ID NO: 1606959 - RNA, 17 nt, Pseudomonas putida KT2440
cacgcccuagaacaggc

SEQ ID NO: 1606960 - RNA, 20 nt, Pseudomonas putida KT2440
cacgccccuuggcacggcca

SEQ ID NO: 1606961 - RNA, 23 nt, Pseudomonas putida KT2440
cacgcccgcgugcuucaagccau

SEQ ID NO: 1606962 - RNA, 12 nt, Pseudomonas putida KT2440
cacgcccgcucc

SEQ ID NO: 1606963 - RNA, 20 nt, Pseudomonas putida KT2440
cacgcccgccggcacuuccu

SEQ ID NO: 1606964 - RNA, 16 nt, Pseudomonas putida KT2440
cacgcugcugcuggcc

SEQ ID NO: 1606965 - RNA, 20 nt, Pseudomonas putida KT2440
cacgcuggccauuucgcggc

SEQ ID NO: 1606966 - RNA, 17 nt, Pseudomonas putida KT2440
cacgcucaugaacagcg

SEQ ID NO: 1606967 - RNA, 21 nt, Pseudomonas putida KT2440
cacgcucaugaacagcgccca

SEQ ID NO: 1606968 - RNA, 18 nt, Pseudomonas putida KT2440
cacgcuaacccccacgcu

SEQ ID NO: 1606969 - RNA, 23 nt, Pseudomonas putida KT2440
cacgcguugggggugcuuuuccu

SEQ ID NO: 1606970 - RNA, 13 nt, Pseudomonas putida KT2440
cacgcuaauaccc

SEQ ID NO: 1606971 - RNA, 16 nt, Pseudomonas putida KT2440
cacgcuaauacccugu

SEQ ID NO: 1606972 - RNA, 10 nt, Pseudomonas putida KT2440
cacgcuccug

SEQ ID NO: 1606973 - RNA, 13 nt, Pseudomonas putida KT2440
cacgcuccaggua

SEQ ID NO: 1606974 - RNA, 14 nt, Pseudomonas putida KT2440
cacgccucaugauc

SEQ ID NO: 1606975 - RNA, 17 nt, Pseudomonas putida KT2440
cacgccuuaguucaccc

SEQ ID NO: 1606976 - RNA, 14 nt, Pseudomonas putida KT2440
cacgccuuccaccg

SEQ ID NO: 1606977 - RNA, 15 nt, Pseudomonas putida KT2440
cacgccuuccaccgg

SEQ ID NO: 1606978 - RNA, 22 nt, Pseudomonas putida KT2440
cacgccuuggucgaaccgcaac

SEQ ID NO: 1606979 - RNA, 17 nt, Pseudomonas putida KT2440
cacgcgcaggcgcugca

SEQ ID NO: 1606980 - RNA, 16 nt, Pseudomonas putida KT2440
cacgcgaccucagccg

SEQ ID NO: 1606981 - RNA, 11 nt, Pseudomonas putida KT2440
cacgcgacgaa

SEQ ID NO: 1606982 - RNA, 20 nt, Pseudomonas putida KT2440
cacgcgcaaaugcuugcccg

SEQ ID NO: 1606983 - RNA, 23 nt, Pseudomonas putida KT2440
cacgcgccucuugcaccuguccc

SEQ ID NO: 1606984 - RNA, 13 nt, Pseudomonas putida KT2440
cacgcgcuuuucc

SEQ ID NO: 1606985 - RNA, 16 nt, Pseudomonas putida KT2440
cacgcgcuuuuccagc

SEQ ID NO: 1606986 - RNA, 21 nt, Pseudomonas putida KT2440
cacgcggguccagcgcggcca

SEQ ID NO: 1606987 - RNA, 23 nt, Pseudomonas putida KT2440
cacgcggcgcuuauggcgccgcg

SEQ ID NO: 1606988 - RNA, 18 nt, Pseudomonas putida KT2440
cacgcuuggcucaucacc

SEQ ID NO: 1606989 - RNA, 20 nt, Pseudomonas putida KT2440
cacgcuugucuuccagcugc

SEQ ID NO: 1606990 - RNA, 19 nt, Pseudomonas putida KT2440
cacgcuucgauccgcgccc

SEQ ID NO: 1606991 - RNA, 20 nt, Pseudomonas putida KT2440
cacgcuucgauccgcgccca

SEQ ID NO: 1606992 - RNA, 16 nt, Pseudomonas putida KT2440
cacggcaagccacgcc

SEQ ID NO: 1606993 - RNA, 22 nt, Pseudomonas putida KT2440
cacggcaauugccaccggcgcu

SEQ ID NO: 1606994 - RNA, 20 nt, Pseudomonas putida KT2440
cacggccaauaucuggugca

SEQ ID NO: 1606995 - RNA, 21 nt, Pseudomonas putida KT2440
cacggcgcgcuucagggucgg

SEQ ID NO: 1606996 - RNA, 15 nt, Pseudomonas putida KT2440
cacggcgcugaccga

SEQ ID NO: 1606997 - RNA, 18 nt, Pseudomonas putida KT2440
cacggcggcauccaggcg

SEQ ID NO: 1606998 - RNA, 20 nt, Pseudomonas putida KT2440
cacggcguccaggcccgcca

SEQ ID NO: 1606999 - RNA, 15 nt, Pseudomonas putida KT2440
cacggcgucgagcag

SEQ ID NO: 1607000 - RNA, 14 nt, Pseudomonas putida KT2440
cacggcguggugcu

SEQ ID NO: 1607001 - RNA, 19 nt, Pseudomonas putida KT2440
cacggcuaaagccgcaccu

SEQ ID NO: 1607002 - RNA, 20 nt, Pseudomonas putida KT2440
cacggcugaacuuccagguc

SEQ ID NO: 1607003 - RNA, 13 nt, Pseudomonas putida KT2440
cacggcugaagaa

SEQ ID NO: 1607004 - RNA, 15 nt, Pseudomonas putida KT2440
cacgggaaugaacug

SEQ ID NO: 1607005 - RNA, 12 nt, Pseudomonas putida KT2440
cacggcugucac

SEQ ID NO: 1607006 - RNA, 22 nt, Pseudomonas putida KT2440
cacggcuucgcagacgucuucc

SEQ ID NO: 1607007 - RNA, 16 nt, Pseudomonas putida KT2440
cacggccagccagcag

SEQ ID NO: 1607008 - RNA, 13 nt, Pseudomonas putida KT2440
cacggccuggccu

SEQ ID NO: 1607009 - RNA, 16 nt, Pseudomonas putida KT2440
cacggcgaugcgcccc

SEQ ID NO: 1607010 - RNA, 16 nt, Pseudomonas putida KT2440
cacccggcugcaucca

SEQ ID NO: 1607011 - RNA, 15 nt, Pseudomonas putida KT2440
cacccgcuugccacg

SEQ ID NO: 1607012 - RNA, 22 nt, Pseudomonas putida KT2440
cacccgcuugccuuccucggcc

SEQ ID NO: 1607013 - RNA, 19 nt, Pseudomonas putida KT2440
cacccggaccagcgccgca

SEQ ID NO: 1607014 - RNA, 15 nt, Pseudomonas putida KT2440
cacccggacccuggu

SEQ ID NO: 1607015 - RNA, 18 nt, Pseudomonas putida KT2440
cacccggucggccagcug

SEQ ID NO: 1607016 - RNA, 16 nt, Pseudomonas putida KT2440
cacccggucccgcccg

SEQ ID NO: 1607017 - RNA, 22 nt, Pseudomonas putida KT2440
cacccggggcagcaucaccacg

SEQ ID NO: 1607018 - RNA, 23 nt, Pseudomonas putida KT2440
cacccggguauuuuuuuugccug

SEQ ID NO: 1607019 - RNA, 18 nt, Pseudomonas putida KT2440
cacccgguagaagcgguc

SEQ ID NO: 1607020 - RNA, 18 nt, Pseudomonas putida KT2440
cacccgggaacagcagca

SEQ ID NO: 1607021 - RNA, 16 nt, Pseudomonas putida KT2440
cacccgcuccaacaaa

SEQ ID NO: 1607022 - RNA, 18 nt, Pseudomonas putida KT2440
cacccgcgcgcccgcggc

SEQ ID NO: 1607023 - RNA, 14 nt, Pseudomonas putida KT2440
cacccgcgcgcuga

SEQ ID NO: 1607024 - RNA, 23 nt, Pseudomonas putida KT2440
cacccgcgaauacgagggugaac

SEQ ID NO: 1607025 - RNA, 17 nt, Pseudomonas putida KT2440
cacccgcgaaugcggua

SEQ ID NO: 1607026 - RNA, 19 nt, Pseudomonas putida KT2440
cacccgcgaaugcuccggc

SEQ ID NO: 1607027 - RNA, 20 nt, Pseudomonas putida KT2440
cacccgcgaaugcuccggcg

SEQ ID NO: 1607028 - RNA, 19 nt, Pseudomonas putida KT2440
cacccgcccaucgcacacc

SEQ ID NO: 1607029 - RNA, 21 nt, Pseudomonas putida KT2440
cacccgcccaucgcacacccu

SEQ ID NO: 1607030 - RNA, 16 nt, Pseudomonas putida KT2440
cacccgccccucuucc

SEQ ID NO: 1607031 - RNA, 22 nt, Pseudomonas putida KT2440
cacccgugcaggggucugugca

SEQ ID NO: 1607032 - RNA, 16 nt, Pseudomonas putida KT2440
cacccgugccugccug

SEQ ID NO: 1607033 - RNA, 18 nt, Pseudomonas putida KT2440
cacccguggcagcccccc

SEQ ID NO: 1607034 - RNA, 20 nt, Pseudomonas putida KT2440
cacccuccgggucaggccga

SEQ ID NO: 1607035 - RNA, 16 nt, Pseudomonas putida KT2440
cacccucacgaugacc

SEQ ID NO: 1607036 - RNA, 20 nt, Pseudomonas putida KT2440
cacccucacgaugacccuuc

SEQ ID NO: 1607037 - RNA, 13 nt, Pseudomonas putida KT2440
cacccucuugaau

SEQ ID NO: 1607038 - RNA, 22 nt, Pseudomonas putida KT2440
cacccucuugaauccccuuaua

SEQ ID NO: 1607039 - RNA, 18 nt, Pseudomonas putida KT2440
cacccucguccccgcgcu

SEQ ID NO: 1607040 - RNA, 21 nt, Pseudomonas putida KT2440
cacccugacgcugcacuucca

SEQ ID NO: 1607041 - RNA, 19 nt, Pseudomonas putida KT2440
caccgaaggccgccggcaa

SEQ ID NO: 1607042 - RNA, 20 nt, Pseudomonas putida KT2440
caccgaaggcgucacccgcg

SEQ ID NO: 1607043 - RNA, 14 nt, Pseudomonas putida KT2440
cacccuuggccacc

SEQ ID NO: 1607044 - RNA, 15 nt, Pseudomonas putida KT2440
cacccuuggccaccu

SEQ ID NO: 1607045 - RNA, 22 nt, Pseudomonas putida KT2440
cacccuugggcaccagcuucca

SEQ ID NO: 1607046 - RNA, 18 nt, Pseudomonas putida KT2440
cacccuugggcucagccg

SEQ ID NO: 1607047 - RNA, 21 nt, Pseudomonas putida KT2440
cacccuugggcucagccgcca

SEQ ID NO: 1607048 - RNA, 16 nt, Pseudomonas putida KT2440
cacccuuuaggggcuc

SEQ ID NO: 1607049 - RNA, 23 nt, Pseudomonas putida KT2440
cacccugucguuauccugcagca

SEQ ID NO: 1607050 - RNA, 16 nt, Pseudomonas putida KT2440
cacccuggucaugcag

SEQ ID NO: 1607051 - RNA, 19 nt, Pseudomonas putida KT2440
cacccuggucaugcagcgg

SEQ ID NO: 1607052 - RNA, 14 nt, Pseudomonas putida KT2440
caccgccagcucca

SEQ ID NO: 1607053 - RNA, 13 nt, Pseudomonas putida KT2440
caccgccagaaaa

SEQ ID NO: 1607054 - RNA, 15 nt, Pseudomonas putida KT2440
caccgccaccccggc

SEQ ID NO: 1607055 - RNA, 14 nt, Pseudomonas putida KT2440
caccgccaccaucg

SEQ ID NO: 1607056 - RNA, 14 nt, Pseudomonas putida KT2440
caccgccaccaugc

SEQ ID NO: 1607057 - RNA, 17 nt, Pseudomonas putida KT2440
caccgauuaccuguuuc

SEQ ID NO: 1607058 - RNA, 17 nt, Pseudomonas putida KT2440
caccgcaacccagcccc

SEQ ID NO: 1607059 - RNA, 20 nt, Pseudomonas putida KT2440
caccgcaaaucacugacccg

SEQ ID NO: 1607060 - RNA, 17 nt, Pseudomonas putida KT2440
caccgcaagcugcaccg

SEQ ID NO: 1607061 - RNA, 14 nt, Pseudomonas putida KT2440
caccgcacugugcu

SEQ ID NO: 1607062 - RNA, 16 nt, Pseudomonas putida KT2440
caccgcagcccagcgc

SEQ ID NO: 1607063 - RNA, 13 nt, Pseudomonas putida KT2440
caccgcagcccca

SEQ ID NO: 1607064 - RNA, 15 nt, Pseudomonas putida KT2440
caccgcagccccagc

SEQ ID NO: 1607065 - RNA, 18 nt, Pseudomonas putida KT2440
caccgagccauugacccg

SEQ ID NO: 1607066 - RNA, 22 nt, Pseudomonas putida KT2440
caccgaggcgugaucacccggg

SEQ ID NO: 1607067 - RNA, 15 nt, Pseudomonas putida KT2440
caccgaucaccuggg

SEQ ID NO: 1607068 - RNA, 12 nt, Pseudomonas putida KT2440
caccgacagccc

SEQ ID NO: 1607069 - RNA, 13 nt, Pseudomonas putida KT2440
caccgacccggcc

SEQ ID NO: 1607070 - RNA, 15 nt, Pseudomonas putida KT2440
caccgacccacaggc

SEQ ID NO: 1607071 - RNA, 19 nt, Pseudomonas putida KT2440
caccgacccacaggcacag

SEQ ID NO: 1607072 - RNA, 20 nt, Pseudomonas putida KT2440
caccgagacgaucaccaggu

SEQ ID NO: 1607073 - RNA, 22 nt, Pseudomonas putida KT2440
caccgacuuccccggcgccgcc

SEQ ID NO: 1607074 - RNA, 14 nt, Pseudomonas putida KT2440
caccgacuccggca

SEQ ID NO: 1607075 - RNA, 21 nt, Pseudomonas putida KT2440
caccgggauggcggcgccugc

SEQ ID NO: 1607076 - RNA, 21 nt, Pseudomonas putida KT2440
caccggcgugccgucgagcag

SEQ ID NO: 1607077 - RNA, 18 nt, Pseudomonas putida KT2440
caccggcgccaaucaucg

SEQ ID NO: 1607078 - RNA, 22 nt, Pseudomonas putida KT2440
caccggcgccaaucaucgccag

SEQ ID NO: 1607079 - RNA, 15 nt, Pseudomonas putida KT2440
caccggccgccagga

SEQ ID NO: 1607080 - RNA, 13 nt, Pseudomonas putida KT2440
caccggccgccgc

SEQ ID NO: 1607081 - RNA, 19 nt, Pseudomonas putida KT2440
caccggcagcgcaaucacc

SEQ ID NO: 1607082 - RNA, 16 nt, Pseudomonas putida KT2440
caccggccagcgcgcu

SEQ ID NO: 1607083 - RNA, 15 nt, Pseudomonas putida KT2440
caccggccaccgugg

SEQ ID NO: 1607084 - RNA, 14 nt, Pseudomonas putida KT2440
caccggcaccaucu

SEQ ID NO: 1607085 - RNA, 14 nt, Pseudomonas putida KT2440
caccggcagcaccu

SEQ ID NO: 1607086 - RNA, 23 nt, Pseudomonas putida KT2440
caccggaguccccaccggcacca

SEQ ID NO: 1607087 - RNA, 20 nt, Pseudomonas putida KT2440
caccgcguuaugacuggccu

SEQ ID NO: 1607088 - RNA, 12 nt, Pseudomonas putida KT2440
caccgcugacca

SEQ ID NO: 1607089 - RNA, 18 nt, Pseudomonas putida KT2440
caccgcucaaacccggca

SEQ ID NO: 1607090 - RNA, 15 nt, Pseudomonas putida KT2440
caccgcugccgggca

SEQ ID NO: 1607091 - RNA, 21 nt, Pseudomonas putida KT2440
caccgcugucggucacagcag

SEQ ID NO: 1607092 - RNA, 16 nt, Pseudomonas putida KT2440
caccgccgcccacgcc

SEQ ID NO: 1607093 - RNA, 13 nt, Pseudomonas putida KT2440
caccgccgccccg

SEQ ID NO: 1607094 - RNA, 14 nt, Pseudomonas putida KT2440
caccgccgccccgc

SEQ ID NO: 1607095 - RNA, 17 nt, Pseudomonas putida KT2440
caccgccaggucgccgg

SEQ ID NO: 1607096 - RNA, 13 nt, Pseudomonas putida KT2440
caccgccccggcc

SEQ ID NO: 1607097 - RNA, 20 nt, Pseudomonas putida KT2440
caccgccggcucgucacugc

SEQ ID NO: 1607098 - RNA, 21 nt, Pseudomonas putida KT2440
caccgccggcucgucacugcc

SEQ ID NO: 1607099 - RNA, 22 nt, Pseudomonas putida KT2440
caccgccggcucgucacugccg

SEQ ID NO: 1607100 - RNA, 23 nt, Pseudomonas putida KT2440
caccgccucuaccacgccgcugc

SEQ ID NO: 1607101 - RNA, 15 nt, Pseudomonas putida KT2440
caccgccucgcccag

SEQ ID NO: 1607102 - RNA, 14 nt, Pseudomonas putida KT2440
caccgcgcaccucc

SEQ ID NO: 1607103 - RNA, 22 nt, Pseudomonas putida KT2440
caccgcguacagcugcucacca

SEQ ID NO: 1607104 - RNA, 18 nt, Pseudomonas putida KT2440
caccgcggaugcgccugg

SEQ ID NO: 1607105 - RNA, 19 nt, Pseudomonas putida KT2440
caccgcggaugcgccuggc

SEQ ID NO: 1607106 - RNA, 16 nt, Pseudomonas putida KT2440
caccgcgccagccugg

SEQ ID NO: 1607107 - RNA, 22 nt, Pseudomonas putida KT2440
caccuggugcgccuuuuccacc

SEQ ID NO: 1607108 - RNA, 22 nt, Pseudomonas putida KT2440
caccugggcgcuuugcacccgc

SEQ ID NO: 1607109 - RNA, 15 nt, Pseudomonas putida KT2440
caccuguucccccac

SEQ ID NO: 1607110 - RNA, 16 nt, Pseudomonas putida KT2440
caccuguucccccacc

SEQ ID NO: 1607111 - RNA, 17 nt, Pseudomonas putida KT2440
caccugcccgggccgcu

SEQ ID NO: 1607112 - RNA, 15 nt, Pseudomonas putida KT2440
caccugcuccagcac

SEQ ID NO: 1607113 - RNA, 16 nt, Pseudomonas putida KT2440
caccugcuccagcacc

SEQ ID NO: 1607114 - RNA, 17 nt, Pseudomonas putida KT2440
caccugcuccagcaccu

SEQ ID NO: 1607115 - RNA, 13 nt, Pseudomonas putida KT2440
caccugcgccccg

SEQ ID NO: 1607116 - RNA, 14 nt, Pseudomonas putida KT2440
caccugcgccuugc

SEQ ID NO: 1607117 - RNA, 16 nt, Pseudomonas putida KT2440
caccuggcugcgggug

SEQ ID NO: 1607118 - RNA, 18 nt, Pseudomonas putida KT2440
caccuggccuuccagcug

SEQ ID NO: 1607119 - RNA, 14 nt, Pseudomonas putida KT2440
caccuggcccugcu

SEQ ID NO: 1607120 - RNA, 22 nt, Pseudomonas putida KT2440
caccuggcccugcucacgcagc

SEQ ID NO: 1607121 - RNA, 16 nt, Pseudomonas putida KT2440
caccuugcuccaccag

SEQ ID NO: 1607122 - RNA, 12 nt, Pseudomonas putida KT2440
caccuugcugaa

SEQ ID NO: 1607123 - RNA, 22 nt, Pseudomonas putida KT2440
caccuugcugaaauccagccgc

SEQ ID NO: 1607124 - RNA, 15 nt, Pseudomonas putida KT2440
caccuugaagugcgc

SEQ ID NO: 1607125 - RNA, 21 nt, Pseudomonas putida KT2440
caccuugaugcgcgagcuggg

SEQ ID NO: 1607126 - RNA, 21 nt, Pseudomonas putida KT2440
caccuugccccgcaggccgcc

SEQ ID NO: 1607127 - RNA, 15 nt, Pseudomonas putida KT2440
caccuugccuaccug

SEQ ID NO: 1607128 - RNA, 14 nt, Pseudomonas putida KT2440
caccuuggccgccc

SEQ ID NO: 1607129 - RNA, 13 nt, Pseudomonas putida KT2440
caccuuccacucu

SEQ ID NO: 1607130 - RNA, 21 nt, Pseudomonas putida KT2440
caccuucgauuagacccagau

SEQ ID NO: 1607131 - RNA, 14 nt, Pseudomonas putida KT2440
caccuucucacuga

SEQ ID NO: 1607132 - RNA, 14 nt, Pseudomonas putida KT2440
caccuucucggccu

SEQ ID NO: 1607133 - RNA, 19 nt, Pseudomonas putida KT2440
caccuucucggccucagcc

SEQ ID NO: 1607134 - RNA, 21 nt, Pseudomonas putida KT2440
cacgaaucgauaccugggucc

SEQ ID NO: 1607135 - RNA, 14 nt, Pseudomonas putida KT2440
cacgacacuccgcu

SEQ ID NO: 1607136 - RNA, 20 nt, Pseudomonas putida KT2440
cacgaaguaacggccacggu

SEQ ID NO: 1607137 - RNA, 14 nt, Pseudomonas putida KT2440
cacgaacaucagca

SEQ ID NO: 1607138 - RNA, 17 nt, Pseudomonas putida KT2440
cacgaacaucagcagga

SEQ ID NO: 1607139 - RNA, 20 nt, Pseudomonas putida KT2440
cacgaacaucagcaggaagc

SEQ ID NO: 1607140 - RNA, 23 nt, Pseudomonas putida KT2440
cacgaacaucagcaggaagcaga

SEQ ID NO: 1607141 - RNA, 13 nt, Pseudomonas putida KT2440
cacgaacagcggc

SEQ ID NO: 1607142 - RNA, 19 nt, Pseudomonas putida KT2440
cacgaacacaucaccugcu

SEQ ID NO: 1607143 - RNA, 18 nt, Pseudomonas putida KT2440
cacgaacaccagccccag

SEQ ID NO: 1607144 - RNA, 15 nt, Pseudomonas putida KT2440
cacgaacgcccccag

SEQ ID NO: 1607145 - RNA, 14 nt, Pseudomonas putida KT2440
cacgaaccugugca

SEQ ID NO: 1607146 - RNA, 13 nt, Pseudomonas putida KT2440
cacgaaaaagcca

SEQ ID NO: 1607147 - RNA, 16 nt, Pseudomonas putida KT2440
cacgaaacgccacgcc

SEQ ID NO: 1607148 - RNA, 14 nt, Pseudomonas putida KT2440
cacgacgauggcca

SEQ ID NO: 1607149 - RNA, 19 nt, Pseudomonas putida KT2440
cacgacgauggccaccagc

SEQ ID NO: 1607150 - RNA, 20 nt, Pseudomonas putida KT2440
cacgacgauggccaccagca

SEQ ID NO: 1607151 - RNA, 20 nt, Pseudomonas putida KT2440
cacgacugaacaccugccag

SEQ ID NO: 1607152 - RNA, 19 nt, Pseudomonas putida KT2440
cacgacugacguaguccuu

SEQ ID NO: 1607153 - RNA, 14 nt, Pseudomonas putida KT2440
cacgagauguacag

SEQ ID NO: 1607154 - RNA, 14 nt, Pseudomonas putida KT2440
caccucccgccacg

SEQ ID NO: 1607155 - RNA, 17 nt, Pseudomonas putida KT2440
caccucagaagucgaag

SEQ ID NO: 1607156 - RNA, 20 nt, Pseudomonas putida KT2440
caccucaauguucuguagcc

SEQ ID NO: 1607157 - RNA, 21 nt, Pseudomonas putida KT2440
caccucaucggcauugcugaa

SEQ ID NO: 1607158 - RNA, 22 nt, Pseudomonas putida KT2440
caccucaucggcauugcugaag

SEQ ID NO: 1607159 - RNA, 17 nt, Pseudomonas putida KT2440
caccucaucccccggcc

SEQ ID NO: 1607160 - RNA, 18 nt, Pseudomonas putida KT2440
caccucaucccccggccc

SEQ ID NO: 1607161 - RNA, 23 nt, Pseudomonas putida KT2440
caccucgguaaaggugcccugcu

SEQ ID NO: 1607162 - RNA, 17 nt, Pseudomonas putida KT2440
caccucggcgaucagcu

SEQ ID NO: 1607163 - RNA, 14 nt, Pseudomonas putida KT2440
caccucggaugcca

SEQ ID NO: 1607164 - RNA, 22 nt, Pseudomonas putida KT2440
caccucggaugccacgcugaac

SEQ ID NO: 1607165 - RNA, 17 nt, Pseudomonas putida KT2440
caccucgaugguuaucu

SEQ ID NO: 1607166 - RNA, 15 nt, Pseudomonas putida KT2440
caccugaccgaugcc

SEQ ID NO: 1607167 - RNA, 13 nt, Pseudomonas putida KT2440
caccucgucgcuc

SEQ ID NO: 1607168 - RNA, 20 nt, Pseudomonas putida KT2440
caccucugcggccuucaagc

SEQ ID NO: 1607169 - RNA, 22 nt, Pseudomonas putida KT2440
caccugacgcaagcgcgccgcc

SEQ ID NO: 1607170 - RNA, 23 nt, Pseudomonas putida KT2440
caccugacgcaagcgcgccgcca

SEQ ID NO: 1607171 - RNA, 19 nt, Pseudomonas putida KT2440
caccugccaacgcaccgac

SEQ ID NO: 1607172 - RNA, 20 nt, Pseudomonas putida KT2440
caccugccaacgcaccgacc

SEQ ID NO: 1607173 - RNA, 20 nt, Pseudomonas putida KT2440
caccugccacacacccgggc

SEQ ID NO: 1607174 - RNA, 18 nt, Pseudomonas putida KT2440
caccugccagccccgcac

SEQ ID NO: 1607175 - RNA, 23 nt, Pseudomonas putida KT2440
caccugcagguacagcagcugca

SEQ ID NO: 1607176 - RNA, 15 nt, Pseudomonas putida KT2440
caccguggcagcaau

SEQ ID NO: 1607177 - RNA, 13 nt, Pseudomonas putida KT2440
caccgugcccacc

SEQ ID NO: 1607178 - RNA, 23 nt, Pseudomonas putida KT2440
caccgugagcauggcaaacagca

SEQ ID NO: 1607179 - RNA, 15 nt, Pseudomonas putida KT2440
caccguugccgccac

SEQ ID NO: 1607180 - RNA, 17 nt, Pseudomonas putida KT2440
caccguguaccccaucu

SEQ ID NO: 1607181 - RNA, 20 nt, Pseudomonas putida KT2440
caccgucuggaagucgcgag

SEQ ID NO: 1607182 - RNA, 19 nt, Pseudomonas putida KT2440
caccguagcgagcaccggc

SEQ ID NO: 1607183 - RNA, 15 nt, Pseudomonas putida KT2440
caccguacuugcugc

SEQ ID NO: 1607184 - RNA, 14 nt, Pseudomonas putida KT2440
caccgucaggcuca

SEQ ID NO: 1607185 - RNA, 17 nt, Pseudomonas putida KT2440
caccgucaggcucagca

SEQ ID NO: 1607186 - RNA, 22 nt, Pseudomonas putida KT2440
caccgguacauugcgcaccccu

SEQ ID NO: 1607187 - RNA, 21 nt, Pseudomonas putida KT2440
caccgguauagcgacaggcuu

SEQ ID NO: 1607188 - RNA, 22 nt, Pseudomonas putida KT2440
caccgguaucgaugcacagcuc

SEQ ID NO: 1607189 - RNA, 21 nt, Pseudomonas putida KT2440
caccgguaccgcucugcgcca

SEQ ID NO: 1607190 - RNA, 23 nt, Pseudomonas putida KT2440
caccaggacaagccgacaaaaac

SEQ ID NO: 1607191 - RNA, 16 nt, Pseudomonas putida KT2440
caccaggaucagguaa

SEQ ID NO: 1607192 - RNA, 23 nt, Pseudomonas putida KT2440
caccaggcaauugugccgcgcca

SEQ ID NO: 1607193 - RNA, 21 nt, Pseudomonas putida KT2440
caccaggauuggccgcaacac

SEQ ID NO: 1607194 - RNA, 24 nt, Pseudomonas putida KT2440
caccagcuccuggccgcccgccuc

SEQ ID NO: 1607195 - RNA, 14 nt, Pseudomonas putida KT2440
caccaggaagcugg

SEQ ID NO: 1607196 - RNA, 17 nt, Pseudomonas putida KT2440
caccaggcccagccggg

SEQ ID NO: 1607197 - RNA, 13 nt, Pseudomonas putida KT2440
caccaggccacgu

SEQ ID NO: 1607198 - RNA, 20 nt, Pseudomonas putida KT2440
caccaggcccgcaagggucu

SEQ ID NO: 1607199 - RNA, 17 nt, Pseudomonas putida KT2440
caccaggccgaucacca

SEQ ID NO: 1607200 - RNA, 21 nt, Pseudomonas putida KT2440
caccaggccgaucaccagcac

SEQ ID NO: 1607201 - RNA, 23 nt, Pseudomonas putida KT2440
caccaggccgaucaccagcaccc

SEQ ID NO: 1607202 - RNA, 14 nt, Pseudomonas putida KT2440
caccaggguaaacc

SEQ ID NO: 1607203 - RNA, 22 nt, Pseudomonas putida KT2440
caccaggguggcgauccacagc

SEQ ID NO: 1607204 - RNA, 23 nt, Pseudomonas putida KT2440
caccaggguggcgauccacagcg

SEQ ID NO: 1607205 - RNA, 17 nt, Pseudomonas putida KT2440
caccagguccaccagca

SEQ ID NO: 1607206 - RNA, 12 nt, Pseudomonas putida KT2440
caccaucaagcc

SEQ ID NO: 1607207 - RNA, 20 nt, Pseudomonas putida KT2440
caccagguuguggcccauga

SEQ ID NO: 1607208 - RNA, 20 nt, Pseudomonas putida KT2440
caccagguugcgugccucgc

SEQ ID NO: 1607209 - RNA, 18 nt, Pseudomonas putida KT2440
caccagguuggccgccgc

SEQ ID NO: 1607210 - RNA, 20 nt, Pseudomonas putida KT2440
caccagguuggccgccgcca

SEQ ID NO: 1607211 - RNA, 21 nt, Pseudomonas putida KT2440
caccagguuggccgccgccag

SEQ ID NO: 1607212 - RNA, 23 nt, Pseudomonas putida KT2440
caccagugaggucgggaauugca

SEQ ID NO: 1607213 - RNA, 22 nt, Pseudomonas putida KT2440
caccaguauugcgucaggcuuc

SEQ ID NO: 1607214 - RNA, 13 nt, Pseudomonas putida KT2440
caccaguuccacc

SEQ ID NO: 1607215 - RNA, 16 nt, Pseudomonas putida KT2440
caccaguuccaccggc

SEQ ID NO: 1607216 - RNA, 17 nt, Pseudomonas putida KT2440
caccagcuccaccuucc

SEQ ID NO: 1607217 - RNA, 13 nt, Pseudomonas putida KT2440
caccagcuccaug

SEQ ID NO: 1607218 - RNA, 16 nt, Pseudomonas putida KT2440
caccagcguugucccg

SEQ ID NO: 1607219 - RNA, 17 nt, Pseudomonas putida KT2440
caccagcguugucccgc

SEQ ID NO: 1607220 - RNA, 19 nt, Pseudomonas putida KT2440
caccagcguugucccgccc

SEQ ID NO: 1607221 - RNA, 21 nt, Pseudomonas putida KT2440
caccagcguugucccgcccug

SEQ ID NO: 1607222 - RNA, 19 nt, Pseudomonas putida KT2440
caccagcucguucaacacc

SEQ ID NO: 1607223 - RNA, 16 nt, Pseudomonas putida KT2440
caccagcgucaccccu

SEQ ID NO: 1607224 - RNA, 21 nt, Pseudomonas putida KT2440
caccagcgucaccccucggcu

SEQ ID NO: 1607225 - RNA, 17 nt, Pseudomonas putida KT2440
caccagcggcuuggcac

SEQ ID NO: 1607226 - RNA, 22 nt, Pseudomonas putida KT2440
caccagcgggcccagcaggugc

SEQ ID NO: 1607227 - RNA, 19 nt, Pseudomonas putida KT2440
caccagcgcccuucacgcu

SEQ ID NO: 1607228 - RNA, 14 nt, Pseudomonas putida KT2440
caccagcagcuucu

SEQ ID NO: 1607229 - RNA, 21 nt, Pseudomonas putida KT2440
caccagcagcuucuucacacc

SEQ ID NO: 1607230 - RNA, 22 nt, Pseudomonas putida KT2440
caccagcagcuucuucacaccg

SEQ ID NO: 1607231 - RNA, 11 nt, Pseudomonas putida KT2440
caccagcagcc

SEQ ID NO: 1607232 - RNA, 15 nt, Pseudomonas putida KT2440
caccagcagccacgg

SEQ ID NO: 1607233 - RNA, 10 nt, Pseudomonas putida KT2440
caccagcagc

SEQ ID NO: 1607234 - RNA, 10 nt, Pseudomonas putida KT2440
caccagcacg

SEQ ID NO: 1607235 - RNA, 16 nt, Pseudomonas putida KT2440
caccagcacugcugcg

SEQ ID NO: 1607236 - RNA, 13 nt, Pseudomonas putida KT2440
caccagcaccacc

SEQ ID NO: 1607237 - RNA, 14 nt, Pseudomonas putida KT2440
caccagcaccaccg

SEQ ID NO: 1607238 - RNA, 22 nt, Pseudomonas putida KT2440
caccagccaaacccggccgcgg

SEQ ID NO: 1607239 - RNA, 15 nt, Pseudomonas putida KT2440
caccagcaucaacag

SEQ ID NO: 1607240 - RNA, 13 nt, Pseudomonas putida KT2440
caccagcccgucc

SEQ ID NO: 1607241 - RNA, 20 nt, Pseudomonas putida KT2440
caccagccccucaggcacau

SEQ ID NO: 1607242 - RNA, 22 nt, Pseudomonas putida KT2440
caccagcccgaagcgcaggucc

SEQ ID NO: 1607243 - RNA, 13 nt, Pseudomonas putida KT2440
caccagccccaau

SEQ ID NO: 1607244 - RNA, 13 nt, Pseudomonas putida KT2440
caccagccccagc

SEQ ID NO: 1607245 - RNA, 14 nt, Pseudomonas putida KT2440
caccagccccagcc

SEQ ID NO: 1607246 - RNA, 17 nt, Pseudomonas putida KT2440
caccccgauucacagca

SEQ ID NO: 1607247 - RNA, 19 nt, Pseudomonas putida KT2440
caccccgcaaagcccugcc

SEQ ID NO: 1607248 - RNA, 14 nt, Pseudomonas putida KT2440
cacccccgccgcca

SEQ ID NO: 1607249 - RNA, 15 nt, Pseudomonas putida KT2440
caccccgaccaaggc

SEQ ID NO: 1607250 - RNA, 18 nt, Pseudomonas putida KT2440
caccccgaccaaggccaa

SEQ ID NO: 1607251 - RNA, 14 nt, Pseudomonas putida KT2440
caccccggugcagg

SEQ ID NO: 1607252 - RNA, 21 nt, Pseudomonas putida KT2440
caccccucggcucacgccccg

SEQ ID NO: 1607253 - RNA, 22 nt, Pseudomonas putida KT2440
caccccguucgcccugcgccug

SEQ ID NO: 1607254 - RNA, 11 nt, Pseudomonas putida KT2440
caccccuucgu

SEQ ID NO: 1607255 - RNA, 16 nt, Pseudomonas putida KT2440
caccccuugcaguauc

SEQ ID NO: 1607256 - RNA, 14 nt, Pseudomonas putida KT2440
cacccgacgccacc

SEQ ID NO: 1607257 - RNA, 17 nt, Pseudomonas putida KT2440
caccccuuuacuggcca

SEQ ID NO: 1607258 - RNA, 17 nt, Pseudomonas putida KT2440
caccccuuucuccagca

SEQ ID NO: 1607259 - RNA, 21 nt, Pseudomonas putida KT2440
cacccgcaggcgacgagccag

SEQ ID NO: 1607260 - RNA, 13 nt, Pseudomonas putida KT2440
cacccaguucggc

SEQ ID NO: 1607261 - RNA, 23 nt, Pseudomonas putida KT2440
cacccagucaccuugcuccacca

SEQ ID NO: 1607262 - RNA, 18 nt, Pseudomonas putida KT2440
cacccagucgccccgcca

SEQ ID NO: 1607263 - RNA, 18 nt, Pseudomonas putida KT2440
cacccagcacgaaggcca

SEQ ID NO: 1607264 - RNA, 13 nt, Pseudomonas putida KT2440
cacccagaugcgg

SEQ ID NO: 1607265 - RNA, 11 nt, Pseudomonas putida KT2440
cacccaggugc

SEQ ID NO: 1607266 - RNA, 23 nt, Pseudomonas putida KT2440
cacccagcucgccaacaccgccc

SEQ ID NO: 1607267 - RNA, 22 nt, Pseudomonas putida KT2440
cacccagcguauagccaccggg

SEQ ID NO: 1607268 - RNA, 20 nt, Pseudomonas putida KT2440
caccccagaacggcacgccc

SEQ ID NO: 1607269 - RNA, 20 nt, Pseudomonas putida KT2440
caccccagccgcucgagaaa

SEQ ID NO: 1607270 - RNA, 20 nt, Pseudomonas putida KT2440
caccccagcaccacccacca

SEQ ID NO: 1607271 - RNA, 22 nt, Pseudomonas putida KT2440
caccccagcaccacccaccagc

SEQ ID NO: 1607272 - RNA, 18 nt, Pseudomonas putida KT2440
cacccccagguuauccac

SEQ ID NO: 1607273 - RNA, 19 nt, Pseudomonas putida KT2440
cacccauucccacaucaaa

SEQ ID NO: 1607274 - RNA, 19 nt, Pseudomonas putida KT2440
cacccagaacagccacagc

SEQ ID NO: 1607275 - RNA, 15 nt, Pseudomonas putida KT2440
cacccaaccgcgcca

SEQ ID NO: 1607276 - RNA, 12 nt, Pseudomonas putida KT2440
cacccaaggcau

SEQ ID NO: 1607277 - RNA, 15 nt, Pseudomonas putida KT2440
cacccaaggcaucca

SEQ ID NO: 1607278 - RNA, 20 nt, Pseudomonas putida KT2440
cacccaccacaaaccacagc

SEQ ID NO: 1607279 - RNA, 17 nt, Pseudomonas putida KT2440
cacccacacccgcgcgu

SEQ ID NO: 1607280 - RNA, 12 nt, Pseudomonas putida KT2440
caccauguucca

SEQ ID NO: 1607281 - RNA, 14 nt, Pseudomonas putida KT2440
caccaugcucagga

SEQ ID NO: 1607282 - RNA, 15 nt, Pseudomonas putida KT2440
caccaugagccccgc

SEQ ID NO: 1607283 - RNA, 16 nt, Pseudomonas putida KT2440
caccaugaacagcacg

SEQ ID NO: 1607284 - RNA, 22 nt, Pseudomonas putida KT2440
caccaugaacucuuccccgccc

SEQ ID NO: 1607285 - RNA, 21 nt, Pseudomonas putida KT2440
caccaucuccagcucgccgcc

SEQ ID NO: 1607286 - RNA, 15 nt, Pseudomonas putida KT2440
caccaucgaccuggc

SEQ ID NO: 1607287 - RNA, 22 nt, Pseudomonas putida KT2440
caccaucggugcggcccccugg

SEQ ID NO: 1607288 - RNA, 14 nt, Pseudomonas putida KT2440
caccaucagccgcg

SEQ ID NO: 1607289 - RNA, 15 nt, Pseudomonas putida KT2440
caccaucagagcgcc

SEQ ID NO: 1607290 - RNA, 22 nt, Pseudomonas putida KT2440
caccaucagagcgccagcaagc

SEQ ID NO: 1607291 - RNA, 17 nt, Pseudomonas putida KT2440
caccaccggccgacccg

SEQ ID NO: 1607292 - RNA, 21 nt, Pseudomonas putida KT2440
caccacccaccagcagugccc

SEQ ID NO: 1607293 - RNA, 13 nt, Pseudomonas putida KT2440
caccacccccagc

SEQ ID NO: 1607294 - RNA, 14 nt, Pseudomonas putida KT2440
caccacccccagcg

SEQ ID NO: 1607295 - RNA, 17 nt, Pseudomonas putida KT2440
caccacccccagcgacc

SEQ ID NO: 1607296 - RNA, 17 nt, Pseudomonas putida KT2440
caccacccccagcgccu

SEQ ID NO: 1607297 - RNA, 20 nt, Pseudomonas putida KT2440
caccaccccggggcgcucca

SEQ ID NO: 1607298 - RNA, 23 nt, Pseudomonas putida KT2440
caccaccccggggcgcuccagca

SEQ ID NO: 1607299 - RNA, 22 nt, Pseudomonas putida KT2440
caccaccgagugcggcaggccg

SEQ ID NO: 1607300 - RNA, 11 nt, Pseudomonas putida KT2440
caccaccagcc

SEQ ID NO: 1607301 - RNA, 13 nt, Pseudomonas putida KT2440
caccaccagcccg

SEQ ID NO: 1607302 - RNA, 15 nt, Pseudomonas putida KT2440
caccaccagcgcccu

SEQ ID NO: 1607303 - RNA, 18 nt, Pseudomonas putida KT2440
caccaccagcgcccuuca

SEQ ID NO: 1607304 - RNA, 16 nt, Pseudomonas putida KT2440
caccaccagcaacacg

SEQ ID NO: 1607305 - RNA, 17 nt, Pseudomonas putida KT2440
caccacauacggcgcac

SEQ ID NO: 1607306 - RNA, 16 nt, Pseudomonas putida KT2440
caccacacuagccccu

SEQ ID NO: 1607307 - RNA, 22 nt, Pseudomonas putida KT2440
caccaauguguauccaccccca

SEQ ID NO: 1607308 - RNA, 15 nt, Pseudomonas putida KT2440
caccacagcugcaca

SEQ ID NO: 1607309 - RNA, 20 nt, Pseudomonas putida KT2440
caccacagcugcacaucucc

SEQ ID NO: 1607310 - RNA, 21 nt, Pseudomonas putida KT2440
caccacagcugcacaucucca

SEQ ID NO: 1607311 - RNA, 12 nt, Pseudomonas putida KT2440
caccaauggcca

SEQ ID NO: 1607312 - RNA, 13 nt, Pseudomonas putida KT2440
caccaauggccau

SEQ ID NO: 1607313 - RNA, 14 nt, Pseudomonas putida KT2440
caccaauggccaua

SEQ ID NO: 1607314 - RNA, 13 nt, Pseudomonas putida KT2440
caccacaaaaccu

SEQ ID NO: 1607315 - RNA, 15 nt, Pseudomonas putida KT2440
caccacaaaccacag

SEQ ID NO: 1607316 - RNA, 16 nt, Pseudomonas putida KT2440
caccacaaaccacagc

SEQ ID NO: 1607317 - RNA, 16 nt, Pseudomonas putida KT2440
caccacaacgcggcgc

SEQ ID NO: 1607318 - RNA, 14 nt, Pseudomonas putida KT2440
caccacugucagcc

SEQ ID NO: 1607319 - RNA, 17 nt, Pseudomonas putida KT2440
caccacuguucaggugu

SEQ ID NO: 1607320 - RNA, 14 nt, Pseudomonas putida KT2440
caccagaugaccaa

SEQ ID NO: 1607321 - RNA, 13 nt, Pseudomonas putida KT2440
caccagaccagca

SEQ ID NO: 1607322 - RNA, 17 nt, Pseudomonas putida KT2440
caccagaccagcagcag

SEQ ID NO: 1607323 - RNA, 13 nt, Pseudomonas putida KT2440
caccacgaacagu

SEQ ID NO: 1607324 - RNA, 15 nt, Pseudomonas putida KT2440
caccacgaacagugg

SEQ ID NO: 1607325 - RNA, 19 nt, Pseudomonas putida KT2440
caccacgaacgcccccagc

SEQ ID NO: 1607326 - RNA, 21 nt, Pseudomonas putida KT2440
caccacgaacgcccccagccc

SEQ ID NO: 1607327 - RNA, 15 nt, Pseudomonas putida KT2440
caccacgccauagcu

SEQ ID NO: 1607328 - RNA, 19 nt, Pseudomonas putida KT2440
caccacgcccuggcccgcc

SEQ ID NO: 1607329 - RNA, 19 nt, Pseudomonas putida KT2440
caccacgaucacgcccggg

SEQ ID NO: 1607330 - RNA, 21 nt, Pseudomonas putida KT2440
caccacggccuggccugcaug

SEQ ID NO: 1607331 - RNA, 17 nt, Pseudomonas putida KT2440
caccacggucggccugc

SEQ ID NO: 1607332 - RNA, 20 nt, Pseudomonas putida KT2440
caccacggucggccugcgcu

SEQ ID NO: 1607333 - RNA, 16 nt, Pseudomonas putida KT2440
caccacgucuuccugg

SEQ ID NO: 1607334 - RNA, 18 nt, Pseudomonas putida KT2440
caccacguagugcuucug

SEQ ID NO: 1607335 - RNA, 17 nt, Pseudomonas putida KT2440
caccacgucacgcacca

SEQ ID NO: 1607336 - RNA, 18 nt, Pseudomonas putida KT2440
caccaaugacuccgcccc

SEQ ID NO: 1607337 - RNA, 20 nt, Pseudomonas putida KT2440
caccaaugacuccgccccaa

SEQ ID NO: 1607338 - RNA, 16 nt, Pseudomonas putida KT2440
caccaacagcaccggc

SEQ ID NO: 1607339 - RNA, 17 nt, Pseudomonas putida KT2440
caccaacagcaccggcc

SEQ ID NO: 1607340 - RNA, 21 nt, Pseudomonas putida KT2440
caccaacgccgauagccagcu

SEQ ID NO: 1607341 - RNA, 14 nt, Pseudomonas putida KT2440
cacauuucacagca

SEQ ID NO: 1607342 - RNA, 20 nt, Pseudomonas putida KT2440
cacauuucacagcaaaaaau

SEQ ID NO: 1607343 - RNA, 24 nt, Pseudomonas putida KT2440
cacauugggcacuucgcucaugga

SEQ ID NO: 1607344 - RNA, 22 nt, Pseudomonas putida KT2440
cacauuccgcacgucagacuuu

SEQ ID NO: 1607345 - RNA, 21 nt, Pseudomonas putida KT2440
cacauuaccgcguguggcauu

SEQ ID NO: 1607346 - RNA, 17 nt, Pseudomonas putida KT2440
cacauuauccaccaggc

SEQ ID NO: 1607347 - RNA, 13 nt, Pseudomonas putida KT2440
cacauccacagcc

SEQ ID NO: 1607348 - RNA, 16 nt, Pseudomonas putida KT2440
cacauccacagccucc

SEQ ID NO: 1607349 - RNA, 18 nt, Pseudomonas putida KT2440
cacauccacagccuccag

SEQ ID NO: 1607350 - RNA, 14 nt, Pseudomonas putida KT2440
cacauccagcgccg

SEQ ID NO: 1607351 - RNA, 23 nt, Pseudomonas putida KT2440
cacauccagcgccgcgccaccga

SEQ ID NO: 1607352 - RNA, 15 nt, Pseudomonas putida KT2440
cacauccagcgccuc

SEQ ID NO: 1607353 - RNA, 16 nt, Pseudomonas putida KT2440
cacauccucaaaggca

SEQ ID NO: 1607354 - RNA, 20 nt, Pseudomonas putida KT2440
cacauccucaaaggcagccu

SEQ ID NO: 1607355 - RNA, 15 nt, Pseudomonas putida KT2440
cacauccgaccccag

SEQ ID NO: 1607356 - RNA, 22 nt, Pseudomonas putida KT2440
cacaucacguuuggcagugcca

SEQ ID NO: 1607357 - RNA, 17 nt, Pseudomonas putida KT2440
cacaucaccugcuuuca

SEQ ID NO: 1607358 - RNA, 15 nt, Pseudomonas putida KT2440
cacaucacgcgaccu

SEQ ID NO: 1607359 - RNA, 13 nt, Pseudomonas putida KT2440
cacaucaccagca

SEQ ID NO: 1607360 - RNA, 23 nt, Pseudomonas putida KT2440
cacaucacacagcggcagacaca

SEQ ID NO: 1607361 - RNA, 14 nt, Pseudomonas putida KT2440
cacauaucagccaa

SEQ ID NO: 1607362 - RNA, 15 nt, Pseudomonas putida KT2440
cacauguaaugaaaa

SEQ ID NO: 1607363 - RNA, 13 nt, Pseudomonas putida KT2440
cacaugccauacc

SEQ ID NO: 1607364 - RNA, 16 nt, Pseudomonas putida KT2440
cacaugcugcgcccca

SEQ ID NO: 1607365 - RNA, 14 nt, Pseudomonas putida KT2440
cacaugcccgcggc

SEQ ID NO: 1607366 - RNA, 23 nt, Pseudomonas putida KT2440
cacaugcccgcggcucacccacc

SEQ ID NO: 1607367 - RNA, 15 nt, Pseudomonas putida KT2440
cacaugccugcacug

SEQ ID NO: 1607368 - RNA, 16 nt, Pseudomonas putida KT2440
cacaugcgagccgcug

SEQ ID NO: 1607369 - RNA, 23 nt, Pseudomonas putida KT2440
cacaugcgagccgcugccaaagu

SEQ ID NO: 1607370 - RNA, 15 nt, Pseudomonas putida KT2440
cacaugcgccacacc

SEQ ID NO: 1607371 - RNA, 16 nt, Pseudomonas putida KT2440
cacaucguccgccgcg

SEQ ID NO: 1607372 - RNA, 16 nt, Pseudomonas putida KT2440
cacaucggucggcccc

SEQ ID NO: 1607373 - RNA, 13 nt, Pseudomonas putida KT2440
cacaucggcggca

SEQ ID NO: 1607374 - RNA, 23 nt, Pseudomonas putida KT2440
cacaucugggguuggacccaggc

SEQ ID NO: 1607375 - RNA, 23 nt, Pseudomonas putida KT2440
cacaucuugccccggugcccauu

SEQ ID NO: 1607376 - RNA, 19 nt, Pseudomonas putida KT2440
cacagcagaucacaaaguu

SEQ ID NO: 1607377 - RNA, 22 nt, Pseudomonas putida KT2440
cacagaucaacgccgccagcgg

SEQ ID NO: 1607378 - RNA, 16 nt, Pseudomonas putida KT2440
cacagauaaaccugcc

SEQ ID NO: 1607379 - RNA, 20 nt, Pseudomonas putida KT2440
cacagauaaaccugccaccc

SEQ ID NO: 1607380 - RNA, 22 nt, Pseudomonas putida KT2440
cacagauaaaccugccacccau

SEQ ID NO: 1607381 - RNA, 14 nt, Pseudomonas putida KT2440
cacagcaaaaaauc

SEQ ID NO: 1607382 - RNA, 13 nt, Pseudomonas putida KT2440
cacagacaccaca

SEQ ID NO: 1607383 - RNA, 17 nt, Pseudomonas putida KT2440
cacagaccgcaacaguu

SEQ ID NO: 1607384 - RNA, 19 nt, Pseudomonas putida KT2440
cacagccgugccuuccagc

SEQ ID NO: 1607385 - RNA, 17 nt, Pseudomonas putida KT2440
cacagcggcagacacag

SEQ ID NO: 1607386 - RNA, 18 nt, Pseudomonas putida KT2440
cacagcggcagacacagg

SEQ ID NO: 1607387 - RNA, 20 nt, Pseudomonas putida KT2440
cacagcggcagacacaggcg

SEQ ID NO: 1607388 - RNA, 14 nt, Pseudomonas putida KT2440
cacagcugccggcc

SEQ ID NO: 1607389 - RNA, 20 nt, Pseudomonas putida KT2440
cacagcugccggccagcgcc

SEQ ID NO: 1607390 - RNA, 16 nt, Pseudomonas putida KT2440
cacagcugcgccagcc

SEQ ID NO: 1607391 - RNA, 17 nt, Pseudomonas putida KT2440
cacagcucgcgcugcca

SEQ ID NO: 1607392 - RNA, 18 nt, Pseudomonas putida KT2440
cacagcucgcgcugccag

SEQ ID NO: 1607393 - RNA, 19 nt, Pseudomonas putida KT2440
cacagccauuggcccacgc

SEQ ID NO: 1607394 - RNA, 22 nt, Pseudomonas putida KT2440
cacagcaucacccgcgaaugcu

SEQ ID NO: 1607395 - RNA, 18 nt, Pseudomonas putida KT2440
cacagcaucagcacacgc

SEQ ID NO: 1607396 - RNA, 19 nt, Pseudomonas putida KT2440
cacagcaucagcacacgcc

SEQ ID NO: 1607397 - RNA, 12 nt, Pseudomonas putida KT2440
cacagccaagcc

SEQ ID NO: 1607398 - RNA, 15 nt, Pseudomonas putida KT2440
cacagugcggcggca

SEQ ID NO: 1607399 - RNA, 18 nt, Pseudomonas putida KT2440
cacagugguguacagcaa

SEQ ID NO: 1607400 - RNA, 20 nt, Pseudomonas putida KT2440
cacagugguguacagcaaca

SEQ ID NO: 1607401 - RNA, 15 nt, Pseudomonas putida KT2440
cacagugucccggcc

SEQ ID NO: 1607402 - RNA, 20 nt, Pseudomonas putida KT2440
cacauacugcuucugccguu

SEQ ID NO: 1607403 - RNA, 20 nt, Pseudomonas putida KT2440
cacauagucgauacccaggc

SEQ ID NO: 1607404 - RNA, 13 nt, Pseudomonas putida KT2440
cacauaaggcagc

SEQ ID NO: 1607405 - RNA, 14 nt, Pseudomonas putida KT2440
cacaggcccagcaa

SEQ ID NO: 1607406 - RNA, 19 nt, Pseudomonas putida KT2440
cacaggcccagcaacagcc

SEQ ID NO: 1607407 - RNA, 14 nt, Pseudomonas putida KT2440
cacaggcccagcau

SEQ ID NO: 1607408 - RNA, 14 nt, Pseudomonas putida KT2440
cacaggcgcagcag

SEQ ID NO: 1607409 - RNA, 15 nt, Pseudomonas putida KT2440
cacaggcgcugaaac

SEQ ID NO: 1607410 - RNA, 18 nt, Pseudomonas putida KT2440
cacaggcuacgcagcacc

SEQ ID NO: 1607411 - RNA, 21 nt, Pseudomonas putida KT2440
cacaggcuacgcagcacccgg

SEQ ID NO: 1607412 - RNA, 13 nt, Pseudomonas putida KT2440
cacaggccgucgu

SEQ ID NO: 1607413 - RNA, 19 nt, Pseudomonas putida KT2440
cacaggcggauguucuuga

SEQ ID NO: 1607414 - RNA, 23 nt, Pseudomonas putida KT2440
cacaggccagccagguauggcca

SEQ ID NO: 1607415 - RNA, 15 nt, Pseudomonas putida KT2440
cacaggccagcccca

SEQ ID NO: 1607416 - RNA, 16 nt, Pseudomonas putida KT2440
cacaggccagccccag

SEQ ID NO: 1607417 - RNA, 17 nt, Pseudomonas putida KT2440
cacaggccagccccagc

SEQ ID NO: 1607418 - RNA, 14 nt, Pseudomonas putida KT2440
cacaggcacaggcc

SEQ ID NO: 1607419 - RNA, 17 nt, Pseudomonas putida KT2440
cacaggcacaggcccag

SEQ ID NO: 1607420 - RNA, 19 nt, Pseudomonas putida KT2440
cacaggaaucaccagaccu

SEQ ID NO: 1607421 - RNA, 16 nt, Pseudomonas putida KT2440
cacagguccagccgcc

SEQ ID NO: 1607422 - RNA, 17 nt, Pseudomonas putida KT2440
cacagguccagccgcca

SEQ ID NO: 1607423 - RNA, 15 nt, Pseudomonas putida KT2440
cacaggucauuugca

SEQ ID NO: 1607424 - RNA, 22 nt, Pseudomonas putida KT2440
cacagguaauacgcugugcucu

SEQ ID NO: 1607425 - RNA, 18 nt, Pseudomonas putida KT2440
cacagguacucgcaagcu

SEQ ID NO: 1607426 - RNA, 15 nt, Pseudomonas putida KT2440
cacagguaguucacu

SEQ ID NO: 1607427 - RNA, 23 nt, Pseudomonas putida KT2440
cacagguaguucacuggccagca

SEQ ID NO: 1607428 - RNA, 17 nt, Pseudomonas putida KT2440
cacagguaucgccgccc

SEQ ID NO: 1607429 - RNA, 18 nt, Pseudomonas putida KT2440
cacagguaucgccgcccu

SEQ ID NO: 1607430 - RNA, 21 nt, Pseudomonas putida KT2440
cacagguaucgccgcccuugg

SEQ ID NO: 1607431 - RNA, 15 nt, Pseudomonas putida KT2440
cacaggugacaagcu

SEQ ID NO: 1607432 - RNA, 19 nt, Pseudomonas putida KT2440
cacaggggccgcgcagccu

SEQ ID NO: 1607433 - RNA, 16 nt, Pseudomonas putida KT2440
cacagggcggccaagg

SEQ ID NO: 1607434 - RNA, 23 nt, Pseudomonas putida KT2440
cacagggcggccaaggcguggcu

SEQ ID NO: 1607435 - RNA, 18 nt, Pseudomonas putida KT2440
cacaggcuggccaccaug

SEQ ID NO: 1607436 - RNA, 20 nt, Pseudomonas putida KT2440
cacaggcuuacaacugcucc

SEQ ID NO: 1607437 - RNA, 15 nt, Pseudomonas putida KT2440
cacagggaccgugca

SEQ ID NO: 1607438 - RNA, 16 nt, Pseudomonas putida KT2440
cacacauaucagccaa

SEQ ID NO: 1607439 - RNA, 20 nt, Pseudomonas putida KT2440
cacacauaucagccaacacc

SEQ ID NO: 1607440 - RNA, 17 nt, Pseudomonas putida KT2440
cacacaccgcaacccag

SEQ ID NO: 1607441 - RNA, 20 nt, Pseudomonas putida KT2440
cacacaccgcaacccagccc

SEQ ID NO: 1607442 - RNA, 21 nt, Pseudomonas putida KT2440
cacaaggugcuacggaacugc

SEQ ID NO: 1607443 - RNA, 16 nt, Pseudomonas putida KT2440
cacaaggccgcuccca

SEQ ID NO: 1607444 - RNA, 23 nt, Pseudomonas putida KT2440
cacaaggcuguuccacagcaguc

SEQ ID NO: 1607445 - RNA, 12 nt, Pseudomonas putida KT2440
cacaaguuucaa

SEQ ID NO: 1607446 - RNA, 15 nt, Pseudomonas putida KT2440
cacaauaagaugcgg

SEQ ID NO: 1607447 - RNA, 19 nt, Pseudomonas putida KT2440
cacaauaagaugcggcgcc

SEQ ID NO: 1607448 - RNA, 22 nt, Pseudomonas putida KT2440
cacaauaagaugcggcgccguc

SEQ ID NO: 1607449 - RNA, 20 nt, Pseudomonas putida KT2440
cacaccgagccauugacccg

SEQ ID NO: 1607450 - RNA, 19 nt, Pseudomonas putida KT2440
cacaccgcaacccagcccc

SEQ ID NO: 1607451 - RNA, 22 nt, Pseudomonas putida KT2440
cacaccccagaacggcacgccc

SEQ ID NO: 1607452 - RNA, 11 nt, Pseudomonas putida KT2440
cacacccaggc

SEQ ID NO: 1607453 - RNA, 19 nt, Pseudomonas putida KT2440
cacaccgcgcaccucgacc

SEQ ID NO: 1607454 - RNA, 13 nt, Pseudomonas putida KT2440
cacacgaccuugg

SEQ ID NO: 1607455 - RNA, 13 nt, Pseudomonas putida KT2440
cacacgcaccacc

SEQ ID NO: 1607456 - RNA, 14 nt, Pseudomonas putida KT2440
cacacgcaccaccc

SEQ ID NO: 1607457 - RNA, 15 nt, Pseudomonas putida KT2440
cacacgcaccacccc

SEQ ID NO: 1607458 - RNA, 22 nt, Pseudomonas putida KT2440
cacacuacacgaucacuccugg

SEQ ID NO: 1607459 - RNA, 19 nt, Pseudomonas putida KT2440
cacacucagccgcugcgcc

SEQ ID NO: 1607460 - RNA, 17 nt, Pseudomonas putida KT2440
cacacggcagccccaac

SEQ ID NO: 1607461 - RNA, 20 nt, Pseudomonas putida KT2440
cacacgguaggcgucuucca

SEQ ID NO: 1607462 - RNA, 21 nt, Pseudomonas putida KT2440
cacacgguaggcgucuuccac

SEQ ID NO: 1607463 - RNA, 16 nt, Pseudomonas putida KT2440
cacacgguuuccaggc

SEQ ID NO: 1607464 - RNA, 18 nt, Pseudomonas putida KT2440
cacacgguuuccaggcgu

SEQ ID NO: 1607465 - RNA, 21 nt, Pseudomonas putida KT2440
cacagaacaauaaaacuaccu

SEQ ID NO: 1607466 - RNA, 18 nt, Pseudomonas putida KT2440
cacagaacaccaccaguu

SEQ ID NO: 1607467 - RNA, 14 nt, Pseudomonas putida KT2440
cacacugcccagca

SEQ ID NO: 1607468 - RNA, 22 nt, Pseudomonas putida KT2440
cacacugucccggcacaaccga

SEQ ID NO: 1607469 - RNA, 20 nt, Pseudomonas putida KT2440
cacacuggucacgcucggcc

SEQ ID NO: 1607470 - RNA, 12 nt, Pseudomonas putida KT2440
cacacugcgcuu

SEQ ID NO: 1607471 - RNA, 16 nt, Pseudomonas putida KT2440
cacacugcucgucaaa

SEQ ID NO: 1607472 - RNA, 15 nt, Pseudomonas putida KT2440
cacaacgcgcauccc

SEQ ID NO: 1607473 - RNA, 22 nt, Pseudomonas putida KT2440
cacaacgcgccaccgccgugcc

SEQ ID NO: 1607474 - RNA, 15 nt, Pseudomonas putida KT2440
cacaacggcgcgccc

SEQ ID NO: 1607475 - RNA, 19 nt, Pseudomonas putida KT2440
cacaacggcgcgcccggcg

SEQ ID NO: 1607476 - RNA, 22 nt, Pseudomonas putida KT2440
cacaacccggggaaagguuugu

SEQ ID NO: 1607477 - RNA, 13 nt, Pseudomonas putida KT2440
cacaaagcccaag

SEQ ID NO: 1607478 - RNA, 16 nt, Pseudomonas putida KT2440
cacaaagcccaagggc

SEQ ID NO: 1607479 - RNA, 22 nt, Pseudomonas putida KT2440
cacaaaugcgcgaguuuccggc

SEQ ID NO: 1607480 - RNA, 21 nt, Pseudomonas putida KT2440
cacaaacaccggccccccagc

SEQ ID NO: 1607481 - RNA, 16 nt, Pseudomonas putida KT2440
cacaaacaaccgugaa

SEQ ID NO: 1607482 - RNA, 22 nt, Pseudomonas putida KT2440
cacaaacgccgggcacaucacc

SEQ ID NO: 1607483 - RNA, 12 nt, Pseudomonas putida KT2440
cacaaaccacag

SEQ ID NO: 1607484 - RNA, 20 nt, Pseudomonas putida KT2440
cacaaaccacagcggccaca

SEQ ID NO: 1607485 - RNA, 13 nt, Pseudomonas putida KT2440
cacaaaaaacccg

SEQ ID NO: 1607486 - RNA, 23 nt, Pseudomonas putida KT2440
cacaaaaccucaguuuuucuccg

SEQ ID NO: 1607487 - RNA, 18 nt, Pseudomonas putida KT2440
caauuuucgaccaaggcu

SEQ ID NO: 1607488 - RNA, 15 nt, Pseudomonas putida KT2440
caaucagcucacagg

SEQ ID NO: 1607489 - RNA, 18 nt, Pseudomonas putida KT2440
caaucagcucacaggcuc

SEQ ID NO: 1607490 - RNA, 18 nt, Pseudomonas putida KT2440
caaucagggauacugcug

SEQ ID NO: 1607491 - RNA, 21 nt, Pseudomonas putida KT2440
caaucagcacugugcucgccc

SEQ ID NO: 1607492 - RNA, 19 nt, Pseudomonas putida KT2440
caaucagcaucagugcagg

SEQ ID NO: 1607493 - RNA, 21 nt, Pseudomonas putida KT2440
caaucaggucucccgcccccu

SEQ ID NO: 1607494 - RNA, 15 nt, Pseudomonas putida KT2440
caauucagcacaggc

SEQ ID NO: 1607495 - RNA, 15 nt, Pseudomonas putida KT2440
caauucggccggcca

SEQ ID NO: 1607496 - RNA, 14 nt, Pseudomonas putida KT2440
caauuccaaugaga

SEQ ID NO: 1607497 - RNA, 21 nt, Pseudomonas putida KT2440
caauugcggacucauagcuca

SEQ ID NO: 1607498 - RNA, 17 nt, Pseudomonas putida KT2440
caauugcgccagccgcu

SEQ ID NO: 1607499 - RNA, 22 nt, Pseudomonas putida KT2440
caauuggcgguuuuuugccuga

SEQ ID NO: 1607500 - RNA, 16 nt, Pseudomonas putida KT2440
caauugcucuuguucc

SEQ ID NO: 1607501 - RNA, 17 nt, Pseudomonas putida KT2440
caauugcggguguggcc

SEQ ID NO: 1607502 - RNA, 22 nt, Pseudomonas putida KT2440
caauugcggguguggccacacu

SEQ ID NO: 1607503 - RNA, 17 nt, Pseudomonas putida KT2440
caauugguuaaaagcca

SEQ ID NO: 1607504 - RNA, 18 nt, Pseudomonas putida KT2440
caauugguuaaaagccaa

SEQ ID NO: 1607505 - RNA, 21 nt, Pseudomonas putida KT2440
auccuuggcgaaggcugccug

SEQ ID NO: 1607506 - RNA, 22 nt, Pseudomonas putida KT2440
auccuugaagaacaccugcagc

SEQ ID NO: 1607507 - RNA, 15 nt, Pseudomonas putida KT2440
auccuguuguuggau

SEQ ID NO: 1607508 - RNA, 15 nt, Pseudomonas putida KT2440
aucgaagcagcagcu

SEQ ID NO: 1607509 - RNA, 16 nt, Pseudomonas putida KT2440
aucgaauucagugucc

SEQ ID NO: 1607510 - RNA, 14 nt, Pseudomonas putida KT2440
aucgaaugaucgaa

SEQ ID NO: 1607511 - RNA, 16 nt, Pseudomonas putida KT2440
aucgacgcaaugaucg

SEQ ID NO: 1607512 - RNA, 16 nt, Pseudomonas putida KT2440
aucgaccugcaggccc

SEQ ID NO: 1607513 - RNA, 13 nt, Pseudomonas putida KT2440
aucgacgaugccg

SEQ ID NO: 1607514 - RNA, 16 nt, Pseudomonas putida KT2440
aucgacaaccccagcc

SEQ ID NO: 1607515 - RNA, 20 nt, Pseudomonas putida KT2440
aucgacaaccccagcccgaa

SEQ ID NO: 1607516 - RNA, 21 nt, Pseudomonas putida KT2440
aucgccaaucagguuguucac

SEQ ID NO: 1607517 - RNA, 16 nt, Pseudomonas putida KT2440
aucgaugagcgagccc

SEQ ID NO: 1607518 - RNA, 16 nt, Pseudomonas putida KT2440
aucgaucaggaaggca

SEQ ID NO: 1607519 - RNA, 17 nt, Pseudomonas putida KT2440
aucgaucaggaaggcac

SEQ ID NO: 1607520 - RNA, 15 nt, Pseudomonas putida KT2440
aucgauccccaguuc

SEQ ID NO: 1607521 - RNA, 13 nt, Pseudomonas putida KT2440
aucgacuggaugc

SEQ ID NO: 1607522 - RNA, 17 nt, Pseudomonas putida KT2440
aucgacucaaggauguc

SEQ ID NO: 1607523 - RNA, 20 nt, Pseudomonas putida KT2440
aucgccagggcucaagacag

SEQ ID NO: 1607524 - RNA, 14 nt, Pseudomonas putida KT2440
aucgccagccccag

SEQ ID NO: 1607525 - RNA, 21 nt, Pseudomonas putida KT2440
aucgccagccccagcccggug

SEQ ID NO: 1607526 - RNA, 11 nt, Pseudomonas putida KT2440
aucgccaggcc

SEQ ID NO: 1607527 - RNA, 16 nt, Pseudomonas putida KT2440
aucgccaggcccagcc

SEQ ID NO: 1607528 - RNA, 21 nt, Pseudomonas putida KT2440
aucgccaggcccagccccgca

SEQ ID NO: 1607529 - RNA, 16 nt, Pseudomonas putida KT2440
aucgccaaccccaacc

SEQ ID NO: 1607530 - RNA, 19 nt, Pseudomonas putida KT2440
aucgccagcaggccgccga

SEQ ID NO: 1607531 - RNA, 17 nt, Pseudomonas putida KT2440
aucgccucggcacugca

SEQ ID NO: 1607532 - RNA, 14 nt, Pseudomonas putida KT2440
aucgccgcaaccgc

SEQ ID NO: 1607533 - RNA, 21 nt, Pseudomonas putida KT2440
aucggcaguagagcccccagc

SEQ ID NO: 1607534 - RNA, 20 nt, Pseudomonas putida KT2440
aucggcaggcgguccagcaa

SEQ ID NO: 1607535 - RNA, 22 nt, Pseudomonas putida KT2440
aucggcaggcgguccagcaagc

SEQ ID NO: 1607536 - RNA, 20 nt, Pseudomonas putida KT2440
aucggcacccgcacaugccu

SEQ ID NO: 1607537 - RNA, 23 nt, Pseudomonas putida KT2440
aucggcacacgguuuccaggcgu

SEQ ID NO: 1607538 - RNA, 22 nt, Pseudomonas putida KT2440
aucggaacgaaaaacuccuuga

SEQ ID NO: 1607539 - RNA, 20 nt, Pseudomonas putida KT2440
aucgcuucgaggauuuucac

SEQ ID NO: 1607540 - RNA, 22 nt, Pseudomonas putida KT2440
aucgcuguccuuggccaacugc

SEQ ID NO: 1607541 - RNA, 16 nt, Pseudomonas putida KT2440
aucgcugugcaacagc

SEQ ID NO: 1607542 - RNA, 20 nt, Pseudomonas putida KT2440
aucgcugugcaacagcgccu

SEQ ID NO: 1607543 - RNA, 17 nt, Pseudomonas putida KT2440
aucgcuaucugaaagaa

SEQ ID NO: 1607544 - RNA, 15 nt, Pseudomonas putida KT2440
aucgcucuggcacuc

SEQ ID NO: 1607545 - RNA, 19 nt, Pseudomonas putida KT2440
aucgcugcccgggcaaagc

SEQ ID NO: 1607546 - RNA, 20 nt, Pseudomonas putida KT2440
aucgcugcccgggcaaagca

SEQ ID NO: 1607547 - RNA, 19 nt, Pseudomonas putida KT2440
aucgcugacuuccagcagc

SEQ ID NO: 1607548 - RNA, 21 nt, Pseudomonas putida KT2440
aucgcugccgccuuggcagcc

SEQ ID NO: 1607549 - RNA, 13 nt, Pseudomonas putida KT2440
aucgcugcgcaug

SEQ ID NO: 1607550 - RNA, 23 nt, Pseudomonas putida KT2440
aucgcugcggccgucgguaaaca

SEQ ID NO: 1607551 - RNA, 15 nt, Pseudomonas putida KT2440
aucguuguaagccau

SEQ ID NO: 1607552 - RNA, 17 nt, Pseudomonas putida KT2440
aucgugaucauccccag

SEQ ID NO: 1607553 - RNA, 20 nt, Pseudomonas putida KT2440
aucgugaucauccccagcau

SEQ ID NO: 1607554 - RNA, 16 nt, Pseudomonas putida KT2440
aucgugaagcaccgcc

SEQ ID NO: 1607555 - RNA, 19 nt, Pseudomonas putida KT2440
aucgucggccccggcccca

SEQ ID NO: 1607556 - RNA, 14 nt, Pseudomonas putida KT2440
aucgucugcaucau

SEQ ID NO: 1607557 - RNA, 16 nt, Pseudomonas putida KT2440
aucgucguaggcgcgg

SEQ ID NO: 1607558 - RNA, 23 nt, Pseudomonas putida KT2440
aucggcgugguccagcguucggc

SEQ ID NO: 1607559 - RNA, 16 nt, Pseudomonas putida KT2440
aucgguuggguuggca

SEQ ID NO: 1607560 - RNA, 22 nt, Pseudomonas putida KT2440
auccuggugaucaacaaaccga

SEQ ID NO: 1607561 - RNA, 18 nt, Pseudomonas putida KT2440
auccugcgugcugugcac

SEQ ID NO: 1607562 - RNA, 21 nt, Pseudomonas putida KT2440
auccugcucgacaagccgcug

SEQ ID NO: 1607563 - RNA, 16 nt, Pseudomonas putida KT2440
auccugcgcggccacu

SEQ ID NO: 1607564 - RNA, 17 nt, Pseudomonas putida KT2440
auccugcacugcaacac

SEQ ID NO: 1607565 - RNA, 14 nt, Pseudomonas putida KT2440
auccugcagccgca

SEQ ID NO: 1607566 - RNA, 19 nt, Pseudomonas putida KT2440
auccugcagccgcaccugc

SEQ ID NO: 1607567 - RNA, 14 nt, Pseudomonas putida KT2440
auccucggccaggc

SEQ ID NO: 1607568 - RNA, 15 nt, Pseudomonas putida KT2440
auccucguccagcuc

SEQ ID NO: 1607569 - RNA, 16 nt, Pseudomonas putida KT2440
auccucugcccgcagc

SEQ ID NO: 1607570 - RNA, 23 nt, Pseudomonas putida KT2440
auccggcgcggccugcuccacaa

SEQ ID NO: 1607571 - RNA, 16 nt, Pseudomonas putida KT2440
auccgucgacucauuu

SEQ ID NO: 1607572 - RNA, 21 nt, Pseudomonas putida KT2440
auccuagguaguaaagccccc

SEQ ID NO: 1607573 - RNA, 20 nt, Pseudomonas putida KT2440
auccucaaaucgcugcggcc

SEQ ID NO: 1607574 - RNA, 18 nt, Pseudomonas putida KT2440
auccguucggcgcgcugc

SEQ ID NO: 1607575 - RNA, 15 nt, Pseudomonas putida KT2440
aucccuguacagauc

SEQ ID NO: 1607576 - RNA, 14 nt, Pseudomonas putida KT2440
auccgaccccagca

SEQ ID NO: 1607577 - RNA, 21 nt, Pseudomonas putida KT2440
auccgcaccccaaggcugcca

SEQ ID NO: 1607578 - RNA, 14 nt, Pseudomonas putida KT2440
auccgcacgcaugu

SEQ ID NO: 1607579 - RNA, 13 nt, Pseudomonas putida KT2440
auccgcagccccg

SEQ ID NO: 1607580 - RNA, 18 nt, Pseudomonas putida KT2440
auccgccaacaccaccuc

SEQ ID NO: 1607581 - RNA, 18 nt, Pseudomonas putida KT2440
auccgccucauccucgcc

SEQ ID NO: 1607582 - RNA, 16 nt, Pseudomonas putida KT2440
aucccccggcccagcc

SEQ ID NO: 1607583 - RNA, 20 nt, Pseudomonas putida KT2440
auccccauguaggagauucu

SEQ ID NO: 1607584 - RNA, 21 nt, Pseudomonas putida KT2440
auccccaaccaugcuggccaa

SEQ ID NO: 1607585 - RNA, 20 nt, Pseudomonas putida KT2440
auccccgccgccagcagcgg

SEQ ID NO: 1607586 - RNA, 17 nt, Pseudomonas putida KT2440
aucccggcgacguucuu

SEQ ID NO: 1607587 - RNA, 21 nt, Pseudomonas putida KT2440
aucccggcgacguucuugccg

SEQ ID NO: 1607588 - RNA, 19 nt, Pseudomonas putida KT2440
aucccgcuucgccagcgcc

SEQ ID NO: 1607589 - RNA, 20 nt, Pseudomonas putida KT2440
aucccgcuucgccagcgcca

SEQ ID NO: 1607590 - RNA, 20 nt, Pseudomonas putida KT2440
aucccgcucccauagccaau

SEQ ID NO: 1607591 - RNA, 15 nt, Pseudomonas putida KT2440
aucccggucaccugc

SEQ ID NO: 1607592 - RNA, 15 nt, Pseudomonas putida KT2440
auccagcgggaugca

SEQ ID NO: 1607593 - RNA, 20 nt, Pseudomonas putida KT2440
auccagcgccucccccagcg

SEQ ID NO: 1607594 - RNA, 13 nt, Pseudomonas putida KT2440
auccagccuuccg

SEQ ID NO: 1607595 - RNA, 22 nt, Pseudomonas putida KT2440
auccagccggcccggcuggcca

SEQ ID NO: 1607596 - RNA, 15 nt, Pseudomonas putida KT2440
auccagcugcaacag

SEQ ID NO: 1607597 - RNA, 16 nt, Pseudomonas putida KT2440
auccagcugcaacagc

SEQ ID NO: 1607598 - RNA, 14 nt, Pseudomonas putida KT2440
auccagcccaccac

SEQ ID NO: 1607599 - RNA, 13 nt, Pseudomonas putida KT2440
auccagcccggcg

SEQ ID NO: 1607600 - RNA, 18 nt, Pseudomonas putida KT2440
auccagcacugccuggcc

SEQ ID NO: 1607601 - RNA, 22 nt, Pseudomonas putida KT2440
auccagcaggguggccagcaag

SEQ ID NO: 1607602 - RNA, 16 nt, Pseudomonas putida KT2440
auccagguucccccca

SEQ ID NO: 1607603 - RNA, 12 nt, Pseudomonas putida KT2440
auccagggcuuc

SEQ ID NO: 1607604 - RNA, 17 nt, Pseudomonas putida KT2440
auccaggucggugauau

SEQ ID NO: 1607605 - RNA, 16 nt, Pseudomonas putida KT2440
auccaggcuggccagc

SEQ ID NO: 1607606 - RNA, 17 nt, Pseudomonas putida KT2440
auccaggcuggccagca

SEQ ID NO: 1607607 - RNA, 21 nt, Pseudomonas putida KT2440
auccaguucauugcgaaucug

SEQ ID NO: 1607608 - RNA, 23 nt, Pseudomonas putida KT2440
auccaguaccagugcauaaucgu

SEQ ID NO: 1607609 - RNA, 20 nt, Pseudomonas putida KT2440
auccagucgaucagcgacac

SEQ ID NO: 1607610 - RNA, 16 nt, Pseudomonas putida KT2440
auccagucggcgcugg

SEQ ID NO: 1607611 - RNA, 12 nt, Pseudomonas putida KT2440
auccagugcagg

SEQ ID NO: 1607612 - RNA, 18 nt, Pseudomonas putida KT2440
aucccacgcccggccacg

SEQ ID NO: 1607613 - RNA, 23 nt, Pseudomonas putida KT2440
auccaucaccacaaaaccuucca

SEQ ID NO: 1607614 - RNA, 17 nt, Pseudomonas putida KT2440
auccaucuucaccuugc

SEQ ID NO: 1607615 - RNA, 23 nt, Pseudomonas putida KT2440
auccaucuucaccuugccuaccu

SEQ ID NO: 1607616 - RNA, 18 nt, Pseudomonas putida KT2440
auccaccgcgccagccug

SEQ ID NO: 1607617 - RNA, 22 nt, Pseudomonas putida KT2440
auccacuugaagaccgccauga

SEQ ID NO: 1607618 - RNA, 22 nt, Pseudomonas putida KT2440
auccacuugucccggcccagcc

SEQ ID NO: 1607619 - RNA, 19 nt, Pseudomonas putida KT2440
auccacauacugcuucugc

SEQ ID NO: 1607620 - RNA, 14 nt, Pseudomonas putida KT2440
auccacagcggguc

SEQ ID NO: 1607621 - RNA, 15 nt, Pseudomonas putida KT2440
auccacccccaauca

SEQ ID NO: 1607622 - RNA, 13 nt, Pseudomonas putida KT2440
auccacacgcugc

SEQ ID NO: 1607623 - RNA, 17 nt, Pseudomonas putida KT2440
auccacaccagcggcgc

SEQ ID NO: 1607624 - RNA, 17 nt, Pseudomonas putida KT2440
auccacacccucguccc

SEQ ID NO: 1607625 - RNA, 14 nt, Pseudomonas putida KT2440
auccaacgcugccu

SEQ ID NO: 1607626 - RNA, 15 nt, Pseudomonas putida KT2440
auccaaauugcucca

SEQ ID NO: 1607627 - RNA, 17 nt, Pseudomonas putida KT2440
aucauucaggcacggca

SEQ ID NO: 1607628 - RNA, 17 nt, Pseudomonas putida KT2440
aucauguccuugcugcg

SEQ ID NO: 1607629 - RNA, 15 nt, Pseudomonas putida KT2440
aucauuaccugcagg

SEQ ID NO: 1607630 - RNA, 17 nt, Pseudomonas putida KT2440
aucaugaacgaggacug

SEQ ID NO: 1607631 - RNA, 21 nt, Pseudomonas putida KT2440
aucaugaacgaggacugcacc

SEQ ID NO: 1607632 - RNA, 22 nt, Pseudomonas putida KT2440
aucaugauggucacgcggccgu

SEQ ID NO: 1607633 - RNA, 12 nt, Pseudomonas putida KT2440
aucaugguguuc

SEQ ID NO: 1607634 - RNA, 15 nt, Pseudomonas putida KT2440
aucaugcgcuggcca

SEQ ID NO: 1607635 - RNA, 19 nt, Pseudomonas putida KT2440
aucaugcaguucuaccagc

SEQ ID NO: 1607636 - RNA, 19 nt, Pseudomonas putida KT2440
aucaucacacucgccccca

SEQ ID NO: 1607637 - RNA, 16 nt, Pseudomonas putida KT2440
aucaucagacagaagc

SEQ ID NO: 1607638 - RNA, 17 nt, Pseudomonas putida KT2440
aucaucagaccgccgau

SEQ ID NO: 1607639 - RNA, 15 nt, Pseudomonas putida KT2440
aucaucggcacgccc

SEQ ID NO: 1607640 - RNA, 20 nt, Pseudomonas putida KT2440
aucaucggcacgcccagcaa

SEQ ID NO: 1607641 - RNA, 21 nt, Pseudomonas putida KT2440
aucaucggcacgcccagcaac

SEQ ID NO: 1607642 - RNA, 22 nt, Pseudomonas putida KT2440
aucaucggcacgcccagcaacu

SEQ ID NO: 1607643 - RNA, 18 nt, Pseudomonas putida KT2440
aucaucggcaugcagcgg

SEQ ID NO: 1607644 - RNA, 14 nt, Pseudomonas putida KT2440
aucaucucugccga

SEQ ID NO: 1607645 - RNA, 13 nt, Pseudomonas putida KT2440
aucaucugcugau

SEQ ID NO: 1607646 - RNA, 22 nt, Pseudomonas putida KT2440
aucaucgaagccaguacgcagg

SEQ ID NO: 1607647 - RNA, 18 nt, Pseudomonas putida KT2440
aucaucgagauguggccc

SEQ ID NO: 1607648 - RNA, 21 nt, Pseudomonas putida KT2440
aucaucgccaccggcauuccc

SEQ ID NO: 1607649 - RNA, 15 nt, Pseudomonas putida KT2440
aucaucgccagcagc

SEQ ID NO: 1607650 - RNA, 16 nt, Pseudomonas putida KT2440
aucagugcaggugcac

SEQ ID NO: 1607651 - RNA, 23 nt, Pseudomonas putida KT2440
aucagugcaggugcacuguugcu

SEQ ID NO: 1607652 - RNA, 17 nt, Pseudomonas putida KT2440
aucagugcccccgccac

SEQ ID NO: 1607653 - RNA, 20 nt, Pseudomonas putida KT2440
aucaggguuugcagcucacc

SEQ ID NO: 1607654 - RNA, 13 nt, Pseudomonas putida KT2440
aucagguggauca

SEQ ID NO: 1607655 - RNA, 18 nt, Pseudomonas putida KT2440
aucagguugcccgcaugc

SEQ ID NO: 1607656 - RNA, 13 nt, Pseudomonas putida KT2440
aucaguaccaggc

SEQ ID NO: 1607657 - RNA, 16 nt, Pseudomonas putida KT2440
aucaguaaguugaaug

SEQ ID NO: 1607658 - RNA, 17 nt, Pseudomonas putida KT2440
aucaggcgauucaggcu

SEQ ID NO: 1607659 - RNA, 23 nt, Pseudomonas putida KT2440
aucaggccuucggugcuggcgcu

SEQ ID NO: 1607660 - RNA, 22 nt, Pseudomonas putida KT2440
aucagggauacugcugaaccug

SEQ ID NO: 1607661 - RNA, 22 nt, Pseudomonas putida KT2440
aucagggaugcuggacagcagg

SEQ ID NO: 1607662 - RNA, 22 nt, Pseudomonas putida KT2440
aucaggcugaucaccgccgcca

SEQ ID NO: 1607663 - RNA, 22 nt, Pseudomonas putida KT2440
aucaggcuggcgacgccacccc

SEQ ID NO: 1607664 - RNA, 19 nt, Pseudomonas putida KT2440
aucaggauugccgcagcug

SEQ ID NO: 1607665 - RNA, 14 nt, Pseudomonas putida KT2440
aucaggaacagcuc

SEQ ID NO: 1607666 - RNA, 18 nt, Pseudomonas putida KT2440
aucaggcagcucaaagag

SEQ ID NO: 1607667 - RNA, 17 nt, Pseudomonas putida KT2440
aucaggcaggccagcac

SEQ ID NO: 1607668 - RNA, 19 nt, Pseudomonas putida KT2440
aucaggccgaugccaagca

SEQ ID NO: 1607669 - RNA, 16 nt, Pseudomonas putida KT2440
aucaggcccggcugaa

SEQ ID NO: 1607670 - RNA, 19 nt, Pseudomonas putida KT2440
aucaggcaugccagcagcu

SEQ ID NO: 1607671 - RNA, 22 nt, Pseudomonas putida KT2440
aucaggcaugccagcagcuggc

SEQ ID NO: 1607672 - RNA, 22 nt, Pseudomonas putida KT2440
aucaggaagccccgcgcgucca

SEQ ID NO: 1607673 - RNA, 20 nt, Pseudomonas putida KT2440
aucaggaaggcaccacggaa

SEQ ID NO: 1607674 - RNA, 21 nt, Pseudomonas putida KT2440
aucaggaaggcgucguacagg

SEQ ID NO: 1607675 - RNA, 18 nt, Pseudomonas putida KT2440
aucaauccucugcccgca

SEQ ID NO: 1607676 - RNA, 16 nt, Pseudomonas putida KT2440
augcgccccccaggcg

SEQ ID NO: 1607677 - RNA, 18 nt, Pseudomonas putida KT2440
augcgccccguccacagc

SEQ ID NO: 1607678 - RNA, 19 nt, Pseudomonas putida KT2440
augcgcccgccgcccgcgg

SEQ ID NO: 1607679 - RNA, 18 nt, Pseudomonas putida KT2440
augcgccgggacagcacc

SEQ ID NO: 1607680 - RNA, 22 nt, Pseudomonas putida KT2440
augcgccgggacagcaccaugc

SEQ ID NO: 1607681 - RNA, 15 nt, Pseudomonas putida KT2440
augcgcccaucucag

SEQ ID NO: 1607682 - RNA, 21 nt, Pseudomonas putida KT2440
augcgcgauucguagcgguug

SEQ ID NO: 1607683 - RNA, 14 nt, Pseudomonas putida KT2440
augcgcgugcauuu

SEQ ID NO: 1607684 - RNA, 22 nt, Pseudomonas putida KT2440
augcgcuucauccagcgggaug

SEQ ID NO: 1607685 - RNA, 20 nt, Pseudomonas putida KT2440
augcggauauaaccccauac

SEQ ID NO: 1607686 - RNA, 17 nt, Pseudomonas putida KT2440
augcggauguaguucuu

SEQ ID NO: 1607687 - RNA, 20 nt, Pseudomonas putida KT2440
augcaugcguugcacgugca

SEQ ID NO: 1607688 - RNA, 17 nt, Pseudomonas putida KT2440
augcgguagugcaggcg

SEQ ID NO: 1607689 - RNA, 21 nt, Pseudomonas putida KT2440
augcgggggccccaccaggca

SEQ ID NO: 1607690 - RNA, 22 nt, Pseudomonas putida KT2440
augcgggcuuuuuuuguuggcc

SEQ ID NO: 1607691 - RNA, 20 nt, Pseudomonas putida KT2440
augcggcucuguuucugccc

SEQ ID NO: 1607692 - RNA, 23 nt, Pseudomonas putida KT2440
augcguagguuauuggccagguc

SEQ ID NO: 1607693 - RNA, 15 nt, Pseudomonas putida KT2440
augcgugaaacgcag

SEQ ID NO: 1607694 - RNA, 16 nt, Pseudomonas putida KT2440
augcucgucagccccu

SEQ ID NO: 1607695 - RNA, 19 nt, Pseudomonas putida KT2440
augcuccggcgacagcuca

SEQ ID NO: 1607696 - RNA, 15 nt, Pseudomonas putida KT2440
augcucggccagcuc

SEQ ID NO: 1607697 - RNA, 17 nt, Pseudomonas putida KT2440
augcucggccagcucgc

SEQ ID NO: 1607698 - RNA, 19 nt, Pseudomonas putida KT2440
augcuccugcgccaccucg

SEQ ID NO: 1607699 - RNA, 22 nt, Pseudomonas putida KT2440
augcucgcgggccuggagcaag

SEQ ID NO: 1607700 - RNA, 13 nt, Pseudomonas putida KT2440
augcucaggaaca

SEQ ID NO: 1607701 - RNA, 14 nt, Pseudomonas putida KT2440
augcucaggaacau

SEQ ID NO: 1607702 - RNA, 18 nt, Pseudomonas putida KT2440
augcucaagcgccagggc

SEQ ID NO: 1607703 - RNA, 15 nt, Pseudomonas putida KT2440
augcuguugugcgau

SEQ ID NO: 1607704 - RNA, 16 nt, Pseudomonas putida KT2440
augcugguguguugaa

SEQ ID NO: 1607705 - RNA, 14 nt, Pseudomonas putida KT2440
augcuggucgccgu

SEQ ID NO: 1607706 - RNA, 23 nt, Pseudomonas putida KT2440
augcuugcgcggcaccggcuuga

SEQ ID NO: 1607707 - RNA, 20 nt, Pseudomonas putida KT2440
augcuucggcugaucucuuc

SEQ ID NO: 1607708 - RNA, 14 nt, Pseudomonas putida KT2440
augcuggccaaggu

SEQ ID NO: 1607709 - RNA, 13 nt, Pseudomonas putida KT2440
augcuggccagga

SEQ ID NO: 1607710 - RNA, 16 nt, Pseudomonas putida KT2440
augcugcugcagugcc

SEQ ID NO: 1607711 - RNA, 12 nt, Pseudomonas putida KT2440
augcugcugccc

SEQ ID NO: 1607712 - RNA, 22 nt, Pseudomonas putida KT2440
augcugcucgcccgcccgcuuc

SEQ ID NO: 1607713 - RNA, 13 nt, Pseudomonas putida KT2440
augcugccaggca

SEQ ID NO: 1607714 - RNA, 19 nt, Pseudomonas putida KT2440
augcugccaugcaaggcaa

SEQ ID NO: 1607715 - RNA, 19 nt, Pseudomonas putida KT2440
augcugaugcgguagugca

SEQ ID NO: 1607716 - RNA, 19 nt, Pseudomonas putida KT2440
auggaaauggaauuuggug

SEQ ID NO: 1607717 - RNA, 16 nt, Pseudomonas putida KT2440
augcuuuuaugauccu

SEQ ID NO: 1607718 - RNA, 12 nt, Pseudomonas putida KT2440
auggacgcgcaa

SEQ ID NO: 1607719 - RNA, 19 nt, Pseudomonas putida KT2440
augucuggcaucaaugcaa

SEQ ID NO: 1607720 - RNA, 20 nt, Pseudomonas putida KT2440
augugcucggccugggcagg

SEQ ID NO: 1607721 - RNA, 22 nt, Pseudomonas putida KT2440
augugcgcccgaacaacagguc

SEQ ID NO: 1607722 - RNA, 19 nt, Pseudomonas putida KT2440
augugcgccggcuugccuu

SEQ ID NO: 1607723 - RNA, 24 nt, Pseudomonas putida KT2440
augugccgcucguacuggucgagg

SEQ ID NO: 1607724 - RNA, 16 nt, Pseudomonas putida KT2440
augugccggcuggaca

SEQ ID NO: 1607725 - RNA, 19 nt, Pseudomonas putida KT2440
augugcgagcccuugucca

SEQ ID NO: 1607726 - RNA, 22 nt, Pseudomonas putida KT2440
augugcgagcccuuguccaggu

SEQ ID NO: 1607727 - RNA, 22 nt, Pseudomonas putida KT2440
auguguccgccacaacccuugc

SEQ ID NO: 1607728 - RNA, 16 nt, Pseudomonas putida KT2440
auguucggugcucagg

SEQ ID NO: 1607729 - RNA, 15 nt, Pseudomonas putida KT2440
auguucgcugccagc

SEQ ID NO: 1607730 - RNA, 18 nt, Pseudomonas putida KT2440
augucggagcgggcuugc

SEQ ID NO: 1607731 - RNA, 17 nt, Pseudomonas putida KT2440
augucggcagucuugcu

SEQ ID NO: 1607732 - RNA, 20 nt, Pseudomonas putida KT2440
augucggcagucuugcugau

SEQ ID NO: 1607733 - RNA, 16 nt, Pseudomonas putida KT2440
augucaucugaggccc

SEQ ID NO: 1607734 - RNA, 14 nt, Pseudomonas putida KT2440
auguacaaugcacu

SEQ ID NO: 1607735 - RNA, 14 nt, Pseudomonas putida KT2440
auggugacugccag

SEQ ID NO: 1607736 - RNA, 22 nt, Pseudomonas putida KT2440
auggugaaggccaggaacagcg

SEQ ID NO: 1607737 - RNA, 19 nt, Pseudomonas putida KT2440
auggugaugccccugcgcc

SEQ ID NO: 1607738 - RNA, 13 nt, Pseudomonas putida KT2440
auggugcaggggg

SEQ ID NO: 1607739 - RNA, 14 nt, Pseudomonas putida KT2440
augguuauuugauc

SEQ ID NO: 1607740 - RNA, 13 nt, Pseudomonas putida KT2440
augguugaagauc

SEQ ID NO: 1607741 - RNA, 20 nt, Pseudomonas putida KT2440
auggucauugaaggccagug

SEQ ID NO: 1607742 - RNA, 19 nt, Pseudomonas putida KT2440
auggucaccuuguccagca

SEQ ID NO: 1607743 - RNA, 17 nt, Pseudomonas putida KT2440
auggucacgccaucccc

SEQ ID NO: 1607744 - RNA, 22 nt, Pseudomonas putida KT2440
auggucacguagaacaggccug

SEQ ID NO: 1607745 - RNA, 15 nt, Pseudomonas putida KT2440
auggucaacagcccg

SEQ ID NO: 1607746 - RNA, 17 nt, Pseudomonas putida KT2440
augggucacucccggga

SEQ ID NO: 1607747 - RNA, 19 nt, Pseudomonas putida KT2440
auggggccgcugugggagu

SEQ ID NO: 1607748 - RNA, 19 nt, Pseudomonas putida KT2440
auggccgaaaccagccccu

SEQ ID NO: 1607749 - RNA, 16 nt, Pseudomonas putida KT2440
auggccgagccaagag

SEQ ID NO: 1607750 - RNA, 13 nt, Pseudomonas putida KT2440
auggccguucuug

SEQ ID NO: 1607751 - RNA, 15 nt, Pseudomonas putida KT2440
auggccuuucugcuu

SEQ ID NO: 1607752 - RNA, 23 nt, Pseudomonas putida KT2440
auggcaaucccccgcucaugguu

SEQ ID NO: 1607753 - RNA, 17 nt, Pseudomonas putida KT2440
auggcaaacagcaccag

SEQ ID NO: 1607754 - RNA, 22 nt, Pseudomonas putida KT2440
auggcgcaaacccucggccaca

SEQ ID NO: 1607755 - RNA, 14 nt, Pseudomonas putida KT2440
auggcgacuucgug

SEQ ID NO: 1607756 - RNA, 22 nt, Pseudomonas putida KT2440
auggcgaaucagcaugcccagc

SEQ ID NO: 1607757 - RNA, 21 nt, Pseudomonas putida KT2440
auggcggucgaacccagcuug

SEQ ID NO: 1607758 - RNA, 22 nt, Pseudomonas putida KT2440
auggcgucugcguaagguagua

SEQ ID NO: 1607759 - RNA, 14 nt, Pseudomonas putida KT2440
augcagcaagcugg

SEQ ID NO: 1607760 - RNA, 19 nt, Pseudomonas putida KT2440
augcagcagugccagcaac

SEQ ID NO: 1607761 - RNA, 22 nt, Pseudomonas putida KT2440
augcagcagugccagcaacaag

SEQ ID NO: 1607762 - RNA, 15 nt, Pseudomonas putida KT2440
augcacgccacgccc

SEQ ID NO: 1607763 - RNA, 18 nt, Pseudomonas putida KT2440
augaucgagcgcaccugg

SEQ ID NO: 1607764 - RNA, 14 nt, Pseudomonas putida KT2440
augaucgccgccgc

SEQ ID NO: 1607765 - RNA, 16 nt, Pseudomonas putida KT2440
augaucgaaagcgguu

SEQ ID NO: 1607766 - RNA, 23 nt, Pseudomonas putida KT2440
augaucgaaugguuuucggcggu

SEQ ID NO: 1607767 - RNA, 16 nt, Pseudomonas putida KT2440
augaucucgcccauga

SEQ ID NO: 1607768 - RNA, 23 nt, Pseudomonas putida KT2440
augaucgcggcguugucagccuu

SEQ ID NO: 1607769 - RNA, 20 nt, Pseudomonas putida KT2440
augaucaagaaguccuccca

SEQ ID NO: 1607770 - RNA, 18 nt, Pseudomonas putida KT2440
augaggcgaugcagggcu

SEQ ID NO: 1607771 - RNA, 18 nt, Pseudomonas putida KT2440
augauauccauguagcac

SEQ ID NO: 1607772 - RNA, 15 nt, Pseudomonas putida KT2440
augauacggggaggc

SEQ ID NO: 1607773 - RNA, 15 nt, Pseudomonas putida KT2440
augagccuucacugu

SEQ ID NO: 1607774 - RNA, 14 nt, Pseudomonas putida KT2440
augagccggggcuu

SEQ ID NO: 1607775 - RNA, 19 nt, Pseudomonas putida KT2440
augagccuacagcaaccgc

SEQ ID NO: 1607776 - RNA, 14 nt, Pseudomonas putida KT2440
augaacagcgcugc

SEQ ID NO: 1607777 - RNA, 13 nt, Pseudomonas putida KT2440
augaacagcaagu

SEQ ID NO: 1607778 - RNA, 11 nt, Pseudomonas putida KT2440
augaacagcac

SEQ ID NO: 1607779 - RNA, 13 nt, Pseudomonas putida KT2440
augaacagccggc

SEQ ID NO: 1607780 - RNA, 23 nt, Pseudomonas putida KT2440
augacaauugucgguacuggcua

SEQ ID NO: 1607781 - RNA, 15 nt, Pseudomonas putida KT2440
augaccggccgggcu

SEQ ID NO: 1607782 - RNA, 22 nt, Pseudomonas putida KT2440
augaccggccgggcuucaacca

SEQ ID NO: 1607783 - RNA, 17 nt, Pseudomonas putida KT2440
augacccuuccagcccg

SEQ ID NO: 1607784 - RNA, 14 nt, Pseudomonas putida KT2440
augaaaaacaacaa

SEQ ID NO: 1607785 - RNA, 18 nt, Pseudomonas putida KT2440
aucuucggugcccacugc

SEQ ID NO: 1607786 - RNA, 12 nt, Pseudomonas putida KT2440
aucuucgccggc

SEQ ID NO: 1607787 - RNA, 16 nt, Pseudomonas putida KT2440
aucuucgacaguucaa

SEQ ID NO: 1607788 - RNA, 13 nt, Pseudomonas putida KT2440
aucuuccugccac

SEQ ID NO: 1607789 - RNA, 19 nt, Pseudomonas putida KT2440
aucuuccugccacucgucc

SEQ ID NO: 1607790 - RNA, 23 nt, Pseudomonas putida KT2440
aucuucccgggaaaagccugcca

SEQ ID NO: 1607791 - RNA, 15 nt, Pseudomonas putida KT2440
aucuuccagccugca

SEQ ID NO: 1607792 - RNA, 22 nt, Pseudomonas putida KT2440
aucuugcgcgccagcgcaugca

SEQ ID NO: 1607793 - RNA, 19 nt, Pseudomonas putida KT2440
aucuugccggccuugaccu

SEQ ID NO: 1607794 - RNA, 12 nt, Pseudomonas putida KT2440
aucuuguaggcg

SEQ ID NO: 1607795 - RNA, 15 nt, Pseudomonas putida KT2440
aucuuguauuggcca

SEQ ID NO: 1607796 - RNA, 23 nt, Pseudomonas putida KT2440
aucuuguguuuugccuccagcuu

SEQ ID NO: 1607797 - RNA, 20 nt, Pseudomonas putida KT2440
aucuuggugaugcuggcuuc

SEQ ID NO: 1607798 - RNA, 15 nt, Pseudomonas putida KT2440
aucuugcugcucugc

SEQ ID NO: 1607799 - RNA, 13 nt, Pseudomonas putida KT2440
aucugcugcagca

SEQ ID NO: 1607800 - RNA, 17 nt, Pseudomonas putida KT2440
aucugcugcggcaggcu

SEQ ID NO: 1607801 - RNA, 23 nt, Pseudomonas putida KT2440
aucugcugcggcaggcuggcacg

SEQ ID NO: 1607802 - RNA, 12 nt, Pseudomonas putida KT2440
aucugcuugccu

SEQ ID NO: 1607803 - RNA, 13 nt, Pseudomonas putida KT2440
aucuggaucacug

SEQ ID NO: 1607804 - RNA, 19 nt, Pseudomonas putida KT2440
aucuggaugaagucggcaa

SEQ ID NO: 1607805 - RNA, 23 nt, Pseudomonas putida KT2440
aucuggucagucgagucgacagu

SEQ ID NO: 1607806 - RNA, 14 nt, Pseudomonas putida KT2440
aucuguccuccugc

SEQ ID NO: 1607807 - RNA, 16 nt, Pseudomonas putida KT2440
aucuguccuccugccg

SEQ ID NO: 1607808 - RNA, 20 nt, Pseudomonas putida KT2440
aucuggucgaagcucaggua

SEQ ID NO: 1607809 - RNA, 16 nt, Pseudomonas putida KT2440
aucuguugcugcaggu

SEQ ID NO: 1607810 - RNA, 16 nt, Pseudomonas putida KT2440
aucuucaccuugccua

SEQ ID NO: 1607811 - RNA, 18 nt, Pseudomonas putida KT2440
auaucucugguacaacaa

SEQ ID NO: 1607812 - RNA, 15 nt, Pseudomonas putida KT2440
auauccgcuuugcuu

SEQ ID NO: 1607813 - RNA, 18 nt, Pseudomonas putida KT2440
auaucgggauaaccgcag

SEQ ID NO: 1607814 - RNA, 20 nt, Pseudomonas putida KT2440
auaucggcgcggcccaguuu

SEQ ID NO: 1607815 - RNA, 21 nt, Pseudomonas putida KT2440
auauccagugcuucacugccg

SEQ ID NO: 1607816 - RNA, 17 nt, Pseudomonas putida KT2440
auagccuguggggcaac

SEQ ID NO: 1607817 - RNA, 18 nt, Pseudomonas putida KT2440
auagccugcugcucccca

SEQ ID NO: 1607818 - RNA, 24 nt, Pseudomonas putida KT2440
auagucccugauacuucugaccaa

SEQ ID NO: 1607819 - RNA, 20 nt, Pseudomonas putida KT2440
auauagcaccgguaccgcuc

SEQ ID NO: 1607820 - RNA, 14 nt, Pseudomonas putida KT2440
auauggcuccacca

SEQ ID NO: 1607821 - RNA, 14 nt, Pseudomonas putida KT2440
auauugcugagcca

SEQ ID NO: 1607822 - RNA, 16 nt, Pseudomonas putida KT2440
auauugcugagccagu

SEQ ID NO: 1607823 - RNA, 18 nt, Pseudomonas putida KT2440
auauugcugagccaguuc

SEQ ID NO: 1607824 - RNA, 20 nt, Pseudomonas putida KT2440
auauugcugagccaguucac

SEQ ID NO: 1607825 - RNA, 21 nt, Pseudomonas putida KT2440
auauugguccagccacaauuu

SEQ ID NO: 1607826 - RNA, 18 nt, Pseudomonas putida KT2440
aucaauaccggcaugccc

SEQ ID NO: 1607827 - RNA, 13 nt, Pseudomonas putida KT2440
aucaacgguggcc

SEQ ID NO: 1607828 - RNA, 15 nt, Pseudomonas putida KT2440
aucaacugacgcagc

SEQ ID NO: 1607829 - RNA, 23 nt, Pseudomonas putida KT2440
aucaacaaaccgacccugcugcu

SEQ ID NO: 1607830 - RNA, 19 nt, Pseudomonas putida KT2440
auauuucacuuucuugaaa

SEQ ID NO: 1607831 - RNA, 15 nt, Pseudomonas putida KT2440
aucaaaagccccccu

SEQ ID NO: 1607832 - RNA, 18 nt, Pseudomonas putida KT2440
aucaaaagccccccugcc

SEQ ID NO: 1607833 - RNA, 16 nt, Pseudomonas putida KT2440
auacagccagaaagcc

SEQ ID NO: 1607834 - RNA, 14 nt, Pseudomonas putida KT2440
auacaggaccaggc

SEQ ID NO: 1607835 - RNA, 22 nt, Pseudomonas putida KT2440
auacagcuggccuugcggcaag

SEQ ID NO: 1607836 - RNA, 23 nt, Pseudomonas putida KT2440
auacagguucggguaguccucca

SEQ ID NO: 1607837 - RNA, 14 nt, Pseudomonas putida KT2440
auacagggccuggc

SEQ ID NO: 1607838 - RNA, 18 nt, Pseudomonas putida KT2440
auacacuggcuuuccccc

SEQ ID NO: 1607839 - RNA, 15 nt, Pseudomonas putida KT2440
auacacgggacaggc

SEQ ID NO: 1607840 - RNA, 19 nt, Pseudomonas putida KT2440
auaauggucagauaacccu

SEQ ID NO: 1607841 - RNA, 12 nt, Pseudomonas putida KT2440
auaccacggucg

SEQ ID NO: 1607842 - RNA, 23 nt, Pseudomonas putida KT2440
auacccuguugcgucaacucauc

SEQ ID NO: 1607843 - RNA, 16 nt, Pseudomonas putida KT2440
auacccuuugccaucc

SEQ ID NO: 1607844 - RNA, 14 nt, Pseudomonas putida KT2440
auaccccgcugccu

SEQ ID NO: 1607845 - RNA, 14 nt, Pseudomonas putida KT2440
auacccaacagcau

SEQ ID NO: 1607846 - RNA, 13 nt, Pseudomonas putida KT2440
auacccaacucca

SEQ ID NO: 1607847 - RNA, 21 nt, Pseudomonas putida KT2440
auacccaauaaaaacaacagg

SEQ ID NO: 1607848 - RNA, 15 nt, Pseudomonas putida KT2440
auaccgaacaccagu

SEQ ID NO: 1607849 - RNA, 16 nt, Pseudomonas putida KT2440
auaccgauugccucag

SEQ ID NO: 1607850 - RNA, 20 nt, Pseudomonas putida KT2440
auaccgcaacaccugccgca

SEQ ID NO: 1607851 - RNA, 20 nt, Pseudomonas putida KT2440
auaccgcaucccaaugugga

SEQ ID NO: 1607852 - RNA, 18 nt, Pseudomonas putida KT2440
auaccgccuauguacucg

SEQ ID NO: 1607853 - RNA, 17 nt, Pseudomonas putida KT2440
auacgcugugcucuggc

SEQ ID NO: 1607854 - RNA, 19 nt, Pseudomonas putida KT2440
auagccggccucagcagcg

SEQ ID NO: 1607855 - RNA, 13 nt, Pseudomonas putida KT2440
auagaccauuucg

SEQ ID NO: 1607856 - RNA, 16 nt, Pseudomonas putida KT2440
auagaacuccaccagc

SEQ ID NO: 1607857 - RNA, 15 nt, Pseudomonas putida KT2440
auagaacgacuugua

SEQ ID NO: 1607858 - RNA, 19 nt, Pseudomonas putida KT2440
auagaacacuggcaggcuc

SEQ ID NO: 1607859 - RNA, 15 nt, Pseudomonas putida KT2440
auagaacagcaucaa

SEQ ID NO: 1607860 - RNA, 20 nt, Pseudomonas putida KT2440
aguuucaccugaccaucagc

SEQ ID NO: 1607861 - RNA, 16 nt, Pseudomonas putida KT2440
aguuucacuaccaccu

SEQ ID NO: 1607862 - RNA, 17 nt, Pseudomonas putida KT2440
aguuugguuuuuucacu

SEQ ID NO: 1607863 - RNA, 14 nt, Pseudomonas putida KT2440
aguuuucaaugcug

SEQ ID NO: 1607864 - RNA, 11 nt, Pseudomonas putida KT2440
auaaaaacaac

SEQ ID NO: 1607865 - RNA, 20 nt, Pseudomonas putida KT2440
auaaaaaagggccccuucaa

SEQ ID NO: 1607866 - RNA, 20 nt, Pseudomonas putida KT2440
aguugccgaugaugcgggca

SEQ ID NO: 1607867 - RNA, 22 nt, Pseudomonas putida KT2440
aguuggcguccagcagugccau

SEQ ID NO: 1607868 - RNA, 16 nt, Pseudomonas putida KT2440
aguuggcucuguggau

SEQ ID NO: 1607869 - RNA, 19 nt, Pseudomonas putida KT2440
aguugcguggggccugccg

SEQ ID NO: 1607870 - RNA, 23 nt, Pseudomonas putida KT2440
aguugaucaacccgugcccggca

SEQ ID NO: 1607871 - RNA, 15 nt, Pseudomonas putida KT2440
aguugaucucaagcu

SEQ ID NO: 1607872 - RNA, 14 nt, Pseudomonas putida KT2440
aguugagcgccgcg

SEQ ID NO: 1607873 - RNA, 18 nt, Pseudomonas putida KT2440
aguugacccugaaucagc

SEQ ID NO: 1607874 - RNA, 16 nt, Pseudomonas putida KT2440
aguugaguggggugga

SEQ ID NO: 1607875 - RNA, 17 nt, Pseudomonas putida KT2440
aguugagugucagaaaa

SEQ ID NO: 1607876 - RNA, 20 nt, Pseudomonas putida KT2440
aguuuauauccuagguagua

SEQ ID NO: 1607877 - RNA, 20 nt, Pseudomonas putida KT2440
aguuggugagguguugaaau

SEQ ID NO: 1607878 - RNA, 22 nt, Pseudomonas putida KT2440
aguugguagagcaguuggcuuu

SEQ ID NO: 1607879 - RNA, 13 nt, Pseudomonas putida KT2440
aguuguccaggcu

SEQ ID NO: 1607880 - RNA, 13 nt, Pseudomonas putida KT2440
aguuguccggguc

SEQ ID NO: 1607881 - RNA, 14 nt, Pseudomonas putida KT2440
aguggccgaaggcg

SEQ ID NO: 1607882 - RNA, 22 nt, Pseudomonas putida KT2440
aguggccuuguugccacccaga

SEQ ID NO: 1607883 - RNA, 22 nt, Pseudomonas putida KT2440
aguggcggcucgcugaacacgc

SEQ ID NO: 1607884 - RNA, 15 nt, Pseudomonas putida KT2440
aguucagcgcccgca

SEQ ID NO: 1607885 - RNA, 18 nt, Pseudomonas putida KT2440
aguucagcgcccgcaaca

SEQ ID NO: 1607886 - RNA, 20 nt, Pseudomonas putida KT2440
aguucacggaucgccaggac

SEQ ID NO: 1607887 - RNA, 14 nt, Pseudomonas putida KT2440
aguuacagaggcau

SEQ ID NO: 1607888 - RNA, 16 nt, Pseudomonas putida KT2440
aguucuuggcggcugg

SEQ ID NO: 1607889 - RNA, 16 nt, Pseudomonas putida KT2440
aguucuuuguccugcg

SEQ ID NO: 1607890 - RNA, 21 nt, Pseudomonas putida KT2440
aguucuucuuuaagccccugc

SEQ ID NO: 1607891 - RNA, 15 nt, Pseudomonas putida KT2440
aguucggcaccuuuc

SEQ ID NO: 1607892 - RNA, 20 nt, Pseudomonas putida KT2440
aguucgcugcgcaaggcauu

SEQ ID NO: 1607893 - RNA, 14 nt, Pseudomonas putida KT2440
aguucuaccagcag

SEQ ID NO: 1607894 - RNA, 21 nt, Pseudomonas putida KT2440
aguucuaccagcagcucaugc

SEQ ID NO: 1607895 - RNA, 13 nt, Pseudomonas putida KT2440
aguucgccacccg

SEQ ID NO: 1607896 - RNA, 20 nt, Pseudomonas putida KT2440
aguucaggcgcccugcgcca

SEQ ID NO: 1607897 - RNA, 18 nt, Pseudomonas putida KT2440
aguucauuguucuggcca

SEQ ID NO: 1607898 - RNA, 21 nt, Pseudomonas putida KT2440
aguucauuguucuggccaccg

SEQ ID NO: 1607899 - RNA, 19 nt, Pseudomonas putida KT2440
auaaacacgaacaucagca

SEQ ID NO: 1607900 - RNA, 14 nt, Pseudomonas putida KT2440
auaacaagaacaac

SEQ ID NO: 1607901 - RNA, 16 nt, Pseudomonas putida KT2440
auaacaagaacaacac

SEQ ID NO: 1607902 - RNA, 23 nt, Pseudomonas putida KT2440
agucucgacccgucgcugccaaa

SEQ ID NO: 1607903 - RNA, 23 nt, Pseudomonas putida KT2440
agugaagcucgaucugccugccu

SEQ ID NO: 1607904 - RNA, 22 nt, Pseudomonas putida KT2440
agugaggucgggaauugcagcc

SEQ ID NO: 1607905 - RNA, 22 nt, Pseudomonas putida KT2440
agugauaacgcgccgcugccug

SEQ ID NO: 1607906 - RNA, 21 nt, Pseudomonas putida KT2440
agugaucuggcgcagcgggga

SEQ ID NO: 1607907 - RNA, 15 nt, Pseudomonas putida KT2440
agugaugcaucagcu

SEQ ID NO: 1607908 - RNA, 20 nt, Pseudomonas putida KT2440
agugccccaaacggaccgca

SEQ ID NO: 1607909 - RNA, 21 nt, Pseudomonas putida KT2440
agugccccuuggcgaaugcgc

SEQ ID NO: 1607910 - RNA, 16 nt, Pseudomonas putida KT2440
agugcaauaccagccu

SEQ ID NO: 1607911 - RNA, 20 nt, Pseudomonas putida KT2440
agugcaauaccagccuggcc

SEQ ID NO: 1607912 - RNA, 22 nt, Pseudomonas putida KT2440
agugcaccaacgccgauagcca

SEQ ID NO: 1607913 - RNA, 21 nt, Pseudomonas putida KT2440
agugccaaggcuuuuugauug

SEQ ID NO: 1607914 - RNA, 11 nt, Pseudomonas putida KT2440
agugcuguaug

SEQ ID NO: 1607915 - RNA, 23 nt, Pseudomonas putida KT2440
agugcugucacccuugggcacca

SEQ ID NO: 1607916 - RNA, 18 nt, Pseudomonas putida KT2440
agugcuucacugccggca

SEQ ID NO: 1607917 - RNA, 18 nt, Pseudomonas putida KT2440
aguggcagguucgaccac

SEQ ID NO: 1607918 - RNA, 21 nt, Pseudomonas putida KT2440
aguggcagguucgaccacugc

SEQ ID NO: 1607919 - RNA, 23 nt, Pseudomonas putida KT2440
agugcggccgggucgauagccag

SEQ ID NO: 1607920 - RNA, 22 nt, Pseudomonas putida KT2440
agugccgcaagcagucccagca

SEQ ID NO: 1607921 - RNA, 15 nt, Pseudomonas putida KT2440
agugccgccaccugg

SEQ ID NO: 1607922 - RNA, 15 nt, Pseudomonas putida KT2440
agucauucgccggca

SEQ ID NO: 1607923 - RNA, 12 nt, Pseudomonas putida KT2440
agucauuuucau

SEQ ID NO: 1607924 - RNA, 16 nt, Pseudomonas putida KT2440
agucauccgccaggcu

SEQ ID NO: 1607925 - RNA, 22 nt, Pseudomonas putida KT2440
agucauccgccaggcucuccag

SEQ ID NO: 1607926 - RNA, 22 nt, Pseudomonas putida KT2440
agucauccgggccgucaccgcu

SEQ ID NO: 1607927 - RNA, 17 nt, Pseudomonas putida KT2440
agucauccucaggggua

SEQ ID NO: 1607928 - RNA, 20 nt, Pseudomonas putida KT2440
aguccaggucgcggagccaa

SEQ ID NO: 1607929 - RNA, 13 nt, Pseudomonas putida KT2440
aguccaucugcuu

SEQ ID NO: 1607930 - RNA, 17 nt, Pseudomonas putida KT2440
aguccagcaucagcaca

SEQ ID NO: 1607931 - RNA, 23 nt, Pseudomonas putida KT2440
aguccagcaucagcacacccagc

SEQ ID NO: 1607932 - RNA, 12 nt, Pseudomonas putida KT2440
aguccagcugca

SEQ ID NO: 1607933 - RNA, 18 nt, Pseudomonas putida KT2440
aguccaggaagcaggcgu

SEQ ID NO: 1607934 - RNA, 20 nt, Pseudomonas putida KT2440
aguccaaccgcaagcggcuc

SEQ ID NO: 1607935 - RNA, 21 nt, Pseudomonas putida KT2440
agucgagauuugucaacaaaa

SEQ ID NO: 1607936 - RNA, 16 nt, Pseudomonas putida KT2440
agucgauguucagcac

SEQ ID NO: 1607937 - RNA, 19 nt, Pseudomonas putida KT2440
agucgcacagguccagccg

SEQ ID NO: 1607938 - RNA, 16 nt, Pseudomonas putida KT2440
agucgcuuugcgggca

SEQ ID NO: 1607939 - RNA, 17 nt, Pseudomonas putida KT2440
agucggccugaugccuc

SEQ ID NO: 1607940 - RNA, 21 nt, Pseudomonas putida KT2440
agucggcgcuggacagguaga

SEQ ID NO: 1607941 - RNA, 21 nt, Pseudomonas putida KT2440
agucggcucuggcaagauguc

SEQ ID NO: 1607942 - RNA, 19 nt, Pseudomonas putida KT2440
agucgguaugcgcccaucu

SEQ ID NO: 1607943 - RNA, 14 nt, Pseudomonas putida KT2440
aguccugccuucca

SEQ ID NO: 1607944 - RNA, 20 nt, Pseudomonas putida KT2440
aguccugaaugucaucugag

SEQ ID NO: 1607945 - RNA, 19 nt, Pseudomonas putida KT2440
aguccuccaacucgcgcau

SEQ ID NO: 1607946 - RNA, 19 nt, Pseudomonas putida KT2440
aguccucccaguacaugau

SEQ ID NO: 1607947 - RNA, 23 nt, Pseudomonas putida KT2440
aguauucgcuaaccucugcaugc

SEQ ID NO: 1607948 - RNA, 14 nt, Pseudomonas putida KT2440
aguauugcgucagg

SEQ ID NO: 1607949 - RNA, 16 nt, Pseudomonas putida KT2440
aguauuaauuugaaca

SEQ ID NO: 1607950 - RNA, 19 nt, Pseudomonas putida KT2440
aguauggaaauggaauuug

SEQ ID NO: 1607951 - RNA, 17 nt, Pseudomonas putida KT2440
aguauccuccagcccug

SEQ ID NO: 1607952 - RNA, 20 nt, Pseudomonas putida KT2440
aguaucgccccggucagcag

SEQ ID NO: 1607953 - RNA, 18 nt, Pseudomonas putida KT2440
agucaccuugcuccacca

SEQ ID NO: 1607954 - RNA, 16 nt, Pseudomonas putida KT2440
agucaacaggguaggu

SEQ ID NO: 1607955 - RNA, 23 nt, Pseudomonas putida KT2440
agucaggccgaugggcaggccau

SEQ ID NO: 1607956 - RNA, 20 nt, Pseudomonas putida KT2440
agucagugugaccuucaacc

SEQ ID NO: 1607957 - RNA, 17 nt, Pseudomonas putida KT2440
agucagggucucggcca

SEQ ID NO: 1607958 - RNA, 17 nt, Pseudomonas putida KT2440
agucagccagguuuuug

SEQ ID NO: 1607959 - RNA, 14 nt, Pseudomonas putida KT2440
agucagaagcagcu

SEQ ID NO: 1607960 - RNA, 15 nt, Pseudomonas putida KT2440
aguaggcugcagccu

SEQ ID NO: 1607961 - RNA, 14 nt, Pseudomonas putida KT2440
aguaggagcggguu

SEQ ID NO: 1607962 - RNA, 13 nt, Pseudomonas putida KT2440
aguagcuccagcc

SEQ ID NO: 1607963 - RNA, 23 nt, Pseudomonas putida KT2440
aguagccuucuucggucagcugg

SEQ ID NO: 1607964 - RNA, 19 nt, Pseudomonas putida KT2440
aguacuugcaggugcaggg

SEQ ID NO: 1607965 - RNA, 13 nt, Pseudomonas putida KT2440
aguacuccagcag

SEQ ID NO: 1607966 - RNA, 19 nt, Pseudomonas putida KT2440
aguaccugcacacugccca

SEQ ID NO: 1607967 - RNA, 10 nt, Pseudomonas putida KT2440
agcuggcgcg

SEQ ID NO: 1607968 - RNA, 16 nt, Pseudomonas putida KT2440
agcuggcaccggcgcc

SEQ ID NO: 1607969 - RNA, 19 nt, Pseudomonas putida KT2440
agcuggcgcaagccgugcc

SEQ ID NO: 1607970 - RNA, 13 nt, Pseudomonas putida KT2440
agcuggccuugcg

SEQ ID NO: 1607971 - RNA, 16 nt, Pseudomonas putida KT2440
agcuggccguccagcu

SEQ ID NO: 1607972 - RNA, 17 nt, Pseudomonas putida KT2440
agcuggccguccagcug

SEQ ID NO: 1607973 - RNA, 23 nt, Pseudomonas putida KT2440
aguacgcgccugcaccuggcuga

SEQ ID NO: 1607974 - RNA, 15 nt, Pseudomonas putida KT2440
agccggcccuucugc

SEQ ID NO: 1607975 - RNA, 19 nt, Pseudomonas putida KT2440
agccggccgguagcucgcu

SEQ ID NO: 1607976 - RNA, 13 nt, Pseudomonas putida KT2440
agccggccuugcu

SEQ ID NO: 1607977 - RNA, 18 nt, Pseudomonas putida KT2440
agccggcgccgguggcgg

SEQ ID NO: 1607978 - RNA, 15 nt, Pseudomonas putida KT2440
agccggcgcugggcu

SEQ ID NO: 1607979 - RNA, 12 nt, Pseudomonas putida KT2440
agccggcggcca

SEQ ID NO: 1607980 - RNA, 15 nt, Pseudomonas putida KT2440
agccggcuaucggac

SEQ ID NO: 1607981 - RNA, 22 nt, Pseudomonas putida KT2440
agccggcuuugcgucaucauca

SEQ ID NO: 1607982 - RNA, 14 nt, Pseudomonas putida KT2440
agccggcuguggca

SEQ ID NO: 1607983 - RNA, 18 nt, Pseudomonas putida KT2440
agccggcuuccagcgaug

SEQ ID NO: 1607984 - RNA, 17 nt, Pseudomonas putida KT2440
agccggucaucacgcuc

SEQ ID NO: 1607985 - RNA, 22 nt, Pseudomonas putida KT2440
agccggucaucacgcucacgca

SEQ ID NO: 1607986 - RNA, 17 nt, Pseudomonas putida KT2440
agccggucguugagcac

SEQ ID NO: 1607987 - RNA, 14 nt, Pseudomonas putida KT2440
agccggucucccag

SEQ ID NO: 1607988 - RNA, 19 nt, Pseudomonas putida KT2440
agccguggcaacgccacac

SEQ ID NO: 1607989 - RNA, 18 nt, Pseudomonas putida KT2440
agccgugaagaggccagu

SEQ ID NO: 1607990 - RNA, 14 nt, Pseudomonas putida KT2440
agccguugcugggc

SEQ ID NO: 1607991 - RNA, 15 nt, Pseudomonas putida KT2440
agccgugcggccaaa

SEQ ID NO: 1607992 - RNA, 17 nt, Pseudomonas putida KT2440
agccucguucgggcacu

SEQ ID NO: 1607993 - RNA, 20 nt, Pseudomonas putida KT2440
agccucguccaucuugcugc

SEQ ID NO: 1607994 - RNA, 21 nt, Pseudomonas putida KT2440
agccucguccaucuugcugcu

SEQ ID NO: 1607995 - RNA, 20 nt, Pseudomonas putida KT2440
agccugcgcaggcgccgcca

SEQ ID NO: 1607996 - RNA, 22 nt, Pseudomonas putida KT2440
agccugcgcaggcgccgccagc

SEQ ID NO: 1607997 - RNA, 11 nt, Pseudomonas putida KT2440
agccugcacca

SEQ ID NO: 1607998 - RNA, 23 nt, Pseudomonas putida KT2440
agccugcacccgcgcgcccgcgg

SEQ ID NO: 1607999 - RNA, 13 nt, Pseudomonas putida KT2440
agccugcagcacc

SEQ ID NO: 1608000 - RNA, 20 nt, Pseudomonas putida KT2440
agccuccaguugcuccaccu

SEQ ID NO: 1608001 - RNA, 15 nt, Pseudomonas putida KT2440
agccucgacccgcug

SEQ ID NO: 1608002 - RNA, 21 nt, Pseudomonas putida KT2440
agccucgacccgcuggcgacc

SEQ ID NO: 1608003 - RNA, 21 nt, Pseudomonas putida KT2440
agccucgagcgcuuucagccg

SEQ ID NO: 1608004 - RNA, 16 nt, Pseudomonas putida KT2440
agccucaaggccggca

SEQ ID NO: 1608005 - RNA, 22 nt, Pseudomonas putida KT2440
agccucaaugggcuuccccagc

SEQ ID NO: 1608006 - RNA, 20 nt, Pseudomonas putida KT2440
agccucaucagagcgugaag

SEQ ID NO: 1608007 - RNA, 22 nt, Pseudomonas putida KT2440
agccucagcgcccgcugcgccg

SEQ ID NO: 1608008 - RNA, 19 nt, Pseudomonas putida KT2440
agccuacgcccccagccuu

SEQ ID NO: 1608009 - RNA, 17 nt, Pseudomonas putida KT2440
agccguuguacaagcug

SEQ ID NO: 1608010 - RNA, 14 nt, Pseudomonas putida KT2440
agccuaaaggcaug

SEQ ID NO: 1608011 - RNA, 15 nt, Pseudomonas putida KT2440
agccuaaaggcaugc

SEQ ID NO: 1608012 - RNA, 14 nt, Pseudomonas putida KT2440
agcgaauagcaaca

SEQ ID NO: 1608013 - RNA, 19 nt, Pseudomonas putida KT2440
agcgacaggcuugaagcug

SEQ ID NO: 1608014 - RNA, 18 nt, Pseudomonas putida KT2440
agcgacaugccggccacc

SEQ ID NO: 1608015 - RNA, 19 nt, Pseudomonas putida KT2440
agcgacagcugcggcauga

SEQ ID NO: 1608016 - RNA, 18 nt, Pseudomonas putida KT2440
agcgacauaaaaaagccc

SEQ ID NO: 1608017 - RNA, 17 nt, Pseudomonas putida KT2440
agcgacagcaucugcac

SEQ ID NO: 1608018 - RNA, 22 nt, Pseudomonas putida KT2440
agcgacaccgccaacuccuugc

SEQ ID NO: 1608019 - RNA, 13 nt, Pseudomonas putida KT2440
agcgacugcagga

SEQ ID NO: 1608020 - RNA, 17 nt, Pseudomonas putida KT2440
agcgacccugagucugg

SEQ ID NO: 1608021 - RNA, 23 nt, Pseudomonas putida KT2440
agcgagcgguugcacggcccccg

SEQ ID NO: 1608022 - RNA, 15 nt, Pseudomonas putida KT2440
agcgagagcuucaga

SEQ ID NO: 1608023 - RNA, 12 nt, Pseudomonas putida KT2440
agcgagcuugcu

SEQ ID NO: 1608024 - RNA, 19 nt, Pseudomonas putida KT2440
agcgaggcaaucagggcau

SEQ ID NO: 1608025 - RNA, 18 nt, Pseudomonas putida KT2440
agcgaggcgggccgcagg

SEQ ID NO: 1608026 - RNA, 23 nt, Pseudomonas putida KT2440
agcgagguaggccgucagcagca

SEQ ID NO: 1608027 - RNA, 22 nt, Pseudomonas putida KT2440
agcgagcccgcgcgcgaugcgc

SEQ ID NO: 1608028 - RNA, 19 nt, Pseudomonas putida KT2440
agcgagcaccggcaguaca

SEQ ID NO: 1608029 - RNA, 14 nt, Pseudomonas putida KT2440
agcgagcagccugg

SEQ ID NO: 1608030 - RNA, 17 nt, Pseudomonas putida KT2440
agcgagcagccuggcau

SEQ ID NO: 1608031 - RNA, 14 nt, Pseudomonas putida KT2440
agccuuggccagcg

SEQ ID NO: 1608032 - RNA, 14 nt, Pseudomonas putida KT2440
agccuugcugauca

SEQ ID NO: 1608033 - RNA, 19 nt, Pseudomonas putida KT2440
agccuugucucugaacaca

SEQ ID NO: 1608034 - RNA, 13 nt, Pseudomonas putida KT2440
agccuugugcugu

SEQ ID NO: 1608035 - RNA, 18 nt, Pseudomonas putida KT2440
agccuuguucgcgcagga

SEQ ID NO: 1608036 - RNA, 16 nt, Pseudomonas putida KT2440
agccuucgccaacugc

SEQ ID NO: 1608037 - RNA, 13 nt, Pseudomonas putida KT2440
agccuuuuccagc

SEQ ID NO: 1608038 - RNA, 20 nt, Pseudomonas putida KT2440
agccuuuuuucgggcugcug

SEQ ID NO: 1608039 - RNA, 22 nt, Pseudomonas putida KT2440
agccuuuuuucgggcugcugcc

SEQ ID NO: 1608040 - RNA, 23 nt, Pseudomonas putida KT2440
agccuuuuuucgggcugcugccg

SEQ ID NO: 1608041 - RNA, 16 nt, Pseudomonas putida KT2440
agcgaaacaccagcaa

SEQ ID NO: 1608042 - RNA, 17 nt, Pseudomonas putida KT2440
agccugcuccagcaccc

SEQ ID NO: 1608043 - RNA, 16 nt, Pseudomonas putida KT2440
agccuucagugcuuca

SEQ ID NO: 1608044 - RNA, 23 nt, Pseudomonas putida KT2440
agccuuccagcuccuucuucacc

SEQ ID NO: 1608045 - RNA, 17 nt, Pseudomonas putida KT2440
agccuucccccuccuga

SEQ ID NO: 1608046 - RNA, 19 nt, Pseudomonas putida KT2440
agccuucccccuccugaac

SEQ ID NO: 1608047 - RNA, 20 nt, Pseudomonas putida KT2440
agccuuccgggcacuggcug

SEQ ID NO: 1608048 - RNA, 13 nt, Pseudomonas putida KT2440
agccuucagcggc

SEQ ID NO: 1608049 - RNA, 18 nt, Pseudomonas putida KT2440
agccuucaggguuguggu

SEQ ID NO: 1608050 - RNA, 12 nt, Pseudomonas putida KT2440
agccuucagugc

SEQ ID NO: 1608051 - RNA, 23 nt, Pseudomonas putida KT2440
agccgaucacuuccuggccgccu

SEQ ID NO: 1608052 - RNA, 17 nt, Pseudomonas putida KT2440
agccgcaccugcccgcc

SEQ ID NO: 1608053 - RNA, 18 nt, Pseudomonas putida KT2440
agccgcaccugcccgccc

SEQ ID NO: 1608054 - RNA, 16 nt, Pseudomonas putida KT2440
agccgagccaagcgac

SEQ ID NO: 1608055 - RNA, 16 nt, Pseudomonas putida KT2440
agccgacaaaaacaac

SEQ ID NO: 1608056 - RNA, 18 nt, Pseudomonas putida KT2440
agccgacaaaaacaacaa

SEQ ID NO: 1608057 - RNA, 13 nt, Pseudomonas putida KT2440
agcccuugcucgg

SEQ ID NO: 1608058 - RNA, 16 nt, Pseudomonas putida KT2440
agcccuugcucggcca

SEQ ID NO: 1608059 - RNA, 14 nt, Pseudomonas putida KT2440
agcccuugcugcag

SEQ ID NO: 1608060 - RNA, 18 nt, Pseudomonas putida KT2440
agcccuucgccggcacgc

SEQ ID NO: 1608061 - RNA, 17 nt, Pseudomonas putida KT2440
agcccuucgcggcaagc

SEQ ID NO: 1608062 - RNA, 15 nt, Pseudomonas putida KT2440
agccgaacuugucug

SEQ ID NO: 1608063 - RNA, 16 nt, Pseudomonas putida KT2440
agccgaacagcaggca

SEQ ID NO: 1608064 - RNA, 17 nt, Pseudomonas putida KT2440
agcccuugucgaacagc

SEQ ID NO: 1608065 - RNA, 18 nt, Pseudomonas putida KT2440
agccgcuucacuguccug

SEQ ID NO: 1608066 - RNA, 21 nt, Pseudomonas putida KT2440
agccggcacagugccaaggac

SEQ ID NO: 1608067 - RNA, 14 nt, Pseudomonas putida KT2440
agccggcagcaagg

SEQ ID NO: 1608068 - RNA, 17 nt, Pseudomonas putida KT2440
agccggcagucacccac

SEQ ID NO: 1608069 - RNA, 22 nt, Pseudomonas putida KT2440
agccggcaucgccaacagaggc

SEQ ID NO: 1608070 - RNA, 19 nt, Pseudomonas putida KT2440
agccgcgguagugcggccg

SEQ ID NO: 1608071 - RNA, 17 nt, Pseudomonas putida KT2440
agccgcugccacaggua

SEQ ID NO: 1608072 - RNA, 13 nt, Pseudomonas putida KT2440
agccgcuggcccu

SEQ ID NO: 1608073 - RNA, 19 nt, Pseudomonas putida KT2440
agccgcugucgguaaaaca

SEQ ID NO: 1608074 - RNA, 14 nt, Pseudomonas putida KT2440
agccgccagcauca

SEQ ID NO: 1608075 - RNA, 19 nt, Pseudomonas putida KT2440
agccgccauugcccagccu

SEQ ID NO: 1608076 - RNA, 16 nt, Pseudomonas putida KT2440
agccgcccgcccgccu

SEQ ID NO: 1608077 - RNA, 18 nt, Pseudomonas putida KT2440
agccgcccgcccgccugc

SEQ ID NO: 1608078 - RNA, 16 nt, Pseudomonas putida KT2440
agccgccgaccaggug

SEQ ID NO: 1608079 - RNA, 13 nt, Pseudomonas putida KT2440
agcccccagaaug

SEQ ID NO: 1608080 - RNA, 15 nt, Pseudomonas putida KT2440
agccccccuguagga

SEQ ID NO: 1608081 - RNA, 16 nt, Pseudomonas putida KT2440
agccccgagcaaagcc

SEQ ID NO: 1608082 - RNA, 19 nt, Pseudomonas putida KT2440
agccccacgcccaggcggc

SEQ ID NO: 1608083 - RNA, 19 nt, Pseudomonas putida KT2440
agccccaaccuuccagcaa

SEQ ID NO: 1608084 - RNA, 13 nt, Pseudomonas putida KT2440
agccccaaugguu

SEQ ID NO: 1608085 - RNA, 18 nt, Pseudomonas putida KT2440
agccccaaaaaaccgggg

SEQ ID NO: 1608086 - RNA, 23 nt, Pseudomonas putida KT2440
agccccaaaaaaucuagcgcaac

SEQ ID NO: 1608087 - RNA, 18 nt, Pseudomonas putida KT2440
agcccaugaacagcaagu

SEQ ID NO: 1608088 - RNA, 16 nt, Pseudomonas putida KT2440
agcccauccagggcuu

SEQ ID NO: 1608089 - RNA, 23 nt, Pseudomonas putida KT2440
agcccauccagggcuuccugcgg

SEQ ID NO: 1608090 - RNA, 22 nt, Pseudomonas putida KT2440
agcccagcgccaguacggccau

SEQ ID NO: 1608091 - RNA, 13 nt, Pseudomonas putida KT2440
agcccagcccgga

SEQ ID NO: 1608092 - RNA, 14 nt, Pseudomonas putida KT2440
agcccaccgagcuu

SEQ ID NO: 1608093 - RNA, 20 nt, Pseudomonas putida KT2440
agcccaccgucaggcucagc

SEQ ID NO: 1608094 - RNA, 18 nt, Pseudomonas putida KT2440
agccauuggcccacgcuc

SEQ ID NO: 1608095 - RNA, 14 nt, Pseudomonas putida KT2440
agccauugcggcug

SEQ ID NO: 1608096 - RNA, 22 nt, Pseudomonas putida KT2440
agccauugcggcugaauccuag

SEQ ID NO: 1608097 - RNA, 23 nt, Pseudomonas putida KT2440
agcccaaggaagaugaagaaacc

SEQ ID NO: 1608098 - RNA, 15 nt, Pseudomonas putida KT2440
agcccaaggccugca

SEQ ID NO: 1608099 - RNA, 17 nt, Pseudomonas putida KT2440
agcccaaggcuggccag

SEQ ID NO: 1608100 - RNA, 21 nt, Pseudomonas putida KT2440
agcccggcacgguugcgcccg

SEQ ID NO: 1608101 - RNA, 15 nt, Pseudomonas putida KT2440
agcccggcgcagccg

SEQ ID NO: 1608102 - RNA, 16 nt, Pseudomonas putida KT2440
agcccggcgccuaucc

SEQ ID NO: 1608103 - RNA, 20 nt, Pseudomonas putida KT2440
agcccggccgcgccaccggg

SEQ ID NO: 1608104 - RNA, 20 nt, Pseudomonas putida KT2440
agcccgucacgugccuucac

SEQ ID NO: 1608105 - RNA, 13 nt, Pseudomonas putida KT2440
agcccguggcccu

SEQ ID NO: 1608106 - RNA, 12 nt, Pseudomonas putida KT2440
agcccugcccua

SEQ ID NO: 1608107 - RNA, 20 nt, Pseudomonas putida KT2440
agcccuacgcagucagccac

SEQ ID NO: 1608108 - RNA, 16 nt, Pseudomonas putida KT2440
agcccucagugcgaaa

SEQ ID NO: 1608109 - RNA, 13 nt, Pseudomonas putida KT2440
agcccucaaggga

SEQ ID NO: 1608110 - RNA, 19 nt, Pseudomonas putida KT2440
agccccugcggcugcccca

SEQ ID NO: 1608111 - RNA, 17 nt, Pseudomonas putida KT2440
agccccuuccccaggcc

SEQ ID NO: 1608112 - RNA, 17 nt, Pseudomonas putida KT2440
agcccgaagcuaucgcc

SEQ ID NO: 1608113 - RNA, 11 nt, Pseudomonas putida KT2440
agccccuccua

SEQ ID NO: 1608114 - RNA, 15 nt, Pseudomonas putida KT2440
agcccgcacccacag

SEQ ID NO: 1608115 - RNA, 14 nt, Pseudomonas putida KT2440
agcccgccagcagg

SEQ ID NO: 1608116 - RNA, 20 nt, Pseudomonas putida KT2440
agcccgcuaccagaaauggu

SEQ ID NO: 1608117 - RNA, 19 nt, Pseudomonas putida KT2440
agcccgcgcuucacgucug

SEQ ID NO: 1608118 - RNA, 21 nt, Pseudomonas putida KT2440
agcccgcucgccacacaaauc

SEQ ID NO: 1608119 - RNA, 20 nt, Pseudomonas putida KT2440
agcccgcgaagaggccagga

SEQ ID NO: 1608120 - RNA, 16 nt, Pseudomonas putida KT2440
agcgccagcacgcagg

SEQ ID NO: 1608121 - RNA, 17 nt, Pseudomonas putida KT2440
agcgccagcacgcaggc

SEQ ID NO: 1608122 - RNA, 13 nt, Pseudomonas putida KT2440
agcgccagcagcc

SEQ ID NO: 1608123 - RNA, 15 nt, Pseudomonas putida KT2440
agcgccagcaacgca

SEQ ID NO: 1608124 - RNA, 19 nt, Pseudomonas putida KT2440
agcgccagcaacgcagcca

SEQ ID NO: 1608125 - RNA, 16 nt, Pseudomonas putida KT2440
agcgccauccaccugu

SEQ ID NO: 1608126 - RNA, 19 nt, Pseudomonas putida KT2440
agcgccaguacggccauca

SEQ ID NO: 1608127 - RNA, 16 nt, Pseudomonas putida KT2440
agcgccaguuacccug

SEQ ID NO: 1608128 - RNA, 15 nt, Pseudomonas putida KT2440
agcgcaucggccacu

SEQ ID NO: 1608129 - RNA, 18 nt, Pseudomonas putida KT2440
agcgcaugcucgcgggcc

SEQ ID NO: 1608130 - RNA, 19 nt, Pseudomonas putida KT2440
agcgcaugcucgcgggccu

SEQ ID NO: 1608131 - RNA, 21 nt, Pseudomonas putida KT2440
agcgccaacgcccccgccacc

SEQ ID NO: 1608132 - RNA, 20 nt, Pseudomonas putida KT2440
agcgcauuggcguugagccg

SEQ ID NO: 1608133 - RNA, 22 nt, Pseudomonas putida KT2440
agcgcauuggcguugagccgcc

SEQ ID NO: 1608134 - RNA, 20 nt, Pseudomonas putida KT2440
agcgcagcgacgaccugcac

SEQ ID NO: 1608135 - RNA, 22 nt, Pseudomonas putida KT2440
agcgcagcguaauagcugguga

SEQ ID NO: 1608136 - RNA, 18 nt, Pseudomonas putida KT2440
agcgcagcuucucaagca

SEQ ID NO: 1608137 - RNA, 18 nt, Pseudomonas putida KT2440
agcgcagggaagguggcc

SEQ ID NO: 1608138 - RNA, 20 nt, Pseudomonas putida KT2440
agcgcagucaccacacggca

SEQ ID NO: 1608139 - RNA, 22 nt, Pseudomonas putida KT2440
agcgauaauugugcccuugaac

SEQ ID NO: 1608140 - RNA, 15 nt, Pseudomonas putida KT2440
agcgauggcggauca

SEQ ID NO: 1608141 - RNA, 24 nt, Pseudomonas putida KT2440
agcgauggcggaucagcgcgucca

SEQ ID NO: 1608142 - RNA, 21 nt, Pseudomonas putida KT2440
agcgcagcaucuuccugccac

SEQ ID NO: 1608143 - RNA, 17 nt, Pseudomonas putida KT2440
agcgcagaucccgcucg

SEQ ID NO: 1608144 - RNA, 16 nt, Pseudomonas putida KT2440
agcgcagacuggguga

SEQ ID NO: 1608145 - RNA, 17 nt, Pseudomonas putida KT2440
agcgcacuuggccugcu

SEQ ID NO: 1608146 - RNA, 15 nt, Pseudomonas putida KT2440
agcgcaccugcaggu

SEQ ID NO: 1608147 - RNA, 23 nt, Pseudomonas putida KT2440
agcgcaccgcugaccacaaagcc

SEQ ID NO: 1608148 - RNA, 11 nt, Pseudomonas putida KT2440
agcgcaccgcg

SEQ ID NO: 1608149 - RNA, 15 nt, Pseudomonas putida KT2440
agcgauuccaagugc

SEQ ID NO: 1608150 - RNA, 16 nt, Pseudomonas putida KT2440
agcgauuccaagugcc

SEQ ID NO: 1608151 - RNA, 23 nt, Pseudomonas putida KT2440
agcgauugcggccuagcaaggcc

SEQ ID NO: 1608152 - RNA, 18 nt, Pseudomonas putida KT2440
agcgcaaaaccaccagcc

SEQ ID NO: 1608153 - RNA, 16 nt, Pseudomonas putida KT2440
agcgcaaucaaagcag

SEQ ID NO: 1608154 - RNA, 17 nt, Pseudomonas putida KT2440
agcgcaaucaaagcaga

SEQ ID NO: 1608155 - RNA, 14 nt, Pseudomonas putida KT2440
agcgcaacaccgcc

SEQ ID NO: 1608156 - RNA, 20 nt, Pseudomonas putida KT2440
agcgccuccagcaggggcag

SEQ ID NO: 1608157 - RNA, 17 nt, Pseudomonas putida KT2440
agcgccuggccugcaga

SEQ ID NO: 1608158 - RNA, 12 nt, Pseudomonas putida KT2440
agcgccuggcga

SEQ ID NO: 1608159 - RNA, 22 nt, Pseudomonas putida KT2440
agcgccuggcgcaguucgucca

SEQ ID NO: 1608160 - RNA, 14 nt, Pseudomonas putida KT2440
agcgccugcugcca

SEQ ID NO: 1608161 - RNA, 17 nt, Pseudomonas putida KT2440
agcgccugauuacccug

SEQ ID NO: 1608162 - RNA, 15 nt, Pseudomonas putida KT2440
agcgccugcaggccc

SEQ ID NO: 1608163 - RNA, 16 nt, Pseudomonas putida KT2440
agcgccucuuugcccu

SEQ ID NO: 1608164 - RNA, 22 nt, Pseudomonas putida KT2440
agcgccgcggccaacauucacg

SEQ ID NO: 1608165 - RNA, 23 nt, Pseudomonas putida KT2440
agcgccgcgcgggcggcgcucgg

SEQ ID NO: 1608166 - RNA, 14 nt, Pseudomonas putida KT2440
agcgccgcuucagc

SEQ ID NO: 1608167 - RNA, 20 nt, Pseudomonas putida KT2440
agcgccgucgaacguccgcu

SEQ ID NO: 1608168 - RNA, 17 nt, Pseudomonas putida KT2440
agcgcccgucuggcugc

SEQ ID NO: 1608169 - RNA, 18 nt, Pseudomonas putida KT2440
agcgcccguugcgcuuga

SEQ ID NO: 1608170 - RNA, 12 nt, Pseudomonas putida KT2440
agcgcccaccaa

SEQ ID NO: 1608171 - RNA, 18 nt, Pseudomonas putida KT2440
agcgcccacgcaaaaccu

SEQ ID NO: 1608172 - RNA, 12 nt, Pseudomonas putida KT2440
agcgcccagaac

SEQ ID NO: 1608173 - RNA, 13 nt, Pseudomonas putida KT2440
agcgccccggcaa

SEQ ID NO: 1608174 - RNA, 12 nt, Pseudomonas putida KT2440
agcgccgcaacg

SEQ ID NO: 1608175 - RNA, 16 nt, Pseudomonas putida KT2440
agcgccgcauccagca

SEQ ID NO: 1608176 - RNA, 17 nt, Pseudomonas putida KT2440
agcgccgcauccagcac

SEQ ID NO: 1608177 - RNA, 23 nt, Pseudomonas putida KT2440
agcgcucgagaaaugccucggca

SEQ ID NO: 1608178 - RNA, 15 nt, Pseudomonas putida KT2440
agcgcucccaggccu

SEQ ID NO: 1608179 - RNA, 19 nt, Pseudomonas putida KT2440
agcgcuucgaucgccggca

SEQ ID NO: 1608180 - RNA, 17 nt, Pseudomonas putida KT2440
agcgcuuaaaucaagag

SEQ ID NO: 1608181 - RNA, 11 nt, Pseudomonas putida KT2440
agcgcuugaag

SEQ ID NO: 1608182 - RNA, 13 nt, Pseudomonas putida KT2440
agcggaucggccg

SEQ ID NO: 1608183 - RNA, 17 nt, Pseudomonas putida KT2440
agcggcaacaccagcag

SEQ ID NO: 1608184 - RNA, 18 nt, Pseudomonas putida KT2440
agcggcaacaccagcagc

SEQ ID NO: 1608185 - RNA, 14 nt, Pseudomonas putida KT2440
agcggaucaccgac

SEQ ID NO: 1608186 - RNA, 13 nt, Pseudomonas putida KT2440
agcgcuuucuggu

SEQ ID NO: 1608187 - RNA, 16 nt, Pseudomonas putida KT2440
agcgccuugucggcac

SEQ ID NO: 1608188 - RNA, 20 nt, Pseudomonas putida KT2440
agcgccuugaucgucauggu

SEQ ID NO: 1608189 - RNA, 23 nt, Pseudomonas putida KT2440
agcgcgucauccgccaacaccac

SEQ ID NO: 1608190 - RNA, 15 nt, Pseudomonas putida KT2440
agcgcguccagcaac

SEQ ID NO: 1608191 - RNA, 17 nt, Pseudomonas putida KT2440
agcgcguccagcaacag

SEQ ID NO: 1608192 - RNA, 18 nt, Pseudomonas putida KT2440
agcgcguccagcaacagc

SEQ ID NO: 1608193 - RNA, 23 nt, Pseudomonas putida KT2440
agcuaccaccccaagcauagcca

SEQ ID NO: 1608194 - RNA, 13 nt, Pseudomonas putida KT2440
agcuacagccccu

SEQ ID NO: 1608195 - RNA, 14 nt, Pseudomonas putida KT2440
agcuacagccccuu

SEQ ID NO: 1608196 - RNA, 21 nt, Pseudomonas putida KT2440
agcuaaaccgcgaugcugcaa

SEQ ID NO: 1608197 - RNA, 15 nt, Pseudomonas putida KT2440
agcgugaagcggcca

SEQ ID NO: 1608198 - RNA, 19 nt, Pseudomonas putida KT2440
agcgucgcgcgcccaggcc

SEQ ID NO: 1608199 - RNA, 18 nt, Pseudomonas putida KT2440
agcgugaaauaagaaccg

SEQ ID NO: 1608200 - RNA, 18 nt, Pseudomonas putida KT2440
agcguugcuccagcucac

SEQ ID NO: 1608201 - RNA, 21 nt, Pseudomonas putida KT2440
agcguuggcacgacgcucgga

SEQ ID NO: 1608202 - RNA, 16 nt, Pseudomonas putida KT2440
agcguuuuauaaagag

SEQ ID NO: 1608203 - RNA, 17 nt, Pseudomonas putida KT2440
agcguuuuauaaagaga

SEQ ID NO: 1608204 - RNA, 14 nt, Pseudomonas putida KT2440
agcguugcauucca

SEQ ID NO: 1608205 - RNA, 19 nt, Pseudomonas putida KT2440
agcggcaggcuggcguggu

SEQ ID NO: 1608206 - RNA, 19 nt, Pseudomonas putida KT2440
agcggcaguugccugccuu

SEQ ID NO: 1608207 - RNA, 13 nt, Pseudomonas putida KT2440
agcggcagcaaca

SEQ ID NO: 1608208 - RNA, 15 nt, Pseudomonas putida KT2440
agcggcagacacagg

SEQ ID NO: 1608209 - RNA, 17 nt, Pseudomonas putida KT2440
agcggcagacacaggcg

SEQ ID NO: 1608210 - RNA, 18 nt, Pseudomonas putida KT2440
agcggcagacacaggcgc

SEQ ID NO: 1608211 - RNA, 17 nt, Pseudomonas putida KT2440
agcggcaauucggccgg

SEQ ID NO: 1608212 - RNA, 19 nt, Pseudomonas putida KT2440
agcgguucgaccaauggcu

SEQ ID NO: 1608213 - RNA, 20 nt, Pseudomonas putida KT2440
agcgguugaccgccgccacc

SEQ ID NO: 1608214 - RNA, 15 nt, Pseudomonas putida KT2440
agcgguugagaugau

SEQ ID NO: 1608215 - RNA, 19 nt, Pseudomonas putida KT2440
agcggguuuacccgcgaac

SEQ ID NO: 1608216 - RNA, 14 nt, Pseudomonas putida KT2440
agcggguuugcgug

SEQ ID NO: 1608217 - RNA, 11 nt, Pseudomonas putida KT2440
agcggguuuuc

SEQ ID NO: 1608218 - RNA, 18 nt, Pseudomonas putida KT2440
agcgguaaacgucggcag

SEQ ID NO: 1608219 - RNA, 18 nt, Pseudomonas putida KT2440
agcggguuccccagcaag

SEQ ID NO: 1608220 - RNA, 20 nt, Pseudomonas putida KT2440
agcgggggcgcgucagccgu

SEQ ID NO: 1608221 - RNA, 16 nt, Pseudomonas putida KT2440
agcgggucgagccagg

SEQ ID NO: 1608222 - RNA, 15 nt, Pseudomonas putida KT2440
agcgggucgagccag

SEQ ID NO: 1608223 - RNA, 14 nt, Pseudomonas putida KT2440
agcguccaguucaa

SEQ ID NO: 1608224 - RNA, 13 nt, Pseudomonas putida KT2440
agcgucaacugcc

SEQ ID NO: 1608225 - RNA, 19 nt, Pseudomonas putida KT2440
agcgucaacugccaggcug

SEQ ID NO: 1608226 - RNA, 15 nt, Pseudomonas putida KT2440
agcguaagcuggcuu

SEQ ID NO: 1608227 - RNA, 15 nt, Pseudomonas putida KT2440
agcgucaaccaggcg

SEQ ID NO: 1608228 - RNA, 16 nt, Pseudomonas putida KT2440
agcucgccguggggga

SEQ ID NO: 1608229 - RNA, 13 nt, Pseudomonas putida KT2440
agcucgcccggca

SEQ ID NO: 1608230 - RNA, 16 nt, Pseudomonas putida KT2440
agcucgcgcagggcau

SEQ ID NO: 1608231 - RNA, 17 nt, Pseudomonas putida KT2440
agcucgcgcugccaggc

SEQ ID NO: 1608232 - RNA, 15 nt, Pseudomonas putida KT2440
agcucgacaaacugc

SEQ ID NO: 1608233 - RNA, 14 nt, Pseudomonas putida KT2440
agcucgaucagugc

SEQ ID NO: 1608234 - RNA, 16 nt, Pseudomonas putida KT2440
agcucgaucugccugc

SEQ ID NO: 1608235 - RNA, 18 nt, Pseudomonas putida KT2440
agcucgaucugccugccu

SEQ ID NO: 1608236 - RNA, 16 nt, Pseudomonas putida KT2440
agcucgauggccagga

SEQ ID NO: 1608237 - RNA, 15 nt, Pseudomonas putida KT2440
agcucgcacgcaugu

SEQ ID NO: 1608238 - RNA, 22 nt, Pseudomonas putida KT2440
agcuccugauccaccucucagc

SEQ ID NO: 1608239 - RNA, 16 nt, Pseudomonas putida KT2440
agcucgaagcgcucau

SEQ ID NO: 1608240 - RNA, 14 nt, Pseudomonas putida KT2440
agcuccaccuucca

SEQ ID NO: 1608241 - RNA, 15 nt, Pseudomonas putida KT2440
agcuccaccuuccac

SEQ ID NO: 1608242 - RNA, 16 nt, Pseudomonas putida KT2440
agcuccaccaaauucc

SEQ ID NO: 1608243 - RNA, 20 nt, Pseudomonas putida KT2440
agcuccaccaaauuccgcuu

SEQ ID NO: 1608244 - RNA, 14 nt, Pseudomonas putida KT2440
agcuccagcccagc

SEQ ID NO: 1608245 - RNA, 19 nt, Pseudomonas putida KT2440
agcuccagcaacugcgccg

SEQ ID NO: 1608246 - RNA, 16 nt, Pseudomonas putida KT2440
agcucauggucagccg

SEQ ID NO: 1608247 - RNA, 15 nt, Pseudomonas putida KT2440
agcuccccagcaacg

SEQ ID NO: 1608248 - RNA, 20 nt, Pseudomonas putida KT2440
agcuccagcguuugcacgga

SEQ ID NO: 1608249 - RNA, 16 nt, Pseudomonas putida KT2440
agcucuggucaccuuc

SEQ ID NO: 1608250 - RNA, 21 nt, Pseudomonas putida KT2440
agcucuugcggaucacuucca

SEQ ID NO: 1608251 - RNA, 16 nt, Pseudomonas putida KT2440
agcucuugcuuguuau

SEQ ID NO: 1608252 - RNA, 14 nt, Pseudomonas putida KT2440
agcugaccuuggac

SEQ ID NO: 1608253 - RNA, 23 nt, Pseudomonas putida KT2440
agcugacugucucgcccaugggc

SEQ ID NO: 1608254 - RNA, 20 nt, Pseudomonas putida KT2440
agcucgucagccaccaccag

SEQ ID NO: 1608255 - RNA, 15 nt, Pseudomonas putida KT2440
agcucguccugcagg

SEQ ID NO: 1608256 - RNA, 14 nt, Pseudomonas putida KT2440
agcucgucgagcaa

SEQ ID NO: 1608257 - RNA, 16 nt, Pseudomonas putida KT2440
agcucuggagguagcc

SEQ ID NO: 1608258 - RNA, 14 nt, Pseudomonas putida KT2440
agcucguucaacac

SEQ ID NO: 1608259 - RNA, 21 nt, Pseudomonas putida KT2440
agcucguugaacacauccuca

SEQ ID NO: 1608260 - RNA, 20 nt, Pseudomonas putida KT2440
agcucgggaacauucucugc

SEQ ID NO: 1608261 - RNA, 16 nt, Pseudomonas putida KT2440
agcucggcuggcuguc

SEQ ID NO: 1608262 - RNA, 14 nt, Pseudomonas putida KT2440
agcugaugcucaag

SEQ ID NO: 1608263 - RNA, 23 nt, Pseudomonas putida KT2440
agcugaugagguuugccaaggca

SEQ ID NO: 1608264 - RNA, 17 nt, Pseudomonas putida KT2440
agcugagaaugcccucc

SEQ ID NO: 1608265 - RNA, 17 nt, Pseudomonas putida KT2440
agcugcggcaugaaggc

SEQ ID NO: 1608266 - RNA, 15 nt, Pseudomonas putida KT2440
agcugcgcugccugc

SEQ ID NO: 1608267 - RNA, 17 nt, Pseudomonas putida KT2440
agcugcguggcauccuu

SEQ ID NO: 1608268 - RNA, 18 nt, Pseudomonas putida KT2440
agcaagcuggcaccggcg

SEQ ID NO: 1608269 - RNA, 19 nt, Pseudomonas putida KT2440
agcaaggccauuucccugc

SEQ ID NO: 1608270 - RNA, 15 nt, Pseudomonas putida KT2440
agcaaggccuccagg

SEQ ID NO: 1608271 - RNA, 23 nt, Pseudomonas putida KT2440
agcaagggccguuacucccacag

SEQ ID NO: 1608272 - RNA, 23 nt, Pseudomonas putida KT2440
agcaagucccccaucggcacccg

SEQ ID NO: 1608273 - RNA, 14 nt, Pseudomonas putida KT2440
agcaagugccccug

SEQ ID NO: 1608274 - RNA, 19 nt, Pseudomonas putida KT2440
agcaaugcccgcucgcugc

SEQ ID NO: 1608275 - RNA, 22 nt, Pseudomonas putida KT2440
agcaaugcgucggcguggaaca

SEQ ID NO: 1608276 - RNA, 15 nt, Pseudomonas putida KT2440
agcaauggcccugga

SEQ ID NO: 1608277 - RNA, 20 nt, Pseudomonas putida KT2440
agcaaucaggucaucgaaga

SEQ ID NO: 1608278 - RNA, 20 nt, Pseudomonas putida KT2440
agcaauacauccaggcccgu

SEQ ID NO: 1608279 - RNA, 22 nt, Pseudomonas putida KT2440
agcaacgccuuggccugcggga

SEQ ID NO: 1608280 - RNA, 15 nt, Pseudomonas putida KT2440
agcaacgccuucagg

SEQ ID NO: 1608281 - RNA, 18 nt, Pseudomonas putida KT2440
agcaacgcuagaaacaga

SEQ ID NO: 1608282 - RNA, 13 nt, Pseudomonas putida KT2440
agcaacggguuca

SEQ ID NO: 1608283 - RNA, 21 nt, Pseudomonas putida KT2440
agcaacggguucagguacagc

SEQ ID NO: 1608284 - RNA, 23 nt, Pseudomonas putida KT2440
agcaacgcccgcaacaaccuggc

SEQ ID NO: 1608285 - RNA, 14 nt, Pseudomonas putida KT2440
agcaacgccgagca

SEQ ID NO: 1608286 - RNA, 16 nt, Pseudomonas putida KT2440
agcaaccgugacuggu

SEQ ID NO: 1608287 - RNA, 16 nt, Pseudomonas putida KT2440
agcaacuggugaauca

SEQ ID NO: 1608288 - RNA, 21 nt, Pseudomonas putida KT2440
agcaacugcgccguggccgcc

SEQ ID NO: 1608289 - RNA, 21 nt, Pseudomonas putida KT2440
agcaacacauacuccaccgcc

SEQ ID NO: 1608290 - RNA, 18 nt, Pseudomonas putida KT2440
agcaaccggacggguuuc

SEQ ID NO: 1608291 - RNA, 21 nt, Pseudomonas putida KT2440
agcaaaugacuguuaaucauu

SEQ ID NO: 1608292 - RNA, 17 nt, Pseudomonas putida KT2440
agcaaagcccgccccaa

SEQ ID NO: 1608293 - RNA, 21 nt, Pseudomonas putida KT2440
agcaaaggcgaccuucggguc

SEQ ID NO: 1608294 - RNA, 18 nt, Pseudomonas putida KT2440
agauuugccuuggaaugc

SEQ ID NO: 1608295 - RNA, 15 nt, Pseudomonas putida KT2440
agauuuucagccaaa

SEQ ID NO: 1608296 - RNA, 23 nt, Pseudomonas putida KT2440
agauuucaccgagugcccgcgca

SEQ ID NO: 1608297 - RNA, 12 nt, Pseudomonas putida KT2440
agcagacagcug

SEQ ID NO: 1608298 - RNA, 21 nt, Pseudomonas putida KT2440
agcagacccagaaucccaacc

SEQ ID NO: 1608299 - RNA, 20 nt, Pseudomonas putida KT2440
agcacuugcuugacagcguu

SEQ ID NO: 1608300 - RNA, 13 nt, Pseudomonas putida KT2440
agcagaacagaaa

SEQ ID NO: 1608301 - RNA, 17 nt, Pseudomonas putida KT2440
agcacuuuugccaccac

SEQ ID NO: 1608302 - RNA, 19 nt, Pseudomonas putida KT2440
agcacuuuugccaccaccc

SEQ ID NO: 1608303 - RNA, 15 nt, Pseudomonas putida KT2440
agcagcaacgcaucg

SEQ ID NO: 1608304 - RNA, 15 nt, Pseudomonas putida KT2440
agcagcaagccugcu

SEQ ID NO: 1608305 - RNA, 13 nt, Pseudomonas putida KT2440
agcagcagcccuu

SEQ ID NO: 1608306 - RNA, 22 nt, Pseudomonas putida KT2440
agcagcagagagauugagagga

SEQ ID NO: 1608307 - RNA, 13 nt, Pseudomonas putida KT2440
agcagcaccgagg

SEQ ID NO: 1608308 - RNA, 16 nt, Pseudomonas putida KT2440
agcagaucacaaaguu

SEQ ID NO: 1608309 - RNA, 14 nt, Pseudomonas putida KT2440
agcacguaguaauc

SEQ ID NO: 1608310 - RNA, 18 nt, Pseudomonas putida KT2440
agcacuacaucuaccuga

SEQ ID NO: 1608311 - RNA, 23 nt, Pseudomonas putida KT2440
agcacugcauuggccacgcccaa

SEQ ID NO: 1608312 - RNA, 23 nt, Pseudomonas putida KT2440
agcacugcugcgcaguacaggcu

SEQ ID NO: 1608313 - RNA, 16 nt, Pseudomonas putida KT2440
agcacugccugcaugc

SEQ ID NO: 1608314 - RNA, 23 nt, Pseudomonas putida KT2440
agcacugccugcaugcgugccuu

SEQ ID NO: 1608315 - RNA, 17 nt, Pseudomonas putida KT2440
agcacugccuggccacu

SEQ ID NO: 1608316 - RNA, 14 nt, Pseudomonas putida KT2440
agcacugccuugcc

SEQ ID NO: 1608317 - RNA, 18 nt, Pseudomonas putida KT2440
agcacugccuugcccugc

SEQ ID NO: 1608318 - RNA, 15 nt, Pseudomonas putida KT2440
agcacugucgauggc

SEQ ID NO: 1608319 - RNA, 16 nt, Pseudomonas putida KT2440
agcacgcccaucagcg

SEQ ID NO: 1608320 - RNA, 14 nt, Pseudomonas putida KT2440
agcacgccgccgau

SEQ ID NO: 1608321 - RNA, 22 nt, Pseudomonas putida KT2440
agcacgccgccgauaccgaaca

SEQ ID NO: 1608322 - RNA, 18 nt, Pseudomonas putida KT2440
agcacgccggcauagaug

SEQ ID NO: 1608323 - RNA, 15 nt, Pseudomonas putida KT2440
agcacgggcagcuug

SEQ ID NO: 1608324 - RNA, 16 nt, Pseudomonas putida KT2440
agcacgggcgcugaag

SEQ ID NO: 1608325 - RNA, 16 nt, Pseudomonas putida KT2440
agcacgcuggccagag

SEQ ID NO: 1608326 - RNA, 24 nt, Pseudomonas putida KT2440
agcacggaaucacgcggcgucacc

SEQ ID NO: 1608327 - RNA, 17 nt, Pseudomonas putida KT2440
agcacgaaggccagcaa

SEQ ID NO: 1608328 - RNA, 17 nt, Pseudomonas putida KT2440
agcacgaaacugcgcug

SEQ ID NO: 1608329 - RNA, 18 nt, Pseudomonas putida KT2440
agcacgaaacugcgcugg

SEQ ID NO: 1608330 - RNA, 21 nt, Pseudomonas putida KT2440
agcacgaaacugcgcugguac

SEQ ID NO: 1608331 - RNA, 14 nt, Pseudomonas putida KT2440
agcacgaacagcaa

SEQ ID NO: 1608332 - RNA, 15 nt, Pseudomonas putida KT2440
agcaccugggcguca

SEQ ID NO: 1608333 - RNA, 13 nt, Pseudomonas putida KT2440
agcaccuucuugc

SEQ ID NO: 1608334 - RNA, 18 nt, Pseudomonas putida KT2440
agcaccagguuugcugcc

SEQ ID NO: 1608335 - RNA, 12 nt, Pseudomonas putida KT2440
agcaccagcucc

SEQ ID NO: 1608336 - RNA, 20 nt, Pseudomonas putida KT2440
agcaccagcgcgaucaccag

SEQ ID NO: 1608337 - RNA, 19 nt, Pseudomonas putida KT2440
agcaccagcgggcccagca

SEQ ID NO: 1608338 - RNA, 17 nt, Pseudomonas putida KT2440
agcaccagcuccuggcc

SEQ ID NO: 1608339 - RNA, 16 nt, Pseudomonas putida KT2440
agcaccauuugucuug

SEQ ID NO: 1608340 - RNA, 14 nt, Pseudomonas putida KT2440
agcacccgcuuggc

SEQ ID NO: 1608341 - RNA, 16 nt, Pseudomonas putida KT2440
agcacccgcuuggcca

SEQ ID NO: 1608342 - RNA, 18 nt, Pseudomonas putida KT2440
agcacccgcuuggccacc

SEQ ID NO: 1608343 - RNA, 14 nt, Pseudomonas putida KT2440
agcacccgcccauc

SEQ ID NO: 1608344 - RNA, 21 nt, Pseudomonas putida KT2440
agcacccgcccaucgcacacc

SEQ ID NO: 1608345 - RNA, 14 nt, Pseudomonas putida KT2440
agcaccccagcacc

SEQ ID NO: 1608346 - RNA, 16 nt, Pseudomonas putida KT2440
agcaccccagcaccac

SEQ ID NO: 1608347 - RNA, 21 nt, Pseudomonas putida KT2440
agcaccccguccagccccaag

SEQ ID NO: 1608348 - RNA, 13 nt, Pseudomonas putida KT2440
agcacccgcaggc

SEQ ID NO: 1608349 - RNA, 23 nt, Pseudomonas putida KT2440
agcacccgcaggcgacgagccag

SEQ ID NO: 1608350 - RNA, 13 nt, Pseudomonas putida KT2440
agcaccugcaggu

SEQ ID NO: 1608351 - RNA, 20 nt, Pseudomonas putida KT2440
agcaccugcagguacagcag

SEQ ID NO: 1608352 - RNA, 12 nt, Pseudomonas putida KT2440
agcaccuggcgg

SEQ ID NO: 1608353 - RNA, 14 nt, Pseudomonas putida KT2440
agcaccugccgcug

SEQ ID NO: 1608354 - RNA, 16 nt, Pseudomonas putida KT2440
agcaccuccugcacau

SEQ ID NO: 1608355 - RNA, 17 nt, Pseudomonas putida KT2440
agcaccuccugcacaua

SEQ ID NO: 1608356 - RNA, 19 nt, Pseudomonas putida KT2440
agcaccuccugcacauaca

SEQ ID NO: 1608357 - RNA, 13 nt, Pseudomonas putida KT2440
agcaccuccaccu

SEQ ID NO: 1608358 - RNA, 14 nt, Pseudomonas putida KT2440
agcaccggccaggc

SEQ ID NO: 1608359 - RNA, 15 nt, Pseudomonas putida KT2440
agcaccggccaggcu

SEQ ID NO: 1608360 - RNA, 23 nt, Pseudomonas putida KT2440
agcaccgguaccgcucugcgcca

SEQ ID NO: 1608361 - RNA, 14 nt, Pseudomonas putida KT2440
agcaccgcugccag

SEQ ID NO: 1608362 - RNA, 18 nt, Pseudomonas putida KT2440
agcaccgcugccagcugc

SEQ ID NO: 1608363 - RNA, 19 nt, Pseudomonas putida KT2440
agcaccgcugccagcugcg

SEQ ID NO: 1608364 - RNA, 17 nt, Pseudomonas putida KT2440
agcaccgcuucacccuc

SEQ ID NO: 1608365 - RNA, 23 nt, Pseudomonas putida KT2440
agcaccgcuucacccucgcgcag

SEQ ID NO: 1608366 - RNA, 20 nt, Pseudomonas putida KT2440
agcacaggccgccugaccug

SEQ ID NO: 1608367 - RNA, 21 nt, Pseudomonas putida KT2440
agcacaggucucgaacgcugu

SEQ ID NO: 1608368 - RNA, 19 nt, Pseudomonas putida KT2440
agcacagugcggcggcacu

SEQ ID NO: 1608369 - RNA, 21 nt, Pseudomonas putida KT2440
agcacagauaaaccugccacc

SEQ ID NO: 1608370 - RNA, 23 nt, Pseudomonas putida KT2440
agcacagauaaaccugccaccca

SEQ ID NO: 1608371 - RNA, 18 nt, Pseudomonas putida KT2440
agcaccacccaccagcag

SEQ ID NO: 1608372 - RNA, 21 nt, Pseudomonas putida KT2440
agcaccacccaccagcagugc

SEQ ID NO: 1608373 - RNA, 15 nt, Pseudomonas putida KT2440
agcaccacuggauga

SEQ ID NO: 1608374 - RNA, 15 nt, Pseudomonas putida KT2440
agcacauucagcagc

SEQ ID NO: 1608375 - RNA, 21 nt, Pseudomonas putida KT2440
agcacauucagcagcgccugg

SEQ ID NO: 1608376 - RNA, 14 nt, Pseudomonas putida KT2440
agcacaaggccacu

SEQ ID NO: 1608377 - RNA, 22 nt, Pseudomonas putida KT2440
agcacaaggcucaagcgcagcc

SEQ ID NO: 1608378 - RNA, 21 nt, Pseudomonas putida KT2440
agcacaaggcuguuccacagc

SEQ ID NO: 1608379 - RNA, 16 nt, Pseudomonas putida KT2440
agcacaagggccaggu

SEQ ID NO: 1608380 - RNA, 20 nt, Pseudomonas putida KT2440
agcacaagccaugugccugg

SEQ ID NO: 1608381 - RNA, 16 nt, Pseudomonas putida KT2440
agcacacgcuugucuu

SEQ ID NO: 1608382 - RNA, 16 nt, Pseudomonas putida KT2440
agcaggguggccagca

SEQ ID NO: 1608383 - RNA, 21 nt, Pseudomonas putida KT2440
agcaggguggccagcaaggca

SEQ ID NO: 1608384 - RNA, 13 nt, Pseudomonas putida KT2440
agcagggugccuu

SEQ ID NO: 1608385 - RNA, 22 nt, Pseudomonas putida KT2440
agcaggucagcgcucaaaaaaa

SEQ ID NO: 1608386 - RNA, 23 nt, Pseudomonas putida KT2440
agcaggucagcgcucaaaaaaau

SEQ ID NO: 1608387 - RNA, 15 nt, Pseudomonas putida KT2440
agcagguacgcgcag

SEQ ID NO: 1608388 - RNA, 18 nt, Pseudomonas putida KT2440
agcagguacgcgcaggca

SEQ ID NO: 1608389 - RNA, 19 nt, Pseudomonas putida KT2440
agcagguugaacagcagcg

SEQ ID NO: 1608390 - RNA, 13 nt, Pseudomonas putida KT2440
agcaggucggcgu

SEQ ID NO: 1608391 - RNA, 16 nt, Pseudomonas putida KT2440
agcaggggacgcauuc

SEQ ID NO: 1608392 - RNA, 20 nt, Pseudomonas putida KT2440
agcagggcugcgcgcccagg

SEQ ID NO: 1608393 - RNA, 21 nt, Pseudomonas putida KT2440
agcagggccgcgcuuggcggc

SEQ ID NO: 1608394 - RNA, 19 nt, Pseudomonas putida KT2440
agcaggcgcgagccuugcc

SEQ ID NO: 1608395 - RNA, 15 nt, Pseudomonas putida KT2440
agcaggcccggcccu

SEQ ID NO: 1608396 - RNA, 16 nt, Pseudomonas putida KT2440
agcaggcaagcccgcu

SEQ ID NO: 1608397 - RNA, 15 nt, Pseudomonas putida KT2440
agcaggccaccggca

SEQ ID NO: 1608398 - RNA, 20 nt, Pseudomonas putida KT2440
agcagcuuccugugccgcuu

SEQ ID NO: 1608399 - RNA, 19 nt, Pseudomonas putida KT2440
agcaggaagaucaucaucu

SEQ ID NO: 1608400 - RNA, 17 nt, Pseudomonas putida KT2440
agcaggaacagcggcag

SEQ ID NO: 1608401 - RNA, 14 nt, Pseudomonas putida KT2440
agcaggaucugcug

SEQ ID NO: 1608402 - RNA, 20 nt, Pseudomonas putida KT2440
agcaggauggugacugccag

SEQ ID NO: 1608403 - RNA, 23 nt, Pseudomonas putida KT2440
agcaggauggugacugccagcac

SEQ ID NO: 1608404 - RNA, 18 nt, Pseudomonas putida KT2440
agcagcucccgagccagg

SEQ ID NO: 1608405 - RNA, 13 nt, Pseudomonas putida KT2440
agcagcuccagcg

SEQ ID NO: 1608406 - RNA, 13 nt, Pseudomonas putida KT2440
agcagcuccauac

SEQ ID NO: 1608407 - RNA, 20 nt, Pseudomonas putida KT2440
agcagcuugaacaacggcgc

SEQ ID NO: 1608408 - RNA, 14 nt, Pseudomonas putida KT2440
agcagcuucagcca

SEQ ID NO: 1608409 - RNA, 16 nt, Pseudomonas putida KT2440
agcagcugggugauca

SEQ ID NO: 1608410 - RNA, 16 nt, Pseudomonas putida KT2440
agcagcgccuggucau

SEQ ID NO: 1608411 - RNA, 14 nt, Pseudomonas putida KT2440
agcagcgcuaugcc

SEQ ID NO: 1608412 - RNA, 15 nt, Pseudomonas putida KT2440
agcagcgcuaugccu

SEQ ID NO: 1608413 - RNA, 14 nt, Pseudomonas putida KT2440
agcagcgcuccgcc

SEQ ID NO: 1608414 - RNA, 19 nt, Pseudomonas putida KT2440
agcagcggguuccccagca

SEQ ID NO: 1608415 - RNA, 14 nt, Pseudomonas putida KT2440
agcagcaggcgcga

SEQ ID NO: 1608416 - RNA, 22 nt, Pseudomonas putida KT2440
agcagcaggcccgccaccgccu

SEQ ID NO: 1608417 - RNA, 22 nt, Pseudomonas putida KT2440
agcagcaguucggcaacauuca

SEQ ID NO: 1608418 - RNA, 12 nt, Pseudomonas putida KT2440
agcagccacccu

SEQ ID NO: 1608419 - RNA, 18 nt, Pseudomonas putida KT2440
agcagccaacgccccagg

SEQ ID NO: 1608420 - RNA, 23 nt, Pseudomonas putida KT2440
agcagcgacaacgcgaaagcgaa

SEQ ID NO: 1608421 - RNA, 12 nt, Pseudomonas putida KT2440
agcagcgacacu

SEQ ID NO: 1608422 - RNA, 20 nt, Pseudomonas putida KT2440
agcagcccuucgcucaaccg

SEQ ID NO: 1608423 - RNA, 13 nt, Pseudomonas putida KT2440
agcagucccagca

SEQ ID NO: 1608424 - RNA, 14 nt, Pseudomonas putida KT2440
agcagucccagcac

SEQ ID NO: 1608425 - RNA, 19 nt, Pseudomonas putida KT2440
agcagucccaucugguugg

SEQ ID NO: 1608426 - RNA, 13 nt, Pseudomonas putida KT2440
agcagguucaggc

SEQ ID NO: 1608427 - RNA, 10 nt, Pseudomonas putida KT2440
agcaguggug

SEQ ID NO: 1608428 - RNA, 12 nt, Pseudomonas putida KT2440
agcagugccauc

SEQ ID NO: 1608429 - RNA, 14 nt, Pseudomonas putida KT2440
agcaguuugcugcg

SEQ ID NO: 1608430 - RNA, 16 nt, Pseudomonas putida KT2440
agcaguuccuucagca

SEQ ID NO: 1608431 - RNA, 17 nt, Pseudomonas putida KT2440
agcaucugggucuugau

SEQ ID NO: 1608432 - RNA, 22 nt, Pseudomonas putida KT2440
agcaucugggucuugaucuugg

SEQ ID NO: 1608433 - RNA, 15 nt, Pseudomonas putida KT2440
agcaucugcaccagg

SEQ ID NO: 1608434 - RNA, 14 nt, Pseudomonas putida KT2440
agcaucuucuuccc

SEQ ID NO: 1608435 - RNA, 21 nt, Pseudomonas putida KT2440
agcaucuuccagccugcagca

SEQ ID NO: 1608436 - RNA, 20 nt, Pseudomonas putida KT2440
agcaucggauaucugcgcca

SEQ ID NO: 1608437 - RNA, 22 nt, Pseudomonas putida KT2440
agcaucgaccugccacugcgcu

SEQ ID NO: 1608438 - RNA, 21 nt, Pseudomonas putida KT2440
agcaucccccuccuaagggga

SEQ ID NO: 1608439 - RNA, 18 nt, Pseudomonas putida KT2440
agcaucagccaugggcag

SEQ ID NO: 1608440 - RNA, 19 nt, Pseudomonas putida KT2440
agcauccagccauuccagg

SEQ ID NO: 1608441 - RNA, 21 nt, Pseudomonas putida KT2440
agcauccagccauuccaggcu

SEQ ID NO: 1608442 - RNA, 18 nt, Pseudomonas putida KT2440
agcaucaccgcgccgguc

SEQ ID NO: 1608443 - RNA, 13 nt, Pseudomonas putida KT2440
agcaucagugcag

SEQ ID NO: 1608444 - RNA, 15 nt, Pseudomonas putida KT2440
agcaucaccacgccc

SEQ ID NO: 1608445 - RNA, 16 nt, Pseudomonas putida KT2440
agcaucaccacgcccu

SEQ ID NO: 1608446 - RNA, 17 nt, Pseudomonas putida KT2440
agcaucaccacgcccug

SEQ ID NO: 1608447 - RNA, 18 nt, Pseudomonas putida KT2440
agcaucaacgcugccaug

SEQ ID NO: 1608448 - RNA, 19 nt, Pseudomonas putida KT2440
agcaucaaucgcuccaggc

SEQ ID NO: 1608449 - RNA, 23 nt, Pseudomonas putida KT2440
agcaucaaucgcuccaggcggcc

SEQ ID NO: 1608450 - RNA, 19 nt, Pseudomonas putida KT2440
agccaggaagaucacgucg

SEQ ID NO: 1608451 - RNA, 22 nt, Pseudomonas putida KT2440
agccaggagaacacccagcgca

SEQ ID NO: 1608452 - RNA, 15 nt, Pseudomonas putida KT2440
agccaggauuuucag

SEQ ID NO: 1608453 - RNA, 23 nt, Pseudomonas putida KT2440
agccagguucggaucagcaauga

SEQ ID NO: 1608454 - RNA, 22 nt, Pseudomonas putida KT2440
agccaggcguauucggccacca

SEQ ID NO: 1608455 - RNA, 24 nt, Pseudomonas putida KT2440
agccagucgcgcaacugcccagga

SEQ ID NO: 1608456 - RNA, 13 nt, Pseudomonas putida KT2440
agccaucgcacca

SEQ ID NO: 1608457 - RNA, 19 nt, Pseudomonas putida KT2440
agccauccaccagccccag

SEQ ID NO: 1608458 - RNA, 22 nt, Pseudomonas putida KT2440
agccauaugaaaaggcccugca

SEQ ID NO: 1608459 - RNA, 17 nt, Pseudomonas putida KT2440
agccaugaaaaagcccg

SEQ ID NO: 1608460 - RNA, 19 nt, Pseudomonas putida KT2440
agccaugagcgagcucaac

SEQ ID NO: 1608461 - RNA, 14 nt, Pseudomonas putida KT2440
agccaugugccugg

SEQ ID NO: 1608462 - RNA, 11 nt, Pseudomonas putida KT2440
agccagcagcc

SEQ ID NO: 1608463 - RNA, 16 nt, Pseudomonas putida KT2440
agccagcagccugugc

SEQ ID NO: 1608464 - RNA, 21 nt, Pseudomonas putida KT2440
agccagccuucgccaacugca

SEQ ID NO: 1608465 - RNA, 22 nt, Pseudomonas putida KT2440
agccagccuucgccaacugcac

SEQ ID NO: 1608466 - RNA, 11 nt, Pseudomonas putida KT2440
agccagcagau

SEQ ID NO: 1608467 - RNA, 18 nt, Pseudomonas putida KT2440
agccacucggcaaucugc

SEQ ID NO: 1608468 - RNA, 19 nt, Pseudomonas putida KT2440
agccacucggcaaucugcu

SEQ ID NO: 1608469 - RNA, 11 nt, Pseudomonas putida KT2440
agccacuggcc

SEQ ID NO: 1608470 - RNA, 15 nt, Pseudomonas putida KT2440
agccacuggccucuu

SEQ ID NO: 1608471 - RNA, 13 nt, Pseudomonas putida KT2440
agccacgccagaa

SEQ ID NO: 1608472 - RNA, 16 nt, Pseudomonas putida KT2440
agccacgcaucugcac

SEQ ID NO: 1608473 - RNA, 13 nt, Pseudomonas putida KT2440
agccaccggcaua

SEQ ID NO: 1608474 - RNA, 23 nt, Pseudomonas putida KT2440
agccacgcuggcacccacgcgcu

SEQ ID NO: 1608475 - RNA, 20 nt, Pseudomonas putida KT2440
agccaccgccaccaucggcc

SEQ ID NO: 1608476 - RNA, 16 nt, Pseudomonas putida KT2440
agccaccgcacucugc

SEQ ID NO: 1608477 - RNA, 16 nt, Pseudomonas putida KT2440
agccacccuccgcaca

SEQ ID NO: 1608478 - RNA, 23 nt, Pseudomonas putida KT2440
agcauggccgaaaccagccccuu

SEQ ID NO: 1608479 - RNA, 17 nt, Pseudomonas putida KT2440
agcauggcaaacagcac

SEQ ID NO: 1608480 - RNA, 20 nt, Pseudomonas putida KT2440
agcauguccugcugcaggcu

SEQ ID NO: 1608481 - RNA, 17 nt, Pseudomonas putida KT2440
agcauguaagcuucagc

SEQ ID NO: 1608482 - RNA, 19 nt, Pseudomonas putida KT2440
agcauggcgaucaacgaaa

SEQ ID NO: 1608483 - RNA, 10 nt, Pseudomonas putida KT2440
agcaugaaca

SEQ ID NO: 1608484 - RNA, 17 nt, Pseudomonas putida KT2440
agcaugaacagcgcugc

SEQ ID NO: 1608485 - RNA, 17 nt, Pseudomonas putida KT2440
agcaugaucaccgccag

SEQ ID NO: 1608486 - RNA, 22 nt, Pseudomonas putida KT2440
agcaugaucaccgccagcggca

SEQ ID NO: 1608487 - RNA, 18 nt, Pseudomonas putida KT2440
agcaugcccagcgccacc

SEQ ID NO: 1608488 - RNA, 21 nt, Pseudomonas putida KT2440
agcaugccccgggugcagccg

SEQ ID NO: 1608489 - RNA, 19 nt, Pseudomonas putida KT2440
agcaugcgggggccccacc

SEQ ID NO: 1608490 - RNA, 21 nt, Pseudomonas putida KT2440
agcaugcgggggccccaccag

SEQ ID NO: 1608491 - RNA, 17 nt, Pseudomonas putida KT2440
agcauguucaccagguu

SEQ ID NO: 1608492 - RNA, 14 nt, Pseudomonas putida KT2440
agcauuacuucuug

SEQ ID NO: 1608493 - RNA, 19 nt, Pseudomonas putida KT2440
agccaaugguauugcccga

SEQ ID NO: 1608494 - RNA, 20 nt, Pseudomonas putida KT2440
agccacauccucugcccgca

SEQ ID NO: 1608495 - RNA, 15 nt, Pseudomonas putida KT2440
agccaacgccccacc

SEQ ID NO: 1608496 - RNA, 15 nt, Pseudomonas putida KT2440
agccaaccgccccac

SEQ ID NO: 1608497 - RNA, 16 nt, Pseudomonas putida KT2440
agccaaccgccccacc

SEQ ID NO: 1608498 - RNA, 13 nt, Pseudomonas putida KT2440
agccaaaguccug

SEQ ID NO: 1608499 - RNA, 15 nt, Pseudomonas putida KT2440
agccaaaguccugca

SEQ ID NO: 1608500 - RNA, 12 nt, Pseudomonas putida KT2440
acuugcguucgc

SEQ ID NO: 1608501 - RNA, 20 nt, Pseudomonas putida KT2440
acuugcucggugcugcugcc

SEQ ID NO: 1608502 - RNA, 17 nt, Pseudomonas putida KT2440
acuugcgggucagcagc

SEQ ID NO: 1608503 - RNA, 23 nt, Pseudomonas putida KT2440
acuugcgggucagcagcaccgcc

SEQ ID NO: 1608504 - RNA, 13 nt, Pseudomonas putida KT2440
acuuggccugcug

SEQ ID NO: 1608505 - RNA, 21 nt, Pseudomonas putida KT2440
acuuggcgccgcccuggaugc

SEQ ID NO: 1608506 - RNA, 14 nt, Pseudomonas putida KT2440
acuuggcagccccg

SEQ ID NO: 1608507 - RNA, 17 nt, Pseudomonas putida KT2440
acuugguccagggccau

SEQ ID NO: 1608508 - RNA, 11 nt, Pseudomonas putida KT2440
acuugaagacc

SEQ ID NO: 1608509 - RNA, 23 nt, Pseudomonas putida KT2440
acuugaucgcguuacccaccaga

SEQ ID NO: 1608510 - RNA, 15 nt, Pseudomonas putida KT2440
acuugccgcccuccg

SEQ ID NO: 1608511 - RNA, 12 nt, Pseudomonas putida KT2440
acuugcagcucg

SEQ ID NO: 1608512 - RNA, 16 nt, Pseudomonas putida KT2440
acuucugcggccaggg

SEQ ID NO: 1608513 - RNA, 22 nt, Pseudomonas putida KT2440
acuucucccgggcaaucaguaa

SEQ ID NO: 1608514 - RNA, 19 nt, Pseudomonas putida KT2440
acuucuggcugggcuucga

SEQ ID NO: 1608515 - RNA, 16 nt, Pseudomonas putida KT2440
acuuccacuccagccg

SEQ ID NO: 1608516 - RNA, 12 nt, Pseudomonas putida KT2440
acuuccacaccc

SEQ ID NO: 1608517 - RNA, 14 nt, Pseudomonas putida KT2440
acuguaggcaaaca

SEQ ID NO: 1608518 - RNA, 13 nt, Pseudomonas putida KT2440
acugucccggcac

SEQ ID NO: 1608519 - RNA, 17 nt, Pseudomonas putida KT2440
acugugcccgccaggcg

SEQ ID NO: 1608520 - RNA, 16 nt, Pseudomonas putida KT2440
acugugggagcaggca

SEQ ID NO: 1608521 - RNA, 19 nt, Pseudomonas putida KT2440
acuguggucauccaggcug

SEQ ID NO: 1608522 - RNA, 15 nt, Pseudomonas putida KT2440
acuucaucaccucca

SEQ ID NO: 1608523 - RNA, 17 nt, Pseudomonas putida KT2440
acuuacuaucacgccuu

SEQ ID NO: 1608524 - RNA, 22 nt, Pseudomonas putida KT2440
acuuucccacauguaaugaaaa

SEQ ID NO: 1608525 - RNA, 12 nt, Pseudomonas putida KT2440
acuuucuugaaa

SEQ ID NO: 1608526 - RNA, 14 nt, Pseudomonas putida KT2440
acuuucuugaaauu

SEQ ID NO: 1608527 - RNA, 20 nt, Pseudomonas putida KT2440
acuuuguuaaggauugugag

SEQ ID NO: 1608528 - RNA, 16 nt, Pseudomonas putida KT2440
acuuuuagguggacac

SEQ ID NO: 1608529 - RNA, 14 nt, Pseudomonas putida KT2440
acuugugcauccug

SEQ ID NO: 1608530 - RNA, 16 nt, Pseudomonas putida KT2440
acuugugcauccugca

SEQ ID NO: 1608531 - RNA, 20 nt, Pseudomonas putida KT2440
acuugucccggcccagccgc

SEQ ID NO: 1608532 - RNA, 15 nt, Pseudomonas putida KT2440
agaaacaccaggccu

SEQ ID NO: 1608533 - RNA, 17 nt, Pseudomonas putida KT2440
agaaaguuugguuuuuu

SEQ ID NO: 1608534 - RNA, 20 nt, Pseudomonas putida KT2440
agaaaguuugguuuuuucac

SEQ ID NO: 1608535 - RNA, 21 nt, Pseudomonas putida KT2440
agaaaagcccgcacugcaaug

SEQ ID NO: 1608536 - RNA, 14 nt, Pseudomonas putida KT2440
agaaaaaacagugc

SEQ ID NO: 1608537 - RNA, 19 nt, Pseudomonas putida KT2440
agagcccgcucggucaggg

SEQ ID NO: 1608538 - RNA, 12 nt, Pseudomonas putida KT2440
agagcccggcgc

SEQ ID NO: 1608539 - RNA, 22 nt, Pseudomonas putida KT2440
agagcauggccagccggcagca

SEQ ID NO: 1608540 - RNA, 18 nt, Pseudomonas putida KT2440
agagcaguuccuucagca

SEQ ID NO: 1608541 - RNA, 13 nt, Pseudomonas putida KT2440
agagcggccccaa

SEQ ID NO: 1608542 - RNA, 15 nt, Pseudomonas putida KT2440
agagcgugaagcgga

SEQ ID NO: 1608543 - RNA, 23 nt, Pseudomonas putida KT2440
agaggaucugaauguacaaugca

SEQ ID NO: 1608544 - RNA, 15 nt, Pseudomonas putida KT2440
agaggcccgucaggc

SEQ ID NO: 1608545 - RNA, 21 nt, Pseudomonas putida KT2440
agaggcccgucaggcaaacca

SEQ ID NO: 1608546 - RNA, 21 nt, Pseudomonas putida KT2440
agaggcccucaagggcgcuga

SEQ ID NO: 1608547 - RNA, 19 nt, Pseudomonas putida KT2440
agaggccggaccugcuggc

SEQ ID NO: 1608548 - RNA, 17 nt, Pseudomonas putida KT2440
agaggccggcacaggaa

SEQ ID NO: 1608549 - RNA, 20 nt, Pseudomonas putida KT2440
agaggccggcacaggaaggc

SEQ ID NO: 1608550 - RNA, 17 nt, Pseudomonas putida KT2440
agaggccucaaucacug

SEQ ID NO: 1608551 - RNA, 22 nt, Pseudomonas putida KT2440
agaguaacugaauggcugguga

SEQ ID NO: 1608552 - RNA, 14 nt, Pseudomonas putida KT2440
agauaacacccccc

SEQ ID NO: 1608553 - RNA, 16 nt, Pseudomonas putida KT2440
agauaaccaaccccug

SEQ ID NO: 1608554 - RNA, 19 nt, Pseudomonas putida KT2440
agacuucgcugucuuccag

SEQ ID NO: 1608555 - RNA, 19 nt, Pseudomonas putida KT2440
agacuucgaagugccacgc

SEQ ID NO: 1608556 - RNA, 20 nt, Pseudomonas putida KT2440
agacucgaaaccaucaauca

SEQ ID NO: 1608557 - RNA, 22 nt, Pseudomonas putida KT2440
agacugccaaguaccaauacca

SEQ ID NO: 1608558 - RNA, 17 nt, Pseudomonas putida KT2440
agacgcucgacagcaac

SEQ ID NO: 1608559 - RNA, 21 nt, Pseudomonas putida KT2440
agacgccgcagugacacggcg

SEQ ID NO: 1608560 - RNA, 18 nt, Pseudomonas putida KT2440
agaccugugguuucacac

SEQ ID NO: 1608561 - RNA, 17 nt, Pseudomonas putida KT2440
agaccgauuucaacccu

SEQ ID NO: 1608562 - RNA, 14 nt, Pseudomonas putida KT2440
agacagggccuuga

SEQ ID NO: 1608563 - RNA, 22 nt, Pseudomonas putida KT2440
agacaucuccauagguuaucca

SEQ ID NO: 1608564 - RNA, 15 nt, Pseudomonas putida KT2440
agacaccacaaaacc

SEQ ID NO: 1608565 - RNA, 17 nt, Pseudomonas putida KT2440
agacaccgcaaaucacu

SEQ ID NO: 1608566 - RNA, 18 nt, Pseudomonas putida KT2440
agacaaaaaaaucggccg

SEQ ID NO: 1608567 - RNA, 14 nt, Pseudomonas putida KT2440
agaagggcugguag

SEQ ID NO: 1608568 - RNA, 22 nt, Pseudomonas putida KT2440
agaagcgaccgguuuucuguug

SEQ ID NO: 1608569 - RNA, 15 nt, Pseudomonas putida KT2440
agaagcggcuaccgc

SEQ ID NO: 1608570 - RNA, 22 nt, Pseudomonas putida KT2440
agaagcggcugccuacccaggc

SEQ ID NO: 1608571 - RNA, 14 nt, Pseudomonas putida KT2440
agaagcggggaggc

SEQ ID NO: 1608572 - RNA, 23 nt, Pseudomonas putida KT2440
agaagccggcaucgccaacagag

SEQ ID NO: 1608573 - RNA, 19 nt, Pseudomonas putida KT2440
agaagccuuggccuuggca

SEQ ID NO: 1608574 - RNA, 15 nt, Pseudomonas putida KT2440
agaagccacuggccu

SEQ ID NO: 1608575 - RNA, 19 nt, Pseudomonas putida KT2440
agaaugccgcccaucaccg

SEQ ID NO: 1608576 - RNA, 20 nt, Pseudomonas putida KT2440
agaauagccggccucagcag

SEQ ID NO: 1608577 - RNA, 17 nt, Pseudomonas putida KT2440
acggcagcgacagcugc

SEQ ID NO: 1608578 - RNA, 22 nt, Pseudomonas putida KT2440
acggcgcaauccgugagccagg

SEQ ID NO: 1608579 - RNA, 17 nt, Pseudomonas putida KT2440
acggcauacccauggua

SEQ ID NO: 1608580 - RNA, 18 nt, Pseudomonas putida KT2440
acggcaucacgcuggcca

SEQ ID NO: 1608581 - RNA, 17 nt, Pseudomonas putida KT2440
acggcgccagcagugca

SEQ ID NO: 1608582 - RNA, 15 nt, Pseudomonas putida KT2440
acggcgcgcuucagg

SEQ ID NO: 1608583 - RNA, 13 nt, Pseudomonas putida KT2440
acggcgucgacac

SEQ ID NO: 1608584 - RNA, 14 nt, Pseudomonas putida KT2440
acggcgucgagcag

SEQ ID NO: 1608585 - RNA, 16 nt, Pseudomonas putida KT2440
acggcugccgacaggc

SEQ ID NO: 1608586 - RNA, 19 nt, Pseudomonas putida KT2440
acggcuugauauccagcac

SEQ ID NO: 1608587 - RNA, 22 nt, Pseudomonas putida KT2440
acggcuucgcgcauuucgucca

SEQ ID NO: 1608588 - RNA, 17 nt, Pseudomonas putida KT2440
acggcuaaagccgcacc

SEQ ID NO: 1608589 - RNA, 19 nt, Pseudomonas putida KT2440
acgcuugucuuccagcugc

SEQ ID NO: 1608590 - RNA, 20 nt, Pseudomonas putida KT2440
acggagacucgaaaccauca

SEQ ID NO: 1608591 - RNA, 19 nt, Pseudomonas putida KT2440
acggcagcaaucgccgccu

SEQ ID NO: 1608592 - RNA, 22 nt, Pseudomonas putida KT2440
acggcagccaucaucagguacg

SEQ ID NO: 1608593 - RNA, 14 nt, Pseudomonas putida KT2440
acggcagcaggcca

SEQ ID NO: 1608594 - RNA, 22 nt, Pseudomonas putida KT2440
acggcagcaggccaaugcccau

SEQ ID NO: 1608595 - RNA, 17 nt, Pseudomonas putida KT2440
acggcagaucaggcaau

SEQ ID NO: 1608596 - RNA, 13 nt, Pseudomonas putida KT2440
acggcaccagcac

SEQ ID NO: 1608597 - RNA, 15 nt, Pseudomonas putida KT2440
acgcuugcccggcuc

SEQ ID NO: 1608598 - RNA, 22 nt, Pseudomonas putida KT2440
acgcuuggccagacucagcugc

SEQ ID NO: 1608599 - RNA, 15 nt, Pseudomonas putida KT2440
acgcuuauggcggcu

SEQ ID NO: 1608600 - RNA, 17 nt, Pseudomonas putida KT2440
acgcugccugcaggcug

SEQ ID NO: 1608601 - RNA, 20 nt, Pseudomonas putida KT2440
acgcugcccaggugccaggc

SEQ ID NO: 1608602 - RNA, 20 nt, Pseudomonas putida KT2440
acgcugcacuuccacacccg

SEQ ID NO: 1608603 - RNA, 22 nt, Pseudomonas putida KT2440
acgcgauacccaauaaaaacaa

SEQ ID NO: 1608604 - RNA, 13 nt, Pseudomonas putida KT2440
acgcgccagcagc

SEQ ID NO: 1608605 - RNA, 21 nt, Pseudomonas putida KT2440
acgcgccauggccuggcgggu

SEQ ID NO: 1608606 - RNA, 18 nt, Pseudomonas putida KT2440
acgcgccagucagaagca

SEQ ID NO: 1608607 - RNA, 21 nt, Pseudomonas putida KT2440
acgcgccagucagaagcagcu

SEQ ID NO: 1608608 - RNA, 16 nt, Pseudomonas putida KT2440
acgcgccauccgccac

SEQ ID NO: 1608609 - RNA, 18 nt, Pseudomonas putida KT2440
acgcgccgcugccugggc

SEQ ID NO: 1608610 - RNA, 16 nt, Pseudomonas putida KT2440
acgcgcaggcgcugca

SEQ ID NO: 1608611 - RNA, 13 nt, Pseudomonas putida KT2440
acgcggaacuggc

SEQ ID NO: 1608612 - RNA, 15 nt, Pseudomonas putida KT2440
acgcggcaaccugca

SEQ ID NO: 1608613 - RNA, 20 nt, Pseudomonas putida KT2440
acgcggcagcagcagcccca

SEQ ID NO: 1608614 - RNA, 23 nt, Pseudomonas putida KT2440
acgcggguccagcgcggccacgc

SEQ ID NO: 1608615 - RNA, 15 nt, Pseudomonas putida KT2440
acgcgguggagggca

SEQ ID NO: 1608616 - RNA, 18 nt, Pseudomonas putida KT2440
acgcucguccaggcccug

SEQ ID NO: 1608617 - RNA, 18 nt, Pseudomonas putida KT2440
acgcuccugcaugccuuc

SEQ ID NO: 1608618 - RNA, 20 nt, Pseudomonas putida KT2440
acgcuccugcaugccuuccu

SEQ ID NO: 1608619 - RNA, 13 nt, Pseudomonas putida KT2440
acgcucaugaaca

SEQ ID NO: 1608620 - RNA, 20 nt, Pseudomonas putida KT2440
acgcucaugaacagcgccca

SEQ ID NO: 1608621 - RNA, 22 nt, Pseudomonas putida KT2440
acgcucaugaacagcgcccaga

SEQ ID NO: 1608622 - RNA, 20 nt, Pseudomonas putida KT2440
acgcguugauuuagcaggca

SEQ ID NO: 1608623 - RNA, 15 nt, Pseudomonas putida KT2440
acgcgucaucugcgc

SEQ ID NO: 1608624 - RNA, 20 nt, Pseudomonas putida KT2440
acgcuagucaagcugcgccg

SEQ ID NO: 1608625 - RNA, 18 nt, Pseudomonas putida KT2440
acgcucaaccccaucacc

SEQ ID NO: 1608626 - RNA, 16 nt, Pseudomonas putida KT2440
acgcuaauacccuguu

SEQ ID NO: 1608627 - RNA, 13 nt, Pseudomonas putida KT2440
acgccaucccccc

SEQ ID NO: 1608628 - RNA, 18 nt, Pseudomonas putida KT2440
acgccaucaggcagcuca

SEQ ID NO: 1608629 - RNA, 12 nt, Pseudomonas putida KT2440
acgccaggugau

SEQ ID NO: 1608630 - RNA, 14 nt, Pseudomonas putida KT2440
acgccaucggccuc

SEQ ID NO: 1608631 - RNA, 18 nt, Pseudomonas putida KT2440
acgccacgcccaacccag

SEQ ID NO: 1608632 - RNA, 20 nt, Pseudomonas putida KT2440
acgccaggcguuguggguga

SEQ ID NO: 1608633 - RNA, 14 nt, Pseudomonas putida KT2440
acgccagcaucacc

SEQ ID NO: 1608634 - RNA, 19 nt, Pseudomonas putida KT2440
acgccaccaugcucggcca

SEQ ID NO: 1608635 - RNA, 20 nt, Pseudomonas putida KT2440
acgccaaagugauaacgcgc

SEQ ID NO: 1608636 - RNA, 17 nt, Pseudomonas putida KT2440
acgcauuuucaucaaaa

SEQ ID NO: 1608637 - RNA, 15 nt, Pseudomonas putida KT2440
acgcauucgcgggug

SEQ ID NO: 1608638 - RNA, 16 nt, Pseudomonas putida KT2440
acgcauguccuuggcc

SEQ ID NO: 1608639 - RNA, 23 nt, Pseudomonas putida KT2440
acgcaugcgcgacagcaucauca

SEQ ID NO: 1608640 - RNA, 20 nt, Pseudomonas putida KT2440
acgcauggcguuguccagca

SEQ ID NO: 1608641 - RNA, 22 nt, Pseudomonas putida KT2440
acgcauggcguuguccagcagg

SEQ ID NO: 1608642 - RNA, 19 nt, Pseudomonas putida KT2440
acgcaucugcaccggcagc

SEQ ID NO: 1608643 - RNA, 13 nt, Pseudomonas putida KT2440
acgcaucugcgcu

SEQ ID NO: 1608644 - RNA, 13 nt, Pseudomonas putida KT2440
acgcagugcagcc

SEQ ID NO: 1608645 - RNA, 12 nt, Pseudomonas putida KT2440
acgcaggcgcga

SEQ ID NO: 1608646 - RNA, 16 nt, Pseudomonas putida KT2440
acgcaggcaccgcacc

SEQ ID NO: 1608647 - RNA, 19 nt, Pseudomonas putida KT2440
acgcaggcgcaggugcagc

SEQ ID NO: 1608648 - RNA, 21 nt, Pseudomonas putida KT2440
acgcaggucuugcccacuucc

SEQ ID NO: 1608649 - RNA, 15 nt, Pseudomonas putida KT2440
acgcagucagccaca

SEQ ID NO: 1608650 - RNA, 23 nt, Pseudomonas putida KT2440
acgcagucagccacauccucugc

SEQ ID NO: 1608651 - RNA, 20 nt, Pseudomonas putida KT2440
acgcaggugcgcacgcugcc

SEQ ID NO: 1608652 - RNA, 14 nt, Pseudomonas putida KT2440
acgcaggcucugcg

SEQ ID NO: 1608653 - RNA, 22 nt, Pseudomonas putida KT2440
acgcaggcauacaggaccaggc

SEQ ID NO: 1608654 - RNA, 16 nt, Pseudomonas putida KT2440
acgcaggccagcgcac

SEQ ID NO: 1608655 - RNA, 13 nt, Pseudomonas putida KT2440
acgcaggcccagc

SEQ ID NO: 1608656 - RNA, 20 nt, Pseudomonas putida KT2440
acgcagcuuccgccaccacg

SEQ ID NO: 1608657 - RNA, 17 nt, Pseudomonas putida KT2440
acgcagccggcaccgcc

SEQ ID NO: 1608658 - RNA, 11 nt, Pseudomonas putida KT2440
acgcagcaugc

SEQ ID NO: 1608659 - RNA, 18 nt, Pseudomonas putida KT2440
acgcacggccuucccgcc

SEQ ID NO: 1608660 - RNA, 19 nt, Pseudomonas putida KT2440
acgcacggccuucccgccu

SEQ ID NO: 1608661 - RNA, 14 nt, Pseudomonas putida KT2440
acgcacccgcacuu

SEQ ID NO: 1608662 - RNA, 16 nt, Pseudomonas putida KT2440
acgcaccagggcuggc

SEQ ID NO: 1608663 - RNA, 14 nt, Pseudomonas putida KT2440
acgcacaucggcaa

SEQ ID NO: 1608664 - RNA, 13 nt, Pseudomonas putida KT2440
acgcacacucccc

SEQ ID NO: 1608665 - RNA, 19 nt, Pseudomonas putida KT2440
accggaguccccaccggca

SEQ ID NO: 1608666 - RNA, 18 nt, Pseudomonas putida KT2440
acgccuuaguucacccac

SEQ ID NO: 1608667 - RNA, 23 nt, Pseudomonas putida KT2440
acgccuuaguucacccacacccg

SEQ ID NO: 1608668 - RNA, 23 nt, Pseudomonas putida KT2440
acgccucgaaguaggcaaacggc

SEQ ID NO: 1608669 - RNA, 19 nt, Pseudomonas putida KT2440
acgcgaaugaugaauaaug

SEQ ID NO: 1608670 - RNA, 14 nt, Pseudomonas putida KT2440
acgccugaaccacc

SEQ ID NO: 1608671 - RNA, 18 nt, Pseudomonas putida KT2440
acgccgcugguacagggu

SEQ ID NO: 1608672 - RNA, 19 nt, Pseudomonas putida KT2440
acgccgcuucucaagaaac

SEQ ID NO: 1608673 - RNA, 15 nt, Pseudomonas putida KT2440
acgccgggucagcuc

SEQ ID NO: 1608674 - RNA, 19 nt, Pseudomonas putida KT2440
acgccgugguagcaccgga

SEQ ID NO: 1608675 - RNA, 19 nt, Pseudomonas putida KT2440
acgccucaugaucugcaag

SEQ ID NO: 1608676 - RNA, 18 nt, Pseudomonas putida KT2440
acgccguacggcccaugu

SEQ ID NO: 1608677 - RNA, 11 nt, Pseudomonas putida KT2440
acgccccgacu

SEQ ID NO: 1608678 - RNA, 19 nt, Pseudomonas putida KT2440
acgcccuagaacaggcggc

SEQ ID NO: 1608679 - RNA, 20 nt, Pseudomonas putida KT2440
acgcccgcaacaaccuggcc

SEQ ID NO: 1608680 - RNA, 19 nt, Pseudomonas putida KT2440
acgcccgcucccacaggua

SEQ ID NO: 1608681 - RNA, 20 nt, Pseudomonas putida KT2440
acgccccccggcuccacacc

SEQ ID NO: 1608682 - RNA, 14 nt, Pseudomonas putida KT2440
acgcccaaccccag

SEQ ID NO: 1608683 - RNA, 18 nt, Pseudomonas putida KT2440
acgccgcguugucaggca

SEQ ID NO: 1608684 - RNA, 16 nt, Pseudomonas putida KT2440
acgccgcugcggcugc

SEQ ID NO: 1608685 - RNA, 12 nt, Pseudomonas putida KT2440
acgccgccccac

SEQ ID NO: 1608686 - RNA, 19 nt, Pseudomonas putida KT2440
acgccgagcauuacaggca

SEQ ID NO: 1608687 - RNA, 18 nt, Pseudomonas putida KT2440
acgccgauagccagcugg

SEQ ID NO: 1608688 - RNA, 20 nt, Pseudomonas putida KT2440
acgcccuuuuucaccaggcg

SEQ ID NO: 1608689 - RNA, 18 nt, Pseudomonas putida KT2440
acugaacaccugccagcc

SEQ ID NO: 1608690 - RNA, 24 nt, Pseudomonas putida KT2440
acugaauuggccggcgcugagcga

SEQ ID NO: 1608691 - RNA, 20 nt, Pseudomonas putida KT2440
acugacaagauaguaggcac

SEQ ID NO: 1608692 - RNA, 20 nt, Pseudomonas putida KT2440
acugacaaagccugcaccca

SEQ ID NO: 1608693 - RNA, 14 nt, Pseudomonas putida KT2440
acucuucccaccac

SEQ ID NO: 1608694 - RNA, 12 nt, Pseudomonas putida KT2440
acucuuccagcu

SEQ ID NO: 1608695 - RNA, 18 nt, Pseudomonas putida KT2440
acucuucgacggucggca

SEQ ID NO: 1608696 - RNA, 17 nt, Pseudomonas putida KT2440
acuccgccccaaaccag

SEQ ID NO: 1608697 - RNA, 14 nt, Pseudomonas putida KT2440
acucgcaagcucca

SEQ ID NO: 1608698 - RNA, 14 nt, Pseudomonas putida KT2440
acucgcgcagcaca

SEQ ID NO: 1608699 - RNA, 18 nt, Pseudomonas putida KT2440
acucgcgcauccagccag

SEQ ID NO: 1608700 - RNA, 19 nt, Pseudomonas putida KT2440
acucgcgcuguuccagccc

SEQ ID NO: 1608701 - RNA, 15 nt, Pseudomonas putida KT2440
acucgcccccaucgc

SEQ ID NO: 1608702 - RNA, 20 nt, Pseudomonas putida KT2440
acucgcccccaucgcagggu

SEQ ID NO: 1608703 - RNA, 21 nt, Pseudomonas putida KT2440
acucgccgauaaagcgucgcc

SEQ ID NO: 1608704 - RNA, 18 nt, Pseudomonas putida KT2440
acucccgggaucaccgca

SEQ ID NO: 1608705 - RNA, 19 nt, Pseudomonas putida KT2440
acucccauguagaccacca

SEQ ID NO: 1608706 - RNA, 15 nt, Pseudomonas putida KT2440
acuccccaccaggca

SEQ ID NO: 1608707 - RNA, 20 nt, Pseudomonas putida KT2440
acucgucaauaccggugccc

SEQ ID NO: 1608708 - RNA, 15 nt, Pseudomonas putida KT2440
acucgucacccucca

SEQ ID NO: 1608709 - RNA, 14 nt, Pseudomonas putida KT2440
acucggcuaccgca

SEQ ID NO: 1608710 - RNA, 22 nt, Pseudomonas putida KT2440
acucguugaccacgaaggcaau

SEQ ID NO: 1608711 - RNA, 21 nt, Pseudomonas putida KT2440
acucguuggcaaagcugaauu

SEQ ID NO: 1608712 - RNA, 23 nt, Pseudomonas putida KT2440
acuaucugcguuucgcuggccug

SEQ ID NO: 1608713 - RNA, 22 nt, Pseudomonas putida KT2440
acucaccacaucggcggcaaug

SEQ ID NO: 1608714 - RNA, 22 nt, Pseudomonas putida KT2440
acucaccgccgccccgcaccag

SEQ ID NO: 1608715 - RNA, 19 nt, Pseudomonas putida KT2440
acucacgcucguuguccag

SEQ ID NO: 1608716 - RNA, 24 nt, Pseudomonas putida KT2440
acucacgcucguuguccagcagca

SEQ ID NO: 1608717 - RNA, 12 nt, Pseudomonas putida KT2440
acucagcggguc

SEQ ID NO: 1608718 - RNA, 14 nt, Pseudomonas putida KT2440
acucagcugcugcu

SEQ ID NO: 1608719 - RNA, 19 nt, Pseudomonas putida KT2440
acuccacugugcccgccag

SEQ ID NO: 1608720 - RNA, 21 nt, Pseudomonas putida KT2440
acuccacugugcccgccaggc

SEQ ID NO: 1608721 - RNA, 12 nt, Pseudomonas putida KT2440
acuccaccauca

SEQ ID NO: 1608722 - RNA, 21 nt, Pseudomonas putida KT2440
acuccagcagcgcauccaccu

SEQ ID NO: 1608723 - RNA, 17 nt, Pseudomonas putida KT2440
acuccagcgaguggcca

SEQ ID NO: 1608724 - RNA, 20 nt, Pseudomonas putida KT2440
acuccaacgcgccgauugcu

SEQ ID NO: 1608725 - RNA, 14 nt, Pseudomonas putida KT2440
acucauuuuguaaa

SEQ ID NO: 1608726 - RNA, 21 nt, Pseudomonas putida KT2440
acuaagaagcaaccgcugcau

SEQ ID NO: 1608727 - RNA, 15 nt, Pseudomonas putida KT2440
acuaauauuugaaca

SEQ ID NO: 1608728 - RNA, 13 nt, Pseudomonas putida KT2440
acuagaggaucug

SEQ ID NO: 1608729 - RNA, 14 nt, Pseudomonas putida KT2440
acuagauggcugaa

SEQ ID NO: 1608730 - RNA, 19 nt, Pseudomonas putida KT2440
acguucacgcaagcgccug

SEQ ID NO: 1608731 - RNA, 23 nt, Pseudomonas putida KT2440
acguucccgccauguugcgcagc

SEQ ID NO: 1608732 - RNA, 20 nt, Pseudomonas putida KT2440
acgugggucgggaacagcuc

SEQ ID NO: 1608733 - RNA, 23 nt, Pseudomonas putida KT2440
acguggucaugccaacggugacu

SEQ ID NO: 1608734 - RNA, 14 nt, Pseudomonas putida KT2440
acgugacuggaacu

SEQ ID NO: 1608735 - RNA, 22 nt, Pseudomonas putida KT2440
acgugaauaugcucuuuccaac

SEQ ID NO: 1608736 - RNA, 12 nt, Pseudomonas putida KT2440
acguccagccac

SEQ ID NO: 1608737 - RNA, 19 nt, Pseudomonas putida KT2440
acguccagagggccugcau

SEQ ID NO: 1608738 - RNA, 22 nt, Pseudomonas putida KT2440
acgucagcuacgcgagucaaca

SEQ ID NO: 1608739 - RNA, 16 nt, Pseudomonas putida KT2440
acgucaaccgugcccg

SEQ ID NO: 1608740 - RNA, 19 nt, Pseudomonas putida KT2440
acgucaaccgugcccgccc

SEQ ID NO: 1608741 - RNA, 20 nt, Pseudomonas putida KT2440
acguagaaaggagacaacca

SEQ ID NO: 1608742 - RNA, 18 nt, Pseudomonas putida KT2440
acguagaacaggccugcg

SEQ ID NO: 1608743 - RNA, 22 nt, Pseudomonas putida KT2440
acguaggcgggagagcagggcu

SEQ ID NO: 1608744 - RNA, 15 nt, Pseudomonas putida KT2440
acgggaucaccgugu

SEQ ID NO: 1608745 - RNA, 15 nt, Pseudomonas putida KT2440
acccugaugcagcag

SEQ ID NO: 1608746 - RNA, 17 nt, Pseudomonas putida KT2440
acccugaugcagcagug

SEQ ID NO: 1608747 - RNA, 22 nt, Pseudomonas putida KT2440
acccugagggagcgggcuugcc

SEQ ID NO: 1608748 - RNA, 16 nt, Pseudomonas putida KT2440
acccuggaaaaugccc

SEQ ID NO: 1608749 - RNA, 16 nt, Pseudomonas putida KT2440
acccuggcaugccccu

SEQ ID NO: 1608750 - RNA, 23 nt, Pseudomonas putida KT2440
acccucguaacgagccuuggcca

SEQ ID NO: 1608751 - RNA, 14 nt, Pseudomonas putida KT2440
acccucguccccgc

SEQ ID NO: 1608752 - RNA, 20 nt, Pseudomonas putida KT2440
acccugacgcugcacuucca

SEQ ID NO: 1608753 - RNA, 19 nt, Pseudomonas putida KT2440
acccucuugaauccccuua

SEQ ID NO: 1608754 - RNA, 24 nt, Pseudomonas putida KT2440
acccugaaucagcaaaccgaccag

SEQ ID NO: 1608755 - RNA, 14 nt, Pseudomonas putida KT2440
acccugaaauggac

SEQ ID NO: 1608756 - RNA, 14 nt, Pseudomonas putida KT2440
acccuugggcacca

SEQ ID NO: 1608757 - RNA, 19 nt, Pseudomonas putida KT2440
acccuugggcgugcgcugc

SEQ ID NO: 1608758 - RNA, 14 nt, Pseudomonas putida KT2440
acccuugggcucag

SEQ ID NO: 1608759 - RNA, 20 nt, Pseudomonas putida KT2440
acccuucgcggguaaacccg

SEQ ID NO: 1608760 - RNA, 15 nt, Pseudomonas putida KT2440
acccugggcuccuca

SEQ ID NO: 1608761 - RNA, 15 nt, Pseudomonas putida KT2440
acccugguucuccac

SEQ ID NO: 1608762 - RNA, 20 nt, Pseudomonas putida KT2440
acccugucgaucacgggcaa

SEQ ID NO: 1608763 - RNA, 16 nt, Pseudomonas putida KT2440
acccuggucaugcagc

SEQ ID NO: 1608764 - RNA, 17 nt, Pseudomonas putida KT2440
acccuggucaugcagcg

SEQ ID NO: 1608765 - RNA, 21 nt, Pseudomonas putida KT2440
acccugucguuauccugcagc

SEQ ID NO: 1608766 - RNA, 22 nt, Pseudomonas putida KT2440
acccugucguuauccugcagca

SEQ ID NO: 1608767 - RNA, 13 nt, Pseudomonas putida KT2440
acccuuccagccc

SEQ ID NO: 1608768 - RNA, 15 nt, Pseudomonas putida KT2440
acccgugcugcucgc

SEQ ID NO: 1608769 - RNA, 17 nt, Pseudomonas putida KT2440
acccgucugcaggaaaa

SEQ ID NO: 1608770 - RNA, 21 nt, Pseudomonas putida KT2440
acccgucugcaggaaaacggc

SEQ ID NO: 1608771 - RNA, 15 nt, Pseudomonas putida KT2440
acccgugcagggcug

SEQ ID NO: 1608772 - RNA, 14 nt, Pseudomonas putida KT2440
acccgugccugccu

SEQ ID NO: 1608773 - RNA, 16 nt, Pseudomonas putida KT2440
acccgugccugccugc

SEQ ID NO: 1608774 - RNA, 19 nt, Pseudomonas putida KT2440
acccucgcacuccgcccgu

SEQ ID NO: 1608775 - RNA, 18 nt, Pseudomonas putida KT2440
acccucacgcgccagguc

SEQ ID NO: 1608776 - RNA, 23 nt, Pseudomonas putida KT2440
acccucacgcgccaggucggaca

SEQ ID NO: 1608777 - RNA, 20 nt, Pseudomonas putida KT2440
acccucacucgcggccauga

SEQ ID NO: 1608778 - RNA, 21 nt, Pseudomonas putida KT2440
acccuaugcgugaaacgcagc

SEQ ID NO: 1608779 - RNA, 16 nt, Pseudomonas putida KT2440
accgaacagcaccgcc

SEQ ID NO: 1608780 - RNA, 24 nt, Pseudomonas putida KT2440
accgacacauaaccccccacccag

SEQ ID NO: 1608781 - RNA, 21 nt, Pseudomonas putida KT2440
accgacacaugcaaacccugg

SEQ ID NO: 1608782 - RNA, 17 nt, Pseudomonas putida KT2440
accgaacccgcugccac

SEQ ID NO: 1608783 - RNA, 19 nt, Pseudomonas putida KT2440
accgaacccgcugccaccc

SEQ ID NO: 1608784 - RNA, 12 nt, Pseudomonas putida KT2440
accgaggaggag

SEQ ID NO: 1608785 - RNA, 18 nt, Pseudomonas putida KT2440
accgaggaggaggcuggg

SEQ ID NO: 1608786 - RNA, 13 nt, Pseudomonas putida KT2440
accgagcgccgcg

SEQ ID NO: 1608787 - RNA, 16 nt, Pseudomonas putida KT2440
accgagaacaggcggc

SEQ ID NO: 1608788 - RNA, 22 nt, Pseudomonas putida KT2440
accgagaagcagaacaucaggu

SEQ ID NO: 1608789 - RNA, 22 nt, Pseudomonas putida KT2440
accgagaugaucgcggcaauca

SEQ ID NO: 1608790 - RNA, 13 nt, Pseudomonas putida KT2440
accgaccaaacca

SEQ ID NO: 1608791 - RNA, 14 nt, Pseudomonas putida KT2440
accgaccaaaccac

SEQ ID NO: 1608792 - RNA, 22 nt, Pseudomonas putida KT2440
accgaccauuugccauccggua

SEQ ID NO: 1608793 - RNA, 13 nt, Pseudomonas putida KT2440
accgacccacagg

SEQ ID NO: 1608794 - RNA, 15 nt, Pseudomonas putida KT2440
accgacccacaggca

SEQ ID NO: 1608795 - RNA, 22 nt, Pseudomonas putida KT2440
accgacaagauaacacccccca

SEQ ID NO: 1608796 - RNA, 14 nt, Pseudomonas putida KT2440
accgacgccaggaa

SEQ ID NO: 1608797 - RNA, 21 nt, Pseudomonas putida KT2440
accgacgaacagggccggccc

SEQ ID NO: 1608798 - RNA, 21 nt, Pseudomonas putida KT2440
accgaccgugcauacacccgg

SEQ ID NO: 1608799 - RNA, 19 nt, Pseudomonas putida KT2440
accgaucaugaacaugccc

SEQ ID NO: 1608800 - RNA, 14 nt, Pseudomonas putida KT2440
accgaggggccgcu

SEQ ID NO: 1608801 - RNA, 19 nt, Pseudomonas putida KT2440
accgagguaccaccggagg

SEQ ID NO: 1608802 - RNA, 21 nt, Pseudomonas putida KT2440
accgaggcgaauggcagguga

SEQ ID NO: 1608803 - RNA, 15 nt, Pseudomonas putida KT2440
accgcagccccagcu

SEQ ID NO: 1608804 - RNA, 16 nt, Pseudomonas putida KT2440
accgcaaaugcugcca

SEQ ID NO: 1608805 - RNA, 17 nt, Pseudomonas putida KT2440
accgcaacaccugccgc

SEQ ID NO: 1608806 - RNA, 18 nt, Pseudomonas putida KT2440
accgcaacaccugccgca

SEQ ID NO: 1608807 - RNA, 20 nt, Pseudomonas putida KT2440
accgcaacaccugccgcagc

SEQ ID NO: 1608808 - RNA, 17 nt, Pseudomonas putida KT2440
accgcaacaguuuucaa

SEQ ID NO: 1608809 - RNA, 15 nt, Pseudomonas putida KT2440
accgcaacccagccc

SEQ ID NO: 1608810 - RNA, 17 nt, Pseudomonas putida KT2440
accgcaucccaaugugg

SEQ ID NO: 1608811 - RNA, 19 nt, Pseudomonas putida KT2440
accgcauccgcaccccaag

SEQ ID NO: 1608812 - RNA, 15 nt, Pseudomonas putida KT2440
accgcaggucacugc

SEQ ID NO: 1608813 - RNA, 23 nt, Pseudomonas putida KT2440
accgcaggugcaggcucggccac

SEQ ID NO: 1608814 - RNA, 12 nt, Pseudomonas putida KT2440
accgccagcccg

SEQ ID NO: 1608815 - RNA, 21 nt, Pseudomonas putida KT2440
accgccaccuuguucgagcgc

SEQ ID NO: 1608816 - RNA, 20 nt, Pseudomonas putida KT2440
accgccacugaccagcccgg

SEQ ID NO: 1608817 - RNA, 21 nt, Pseudomonas putida KT2440
accgccacugaccagcccggc

SEQ ID NO: 1608818 - RNA, 23 nt, Pseudomonas putida KT2440
accgccacugaccagcccggcuc

SEQ ID NO: 1608819 - RNA, 14 nt, Pseudomonas putida KT2440
accgccgccaccau

SEQ ID NO: 1608820 - RNA, 14 nt, Pseudomonas putida KT2440
accgccgcccgguc

SEQ ID NO: 1608821 - RNA, 22 nt, Pseudomonas putida KT2440
accgccgaucgaagcagcagcu

SEQ ID NO: 1608822 - RNA, 23 nt, Pseudomonas putida KT2440
accgccgcacaggaaaacugcgg

SEQ ID NO: 1608823 - RNA, 16 nt, Pseudomonas putida KT2440
accgccagcggcaagc

SEQ ID NO: 1608824 - RNA, 21 nt, Pseudomonas putida KT2440
accgccagguccaggcugcgc

SEQ ID NO: 1608825 - RNA, 23 nt, Pseudomonas putida KT2440
accgcccgcgccgcccagcucuu

SEQ ID NO: 1608826 - RNA, 17 nt, Pseudomonas putida KT2440
accgcgguuucugcaac

SEQ ID NO: 1608827 - RNA, 15 nt, Pseudomonas putida KT2440
accgcgucacaucgg

SEQ ID NO: 1608828 - RNA, 23 nt, Pseudomonas putida KT2440
accgcguuaugacuggccucggc

SEQ ID NO: 1608829 - RNA, 14 nt, Pseudomonas putida KT2440
accgcucagugccg

SEQ ID NO: 1608830 - RNA, 17 nt, Pseudomonas putida KT2440
accgcucagugccgggg

SEQ ID NO: 1608831 - RNA, 18 nt, Pseudomonas putida KT2440
accggacgcuugccaccc

SEQ ID NO: 1608832 - RNA, 20 nt, Pseudomonas putida KT2440
accggaauagaacacuggca

SEQ ID NO: 1608833 - RNA, 19 nt, Pseudomonas putida KT2440
accgcuuucacuucaucca

SEQ ID NO: 1608834 - RNA, 20 nt, Pseudomonas putida KT2440
accgcgcaccuccugcggca

SEQ ID NO: 1608835 - RNA, 13 nt, Pseudomonas putida KT2440
accgcgccagccu

SEQ ID NO: 1608836 - RNA, 14 nt, Pseudomonas putida KT2440
accgcgccagccug

SEQ ID NO: 1608837 - RNA, 21 nt, Pseudomonas putida KT2440
accgcgccagcuccacacucg

SEQ ID NO: 1608838 - RNA, 13 nt, Pseudomonas putida KT2440
accgcgcccggcu

SEQ ID NO: 1608839 - RNA, 18 nt, Pseudomonas putida KT2440
accgcgcccggcuugccc

SEQ ID NO: 1608840 - RNA, 23 nt, Pseudomonas putida KT2440
accgcggcugacgaagcgccugg

SEQ ID NO: 1608841 - RNA, 15 nt, Pseudomonas putida KT2440
accgccgcccagguc

SEQ ID NO: 1608842 - RNA, 17 nt, Pseudomonas putida KT2440
acccgcgcugccucguc

SEQ ID NO: 1608843 - RNA, 22 nt, Pseudomonas putida KT2440
acccgcgugugcucgaggaagc

SEQ ID NO: 1608844 - RNA, 19 nt, Pseudomonas putida KT2440
acccgcguuggcagcacca

SEQ ID NO: 1608845 - RNA, 17 nt, Pseudomonas putida KT2440
acccgcgaaagggccag

SEQ ID NO: 1608846 - RNA, 21 nt, Pseudomonas putida KT2440
acccgcgaaagggccggcccu

SEQ ID NO: 1608847 - RNA, 16 nt, Pseudomonas putida KT2440
acccgcgaagaagccg

SEQ ID NO: 1608848 - RNA, 20 nt, Pseudomonas putida KT2440
acccgcgaagaggccggcac

SEQ ID NO: 1608849 - RNA, 21 nt, Pseudomonas putida KT2440
acccgcgaaggggccggcccu

SEQ ID NO: 1608850 - RNA, 18 nt, Pseudomonas putida KT2440
acccgccuccggcgcuuu

SEQ ID NO: 1608851 - RNA, 21 nt, Pseudomonas putida KT2440
acccgccguucacuguugccg

SEQ ID NO: 1608852 - RNA, 14 nt, Pseudomonas putida KT2440
acccgccgcuucgc

SEQ ID NO: 1608853 - RNA, 22 nt, Pseudomonas putida KT2440
acccgcccaucgcacacccugu

SEQ ID NO: 1608854 - RNA, 14 nt, Pseudomonas putida KT2440
acccggcagaauca

SEQ ID NO: 1608855 - RNA, 13 nt, Pseudomonas putida KT2440
acccgcuugccac

SEQ ID NO: 1608856 - RNA, 22 nt, Pseudomonas putida KT2440
acccgcuugccuuccucggcca

SEQ ID NO: 1608857 - RNA, 13 nt, Pseudomonas putida KT2440
acccggacccugg

SEQ ID NO: 1608858 - RNA, 18 nt, Pseudomonas putida KT2440
acccgcugccacccacag

SEQ ID NO: 1608859 - RNA, 21 nt, Pseudomonas putida KT2440
acccgcugccacccacaggca

SEQ ID NO: 1608860 - RNA, 23 nt, Pseudomonas putida KT2440
acccgcucccacaaaggaaaucc

SEQ ID NO: 1608861 - RNA, 13 nt, Pseudomonas putida KT2440
acccgcuccuaca

SEQ ID NO: 1608862 - RNA, 18 nt, Pseudomonas putida KT2440
acccgcuccuacaaggua

SEQ ID NO: 1608863 - RNA, 14 nt, Pseudomonas putida KT2440
acccgcuccuacag

SEQ ID NO: 1608864 - RNA, 18 nt, Pseudomonas putida KT2440
acccgcuccuacaggaug

SEQ ID NO: 1608865 - RNA, 18 nt, Pseudomonas putida KT2440
acccgcuccuacaggcga

SEQ ID NO: 1608866 - RNA, 23 nt, Pseudomonas putida KT2440
acccgcuccuacgggcaaccgca

SEQ ID NO: 1608867 - RNA, 21 nt, Pseudomonas putida KT2440
acccggccaacgacaggucgg

SEQ ID NO: 1608868 - RNA, 13 nt, Pseudomonas putida KT2440
acccggccgcucc

SEQ ID NO: 1608869 - RNA, 18 nt, Pseudomonas putida KT2440
acccggucccgcccggcc

SEQ ID NO: 1608870 - RNA, 17 nt, Pseudomonas putida KT2440
acccggucggccagcug

SEQ ID NO: 1608871 - RNA, 19 nt, Pseudomonas putida KT2440
acccggucggccagcugcu

SEQ ID NO: 1608872 - RNA, 22 nt, Pseudomonas putida KT2440
acccggucggccagcugcugcg

SEQ ID NO: 1608873 - RNA, 13 nt, Pseudomonas putida KT2440
acccggugcaccc

SEQ ID NO: 1608874 - RNA, 20 nt, Pseudomonas putida KT2440
acccguccaguuccggcagg

SEQ ID NO: 1608875 - RNA, 23 nt, Pseudomonas putida KT2440
accccgcuucggcgggguuuuuu

SEQ ID NO: 1608876 - RNA, 16 nt, Pseudomonas putida KT2440
accccgcugccugcgc

SEQ ID NO: 1608877 - RNA, 22 nt, Pseudomonas putida KT2440
accccguauugguagccacgug

SEQ ID NO: 1608878 - RNA, 14 nt, Pseudomonas putida KT2440
accccguccagccc

SEQ ID NO: 1608879 - RNA, 23 nt, Pseudomonas putida KT2440
accccuugcgggaacacccaguc

SEQ ID NO: 1608880 - RNA, 18 nt, Pseudomonas putida KT2440
accccuugcucaaccggu

SEQ ID NO: 1608881 - RNA, 15 nt, Pseudomonas putida KT2440
accccguacacccgc

SEQ ID NO: 1608882 - RNA, 16 nt, Pseudomonas putida KT2440
accccgggcacaugca

SEQ ID NO: 1608883 - RNA, 15 nt, Pseudomonas putida KT2440
accccggcguucagc

SEQ ID NO: 1608884 - RNA, 14 nt, Pseudomonas putida KT2440
acccaucugcucgc

SEQ ID NO: 1608885 - RNA, 21 nt, Pseudomonas putida KT2440
acccaugguaaaagccgccac

SEQ ID NO: 1608886 - RNA, 23 nt, Pseudomonas putida KT2440
acccauuugcagcacaaggcugu

SEQ ID NO: 1608887 - RNA, 18 nt, Pseudomonas putida KT2440
acccaucucgaucauguc

SEQ ID NO: 1608888 - RNA, 14 nt, Pseudomonas putida KT2440
acccgccaccccag

SEQ ID NO: 1608889 - RNA, 22 nt, Pseudomonas putida KT2440
acccgcaggacggauacaccag

SEQ ID NO: 1608890 - RNA, 17 nt, Pseudomonas putida KT2440
acccgcauaaccaccac

SEQ ID NO: 1608891 - RNA, 19 nt, Pseudomonas putida KT2440
acccgcauaaccaccaccg

SEQ ID NO: 1608892 - RNA, 14 nt, Pseudomonas putida KT2440
acccgaacaaaacc

SEQ ID NO: 1608893 - RNA, 15 nt, Pseudomonas putida KT2440
acccgacgccaccuu

SEQ ID NO: 1608894 - RNA, 14 nt, Pseudomonas putida KT2440
acccacuccgggug

SEQ ID NO: 1608895 - RNA, 17 nt, Pseudomonas putida KT2440
acccacuccccacuccu

SEQ ID NO: 1608896 - RNA, 11 nt, Pseudomonas putida KT2440
acccacuggcc

SEQ ID NO: 1608897 - RNA, 16 nt, Pseudomonas putida KT2440
acccagcucgccaaca

SEQ ID NO: 1608898 - RNA, 17 nt, Pseudomonas putida KT2440
acccaggcauacagcug

SEQ ID NO: 1608899 - RNA, 20 nt, Pseudomonas putida KT2440
acccaggcauacagcuggcc

SEQ ID NO: 1608900 - RNA, 20 nt, Pseudomonas putida KT2440
acccaggccguuguaggagc

SEQ ID NO: 1608901 - RNA, 15 nt, Pseudomonas putida KT2440
acccagguacgaagc

SEQ ID NO: 1608902 - RNA, 18 nt, Pseudomonas putida KT2440
acccagguacgaagccau

SEQ ID NO: 1608903 - RNA, 17 nt, Pseudomonas putida KT2440
acccaggugaucgccac

SEQ ID NO: 1608904 - RNA, 17 nt, Pseudomonas putida KT2440
acccaggugaugcaggc

SEQ ID NO: 1608905 - RNA, 23 nt, Pseudomonas putida KT2440
acccagucgccccgccagcgccu

SEQ ID NO: 1608906 - RNA, 16 nt, Pseudomonas putida KT2440
acccagucaccuugcu

SEQ ID NO: 1608907 - RNA, 16 nt, Pseudomonas putida KT2440
acccauacgcaugaag

SEQ ID NO: 1608908 - RNA, 13 nt, Pseudomonas putida KT2440
acccacccucgca

SEQ ID NO: 1608909 - RNA, 19 nt, Pseudomonas putida KT2440
accauguacugcagacagu

SEQ ID NO: 1608910 - RNA, 14 nt, Pseudomonas putida KT2440
accauguuccaguu

SEQ ID NO: 1608911 - RNA, 20 nt, Pseudomonas putida KT2440
accauguugaaaauagcucc

SEQ ID NO: 1608912 - RNA, 15 nt, Pseudomonas putida KT2440
accaugcgccgcugc

SEQ ID NO: 1608913 - RNA, 20 nt, Pseudomonas putida KT2440
accaugcgaugguacagcuc

SEQ ID NO: 1608914 - RNA, 20 nt, Pseudomonas putida KT2440
accauggcgaugaacugccg
